United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 26

SEQ ID NO: 1130469 - RNA, 22 nt, Human
ugucacauaauuuaucuguagg

SEQ ID NO: 1130470 - RNA, 17 nt, Human
gguguauggggagggaa

SEQ ID NO: 1130471 - RNA, 22 nt, Human
agagcugaauuuggguggugga

SEQ ID NO: 1130472 - RNA, 22 nt, Human
aaagguuugcauggaauuuacc

SEQ ID NO: 1130473 - RNA, 22 nt, Human
gaggcugguaggaaaggaaaca

SEQ ID NO: 1130474 - RNA, 18 nt, Human
aaguaacagaagagcaca

SEQ ID NO: 1130475 - RNA, 22 nt, Human
cuccagaagacccauccucaug

SEQ ID NO: 1130476 - RNA, 22 nt, Human
ccacccuuggguucggaggccg

SEQ ID NO: 1130477 - RNA, 19 nt, Human
cugucaggggcuggauguu

SEQ ID NO: 1130478 - RNA, 22 nt, Human
aggccuguuccuuccugggcac

SEQ ID NO: 1130479 - RNA, 22 nt, Human
guuauguaaucuaacacucagu

SEQ ID NO: 1130480 - RNA, 22 nt, Human
cagcccugagaaggaggaucuc

SEQ ID NO: 1130481 - RNA, 22 nt, Human
cuggagcagguuuaggaguccc

SEQ ID NO: 1130482 - RNA, 22 nt, Human
cacaggcucuucucacuugauu

SEQ ID NO: 1130483 - RNA, 22 nt, Human
ugcauauuauguguaucugucu

SEQ ID NO: 1130484 - RNA, 22 nt, Human
aagagcuggagcugcuacagga

SEQ ID NO: 1130485 - RNA, 22 nt, Human
ggugcagaggagccagcugggg

SEQ ID NO: 1130486 - RNA, 20 nt, Human
ugaaaaggucaggagacaug

SEQ ID NO: 1130487 - RNA, 22 nt, Human
uuucacauguggaaugccaggu

SEQ ID NO: 1130488 - RNA, 22 nt, Human
ucuggagccacaaaccucagcu

SEQ ID NO: 1130489 - RNA, 22 nt, Human
ugaagccagcuuuggaagacac

SEQ ID NO: 1130490 - RNA, 22 nt, Human
gcagaaggucuggcacuucagg

SEQ ID NO: 1130491 - RNA, 22 nt, Human
cccuggugguacggcacuggca

SEQ ID NO: 1130492 - RNA, 23 nt, Human
auuugagaaaguauuuuuaagac

SEQ ID NO: 1130493 - RNA, 22 nt, Human
ggucaugcugugaaucagugcu

SEQ ID NO: 1130494 - RNA, 22 nt, Human
ccaggaaugaaauguagauaaa

SEQ ID NO: 1130495 - RNA, 17 nt, Human
gcugagugcagggaguc

SEQ ID NO: 1130496 - RNA, 22 nt, Human
cuuucacagcugugcuuaugau

SEQ ID NO: 1130497 - RNA, 22 nt, Human
agaugcugugaggaagcuagga

SEQ ID NO: 1130498 - RNA, 22 nt, Human
cuguuuaucccuuuggucagca

SEQ ID NO: 1130499 - RNA, 22 nt, Human
cccaggagguggagguugcagc

SEQ ID NO: 1130500 - RNA, 22 nt, Human
gaugagggccugguggcugugc

SEQ ID NO: 1130501 - RNA, 22 nt, Human
uacaguaaagcugcuaugaauu

SEQ ID NO: 1130502 - RNA, 22 nt, Human
cuggagcuccagggucuccucu

SEQ ID NO: 1130503 - RNA, 22 nt, Human
ugcuggcccaugaagacgcagu

SEQ ID NO: 1130504 - RNA, 22 nt, Human
gggcagcugcagggauggugac

SEQ ID NO: 1130505 - RNA, 22 nt, Human
gccucuggucccucaugcugug

SEQ ID NO: 1130506 - RNA, 22 nt, Human
ucaguuuuuaaaugauauaauu

SEQ ID NO: 1130507 - RNA, 22 nt, Human
gaggccuguagucauggaugua

SEQ ID NO: 1130508 - RNA, 22 nt, Human
auugaaaggcaaaguaggaagc

SEQ ID NO: 1130509 - RNA, 22 nt, Human
uccuugaaaggggcugcagggc

SEQ ID NO: 1130510 - RNA, 22 nt, Human
cagcuccccaugguuccugaag

SEQ ID NO: 1130511 - RNA, 22 nt, Human
ucaggugguccuaagugccauc

SEQ ID NO: 1130512 - RNA, 22 nt, Human
gcuguccaugucuggccucagu

SEQ ID NO: 1130513 - RNA, 22 nt, Human
augugcauuaaaugucaauguu

SEQ ID NO: 1130514 - RNA, 22 nt, Human
acacaugcugauaagaauauaa

SEQ ID NO: 1130515 - RNA, 22 nt, Human
ccaccagcagugugcaaggauu

SEQ ID NO: 1130516 - RNA, 22 nt, Human
uuagauaacaguagaauaucaa

SEQ ID NO: 1130517 - RNA, 22 nt, Human
uagacagauuucuuguuagaca

SEQ ID NO: 1130518 - RNA, 22 nt, Human
ugucagugguagacccagaggu

SEQ ID NO: 1130519 - RNA, 22 nt, Human
caggguggaaaagcuaguugga

SEQ ID NO: 1130520 - RNA, 22 nt, Human
ccagcugcgggcaucgagaguu

SEQ ID NO: 1130521 - RNA, 22 nt, Human
acacacagguaaaggagccugg

SEQ ID NO: 1130522 - RNA, 22 nt, Human
gucccagggaugcagacaugag

SEQ ID NO: 1130523 - RNA, 22 nt, Human
cugccacuuacuaggcauggug

SEQ ID NO: 1130524 - RNA, 22 nt, Human
aggccaaguagcuagcauugaa

SEQ ID NO: 1130525 - RNA, 22 nt, Human
gggucccaggaaggagcagugu

SEQ ID NO: 1130526 - RNA, 22 nt, Human
aaagccuugagauccuauaguu

SEQ ID NO: 1130527 - RNA, 23 nt, Human
ucugagagaacaaugccuccuau

SEQ ID NO: 1130528 - RNA, 22 nt, Human
guggcugcucgggcuccggccc

SEQ ID NO: 1130529 - RNA, 17 nt, Human
uuccucucacauuuuuu

SEQ ID NO: 1130530 - RNA, 22 nt, Human
agcagaaccacagcacuguuga

SEQ ID NO: 1130531 - RNA, 22 nt, Human
cagcacugcugcuguacacaca

SEQ ID NO: 1130532 - RNA, 22 nt, Human
auguaacuucugugaaucugac

SEQ ID NO: 1130533 - RNA, 22 nt, Human
ugcucagacaagcugaacagua

SEQ ID NO: 1130534 - RNA, 22 nt, Human
cacagggcagguacucucagag

SEQ ID NO: 1130535 - RNA, 22 nt, Human
ggagauagacuuggugagccac

SEQ ID NO: 1130536 - RNA, 22 nt, Human
aaugccaguguguugauuccag

SEQ ID NO: 1130537 - RNA, 22 nt, Human
ccugagagcagcuuccugcuua

SEQ ID NO: 1130538 - RNA, 22 nt, Human
aggggagcuaacaccagagccc

SEQ ID NO: 1130539 - RNA, 22 nt, Human
ggcaggguggcccuccagugag

SEQ ID NO: 1130540 - RNA, 22 nt, Human
ucugucugcucauuuaccucag

SEQ ID NO: 1130541 - RNA, 20 nt, Human
cccucugcuacacugggagc

SEQ ID NO: 1130542 - RNA, 22 nt, Human
uagcagcucugauucugggccc

SEQ ID NO: 1130543 - RNA, 22 nt, Human
ggaggccaaggcgggcggauca

SEQ ID NO: 1130544 - RNA, 22 nt, Human
ccagucccaggcagaaauccag

SEQ ID NO: 1130545 - RNA, 22 nt, Human
uuauaaagauuguuauguaucu

SEQ ID NO: 1130546 - RNA, 22 nt, Human
ucaaggugcugugcugugcuag

SEQ ID NO: 1130547 - RNA, 21 nt, Human
aggagggcacaaggccaggaa

SEQ ID NO: 1130548 - RNA, 22 nt, Human
agggagcuuccgaacuacagcu

SEQ ID NO: 1130549 - RNA, 22 nt, Human
gcagauggugggggaggaguac

SEQ ID NO: 1130550 - RNA, 20 nt, Human
ggcucuggaaucuggugggc

SEQ ID NO: 1130551 - RNA, 22 nt, Human
uagcuuuacaaagugcugcacc

SEQ ID NO: 1130552 - RNA, 16 nt, Human
agcagggcgggaagga

SEQ ID NO: 1130553 - RNA, 22 nt, Human
ucucacuggguauaaaugagua

SEQ ID NO: 1130554 - RNA, 18 nt, Human
gcaggagauggguggggu

SEQ ID NO: 1130555 - RNA, 22 nt, Human
cagcuggaucccugcagaacuu

SEQ ID NO: 1130556 - RNA, 22 nt, Human
uauuuuguuaauaauccagucc

SEQ ID NO: 1130557 - RNA, 22 nt, Human
ccugucugcggaggaguggaag

SEQ ID NO: 1130558 - RNA, 22 nt, Human
agguaaagacugcaaggagaau

SEQ ID NO: 1130559 - RNA, 22 nt, Human
acaguaauauugaugcucguca

SEQ ID NO: 1130560 - RNA, 22 nt, Human
ugcucuucggggccacugcuug

SEQ ID NO: 1130561 - RNA, 22 nt, Human
agagccugcaucaggcuugggg

SEQ ID NO: 1130562 - RNA, 22 nt, Human
ugcaguggcgccaucucagcuc

SEQ ID NO: 1130563 - RNA, 22 nt, Human
agcagcuucuuucacuccugga

SEQ ID NO: 1130564 - RNA, 22 nt, Human
cuggccugagaaugcuacccuu

SEQ ID NO: 1130565 - RNA, 22 nt, Human
agggguggagaguguugccagu

SEQ ID NO: 1130566 - RNA, 21 nt, Human
cugcaucucauagaacauguc

SEQ ID NO: 1130567 - RNA, 22 nt, Human
ggccugagcucuggggaggcaa

SEQ ID NO: 1130568 - RNA, 22 nt, Human
aguuacaaccaugacacaagca

SEQ ID NO: 1130569 - RNA, 22 nt, Human
ggcagggucuggacugaaagcu

SEQ ID NO: 1130570 - RNA, 22 nt, Human
agcagggccaacaguaaacacc

SEQ ID NO: 1130571 - RNA, 22 nt, Human
uccucacaagcaagcacaggua

SEQ ID NO: 1130572 - RNA, 22 nt, Human
gcugggagccccgagccagcgc

SEQ ID NO: 1130573 - RNA, 22 nt, Human
gccuucugauugcuggacugac

SEQ ID NO: 1130574 - RNA, 22 nt, Human
aggcaucugaguuugcaagcuu

SEQ ID NO: 1130575 - RNA, 22 nt, Human
gaugguuugguaaaaguauguu

SEQ ID NO: 1130576 - RNA, 19 nt, Human
acuuucuccaggaccuguu

SEQ ID NO: 1130577 - RNA, 22 nt, Human
uggagcaggccggaaguggcuu

SEQ ID NO: 1130578 - RNA, 22 nt, Human
gacaggaggcagagcucaggug

SEQ ID NO: 1130579 - RNA, 22 nt, Human
aggugaguuacaggaggagguc

SEQ ID NO: 1130580 - RNA, 21 nt, Human
ccugggagaucagcugccuuc

SEQ ID NO: 1130581 - RNA, 22 nt, Human
uuuauaaacaguaccacggugc

SEQ ID NO: 1130582 - RNA, 22 nt, Human
aaucagucauuagcucugaccu

SEQ ID NO: 1130583 - RNA, 22 nt, Human
cagggccugccugguuccugga

SEQ ID NO: 1130584 - RNA, 19 nt, Human
caucuggaugauucuccug

SEQ ID NO: 1130585 - RNA, 22 nt, Human
aagggcuggcccugggaagagu

SEQ ID NO: 1130586 - RNA, 23 nt, Human
uguaaaaugggguaguguuacca

SEQ ID NO: 1130587 - RNA, 22 nt, Human
guccuggcccacuggcaggcug

SEQ ID NO: 1130588 - RNA, 17 nt, Human
agcuccugcccauggcu

SEQ ID NO: 1130589 - RNA, 22 nt, Human
gagauauguuagaaagcuauug

SEQ ID NO: 1130590 - RNA, 22 nt, Human
ugaagcaggguggccagauugu

SEQ ID NO: 1130591 - RNA, 22 nt, Human
uaaaugcagauuccugagccua

SEQ ID NO: 1130592 - RNA, 22 nt, Human
guuugcauaaaguggaugcagg

SEQ ID NO: 1130593 - RNA, 22 nt, Human
ucuuugcaugugcuucuuggcc

SEQ ID NO: 1130594 - RNA, 22 nt, Human
aggccuggcuuugguuugcuga

SEQ ID NO: 1130595 - RNA, 22 nt, Human
aucuggcuggauucuuagcguu

SEQ ID NO: 1130596 - RNA, 22 nt, Human
uguacacaauucuuaacauaca

SEQ ID NO: 1130597 - RNA, 22 nt, Human
ccaaagugcugagauuacaggu

SEQ ID NO: 1130598 - RNA, 22 nt, Human
agccaagcugaucuccugcuga

SEQ ID NO: 1130599 - RNA, 22 nt, Human
uuccuguaguugugcaauguac

SEQ ID NO: 1130600 - RNA, 22 nt, Human
gcuggccugucuagagccuuac

SEQ ID NO: 1130601 - RNA, 22 nt, Human
gugcucuggcuggucucccggu

SEQ ID NO: 1130602 - RNA, 22 nt, Human
ggccucucuccuuggcuugcag

SEQ ID NO: 1130603 - RNA, 18 nt, Human
aaugcacacauuuacucc

SEQ ID NO: 1130604 - RNA, 22 nt, Human
auggggagagaagggcugagcu

SEQ ID NO: 1130605 - RNA, 22 nt, Human
uccaauguuauuaucuagaggc

SEQ ID NO: 1130606 - RNA, 22 nt, Human
uuagauaaauuaagacuuuaca

SEQ ID NO: 1130607 - RNA, 22 nt, Human
gcucugggcugcccucuggaca

SEQ ID NO: 1130608 - RNA, 22 nt, Human
cagcugaguguuggcauguuca

SEQ ID NO: 1130609 - RNA, 22 nt, Human
guuccaggcaagugggauagga

SEQ ID NO: 1130610 - RNA, 22 nt, Human
aaaggcuaugagauagaagaua

SEQ ID NO: 1130611 - RNA, 22 nt, Human
uagaaaugauuuugaugcuuca

SEQ ID NO: 1130612 - RNA, 22 nt, Human
ggggugggcgugcagggacacc

SEQ ID NO: 1130613 - RNA, 22 nt, Human
ggagcugaaggggugggcucag

SEQ ID NO: 1130614 - RNA, 23 nt, Human
aucaaaguggaaaucaauuaucu

SEQ ID NO: 1130615 - RNA, 22 nt, Human
ugcaguggaggccgugagacag

SEQ ID NO: 1130616 - RNA, 22 nt, Human
agaaguaggcagggcuguauca

SEQ ID NO: 1130617 - RNA, 22 nt, Human
uuaaaaugcagauucugauuca

SEQ ID NO: 1130618 - RNA, 22 nt, Human
cugggccagcaacugcaaugga

SEQ ID NO: 1130619 - RNA, 22 nt, Human
gcucagagaaucagcagacacc

SEQ ID NO: 1130620 - RNA, 22 nt, Human
uuagucaauagugaauauagag

SEQ ID NO: 1130621 - RNA, 22 nt, Human
agcaguggcuggauggugugcu

SEQ ID NO: 1130622 - RNA, 22 nt, Human
ugugcagggaagggcaugcuau

SEQ ID NO: 1130623 - RNA, 22 nt, Human
gggagggaaggaccuuaugaau

SEQ ID NO: 1130624 - RNA, 22 nt, Human
cccagcauuucugggcugcacu

SEQ ID NO: 1130625 - RNA, 22 nt, Human
cagagccaacgccaccugccca

SEQ ID NO: 1130626 - RNA, 22 nt, Human
gucccucugugucccugcaguc

SEQ ID NO: 1130627 - RNA, 22 nt, Human
caggaugggugucggccagcac

SEQ ID NO: 1130628 - RNA, 22 nt, Human
cagcauggcuugaguguuuccu

SEQ ID NO: 1130629 - RNA, 22 nt, Human
ugccugugucacagugauguuu

SEQ ID NO: 1130630 - RNA, 22 nt, Human
cagggccuucguaaguguccgg

SEQ ID NO: 1130631 - RNA, 20 nt, Human
ggcagcucacuacuuucugu

SEQ ID NO: 1130632 - RNA, 22 nt, Human
gucugagaaucuugcauaucau

SEQ ID NO: 1130633 - RNA, 22 nt, Human
ggggacugccuuccacagacac

SEQ ID NO: 1130634 - RNA, 22 nt, Human
ggcagcuguggacgucgucauu

SEQ ID NO: 1130635 - RNA, 22 nt, Human
aaaaugaggucaauauccuuuu

SEQ ID NO: 1130636 - RNA, 22 nt, Human
aaggucauggcaaauuacuuuu

SEQ ID NO: 1130637 - RNA, 20 nt, Human
agaguaacuggcacauaggg

SEQ ID NO: 1130638 - RNA, 22 nt, Human
ucugagcuacgaugccugucac

SEQ ID NO: 1130639 - RNA, 22 nt, Human
gauuuccuagacauggggcaga

SEQ ID NO: 1130640 - RNA, 22 nt, Human
ggcugcugugaccucaggugau

SEQ ID NO: 1130641 - RNA, 22 nt, Human
guggauggauugaggcaguggg

SEQ ID NO: 1130642 - RNA, 17 nt, Human
ugcauguccuuuguucc

SEQ ID NO: 1130643 - RNA, 22 nt, Human
accugaggcuguuagucuaggu

SEQ ID NO: 1130644 - RNA, 18 nt, Human
gggcacuggggacuggag

SEQ ID NO: 1130645 - RNA, 22 nt, Human
uagaaaugcccagauucugcua

SEQ ID NO: 1130646 - RNA, 22 nt, Human
aaguguguugacugaauugggg

SEQ ID NO: 1130647 - RNA, 22 nt, Human
ucugucucaaguucuugcacuc

SEQ ID NO: 1130648 - RNA, 19 nt, Human
gggcagaauggcaucucag

SEQ ID NO: 1130649 - RNA, 22 nt, Human
ggcucaggacacagugguuuag

SEQ ID NO: 1130650 - RNA, 22 nt, Human
uaaguucaguuggucgaaguag

SEQ ID NO: 1130651 - RNA, 22 nt, Human
agacagcaggggagucugguuu

SEQ ID NO: 1130652 - RNA, 20 nt, Human
aguaggggaaugcaagagca

SEQ ID NO: 1130653 - RNA, 22 nt, Human
ucagaacauuuaaaaagugguu

SEQ ID NO: 1130654 - RNA, 22 nt, Human
uuucaagcauaacugggaagag

SEQ ID NO: 1130655 - RNA, 22 nt, Human
guccuggggauacagaagugaa

SEQ ID NO: 1130656 - RNA, 22 nt, Human
agggcagagaaauguaguugag

SEQ ID NO: 1130657 - RNA, 22 nt, Human
aaaugugucauauucaaaguca

SEQ ID NO: 1130658 - RNA, 22 nt, Human
uacaaaaguaauuacgguuuuu

SEQ ID NO: 1130659 - RNA, 22 nt, Human
cagguggagcugacugagggca

SEQ ID NO: 1130660 - RNA, 22 nt, Human
uacaaagcuguauagccugguc

SEQ ID NO: 1130661 - RNA, 22 nt, Human
caauauucaguggaaaagccau

SEQ ID NO: 1130662 - RNA, 22 nt, Human
ccagcuggagccaagguggacu

SEQ ID NO: 1130663 - RNA, 20 nt, Human
gcagagccucacugcaaggg

SEQ ID NO: 1130664 - RNA, 22 nt, Human
cugagcugaaacuugagaggcu

SEQ ID NO: 1130665 - RNA, 22 nt, Human
cagacacaccaggcccauucug

SEQ ID NO: 1130666 - RNA, 22 nt, Human
cacugaagguaggaccaaggcu

SEQ ID NO: 1130667 - RNA, 22 nt, Human
cugaugcuauaagccacagugg

SEQ ID NO: 1130668 - RNA, 22 nt, Human
cagugcauagauccugaggccu

SEQ ID NO: 1130669 - RNA, 22 nt, Human
ucuguggauuuuaguguucaug

SEQ ID NO: 1130670 - RNA, 22 nt, Human
ucuuuugucgguguaucaugga

SEQ ID NO: 1130671 - RNA, 22 nt, Human
ccagccaguccagcauuggugu

SEQ ID NO: 1130672 - RNA, 22 nt, Human
ucagugcuucggcgagcaccua

SEQ ID NO: 1130673 - RNA, 22 nt, Human
ucuucucaguuucucuaggaug

SEQ ID NO: 1130674 - RNA, 22 nt, Human
uaaguucauaagcuuauucuua

SEQ ID NO: 1130675 - RNA, 22 nt, Human
ugagagugaaaugucacauguc

SEQ ID NO: 1130676 - RNA, 22 nt, Human
ugugaaagauacuaggcagagg

SEQ ID NO: 1130677 - RNA, 22 nt, Human
gcugagcuagcuaucucagucu

SEQ ID NO: 1130678 - RNA, 22 nt, Human
ugagcccagagaucugagcuau

SEQ ID NO: 1130679 - RNA, 22 nt, Human
ggcucuggcaaggggaggcuac

SEQ ID NO: 1130680 - RNA, 17 nt, Human
gccuggcccagccuggc

SEQ ID NO: 1130681 - RNA, 22 nt, Human
gcugggagcaaagccaugcaua

SEQ ID NO: 1130682 - RNA, 22 nt, Human
uaaaguucuggugagagguaag

SEQ ID NO: 1130683 - RNA, 22 nt, Human
uuacaaagaguguucuuuucca

SEQ ID NO: 1130684 - RNA, 22 nt, Human
ugccugggggacuaaggccaaa

SEQ ID NO: 1130685 - RNA, 22 nt, Human
gcaccacaucaaugaggggagc

SEQ ID NO: 1130686 - RNA, 22 nt, Human
gaggccuggaauuccagccugg

SEQ ID NO: 1130687 - RNA, 22 nt, Human
aagggcaggagaagacggauau

SEQ ID NO: 1130688 - RNA, 19 nt, Human
cuggcagccugucuguguc

SEQ ID NO: 1130689 - RNA, 22 nt, Human
gcagugguccaguucacaccca

SEQ ID NO: 1130690 - RNA, 22 nt, Human
ccagcugcuugggaaaaugucu

SEQ ID NO: 1130691 - RNA, 22 nt, Human
agcuuccuuggcgcugaggccu

SEQ ID NO: 1130692 - RNA, 22 nt, Human
cugggcugcaggaguggggcaa

SEQ ID NO: 1130693 - RNA, 16 nt, Human
ccacagggcaaggggc

SEQ ID NO: 1130694 - RNA, 22 nt, Human
aggugcagcaugaguccaacgg

SEQ ID NO: 1130695 - RNA, 22 nt, Human
auuugucuucaguagguucuuc

SEQ ID NO: 1130696 - RNA, 20 nt, Human
auuccauaguuggcacuuuu

SEQ ID NO: 1130697 - RNA, 19 nt, Human
agucccaggcccgaaagag

SEQ ID NO: 1130698 - RNA, 22 nt, Human
augguacaaaauguauaaaguc

SEQ ID NO: 1130699 - RNA, 22 nt, Human
agauuuagugguggaauuuugg

SEQ ID NO: 1130700 - RNA, 22 nt, Human
gcaggggaguccacucuaugca

SEQ ID NO: 1130701 - RNA, 21 nt, Human
uccugccuuaguccagagcag

SEQ ID NO: 1130702 - RNA, 22 nt, Human
ucauacauaacuuguacaguga

SEQ ID NO: 1130703 - RNA, 22 nt, Human
aaaaagauguccugaaguuuag

SEQ ID NO: 1130704 - RNA, 22 nt, Human
cuggccacuggagguggcaccc

SEQ ID NO: 1130705 - RNA, 22 nt, Human
ccagcgcuucccaucagggagg

SEQ ID NO: 1130706 - RNA, 22 nt, Human
uggcagagcaaaaagauagaau

SEQ ID NO: 1130707 - RNA, 22 nt, Human
caggagcuacucagguuggguu

SEQ ID NO: 1130708 - RNA, 22 nt, Human
gcagagcucaagguguucagcu

SEQ ID NO: 1130709 - RNA, 22 nt, Human
ucuuuacacaagacaagaauaa

SEQ ID NO: 1130710 - RNA, 22 nt, Human
aucaguuuaacugucaagagcc

SEQ ID NO: 1130711 - RNA, 20 nt, Human
uguucacaguaguugcugcu

SEQ ID NO: 1130712 - RNA, 22 nt, Human
caccaggcugaaccagagggga

SEQ ID NO: 1130713 - RNA, 18 nt, Human
ugcuggcaacuacuauug

SEQ ID NO: 1130714 - RNA, 22 nt, Human
cugggagucaccaggagcaagg

SEQ ID NO: 1130715 - RNA, 22 nt, Human
aaaugcuugcucuugauuauuu

SEQ ID NO: 1130716 - RNA, 20 nt, Human
ugacucugcaaccgucucuc

SEQ ID NO: 1130717 - RNA, 22 nt, Human
cucaaguaagaaacagaauugg

SEQ ID NO: 1130718 - RNA, 22 nt, Human
guguacaugagaaaucaacuuu

SEQ ID NO: 1130719 - RNA, 22 nt, Human
ugggccacaagccaugggacca

SEQ ID NO: 1130720 - RNA, 22 nt, Human
uggcagcauguuauguaaggaa

SEQ ID NO: 1130721 - RNA, 20 nt, Human
ucugcccaccccggcuccca

SEQ ID NO: 1130722 - RNA, 22 nt, Human
gcaggaugggagcuucacucug

SEQ ID NO: 1130723 - RNA, 22 nt, Human
cucagggcaguauggcugagag

SEQ ID NO: 1130724 - RNA, 22 nt, Human
cugcagaggccucgccuccucu

SEQ ID NO: 1130725 - RNA, 22 nt, Human
uuggcugagagaggaaaagggc

SEQ ID NO: 1130726 - RNA, 22 nt, Human
auaaagucugggccaggcaugg

SEQ ID NO: 1130727 - RNA, 22 nt, Human
agagggcccauguugggcugcu

SEQ ID NO: 1130728 - RNA, 22 nt, Human
uuccuguaugucagugaagagc

SEQ ID NO: 1130729 - RNA, 22 nt, Human
gggucuggacggcugcaggaag

SEQ ID NO: 1130730 - RNA, 22 nt, Human
agccuccacagaugcaaagggc

SEQ ID NO: 1130731 - RNA, 22 nt, Human
caugcuccaaaaacaagagaau

SEQ ID NO: 1130732 - RNA, 22 nt, Human
gaggggcucuugggcaugaagg

SEQ ID NO: 1130733 - RNA, 22 nt, Human
gaaaugcaggcuuggauucagc

SEQ ID NO: 1130734 - RNA, 22 nt, Human
ugcccuuggguaacuugcugau

SEQ ID NO: 1130735 - RNA, 22 nt, Human
cuucuuaaugacagauuaaaau

SEQ ID NO: 1130736 - RNA, 22 nt, Human
uuugcagcaaggagagagcauu

SEQ ID NO: 1130737 - RNA, 22 nt, Human
gccucugcaucaucacuccagc

SEQ ID NO: 1130738 - RNA, 22 nt, Human
uuccucucaacaugccugccgg

SEQ ID NO: 1130739 - RNA, 22 nt, Human
ugcagccuugccuccucccagc

SEQ ID NO: 1130740 - RNA, 22 nt, Human
agaggcuccuucacucuggcac

SEQ ID NO: 1130741 - RNA, 22 nt, Human
cagcuccugcagcugcugccgu

SEQ ID NO: 1130742 - RNA, 22 nt, Human
ccaaggagcaaguuuacaccug

SEQ ID NO: 1130743 - RNA, 21 nt, Human
agggaaagaaaaugagcuaau

SEQ ID NO: 1130744 - RNA, 22 nt, Human
ucucagggccccaaaggcuagu

SEQ ID NO: 1130745 - RNA, 16 nt, Human
cagaguguaaacagga

SEQ ID NO: 1130746 - RNA, 22 nt, Human
uaauccaaaacugaaucugugg

SEQ ID NO: 1130747 - RNA, 22 nt, Human
gagaugaauguaaacaaaggca

SEQ ID NO: 1130748 - RNA, 21 nt, Human
ggccugaguauaggacaggcc

SEQ ID NO: 1130749 - RNA, 22 nt, Human
gcacagagggcagugagccucu

SEQ ID NO: 1130750 - RNA, 22 nt, Human
gcugucugucuucacaucucgc

SEQ ID NO: 1130751 - RNA, 22 nt, Human
auggggcucugcggcugcuccc

SEQ ID NO: 1130752 - RNA, 22 nt, Human
uuagaaaucaccucugaagauc

SEQ ID NO: 1130753 - RNA, 18 nt, Human
uccucucuuuccccaggg

SEQ ID NO: 1130754 - RNA, 22 nt, Human
uaaauucugaucaaguuccuuc

SEQ ID NO: 1130755 - RNA, 22 nt, Human
gugucccaauguucaggacggc

SEQ ID NO: 1130756 - RNA, 22 nt, Human
ugcagccaucgcagagucugua

SEQ ID NO: 1130757 - RNA, 22 nt, Human
agcaccugcuaugugucaggga

SEQ ID NO: 1130758 - RNA, 23 nt, Human
ccagcccuccaccagcucuaggc

SEQ ID NO: 1130759 - RNA, 22 nt, Human
agggcagaggcggacacggaag

SEQ ID NO: 1130760 - RNA, 22 nt, Human
gcuggcaccugcaccaagcagg

SEQ ID NO: 1130761 - RNA, 22 nt, Human
ccagcagagucuaggaaggagg

SEQ ID NO: 1130762 - RNA, 22 nt, Human
gucaccagugcuaagaggugga

SEQ ID NO: 1130763 - RNA, 17 nt, Human
uugggagagaaagguau

SEQ ID NO: 1130764 - RNA, 22 nt, Human
gcagcagaugcuuucauggaca

SEQ ID NO: 1130765 - RNA, 22 nt, Human
uggcagccacaucucguggauu

SEQ ID NO: 1130766 - RNA, 22 nt, Human
ugaagcagcuucuuucugucaa

SEQ ID NO: 1130767 - RNA, 22 nt, Human
agaagccagcuucagcugcccg

SEQ ID NO: 1130768 - RNA, 22 nt, Human
agagcugagaauguggcuuccu

SEQ ID NO: 1130769 - RNA, 22 nt, Human
gugccugcugcagagucgcugu

SEQ ID NO: 1130770 - RNA, 22 nt, Human
gacucugcuacaggccgagguu

SEQ ID NO: 1130771 - RNA, 22 nt, Human
auguaucagaaauagcauuggc

SEQ ID NO: 1130772 - RNA, 22 nt, Human
ccagccuggguguuagaagaca

SEQ ID NO: 1130773 - RNA, 22 nt, Human
ggggcagagcauagcuccaauu

SEQ ID NO: 1130774 - RNA, 22 nt, Human
gaaaugugggucaugacccauu

SEQ ID NO: 1130775 - RNA, 22 nt, Human
gcacacaggcaguuuccagcca

SEQ ID NO: 1130776 - RNA, 22 nt, Human
ccuggcuguggcggugcucuca

SEQ ID NO: 1130777 - RNA, 22 nt, Human
cuggggacuugcagacacaauu

SEQ ID NO: 1130778 - RNA, 22 nt, Human
aaucgguugaacccaggaagug

SEQ ID NO: 1130779 - RNA, 22 nt, Human
aaguugaagcaugaaccaaggu

SEQ ID NO: 1130780 - RNA, 22 nt, Human
gguagcagggcugugagucaga

SEQ ID NO: 1130781 - RNA, 22 nt, Human
ucucucuucuuuguuaagaaug

SEQ ID NO: 1130782 - RNA, 22 nt, Human
gaaggccucacucugcagcaua

SEQ ID NO: 1130783 - RNA, 22 nt, Human
caggcagggagcuggaaaggau

SEQ ID NO: 1130784 - RNA, 23 nt, Human
uggcucugagcuuccugguggcc

SEQ ID NO: 1130785 - RNA, 20 nt, Human
ccugccugccucggcucauu

SEQ ID NO: 1130786 - RNA, 22 nt, Human
uuaaaguucauuaaaugagcca

SEQ ID NO: 1130787 - RNA, 23 nt, Human
ucugucaccuauggcugcucuuc

SEQ ID NO: 1130788 - RNA, 22 nt, Human
uguaugcuuguguauaauauaa

SEQ ID NO: 1130789 - RNA, 22 nt, Human
auggacaggcugagcuuccuca

SEQ ID NO: 1130790 - RNA, 22 nt, Human
uuaggcaaauaaaauguuucca

SEQ ID NO: 1130791 - RNA, 22 nt, Human
agcuguucccucacugcaguca

SEQ ID NO: 1130792 - RNA, 22 nt, Human
gagcugccugugugccaugaug

SEQ ID NO: 1130793 - RNA, 22 nt, Human
aggcuccuaucgcuuucagcaa

SEQ ID NO: 1130794 - RNA, 22 nt, Human
ucaggcugcccguucagggcuc

SEQ ID NO: 1130795 - RNA, 22 nt, Human
ccuggagcaggagcugcagagg

SEQ ID NO: 1130796 - RNA, 22 nt, Human
ggucagggggaucugugaggua

SEQ ID NO: 1130797 - RNA, 22 nt, Human
ggcuggccucaggguccucgcu

SEQ ID NO: 1130798 - RNA, 22 nt, Human
gguccccagcaguggcugcuuc

SEQ ID NO: 1130799 - RNA, 19 nt, Human
agggcugcucuggccuggg

SEQ ID NO: 1130800 - RNA, 20 nt, Human
gugaccagaagacagugggu

SEQ ID NO: 1130801 - RNA, 22 nt, Human
cugcugcauuacucuucucaag

SEQ ID NO: 1130802 - RNA, 20 nt, Human
uguuucuuuuaaugagcggc

SEQ ID NO: 1130803 - RNA, 22 nt, Human
uuaagucauuucugauuauaga

SEQ ID NO: 1130804 - RNA, 22 nt, Human
aaacagaaauuuccucaugcuc

SEQ ID NO: 1130805 - RNA, 22 nt, Human
acagcagccugcagcccugugu

SEQ ID NO: 1130806 - RNA, 22 nt, Human
aagagcauauuaauaguggaga

SEQ ID NO: 1130807 - RNA, 22 nt, Human
gccagcagcccagaaggacuuu

SEQ ID NO: 1130808 - RNA, 22 nt, Human
agcugcccuggcggagcugcuc

SEQ ID NO: 1130809 - RNA, 22 nt, Human
agagggagcccagucauagcug

SEQ ID NO: 1130810 - RNA, 22 nt, Human
cccuccagccauggacccaggu

SEQ ID NO: 1130811 - RNA, 22 nt, Human
gcucugagauugagccuuuggu

SEQ ID NO: 1130812 - RNA, 22 nt, Human
ggagagcaggguccugagauac

SEQ ID NO: 1130813 - RNA, 22 nt, Human
uggcuggcccugggagugcaga

SEQ ID NO: 1130814 - RNA, 22 nt, Human
ccaggacuucgaggcuacagug

SEQ ID NO: 1130815 - RNA, 22 nt, Human
ucccaggauguuggcggcaggu

SEQ ID NO: 1130816 - RNA, 22 nt, Human
ucucucuucaugcuuuuagaau

SEQ ID NO: 1130817 - RNA, 22 nt, Human
ccugagggaaggaugcuaccca

SEQ ID NO: 1130818 - RNA, 22 nt, Human
uuuucauuuuuguagaugcaag

SEQ ID NO: 1130819 - RNA, 20 nt, Human
cuggcaggagcgagucuacc

SEQ ID NO: 1130820 - RNA, 22 nt, Human
agggcuggcuccguuaccuuga

SEQ ID NO: 1130821 - RNA, 22 nt, Human
cucccucugucuuguccagaaa

SEQ ID NO: 1130822 - RNA, 20 nt, Human
gaggaaaagcugccaggccu

SEQ ID NO: 1130823 - RNA, 22 nt, Human
cccaggagagaggccaguuggc

SEQ ID NO: 1130824 - RNA, 23 nt, Human
gcugucaguuguuuuugucucua

SEQ ID NO: 1130825 - RNA, 22 nt, Human
gguggcagcgucuaucugacau

SEQ ID NO: 1130826 - RNA, 22 nt, Human
cugucuccuccacugcauggga

SEQ ID NO: 1130827 - RNA, 22 nt, Human
agagcuguggauaguccuggau

SEQ ID NO: 1130828 - RNA, 22 nt, Human
uggcagggugggcuucagcccc

SEQ ID NO: 1130829 - RNA, 22 nt, Human
agaacagaagggaggaaggccu

SEQ ID NO: 1130830 - RNA, 22 nt, Human
cagcagcucccauccgcugagc

SEQ ID NO: 1130831 - RNA, 21 nt, Human
gugguuauuuucauuagcauc

SEQ ID NO: 1130832 - RNA, 22 nt, Human
cuccucuggaaauuccucugcc

SEQ ID NO: 1130833 - RNA, 19 nt, Human
gggcucuggccucaguggg

SEQ ID NO: 1130834 - RNA, 22 nt, Human
auagucuuagaucagauaaagu

SEQ ID NO: 1130835 - RNA, 22 nt, Human
agcugagcauuugauccaccuc

SEQ ID NO: 1130836 - RNA, 19 nt, Human
uccccagcaccucugaguc

SEQ ID NO: 1130837 - RNA, 23 nt, Human
cugaggccugcugcguucagguu

SEQ ID NO: 1130838 - RNA, 22 nt, Human
gagagugauucccucccauaga

SEQ ID NO: 1130839 - RNA, 22 nt, Human
cugaggucucuuuccauaguga

SEQ ID NO: 1130840 - RNA, 22 nt, Human
uaaauguaccuucugccuuacu

SEQ ID NO: 1130841 - RNA, 22 nt, Human
ggcuggaaguccaagaucaaga

SEQ ID NO: 1130842 - RNA, 22 nt, Human
aaaguguugggaagaaagugca

SEQ ID NO: 1130843 - RNA, 22 nt, Human
aucuggcuugacuuugcgacuu

SEQ ID NO: 1130844 - RNA, 22 nt, Human
uacauuugcuuugauuuucagc

SEQ ID NO: 1130845 - RNA, 22 nt, Human
gagaaggggugauguggguaau

SEQ ID NO: 1130846 - RNA, 22 nt, Human
gacagcagacagaacuaccugc

SEQ ID NO: 1130847 - RNA, 22 nt, Human
ugaaggaaaugacggcagaaga

SEQ ID NO: 1130848 - RNA, 22 nt, Human
cucugggcaccaaagagcagcu

SEQ ID NO: 1130849 - RNA, 22 nt, Human
agagugaaaagcuagagcagua

SEQ ID NO: 1130850 - RNA, 22 nt, Human
caggcacuggggaugcugggau

SEQ ID NO: 1130851 - RNA, 22 nt, Human
ggagaugguggaagcuggugca

SEQ ID NO: 1130852 - RNA, 22 nt, Human
gggagagagaaaacguggcgca

SEQ ID NO: 1130853 - RNA, 22 nt, Human
uaaacauggauucugaucacag

SEQ ID NO: 1130854 - RNA, 22 nt, Human
cuucugugcuucacaguugcca

SEQ ID NO: 1130855 - RNA, 22 nt, Human
gcaggagcucguuuccaggcug

SEQ ID NO: 1130856 - RNA, 22 nt, Human
aacuuuauuguuaggggcuaaa

SEQ ID NO: 1130857 - RNA, 22 nt, Human
uaaguuuaaauguacaugaagc

SEQ ID NO: 1130858 - RNA, 22 nt, Human
gggacuguaaauucauauggcc

SEQ ID NO: 1130859 - RNA, 23 nt, Human
ccacagagcugccaauuccugug

SEQ ID NO: 1130860 - RNA, 19 nt, Human
ucucagagcccuagaggcc

SEQ ID NO: 1130861 - RNA, 21 nt, Human
gggugcuguggucaugcagga

SEQ ID NO: 1130862 - RNA, 22 nt, Human
agggccuggugaccuggguccu

SEQ ID NO: 1130863 - RNA, 22 nt, Human
acagagccaaaaggacauagua

SEQ ID NO: 1130864 - RNA, 22 nt, Human
agcaggguauguuagagcugua

SEQ ID NO: 1130865 - RNA, 22 nt, Human
uuagcucagaaaauuuaaacuu

SEQ ID NO: 1130866 - RNA, 22 nt, Human
gccccuggcuggccagcuccuc

SEQ ID NO: 1130867 - RNA, 22 nt, Human
acagauauaugauuguguaaau

SEQ ID NO: 1130868 - RNA, 17 nt, Human
gagugcugguggagcuc

SEQ ID NO: 1130869 - RNA, 22 nt, Human
agaaauguuguggguuuuguua

SEQ ID NO: 1130870 - RNA, 22 nt, Human
gacagggcauggugcagaguuc

SEQ ID NO: 1130871 - RNA, 22 nt, Human
ugcccugugugugcaagcacug

SEQ ID NO: 1130872 - RNA, 22 nt, Human
aacuagaaccacuuguauuucc

SEQ ID NO: 1130873 - RNA, 22 nt, Human
cuggccugugggcugucuccgg

SEQ ID NO: 1130874 - RNA, 22 nt, Human
agccuggaauuaaggaaaugca

SEQ ID NO: 1130875 - RNA, 21 nt, Human
aaagagguuaauauuguaagu

SEQ ID NO: 1130876 - RNA, 22 nt, Human
uggaggagaauuuauggucgaa

SEQ ID NO: 1130877 - RNA, 22 nt, Human
cuggagccccaggcugugcaga

SEQ ID NO: 1130878 - RNA, 22 nt, Human
cccagacauaacagcagagagg

SEQ ID NO: 1130879 - RNA, 22 nt, Human
ccacagccauuccagggaggcu

SEQ ID NO: 1130880 - RNA, 22 nt, Human
guuauguaucuugauugggugg

SEQ ID NO: 1130881 - RNA, 22 nt, Human
augcaguacugauacaugccac

SEQ ID NO: 1130882 - RNA, 22 nt, Human
agcugcuguccuaggcacugua

SEQ ID NO: 1130883 - RNA, 22 nt, Human
gaacagaagaggcuggugccac

SEQ ID NO: 1130884 - RNA, 22 nt, Human
ucuucuuccuccacagggccca

SEQ ID NO: 1130885 - RNA, 22 nt, Human
cucuggccagagccugcgggaa

SEQ ID NO: 1130886 - RNA, 22 nt, Human
gcccugugccagucacgcugug

SEQ ID NO: 1130887 - RNA, 22 nt, Human
uggccugccucccggcuucuuu

SEQ ID NO: 1130888 - RNA, 22 nt, Human
gccuaggagacaagcgugaaag

SEQ ID NO: 1130889 - RNA, 22 nt, Human
agugggaggcggcugacgggcg

SEQ ID NO: 1130890 - RNA, 22 nt, Human
ugucucaguucccuucucugga

SEQ ID NO: 1130891 - RNA, 17 nt, Human
gcugcagcgguaggcag

SEQ ID NO: 1130892 - RNA, 22 nt, Human
aaugcacaugucuuggccucac

SEQ ID NO: 1130893 - RNA, 22 nt, Human
agucucagaaaauaugcuuuuu

SEQ ID NO: 1130894 - RNA, 22 nt, Human
cuggugcuggagccuagucccu

SEQ ID NO: 1130895 - RNA, 22 nt, Human
aggaggcugguucaggccauau

SEQ ID NO: 1130896 - RNA, 22 nt, Human
uaauacuugcuuuggauguaug

SEQ ID NO: 1130897 - RNA, 22 nt, Human
ugcuugagacacauaugaauuu

SEQ ID NO: 1130898 - RNA, 22 nt, Human
acccuggguucccgcagcacca

SEQ ID NO: 1130899 - RNA, 22 nt, Human
gccugcagaggugcugcuagcu

SEQ ID NO: 1130900 - RNA, 22 nt, Human
acauagcuuaaaugagaagaua

SEQ ID NO: 1130901 - RNA, 22 nt, Human
guaucuuuccacaucuucagua

SEQ ID NO: 1130902 - RNA, 22 nt, Human
auggauaagucaaagaguaucc

SEQ ID NO: 1130903 - RNA, 22 nt, Human
acagugucugacacauuguagc

SEQ ID NO: 1130904 - RNA, 22 nt, Human
augcaccugaacuccaucagcu

SEQ ID NO: 1130905 - RNA, 21 nt, Human
gcagcagaggcuugacagaca

SEQ ID NO: 1130906 - RNA, 20 nt, Human
ccugucugcaauggagguca

SEQ ID NO: 1130907 - RNA, 22 nt, Human
ccuggcugugcauugccggccc

SEQ ID NO: 1130908 - RNA, 22 nt, Human
uagaacagaggguugcccagau

SEQ ID NO: 1130909 - RNA, 22 nt, Human
caggaaaggugugucaugaugg

SEQ ID NO: 1130910 - RNA, 22 nt, Human
cagagagagucaaaucuuugcu

SEQ ID NO: 1130911 - RNA, 22 nt, Human
cugcagagaauuguggggcuuc

SEQ ID NO: 1130912 - RNA, 22 nt, Human
guguaaggugaaaucaacaaau

SEQ ID NO: 1130913 - RNA, 22 nt, Human
gggcacugcuggaggcucccug

SEQ ID NO: 1130914 - RNA, 22 nt, Human
aaggcccuaauagagcacauau

SEQ ID NO: 1130915 - RNA, 22 nt, Human
ugccacccagccaggaguggga

SEQ ID NO: 1130916 - RNA, 22 nt, Human
guacauuggcaacucucuuaga

SEQ ID NO: 1130917 - RNA, 22 nt, Human
cuuccucaugugcaaugcaagc

SEQ ID NO: 1130918 - RNA, 22 nt, Human
uguaugcaaauuuauuagcaca

SEQ ID NO: 1130919 - RNA, 22 nt, Human
accucugccaagaugugcuccc

SEQ ID NO: 1130920 - RNA, 22 nt, Human
uguguacaggccuugcuagacu

SEQ ID NO: 1130921 - RNA, 22 nt, Human
cugagguguugaugaccuaugc

SEQ ID NO: 1130922 - RNA, 23 nt, Human
ccagcuccgugagccucgggcuc

SEQ ID NO: 1130923 - RNA, 22 nt, Human
cacacuagucuauccauuagcu

SEQ ID NO: 1130924 - RNA, 22 nt, Human
uguuuguucccucucuuuccug

SEQ ID NO: 1130925 - RNA, 22 nt, Human
cagggagaagucuggucagucc

SEQ ID NO: 1130926 - RNA, 22 nt, Human
gcugucuuccuugcuccaaggg

SEQ ID NO: 1130927 - RNA, 22 nt, Human
gcuccagguauuugcccuuuua

SEQ ID NO: 1130928 - RNA, 22 nt, Human
ggagugggaacaaugacauggu

SEQ ID NO: 1130929 - RNA, 22 nt, Human
cugggacacccaaggaaagagc

SEQ ID NO: 1130930 - RNA, 22 nt, Human
uagaaguuaaaggaauacagaa

SEQ ID NO: 1130931 - RNA, 22 nt, Human
uagauuucgcugcaucucaauc

SEQ ID NO: 1130932 - RNA, 22 nt, Human
aaaaaguuucaacugccaacuc

SEQ ID NO: 1130933 - RNA, 22 nt, Human
aaggcugcuuuuaacaugcaua

SEQ ID NO: 1130934 - RNA, 22 nt, Human
agugaaauugcuguaagaggaa

SEQ ID NO: 1130935 - RNA, 22 nt, Human
aaaugcacagaggccagagagg

SEQ ID NO: 1130936 - RNA, 22 nt, Human
ucaaaugcaggucuggucuugg

SEQ ID NO: 1130937 - RNA, 22 nt, Human
uacauucaacaugucacuaugu

SEQ ID NO: 1130938 - RNA, 22 nt, Human
uccucugcuccaucuuuacugu

SEQ ID NO: 1130939 - RNA, 22 nt, Human
accaguccgcggagcuccgggg

SEQ ID NO: 1130940 - RNA, 22 nt, Human
ucauugcauuuauucacuggca

SEQ ID NO: 1130941 - RNA, 23 nt, Human
ccuggcagcaaacgaggagguua

SEQ ID NO: 1130942 - RNA, 22 nt, Human
uguuuaaucuauaaaauggaga

SEQ ID NO: 1130943 - RNA, 22 nt, Human
caguuuuugccauuaagaguaa

SEQ ID NO: 1130944 - RNA, 22 nt, Human
uggccugccccgagauccuggc

SEQ ID NO: 1130945 - RNA, 22 nt, Human
gagagaagaaagccaugguccu

SEQ ID NO: 1130946 - RNA, 22 nt, Human
auacauguaacugcauuguaau

SEQ ID NO: 1130947 - RNA, 23 nt, Human
ucaggauauugugugccaaggug

SEQ ID NO: 1130948 - RNA, 22 nt, Human
uagccggguguugugucaugca

SEQ ID NO: 1130949 - RNA, 22 nt, Human
guccacauaggaacccagcuuc

SEQ ID NO: 1130950 - RNA, 22 nt, Human
uggcucaguagcagugugguca

SEQ ID NO: 1130951 - RNA, 22 nt, Human
uccagggaccucccugagagcu

SEQ ID NO: 1130952 - RNA, 22 nt, Human
cuggccacaacuagcccaggac

SEQ ID NO: 1130953 - RNA, 20 nt, Human
agucccagaucaaauuucug

SEQ ID NO: 1130954 - RNA, 18 nt, Human
gggaagaggaucuggccc

SEQ ID NO: 1130955 - RNA, 22 nt, Human
uccucuucugcccaucagaggc

SEQ ID NO: 1130956 - RNA, 22 nt, Human
accagagauggggcuucucugu

SEQ ID NO: 1130957 - RNA, 22 nt, Human
uguguauuaccauuuuacagcu

SEQ ID NO: 1130958 - RNA, 22 nt, Human
ucucuggguuuuuguccuguac

SEQ ID NO: 1130959 - RNA, 22 nt, Human
uggcccugcuguaucaucugcu

SEQ ID NO: 1130960 - RNA, 22 nt, Human
ccuggcugguggcagcgacaag

SEQ ID NO: 1130961 - RNA, 22 nt, Human
cagaguguauucugcaguugca

SEQ ID NO: 1130962 - RNA, 22 nt, Human
agcucccaauugacuugaacua

SEQ ID NO: 1130963 - RNA, 22 nt, Human
cucuuucaguucugauagucuc

SEQ ID NO: 1130964 - RNA, 22 nt, Human
gcugugcuauaucucugagugu

SEQ ID NO: 1130965 - RNA, 22 nt, Human
acacuuuacagcuuccuuugca

SEQ ID NO: 1130966 - RNA, 22 nt, Human
ugggugggagcacccugucugg

SEQ ID NO: 1130967 - RNA, 22 nt, Human
uugcucagcacuggagccagcu

SEQ ID NO: 1130968 - RNA, 22 nt, Human
cagaggccauauuucuucacuc

SEQ ID NO: 1130969 - RNA, 22 nt, Human
guaucuuucccaccaaucacaa

SEQ ID NO: 1130970 - RNA, 21 nt, Human
ccuggcugcacaguugcuggu

SEQ ID NO: 1130971 - RNA, 22 nt, Human
ucaugacaucuguuuaucucaa

SEQ ID NO: 1130972 - RNA, 22 nt, Human
ugcuggggcucugaccacucca

SEQ ID NO: 1130973 - RNA, 22 nt, Human
gagaggagucccuaucacaguu

SEQ ID NO: 1130974 - RNA, 19 nt, Human
cucugccucuggcuguggc

SEQ ID NO: 1130975 - RNA, 22 nt, Human
cagcucugggugacaggagggc

SEQ ID NO: 1130976 - RNA, 22 nt, Human
gcagggacaucuuugucuagua

SEQ ID NO: 1130977 - RNA, 22 nt, Human
gccaggcacaguucuaggugcu

SEQ ID NO: 1130978 - RNA, 22 nt, Human
cuuucaaugugccugccuuggg

SEQ ID NO: 1130979 - RNA, 22 nt, Human
gggcugcugcccaggaggcacc

SEQ ID NO: 1130980 - RNA, 22 nt, Human
gagaagcaauuuccaacugugc

SEQ ID NO: 1130981 - RNA, 22 nt, Human
ucagagugcagggaguagcagc

SEQ ID NO: 1130982 - RNA, 22 nt, Human
gauuucaagcccccagagauuc

SEQ ID NO: 1130983 - RNA, 20 nt, Human
cuguagggugcagcaggcuc

SEQ ID NO: 1130984 - RNA, 18 nt, Human
uggcagggaggaaauaua

SEQ ID NO: 1130985 - RNA, 21 nt, Human
uucaaagagugggcauuguca

SEQ ID NO: 1130986 - RNA, 22 nt, Human
ugucucugaacagcuuacuaaa

SEQ ID NO: 1130987 - RNA, 22 nt, Human
ucagccuggcaggauggccugg

SEQ ID NO: 1130988 - RNA, 22 nt, Human
uacaaaugaccauagccacuua

SEQ ID NO: 1130989 - RNA, 22 nt, Human
ggcuguccuuggccaaggcacu

SEQ ID NO: 1130990 - RNA, 22 nt, Human
gcccucagaggacagcugacuu

SEQ ID NO: 1130991 - RNA, 20 nt, Human
ggcugcugugggcagagagg

SEQ ID NO: 1130992 - RNA, 22 nt, Human
ccucugcucccuggugucugag

SEQ ID NO: 1130993 - RNA, 22 nt, Human
uacaaaguuuucuuggauugag

SEQ ID NO: 1130994 - RNA, 21 nt, Human
cuggacugaggagacagucgc

SEQ ID NO: 1130995 - RNA, 22 nt, Human
gcugccaugccacagcacucac

SEQ ID NO: 1130996 - RNA, 22 nt, Human
auaauaaaccaggaugggucug

SEQ ID NO: 1130997 - RNA, 22 nt, Human
gcuggcugcgucaucacagggc

SEQ ID NO: 1130998 - RNA, 22 nt, Human
cugcugcaggaugggcacucug

SEQ ID NO: 1130999 - RNA, 22 nt, Human
cgugucaucugagccuugggcg

SEQ ID NO: 1131000 - RNA, 22 nt, Human
ggucccaggagaauaggugcaa

SEQ ID NO: 1131001 - RNA, 22 nt, Human
ccagcagcagcguccaaggaga

SEQ ID NO: 1131002 - RNA, 22 nt, Human
cagucccaggguugguucagcu

SEQ ID NO: 1131003 - RNA, 22 nt, Human
cccccaggcucugacacaggag

SEQ ID NO: 1131004 - RNA, 17 nt, Human
ccucccacaccgcccug

SEQ ID NO: 1131005 - RNA, 22 nt, Human
augggaggcagacacuaaguuc

SEQ ID NO: 1131006 - RNA, 22 nt, Human
uggcugaauaauauucuguugu

SEQ ID NO: 1131007 - RNA, 22 nt, Human
gcauuucuuccuggugugagcc

SEQ ID NO: 1131008 - RNA, 22 nt, Human
caggucagagucccccuguccu

SEQ ID NO: 1131009 - RNA, 22 nt, Human
uuuccauauuuggucuuuggga

SEQ ID NO: 1131010 - RNA, 22 nt, Human
aggggcugggacagagccaagc

SEQ ID NO: 1131011 - RNA, 22 nt, Human
aaagacugguguguuacauaua

SEQ ID NO: 1131012 - RNA, 22 nt, Human
uacuuuuugucucuuugaaugu

SEQ ID NO: 1131013 - RNA, 22 nt, Human
cagggucuuauaaggccaauuu

SEQ ID NO: 1131014 - RNA, 22 nt, Human
caguggaggcucaagugugcuu

SEQ ID NO: 1131015 - RNA, 22 nt, Human
ccaggagcaaagaucacuggga

SEQ ID NO: 1131016 - RNA, 22 nt, Human
acagccuggacuggcucucugc

SEQ ID NO: 1131017 - RNA, 22 nt, Human
uggagcauauucuggagcuugg

SEQ ID NO: 1131018 - RNA, 22 nt, Human
aaggccaggacaccaggggacu

SEQ ID NO: 1131019 - RNA, 22 nt, Human
acagaauuaaugaaaauuacaa

SEQ ID NO: 1131020 - RNA, 21 nt, Human
uuguucuuccagaagcaaagu

SEQ ID NO: 1131021 - RNA, 22 nt, Human
ccugccagcccgcguucaugcc

SEQ ID NO: 1131022 - RNA, 22 nt, Human
uccagccaugacucggacagug

SEQ ID NO: 1131023 - RNA, 22 nt, Human
cuguccuguagcuccaucaguc

SEQ ID NO: 1131024 - RNA, 22 nt, Human
aggcugcagugcagguaggauu

SEQ ID NO: 1131025 - RNA, 22 nt, Human
aggcuuccuggaggaagaggua

SEQ ID NO: 1131026 - RNA, 22 nt, Human
gggccugugcacaguucuguua

SEQ ID NO: 1131027 - RNA, 21 nt, Human
gagacagacuuucguccccug

SEQ ID NO: 1131028 - RNA, 22 nt, Human
cuagagggauguuaggauagca

SEQ ID NO: 1131029 - RNA, 21 nt, Human
acaguucaugauaacuccauc

SEQ ID NO: 1131030 - RNA, 22 nt, Human
acagggccagccugggaccugg

SEQ ID NO: 1131031 - RNA, 22 nt, Human
cugccuggguucaaguccuguu

SEQ ID NO: 1131032 - RNA, 22 nt, Human
ccucccuggccagagcagcagc

SEQ ID NO: 1131033 - RNA, 22 nt, Human
agcucccagaagccagagucgg

SEQ ID NO: 1131034 - RNA, 22 nt, Human
acacaguaccccaaggcugggc

SEQ ID NO: 1131035 - RNA, 22 nt, Human
uuauuuauuguguaccuacugu

SEQ ID NO: 1131036 - RNA, 22 nt, Human
augacagaggagugcaggugau

SEQ ID NO: 1131037 - RNA, 22 nt, Human
gcagagccugugucugagcaaa

SEQ ID NO: 1131038 - RNA, 20 nt, Human
gccugcagagaaggucagag

SEQ ID NO: 1131039 - RNA, 22 nt, Human
ggcugccuccugcugggcugga

SEQ ID NO: 1131040 - RNA, 22 nt, Human
auguagcagaagauguuuuccu

SEQ ID NO: 1131041 - RNA, 22 nt, Human
acugagcugugacaaugcuuaa

SEQ ID NO: 1131042 - RNA, 22 nt, Human
uggcuucuuagaccaguggccu

SEQ ID NO: 1131043 - RNA, 20 nt, Human
uggcccuguuuucuccaggc

SEQ ID NO: 1131044 - RNA, 21 nt, Human
ggccucugccuugccccacuc

SEQ ID NO: 1131045 - RNA, 22 nt, Human
gcuuccuggagggagagagcug

SEQ ID NO: 1131046 - RNA, 22 nt, Human
gucucagagagcuacucucuua

SEQ ID NO: 1131047 - RNA, 22 nt, Human
auuucagcccaguaugagcccc

SEQ ID NO: 1131048 - RNA, 22 nt, Human
uucuuccucagcagggcugccu

SEQ ID NO: 1131049 - RNA, 22 nt, Human
uagagaaauaagcuuugccuug

SEQ ID NO: 1131050 - RNA, 22 nt, Human
aucaguuuggugcuuucaguga

SEQ ID NO: 1131051 - RNA, 22 nt, Human
cagcucccagagugaccagcag

SEQ ID NO: 1131052 - RNA, 21 nt, Human
agcagcugcaguuucuaucug

SEQ ID NO: 1131053 - RNA, 22 nt, Human
cagagcugcuucccaguuugug

SEQ ID NO: 1131054 - RNA, 22 nt, Human
ugguccugccccgugcacagag

SEQ ID NO: 1131055 - RNA, 22 nt, Human
acagugaaugcccaagaaaagu

SEQ ID NO: 1131056 - RNA, 21 nt, Human
uggcucugagccucauggcug

SEQ ID NO: 1131057 - RNA, 22 nt, Human
ccaguccagugccaugcauggc

SEQ ID NO: 1131058 - RNA, 22 nt, Human
gagagcugcagccgagaggggg

SEQ ID NO: 1131059 - RNA, 22 nt, Human
cagagccagcuguccuuggcau

SEQ ID NO: 1131060 - RNA, 22 nt, Human
cucucucuucuuuguaggggcc

SEQ ID NO: 1131061 - RNA, 19 nt, Human
uguguaaagucugugguca

SEQ ID NO: 1131062 - RNA, 22 nt, Human
gcagauggacuguaugaccuga

SEQ ID NO: 1131063 - RNA, 22 nt, Human
augcccgauaccuaguuaacuc

SEQ ID NO: 1131064 - RNA, 22 nt, Human
cuuucauucuuagauauuagug

SEQ ID NO: 1131065 - RNA, 22 nt, Human
ucagggcauacucuucaagguc

SEQ ID NO: 1131066 - RNA, 22 nt, Human
cccuggagcugcuugcauguug

SEQ ID NO: 1131067 - RNA, 22 nt, Human
ugagccuggcggaagcagcgug

SEQ ID NO: 1131068 - RNA, 19 nt, Human
acccucucagugccugagg

SEQ ID NO: 1131069 - RNA, 22 nt, Human
gggaucagaaacauagcccuga

SEQ ID NO: 1131070 - RNA, 22 nt, Human
cuggagagggagcccuggcagu

SEQ ID NO: 1131071 - RNA, 22 nt, Human
uguaguaagugcgcaauaaaua

SEQ ID NO: 1131072 - RNA, 22 nt, Human
uuccauaaucaccuuauucuuu

SEQ ID NO: 1131073 - RNA, 21 nt, Human
uggccucccacacuuccaugg

SEQ ID NO: 1131074 - RNA, 22 nt, Human
cugccgagugggucaugaggca

SEQ ID NO: 1131075 - RNA, 22 nt, Human
gagagugaggccugggaaucua

SEQ ID NO: 1131076 - RNA, 22 nt, Human
guauuugauagauuucaaagga

SEQ ID NO: 1131077 - RNA, 17 nt, Human
ggccuugggcugcucuu

SEQ ID NO: 1131078 - RNA, 22 nt, Human
ucuguccucuuugaagcugcuc

SEQ ID NO: 1131079 - RNA, 22 nt, Human
gagcagcugguaggugaaccca

SEQ ID NO: 1131080 - RNA, 22 nt, Human
aagccuuccugagugcaaggcc

SEQ ID NO: 1131081 - RNA, 18 nt, Human
uccauuguucuacuguga

SEQ ID NO: 1131082 - RNA, 22 nt, Human
gcagcaggagaguuuguccugc

SEQ ID NO: 1131083 - RNA, 22 nt, Human
ucugguuagccaauaaugccaa

SEQ ID NO: 1131084 - RNA, 22 nt, Human
gcaggccugacuguagggggca

SEQ ID NO: 1131085 - RNA, 19 nt, Human
acauuuagaauguacuugc

SEQ ID NO: 1131086 - RNA, 22 nt, Human
ucacaugcuugaggaaagaaaa

SEQ ID NO: 1131087 - RNA, 22 nt, Human
cugggcucagaugagaggaagg

SEQ ID NO: 1131088 - RNA, 22 nt, Human
cccauuuagauaacaguucaaa

SEQ ID NO: 1131089 - RNA, 22 nt, Human
ggagacagugacuuagagacug

SEQ ID NO: 1131090 - RNA, 22 nt, Human
agucucagaaaagaagcaugga

SEQ ID NO: 1131091 - RNA, 22 nt, Human
gcugccugggcaggaggcgcug

SEQ ID NO: 1131092 - RNA, 22 nt, Human
ccucuugccaaucagcuacaga

SEQ ID NO: 1131093 - RNA, 22 nt, Human
uggcagaguuauggguauuuau

SEQ ID NO: 1131094 - RNA, 22 nt, Human
ugcugguggagaaaguggaggu

SEQ ID NO: 1131095 - RNA, 22 nt, Human
agggcagauggaacuuccccga

SEQ ID NO: 1131096 - RNA, 22 nt, Human
gguacaaggagugaagguuugg

SEQ ID NO: 1131097 - RNA, 22 nt, Human
agggaggauaguagucaguuua

SEQ ID NO: 1131098 - RNA, 22 nt, Human
uaagaacaguguuucaucucua

SEQ ID NO: 1131099 - RNA, 22 nt, Human
ccugagaccaaguugcagccau

SEQ ID NO: 1131100 - RNA, 22 nt, Human
cacugcuuuuuuggcuauguac

SEQ ID NO: 1131101 - RNA, 22 nt, Human
caggcuugauuauucagacaau

SEQ ID NO: 1131102 - RNA, 22 nt, Human
uguuucagucccuguguucaau

SEQ ID NO: 1131103 - RNA, 22 nt, Human
caggcugucugaauggaggccc

SEQ ID NO: 1131104 - RNA, 22 nt, Human
gcuguauuuauuuucuaggguu

SEQ ID NO: 1131105 - RNA, 22 nt, Human
gaggcagcaaaauauaucauaa

SEQ ID NO: 1131106 - RNA, 22 nt, Human
ugaacccaggagguugcaguga

SEQ ID NO: 1131107 - RNA, 22 nt, Human
ggcagauggagaagcagcaggu

SEQ ID NO: 1131108 - RNA, 22 nt, Human
cuccagggagcuguggagguuu

SEQ ID NO: 1131109 - RNA, 22 nt, Human
uguuaacaucuuggacucguga

SEQ ID NO: 1131110 - RNA, 22 nt, Human
gcacagaaguaaaauacaaguc

SEQ ID NO: 1131111 - RNA, 22 nt, Human
ggcugcagagcugggugggccu

SEQ ID NO: 1131112 - RNA, 20 nt, Human
uuuuuccuucucuacaggca

SEQ ID NO: 1131113 - RNA, 18 nt, Human
aguccaugcauggcuaua

SEQ ID NO: 1131114 - RNA, 22 nt, Human
uggcucaggaucuaagcagaau

SEQ ID NO: 1131115 - RNA, 22 nt, Human
uuuccucuccggggccuccagg

SEQ ID NO: 1131116 - RNA, 22 nt, Human
ugggcugccagcucuccagaug

SEQ ID NO: 1131117 - RNA, 22 nt, Human
uccugcagaccucagucagguc

SEQ ID NO: 1131118 - RNA, 22 nt, Human
ugaugcugcugggaguggugcu

SEQ ID NO: 1131119 - RNA, 22 nt, Human
ucuucacaccgggcagcaggaa

SEQ ID NO: 1131120 - RNA, 22 nt, Human
auguguguguuuaauccucaaa

SEQ ID NO: 1131121 - RNA, 21 nt, Human
cagagcagcguucugcugugg

SEQ ID NO: 1131122 - RNA, 22 nt, Human
ugaacagauggcccagcagagg

SEQ ID NO: 1131123 - RNA, 20 nt, Human
gacaucauguacacauugcc

SEQ ID NO: 1131124 - RNA, 22 nt, Human
acacagggcggaaagcaugaga

SEQ ID NO: 1131125 - RNA, 22 nt, Human
agggagcucaguuggaagcggu

SEQ ID NO: 1131126 - RNA, 22 nt, Human
gcagguguggaguggggugagc

SEQ ID NO: 1131127 - RNA, 22 nt, Human
gcuggccucuggagaagggcuu

SEQ ID NO: 1131128 - RNA, 22 nt, Human
cugggcuggcgcauccgacacg

SEQ ID NO: 1131129 - RNA, 22 nt, Human
cugggcagugcagcuauagaac

SEQ ID NO: 1131130 - RNA, 22 nt, Human
cacugggcguguccugggugag

SEQ ID NO: 1131131 - RNA, 22 nt, Human
cagcucaaguuucccaggucag

SEQ ID NO: 1131132 - RNA, 22 nt, Human
aagucacacuagacaacugagg

SEQ ID NO: 1131133 - RNA, 19 nt, Human
ggcuccuguggcugcagcc

SEQ ID NO: 1131134 - RNA, 22 nt, Human
gcugcucugaaaaugacuguug

SEQ ID NO: 1131135 - RNA, 22 nt, Human
ggauaagaaaauuguaauaacu

SEQ ID NO: 1131136 - RNA, 22 nt, Human
aguguugucaaacggcucagca

SEQ ID NO: 1131137 - RNA, 22 nt, Human
ucaggggcuugaggugcauguc

SEQ ID NO: 1131138 - RNA, 22 nt, Human
caggagacaaguuagcagcuga

SEQ ID NO: 1131139 - RNA, 22 nt, Human
agaaaucagaacccugaaguuc

SEQ ID NO: 1131140 - RNA, 22 nt, Human
ucucccaggcugcccuguggac

SEQ ID NO: 1131141 - RNA, 22 nt, Human
ccagcauggcaccugagaugag

SEQ ID NO: 1131142 - RNA, 22 nt, Human
uccaggcuagguuuacaggaca

SEQ ID NO: 1131143 - RNA, 22 nt, Human
uuagauaauguagagauaugag

SEQ ID NO: 1131144 - RNA, 22 nt, Human
cuggcuccuccaaggccuggag

SEQ ID NO: 1131145 - RNA, 22 nt, Human
gaugggggccagggccugcuuu

SEQ ID NO: 1131146 - RNA, 20 nt, Human
auaaaauaacugccacaaga

SEQ ID NO: 1131147 - RNA, 22 nt, Human
ggcagagguagcuggaaccagg

SEQ ID NO: 1131148 - RNA, 22 nt, Human
uauuucuuguuauucucguuga

SEQ ID NO: 1131149 - RNA, 22 nt, Human
cuggcucauuuuagcaucaggu

SEQ ID NO: 1131150 - RNA, 22 nt, Human
ccuggcaguuuugcccaggauu

SEQ ID NO: 1131151 - RNA, 21 nt, Human
caugaagccgguucccuguuu

SEQ ID NO: 1131152 - RNA, 22 nt, Human
auuauguagcuaaaaauugugu

SEQ ID NO: 1131153 - RNA, 22 nt, Human
cuucaagauauuucuagaauca

SEQ ID NO: 1131154 - RNA, 22 nt, Human
ggcugagccuggagcaucuggu

SEQ ID NO: 1131155 - RNA, 22 nt, Human
ggugggcaggcgaggcccaggu

SEQ ID NO: 1131156 - RNA, 22 nt, Human
gagcagcuagauaaagcccuuc

SEQ ID NO: 1131157 - RNA, 22 nt, Human
uggggcugucccgguuuggcga

SEQ ID NO: 1131158 - RNA, 22 nt, Human
cccagcucaucaggagccgccc

SEQ ID NO: 1131159 - RNA, 22 nt, Human
uguguacuugaaagggcagguc

SEQ ID NO: 1131160 - RNA, 23 nt, Human
aaaugcagggucgcagguuacag

SEQ ID NO: 1131161 - RNA, 22 nt, Human
gaugugugcuuuucgcaguguc

SEQ ID NO: 1131162 - RNA, 22 nt, Human
uggcagugccccuugaccagug

SEQ ID NO: 1131163 - RNA, 22 nt, Human
ggcucaggccagaccacgacuc

SEQ ID NO: 1131164 - RNA, 22 nt, Human
augagcuguaagguggcuuccu

SEQ ID NO: 1131165 - RNA, 22 nt, Human
gcugcagcuguaggacacaauu

SEQ ID NO: 1131166 - RNA, 22 nt, Human
cugagaaggaagccuccacucu

SEQ ID NO: 1131167 - RNA, 22 nt, Human
cucccuggcuuuguccugaggc

SEQ ID NO: 1131168 - RNA, 22 nt, Human
agcagggcucuguggagggugg

SEQ ID NO: 1131169 - RNA, 22 nt, Human
ggcccugugguuuugcaaaguc

SEQ ID NO: 1131170 - RNA, 22 nt, Human
caggccaggcugcauuugcccc

SEQ ID NO: 1131171 - RNA, 22 nt, Human
aaaugcacagagccuuagagau

SEQ ID NO: 1131172 - RNA, 22 nt, Human
cagcagcaaaucuagaagagga

SEQ ID NO: 1131173 - RNA, 22 nt, Human
guccagggaaauagcgacaggg

SEQ ID NO: 1131174 - RNA, 23 nt, Human
uggcucagcuaguuuuccauuuc

SEQ ID NO: 1131175 - RNA, 22 nt, Human
ucaguuuuuaagaguuaugcga

SEQ ID NO: 1131176 - RNA, 22 nt, Human
uaugaagauauaucugaucucu

SEQ ID NO: 1131177 - RNA, 22 nt, Human
gccaggugcauggcugagucuc

SEQ ID NO: 1131178 - RNA, 22 nt, Human
gccagccuucuguggccugcaa

SEQ ID NO: 1131179 - RNA, 22 nt, Human
uauaagccucgaugguaagccu

SEQ ID NO: 1131180 - RNA, 22 nt, Human
cagaggccaccuguggccacug

SEQ ID NO: 1131181 - RNA, 22 nt, Human
gugcucuccuggcugcccugac

SEQ ID NO: 1131182 - RNA, 23 nt, Human
uggcucucucagugcugcagagg

SEQ ID NO: 1131183 - RNA, 22 nt, Human
uggccugggucacaccaggguc

SEQ ID NO: 1131184 - RNA, 22 nt, Human
agaagccaauucugugugaguc

SEQ ID NO: 1131185 - RNA, 22 nt, Human
gaaaugugcagaauguguuaga

SEQ ID NO: 1131186 - RNA, 22 nt, Human
ccugucuguaucgguucagagu

SEQ ID NO: 1131187 - RNA, 22 nt, Human
accugccuauggagccacaugg

SEQ ID NO: 1131188 - RNA, 22 nt, Human
ucaaacuguuuacagugagaua

SEQ ID NO: 1131189 - RNA, 22 nt, Human
uggcucuggcgugaagcccaga

SEQ ID NO: 1131190 - RNA, 22 nt, Human
aaaucaguuagugguaggauug

SEQ ID NO: 1131191 - RNA, 22 nt, Human
cccaggagguggagcuugcagu

SEQ ID NO: 1131192 - RNA, 20 nt, Human
auguagaugaaagcaaaggc

SEQ ID NO: 1131193 - RNA, 20 nt, Human
ugggagcuggugaggucuca

SEQ ID NO: 1131194 - RNA, 22 nt, Human
augggcagcagcugccauucau

SEQ ID NO: 1131195 - RNA, 22 nt, Human
cucaggcccacagcagacccac

SEQ ID NO: 1131196 - RNA, 22 nt, Human
agcuggagaucaugcugauacu

SEQ ID NO: 1131197 - RNA, 22 nt, Human
ccagugggugcugggcucugcc

SEQ ID NO: 1131198 - RNA, 22 nt, Human
guggaggagaggcgccuugcgg

SEQ ID NO: 1131199 - RNA, 22 nt, Human
ucugcuguaaagaauuucugcc

SEQ ID NO: 1131200 - RNA, 22 nt, Human
ucagccagguaauguggagaug

SEQ ID NO: 1131201 - RNA, 22 nt, Human
cuuaacagauacaucugugguu

SEQ ID NO: 1131202 - RNA, 21 nt, Human
ggugggcacaggagagcagag

SEQ ID NO: 1131203 - RNA, 22 nt, Human
uauuauguagaguaaggguuaa

SEQ ID NO: 1131204 - RNA, 17 nt, Human
cccagagaugcugccuu

SEQ ID NO: 1131205 - RNA, 17 nt, Human
uguggccuucugagcuu

SEQ ID NO: 1131206 - RNA, 22 nt, Human
ucucccacuggccuuguaugau

SEQ ID NO: 1131207 - RNA, 22 nt, Human
ggcagagcuugcagugagccga

SEQ ID NO: 1131208 - RNA, 22 nt, Human
ccuggcuccugccucugcaggg

SEQ ID NO: 1131209 - RNA, 22 nt, Human
uuucauuacguguuugacuugu

SEQ ID NO: 1131210 - RNA, 18 nt, Human
ugggauggagaguaacug

SEQ ID NO: 1131211 - RNA, 22 nt, Human
ucuccuuuaagauuuccucagg

SEQ ID NO: 1131212 - RNA, 21 nt, Human
aucagcaaaugccugucuccc

SEQ ID NO: 1131213 - RNA, 22 nt, Human
cucagaguggggcucccugagg

SEQ ID NO: 1131214 - RNA, 22 nt, Human
ugguccaggguguaguacagag

SEQ ID NO: 1131215 - RNA, 20 nt, Human
gcugaccccugcugucaugc

SEQ ID NO: 1131216 - RNA, 22 nt, Human
cauguguugucucauuuaaucc

SEQ ID NO: 1131217 - RNA, 22 nt, Human
agcagcaggagccgugggguga

SEQ ID NO: 1131218 - RNA, 20 nt, Human
uuucagugguuugugccuag

SEQ ID NO: 1131219 - RNA, 22 nt, Human
acacaggggcucggcugggugc

SEQ ID NO: 1131220 - RNA, 22 nt, Human
ccucugagaccagcucugcacc

SEQ ID NO: 1131221 - RNA, 21 nt, Human
uggcagaguugaguaguuaug

SEQ ID NO: 1131222 - RNA, 22 nt, Human
uggagcagcuaagccucugaga

SEQ ID NO: 1131223 - RNA, 22 nt, Human
uucaaucauuuuuacauagucc

SEQ ID NO: 1131224 - RNA, 22 nt, Human
ggccuucacgugaccuggcgug

SEQ ID NO: 1131225 - RNA, 22 nt, Human
cccuggcagaaugucucugggc

SEQ ID NO: 1131226 - RNA, 22 nt, Human
cacagccugcugcacucaagaa

SEQ ID NO: 1131227 - RNA, 22 nt, Human
aagugacaaaaggguauccaaa

SEQ ID NO: 1131228 - RNA, 22 nt, Human
aagaacauuuuguagaaugaca

SEQ ID NO: 1131229 - RNA, 21 nt, Human
agcucagccgggcacaguggc

SEQ ID NO: 1131230 - RNA, 22 nt, Human
acagaaagaagguguauuugag

SEQ ID NO: 1131231 - RNA, 22 nt, Human
ucccagagucagagguggggcc

SEQ ID NO: 1131232 - RNA, 22 nt, Human
cagagggcucaguccugcugga

SEQ ID NO: 1131233 - RNA, 22 nt, Human
ggagccugacagugcccagcau

SEQ ID NO: 1131234 - RNA, 22 nt, Human
aacagaauugcugcugccaaug

SEQ ID NO: 1131235 - RNA, 22 nt, Human
cugggcugcgggcgccccucca

SEQ ID NO: 1131236 - RNA, 22 nt, Human
uaaguccaccucauucuucagc

SEQ ID NO: 1131237 - RNA, 22 nt, Human
uagacacauccguggaagcuuc

SEQ ID NO: 1131238 - RNA, 22 nt, Human
agagccacugggagacagagca

SEQ ID NO: 1131239 - RNA, 18 nt, Human
uugagggaggggcagagu

SEQ ID NO: 1131240 - RNA, 21 nt, Human
augacagaugcugcagaucgu

SEQ ID NO: 1131241 - RNA, 22 nt, Human
cuccucacuuuccagacugggc

SEQ ID NO: 1131242 - RNA, 22 nt, Human
acaaaugccauauauaaauucu

SEQ ID NO: 1131243 - RNA, 21 nt, Human
gcaugccugcaucuuaguguu

SEQ ID NO: 1131244 - RNA, 18 nt, Human
auccuugaugagaggucu

SEQ ID NO: 1131245 - RNA, 22 nt, Human
gcagggcucauucuaguacaau

SEQ ID NO: 1131246 - RNA, 22 nt, Human
cuggcagguccagcuggacuca

SEQ ID NO: 1131247 - RNA, 22 nt, Human
auuguaucuugucauuaugcau

SEQ ID NO: 1131248 - RNA, 22 nt, Human
gggcagaggcucuggcccaucc

SEQ ID NO: 1131249 - RNA, 22 nt, Human
gauacauuuuaucuccuaacag

SEQ ID NO: 1131250 - RNA, 22 nt, Human
ucacagacaauuguuuuggugu

SEQ ID NO: 1131251 - RNA, 20 nt, Human
ucagggcaugggacagcccc

SEQ ID NO: 1131252 - RNA, 22 nt, Human
ucacuuauugcucaucucaugc

SEQ ID NO: 1131253 - RNA, 22 nt, Human
caggccuggggcuggcuuccag

SEQ ID NO: 1131254 - RNA, 22 nt, Human
ucagccagugccuugaucuugc

SEQ ID NO: 1131255 - RNA, 22 nt, Human
ccugccagauccccugagcuga

SEQ ID NO: 1131256 - RNA, 22 nt, Human
aagaguuuucuauaaucuuggc

SEQ ID NO: 1131257 - RNA, 22 nt, Human
gacagccaugcacuucugcugu

SEQ ID NO: 1131258 - RNA, 22 nt, Human
gcacugcaucuacuggcaagua

SEQ ID NO: 1131259 - RNA, 22 nt, Human
ggagugacucacagcugggaca

SEQ ID NO: 1131260 - RNA, 22 nt, Human
aagcaauauacugauaugauua

SEQ ID NO: 1131261 - RNA, 22 nt, Human
ugagagagccugaaucucuuac

SEQ ID NO: 1131262 - RNA, 19 nt, Human
cgcaggagccgaggugacc

SEQ ID NO: 1131263 - RNA, 22 nt, Human
gagcagcuggacaggccucccu

SEQ ID NO: 1131264 - RNA, 19 nt, Human
uggcugggcgugccuccgu

SEQ ID NO: 1131265 - RNA, 22 nt, Human
ugcaccauguaaguggccacgu

SEQ ID NO: 1131266 - RNA, 22 nt, Human
ucagggcagccuaaggcaccuc

SEQ ID NO: 1131267 - RNA, 18 nt, Human
ugagagugugugcucuug

SEQ ID NO: 1131268 - RNA, 22 nt, Human
uggccucugcaauggauucacc

SEQ ID NO: 1131269 - RNA, 22 nt, Human
agggcugcugaggaagccuugc

SEQ ID NO: 1131270 - RNA, 21 nt, Human
acagccugucaucucaugguc

SEQ ID NO: 1131271 - RNA, 21 nt, Human
uggcucuguucaauauaugga

SEQ ID NO: 1131272 - RNA, 22 nt, Human
agagggaucacccuguuucugg

SEQ ID NO: 1131273 - RNA, 22 nt, Human
cgcagaagagguugucuagucc

SEQ ID NO: 1131274 - RNA, 22 nt, Human
gccugugacucgucuugggcca

SEQ ID NO: 1131275 - RNA, 22 nt, Human
uugaagcauuguggcuuguauu

SEQ ID NO: 1131276 - RNA, 22 nt, Human
cagacagcugcuuucuugcugu

SEQ ID NO: 1131277 - RNA, 22 nt, Human
gauggcagucaaccaggugagg

SEQ ID NO: 1131278 - RNA, 22 nt, Human
aacacaaagaagcugcaggauc

SEQ ID NO: 1131279 - RNA, 22 nt, Human
agcuggaggauaacucacuucu

SEQ ID NO: 1131280 - RNA, 22 nt, Human
cuggcaggagcauucacagagg

SEQ ID NO: 1131281 - RNA, 23 nt, Human
ccucccaccuauuucacuuucuu

SEQ ID NO: 1131282 - RNA, 22 nt, Human
ccuccaggauaagucagggccu

SEQ ID NO: 1131283 - RNA, 21 nt, Human
agcugcuuucagcuccuagag

SEQ ID NO: 1131284 - RNA, 22 nt, Human
ucagcugaguucuagagcacuc

SEQ ID NO: 1131285 - RNA, 22 nt, Human
uggagccaaggccaguucucag

SEQ ID NO: 1131286 - RNA, 22 nt, Human
agucucugcaugccugcugugc

SEQ ID NO: 1131287 - RNA, 22 nt, Human
gagccagcgccuugccucuggg

SEQ ID NO: 1131288 - RNA, 22 nt, Human
ccacacagucaguuuccaagaa

SEQ ID NO: 1131289 - RNA, 22 nt, Human
aaugaugggaaggagaaaagca

SEQ ID NO: 1131290 - RNA, 22 nt, Human
gggcugcuuccuggggaaugcu

SEQ ID NO: 1131291 - RNA, 21 nt, Human
agguggggcugcaccucugcu

SEQ ID NO: 1131292 - RNA, 22 nt, Human
ucucauguauugcccuggugug

SEQ ID NO: 1131293 - RNA, 22 nt, Human
agugacugggcagggcagggcc

SEQ ID NO: 1131294 - RNA, 22 nt, Human
ggaguucacugugcaggcucug

SEQ ID NO: 1131295 - RNA, 22 nt, Human
gccuuccuuuuaccaccagcca

SEQ ID NO: 1131296 - RNA, 22 nt, Human
ugagagugguucagcucagaag

SEQ ID NO: 1131297 - RNA, 22 nt, Human
auccuugagccuuaucuuuugu

SEQ ID NO: 1131298 - RNA, 22 nt, Human
agugguaacuaaguccugcuua

SEQ ID NO: 1131299 - RNA, 22 nt, Human
cuggccaggcuugggacagaca

SEQ ID NO: 1131300 - RNA, 22 nt, Human
uggaggugagugugguacagca

SEQ ID NO: 1131301 - RNA, 22 nt, Human
agugagggaugaagaacugcgg

SEQ ID NO: 1131302 - RNA, 22 nt, Human
ccugugucagccccugccucca

SEQ ID NO: 1131303 - RNA, 22 nt, Human
ggagcugcuuugaucugaagaa

SEQ ID NO: 1131304 - RNA, 22 nt, Human
ccacagggcacaagggagguug

SEQ ID NO: 1131305 - RNA, 22 nt, Human
uggugcugacaguucugagugc

SEQ ID NO: 1131306 - RNA, 22 nt, Human
ugcaggcaggggaugagcagcc

SEQ ID NO: 1131307 - RNA, 22 nt, Human
cucugagaggugagaagcagca

SEQ ID NO: 1131308 - RNA, 22 nt, Human
cauuucuguucucuuccuguac

SEQ ID NO: 1131309 - RNA, 23 nt, Human
ggacagggcccugcccuauggcc

SEQ ID NO: 1131310 - RNA, 22 nt, Human
ggaagggcaaaagagaugaacu

SEQ ID NO: 1131311 - RNA, 22 nt, Human
cugccuggucucaggcaugggg

SEQ ID NO: 1131312 - RNA, 22 nt, Human
auguguguaugugccuauaucu

SEQ ID NO: 1131313 - RNA, 22 nt, Human
ccugcagguccccggaugcgca

SEQ ID NO: 1131314 - RNA, 22 nt, Human
cacugcagcaccaugcagggcu

SEQ ID NO: 1131315 - RNA, 22 nt, Human
ggcaguggguggaucucaggga

SEQ ID NO: 1131316 - RNA, 22 nt, Human
uggucaggcugcucugcggcgu

SEQ ID NO: 1131317 - RNA, 22 nt, Human
ucuggccuacuggaguccauga

SEQ ID NO: 1131318 - RNA, 18 nt, Human
ccuggagcuccacagcaa

SEQ ID NO: 1131319 - RNA, 22 nt, Human
cagagcagguaucuuuggugaa

SEQ ID NO: 1131320 - RNA, 22 nt, Human
ucgugucagaucagagguuccu

SEQ ID NO: 1131321 - RNA, 22 nt, Human
gccaggcugcuggcugcugucc

SEQ ID NO: 1131322 - RNA, 22 nt, Human
gccucugcacuguggcacacca

SEQ ID NO: 1131323 - RNA, 22 nt, Human
gcugccugccuugccuggagga

SEQ ID NO: 1131324 - RNA, 22 nt, Human
ucugagcuuuuauuaucaaccu

SEQ ID NO: 1131325 - RNA, 22 nt, Human
aaguuacaggagaaagagauca

SEQ ID NO: 1131326 - RNA, 22 nt, Human
gcugucucggggcuuucuccug

SEQ ID NO: 1131327 - RNA, 22 nt, Human
aaucacaauuacuuuugcacca

SEQ ID NO: 1131328 - RNA, 22 nt, Human
ccagcuggcaggagagucaggg

SEQ ID NO: 1131329 - RNA, 22 nt, Human
aaggcacuugcccagagcugca

SEQ ID NO: 1131330 - RNA, 22 nt, Human
cuugaaagcuuugcgucuucua

SEQ ID NO: 1131331 - RNA, 22 nt, Human
cccaggaguuugaguucagcau

SEQ ID NO: 1131332 - RNA, 20 nt, Human
aaaguguaagcauauaauua

SEQ ID NO: 1131333 - RNA, 22 nt, Human
uguuacuuaucucacgugaugc

SEQ ID NO: 1131334 - RNA, 22 nt, Human
uccugggaagagaccugagcau

SEQ ID NO: 1131335 - RNA, 22 nt, Human
cacugaaucucaaggggagggu

SEQ ID NO: 1131336 - RNA, 22 nt, Human
ugucccagcagcuggguucucu

SEQ ID NO: 1131337 - RNA, 21 nt, Human
uguucacauggagcagaaugu

SEQ ID NO: 1131338 - RNA, 22 nt, Human
gagcacagccaaaguaagaagg

SEQ ID NO: 1131339 - RNA, 22 nt, Human
ugggugaggaugaugaggcagc

SEQ ID NO: 1131340 - RNA, 22 nt, Human
cugccuggagcauucugaaggu

SEQ ID NO: 1131341 - RNA, 22 nt, Human
ucaguuuucauuucaugagcag

SEQ ID NO: 1131342 - RNA, 22 nt, Human
gagccugagugcugccuccccu

SEQ ID NO: 1131343 - RNA, 20 nt, Human
cccugcagccaugggagugg

SEQ ID NO: 1131344 - RNA, 22 nt, Human
acaggcagcacuaaucucuggu

SEQ ID NO: 1131345 - RNA, 22 nt, Human
ggcuucucucccccagcuccac

SEQ ID NO: 1131346 - RNA, 22 nt, Human
ggcacugaucugauuucccucc

SEQ ID NO: 1131347 - RNA, 22 nt, Human
ucacuguauuugcugaugcaua

SEQ ID NO: 1131348 - RNA, 22 nt, Human
auugaaagauauacuguucuca

SEQ ID NO: 1131349 - RNA, 22 nt, Human
ucacauuuuaucuauuuuaagu

SEQ ID NO: 1131350 - RNA, 22 nt, Human
agcauuuaggagaauuugagaa

SEQ ID NO: 1131351 - RNA, 22 nt, Human
agggagccagaguugggagcuc

SEQ ID NO: 1131352 - RNA, 22 nt, Human
cagaagaauggugucugagcuc

SEQ ID NO: 1131353 - RNA, 22 nt, Human
ggggaugguggcauuuguaaaa

SEQ ID NO: 1131354 - RNA, 22 nt, Human
gggcagccucggugccugcugc

SEQ ID NO: 1131355 - RNA, 19 nt, Human
cuggugcuugagugaguca

SEQ ID NO: 1131356 - RNA, 22 nt, Human
cuuuauguucaguacaaugcuu

SEQ ID NO: 1131357 - RNA, 22 nt, Human
aguaacaagugccaacguuaga

SEQ ID NO: 1131358 - RNA, 22 nt, Human
gaggccuggcugggaggaggug

SEQ ID NO: 1131359 - RNA, 22 nt, Human
uucauucccuuauauuagcauu

SEQ ID NO: 1131360 - RNA, 23 nt, Human
ugagcccaggaggucaaggcugc

SEQ ID NO: 1131361 - RNA, 22 nt, Human
aggcucugcagugcuggaggac

SEQ ID NO: 1131362 - RNA, 22 nt, Human
ugcccaggguggagugcagcgg

SEQ ID NO: 1131363 - RNA, 22 nt, Human
ugcuggccaacaaggcuccaag

SEQ ID NO: 1131364 - RNA, 22 nt, Human
gcucugagaggugcagcaguaa

SEQ ID NO: 1131365 - RNA, 22 nt, Human
gcugccugaagugucuacacug

SEQ ID NO: 1131366 - RNA, 22 nt, Human
ugauuucauaguauauacauga

SEQ ID NO: 1131367 - RNA, 22 nt, Human
auugacaauguauuuguaucug

SEQ ID NO: 1131368 - RNA, 22 nt, Human
ugaagcaguuacuggguguuaa

SEQ ID NO: 1131369 - RNA, 22 nt, Human
aaagauuucagaagccugugcc

SEQ ID NO: 1131370 - RNA, 21 nt, Human
gcacagugccaggcacacagu

SEQ ID NO: 1131371 - RNA, 21 nt, Human
ucccagagugcuugggacugc

SEQ ID NO: 1131372 - RNA, 22 nt, Human
agcaggagcccuuaucaccagg

SEQ ID NO: 1131373 - RNA, 21 nt, Human
ggccuuggcgggggccgaauu

SEQ ID NO: 1131374 - RNA, 22 nt, Human
gagcagcugcagugcagacccu

SEQ ID NO: 1131375 - RNA, 22 nt, Human
uucccaguauuaccuucaggaa

SEQ ID NO: 1131376 - RNA, 22 nt, Human
agaggcuguuacacucccagau

SEQ ID NO: 1131377 - RNA, 22 nt, Human
cagagcuguuacuauucaugaa

SEQ ID NO: 1131378 - RNA, 22 nt, Human
uccuggaggcaaaugaagacuc

SEQ ID NO: 1131379 - RNA, 20 nt, Human
cagagcuguuauggaugaug

SEQ ID NO: 1131380 - RNA, 22 nt, Human
cagccagcuucagauccaagcc

SEQ ID NO: 1131381 - RNA, 22 nt, Human
cauagcaacagcaucaagucaa

SEQ ID NO: 1131382 - RNA, 22 nt, Human
augaagauaagaccaggcugga

SEQ ID NO: 1131383 - RNA, 22 nt, Human
gaugcacuuucuuuucaacagu

SEQ ID NO: 1131384 - RNA, 22 nt, Human
gugcuuuccauccucccugcug

SEQ ID NO: 1131385 - RNA, 22 nt, Human
ucccagaggacuguuggugcua

SEQ ID NO: 1131386 - RNA, 22 nt, Human
gucucccacuuucuggccucuu

SEQ ID NO: 1131387 - RNA, 22 nt, Human
cauuuacauuuaagguuaauau

SEQ ID NO: 1131388 - RNA, 22 nt, Human
gcugcccaggguggagccggcu

SEQ ID NO: 1131389 - RNA, 21 nt, Human
cagaggcugagagggcaaucu

SEQ ID NO: 1131390 - RNA, 22 nt, Human
ugccucugaggaagauuguguu

SEQ ID NO: 1131391 - RNA, 22 nt, Human
gcugaaggaggcucugguacua

SEQ ID NO: 1131392 - RNA, 22 nt, Human
uguacuuccccaaugacagcac

SEQ ID NO: 1131393 - RNA, 22 nt, Human
ucuguaguagguuguaguucuu

SEQ ID NO: 1131394 - RNA, 22 nt, Human
cuggccugcugggugagguccu

SEQ ID NO: 1131395 - RNA, 22 nt, Human
cuggcccagucucagaguguca

SEQ ID NO: 1131396 - RNA, 22 nt, Human
ugagugccugaacauagaguag

SEQ ID NO: 1131397 - RNA, 22 nt, Human
ugagccugggagauggaggcug

SEQ ID NO: 1131398 - RNA, 22 nt, Human
cccagcucuuuuagcggcaucu

SEQ ID NO: 1131399 - RNA, 22 nt, Human
accuuucacgguaucagacauc

SEQ ID NO: 1131400 - RNA, 22 nt, Human
ccaggaggcagaaguugcagug

SEQ ID NO: 1131401 - RNA, 22 nt, Human
ccagucccaucucugucgcuua

SEQ ID NO: 1131402 - RNA, 22 nt, Human
cagaagcauuccagcaaauagu

SEQ ID NO: 1131403 - RNA, 22 nt, Human
aauguuuucugacugcuaacuu

SEQ ID NO: 1131404 - RNA, 21 nt, Human
ugagccaggcugacggcugug

SEQ ID NO: 1131405 - RNA, 22 nt, Human
cugcagcuuuggaaaccuguuu

SEQ ID NO: 1131406 - RNA, 21 nt, Human
uuucugucucugccacuaguu

SEQ ID NO: 1131407 - RNA, 22 nt, Human
cucucccccacagcagccuucu

SEQ ID NO: 1131408 - RNA, 22 nt, Human
ugacagcauaacacuggucuug

SEQ ID NO: 1131409 - RNA, 22 nt, Human
ccuguguggccaggcuggaguc

SEQ ID NO: 1131410 - RNA, 22 nt, Human
aguuaaagucugaaauagagaa

SEQ ID NO: 1131411 - RNA, 19 nt, Human
agguggucuaggcuggaga

SEQ ID NO: 1131412 - RNA, 22 nt, Human
accccaagacaguagaagagaa

SEQ ID NO: 1131413 - RNA, 22 nt, Human
aaaucugggucaagguggagug

SEQ ID NO: 1131414 - RNA, 22 nt, Human
gggaaggagguggcuugaagug

SEQ ID NO: 1131415 - RNA, 22 nt, Human
cccccagccagcagugcucagc

SEQ ID NO: 1131416 - RNA, 22 nt, Human
auuauaaagaacaugugugugg

SEQ ID NO: 1131417 - RNA, 22 nt, Human
cuacauggagaagaaaauucuu

SEQ ID NO: 1131418 - RNA, 22 nt, Human
aggagaguaccauugggccgca

SEQ ID NO: 1131419 - RNA, 22 nt, Human
gagaggcugacuggcuguccug

SEQ ID NO: 1131420 - RNA, 22 nt, Human
ggcugccauaacugauaccaua

SEQ ID NO: 1131421 - RNA, 22 nt, Human
ccagcccuugcugaaggguggc

SEQ ID NO: 1131422 - RNA, 22 nt, Human
gcuggcauuacaggagagaacc

SEQ ID NO: 1131423 - RNA, 22 nt, Human
cucccugggcagauguggcucu

SEQ ID NO: 1131424 - RNA, 22 nt, Human
acagaccaaaaaaggauauugg

SEQ ID NO: 1131425 - RNA, 22 nt, Human
uuccuauuuccaugaaacacaa

SEQ ID NO: 1131426 - RNA, 22 nt, Human
acugcuuacaaaaggaaagaau

SEQ ID NO: 1131427 - RNA, 22 nt, Human
uggccuggugucugcgaggccu

SEQ ID NO: 1131428 - RNA, 22 nt, Human
cauucauuuacuuucaacagcu

SEQ ID NO: 1131429 - RNA, 22 nt, Human
caagggugguauugggagcaua

SEQ ID NO: 1131430 - RNA, 22 nt, Human
aggauccuguauggagaagcug

SEQ ID NO: 1131431 - RNA, 22 nt, Human
gcccucugcacagcucugagca

SEQ ID NO: 1131432 - RNA, 17 nt, Human
gccaaaggguuccaauc

SEQ ID NO: 1131433 - RNA, 22 nt, Human
ugggcacuggaagccugcugug

SEQ ID NO: 1131434 - RNA, 22 nt, Human
cuggcagcuucaggacacucgg

SEQ ID NO: 1131435 - RNA, 22 nt, Human
augguuuguaacccaauacucc

SEQ ID NO: 1131436 - RNA, 22 nt, Human
ucuuaaaaguaugccaauugga

SEQ ID NO: 1131437 - RNA, 22 nt, Human
ucagugucuugaccugggugug

SEQ ID NO: 1131438 - RNA, 22 nt, Human
aggugagugugacugcaagaga

SEQ ID NO: 1131439 - RNA, 23 nt, Human
cucucucuaccaugugaggacac

SEQ ID NO: 1131440 - RNA, 22 nt, Human
guggauggauuuugaggaaugg

SEQ ID NO: 1131441 - RNA, 22 nt, Human
aaaguuucaauagaggaagugg

SEQ ID NO: 1131442 - RNA, 22 nt, Human
agggccuggcgcguggccgccg

SEQ ID NO: 1131443 - RNA, 22 nt, Human
uccaagaagucaucuaaacugu

SEQ ID NO: 1131444 - RNA, 18 nt, Human
aggccagcccugcuacug

SEQ ID NO: 1131445 - RNA, 22 nt, Human
acugugugggccgcucacuggg

SEQ ID NO: 1131446 - RNA, 22 nt, Human
ucuccuuugaaaguuaggacug

SEQ ID NO: 1131447 - RNA, 22 nt, Human
aaaaaugaauucuucaguggca

SEQ ID NO: 1131448 - RNA, 22 nt, Human
ucuugccucuuccccuuuccau

SEQ ID NO: 1131449 - RNA, 22 nt, Human
uaacagaagagcaggcagcccu

SEQ ID NO: 1131450 - RNA, 22 nt, Human
ccagggccaguaagauuggcau

SEQ ID NO: 1131451 - RNA, 22 nt, Human
cuuccuggccauugccauggca

SEQ ID NO: 1131452 - RNA, 22 nt, Human
gcuuccugucccucagccauga

SEQ ID NO: 1131453 - RNA, 22 nt, Human
augcaguagauaggcacuuuua

SEQ ID NO: 1131454 - RNA, 23 nt, Human
ugauuuccagugagucaguggga

SEQ ID NO: 1131455 - RNA, 22 nt, Human
aggaggcccuagagcucuagag

SEQ ID NO: 1131456 - RNA, 22 nt, Human
aagggcagaaagggacgcuuug

SEQ ID NO: 1131457 - RNA, 22 nt, Human
uuagauauguuuuugcuaaugc

SEQ ID NO: 1131458 - RNA, 22 nt, Human
agucaguggcuccgagccuggu

SEQ ID NO: 1131459 - RNA, 22 nt, Human
gccuggagcccaguguggggcu

SEQ ID NO: 1131460 - RNA, 20 nt, Human
gagagcuggggaugaggcug

SEQ ID NO: 1131461 - RNA, 19 nt, Human
aguagcagaaagugcagug

SEQ ID NO: 1131462 - RNA, 22 nt, Human
cagagcuggagggaacccuggc

SEQ ID NO: 1131463 - RNA, 22 nt, Human
gccucugcggagcuguacauca

SEQ ID NO: 1131464 - RNA, 22 nt, Human
gcaggcucuucuuucugcccag

SEQ ID NO: 1131465 - RNA, 22 nt, Human
aagcaucucuauguggagagug

SEQ ID NO: 1131466 - RNA, 22 nt, Human
aaaauacacauacuaggggaaa

SEQ ID NO: 1131467 - RNA, 21 nt, Human
uagaaaucagcuggugccucu

SEQ ID NO: 1131468 - RNA, 22 nt, Human
agucccaguucgguucuuccuc

SEQ ID NO: 1131469 - RNA, 22 nt, Human
aaguccaugaucaagauguggc

SEQ ID NO: 1131470 - RNA, 22 nt, Human
ugagccugcugucgcuggaccc

SEQ ID NO: 1131471 - RNA, 22 nt, Human
gcccucuggcagccuuggcugg

SEQ ID NO: 1131472 - RNA, 19 nt, Human
uuugaauauaaugcagcua

SEQ ID NO: 1131473 - RNA, 22 nt, Human
uucaagauggcaccagugagug

SEQ ID NO: 1131474 - RNA, 22 nt, Human
uaggccagcccuuaguccuguc

SEQ ID NO: 1131475 - RNA, 22 nt, Human
uggaaagacauucagccgcugg

SEQ ID NO: 1131476 - RNA, 22 nt, Human
cauuuacuguugaaucccuagc

SEQ ID NO: 1131477 - RNA, 22 nt, Human
uauucacaggcuggagugaugu

SEQ ID NO: 1131478 - RNA, 18 nt, Human
aagcugcccucaggcagg

SEQ ID NO: 1131479 - RNA, 22 nt, Human
ucucugucugagccuggcagac

SEQ ID NO: 1131480 - RNA, 22 nt, Human
accugccuaucagcugccugcu

SEQ ID NO: 1131481 - RNA, 22 nt, Human
gccugcuguuaacugcaggaau

SEQ ID NO: 1131482 - RNA, 22 nt, Human
ggucagguuuuuaggagugacc

SEQ ID NO: 1131483 - RNA, 22 nt, Human
gcugagggcauguguggcgacu

SEQ ID NO: 1131484 - RNA, 22 nt, Human
agagaagacuuacagccacagu

SEQ ID NO: 1131485 - RNA, 22 nt, Human
ccagcuccagguagaugggcag

SEQ ID NO: 1131486 - RNA, 22 nt, Human
guccauggcauuuccgucacau

SEQ ID NO: 1131487 - RNA, 22 nt, Human
cagcaggcagccauuucacugu

SEQ ID NO: 1131488 - RNA, 22 nt, Human
gggcagcagagcccugccgagu

SEQ ID NO: 1131489 - RNA, 22 nt, Human
augggcuguccuaguccagccc

SEQ ID NO: 1131490 - RNA, 22 nt, Human
gcagccccaggagacgcccagg

SEQ ID NO: 1131491 - RNA, 22 nt, Human
gcuguggccaacaaaccacuuu

SEQ ID NO: 1131492 - RNA, 22 nt, Human
gcaugcugcaccagagccucuc

SEQ ID NO: 1131493 - RNA, 22 nt, Human
cuguggagcuuguggcaguggg

SEQ ID NO: 1131494 - RNA, 22 nt, Human
cagcucccgccaucgggaggca

SEQ ID NO: 1131495 - RNA, 22 nt, Human
uuuuuccuagugcuuucuggua

SEQ ID NO: 1131496 - RNA, 22 nt, Human
aggucauuccuugucuucuugc

SEQ ID NO: 1131497 - RNA, 22 nt, Human
cucaggauuuacuaauuucaag

SEQ ID NO: 1131498 - RNA, 18 nt, Human
gcugucugaggucugagg

SEQ ID NO: 1131499 - RNA, 17 nt, Human
ggaaaaggaugauacag

SEQ ID NO: 1131500 - RNA, 22 nt, Human
ccuggccuuaagggcagggagc

SEQ ID NO: 1131501 - RNA, 23 nt, Human
aggcagagccaaggucaaaaccc

SEQ ID NO: 1131502 - RNA, 22 nt, Human
gugugugccaucaagagcuuuc

SEQ ID NO: 1131503 - RNA, 22 nt, Human
cugccucuugacagaucguggc

SEQ ID NO: 1131504 - RNA, 22 nt, Human
ugcaucuuacguuuugaaaggg

SEQ ID NO: 1131505 - RNA, 22 nt, Human
cccagccucagcuuuacuucca

SEQ ID NO: 1131506 - RNA, 22 nt, Human
gcuggcaggguucucacugaaa

SEQ ID NO: 1131507 - RNA, 22 nt, Human
cagggcaguaccgcccucuggc

SEQ ID NO: 1131508 - RNA, 22 nt, Human
gagggugguggcuuaaggugcu

SEQ ID NO: 1131509 - RNA, 22 nt, Human
cccagcuccaagggacagcgaa

SEQ ID NO: 1131510 - RNA, 22 nt, Human
uuccauaauuaaguggagagaa

SEQ ID NO: 1131511 - RNA, 22 nt, Human
uucaggaucauuuguuuuaucu

SEQ ID NO: 1131512 - RNA, 21 nt, Human
agaagccuggguggagguggg

SEQ ID NO: 1131513 - RNA, 22 nt, Human
ucccagauuguugauggcuuaa

SEQ ID NO: 1131514 - RNA, 22 nt, Human
ucagcuggagaugagaaccgaa

SEQ ID NO: 1131515 - RNA, 22 nt, Human
ugcucccaggcauucucuguug

SEQ ID NO: 1131516 - RNA, 22 nt, Human
ucugcagcuuuuugguggggug

SEQ ID NO: 1131517 - RNA, 22 nt, Human
ugagaaccaugaaaagcuguca

SEQ ID NO: 1131518 - RNA, 22 nt, Human
auggggcuguucucugcccugc

SEQ ID NO: 1131519 - RNA, 22 nt, Human
uaucuugagagacaacacagca

SEQ ID NO: 1131520 - RNA, 22 nt, Human
agccaggauuggcugagccuua

SEQ ID NO: 1131521 - RNA, 22 nt, Human
aggacccagaggcagaggacgu

SEQ ID NO: 1131522 - RNA, 22 nt, Human
auugaaagcacaaagaacaagu

SEQ ID NO: 1131523 - RNA, 22 nt, Human
cugggcaguuuauucaguucug

SEQ ID NO: 1131524 - RNA, 22 nt, Human
gucaggggccaugggccaagga

SEQ ID NO: 1131525 - RNA, 22 nt, Human
aaaugcauugguuucuacuugu

SEQ ID NO: 1131526 - RNA, 22 nt, Human
ggaggccuugaggccaggagcu

SEQ ID NO: 1131527 - RNA, 22 nt, Human
cugcagaggucuugcugauggu

SEQ ID NO: 1131528 - RNA, 22 nt, Human
cugaggugcuauggaggauacg

SEQ ID NO: 1131529 - RNA, 22 nt, Human
cuggcucauagagcagcuccaa

SEQ ID NO: 1131530 - RNA, 22 nt, Human
ggcugggccagggccuguggac

SEQ ID NO: 1131531 - RNA, 22 nt, Human
cugcugcucgaccagucccagg

SEQ ID NO: 1131532 - RNA, 22 nt, Human
cacaugggcguaauguccaugg

SEQ ID NO: 1131533 - RNA, 22 nt, Human
cagcaauaagguaagcuucucc

SEQ ID NO: 1131534 - RNA, 22 nt, Human
aagguacaccaaaguucaaguu

SEQ ID NO: 1131535 - RNA, 22 nt, Human
uggcucagugaagagauaacuu

SEQ ID NO: 1131536 - RNA, 22 nt, Human
uuugaacaugcugcaugauaau

SEQ ID NO: 1131537 - RNA, 22 nt, Human
gcaggguccauggaggcagccc

SEQ ID NO: 1131538 - RNA, 22 nt, Human
gagaaguuucugguuugcauag

SEQ ID NO: 1131539 - RNA, 22 nt, Human
guggccugccgugugguauggg

SEQ ID NO: 1131540 - RNA, 22 nt, Human
aauuugcaugaugagaacaaua

SEQ ID NO: 1131541 - RNA, 21 nt, Human
ucauuuuuauugcuaccuugc

SEQ ID NO: 1131542 - RNA, 22 nt, Human
auaugugugaugcauggacuaa

SEQ ID NO: 1131543 - RNA, 22 nt, Human
uggagccaggagccugggaguc

SEQ ID NO: 1131544 - RNA, 22 nt, Human
cuggcagcgcagcaugaagucg

SEQ ID NO: 1131545 - RNA, 22 nt, Human
gucuggaguggggccugagaau

SEQ ID NO: 1131546 - RNA, 22 nt, Human
cacauuuaauccuuuauaagua

SEQ ID NO: 1131547 - RNA, 20 nt, Human
agagccuggaaaaagacauc

SEQ ID NO: 1131548 - RNA, 22 nt, Human
auggaaagccaguguuccauca

SEQ ID NO: 1131549 - RNA, 22 nt, Human
cugcuccacaccuccauuuccu

SEQ ID NO: 1131550 - RNA, 22 nt, Human
ugagagucucagaccuccuggu

SEQ ID NO: 1131551 - RNA, 22 nt, Human
gcagguggauuaucagaagugc

SEQ ID NO: 1131552 - RNA, 23 nt, Human
uuucuguuggguauauauccaag

SEQ ID NO: 1131553 - RNA, 22 nt, Human
aguguacauguuuacagcaucu

SEQ ID NO: 1131554 - RNA, 22 nt, Human
caguuucucucaauaagcaucg

SEQ ID NO: 1131555 - RNA, 22 nt, Human
aagcccagaugugagaacugag

SEQ ID NO: 1131556 - RNA, 22 nt, Human
uccguauuugacuauugcaccg

SEQ ID NO: 1131557 - RNA, 22 nt, Human
ugucucagauacgccaucaagg

SEQ ID NO: 1131558 - RNA, 22 nt, Human
cccuggagggauuucucaauca

SEQ ID NO: 1131559 - RNA, 22 nt, Human
cuggcucauccagguguugcuc

SEQ ID NO: 1131560 - RNA, 21 nt, Human
agcugccacccuagcuucuga

SEQ ID NO: 1131561 - RNA, 22 nt, Human
uucagcagucguccaggaaaag

SEQ ID NO: 1131562 - RNA, 22 nt, Human
cagccugcuagggcaaugccuu

SEQ ID NO: 1131563 - RNA, 22 nt, Human
agccagggagguggagguugca

SEQ ID NO: 1131564 - RNA, 22 nt, Human
aaaugcaggaaauuaugcuuuu

SEQ ID NO: 1131565 - RNA, 22 nt, Human
ccuggccugcucggcucuuaag

SEQ ID NO: 1131566 - RNA, 22 nt, Human
ggcucagaaacuaaaggcgcug

SEQ ID NO: 1131567 - RNA, 22 nt, Human
ucuggcucuguguccccaccca

SEQ ID NO: 1131568 - RNA, 21 nt, Human
aggagcuguguuagcuggucg

SEQ ID NO: 1131569 - RNA, 22 nt, Human
ugaggcagcaauuguauuguau

SEQ ID NO: 1131570 - RNA, 22 nt, Human
agcaggcuuucaagagucuucu

SEQ ID NO: 1131571 - RNA, 22 nt, Human
ccaggccagcaggcacaccugc

SEQ ID NO: 1131572 - RNA, 22 nt, Human
gagagcugggaaagccguggag

SEQ ID NO: 1131573 - RNA, 22 nt, Human
aggcacuggucuaccccuuagu

SEQ ID NO: 1131574 - RNA, 22 nt, Human
ggggcugggauuugaacccagg

SEQ ID NO: 1131575 - RNA, 22 nt, Human
uggcugaaggaagauucuucua

SEQ ID NO: 1131576 - RNA, 22 nt, Human
cuauugaauagcccaaaucauu

SEQ ID NO: 1131577 - RNA, 22 nt, Human
gugucccaggccucuggaauua

SEQ ID NO: 1131578 - RNA, 22 nt, Human
uagcagcuuaaguaauuagaau

SEQ ID NO: 1131579 - RNA, 20 nt, Human
aggcucagagcaguaguaca

SEQ ID NO: 1131580 - RNA, 22 nt, Human
gccacguugccacccgggugac

SEQ ID NO: 1131581 - RNA, 22 nt, Human
cagaguguuagcgcugguuggg

SEQ ID NO: 1131582 - RNA, 22 nt, Human
gccuucugauaucucuuggcau

SEQ ID NO: 1131583 - RNA, 22 nt, Human
uccuugaagaaugauucuugga

SEQ ID NO: 1131584 - RNA, 22 nt, Human
gggaagggagggaccucagucu

SEQ ID NO: 1131585 - RNA, 21 nt, Human
aggucccagguuugggcagca

SEQ ID NO: 1131586 - RNA, 22 nt, Human
cuggccucauagccaagcugug

SEQ ID NO: 1131587 - RNA, 21 nt, Human
uauuucuuugacucucucccu

SEQ ID NO: 1131588 - RNA, 22 nt, Human
agcugggaugauaaccucaguc

SEQ ID NO: 1131589 - RNA, 22 nt, Human
ugggccuguugggguugaguua

SEQ ID NO: 1131590 - RNA, 22 nt, Human
ugagcaguaggucugaauagug

SEQ ID NO: 1131591 - RNA, 22 nt, Human
uacauggugguggcacuugacu

SEQ ID NO: 1131592 - RNA, 22 nt, Human
acagggcagagaggcaggcuug

SEQ ID NO: 1131593 - RNA, 22 nt, Human
auguaagguucagaguauguga

SEQ ID NO: 1131594 - RNA, 22 nt, Human
ccugagagcgaguggccucaug

SEQ ID NO: 1131595 - RNA, 22 nt, Human
uagaggugucacuuugggaagu

SEQ ID NO: 1131596 - RNA, 22 nt, Human
uuuaguaaguucacugcaaagc

SEQ ID NO: 1131597 - RNA, 22 nt, Human
ccagaaaaugcagaacauagaa

SEQ ID NO: 1131598 - RNA, 22 nt, Human
agcaggguuuggggauuggcac

SEQ ID NO: 1131599 - RNA, 22 nt, Human
gaaaguuugccucucucuugag

SEQ ID NO: 1131600 - RNA, 22 nt, Human
ggcagcaugagccuggugaauu

SEQ ID NO: 1131601 - RNA, 22 nt, Human
agaggaugauuuuaaggacacu

SEQ ID NO: 1131602 - RNA, 22 nt, Human
caguagcaggcacucagcacgu

SEQ ID NO: 1131603 - RNA, 22 nt, Human
uucuuucccuuccagcagcucc

SEQ ID NO: 1131604 - RNA, 22 nt, Human
ccucagagaaagguauggcuga

SEQ ID NO: 1131605 - RNA, 22 nt, Human
agcucccagaaggcccugcgcc

SEQ ID NO: 1131606 - RNA, 22 nt, Human
aaugcuguaaagaugcuaucug

SEQ ID NO: 1131607 - RNA, 22 nt, Human
gccuggcacucacugaagaggc

SEQ ID NO: 1131608 - RNA, 22 nt, Human
gagagggccgggggccagcucc

SEQ ID NO: 1131609 - RNA, 22 nt, Human
gcucugagccgggggccugucc

SEQ ID NO: 1131610 - RNA, 22 nt, Human
uaaggucauggugaauaauaag

SEQ ID NO: 1131611 - RNA, 22 nt, Human
ucagaaauagucuuuaaaauga

SEQ ID NO: 1131612 - RNA, 23 nt, Human
cacaccaggagccgucugggcca

SEQ ID NO: 1131613 - RNA, 22 nt, Human
aaaugcacacaccaggaaacua

SEQ ID NO: 1131614 - RNA, 22 nt, Human
ggcugccaggagaagcucagug

SEQ ID NO: 1131615 - RNA, 22 nt, Human
uguccucacaggaaugaacuuu

SEQ ID NO: 1131616 - RNA, 22 nt, Human
ucaguguagcagacuuguagcc

SEQ ID NO: 1131617 - RNA, 22 nt, Human
agagagcccgggccagggcaca

SEQ ID NO: 1131618 - RNA, 23 nt, Human
ggguccagagacaggcaugggug

SEQ ID NO: 1131619 - RNA, 23 nt, Human
uggcucagggucucuuaugaagu

SEQ ID NO: 1131620 - RNA, 22 nt, Human
cucugagcccgcugcagcccca

SEQ ID NO: 1131621 - RNA, 22 nt, Human
gaugcacaugugaguauagaag

SEQ ID NO: 1131622 - RNA, 22 nt, Human
aaaaaaucagaucuuugguuaa

SEQ ID NO: 1131623 - RNA, 22 nt, Human
aaaaaugaaacggcugguuggc

SEQ ID NO: 1131624 - RNA, 22 nt, Human
uauaacaguuuaggugguguca

SEQ ID NO: 1131625 - RNA, 22 nt, Human
cuguggcuuucucugccuccuu

SEQ ID NO: 1131626 - RNA, 22 nt, Human
ugccagcacuucuggcugucug

SEQ ID NO: 1131627 - RNA, 21 nt, Human
guggccugauuaugaaugggu

SEQ ID NO: 1131628 - RNA, 22 nt, Human
aucuggcucccuuggaauccgu

SEQ ID NO: 1131629 - RNA, 22 nt, Human
ucccagagauuuccucuccuuc

SEQ ID NO: 1131630 - RNA, 22 nt, Human
uggacucaaguccaaguucacg

SEQ ID NO: 1131631 - RNA, 22 nt, Human
agggcagcucucaccucuggcc

SEQ ID NO: 1131632 - RNA, 22 nt, Human
gcaaggcugcugccacccaucu

SEQ ID NO: 1131633 - RNA, 22 nt, Human
gaggggcagaaugugaucaggg

SEQ ID NO: 1131634 - RNA, 22 nt, Human
cuugccuucuuuuccuauagaa

SEQ ID NO: 1131635 - RNA, 22 nt, Human
guguacauauugagucugcuga

SEQ ID NO: 1131636 - RNA, 22 nt, Human
gccucugcaccaguacugugcc

SEQ ID NO: 1131637 - RNA, 22 nt, Human
gccuggagacagcagaggcggc

SEQ ID NO: 1131638 - RNA, 22 nt, Human
gacaggguacgggcuaggcaca

SEQ ID NO: 1131639 - RNA, 22 nt, Human
aacuagaaaacaagaugcugau

SEQ ID NO: 1131640 - RNA, 22 nt, Human
acagggcagaaauguugcaucu

SEQ ID NO: 1131641 - RNA, 22 nt, Human
ucaggugggaccugcuaggaca

SEQ ID NO: 1131642 - RNA, 22 nt, Human
gccuccuggccuuugcuccuca

SEQ ID NO: 1131643 - RNA, 22 nt, Human
ccagggucucugcugccugaga

SEQ ID NO: 1131644 - RNA, 22 nt, Human
cugccacuagcuuucacaucuu

SEQ ID NO: 1131645 - RNA, 22 nt, Human
uccagagccuauauguucaacu

SEQ ID NO: 1131646 - RNA, 22 nt, Human
uaugcacacauguaugcaugug

SEQ ID NO: 1131647 - RNA, 22 nt, Human
cuuauguaugcuacuuuguggu

SEQ ID NO: 1131648 - RNA, 22 nt, Human
gggcagagagcuggaacuccuu

SEQ ID NO: 1131649 - RNA, 22 nt, Human
ugagccuggccugcagagacca

SEQ ID NO: 1131650 - RNA, 22 nt, Human
ccagccuggagggcaguggugg

SEQ ID NO: 1131651 - RNA, 22 nt, Human
gccugccuggagcuugagguga

SEQ ID NO: 1131652 - RNA, 22 nt, Human
caggguggcccuguggucucau

SEQ ID NO: 1131653 - RNA, 22 nt, Human
cagcauggggaucacuguaggc

SEQ ID NO: 1131654 - RNA, 22 nt, Human
ccagcugcagguguuccagaug

SEQ ID NO: 1131655 - RNA, 22 nt, Human
gccugcagccucaagggcugag

SEQ ID NO: 1131656 - RNA, 21 nt, Human
aauaaaacaguuggugucaau

SEQ ID NO: 1131657 - RNA, 22 nt, Human
augaguaaaaccacuauuuaca

SEQ ID NO: 1131658 - RNA, 22 nt, Human
ccagaggcauguucaaagcaau

SEQ ID NO: 1131659 - RNA, 22 nt, Human
ugugacagaucuuuaaauaaug

SEQ ID NO: 1131660 - RNA, 17 nt, Human
cugaggcccagggccca

SEQ ID NO: 1131661 - RNA, 22 nt, Human
ucagcagugcagggugaggcag

SEQ ID NO: 1131662 - RNA, 22 nt, Human
gagagcuguguucauucuacca

SEQ ID NO: 1131663 - RNA, 23 nt, Human
gugauuucagggaacagaaucag

SEQ ID NO: 1131664 - RNA, 22 nt, Human
agaggggcucaagcaguggucu

SEQ ID NO: 1131665 - RNA, 22 nt, Human
ucagcaguguaguuuaucauuc

SEQ ID NO: 1131666 - RNA, 22 nt, Human
auaucuuuguaugguucagcag

SEQ ID NO: 1131667 - RNA, 22 nt, Human
aaguucaaggcucuagaguucc

SEQ ID NO: 1131668 - RNA, 22 nt, Human
ucacugcaaccucugccuuccg

SEQ ID NO: 1131669 - RNA, 22 nt, Human
cugggagucuggccucuggucc

SEQ ID NO: 1131670 - RNA, 22 nt, Human
ugcugccacaaauucagcugcc

SEQ ID NO: 1131671 - RNA, 20 nt, Human
cucugcuuuaggagagucag

SEQ ID NO: 1131672 - RNA, 23 nt, Human
uguagcaucucuuauuucucagc

SEQ ID NO: 1131673 - RNA, 22 nt, Human
acagaacuuccugcuggagugg

SEQ ID NO: 1131674 - RNA, 22 nt, Human
cucagagaaaaggagcaagggu

SEQ ID NO: 1131675 - RNA, 19 nt, Human
gggaaauucacuugcuucc

SEQ ID NO: 1131676 - RNA, 22 nt, Human
gacccuguuucuacaaauaauu

SEQ ID NO: 1131677 - RNA, 18 nt, Human
cagagcagagguggagcg

SEQ ID NO: 1131678 - RNA, 22 nt, Human
caaaugugacuuuugggcuucu

SEQ ID NO: 1131679 - RNA, 22 nt, Human
gaaggagcuaaagggagcccug

SEQ ID NO: 1131680 - RNA, 22 nt, Human
ucucagaguaauucuuuaaggu

SEQ ID NO: 1131681 - RNA, 22 nt, Human
cugggccagauccagccucaca

SEQ ID NO: 1131682 - RNA, 22 nt, Human
ggcaggcuggcuuuguuccagg

SEQ ID NO: 1131683 - RNA, 22 nt, Human
agcucauggugcuaucucaggg

SEQ ID NO: 1131684 - RNA, 22 nt, Human
cccuccccacaaagcuucacac

SEQ ID NO: 1131685 - RNA, 22 nt, Human
agaugcugugucuguucccuug

SEQ ID NO: 1131686 - RNA, 22 nt, Human
caaagccucugauuucacuugu

SEQ ID NO: 1131687 - RNA, 22 nt, Human
agguaggguuaauggagauaua

SEQ ID NO: 1131688 - RNA, 22 nt, Human
cacagcugccauggcugcacuu

SEQ ID NO: 1131689 - RNA, 22 nt, Human
aaaugcaccuugcugugagacu

SEQ ID NO: 1131690 - RNA, 22 nt, Human
ggcucaagcagucugccugccu

SEQ ID NO: 1131691 - RNA, 22 nt, Human
ugggcucauggcccagcacugg

SEQ ID NO: 1131692 - RNA, 22 nt, Human
gcucucugccauaugaggauac

SEQ ID NO: 1131693 - RNA, 22 nt, Human
aggggugauuugggacaggaca

SEQ ID NO: 1131694 - RNA, 22 nt, Human
aguggcagagcaggugcuggaa

SEQ ID NO: 1131695 - RNA, 23 nt, Human
gggagccaggaccucgcgcccca

SEQ ID NO: 1131696 - RNA, 22 nt, Human
agacagggucuugaucagagcu

SEQ ID NO: 1131697 - RNA, 22 nt, Human
guggccuggaaaggcuggucug

SEQ ID NO: 1131698 - RNA, 20 nt, Human
uaugaagauaugugaacagc

SEQ ID NO: 1131699 - RNA, 22 nt, Human
gccuggaguacuccuugaagug

SEQ ID NO: 1131700 - RNA, 22 nt, Human
agcagggcagguaaggaucaga

SEQ ID NO: 1131701 - RNA, 22 nt, Human
agagcuguucaacguagcaaug

SEQ ID NO: 1131702 - RNA, 21 nt, Human
ugugugugcaggcacacacac

SEQ ID NO: 1131703 - RNA, 22 nt, Human
cucucugaggcaggccuguggg

SEQ ID NO: 1131704 - RNA, 22 nt, Human
aagggagguaaagcuauuuaaa

SEQ ID NO: 1131705 - RNA, 18 nt, Human
ucucagaggccauccuag

SEQ ID NO: 1131706 - RNA, 22 nt, Human
ucaucaaagucaaagaaugacu

SEQ ID NO: 1131707 - RNA, 22 nt, Human
agcagagcugcaguggccugcu

SEQ ID NO: 1131708 - RNA, 22 nt, Human
cagccaggagcucccccugcuc

SEQ ID NO: 1131709 - RNA, 22 nt, Human
agcugucuuucugccuccugau

SEQ ID NO: 1131710 - RNA, 22 nt, Human
cagcaggcucugaguggcugcc

SEQ ID NO: 1131711 - RNA, 22 nt, Human
cucaggagaugacagaagguau

SEQ ID NO: 1131712 - RNA, 22 nt, Human
gagcacaggcuuugguggacac

SEQ ID NO: 1131713 - RNA, 22 nt, Human
gccugggagggcagcagugugg

SEQ ID NO: 1131714 - RNA, 22 nt, Human
uggcagaggcucugugauguug

SEQ ID NO: 1131715 - RNA, 22 nt, Human
ugauuuccuagcugacaugaaa

SEQ ID NO: 1131716 - RNA, 22 nt, Human
ugguaucagagccaucuguauu

SEQ ID NO: 1131717 - RNA, 22 nt, Human
ggccaagauggaaggagagaug

SEQ ID NO: 1131718 - RNA, 22 nt, Human
ucaaugauuagaguuuagugug

SEQ ID NO: 1131719 - RNA, 22 nt, Human
aaggagcuuguucgccuuccuc

SEQ ID NO: 1131720 - RNA, 22 nt, Human
ugcugcucuucaccauggccuc

SEQ ID NO: 1131721 - RNA, 22 nt, Human
acagaauacuacagacugguua

SEQ ID NO: 1131722 - RNA, 20 nt, Human
acauguacuaaugaauacag

SEQ ID NO: 1131723 - RNA, 22 nt, Human
aggccuccuggcuccaggccuu

SEQ ID NO: 1131724 - RNA, 22 nt, Human
uuuuagaaauacugauuuagug

SEQ ID NO: 1131725 - RNA, 22 nt, Human
cucugggcacauuuuccaggac

SEQ ID NO: 1131726 - RNA, 22 nt, Human
ugacaugcuuguuuuccuugaa

SEQ ID NO: 1131727 - RNA, 22 nt, Human
uaaauguggagacucaggaguc

SEQ ID NO: 1131728 - RNA, 20 nt, Human
ucucugcuguccacauuugc

SEQ ID NO: 1131729 - RNA, 22 nt, Human
gccuguccacuaaacagccaag

SEQ ID NO: 1131730 - RNA, 22 nt, Human
gcagaagcccggucagcgcacg

SEQ ID NO: 1131731 - RNA, 22 nt, Human
ccugccugucaucgccugcgcc

SEQ ID NO: 1131732 - RNA, 22 nt, Human
cacagggcagaggguccguggc

SEQ ID NO: 1131733 - RNA, 22 nt, Human
cagccaucaguaaagacagcuu

SEQ ID NO: 1131734 - RNA, 22 nt, Human
gcugucaggccaugugggccuu

SEQ ID NO: 1131735 - RNA, 22 nt, Human
uccuucaguucaauuaguccgu

SEQ ID NO: 1131736 - RNA, 22 nt, Human
cagcagcuacuuggagcagcag

SEQ ID NO: 1131737 - RNA, 22 nt, Human
agcucucaagauaagaaagaac

SEQ ID NO: 1131738 - RNA, 22 nt, Human
gggcagagaaauggacaguugg

SEQ ID NO: 1131739 - RNA, 22 nt, Human
aacaaauggggccuuguaugaa

SEQ ID NO: 1131740 - RNA, 22 nt, Human
aaaagguuuugaguacaaauau

SEQ ID NO: 1131741 - RNA, 22 nt, Human
caucuggcuagcuaucauugug

SEQ ID NO: 1131742 - RNA, 19 nt, Human
agcagccaucgaccaugga

SEQ ID NO: 1131743 - RNA, 19 nt, Human
ucagaggauuuggcuauga

SEQ ID NO: 1131744 - RNA, 22 nt, Human
cuggccuggagccucugggugg

SEQ ID NO: 1131745 - RNA, 22 nt, Human
ugaaaaggguagaucccuaagu

SEQ ID NO: 1131746 - RNA, 22 nt, Human
uuugcaauuugugcugcaaaug

SEQ ID NO: 1131747 - RNA, 22 nt, Human
ugggaggagcccucugggaagg

SEQ ID NO: 1131748 - RNA, 22 nt, Human
ccuggcucuucagagguuccua

SEQ ID NO: 1131749 - RNA, 22 nt, Human
aucuggcuuuuaccccacggcc

SEQ ID NO: 1131750 - RNA, 22 nt, Human
guauacauagaugaugaacaag

SEQ ID NO: 1131751 - RNA, 22 nt, Human
uugauacauagcacaguuuagg

SEQ ID NO: 1131752 - RNA, 22 nt, Human
ugugccaugaggcucugauaug

SEQ ID NO: 1131753 - RNA, 22 nt, Human
uuuauuauguacaggcacuaua

SEQ ID NO: 1131754 - RNA, 21 nt, Human
ccaccaggucuucugcucggg

SEQ ID NO: 1131755 - RNA, 22 nt, Human
acccagagccagggucaggagc

SEQ ID NO: 1131756 - RNA, 22 nt, Human
ggguccagaguugaagagguua

SEQ ID NO: 1131757 - RNA, 22 nt, Human
ugucucaguauacgaaacacuu

SEQ ID NO: 1131758 - RNA, 22 nt, Human
uggucaguugcaucagagaagu

SEQ ID NO: 1131759 - RNA, 22 nt, Human
agcauuuaauuacaguuuaauu

SEQ ID NO: 1131760 - RNA, 22 nt, Human
cagguggaucucuaaggacuga

SEQ ID NO: 1131761 - RNA, 22 nt, Human
ucuucagauugcacugagcaag

SEQ ID NO: 1131762 - RNA, 22 nt, Human
ugcguugcgcuccugcagcagg

SEQ ID NO: 1131763 - RNA, 22 nt, Human
aaguucaaggaagccuccaguu

SEQ ID NO: 1131764 - RNA, 22 nt, Human
ggcuggcacugaggagagcucu

SEQ ID NO: 1131765 - RNA, 19 nt, Human
gcagccaccgcggcggccg

SEQ ID NO: 1131766 - RNA, 22 nt, Human
agcagccaggaaucugcagagc

SEQ ID NO: 1131767 - RNA, 22 nt, Human
uuaacagagaacauagaaguag

SEQ ID NO: 1131768 - RNA, 22 nt, Human
agggaugguggagguugcaagu

SEQ ID NO: 1131769 - RNA, 22 nt, Human
accaggaggccuggagcacaaa

SEQ ID NO: 1131770 - RNA, 22 nt, Human
uggcucagaagaaaagguaaac

SEQ ID NO: 1131771 - RNA, 22 nt, Human
aaggccugcucagcugucugug

SEQ ID NO: 1131772 - RNA, 22 nt, Human
guuugcauaucugugaaaugga

SEQ ID NO: 1131773 - RNA, 22 nt, Human
gccagagcaugcacugccugca

SEQ ID NO: 1131774 - RNA, 22 nt, Human
augggaguuuucucugaugcuc

SEQ ID NO: 1131775 - RNA, 18 nt, Human
gcagagugcgucucugug

SEQ ID NO: 1131776 - RNA, 22 nt, Human
ggccuugggcuggcugcaguau

SEQ ID NO: 1131777 - RNA, 19 nt, Human
gcauaaaaugucaaugugu

SEQ ID NO: 1131778 - RNA, 22 nt, Human
agaggcccucucucuccugaug

SEQ ID NO: 1131779 - RNA, 22 nt, Human
aaggucauuuaacaauuuauga

SEQ ID NO: 1131780 - RNA, 22 nt, Human
ccagccuggacugggucuugug

SEQ ID NO: 1131781 - RNA, 22 nt, Human
gcuggccugggcucaagaccag

SEQ ID NO: 1131782 - RNA, 22 nt, Human
uugaaucauuacaauagauaag

SEQ ID NO: 1131783 - RNA, 18 nt, Human
aggcuucccaggcaggcc

SEQ ID NO: 1131784 - RNA, 22 nt, Human
caguacuugggggguucuaagu

SEQ ID NO: 1131785 - RNA, 23 nt, Human
aagaauaaaugacauuaaaggug

SEQ ID NO: 1131786 - RNA, 22 nt, Human
gucaccaggucugaugcagcca

SEQ ID NO: 1131787 - RNA, 22 nt, Human
gccaguuccuguggagucagag

SEQ ID NO: 1131788 - RNA, 22 nt, Human
gugccuggagcuaauguguaua

SEQ ID NO: 1131789 - RNA, 22 nt, Human
cguguggucccggcaaggcaag

SEQ ID NO: 1131790 - RNA, 22 nt, Human
cugccuguuuucugauagauuu

SEQ ID NO: 1131791 - RNA, 22 nt, Human
cuggcugcuggccugaggaugc

SEQ ID NO: 1131792 - RNA, 22 nt, Human
ucccagagccaagcuauggaug

SEQ ID NO: 1131793 - RNA, 22 nt, Human
ucucagagaucuuucugcaugu

SEQ ID NO: 1131794 - RNA, 22 nt, Human
ggucccagguugacagggagac

SEQ ID NO: 1131795 - RNA, 22 nt, Human
gccaccucggcuuucucugcuc

SEQ ID NO: 1131796 - RNA, 20 nt, Human
ugaugguucuuuccggguug

SEQ ID NO: 1131797 - RNA, 22 nt, Human
uggcccuguggaggucagugag

SEQ ID NO: 1131798 - RNA, 19 nt, Human
agaggcugucaccuguagc

SEQ ID NO: 1131799 - RNA, 22 nt, Human
cacagggccacuuucccaguaa

SEQ ID NO: 1131800 - RNA, 22 nt, Human
ccagcccuucccaacuggccag

SEQ ID NO: 1131801 - RNA, 21 nt, Human
gcagcaguguucuagaauacu

SEQ ID NO: 1131802 - RNA, 23 nt, Human
aaaguguagccagguuaagaacc

SEQ ID NO: 1131803 - RNA, 22 nt, Human
gcaggagcugcucuccugacga

SEQ ID NO: 1131804 - RNA, 20 nt, Human
aagagaagaagucuuugaaa

SEQ ID NO: 1131805 - RNA, 22 nt, Human
ugcagcauugcaaagcagucuu

SEQ ID NO: 1131806 - RNA, 22 nt, Human
ugcagaggaccauuguccugga

SEQ ID NO: 1131807 - RNA, 22 nt, Human
uagaaaucauuuagaaguauug

SEQ ID NO: 1131808 - RNA, 22 nt, Human
gguggccaggccagcucuggcc

SEQ ID NO: 1131809 - RNA, 22 nt, Human
guccucugggagccuugagccu

SEQ ID NO: 1131810 - RNA, 22 nt, Human
uccugccucaggcucuggagua

SEQ ID NO: 1131811 - RNA, 22 nt, Human
ucuuugcaacucccauuuccau

SEQ ID NO: 1131812 - RNA, 19 nt, Human
aagggcugggcaccucacu

SEQ ID NO: 1131813 - RNA, 22 nt, Human
caggugcccagcuccugcugug

SEQ ID NO: 1131814 - RNA, 22 nt, Human
aggccucuucagggagcaugga

SEQ ID NO: 1131815 - RNA, 22 nt, Human
uuaggcaauaucauuggaguug

SEQ ID NO: 1131816 - RNA, 22 nt, Human
agcugcugcggaaagaugccac

SEQ ID NO: 1131817 - RNA, 20 nt, Human
uccuggccuucucgggcagu

SEQ ID NO: 1131818 - RNA, 22 nt, Human
ucccuggccauuccucuaggcc

SEQ ID NO: 1131819 - RNA, 22 nt, Human
aggcagccagauggcagccugc

SEQ ID NO: 1131820 - RNA, 21 nt, Human
ugccaggccugagcugggguc

SEQ ID NO: 1131821 - RNA, 22 nt, Human
uaaguucaaugaacucaguucu

SEQ ID NO: 1131822 - RNA, 22 nt, Human
cagaggccccagaacuagcucu

SEQ ID NO: 1131823 - RNA, 22 nt, Human
gagcagugguugaacagaggca

SEQ ID NO: 1131824 - RNA, 22 nt, Human
uacaguucacaguaucauaaau

SEQ ID NO: 1131825 - RNA, 22 nt, Human
acagaggccccgugggagagcc

SEQ ID NO: 1131826 - RNA, 22 nt, Human
ugggcagacgcuguuggaaggc

SEQ ID NO: 1131827 - RNA, 22 nt, Human
uuggcugaagguuaagugcugg

SEQ ID NO: 1131828 - RNA, 21 nt, Human
gcucccugcucagcuccuggg

SEQ ID NO: 1131829 - RNA, 22 nt, Human
cugagagcagggacuugagcca

SEQ ID NO: 1131830 - RNA, 22 nt, Human
uggaaagaaaguaaaggcguau

SEQ ID NO: 1131831 - RNA, 22 nt, Human
ggaggccaaggcagguggauca

SEQ ID NO: 1131832 - RNA, 23 nt, Human
auuuccuacuauaaaagagguaa

SEQ ID NO: 1131833 - RNA, 22 nt, Human
ucucuucuagcuucuugugguu

SEQ ID NO: 1131834 - RNA, 22 nt, Human
uaaaguccuugaaccggaugua

SEQ ID NO: 1131835 - RNA, 22 nt, Human
ucauugcagaaauaaaggugaa

SEQ ID NO: 1131836 - RNA, 22 nt, Human
gagcugcuucugugugccgggu

SEQ ID NO: 1131837 - RNA, 22 nt, Human
gaaagaggaaggagauguauua

SEQ ID NO: 1131838 - RNA, 21 nt, Human
ccugcagcaccagaaggagau

SEQ ID NO: 1131839 - RNA, 22 nt, Human
ucuccucugcgcggcagugccc

SEQ ID NO: 1131840 - RNA, 22 nt, Human
ucccaguguggcaggccaugga

SEQ ID NO: 1131841 - RNA, 22 nt, Human
uugcagggcaggaccauggaca

SEQ ID NO: 1131842 - RNA, 20 nt, Human
ccagagcagccacugaaguu

SEQ ID NO: 1131843 - RNA, 22 nt, Human
cucagagcccaggguacacccg

SEQ ID NO: 1131844 - RNA, 22 nt, Human
cuuaggcaagcagagcccaucc

SEQ ID NO: 1131845 - RNA, 22 nt, Human
uccauggguagcccugguugag

SEQ ID NO: 1131846 - RNA, 22 nt, Human
aagccaggggcugcuuaggaga

SEQ ID NO: 1131847 - RNA, 22 nt, Human
aaauucuuucauggcuaauaag

SEQ ID NO: 1131848 - RNA, 22 nt, Human
ccacccagccagaugcaggaag

SEQ ID NO: 1131849 - RNA, 22 nt, Human
aagccagauagaagaacucauu

SEQ ID NO: 1131850 - RNA, 22 nt, Human
uccauuguguuacagagcauuc

SEQ ID NO: 1131851 - RNA, 22 nt, Human
ggccaggcuggucucagacuuc

SEQ ID NO: 1131852 - RNA, 22 nt, Human
caggacaguuugcuuugcccug

SEQ ID NO: 1131853 - RNA, 22 nt, Human
cugcccuguuuggacagcccgg

SEQ ID NO: 1131854 - RNA, 22 nt, Human
ucccagccauuccuuuaggugu

SEQ ID NO: 1131855 - RNA, 22 nt, Human
ucugccugagggagcugaggaa

SEQ ID NO: 1131856 - RNA, 22 nt, Human
agcaccuucacaggcucucagg

SEQ ID NO: 1131857 - RNA, 22 nt, Human
gccuucagcccugacuggccag

SEQ ID NO: 1131858 - RNA, 22 nt, Human
uuagauaaauugcaacuugauu

SEQ ID NO: 1131859 - RNA, 22 nt, Human
uuccucucgcucuccggggccc

SEQ ID NO: 1131860 - RNA, 22 nt, Human
cugccagcaaugugaccaugcu

SEQ ID NO: 1131861 - RNA, 22 nt, Human
ccugagggcgccgagcucccag

SEQ ID NO: 1131862 - RNA, 22 nt, Human
ugaaacagucuccagacuugga

SEQ ID NO: 1131863 - RNA, 22 nt, Human
cccugagcccauaguugacauu

SEQ ID NO: 1131864 - RNA, 17 nt, Human
acacagggagagggagc

SEQ ID NO: 1131865 - RNA, 22 nt, Human
ccugggcagguguggcuucccc

SEQ ID NO: 1131866 - RNA, 22 nt, Human
gcaccugcaggaugagccaggg

SEQ ID NO: 1131867 - RNA, 22 nt, Human
cacagggcagagaccugggugc

SEQ ID NO: 1131868 - RNA, 22 nt, Human
ucaaagucauggcuaguaauga

SEQ ID NO: 1131869 - RNA, 22 nt, Human
ccugaggacacacgcugcagga

SEQ ID NO: 1131870 - RNA, 18 nt, Human
agcagcugugccacacug

SEQ ID NO: 1131871 - RNA, 22 nt, Human
agccauugaauuuagugccuuu

SEQ ID NO: 1131872 - RNA, 22 nt, Human
agagccugcuguguaagucaca

SEQ ID NO: 1131873 - RNA, 19 nt, Human
agcaccugugagagccugg

SEQ ID NO: 1131874 - RNA, 22 nt, Human
ugcugccacugguagucucauu

SEQ ID NO: 1131875 - RNA, 19 nt, Human
caguggagauuggaggagg

SEQ ID NO: 1131876 - RNA, 23 nt, Human
ucaguuuuggcuguucaguguug

SEQ ID NO: 1131877 - RNA, 22 nt, Human
caaaguccauaguuuacaauag

SEQ ID NO: 1131878 - RNA, 22 nt, Human
gcaggggcaggagaucucaggc

SEQ ID NO: 1131879 - RNA, 22 nt, Human
aacccagccguguagcugccgc

SEQ ID NO: 1131880 - RNA, 22 nt, Human
ugggcugccggcaggcucugcc

SEQ ID NO: 1131881 - RNA, 22 nt, Human
agggugcagaaggagccuagga

SEQ ID NO: 1131882 - RNA, 23 nt, Human
auucuucauuaucuucuagaaaa

SEQ ID NO: 1131883 - RNA, 22 nt, Human
uccuucaguuaucacaguacug

SEQ ID NO: 1131884 - RNA, 22 nt, Human
gugggcaaggucccugccagcu

SEQ ID NO: 1131885 - RNA, 22 nt, Human
uagccuucucaagacaaaguug

SEQ ID NO: 1131886 - RNA, 22 nt, Human
augcugagacuggagcagcugg

SEQ ID NO: 1131887 - RNA, 22 nt, Human
cacuggggaaaacaggcuucuu

SEQ ID NO: 1131888 - RNA, 22 nt, Human
ugggacagggaaucugaucccc

SEQ ID NO: 1131889 - RNA, 22 nt, Human
ucucacugggucacagcagagg

SEQ ID NO: 1131890 - RNA, 22 nt, Human
uaagaacaagauguuccuguuu

SEQ ID NO: 1131891 - RNA, 22 nt, Human
gaggggcugcccuggugucagg

SEQ ID NO: 1131892 - RNA, 22 nt, Human
agucucugcacaguaagaagca

SEQ ID NO: 1131893 - RNA, 20 nt, Human
cuguaucagguuacaaagua

SEQ ID NO: 1131894 - RNA, 22 nt, Human
agggcagagauuaauuaagaca

SEQ ID NO: 1131895 - RNA, 22 nt, Human
acauuguauaaugauuaucaca

SEQ ID NO: 1131896 - RNA, 22 nt, Human
cugguucauccccuuccaggaa

SEQ ID NO: 1131897 - RNA, 22 nt, Human
uagcagcucacagccucccauu

SEQ ID NO: 1131898 - RNA, 22 nt, Human
cuggagccacuuuuuauccuuu

SEQ ID NO: 1131899 - RNA, 22 nt, Human
cagggugccaaagaacaaauau

SEQ ID NO: 1131900 - RNA, 22 nt, Human
uggggcugaggagccucacucu

SEQ ID NO: 1131901 - RNA, 22 nt, Human
cagggccaagccccuuuggcug

SEQ ID NO: 1131902 - RNA, 22 nt, Human
cagaguguggcaucuuccaacu

SEQ ID NO: 1131903 - RNA, 22 nt, Human
auuagcugaccucuaaggagcc

SEQ ID NO: 1131904 - RNA, 22 nt, Human
uguaaucauuacaguacaugga

SEQ ID NO: 1131905 - RNA, 22 nt, Human
gcagugggcaacaagagcugga

SEQ ID NO: 1131906 - RNA, 22 nt, Human
acugccuuauaugcugugugug

SEQ ID NO: 1131907 - RNA, 22 nt, Human
agcugcccugggucuugcugcu

SEQ ID NO: 1131908 - RNA, 22 nt, Human
guaacagaggguuugcagauau

SEQ ID NO: 1131909 - RNA, 22 nt, Human
ugcccuguuccugccuccagcu

SEQ ID NO: 1131910 - RNA, 22 nt, Human
aaucaguuagaaggaagagaau

SEQ ID NO: 1131911 - RNA, 22 nt, Human
acugcuuuuagaaaucuauaga

SEQ ID NO: 1131912 - RNA, 22 nt, Human
gggugcaggcagcccaggcagg

SEQ ID NO: 1131913 - RNA, 22 nt, Human
cacccagccuucacacaggagu

SEQ ID NO: 1131914 - RNA, 22 nt, Human
uggaagagggagcuggguggcc

SEQ ID NO: 1131915 - RNA, 22 nt, Human
aagaacagauucagccugaacu

SEQ ID NO: 1131916 - RNA, 21 nt, Human
ggccugagcaccuguccaccu

SEQ ID NO: 1131917 - RNA, 22 nt, Human
uuagaaaaaggcuguggucuua

SEQ ID NO: 1131918 - RNA, 22 nt, Human
ucagcagggcugugguguggcu

SEQ ID NO: 1131919 - RNA, 22 nt, Human
agcucuggaauaaugaugugau

SEQ ID NO: 1131920 - RNA, 22 nt, Human
acagggcagagugaaaugcuau

SEQ ID NO: 1131921 - RNA, 22 nt, Human
uggcucagcaagacauugaccu

SEQ ID NO: 1131922 - RNA, 19 nt, Human
gcaggcaguggcauucgga

SEQ ID NO: 1131923 - RNA, 22 nt, Human
ggcaaaaaccgcaauaacuucu

SEQ ID NO: 1131924 - RNA, 22 nt, Human
cucuggaauuaaggaagccugu

SEQ ID NO: 1131925 - RNA, 22 nt, Human
gaaaggucuuccggucuuccag

SEQ ID NO: 1131926 - RNA, 22 nt, Human
ucuggcucagggcucugaggga

SEQ ID NO: 1131927 - RNA, 22 nt, Human
cucccaggcacagggaggagcc

SEQ ID NO: 1131928 - RNA, 22 nt, Human
augauucagcaauuuuauaucu

SEQ ID NO: 1131929 - RNA, 22 nt, Human
ccuccaggcugaauaucuagaa

SEQ ID NO: 1131930 - RNA, 22 nt, Human
cagggugccuguccucagcaaa

SEQ ID NO: 1131931 - RNA, 22 nt, Human
cacauccuucagcugagcccag

SEQ ID NO: 1131932 - RNA, 22 nt, Human
gggcuggaggagauccagaggc

SEQ ID NO: 1131933 - RNA, 22 nt, Human
ugagcuuacuucuguacacaga

SEQ ID NO: 1131934 - RNA, 22 nt, Human
uacaugcuccacuuucuccugu

SEQ ID NO: 1131935 - RNA, 22 nt, Human
caggccuggcugcagcucgccu

SEQ ID NO: 1131936 - RNA, 22 nt, Human
uaguuuuuucaacaaauggugc

SEQ ID NO: 1131937 - RNA, 22 nt, Human
ugccagggcugcuacuggcuga

SEQ ID NO: 1131938 - RNA, 22 nt, Human
gucaggaugcuauuguuauuaa

SEQ ID NO: 1131939 - RNA, 21 nt, Human
ccacaggggcuccccugucag

SEQ ID NO: 1131940 - RNA, 22 nt, Human
uggcaggggaggugcuugcuua

SEQ ID NO: 1131941 - RNA, 22 nt, Human
ucuuccagcaaugugaaaucac

SEQ ID NO: 1131942 - RNA, 22 nt, Human
gucccugcccuccugggacuca

SEQ ID NO: 1131943 - RNA, 22 nt, Human
ggguccagcuacaucagggugg

SEQ ID NO: 1131944 - RNA, 22 nt, Human
ugggggugaaagucuggacagu

SEQ ID NO: 1131945 - RNA, 22 nt, Human
uauaguacauggaaucuucaua

SEQ ID NO: 1131946 - RNA, 22 nt, Human
acugcagccuugaacucugggc

SEQ ID NO: 1131947 - RNA, 22 nt, Human
agcugcccuucucuugcccuug

SEQ ID NO: 1131948 - RNA, 22 nt, Human
cucugugggggagaggcagcug

SEQ ID NO: 1131949 - RNA, 22 nt, Human
uauguacauggagagcaauuga

SEQ ID NO: 1131950 - RNA, 22 nt, Human
cugcaggauucucccaguugga

SEQ ID NO: 1131951 - RNA, 22 nt, Human
uggcccucagucuugcuccugc

SEQ ID NO: 1131952 - RNA, 22 nt, Human
agugaaaugauucugagcaaga

SEQ ID NO: 1131953 - RNA, 22 nt, Human
ccuggagcacucucccuggcug

SEQ ID NO: 1131954 - RNA, 22 nt, Human
caauguuugaguaggagcauaa

SEQ ID NO: 1131955 - RNA, 22 nt, Human
acagguggcauaggcaguuuga

SEQ ID NO: 1131956 - RNA, 22 nt, Human
gaagagcugcucagaacaugau

SEQ ID NO: 1131957 - RNA, 19 nt, Human
uacuuuuucaggacagagu

SEQ ID NO: 1131958 - RNA, 22 nt, Human
auaaagucauuaugaagaucua

SEQ ID NO: 1131959 - RNA, 22 nt, Human
cagcaggguagguuguaucagu

SEQ ID NO: 1131960 - RNA, 22 nt, Human
gcccagcuggcuuccagcacau

SEQ ID NO: 1131961 - RNA, 22 nt, Human
gagcugucuggggacucugggu

SEQ ID NO: 1131962 - RNA, 22 nt, Human
gcugcagcucgccuuccggccu

SEQ ID NO: 1131963 - RNA, 17 nt, Human
ucaggauccaggguucu

SEQ ID NO: 1131964 - RNA, 22 nt, Human
uguacauuuagagcucaauaga

SEQ ID NO: 1131965 - RNA, 22 nt, Human
acacagggaggaggugcugugc

SEQ ID NO: 1131966 - RNA, 22 nt, Human
cugugucggacgugggcagcag

SEQ ID NO: 1131967 - RNA, 22 nt, Human
cccaaggcauggcaugguggca

SEQ ID NO: 1131968 - RNA, 21 nt, Human
ccuggcagaagccugauaugc

SEQ ID NO: 1131969 - RNA, 19 nt, Human
acaggcagaauugggugug

SEQ ID NO: 1131970 - RNA, 22 nt, Human
cuucuaggcuucucagggggca

SEQ ID NO: 1131971 - RNA, 22 nt, Human
uggcucaguuucaguccugguu

SEQ ID NO: 1131972 - RNA, 21 nt, Human
gagcugggcgaggcuccgggg

SEQ ID NO: 1131973 - RNA, 22 nt, Human
auccaaagcccuaaguuaacug

SEQ ID NO: 1131974 - RNA, 22 nt, Human
ccugccugcaccuucucugggg

SEQ ID NO: 1131975 - RNA, 22 nt, Human
uggccugccugggagcagcagg

SEQ ID NO: 1131976 - RNA, 22 nt, Human
gcuuuauguaaguccaaaggca

SEQ ID NO: 1131977 - RNA, 22 nt, Human
agaaaaaucuuggcgcuugucu

SEQ ID NO: 1131978 - RNA, 22 nt, Human
caguacuucuuggaaacuggau

SEQ ID NO: 1131979 - RNA, 22 nt, Human
cagggccagagagggcuggcug

SEQ ID NO: 1131980 - RNA, 22 nt, Human
uaugaguacaaggacucugucu

SEQ ID NO: 1131981 - RNA, 22 nt, Human
caggccuggguucaaaucccuu

SEQ ID NO: 1131982 - RNA, 22 nt, Human
gugggccucuugaggguggcua

SEQ ID NO: 1131983 - RNA, 22 nt, Human
cugcagccucaaccuccugagc

SEQ ID NO: 1131984 - RNA, 22 nt, Human
uguauguggcuacuuuucuugc

SEQ ID NO: 1131985 - RNA, 22 nt, Human
agggacacugaugagaaauucu

SEQ ID NO: 1131986 - RNA, 20 nt, Human
uauuuagauucaaguaugga

SEQ ID NO: 1131987 - RNA, 22 nt, Human
ucccuggcuguguucaggugcg

SEQ ID NO: 1131988 - RNA, 22 nt, Human
ccugccagcauggcuuaucucc

SEQ ID NO: 1131989 - RNA, 22 nt, Human
gcugagcuagaaaaggaccaca

SEQ ID NO: 1131990 - RNA, 22 nt, Human
uugcacuccagcccgagcaaca

SEQ ID NO: 1131991 - RNA, 22 nt, Human
cacugccuccccaggcuccaca

SEQ ID NO: 1131992 - RNA, 22 nt, Human
uuucaaauggagucgugaaaug

SEQ ID NO: 1131993 - RNA, 22 nt, Human
cgcugggcgccgaccugcuggc

SEQ ID NO: 1131994 - RNA, 22 nt, Human
uggcucagaggggaagugguuu

SEQ ID NO: 1131995 - RNA, 22 nt, Human
gguggccugcccugaucccugg

SEQ ID NO: 1131996 - RNA, 22 nt, Human
agaugguguuuccccaggugga

SEQ ID NO: 1131997 - RNA, 22 nt, Human
cucccuggcacagcgagagguu

SEQ ID NO: 1131998 - RNA, 20 nt, Human
uucauucauuccacaacuuc

SEQ ID NO: 1131999 - RNA, 22 nt, Human
acugugcaugaaccgaaacaaa

SEQ ID NO: 1132000 - RNA, 22 nt, Human
ucugucugcgcuugcccuggug

SEQ ID NO: 1132001 - RNA, 22 nt, Human
accuuuuuguucuguucucagc

SEQ ID NO: 1132002 - RNA, 22 nt, Human
ccaauguuuauuuuccugcugc

SEQ ID NO: 1132003 - RNA, 22 nt, Human
cauuaagauuuuuuucuacugg

SEQ ID NO: 1132004 - RNA, 22 nt, Human
uggcucaggccuacgacgccuu

SEQ ID NO: 1132005 - RNA, 22 nt, Human
uggcccugaggggcugugcccc

SEQ ID NO: 1132006 - RNA, 22 nt, Human
gcugucccaugguugcaagaug

SEQ ID NO: 1132007 - RNA, 22 nt, Human
uaacagaaauauuuccagguga

SEQ ID NO: 1132008 - RNA, 22 nt, Human
gagcaggcauucuaguggcuga

SEQ ID NO: 1132009 - RNA, 22 nt, Human
acucugcuuauugcugcaggca

SEQ ID NO: 1132010 - RNA, 22 nt, Human
aagaugcuuauugcuccugcag

SEQ ID NO: 1132011 - RNA, 21 nt, Human
ccuauugaauauaggaagauu

SEQ ID NO: 1132012 - RNA, 22 nt, Human
aucacgucaugguuugaucugg

SEQ ID NO: 1132013 - RNA, 22 nt, Human
cagagagaggccacugcuauua

SEQ ID NO: 1132014 - RNA, 22 nt, Human
cagccccucccucaggcaggug

SEQ ID NO: 1132015 - RNA, 22 nt, Human
ccuccagguguuacauaugacu

SEQ ID NO: 1132016 - RNA, 22 nt, Human
ggcuugcuucuuguccaggaau

SEQ ID NO: 1132017 - RNA, 22 nt, Human
uuuccucugagugagcugggag

SEQ ID NO: 1132018 - RNA, 22 nt, Human
auguuuugcuggauguuggcua

SEQ ID NO: 1132019 - RNA, 22 nt, Human
uucuggagagaaaccuuacaaa

SEQ ID NO: 1132020 - RNA, 22 nt, Human
cucaggacccgguccagguggg

SEQ ID NO: 1132021 - RNA, 23 nt, Human
uggcaccaggcauucuaggggua

SEQ ID NO: 1132022 - RNA, 22 nt, Human
guuuggggucugcagagcggcg

SEQ ID NO: 1132023 - RNA, 22 nt, Human
acucccagguugccuggcaggc

SEQ ID NO: 1132024 - RNA, 22 nt, Human
ugccaggagagugcaugcaggg

SEQ ID NO: 1132025 - RNA, 22 nt, Human
uuccucucucuugccagaaugu

SEQ ID NO: 1132026 - RNA, 18 nt, Human
gggcucugauccuucacc

SEQ ID NO: 1132027 - RNA, 22 nt, Human
ucucugcucugugccucaguuu

SEQ ID NO: 1132028 - RNA, 22 nt, Human
ucugucacuuauuaagauggau

SEQ ID NO: 1132029 - RNA, 22 nt, Human
gccugucucuuggaacuuggua

SEQ ID NO: 1132030 - RNA, 19 nt, Human
cugagagaugcuucacaca

SEQ ID NO: 1132031 - RNA, 22 nt, Human
auaugaagaauuccaauuugga

SEQ ID NO: 1132032 - RNA, 22 nt, Human
gggcugucaugugucagugacc

SEQ ID NO: 1132033 - RNA, 22 nt, Human
uauaaaguuucgaaagauguau

SEQ ID NO: 1132034 - RNA, 22 nt, Human
uggcagggaauacagauguuua

SEQ ID NO: 1132035 - RNA, 22 nt, Human
cugucugcuagaacaucuauac

SEQ ID NO: 1132036 - RNA, 22 nt, Human
guggccuggauagacuccaucu

SEQ ID NO: 1132037 - RNA, 22 nt, Human
guaauugacucagcucuguuca

SEQ ID NO: 1132038 - RNA, 22 nt, Human
ucuagaaaaaaacugcugugga

SEQ ID NO: 1132039 - RNA, 22 nt, Human
ggaggccaaggcaggcggauca

SEQ ID NO: 1132040 - RNA, 22 nt, Human
gccagggcucgcggucccucgu

SEQ ID NO: 1132041 - RNA, 22 nt, Human
aggcugggcaccguuuugaucc

SEQ ID NO: 1132042 - RNA, 22 nt, Human
caggcaggugcagauuccucuu

SEQ ID NO: 1132043 - RNA, 22 nt, Human
agcucccagcuccuuugagaga

SEQ ID NO: 1132044 - RNA, 22 nt, Human
uacagggguaacaguggggaau

SEQ ID NO: 1132045 - RNA, 17 nt, Human
gguggccugcaguggcu

SEQ ID NO: 1132046 - RNA, 18 nt, Human
ucugucuguacaaguauc

SEQ ID NO: 1132047 - RNA, 22 nt, Human
gcagggccagggcucaggcugu

SEQ ID NO: 1132048 - RNA, 22 nt, Human
agcugcagucaagcugggccac

SEQ ID NO: 1132049 - RNA, 22 nt, Human
acagggcaaccucugggagacu

SEQ ID NO: 1132050 - RNA, 22 nt, Human
ccagggcauguaacuaauggug

SEQ ID NO: 1132051 - RNA, 22 nt, Human
cuggagagaccgaaagaggcug

SEQ ID NO: 1132052 - RNA, 22 nt, Human
uccugggcccaggcugccaggg

SEQ ID NO: 1132053 - RNA, 22 nt, Human
cagguggguguaugaaugcaaa

SEQ ID NO: 1132054 - RNA, 22 nt, Human
ugaagcugugggcaguggagcc

SEQ ID NO: 1132055 - RNA, 22 nt, Human
ucuuugcaaauguuauuaucuu

SEQ ID NO: 1132056 - RNA, 22 nt, Human
aaggcagccucugccagccggg

SEQ ID NO: 1132057 - RNA, 22 nt, Human
uccauugucuuugguccuagcc

SEQ ID NO: 1132058 - RNA, 22 nt, Human
ccagaggugcugggagaggucu

SEQ ID NO: 1132059 - RNA, 22 nt, Human
acugcagcaaagcccgugucuu

SEQ ID NO: 1132060 - RNA, 16 nt, Human
ggagagugucugcaaa

SEQ ID NO: 1132061 - RNA, 22 nt, Human
ucacuggggccuuuggucagga

SEQ ID NO: 1132062 - RNA, 22 nt, Human
caguauguuugggagacaugac

SEQ ID NO: 1132063 - RNA, 22 nt, Human
acuccugguuuguguccuggcu

SEQ ID NO: 1132064 - RNA, 22 nt, Human
gccuuugcaccaucagugcaau

SEQ ID NO: 1132065 - RNA, 22 nt, Human
caggcugggcagccuccccggc

SEQ ID NO: 1132066 - RNA, 23 nt, Human
agcuggaggcugucuacucccaa

SEQ ID NO: 1132067 - RNA, 20 nt, Human
gcauugaguauagacagaug

SEQ ID NO: 1132068 - RNA, 22 nt, Human
agggccaggaacaccugaaggg

SEQ ID NO: 1132069 - RNA, 22 nt, Human
ggagccaggcaaucuguacuuu

SEQ ID NO: 1132070 - RNA, 21 nt, Human
ggagcugcaggagccgaaggc

SEQ ID NO: 1132071 - RNA, 22 nt, Human
cugaggagagaucacguggugu

SEQ ID NO: 1132072 - RNA, 19 nt, Human
cacagggcaggucucaugu

SEQ ID NO: 1132073 - RNA, 22 nt, Human
ugggaggaaugucacugagcca

SEQ ID NO: 1132074 - RNA, 22 nt, Human
ucugccuggauuuuggaaagcu

SEQ ID NO: 1132075 - RNA, 22 nt, Human
aagcagaugggacuccaaggca

SEQ ID NO: 1132076 - RNA, 22 nt, Human
aggcacuggguaauuaguagcu

SEQ ID NO: 1132077 - RNA, 22 nt, Human
uacauuccauguguguguauuc

SEQ ID NO: 1132078 - RNA, 22 nt, Human
agggacagaugaaugacugagu

SEQ ID NO: 1132079 - RNA, 22 nt, Human
uccugcagccacugcaggcaga

SEQ ID NO: 1132080 - RNA, 22 nt, Human
cagaguacugggagaacagaag

SEQ ID NO: 1132081 - RNA, 22 nt, Human
aagguacaaaguauuauuuaaa

SEQ ID NO: 1132082 - RNA, 22 nt, Human
uaaugcacaugacugaacuauu

SEQ ID NO: 1132083 - RNA, 22 nt, Human
aguugaaauuagaguccuggcu

SEQ ID NO: 1132084 - RNA, 22 nt, Human
gcagcugagcgugaggaagagu

SEQ ID NO: 1132085 - RNA, 22 nt, Human
auccauggcuaaguauauagag

SEQ ID NO: 1132086 - RNA, 22 nt, Human
guuugcauuucuugaacuauau

SEQ ID NO: 1132087 - RNA, 22 nt, Human
aaaguuugaaugauauauuagu

SEQ ID NO: 1132088 - RNA, 22 nt, Human
ucuuuccuguaacugcuguuca

SEQ ID NO: 1132089 - RNA, 22 nt, Human
cagcuggaugggagaccauguu

SEQ ID NO: 1132090 - RNA, 22 nt, Human
ugaugggacugccagcugcuga

SEQ ID NO: 1132091 - RNA, 22 nt, Human
ugccaggcgugguggugcgcac

SEQ ID NO: 1132092 - RNA, 22 nt, Human
acagccagggucucaggaggcg

SEQ ID NO: 1132093 - RNA, 22 nt, Human
ggccaggaagggaagaucagca

SEQ ID NO: 1132094 - RNA, 22 nt, Human
uccagugguacauggagacacu

SEQ ID NO: 1132095 - RNA, 22 nt, Human
gcucugcugaagccccuugcau

SEQ ID NO: 1132096 - RNA, 22 nt, Human
ccuggcagcauugguagagauu

SEQ ID NO: 1132097 - RNA, 22 nt, Human
ucaccugggagggcugugguag

SEQ ID NO: 1132098 - RNA, 22 nt, Human
uuuuccucuguauuugaaaugc

SEQ ID NO: 1132099 - RNA, 22 nt, Human
auggcaggcccagguguucauu

SEQ ID NO: 1132100 - RNA, 22 nt, Human
gggacuggaacuacuggugcag

SEQ ID NO: 1132101 - RNA, 19 nt, Human
aggguccagggagcggcuc

SEQ ID NO: 1132102 - RNA, 22 nt, Human
uaagaacaguagaacaguaggu

SEQ ID NO: 1132103 - RNA, 22 nt, Human
gcugggagaggcccugaaguga

SEQ ID NO: 1132104 - RNA, 21 nt, Human
gcucucugcaugguggcucag

SEQ ID NO: 1132105 - RNA, 22 nt, Human
ccaggcagagggauccccaucc

SEQ ID NO: 1132106 - RNA, 22 nt, Human
caaagaugcugauguuggauca

SEQ ID NO: 1132107 - RNA, 22 nt, Human
uguuuuguuuaugagagcacag

SEQ ID NO: 1132108 - RNA, 22 nt, Human
uacauauuugucuuuguacugu

SEQ ID NO: 1132109 - RNA, 22 nt, Human
gggagggaaggaggcgccgugu

SEQ ID NO: 1132110 - RNA, 22 nt, Human
uaaauucccaacucugcucuuc

SEQ ID NO: 1132111 - RNA, 22 nt, Human
ggcugcuucucacucauuugca

SEQ ID NO: 1132112 - RNA, 22 nt, Human
gcagcacauauaaacaaagaga

SEQ ID NO: 1132113 - RNA, 22 nt, Human
cagcaggcguugggagaaagac

SEQ ID NO: 1132114 - RNA, 22 nt, Human
gcauuucugugcauacacauga

SEQ ID NO: 1132115 - RNA, 22 nt, Human
uguguguguaaaagcauuuaua

SEQ ID NO: 1132116 - RNA, 21 nt, Human
gcagagccggggcgagaaggc

SEQ ID NO: 1132117 - RNA, 22 nt, Human
ggguggcacaggugcagagggu

SEQ ID NO: 1132118 - RNA, 22 nt, Human
ccuggccucagacagagggugg

SEQ ID NO: 1132119 - RNA, 22 nt, Human
agugggcagcccaggaggucuu

SEQ ID NO: 1132120 - RNA, 22 nt, Human
cugggugguucuaacuguugau

SEQ ID NO: 1132121 - RNA, 22 nt, Human
cagccagcugaauguaccauga

SEQ ID NO: 1132122 - RNA, 22 nt, Human
ugccuggaugugcuggccucac

SEQ ID NO: 1132123 - RNA, 22 nt, Human
ggaugcaggacggcauggaugu

SEQ ID NO: 1132124 - RNA, 22 nt, Human
cuuauguacacacauauauugu

SEQ ID NO: 1132125 - RNA, 22 nt, Human
ccagcuugaagaugugcugguu

SEQ ID NO: 1132126 - RNA, 22 nt, Human
cuucccugauaagagccucaga

SEQ ID NO: 1132127 - RNA, 17 nt, Human
agaggcagauacuugga

SEQ ID NO: 1132128 - RNA, 22 nt, Human
ggagucccagcaaagccuuccc

SEQ ID NO: 1132129 - RNA, 22 nt, Human
agcacuuuccuggcaaaugugg

SEQ ID NO: 1132130 - RNA, 22 nt, Human
agagcuguucagcagccagguu

SEQ ID NO: 1132131 - RNA, 22 nt, Human
ugcugggcuaggguggagcucu

SEQ ID NO: 1132132 - RNA, 22 nt, Human
ugggcucugaagucagucugcu

SEQ ID NO: 1132133 - RNA, 22 nt, Human
caaauguguuuuuucuucuaca

SEQ ID NO: 1132134 - RNA, 22 nt, Human
cuggguggcuguccagccagcc

SEQ ID NO: 1132135 - RNA, 17 nt, Human
uuccccugaccaagccu

SEQ ID NO: 1132136 - RNA, 22 nt, Human
aggaaaaaccuguuaaugguag

SEQ ID NO: 1132137 - RNA, 22 nt, Human
ggacacaagcuccggggcugca

SEQ ID NO: 1132138 - RNA, 22 nt, Human
ccugccugguguaagucuaagg

SEQ ID NO: 1132139 - RNA, 22 nt, Human
ugggcucuccuggaggacaaca

SEQ ID NO: 1132140 - RNA, 22 nt, Human
uccaguggugguuugaagggca

SEQ ID NO: 1132141 - RNA, 22 nt, Human
uagcugccuuugggcuccugcu

SEQ ID NO: 1132142 - RNA, 22 nt, Human
aaggcacuguacuaguuaguua

SEQ ID NO: 1132143 - RNA, 22 nt, Human
uagcugccuaugugauaagaga

SEQ ID NO: 1132144 - RNA, 17 nt, Human
cagggcugucugccuag

SEQ ID NO: 1132145 - RNA, 22 nt, Human
aagggcagcugacagaugcuua

SEQ ID NO: 1132146 - RNA, 22 nt, Human
caaggagaguaauugaaugaga

SEQ ID NO: 1132147 - RNA, 23 nt, Human
acagcugcaccuggccgccuggc

SEQ ID NO: 1132148 - RNA, 22 nt, Human
uggcucugggaaucuguugcuu

SEQ ID NO: 1132149 - RNA, 22 nt, Human
ugcuggcccuggcucagggaac

SEQ ID NO: 1132150 - RNA, 21 nt, Human
ucaggggcuguguuuuccauc

SEQ ID NO: 1132151 - RNA, 22 nt, Human
uuauuuaauuuucucacucaga

SEQ ID NO: 1132152 - RNA, 22 nt, Human
acuccugggugcugaccagcgu

SEQ ID NO: 1132153 - RNA, 22 nt, Human
caggugggcuugggagaacacu

SEQ ID NO: 1132154 - RNA, 18 nt, Human
ugucauugccagggaagc

SEQ ID NO: 1132155 - RNA, 22 nt, Human
uuuuccuacugauaaacaguua

SEQ ID NO: 1132156 - RNA, 22 nt, Human
uggcagagaaccugggcuuugu

SEQ ID NO: 1132157 - RNA, 22 nt, Human
ugcugucuguuuacuggcuaua

SEQ ID NO: 1132158 - RNA, 22 nt, Human
caggcacugugcugagcucugc

SEQ ID NO: 1132159 - RNA, 22 nt, Human
agcugcugagccaggcugaugu

SEQ ID NO: 1132160 - RNA, 22 nt, Human
gccuccuggauuuuagugccau

SEQ ID NO: 1132161 - RNA, 22 nt, Human
ggcugucucugugacugccacc

SEQ ID NO: 1132162 - RNA, 22 nt, Human
uggcccugaggacccagugugg

SEQ ID NO: 1132163 - RNA, 22 nt, Human
ggccagaggccauccuccugcu

SEQ ID NO: 1132164 - RNA, 22 nt, Human
aggccugagcagaggaguggac

SEQ ID NO: 1132165 - RNA, 22 nt, Human
ccuggagggcgccgcacagucc

SEQ ID NO: 1132166 - RNA, 17 nt, Human
uggcucugaggcugaau

SEQ ID NO: 1132167 - RNA, 22 nt, Human
ggaaagagcccagcagugcuug

SEQ ID NO: 1132168 - RNA, 22 nt, Human
gccuggagaagauggaacuagc

SEQ ID NO: 1132169 - RNA, 22 nt, Human
gugcugucguggaacugggcug

SEQ ID NO: 1132170 - RNA, 22 nt, Human
gcuguauuccugcacuguauag

SEQ ID NO: 1132171 - RNA, 22 nt, Human
aagggccuccuggggagccugg

SEQ ID NO: 1132172 - RNA, 22 nt, Human
caugagcugcugggagccuguc

SEQ ID NO: 1132173 - RNA, 22 nt, Human
agaggccagguccagaguuugu

SEQ ID NO: 1132174 - RNA, 22 nt, Human
guguuuccucuagaagccaugg

SEQ ID NO: 1132175 - RNA, 22 nt, Human
ucuggcucauacaagccugcaa

SEQ ID NO: 1132176 - RNA, 22 nt, Human
aguauguagugcaaucagucag

SEQ ID NO: 1132177 - RNA, 23 nt, Human
ucagcugcuuccuccugccugcc

SEQ ID NO: 1132178 - RNA, 19 nt, Human
uggcaggcccaggauggac

SEQ ID NO: 1132179 - RNA, 22 nt, Human
agaugcugcuccacaggccagg

SEQ ID NO: 1132180 - RNA, 22 nt, Human
uguggcuguguccaccugcugc

SEQ ID NO: 1132181 - RNA, 22 nt, Human
guuugucuuaauuaggcaucga

SEQ ID NO: 1132182 - RNA, 22 nt, Human
cagccucuaagcacagccucuc

SEQ ID NO: 1132183 - RNA, 21 nt, Human
ugauccuuucccccauguugc

SEQ ID NO: 1132184 - RNA, 22 nt, Human
ggugacugguuuaucuggcagu

SEQ ID NO: 1132185 - RNA, 22 nt, Human
aagauuucugcuccugagagaa

SEQ ID NO: 1132186 - RNA, 22 nt, Human
agaauguagucuuggagauuua

SEQ ID NO: 1132187 - RNA, 22 nt, Human
cagcaguguggaagcugagggg

SEQ ID NO: 1132188 - RNA, 22 nt, Human
ugaaaguuacaggaaaacagau

SEQ ID NO: 1132189 - RNA, 17 nt, Human
ucuguccagggagugug

SEQ ID NO: 1132190 - RNA, 22 nt, Human
gagcuguccgccccugggccga

SEQ ID NO: 1132191 - RNA, 22 nt, Human
ugugaaaggagccauagacagu

SEQ ID NO: 1132192 - RNA, 22 nt, Human
agaaaugacacacaugagacau

SEQ ID NO: 1132193 - RNA, 22 nt, Human
gggagggauuaguucugccugg

SEQ ID NO: 1132194 - RNA, 22 nt, Human
ccugggagugugccaucucugu

SEQ ID NO: 1132195 - RNA, 22 nt, Human
gcaaggcugagcacauuugcau

SEQ ID NO: 1132196 - RNA, 22 nt, Human
aggcaguguauugcuagcggcu

SEQ ID NO: 1132197 - RNA, 22 nt, Human
ccaggacuuauuacaguauaac

SEQ ID NO: 1132198 - RNA, 17 nt, Human
guccugggaggagagag

SEQ ID NO: 1132199 - RNA, 22 nt, Human
gcugguuaggugagggugcgcc

SEQ ID NO: 1132200 - RNA, 22 nt, Human
gccucugcaucuucgccgcacu

SEQ ID NO: 1132201 - RNA, 22 nt, Human
ccucagagguguggcaucucug

SEQ ID NO: 1132202 - RNA, 22 nt, Human
aggcagcaaagaaaugaugcug

SEQ ID NO: 1132203 - RNA, 22 nt, Human
augcaagauguauagaagacuu

SEQ ID NO: 1132204 - RNA, 22 nt, Human
cagcauuggguuaccuuuguuu

SEQ ID NO: 1132205 - RNA, 22 nt, Human
cagagcugacccaaggauugaa

SEQ ID NO: 1132206 - RNA, 22 nt, Human
gccucugcccauccaccaucag

SEQ ID NO: 1132207 - RNA, 22 nt, Human
agcuggcccucgagagccaauu

SEQ ID NO: 1132208 - RNA, 22 nt, Human
uguucuugagccuuuagaccua

SEQ ID NO: 1132209 - RNA, 22 nt, Human
uggagcaggugccaggugugug

SEQ ID NO: 1132210 - RNA, 22 nt, Human
agaccagcugccucccagggcc

SEQ ID NO: 1132211 - RNA, 22 nt, Human
aggagccuccuucucaugugca

SEQ ID NO: 1132212 - RNA, 22 nt, Human
gggacagacccaugggccaggu

SEQ ID NO: 1132213 - RNA, 22 nt, Human
gugauuucaaauauagagugag

SEQ ID NO: 1132214 - RNA, 23 nt, Human
uggagcugacagucagagggagg

SEQ ID NO: 1132215 - RNA, 22 nt, Human
caagagcugcaaauagcgugac

SEQ ID NO: 1132216 - RNA, 18 nt, Human
ggccugaggauuucagca

SEQ ID NO: 1132217 - RNA, 18 nt, Human
cuuucagauggauaugcu

SEQ ID NO: 1132218 - RNA, 22 nt, Human
uguguguguuucugcucauaca

SEQ ID NO: 1132219 - RNA, 22 nt, Human
guucaaagcuccugguacagua

SEQ ID NO: 1132220 - RNA, 22 nt, Human
ccagccagcugcccuuggggcc

SEQ ID NO: 1132221 - RNA, 22 nt, Human
aagagggcugcaaucuuauugc

SEQ ID NO: 1132222 - RNA, 22 nt, Human
gcugggagucgcgucuguggcc

SEQ ID NO: 1132223 - RNA, 22 nt, Human
aaaguuuguuauaugauaagga

SEQ ID NO: 1132224 - RNA, 22 nt, Human
cauguaaaacacucagaacagu

SEQ ID NO: 1132225 - RNA, 22 nt, Human
caggaaccuaaagagacauuac

SEQ ID NO: 1132226 - RNA, 22 nt, Human
gcugaagggagugcugagucug

SEQ ID NO: 1132227 - RNA, 22 nt, Human
cauuucugcagaauugcucuuc

SEQ ID NO: 1132228 - RNA, 22 nt, Human
ucugccuuccccauaaucugau

SEQ ID NO: 1132229 - RNA, 22 nt, Human
uggcucuggugcgggcuccugc

SEQ ID NO: 1132230 - RNA, 22 nt, Human
uuugaacaagagcuucacauua

SEQ ID NO: 1132231 - RNA, 22 nt, Human
uucaaugaggauagaacuggau

SEQ ID NO: 1132232 - RNA, 23 nt, Human
uuugcaaauuggacacaaccaca

SEQ ID NO: 1132233 - RNA, 22 nt, Human
aaaagguagauucuccuucuau

SEQ ID NO: 1132234 - RNA, 22 nt, Human
acagccagggcauugucgccga

SEQ ID NO: 1132235 - RNA, 22 nt, Human
agccuggauucgugcauccaca

SEQ ID NO: 1132236 - RNA, 22 nt, Human
gaagcucucaaacucuccccuu

SEQ ID NO: 1132237 - RNA, 22 nt, Human
auugaaagaguuuucugcugca

SEQ ID NO: 1132238 - RNA, 22 nt, Human
uggaggaugccuggggaggccu

SEQ ID NO: 1132239 - RNA, 19 nt, Human
agcagcuggagguggagug

SEQ ID NO: 1132240 - RNA, 22 nt, Human
cuuugaaagcucccaggacuua

SEQ ID NO: 1132241 - RNA, 21 nt, Human
aacaaagggaugcucaucuuu

SEQ ID NO: 1132242 - RNA, 22 nt, Human
uagggaggcuacuucuuguagg

SEQ ID NO: 1132243 - RNA, 21 nt, Human
ucccagggccaggugccauca

SEQ ID NO: 1132244 - RNA, 19 nt, Human
cugugcuuuaaacuccuau

SEQ ID NO: 1132245 - RNA, 22 nt, Human
cuugucugugucggauaaaacu

SEQ ID NO: 1132246 - RNA, 22 nt, Human
cgcugccaggucaccaggggua

SEQ ID NO: 1132247 - RNA, 22 nt, Human
cagcaggguuaagugacucacc

SEQ ID NO: 1132248 - RNA, 22 nt, Human
ugcauuaucuuuaauguucuca

SEQ ID NO: 1132249 - RNA, 22 nt, Human
cauucacucagcgaugccagua

SEQ ID NO: 1132250 - RNA, 22 nt, Human
caaacugagcaucagaaaguuu

SEQ ID NO: 1132251 - RNA, 22 nt, Human
agcugucagugcugugccugua

SEQ ID NO: 1132252 - RNA, 22 nt, Human
ggcuccuggcaucuggugggua

SEQ ID NO: 1132253 - RNA, 22 nt, Human
gcccacacaccagcucaggagg

SEQ ID NO: 1132254 - RNA, 22 nt, Human
ggccucuggucaagacaagcau

SEQ ID NO: 1132255 - RNA, 22 nt, Human
auaaggcaucucucaguuagca

SEQ ID NO: 1132256 - RNA, 22 nt, Human
gcuggccugcaaagcccggcug

SEQ ID NO: 1132257 - RNA, 22 nt, Human
agggcagaaaccaccuugaugg

SEQ ID NO: 1132258 - RNA, 20 nt, Human
ccaggcacugucccaugcag

SEQ ID NO: 1132259 - RNA, 22 nt, Human
cagaguccuggacacagagaca

SEQ ID NO: 1132260 - RNA, 22 nt, Human
ggaugcaggggcagcagagccu

SEQ ID NO: 1132261 - RNA, 22 nt, Human
uagugauuaaaggcagaauguu

SEQ ID NO: 1132262 - RNA, 22 nt, Human
ucucuggaauuggcugaggcaa

SEQ ID NO: 1132263 - RNA, 22 nt, Human
aaucuuucccuauuaaaugugg

SEQ ID NO: 1132264 - RNA, 22 nt, Human
augugugugcauuucucucccu

SEQ ID NO: 1132265 - RNA, 22 nt, Human
agggagcaugggugaagcaggc

SEQ ID NO: 1132266 - RNA, 22 nt, Human
gagacugauggggcucccagaa

SEQ ID NO: 1132267 - RNA, 22 nt, Human
cugcagagcauaaaucugaaua

SEQ ID NO: 1132268 - RNA, 22 nt, Human
auacauuagaaucugguacuca

SEQ ID NO: 1132269 - RNA, 22 nt, Human
caggaaagagcugccaggcagg

SEQ ID NO: 1132270 - RNA, 22 nt, Human
cuacacaguucugccuaauggc

SEQ ID NO: 1132271 - RNA, 22 nt, Human
aaugucugccugaacuuuauau

SEQ ID NO: 1132272 - RNA, 22 nt, Human
ggggcccagcaccccuccucgc

SEQ ID NO: 1132273 - RNA, 22 nt, Human
gcagcugcaggcaggcuugcug

SEQ ID NO: 1132274 - RNA, 22 nt, Human
cuggacagaaaaggccacugga

SEQ ID NO: 1132275 - RNA, 22 nt, Human
ucaucacauaugucaugauuug

SEQ ID NO: 1132276 - RNA, 22 nt, Human
aacccuggggcagcugcuaggg

SEQ ID NO: 1132277 - RNA, 18 nt, Human
ccugcagcccaggaggcc

SEQ ID NO: 1132278 - RNA, 22 nt, Human
agaacagcaguuaugguucauu

SEQ ID NO: 1132279 - RNA, 18 nt, Human
auggucucauacugggag

SEQ ID NO: 1132280 - RNA, 22 nt, Human
auuuuuaugacaaaccauccuc

SEQ ID NO: 1132281 - RNA, 22 nt, Human
ccagaccacccuggccaugcac

SEQ ID NO: 1132282 - RNA, 22 nt, Human
auagacuugguuaguaaauuug

SEQ ID NO: 1132283 - RNA, 20 nt, Human
gcacugaagguuccagggga

SEQ ID NO: 1132284 - RNA, 22 nt, Human
aaggagucucagcugggccuga

SEQ ID NO: 1132285 - RNA, 22 nt, Human
ucacagggcauuauggcuccag

SEQ ID NO: 1132286 - RNA, 22 nt, Human
cuucucucugcauaggcauggg

SEQ ID NO: 1132287 - RNA, 22 nt, Human
ugcauuugucuugucucaugaa

SEQ ID NO: 1132288 - RNA, 22 nt, Human
uggagcaagcuggagagaacau

SEQ ID NO: 1132289 - RNA, 22 nt, Human
caguccuggggaccaggcugag

SEQ ID NO: 1132290 - RNA, 23 nt, Human
uggcagugaucaaaagcuuacau

SEQ ID NO: 1132291 - RNA, 22 nt, Human
auuauaggcuugagccaccgug

SEQ ID NO: 1132292 - RNA, 22 nt, Human
ccagcuggaagagugcagaacu

SEQ ID NO: 1132293 - RNA, 22 nt, Human
cagggcagggauguugcggcag

SEQ ID NO: 1132294 - RNA, 22 nt, Human
ccacagggugucaucagcuuga

SEQ ID NO: 1132295 - RNA, 22 nt, Human
agugcacaccuuaguacaaagu

SEQ ID NO: 1132296 - RNA, 22 nt, Human
uccagagggcgauggcuggggg

SEQ ID NO: 1132297 - RNA, 22 nt, Human
ccuggagcccaaggcagugaga

SEQ ID NO: 1132298 - RNA, 22 nt, Human
gagcucuggcagggcaggucug

SEQ ID NO: 1132299 - RNA, 22 nt, Human
aaguucuaauuuugcauucagg

SEQ ID NO: 1132300 - RNA, 22 nt, Human
agaggcugaaugaugucaucau

SEQ ID NO: 1132301 - RNA, 19 nt, Human
cagaguacaccagauagga

SEQ ID NO: 1132302 - RNA, 22 nt, Human
ccaaaguccauaguuuacauua

SEQ ID NO: 1132303 - RNA, 23 nt, Human
agcagccauagggaagcaauaca

SEQ ID NO: 1132304 - RNA, 22 nt, Human
gagaagcaaucaguggccaccc

SEQ ID NO: 1132305 - RNA, 17 nt, Human
uguauguggauacacua

SEQ ID NO: 1132306 - RNA, 22 nt, Human
cuggccucaccucagacuuacu

SEQ ID NO: 1132307 - RNA, 22 nt, Human
ccucccucuuucagucccacag

SEQ ID NO: 1132308 - RNA, 22 nt, Human
caccagggcucugagcucugaa

SEQ ID NO: 1132309 - RNA, 22 nt, Human
cagagcugcucaugguggccag

SEQ ID NO: 1132310 - RNA, 19 nt, Human
agcagagcagggccguggg

SEQ ID NO: 1132311 - RNA, 22 nt, Human
ugggcacuguagcuggugcugg

SEQ ID NO: 1132312 - RNA, 22 nt, Human
agcugcuccuuuccugcaggcg

SEQ ID NO: 1132313 - RNA, 22 nt, Human
gcagaggcaaucagguaugugg

SEQ ID NO: 1132314 - RNA, 22 nt, Human
cuuaggcagggcuggaagaucu

SEQ ID NO: 1132315 - RNA, 22 nt, Human
gcaaagucucaagacccaagug

SEQ ID NO: 1132316 - RNA, 22 nt, Human
cugagccagagggagucggguc

SEQ ID NO: 1132317 - RNA, 22 nt, Human
uacauaguauucacauuguuuu

SEQ ID NO: 1132318 - RNA, 22 nt, Human
cauacauuuugcauauuuacca

SEQ ID NO: 1132319 - RNA, 21 nt, Human
agcagcugggcaacauggagg

SEQ ID NO: 1132320 - RNA, 23 nt, Human
ucagaaugcacugaauuuacccu

SEQ ID NO: 1132321 - RNA, 22 nt, Human
aagggcagagggaaucccacau

SEQ ID NO: 1132322 - RNA, 22 nt, Human
ucauaaaacacaccagguaguu

SEQ ID NO: 1132323 - RNA, 22 nt, Human
cuacuucugugaugaaacuaca

SEQ ID NO: 1132324 - RNA, 22 nt, Human
uucuguguggguagcuccuguu

SEQ ID NO: 1132325 - RNA, 22 nt, Human
cagcugccugucuggaggcaau

SEQ ID NO: 1132326 - RNA, 22 nt, Human
uaaugaauaaacuugagaguca

SEQ ID NO: 1132327 - RNA, 22 nt, Human
acuguguccuauuuccuugaca

SEQ ID NO: 1132328 - RNA, 20 nt, Human
aguaccuuuuguauguuacc

SEQ ID NO: 1132329 - RNA, 22 nt, Human
ccagcccucacugaggccucuc

SEQ ID NO: 1132330 - RNA, 22 nt, Human
aaaaaugugaccacaggguguu

SEQ ID NO: 1132331 - RNA, 22 nt, Human
uguuuuguccuuuucuauauac

SEQ ID NO: 1132332 - RNA, 17 nt, Human
ccagagcuacugagacu

SEQ ID NO: 1132333 - RNA, 22 nt, Human
agagccaggcaggcaauguuga

SEQ ID NO: 1132334 - RNA, 22 nt, Human
acuguguccucauguggcagaa

SEQ ID NO: 1132335 - RNA, 22 nt, Human
ggcugcugcccaccccugcaug

SEQ ID NO: 1132336 - RNA, 22 nt, Human
agugccaggagcaaggagcucc

SEQ ID NO: 1132337 - RNA, 22 nt, Human
caguggguaggaaaggcucuuc

SEQ ID NO: 1132338 - RNA, 22 nt, Human
augacagaaggccucccugaca

SEQ ID NO: 1132339 - RNA, 22 nt, Human
augcacagcagugaguucagug

SEQ ID NO: 1132340 - RNA, 22 nt, Human
uagagcuauuuagagcauuuua

SEQ ID NO: 1132341 - RNA, 22 nt, Human
accuuuuuucagaacucuaaag

SEQ ID NO: 1132342 - RNA, 22 nt, Human
cagcuugcaguacuuguuuuug

SEQ ID NO: 1132343 - RNA, 22 nt, Human
caugggaggucugcaaggugcu

SEQ ID NO: 1132344 - RNA, 22 nt, Human
ggcuuauauauuuucacuugcc

SEQ ID NO: 1132345 - RNA, 22 nt, Human
uuuuuccuuagggguuacucac

SEQ ID NO: 1132346 - RNA, 22 nt, Human
agauuucccucuuguauuugca

SEQ ID NO: 1132347 - RNA, 22 nt, Human
gcucagccgaacuucagagcag

SEQ ID NO: 1132348 - RNA, 22 nt, Human
uggcuggggccacaguuuuccu

SEQ ID NO: 1132349 - RNA, 22 nt, Human
cagcaauaacucaaagccauuu

SEQ ID NO: 1132350 - RNA, 19 nt, Human
aucuuacagagcagaguac

SEQ ID NO: 1132351 - RNA, 22 nt, Human
uagaaacacagaucugguguca

SEQ ID NO: 1132352 - RNA, 22 nt, Human
gcaggagugacauggaugugga

SEQ ID NO: 1132353 - RNA, 22 nt, Human
ccugacucuggccaggccagcu

SEQ ID NO: 1132354 - RNA, 22 nt, Human
ccuuucagaugggcauggaccg

SEQ ID NO: 1132355 - RNA, 20 nt, Human
ucagaggcugccagcugggg

SEQ ID NO: 1132356 - RNA, 22 nt, Human
aaggccagcuuguagggcuggu

SEQ ID NO: 1132357 - RNA, 22 nt, Human
uuucacaauuuuaaggagcaaa

SEQ ID NO: 1132358 - RNA, 22 nt, Human
gauuauauaauggaagcucuug

SEQ ID NO: 1132359 - RNA, 22 nt, Human
gcagacagacugcagugauuuu

SEQ ID NO: 1132360 - RNA, 22 nt, Human
cucacuggcaagacuacaggug

SEQ ID NO: 1132361 - RNA, 22 nt, Human
gcucugugggugaguagaaucu

SEQ ID NO: 1132362 - RNA, 22 nt, Human
cugggacuuuacccuguggccc

SEQ ID NO: 1132363 - RNA, 22 nt, Human
caagagcuagacuuugucagga

SEQ ID NO: 1132364 - RNA, 20 nt, Human
uaaggcuguuuuguauuccu

SEQ ID NO: 1132365 - RNA, 21 nt, Human
guauucuuuaugaagugaaaa

SEQ ID NO: 1132366 - RNA, 22 nt, Human
cgcugggggaacagcgagggug

SEQ ID NO: 1132367 - RNA, 22 nt, Human
uggccucuggcugaggacuaac

SEQ ID NO: 1132368 - RNA, 22 nt, Human
gcugccacauuuucaggacuaa

SEQ ID NO: 1132369 - RNA, 22 nt, Human
uacuuugucauucuaaccuucc

SEQ ID NO: 1132370 - RNA, 22 nt, Human
ugccagaagauucucuaucaga

SEQ ID NO: 1132371 - RNA, 22 nt, Human
uccugagagcagaguccaggug

SEQ ID NO: 1132372 - RNA, 22 nt, Human
gcugagguggcugccuuaguaa

SEQ ID NO: 1132373 - RNA, 22 nt, Human
ucaggggagguugaaucgucuc

SEQ ID NO: 1132374 - RNA, 22 nt, Human
gcucccagauuucagccuugug

SEQ ID NO: 1132375 - RNA, 22 nt, Human
agucccagcuucccccaugcag

SEQ ID NO: 1132376 - RNA, 22 nt, Human
gcaaagguagccaaggagcuca

SEQ ID NO: 1132377 - RNA, 19 nt, Human
ucaaagucugagucacuuu

SEQ ID NO: 1132378 - RNA, 22 nt, Human
cagacccucgggugaguuggcc

SEQ ID NO: 1132379 - RNA, 22 nt, Human
aggaccuguagggccugcaucc

SEQ ID NO: 1132380 - RNA, 22 nt, Human
ucuuuacaaucuaagcauaguu

SEQ ID NO: 1132381 - RNA, 22 nt, Human
uuucacaaugcaauccuacuuc

SEQ ID NO: 1132382 - RNA, 22 nt, Human
gaggcccaggucaagcagccac

SEQ ID NO: 1132383 - RNA, 22 nt, Human
guugggaagcagauggaugagc

SEQ ID NO: 1132384 - RNA, 22 nt, Human
agcccagaggcugggcgugcau

SEQ ID NO: 1132385 - RNA, 21 nt, Human
agacagaacaacugcucucca

SEQ ID NO: 1132386 - RNA, 22 nt, Human
agaagcugccuacaugaccagc

SEQ ID NO: 1132387 - RNA, 22 nt, Human
ggcuucaccaggugcaugcaug

SEQ ID NO: 1132388 - RNA, 22 nt, Human
cagggcuccccgcaccgcagcc

SEQ ID NO: 1132389 - RNA, 22 nt, Human
aagcccagaugggagcauuuca

SEQ ID NO: 1132390 - RNA, 22 nt, Human
uacacuuuuuacuacagauucu

SEQ ID NO: 1132391 - RNA, 22 nt, Human
aggcagcagccacaaggccuga

SEQ ID NO: 1132392 - RNA, 18 nt, Human
uggagccagcucuaggau

SEQ ID NO: 1132393 - RNA, 22 nt, Human
ggaggccaaggaggagcuugcc

SEQ ID NO: 1132394 - RNA, 22 nt, Human
gguggccuuucaguggaucagg

SEQ ID NO: 1132395 - RNA, 22 nt, Human
ucucuggggauggaccugggag

SEQ ID NO: 1132396 - RNA, 22 nt, Human
uaucuuugcaaauaucucuaag

SEQ ID NO: 1132397 - RNA, 22 nt, Human
uuaugcuaguauaguccuuaga

SEQ ID NO: 1132398 - RNA, 22 nt, Human
aguugcagacgcagagauguug

SEQ ID NO: 1132399 - RNA, 22 nt, Human
agguggagaagagaugggcagu

SEQ ID NO: 1132400 - RNA, 23 nt, Human
ccugaagggucaggguccucagc

SEQ ID NO: 1132401 - RNA, 22 nt, Human
agcugcagauucuaucuagaag

SEQ ID NO: 1132402 - RNA, 22 nt, Human
uauguacauguuaaagggcaaa

SEQ ID NO: 1132403 - RNA, 22 nt, Human
aagcuccccgaaacccaccucu

SEQ ID NO: 1132404 - RNA, 22 nt, Human
acugggaguucuccaugucccu

SEQ ID NO: 1132405 - RNA, 22 nt, Human
gaggagguuccggguggagaag

SEQ ID NO: 1132406 - RNA, 22 nt, Human
acagaauucuaguauguggcuu

SEQ ID NO: 1132407 - RNA, 22 nt, Human
gaggcccuccagcugucagcug

SEQ ID NO: 1132408 - RNA, 22 nt, Human
gagcucccuggagguucagaua

SEQ ID NO: 1132409 - RNA, 22 nt, Human
uaaacagaaagcagauguacuu

SEQ ID NO: 1132410 - RNA, 22 nt, Human
uucuuucacucaagaaggaucu

SEQ ID NO: 1132411 - RNA, 19 nt, Human
aagcagcccuggcaagagc

SEQ ID NO: 1132412 - RNA, 22 nt, Human
cagaggcuguguaggcagacug

SEQ ID NO: 1132413 - RNA, 22 nt, Human
cacaggugcuccucggggagcu

SEQ ID NO: 1132414 - RNA, 22 nt, Human
agcagcugggcucagagcuggg

SEQ ID NO: 1132415 - RNA, 22 nt, Human
acucugaggcaggucagggcag

SEQ ID NO: 1132416 - RNA, 22 nt, Human
gccuggguuccaugaucuccag

SEQ ID NO: 1132417 - RNA, 17 nt, Human
aggcauggucuggggug

SEQ ID NO: 1132418 - RNA, 22 nt, Human
gaaggccauugcguccugggau

SEQ ID NO: 1132419 - RNA, 23 nt, Human
aggugccaacugagagcugagag

SEQ ID NO: 1132420 - RNA, 22 nt, Human
acuuugcagagccagaagagaa

SEQ ID NO: 1132421 - RNA, 22 nt, Human
aggaccagccuccaggucucuu

SEQ ID NO: 1132422 - RNA, 22 nt, Human
gcagagccgugaauggauuuca

SEQ ID NO: 1132423 - RNA, 20 nt, Human
acagaauaugcugguugugg

SEQ ID NO: 1132424 - RNA, 22 nt, Human
ugguccuggggaucugcaguga

SEQ ID NO: 1132425 - RNA, 22 nt, Human
ucucuucuuguguuuuccugcc

SEQ ID NO: 1132426 - RNA, 22 nt, Human
ggcucugcccagaugaagagga

SEQ ID NO: 1132427 - RNA, 22 nt, Human
gcauuuagcuuuaaaauauuuc

SEQ ID NO: 1132428 - RNA, 21 nt, Human
ggcagaaguagcauggacggg

SEQ ID NO: 1132429 - RNA, 22 nt, Human
acauguggucaaucuguguagg

SEQ ID NO: 1132430 - RNA, 22 nt, Human
gccccagcucugccacaacuag

SEQ ID NO: 1132431 - RNA, 22 nt, Human
cuggugggagcagcaggcagcu

SEQ ID NO: 1132432 - RNA, 22 nt, Human
agccuggaagaaccugaagucu

SEQ ID NO: 1132433 - RNA, 22 nt, Human
uaaccauauuuuccauuaaguu

SEQ ID NO: 1132434 - RNA, 19 nt, Human
aauguaguguuaugucaac

SEQ ID NO: 1132435 - RNA, 22 nt, Human
acaugcaugucuaugggcaggu

SEQ ID NO: 1132436 - RNA, 22 nt, Human
caggaacagcaccaggagcuag

SEQ ID NO: 1132437 - RNA, 22 nt, Human
ggagccuguggcugcuugaagc

SEQ ID NO: 1132438 - RNA, 22 nt, Human
uuuugaaagggugauuuggcuu

SEQ ID NO: 1132439 - RNA, 22 nt, Human
aaagccuugcccgucacuggga

SEQ ID NO: 1132440 - RNA, 22 nt, Human
ggaggccaaggugggcggauca

SEQ ID NO: 1132441 - RNA, 22 nt, Human
gagagcugggggacuguggaug

SEQ ID NO: 1132442 - RNA, 22 nt, Human
agccaggaaugcaugcucugcu

SEQ ID NO: 1132443 - RNA, 22 nt, Human
uagccaggcgaggucagugucg

SEQ ID NO: 1132444 - RNA, 22 nt, Human
gguggcaggcccugagcauccc

SEQ ID NO: 1132445 - RNA, 22 nt, Human
cugcucuggucucuucauguuu

SEQ ID NO: 1132446 - RNA, 22 nt, Human
agugaaaucagguuuugacugc

SEQ ID NO: 1132447 - RNA, 22 nt, Human
uuuuccucuguuauuaguguga

SEQ ID NO: 1132448 - RNA, 23 nt, Human
ugggcaucuccucugugccaggc

SEQ ID NO: 1132449 - RNA, 22 nt, Human
gcagcguggggacaggagcuca

SEQ ID NO: 1132450 - RNA, 22 nt, Human
cugucuccagggcaggugcagg

SEQ ID NO: 1132451 - RNA, 22 nt, Human
cuggcuccacucccugccugac

SEQ ID NO: 1132452 - RNA, 22 nt, Human
aaauguauugcauaggauauuu

SEQ ID NO: 1132453 - RNA, 22 nt, Human
cccagcagccagaaugaggagc

SEQ ID NO: 1132454 - RNA, 22 nt, Human
ggugaagggugucauggcauuu

SEQ ID NO: 1132455 - RNA, 22 nt, Human
gggcaagcucuucagaagcucu

SEQ ID NO: 1132456 - RNA, 18 nt, Human
cugcugcaggcacucagg

SEQ ID NO: 1132457 - RNA, 22 nt, Human
aucagcaagcauuuauugagug

SEQ ID NO: 1132458 - RNA, 22 nt, Human
agcagagcuauucuugugcaau

SEQ ID NO: 1132459 - RNA, 22 nt, Human
cccaggcagucuggcucuaaag

SEQ ID NO: 1132460 - RNA, 22 nt, Human
ugccagcccaccuuggggccuc

SEQ ID NO: 1132461 - RNA, 22 nt, Human
gcaguggauccaaugguaucuu

SEQ ID NO: 1132462 - RNA, 22 nt, Human
acaaggaggucuggggggcccu

SEQ ID NO: 1132463 - RNA, 22 nt, Human
aguuuguaucaauuugcuuuau

SEQ ID NO: 1132464 - RNA, 22 nt, Human
uucauuacugcgguagucacac

SEQ ID NO: 1132465 - RNA, 22 nt, Human
cuguuuucaaagagagagaaug

SEQ ID NO: 1132466 - RNA, 22 nt, Human
augcccaaugucacaauuuuug

SEQ ID NO: 1132467 - RNA, 22 nt, Human
aaaugugcuugugaucagcugu

SEQ ID NO: 1132468 - RNA, 22 nt, Human
ucagaggagaaguugggaaaau

SEQ ID NO: 1132469 - RNA, 20 nt, Human
aacagggggcugcagagggc

SEQ ID NO: 1132470 - RNA, 22 nt, Human
ccagggcagccaacccagaugc

SEQ ID NO: 1132471 - RNA, 20 nt, Human
ccuggcuuugcaucugugau

SEQ ID NO: 1132472 - RNA, 22 nt, Human
cuggagccacugggucuuguau

SEQ ID NO: 1132473 - RNA, 22 nt, Human
aaaugcagaucccugaaucuca

SEQ ID NO: 1132474 - RNA, 21 nt, Human
ugccagcauuaaacagucauu

SEQ ID NO: 1132475 - RNA, 22 nt, Human
caagggcucuuuugaggaaugu

SEQ ID NO: 1132476 - RNA, 22 nt, Human
ugcugccacauuuaaagagggg

SEQ ID NO: 1132477 - RNA, 22 nt, Human
uaucuacaggugucagguaaga

SEQ ID NO: 1132478 - RNA, 19 nt, Human
uauguguguguauuuacau

SEQ ID NO: 1132479 - RNA, 22 nt, Human
ggccucgcggcuucugguggcu

SEQ ID NO: 1132480 - RNA, 22 nt, Human
ccagcuuguuugaagcucguca

SEQ ID NO: 1132481 - RNA, 17 nt, Human
uccuggcucugccacug

SEQ ID NO: 1132482 - RNA, 22 nt, Human
uggcucagauuuuuguaggcuu

SEQ ID NO: 1132483 - RNA, 22 nt, Human
gcccucucuucugcagccucca

SEQ ID NO: 1132484 - RNA, 22 nt, Human
ggcccaaggcccaggucgagcu

SEQ ID NO: 1132485 - RNA, 22 nt, Human
ugucccagggaaggcccagcac

SEQ ID NO: 1132486 - RNA, 22 nt, Human
aagcugaggcccauggcaaggu

SEQ ID NO: 1132487 - RNA, 22 nt, Human
cagaguguaucuguguaagcau

SEQ ID NO: 1132488 - RNA, 22 nt, Human
ggugugccuggggcuuagcugc

SEQ ID NO: 1132489 - RNA, 22 nt, Human
uucuuucagaacacaagugauu

SEQ ID NO: 1132490 - RNA, 22 nt, Human
gugcuuucugcaugguuccuac

SEQ ID NO: 1132491 - RNA, 22 nt, Human
aagagcugcccaaggugaacag

SEQ ID NO: 1132492 - RNA, 22 nt, Human
gcugugcacuaccuauacaucc

SEQ ID NO: 1132493 - RNA, 20 nt, Human
uccugcaguuccuaggaggg

SEQ ID NO: 1132494 - RNA, 22 nt, Human
gcagggccagugcagagaggaa

SEQ ID NO: 1132495 - RNA, 22 nt, Human
uauguguguaugacagacagag

SEQ ID NO: 1132496 - RNA, 22 nt, Human
uauugacagagggucagaagag

SEQ ID NO: 1132497 - RNA, 19 nt, Human
uuagaaacuguugacacug

SEQ ID NO: 1132498 - RNA, 22 nt, Human
guaacagaaagucaugcucauu

SEQ ID NO: 1132499 - RNA, 22 nt, Human
ucucagagauucagggagaagu

SEQ ID NO: 1132500 - RNA, 21 nt, Human
cuguuucuugugaagugacac

SEQ ID NO: 1132501 - RNA, 19 nt, Human
ucauaaggagagaggaaau

SEQ ID NO: 1132502 - RNA, 22 nt, Human
cagggcuggcucaugaaaaguu

SEQ ID NO: 1132503 - RNA, 20 nt, Human
cugagcgucuaagaggugag

SEQ ID NO: 1132504 - RNA, 22 nt, Human
ucaaugaugcugaagguagcgu

SEQ ID NO: 1132505 - RNA, 22 nt, Human
agggacugagcuaggaucuagu

SEQ ID NO: 1132506 - RNA, 22 nt, Human
acauuugagaugccuuuuaggu

SEQ ID NO: 1132507 - RNA, 22 nt, Human
uucucauucugacucaguguag

SEQ ID NO: 1132508 - RNA, 22 nt, Human
ucucucagggggaaggcugaag

SEQ ID NO: 1132509 - RNA, 22 nt, Human
cugcaggggccucgagcacagg

SEQ ID NO: 1132510 - RNA, 22 nt, Human
ggagucagccugucagagugua

SEQ ID NO: 1132511 - RNA, 22 nt, Human
agggcugcuauguugauucaga

SEQ ID NO: 1132512 - RNA, 22 nt, Human
ugcucccaggcucuguggucug

SEQ ID NO: 1132513 - RNA, 22 nt, Human
gcagggacagggcagggccuuu

SEQ ID NO: 1132514 - RNA, 22 nt, Human
ggccugaggcgucccagcugug

SEQ ID NO: 1132515 - RNA, 22 nt, Human
cuacauuuugugauuaugaaau

SEQ ID NO: 1132516 - RNA, 22 nt, Human
acauacuaugaauacauguguc

SEQ ID NO: 1132517 - RNA, 23 nt, Human
agccucuuuucuccugcccugca

SEQ ID NO: 1132518 - RNA, 22 nt, Human
uggcucagaaggcugccuucac

SEQ ID NO: 1132519 - RNA, 22 nt, Human
ggcugaguugagaggauuacuu

SEQ ID NO: 1132520 - RNA, 22 nt, Human
aggugcagaaaaaaguccuuua

SEQ ID NO: 1132521 - RNA, 20 nt, Human
gugcauuucaccuguacugu

SEQ ID NO: 1132522 - RNA, 21 nt, Human
agaaauguaucauucuuuucc

SEQ ID NO: 1132523 - RNA, 22 nt, Human
aaguguauauaugacuuauaaa

SEQ ID NO: 1132524 - RNA, 22 nt, Human
aaaugcacucugcuucugugac

SEQ ID NO: 1132525 - RNA, 22 nt, Human
agaaaucaauaucuauauguug

SEQ ID NO: 1132526 - RNA, 22 nt, Human
uguccucaaggagcuucagucu

SEQ ID NO: 1132527 - RNA, 22 nt, Human
cccuggaggcaaagguugcagu

SEQ ID NO: 1132528 - RNA, 22 nt, Human
gcugucaccaaagcaggcacug

SEQ ID NO: 1132529 - RNA, 22 nt, Human
acaggcuuacaggcugcaagua

SEQ ID NO: 1132530 - RNA, 22 nt, Human
ugggcagaggcagcagaaaccu

SEQ ID NO: 1132531 - RNA, 22 nt, Human
gcagcuggggccacacuuaggc

SEQ ID NO: 1132532 - RNA, 22 nt, Human
uggagcugguaaacagugacau

SEQ ID NO: 1132533 - RNA, 22 nt, Human
guggcuucacauggcauuuggc

SEQ ID NO: 1132534 - RNA, 22 nt, Human
gagagcuggccagcuucaguau

SEQ ID NO: 1132535 - RNA, 22 nt, Human
aggccugaaguguggagugggg

SEQ ID NO: 1132536 - RNA, 20 nt, Human
caaugcacacagcugcuucu

SEQ ID NO: 1132537 - RNA, 22 nt, Human
cagguggcuucucccuaggcca

SEQ ID NO: 1132538 - RNA, 22 nt, Human
gggucagcugcugggggcugac

SEQ ID NO: 1132539 - RNA, 22 nt, Human
agacagcauggagcugauaaca

SEQ ID NO: 1132540 - RNA, 22 nt, Human
aggagaguucacacuggucaga

SEQ ID NO: 1132541 - RNA, 22 nt, Human
gcucccucugcucaggcacuug

SEQ ID NO: 1132542 - RNA, 22 nt, Human
uuaacagacauauauauuugua

SEQ ID NO: 1132543 - RNA, 22 nt, Human
agaugaaaagauaagcagcaau

SEQ ID NO: 1132544 - RNA, 22 nt, Human
caguagcauguaauaaagacag

SEQ ID NO: 1132545 - RNA, 22 nt, Human
cucuuccucucaugcggucaua

SEQ ID NO: 1132546 - RNA, 22 nt, Human
cccagcucugcagaccugcccu

SEQ ID NO: 1132547 - RNA, 22 nt, Human
uucacauugguucuugauagcu

SEQ ID NO: 1132548 - RNA, 22 nt, Human
agauuuagacugccuuaaucau

SEQ ID NO: 1132549 - RNA, 22 nt, Human
cuggucugagggcucuugaggc

SEQ ID NO: 1132550 - RNA, 22 nt, Human
aggcccagggcugcucucugaa

SEQ ID NO: 1132551 - RNA, 18 nt, Human
uuccauaauguauguaac

SEQ ID NO: 1132552 - RNA, 22 nt, Human
gagaaccucuccacaagucugg

SEQ ID NO: 1132553 - RNA, 22 nt, Human
ugcuugggaauguggagucaga

SEQ ID NO: 1132554 - RNA, 22 nt, Human
aggaagcccuugucauuucugu

SEQ ID NO: 1132555 - RNA, 22 nt, Human
uccuucagcuuauuucuuagga

SEQ ID NO: 1132556 - RNA, 22 nt, Human
cagcagaggaaagcaaaucuaa

SEQ ID NO: 1132557 - RNA, 22 nt, Human
ugggcaggaugcguugauucuu

SEQ ID NO: 1132558 - RNA, 18 nt, Human
acaaaggucugcaagacc

SEQ ID NO: 1132559 - RNA, 22 nt, Human
ucccugggcaucacguugcuuc

SEQ ID NO: 1132560 - RNA, 22 nt, Human
gcagcugcagguggucccaugc

SEQ ID NO: 1132561 - RNA, 22 nt, Human
acagagcauauaaagugcuuug

SEQ ID NO: 1132562 - RNA, 22 nt, Human
auccugggcagugugucacucu

SEQ ID NO: 1132563 - RNA, 22 nt, Human
ucagagugcagcgggaggcugg

SEQ ID NO: 1132564 - RNA, 22 nt, Human
gaaggcuggcuuucugagagca

SEQ ID NO: 1132565 - RNA, 22 nt, Human
agagcuggacgucugagcccua

SEQ ID NO: 1132566 - RNA, 22 nt, Human
caggagacuauggcccaaggcc

SEQ ID NO: 1132567 - RNA, 22 nt, Human
cagaaauguucuaaugauucag

SEQ ID NO: 1132568 - RNA, 22 nt, Human
gcagauggaaagugcuugaggg

SEQ ID NO: 1132569 - RNA, 19 nt, Human
gcuggggccugaccagaca

SEQ ID NO: 1132570 - RNA, 22 nt, Human
cuggggcccaucgagggcugag

SEQ ID NO: 1132571 - RNA, 22 nt, Human
cugugcuucgcaacuccaaggu

SEQ ID NO: 1132572 - RNA, 22 nt, Human
aucucagggcuggagcccugga

SEQ ID NO: 1132573 - RNA, 22 nt, Human
caccagcuuugcccacugccca

SEQ ID NO: 1132574 - RNA, 22 nt, Human
gcugcuucucugauggagucca

SEQ ID NO: 1132575 - RNA, 22 nt, Human
cucugcaggggaggcaugcacu

SEQ ID NO: 1132576 - RNA, 22 nt, Human
gcucccugcagcugagaguucc

SEQ ID NO: 1132577 - RNA, 22 nt, Human
aagggcagggaguuugugucua

SEQ ID NO: 1132578 - RNA, 22 nt, Human
acaauguaggauauguacuugu

SEQ ID NO: 1132579 - RNA, 20 nt, Human
aauuuacucacagaaugaau

SEQ ID NO: 1132580 - RNA, 22 nt, Human
ggcucagggaaugaggaagaau

SEQ ID NO: 1132581 - RNA, 22 nt, Human
uggccuccccuaacagccucuu

SEQ ID NO: 1132582 - RNA, 22 nt, Human
aauaauguugacgauagucuua

SEQ ID NO: 1132583 - RNA, 22 nt, Human
gcuggcuuugcacugggugcau

SEQ ID NO: 1132584 - RNA, 20 nt, Human
gugugugcuccaugcaugcu

SEQ ID NO: 1132585 - RNA, 22 nt, Human
gagaggaguaggcugauggugc

SEQ ID NO: 1132586 - RNA, 22 nt, Human
auaaguucagguaaagaaauca

SEQ ID NO: 1132587 - RNA, 22 nt, Human
cagcuggcgggcagagccgcca

SEQ ID NO: 1132588 - RNA, 22 nt, Human
ggcugcuuuaucggcugcugaa

SEQ ID NO: 1132589 - RNA, 22 nt, Human
ggcuccuguccuccuggagcuc

SEQ ID NO: 1132590 - RNA, 22 nt, Human
cuggcucaggguggucuggguc

SEQ ID NO: 1132591 - RNA, 17 nt, Human
agguggcugcugcgccu

SEQ ID NO: 1132592 - RNA, 22 nt, Human
cuggcucaauaaauauuagcug

SEQ ID NO: 1132593 - RNA, 22 nt, Human
aguuuuucugggaggcacugcu

SEQ ID NO: 1132594 - RNA, 22 nt, Human
aagaggaagucuccauggagag

SEQ ID NO: 1132595 - RNA, 22 nt, Human
augcuuuuccuaaaaugaugcc

SEQ ID NO: 1132596 - RNA, 22 nt, Human
gagggcugcaaugagacagaga

SEQ ID NO: 1132597 - RNA, 22 nt, Human
uugcuuccaguccaagucuguu

SEQ ID NO: 1132598 - RNA, 22 nt, Human
ucaggcagaugcagggauggau

SEQ ID NO: 1132599 - RNA, 22 nt, Human
cugggagguggagguugcauug

SEQ ID NO: 1132600 - RNA, 22 nt, Human
aggccugaggaccagauaaaug

SEQ ID NO: 1132601 - RNA, 22 nt, Human
ugucuccucauacugucauauu

SEQ ID NO: 1132602 - RNA, 22 nt, Human
auggaaagggaagcaaggaaca

SEQ ID NO: 1132603 - RNA, 22 nt, Human
ccuggcaguggugaagaagagg

SEQ ID NO: 1132604 - RNA, 22 nt, Human
uggcucaggagggaucuuugcu

SEQ ID NO: 1132605 - RNA, 22 nt, Human
guuuccauggcucuguuaaugg

SEQ ID NO: 1132606 - RNA, 22 nt, Human
ggagggugcauuuuacccugug

SEQ ID NO: 1132607 - RNA, 22 nt, Human
ugcccacaggaagacaccagcg

SEQ ID NO: 1132608 - RNA, 22 nt, Human
cugccuggaaugccagcuucuc

SEQ ID NO: 1132609 - RNA, 22 nt, Human
ugggcagaaggaagagccaccu

SEQ ID NO: 1132610 - RNA, 22 nt, Human
agaaauaugcugauuagaugaa

SEQ ID NO: 1132611 - RNA, 22 nt, Human
ucuguggcacgauugcacugca

SEQ ID NO: 1132612 - RNA, 22 nt, Human
gcugcaggagcuggagcugugg

SEQ ID NO: 1132613 - RNA, 20 nt, Human
uacuuaggcuuguuuuggcc

SEQ ID NO: 1132614 - RNA, 22 nt, Human
ugggcugcggauaggccucgga

SEQ ID NO: 1132615 - RNA, 22 nt, Human
augucuuuauaaauguauaaug

SEQ ID NO: 1132616 - RNA, 22 nt, Human
agggcugcaggcaagauauggc

SEQ ID NO: 1132617 - RNA, 22 nt, Human
aggcaguguguagcuggaagag

SEQ ID NO: 1132618 - RNA, 22 nt, Human
gaaaguuuauagguuauauaau

SEQ ID NO: 1132619 - RNA, 22 nt, Human
agccucucuccagcuuggcaga

SEQ ID NO: 1132620 - RNA, 22 nt, Human
gcccugagacugagcauggguu

SEQ ID NO: 1132621 - RNA, 22 nt, Human
gagcugugagggacacauugcu

SEQ ID NO: 1132622 - RNA, 22 nt, Human
uuucagauggagguuuaggaca

SEQ ID NO: 1132623 - RNA, 22 nt, Human
cugcucuguuaauuaaacuuug

SEQ ID NO: 1132624 - RNA, 22 nt, Human
ucucaggggccuggaguccugg

SEQ ID NO: 1132625 - RNA, 22 nt, Human
guggccucugugcuccugccua

SEQ ID NO: 1132626 - RNA, 20 nt, Human
cccucugcacauggcugugg

SEQ ID NO: 1132627 - RNA, 22 nt, Human
uggcuuaucacauuguccaugg

SEQ ID NO: 1132628 - RNA, 22 nt, Human
gcaaaugcucuccuuggucagg

SEQ ID NO: 1132629 - RNA, 22 nt, Human
gccagggaggcuguaggguccu

SEQ ID NO: 1132630 - RNA, 22 nt, Human
uccagaguacggaagagucauc

SEQ ID NO: 1132631 - RNA, 22 nt, Human
guuguauucuucaauaucagag

SEQ ID NO: 1132632 - RNA, 23 nt, Human
uggggccaagugaggaagggucu

SEQ ID NO: 1132633 - RNA, 22 nt, Human
gauggcacacagacauccccgc

SEQ ID NO: 1132634 - RNA, 22 nt, Human
aguuuuucuccccuggcuucau

SEQ ID NO: 1132635 - RNA, 22 nt, Human
cugcugcugcuaucuacccagg

SEQ ID NO: 1132636 - RNA, 22 nt, Human
gaaaucugaaucuucuguuggu

SEQ ID NO: 1132637 - RNA, 22 nt, Human
ucuuucucucuaaucaagcaca

SEQ ID NO: 1132638 - RNA, 22 nt, Human
uuuucuaacaucuaguaauuug

SEQ ID NO: 1132639 - RNA, 20 nt, Human
ucugcucagcccucaguggc

SEQ ID NO: 1132640 - RNA, 22 nt, Human
aagcugcccuguguuagaguuc

SEQ ID NO: 1132641 - RNA, 22 nt, Human
acuggaagccaguugacaauca

SEQ ID NO: 1132642 - RNA, 22 nt, Human
gugacagaguuuuagaucucau

SEQ ID NO: 1132643 - RNA, 22 nt, Human
gcugucugcaagccaggaaaug

SEQ ID NO: 1132644 - RNA, 22 nt, Human
cucuucagauaaaagggauauu

SEQ ID NO: 1132645 - RNA, 22 nt, Human
uuugcauuucuaaugagcuccg

SEQ ID NO: 1132646 - RNA, 22 nt, Human
gcagggcucaacaggacacccc

SEQ ID NO: 1132647 - RNA, 22 nt, Human
agggcacaagacucugagcccc

SEQ ID NO: 1132648 - RNA, 22 nt, Human
gcacugcagguggguggagagg

SEQ ID NO: 1132649 - RNA, 22 nt, Human
cuggggcugcagcgaucuucau

SEQ ID NO: 1132650 - RNA, 22 nt, Human
ccagagcugcauccagcagguu

SEQ ID NO: 1132651 - RNA, 22 nt, Human
gcucagagauggggaaugaaaa

SEQ ID NO: 1132652 - RNA, 18 nt, Human
ccgggcuuuggugacaca

SEQ ID NO: 1132653 - RNA, 22 nt, Human
ugaaggcauugaugaaggaauc

SEQ ID NO: 1132654 - RNA, 22 nt, Human
ucagagugggagaaugugccaa

SEQ ID NO: 1132655 - RNA, 22 nt, Human
uccuugaagcuuguaucuaaua

SEQ ID NO: 1132656 - RNA, 22 nt, Human
uagcacauaacuuagaauaguu

SEQ ID NO: 1132657 - RNA, 22 nt, Human
ggcucugguugaccaugauggc

SEQ ID NO: 1132658 - RNA, 22 nt, Human
guuccauaucacagcagacgaa

SEQ ID NO: 1132659 - RNA, 21 nt, Human
uugaagcaaggguggcucuga

SEQ ID NO: 1132660 - RNA, 21 nt, Human
ugguacaccuugccugucaga

SEQ ID NO: 1132661 - RNA, 22 nt, Human
gccugcagauauauaggauggu

SEQ ID NO: 1132662 - RNA, 19 nt, Human
cagagccucagagcuagaa

SEQ ID NO: 1132663 - RNA, 22 nt, Human
agcaauauuucagcuagcaggu

SEQ ID NO: 1132664 - RNA, 22 nt, Human
caggggccggcuguccgugccc

SEQ ID NO: 1132665 - RNA, 22 nt, Human
ugccagugggugugcagagacu

SEQ ID NO: 1132666 - RNA, 22 nt, Human
ugcauugcauuugucaugaaga

SEQ ID NO: 1132667 - RNA, 23 nt, Human
ugcucccaggugacgcugcuguu

SEQ ID NO: 1132668 - RNA, 22 nt, Human
cugagcucuaaugucagccuug

SEQ ID NO: 1132669 - RNA, 22 nt, Human
gaggcccaguccugcaagcacg

SEQ ID NO: 1132670 - RNA, 21 nt, Human
uaucuacuggugucuuucaga

SEQ ID NO: 1132671 - RNA, 22 nt, Human
gcacagccagcaucugagggau

SEQ ID NO: 1132672 - RNA, 22 nt, Human
cagcagugucuccagcaucaca

SEQ ID NO: 1132673 - RNA, 22 nt, Human
gggauggacuuggggacuccag

SEQ ID NO: 1132674 - RNA, 22 nt, Human
uuuggaaaguguacaaauuuga

SEQ ID NO: 1132675 - RNA, 22 nt, Human
cuucagaacuauaaaaaguacu

SEQ ID NO: 1132676 - RNA, 22 nt, Human
cagggccacuguagaugaggag

SEQ ID NO: 1132677 - RNA, 22 nt, Human
cugaaggauguguggugggagu

SEQ ID NO: 1132678 - RNA, 22 nt, Human
uuacaguauuguuaaacucuuu

SEQ ID NO: 1132679 - RNA, 22 nt, Human
augggaggaagagaagaugucu

SEQ ID NO: 1132680 - RNA, 22 nt, Human
ggggcagaaagcccacagagug

SEQ ID NO: 1132681 - RNA, 22 nt, Human
ggcuagaauaauugacuucauu

SEQ ID NO: 1132682 - RNA, 22 nt, Human
ugucucaggcccaagccaguaa

SEQ ID NO: 1132683 - RNA, 22 nt, Human
gcugucuucacuuccugguuuc

SEQ ID NO: 1132684 - RNA, 22 nt, Human
ucuggagcuuguuucagauggu

SEQ ID NO: 1132685 - RNA, 22 nt, Human
cccagggacagcuagguggggc

SEQ ID NO: 1132686 - RNA, 21 nt, Human
aaguaaaucagagaaauaacc

SEQ ID NO: 1132687 - RNA, 17 nt, Human
uucucuuccuggauagu

SEQ ID NO: 1132688 - RNA, 22 nt, Human
guauguguaaguaugccaccuu

SEQ ID NO: 1132689 - RNA, 22 nt, Human
acacugcagaugaaagcauaag

SEQ ID NO: 1132690 - RNA, 22 nt, Human
agcugaguuaauucaucacuua

SEQ ID NO: 1132691 - RNA, 22 nt, Human
cagcuggcagaaccugcaucca

SEQ ID NO: 1132692 - RNA, 22 nt, Human
acagggcagugucuugaaaaau

SEQ ID NO: 1132693 - RNA, 22 nt, Human
uuaugaaagacauuucuguugg

SEQ ID NO: 1132694 - RNA, 22 nt, Human
uggcucagcugacucggcuucu

SEQ ID NO: 1132695 - RNA, 22 nt, Human
ugguggcuucugaggauggcga

SEQ ID NO: 1132696 - RNA, 22 nt, Human
aggauccuccuuagaaaagacc

SEQ ID NO: 1132697 - RNA, 22 nt, Human
cacagggccuggggcagcugcu

SEQ ID NO: 1132698 - RNA, 22 nt, Human
gggacaggccccucgcuagcuu

SEQ ID NO: 1132699 - RNA, 22 nt, Human
ccagcccuccuccaucagagga

SEQ ID NO: 1132700 - RNA, 22 nt, Human
uucaagauggcugcaaauacuu

SEQ ID NO: 1132701 - RNA, 22 nt, Human
gcaggagcagucaggggcagcu

SEQ ID NO: 1132702 - RNA, 22 nt, Human
aaguuugacagaaguuucuaau

SEQ ID NO: 1132703 - RNA, 22 nt, Human
gaaaauguuuguccggagcuga

SEQ ID NO: 1132704 - RNA, 22 nt, Human
ugcuggagaucauuaauguuca

SEQ ID NO: 1132705 - RNA, 22 nt, Human
acugugcuuucucuggaggcau

SEQ ID NO: 1132706 - RNA, 22 nt, Human
cugggaggcaccgcgucgugcu

SEQ ID NO: 1132707 - RNA, 22 nt, Human
guccucugaaguugugcaaugc

SEQ ID NO: 1132708 - RNA, 19 nt, Human
ggccuggauuuagggcucc

SEQ ID NO: 1132709 - RNA, 22 nt, Human
gcaggagcccuggcauguucuu

SEQ ID NO: 1132710 - RNA, 22 nt, Human
ucacaugcccuguauuuaccag

SEQ ID NO: 1132711 - RNA, 22 nt, Human
cccaggaggucgaagcugcagu

SEQ ID NO: 1132712 - RNA, 22 nt, Human
cccagaaggucgaggcugcagu

SEQ ID NO: 1132713 - RNA, 22 nt, Human
caucacugacgcugagauucca

SEQ ID NO: 1132714 - RNA, 22 nt, Human
uaaaugcaaugugcuuuaccag

SEQ ID NO: 1132715 - RNA, 22 nt, Human
acugcuuuucagagucugccug

SEQ ID NO: 1132716 - RNA, 22 nt, Human
ucuuacauauagcaugaguaca

SEQ ID NO: 1132717 - RNA, 22 nt, Human
aaauugcaaaaguacuuuuagg

SEQ ID NO: 1132718 - RNA, 22 nt, Human
uggcagcagggaggccaguguu

SEQ ID NO: 1132719 - RNA, 19 nt, Human
caggagagcaugcacuuug

SEQ ID NO: 1132720 - RNA, 22 nt, Human
cagcaucuaaucuucaugccgg

SEQ ID NO: 1132721 - RNA, 22 nt, Human
ccauaaggagccagacauucca

SEQ ID NO: 1132722 - RNA, 22 nt, Human
ugcauuccuccaccuccugcac

SEQ ID NO: 1132723 - RNA, 22 nt, Human
ugucccagacauaaguggacau

SEQ ID NO: 1132724 - RNA, 22 nt, Human
gcaggugggggucggugcaucu

SEQ ID NO: 1132725 - RNA, 22 nt, Human
agaagccauucccuguaggcuc

SEQ ID NO: 1132726 - RNA, 22 nt, Human
uccugucugucuuuggucccuu

SEQ ID NO: 1132727 - RNA, 22 nt, Human
cugucccagauguucucagcac

SEQ ID NO: 1132728 - RNA, 22 nt, Human
agccucugacugucagcaaggu

SEQ ID NO: 1132729 - RNA, 22 nt, Human
ccuguccuccaagagcacaucu

SEQ ID NO: 1132730 - RNA, 22 nt, Human
agugacucacuagcucucagug

SEQ ID NO: 1132731 - RNA, 22 nt, Human
agccuggauccuaggcucagcu

SEQ ID NO: 1132732 - RNA, 22 nt, Human
aucuucaacuugaucauuugaa

SEQ ID NO: 1132733 - RNA, 22 nt, Human
acagaaauuagcagugaguuua

SEQ ID NO: 1132734 - RNA, 22 nt, Human
agcugggagcagagccacagcc

SEQ ID NO: 1132735 - RNA, 20 nt, Human
ccagacagcaccugccuggu

SEQ ID NO: 1132736 - RNA, 22 nt, Human
cagguggguacaucacagagac

SEQ ID NO: 1132737 - RNA, 22 nt, Human
uggagcagagaugguggccuuc

SEQ ID NO: 1132738 - RNA, 22 nt, Human
uuagaaaacauaagugguaaag

SEQ ID NO: 1132739 - RNA, 22 nt, Human
aggagaaggaagugcaucacua

SEQ ID NO: 1132740 - RNA, 22 nt, Human
gcaggcaguuauuuaguagaau

SEQ ID NO: 1132741 - RNA, 22 nt, Human
cugggaggcggagguuguagug

SEQ ID NO: 1132742 - RNA, 22 nt, Human
uuucauguuuucuuaaauggca

SEQ ID NO: 1132743 - RNA, 22 nt, Human
uggcugggccgggccuugugcc

SEQ ID NO: 1132744 - RNA, 22 nt, Human
aauguuguuuuucugcaugucu

SEQ ID NO: 1132745 - RNA, 18 nt, Human
acagaggcagacauguau

SEQ ID NO: 1132746 - RNA, 22 nt, Human
aguaggaggcgggagcaugaag

SEQ ID NO: 1132747 - RNA, 22 nt, Human
cuuauguaaacuacagauaaua

SEQ ID NO: 1132748 - RNA, 22 nt, Human
gucccaggcagagucaggaggg

SEQ ID NO: 1132749 - RNA, 22 nt, Human
gaaaagcuaggccaguucagcu

SEQ ID NO: 1132750 - RNA, 20 nt, Human
gccagcccugacacaggagc

SEQ ID NO: 1132751 - RNA, 22 nt, Human
gggcacugaaugccaagcuagg

SEQ ID NO: 1132752 - RNA, 22 nt, Human
ucucagagauuuuguuucccuu

SEQ ID NO: 1132753 - RNA, 22 nt, Human
uguggcugucuguucuccuagg

SEQ ID NO: 1132754 - RNA, 23 nt, Human
ccaaagucgaagucuaguccaga

SEQ ID NO: 1132755 - RNA, 22 nt, Human
ucuuagaaugucaacugauguu

SEQ ID NO: 1132756 - RNA, 22 nt, Human
ggaagaagggucauuggcagcc

SEQ ID NO: 1132757 - RNA, 20 nt, Human
ccugccuguguuugugauga

SEQ ID NO: 1132758 - RNA, 22 nt, Human
gaaguucaggugggaauugagc

SEQ ID NO: 1132759 - RNA, 22 nt, Human
cauugucacccaaagcucauag

SEQ ID NO: 1132760 - RNA, 22 nt, Human
agucccagcucagaaccacuag

SEQ ID NO: 1132761 - RNA, 22 nt, Human
auguuucuaguuguaugucacu

SEQ ID NO: 1132762 - RNA, 22 nt, Human
augauugaccaucugcugggcu

SEQ ID NO: 1132763 - RNA, 22 nt, Human
aggggcucaguuacuuuggcag

SEQ ID NO: 1132764 - RNA, 17 nt, Human
ggcagcugccacuuuuu

SEQ ID NO: 1132765 - RNA, 22 nt, Human
ugagcuguagcagaugcuguug

SEQ ID NO: 1132766 - RNA, 22 nt, Human
gucccaggcuuauguggagcuu

SEQ ID NO: 1132767 - RNA, 22 nt, Human
caggugcugcguggcggagcug

SEQ ID NO: 1132768 - RNA, 22 nt, Human
guacauuuuacuuuguuugaau

SEQ ID NO: 1132769 - RNA, 22 nt, Human
uuuuuccaccguacuuccugag

SEQ ID NO: 1132770 - RNA, 22 nt, Human
ucacuugccuagcccaguucag

SEQ ID NO: 1132771 - RNA, 22 nt, Human
cacugccuggaaggagagacau

SEQ ID NO: 1132772 - RNA, 22 nt, Human
aauuaacaaauguagcugugau

SEQ ID NO: 1132773 - RNA, 18 nt, Human
acauuucuaggugaaagc

SEQ ID NO: 1132774 - RNA, 22 nt, Human
ugggaggcagguaggugaugau

SEQ ID NO: 1132775 - RNA, 22 nt, Human
auugaaagauaggcuacugugg

SEQ ID NO: 1132776 - RNA, 22 nt, Human
ggucccagcuggucacugucag

SEQ ID NO: 1132777 - RNA, 22 nt, Human
cagagccaaaccucagggcccg

SEQ ID NO: 1132778 - RNA, 22 nt, Human
cuggcagcuggaggcuagaggc

SEQ ID NO: 1132779 - RNA, 22 nt, Human
acagccaggagccaugggcagg

SEQ ID NO: 1132780 - RNA, 20 nt, Human
ccaccuggccaaggcugugc

SEQ ID NO: 1132781 - RNA, 23 nt, Human
ucacacagcuggucagguacaga

SEQ ID NO: 1132782 - RNA, 22 nt, Human
guauuugauacaugaaauggug

SEQ ID NO: 1132783 - RNA, 22 nt, Human
agaggggcucauauccugucau

SEQ ID NO: 1132784 - RNA, 22 nt, Human
agggagcugcucugcuuccgug

SEQ ID NO: 1132785 - RNA, 18 nt, Human
uucacaggaaaugucuuu

SEQ ID NO: 1132786 - RNA, 19 nt, Human
gccugccuggguuucugag

SEQ ID NO: 1132787 - RNA, 22 nt, Human
cuggcucaugugaugagggcaa

SEQ ID NO: 1132788 - RNA, 22 nt, Human
agauuucagguuggggcagaag

SEQ ID NO: 1132789 - RNA, 22 nt, Human
ucaacacuauccaggcaaucuu

SEQ ID NO: 1132790 - RNA, 22 nt, Human
acugucuuccaggucuggaggu

SEQ ID NO: 1132791 - RNA, 22 nt, Human
gggacagaaggaagugagcaca

SEQ ID NO: 1132792 - RNA, 22 nt, Human
ggcucugcuucagaaggcucau

SEQ ID NO: 1132793 - RNA, 22 nt, Human
cugagccuuauucaccagcccu

SEQ ID NO: 1132794 - RNA, 22 nt, Human
aaagauuuaugaaguucaauua

SEQ ID NO: 1132795 - RNA, 22 nt, Human
cagcugcccaagccccagaugu

SEQ ID NO: 1132796 - RNA, 22 nt, Human
ccugucugcaugaucccugcca

SEQ ID NO: 1132797 - RNA, 22 nt, Human
aggagccaggaaaccugcucug

SEQ ID NO: 1132798 - RNA, 22 nt, Human
gccagguggcugagcagcugca

SEQ ID NO: 1132799 - RNA, 22 nt, Human
aucuuugaagaggacuugaagu

SEQ ID NO: 1132800 - RNA, 22 nt, Human
gaaaucugcuucuugcauagua

SEQ ID NO: 1132801 - RNA, 22 nt, Human
gccugcagggugaugggcugcc

SEQ ID NO: 1132802 - RNA, 22 nt, Human
ggcugcugggaauaugccagcu

SEQ ID NO: 1132803 - RNA, 21 nt, Human
cagaggccucaugcucugugc

SEQ ID NO: 1132804 - RNA, 22 nt, Human
ggcccaucucuugcucuggguu

SEQ ID NO: 1132805 - RNA, 21 nt, Human
gcagccagacgggauucaguu

SEQ ID NO: 1132806 - RNA, 22 nt, Human
gucccuaguggaaagacaugau

SEQ ID NO: 1132807 - RNA, 22 nt, Human
cugucagcacucuacuacagau

SEQ ID NO: 1132808 - RNA, 22 nt, Human
cuugugcauuucauuccucagg

SEQ ID NO: 1132809 - RNA, 22 nt, Human
agaauucuggaguugggaggaa

SEQ ID NO: 1132810 - RNA, 22 nt, Human
gugugcaugcauagacaccaca

SEQ ID NO: 1132811 - RNA, 22 nt, Human
uuucaauguaugucuuucugag

SEQ ID NO: 1132812 - RNA, 22 nt, Human
uaaaugugcacagguuagaagg

SEQ ID NO: 1132813 - RNA, 22 nt, Human
aggccugacuugaauuuagggc

SEQ ID NO: 1132814 - RNA, 22 nt, Human
cuccucccucuuugccacacau

SEQ ID NO: 1132815 - RNA, 22 nt, Human
uggaggcaucagagugcuuggc

SEQ ID NO: 1132816 - RNA, 23 nt, Human
aguuccagaaaaaugcucaagca

SEQ ID NO: 1132817 - RNA, 22 nt, Human
agggugccugcugcagguucag

SEQ ID NO: 1132818 - RNA, 22 nt, Human
uuaggcaaugaauuauuccaag

SEQ ID NO: 1132819 - RNA, 22 nt, Human
ugucuagggagcugcucaggcu

SEQ ID NO: 1132820 - RNA, 22 nt, Human
ggcuggagauaugucuggaaca

SEQ ID NO: 1132821 - RNA, 22 nt, Human
cuggcugcaggaaggagugggc

SEQ ID NO: 1132822 - RNA, 22 nt, Human
uacccagcuucaagucaggacu

SEQ ID NO: 1132823 - RNA, 22 nt, Human
cucucugaggaaggagcaucug

SEQ ID NO: 1132824 - RNA, 22 nt, Human
ugcugcucucagccaccaggaa

SEQ ID NO: 1132825 - RNA, 22 nt, Human
ugcugccucagcuuccugggcu

SEQ ID NO: 1132826 - RNA, 22 nt, Human
cuggccugagcacagcggcugc

SEQ ID NO: 1132827 - RNA, 22 nt, Human
gaggucagucagaccaggguuu

SEQ ID NO: 1132828 - RNA, 22 nt, Human
ugugugugcacaugcauauaca

SEQ ID NO: 1132829 - RNA, 22 nt, Human
caaaugcauaguuuauaagaag

SEQ ID NO: 1132830 - RNA, 22 nt, Human
ugguggccuugauggcaucugc

SEQ ID NO: 1132831 - RNA, 22 nt, Human
augggggccugaacaggcaaaa

SEQ ID NO: 1132832 - RNA, 20 nt, Human
ugcucaggauggagaggugu

SEQ ID NO: 1132833 - RNA, 22 nt, Human
gcagcugccgugagcucacgcc

SEQ ID NO: 1132834 - RNA, 22 nt, Human
cccaguccuaaagcagacgcca

SEQ ID NO: 1132835 - RNA, 22 nt, Human
auaaggcagugacuucaucuau

SEQ ID NO: 1132836 - RNA, 22 nt, Human
gcucagagcuugaaguuccacu

SEQ ID NO: 1132837 - RNA, 22 nt, Human
ccucacucugcacccugcagca

SEQ ID NO: 1132838 - RNA, 22 nt, Human
agcugcaggcccaugcucaguc

SEQ ID NO: 1132839 - RNA, 22 nt, Human
gagagcugcauucucagacaca

SEQ ID NO: 1132840 - RNA, 22 nt, Human
cagguaggauggaagggcucaa

SEQ ID NO: 1132841 - RNA, 22 nt, Human
gcaguggggcgcugggaguugg

SEQ ID NO: 1132842 - RNA, 22 nt, Human
aucagcaaguccuguuaauucu

SEQ ID NO: 1132843 - RNA, 22 nt, Human
gaaaucugaacaacagcuguca

SEQ ID NO: 1132844 - RNA, 22 nt, Human
gagugugggcacgggggccuug

SEQ ID NO: 1132845 - RNA, 22 nt, Human
cugccaaggcuggggaggacaa

SEQ ID NO: 1132846 - RNA, 22 nt, Human
uccagcagcccgaaggcccauc

SEQ ID NO: 1132847 - RNA, 22 nt, Human
agcuuccugaugcaagagggcu

SEQ ID NO: 1132848 - RNA, 22 nt, Human
ugggccugacucaccugccucc

SEQ ID NO: 1132849 - RNA, 22 nt, Human
ucuggcuccaggaccgggcaca

SEQ ID NO: 1132850 - RNA, 22 nt, Human
cucuugggagugcucuggagaa

SEQ ID NO: 1132851 - RNA, 22 nt, Human
agcagugggugacagagcugag

SEQ ID NO: 1132852 - RNA, 22 nt, Human
ugagcccagucugucugacaug

SEQ ID NO: 1132853 - RNA, 22 nt, Human
aggagucaggaccaaauggaaa

SEQ ID NO: 1132854 - RNA, 22 nt, Human
caugcacagugauaucugaaga

SEQ ID NO: 1132855 - RNA, 22 nt, Human
gggcuggagccagcuguggcug

SEQ ID NO: 1132856 - RNA, 22 nt, Human
guguccagggccguguugucuu

SEQ ID NO: 1132857 - RNA, 22 nt, Human
uuuauguaguuacggacuauca

SEQ ID NO: 1132858 - RNA, 21 nt, Human
auccuugaucagaagagugcu

SEQ ID NO: 1132859 - RNA, 22 nt, Human
cagggcagccaggccccguggg

SEQ ID NO: 1132860 - RNA, 21 nt, Human
cagagguggccugaccucuga

SEQ ID NO: 1132861 - RNA, 18 nt, Human
caggaugagugaugggga

SEQ ID NO: 1132862 - RNA, 22 nt, Human
auguccuucuccucuuaccugc

SEQ ID NO: 1132863 - RNA, 22 nt, Human
gguggagcuggaccaggagagg

SEQ ID NO: 1132864 - RNA, 22 nt, Human
ucaagcaggguagcaagcuggu

SEQ ID NO: 1132865 - RNA, 22 nt, Human
ccagcagcgauagggugagugc

SEQ ID NO: 1132866 - RNA, 22 nt, Human
gccuuccugcagcucugagcgu

SEQ ID NO: 1132867 - RNA, 22 nt, Human
gccuaggaguggggauggcggu

SEQ ID NO: 1132868 - RNA, 22 nt, Human
ucugaggcuucagacuguacug

SEQ ID NO: 1132869 - RNA, 22 nt, Human
gguugccggggcaggacuggaa

SEQ ID NO: 1132870 - RNA, 22 nt, Human
ugucccaguucccaggguugcu

SEQ ID NO: 1132871 - RNA, 22 nt, Human
gaaagaagcuuuagauggcuau

SEQ ID NO: 1132872 - RNA, 22 nt, Human
aagcagaauuucccacuaguug

SEQ ID NO: 1132873 - RNA, 22 nt, Human
aaaguuuccugcuaagugcuau

SEQ ID NO: 1132874 - RNA, 22 nt, Human
agccuggagaagauguguauug

SEQ ID NO: 1132875 - RNA, 22 nt, Human
caucagcaggcaacacucuugg

SEQ ID NO: 1132876 - RNA, 22 nt, Human
ucuggagcuggcagggcccugg

SEQ ID NO: 1132877 - RNA, 22 nt, Human
uggcuggcuuguucacugacug

SEQ ID NO: 1132878 - RNA, 22 nt, Human
gagugagggcagcaggggcugc

SEQ ID NO: 1132879 - RNA, 22 nt, Human
uucagugugugauaccugcugu

SEQ ID NO: 1132880 - RNA, 22 nt, Human
aggagcugaaacuucucauaug

SEQ ID NO: 1132881 - RNA, 22 nt, Human
aaauugugagcuauagaucuag

SEQ ID NO: 1132882 - RNA, 22 nt, Human
acuggcagccacaacuggcagg

SEQ ID NO: 1132883 - RNA, 22 nt, Human
cugggguggugcaggccucaug

SEQ ID NO: 1132884 - RNA, 22 nt, Human
cugucaucacaguugagcagcc

SEQ ID NO: 1132885 - RNA, 22 nt, Human
gcugcuuccuuuccugcugacc

SEQ ID NO: 1132886 - RNA, 22 nt, Human
gaggggcuggcacgauggcugc

SEQ ID NO: 1132887 - RNA, 22 nt, Human
cuggcucaauuuguacugcugu

SEQ ID NO: 1132888 - RNA, 22 nt, Human
cagaaugcaaauuuuauaauau

SEQ ID NO: 1132889 - RNA, 22 nt, Human
cuggagccuucaccaggggaaa

SEQ ID NO: 1132890 - RNA, 22 nt, Human
uggaggaugccauccaggauac

SEQ ID NO: 1132891 - RNA, 22 nt, Human
gccaggcauucuagaaguagug

SEQ ID NO: 1132892 - RNA, 19 nt, Human
uccauaagcuuguguucau

SEQ ID NO: 1132893 - RNA, 22 nt, Human
gcuggcugaggucuagcucuuu

SEQ ID NO: 1132894 - RNA, 23 nt, Human
ugcagccacucaggagcucagug

SEQ ID NO: 1132895 - RNA, 22 nt, Human
ccuggagcuuggucacgcugcg

SEQ ID NO: 1132896 - RNA, 22 nt, Human
cccuggagugccggaaucaaga

SEQ ID NO: 1132897 - RNA, 22 nt, Human
uuggcuuccaggaucucagcag

SEQ ID NO: 1132898 - RNA, 22 nt, Human
gcagugguggagcuuacauauc

SEQ ID NO: 1132899 - RNA, 22 nt, Human
accucaggauguggacacagaa

SEQ ID NO: 1132900 - RNA, 22 nt, Human
ccuggcugggccugauuucuca

SEQ ID NO: 1132901 - RNA, 22 nt, Human
agcccagcaaagggagguucag

SEQ ID NO: 1132902 - RNA, 22 nt, Human
cuggccuggcagggagggcaug

SEQ ID NO: 1132903 - RNA, 18 nt, Human
uccugccugcgggcuccc

SEQ ID NO: 1132904 - RNA, 22 nt, Human
aggagccaagcagaacuaagga

SEQ ID NO: 1132905 - RNA, 22 nt, Human
auaauuuaauuuucacaguggu

SEQ ID NO: 1132906 - RNA, 20 nt, Human
cccucccagaugcuucccaa

SEQ ID NO: 1132907 - RNA, 22 nt, Human
ggcuucugccacgagagggaag

SEQ ID NO: 1132908 - RNA, 22 nt, Human
gcagccacuuugcaaccaagag

SEQ ID NO: 1132909 - RNA, 22 nt, Human
gcuggcucagggacuagaguuu

SEQ ID NO: 1132910 - RNA, 22 nt, Human
cuuccucacggugcaacaggaa

SEQ ID NO: 1132911 - RNA, 22 nt, Human
uugaaggacauccuauuucuag

SEQ ID NO: 1132912 - RNA, 22 nt, Human
uccuggagccacggagcuuuca

SEQ ID NO: 1132913 - RNA, 22 nt, Human
uuuccucuuccgagggggaggc

SEQ ID NO: 1132914 - RNA, 22 nt, Human
gucuuguuugggauguggaugg

SEQ ID NO: 1132915 - RNA, 22 nt, Human
cagccaggagccucugcaacua

SEQ ID NO: 1132916 - RNA, 22 nt, Human
aagccuugcagcauuaggcucu

SEQ ID NO: 1132917 - RNA, 22 nt, Human
gaggcagaggaagguggucucu

SEQ ID NO: 1132918 - RNA, 22 nt, Human
ccaggagcaacuugaaggcaag

SEQ ID NO: 1132919 - RNA, 22 nt, Human
aagcccagcaucccugcaccag

SEQ ID NO: 1132920 - RNA, 22 nt, Human
gcuuuuucaaaugaaagcuggu

SEQ ID NO: 1132921 - RNA, 23 nt, Human
uccagcagccaagaaggguagaa

SEQ ID NO: 1132922 - RNA, 22 nt, Human
ugcagaagcugcaggucagugg

SEQ ID NO: 1132923 - RNA, 18 nt, Human
acaggccucaguccugca

SEQ ID NO: 1132924 - RNA, 22 nt, Human
ggucccaguugcccaggucagg

SEQ ID NO: 1132925 - RNA, 22 nt, Human
agccaggacguugcucagcucc

SEQ ID NO: 1132926 - RNA, 22 nt, Human
aaaguguacuaugucaugaaca

SEQ ID NO: 1132927 - RNA, 22 nt, Human
agcagcaggcuguguggacuga

SEQ ID NO: 1132928 - RNA, 22 nt, Human
cucucugagugagggacaagcu

SEQ ID NO: 1132929 - RNA, 22 nt, Human
ugugugcauucacaugcaugcc

SEQ ID NO: 1132930 - RNA, 22 nt, Human
gaggccagcgcgcagcacuuuu

SEQ ID NO: 1132931 - RNA, 22 nt, Human
augaugugugcugaucaagcuu

SEQ ID NO: 1132932 - RNA, 18 nt, Human
agcagaauucuaggguuc

SEQ ID NO: 1132933 - RNA, 22 nt, Human
ucagcaguggcucucaugcagu

SEQ ID NO: 1132934 - RNA, 22 nt, Human
agaaacuucagcuauucuuuug

SEQ ID NO: 1132935 - RNA, 22 nt, Human
cucugcagaauuugagcugcuc

SEQ ID NO: 1132936 - RNA, 22 nt, Human
cagugggugaugaguccugggg

SEQ ID NO: 1132937 - RNA, 22 nt, Human
cagaacauucacucauaugugg

SEQ ID NO: 1132938 - RNA, 22 nt, Human
gugauuccuauuaguacaugca

SEQ ID NO: 1132939 - RNA, 22 nt, Human
auaaggcagaaauagggaaagu

SEQ ID NO: 1132940 - RNA, 22 nt, Human
uugcucaggcuuagagcuacua

SEQ ID NO: 1132941 - RNA, 22 nt, Human
caaaaugugagucccaccucaa

SEQ ID NO: 1132942 - RNA, 22 nt, Human
gugggugauguacuggaggcca

SEQ ID NO: 1132943 - RNA, 22 nt, Human
gucagcugucuccccagagugg

SEQ ID NO: 1132944 - RNA, 22 nt, Human
agcagggggccacagucacagc

SEQ ID NO: 1132945 - RNA, 22 nt, Human
ggcugcagauagccagccacca

SEQ ID NO: 1132946 - RNA, 22 nt, Human
ccuuccaggugcaggcaagccu

SEQ ID NO: 1132947 - RNA, 22 nt, Human
acagagccuccaggagugcugg

SEQ ID NO: 1132948 - RNA, 22 nt, Human
gccagcagggcccaaaugcugg

SEQ ID NO: 1132949 - RNA, 22 nt, Human
cugccugcugccuguggagggu

SEQ ID NO: 1132950 - RNA, 22 nt, Human
gaaggcugaugacagauucugc

SEQ ID NO: 1132951 - RNA, 22 nt, Human
cagggcagggagcuuagaauga

SEQ ID NO: 1132952 - RNA, 22 nt, Human
gcucugggaacugacugccuuc

SEQ ID NO: 1132953 - RNA, 22 nt, Human
aaaaugugaucuacaaaugcaa

SEQ ID NO: 1132954 - RNA, 22 nt, Human
ggaaaaggccauuguuucucug

SEQ ID NO: 1132955 - RNA, 21 nt, Human
agagaagaggacuuucucaca

SEQ ID NO: 1132956 - RNA, 22 nt, Human
aagucauuaucucuucuaaucu

SEQ ID NO: 1132957 - RNA, 20 nt, Human
ucucccaggcucagggaaga

SEQ ID NO: 1132958 - RNA, 22 nt, Human
gcccagcagcugguggagaagg

SEQ ID NO: 1132959 - RNA, 22 nt, Human
uugcauaaaugcuuaaaauuug

SEQ ID NO: 1132960 - RNA, 22 nt, Human
uggaggaaguggcuggccagaa

SEQ ID NO: 1132961 - RNA, 22 nt, Human
cuuguccuuuacuugagacuca

SEQ ID NO: 1132962 - RNA, 22 nt, Human
uuagggcuuuucugaauaggcc

SEQ ID NO: 1132963 - RNA, 20 nt, Human
cagaccugcacccacuucga

SEQ ID NO: 1132964 - RNA, 20 nt, Human
cuuugccuauucucugccug

SEQ ID NO: 1132965 - RNA, 22 nt, Human
ggggcggggcucugagaagcau

SEQ ID NO: 1132966 - RNA, 22 nt, Human
agguggggaaaccagcgauccc

SEQ ID NO: 1132967 - RNA, 22 nt, Human
uuugcauuuguucaaguauuga

SEQ ID NO: 1132968 - RNA, 22 nt, Human
ccugccugucccucaguccaca

SEQ ID NO: 1132969 - RNA, 22 nt, Human
acaauucuggguauuuauauag

SEQ ID NO: 1132970 - RNA, 22 nt, Human
agugccuggaccccaugacaua

SEQ ID NO: 1132971 - RNA, 22 nt, Human
ccaggccuccugugaguggacc

SEQ ID NO: 1132972 - RNA, 22 nt, Human
ggcucaggggccaggccugucc

SEQ ID NO: 1132973 - RNA, 22 nt, Human
guucauauuacuuugagugcag

SEQ ID NO: 1132974 - RNA, 22 nt, Human
ugggcacaggggaauggaugaa

SEQ ID NO: 1132975 - RNA, 22 nt, Human
acacaugagaaacaucaguugu

SEQ ID NO: 1132976 - RNA, 22 nt, Human
gccaggcuggugucacaacucu

SEQ ID NO: 1132977 - RNA, 22 nt, Human
auguuuuaugcuucagaugagg

SEQ ID NO: 1132978 - RNA, 22 nt, Human
ucuggccuauuucugucagauc

SEQ ID NO: 1132979 - RNA, 19 nt, Human
uuguucguuccugacaggc

SEQ ID NO: 1132980 - RNA, 19 nt, Human
uggccagguacugucugcu

SEQ ID NO: 1132981 - RNA, 22 nt, Human
agugaaauggaugcugcuacug

SEQ ID NO: 1132982 - RNA, 22 nt, Human
agauacaucauuuauaccuuca

SEQ ID NO: 1132983 - RNA, 22 nt, Human
ucaguuuucucauuuaugagau

SEQ ID NO: 1132984 - RNA, 22 nt, Human
gagagcugggcuuugggugaag

SEQ ID NO: 1132985 - RNA, 22 nt, Human
cuccagggagcuuggaaagacc

SEQ ID NO: 1132986 - RNA, 20 nt, Human
ggaccagguggggcgguggc

SEQ ID NO: 1132987 - RNA, 22 nt, Human
uucuuuccucccagccuuugga

SEQ ID NO: 1132988 - RNA, 20 nt, Human
uauuugaaauggccaagugu

SEQ ID NO: 1132989 - RNA, 22 nt, Human
ggcugggcucgcugauuggcug

SEQ ID NO: 1132990 - RNA, 22 nt, Human
ugugugugggcggaacggcccc

SEQ ID NO: 1132991 - RNA, 22 nt, Human
gagugcaucguggccauuuuaa

SEQ ID NO: 1132992 - RNA, 22 nt, Human
uggcucagcgcggccuggucuu

SEQ ID NO: 1132993 - RNA, 18 nt, Human
gggaucaggcugccuagg

SEQ ID NO: 1132994 - RNA, 22 nt, Human
uccucaggaugugggguagaau

SEQ ID NO: 1132995 - RNA, 22 nt, Human
cccagacuccucuggcuggugg

SEQ ID NO: 1132996 - RNA, 22 nt, Human
cagagcuguugcggggcuuggc

SEQ ID NO: 1132997 - RNA, 22 nt, Human
ggccugcacagagguggcucua

SEQ ID NO: 1132998 - RNA, 17 nt, Human
ugcugccaagucccaac

SEQ ID NO: 1132999 - RNA, 22 nt, Human
ggagagaauuccauggacaugu

SEQ ID NO: 1133000 - RNA, 22 nt, Human
acaggcugacuuccugccaugu

SEQ ID NO: 1133001 - RNA, 22 nt, Human
gcucucugccuuucucaaugac

SEQ ID NO: 1133002 - RNA, 22 nt, Human
uuaggcaaagauauuacguagu

SEQ ID NO: 1133003 - RNA, 22 nt, Human
aggcacugugcugaugucuuau

SEQ ID NO: 1133004 - RNA, 22 nt, Human
aggaguguggccagggcucugg

SEQ ID NO: 1133005 - RNA, 22 nt, Human
ugcagaagacacaagguaacgu

SEQ ID NO: 1133006 - RNA, 22 nt, Human
uagcagcuuccagagagggcag

SEQ ID NO: 1133007 - RNA, 21 nt, Human
ggcagccugacccccagagag

SEQ ID NO: 1133008 - RNA, 22 nt, Human
ugcagaagaccuuccagggcug

SEQ ID NO: 1133009 - RNA, 22 nt, Human
caggguggaauggaaugcuggc

SEQ ID NO: 1133010 - RNA, 22 nt, Human
agagauaugaguaguugugaca

SEQ ID NO: 1133011 - RNA, 23 nt, Human
ugucacauuuaguuggcauuguu

SEQ ID NO: 1133012 - RNA, 22 nt, Human
cacagaaucugugacuccaaga

SEQ ID NO: 1133013 - RNA, 22 nt, Human
cugaaauuccauuucagccaca

SEQ ID NO: 1133014 - RNA, 22 nt, Human
uccuugaauauaauaacaguag

SEQ ID NO: 1133015 - RNA, 22 nt, Human
cugccagccaggccagguaggc

SEQ ID NO: 1133016 - RNA, 22 nt, Human
cugggaggcacuauucaggagg

SEQ ID NO: 1133017 - RNA, 22 nt, Human
aggccugggucucgugccuacc

SEQ ID NO: 1133018 - RNA, 22 nt, Human
ucaagagagugcugcuuggggu

SEQ ID NO: 1133019 - RNA, 22 nt, Human
uguauuuugugaggaucacucu

SEQ ID NO: 1133020 - RNA, 22 nt, Human
agaagauuuagguugacgcuau

SEQ ID NO: 1133021 - RNA, 22 nt, Human
auaauuaauuucaguaaucucc

SEQ ID NO: 1133022 - RNA, 22 nt, Human
gcugggcugagcuagacuuggc

SEQ ID NO: 1133023 - RNA, 17 nt, Human
aauagcugcucagagag

SEQ ID NO: 1133024 - RNA, 20 nt, Human
ugaagcagccuugauucugu

SEQ ID NO: 1133025 - RNA, 22 nt, Human
agagccugugauugucaucacc

SEQ ID NO: 1133026 - RNA, 22 nt, Human
uccaagaucuacagcaguuuag

SEQ ID NO: 1133027 - RNA, 21 nt, Human
gauuucacuuaccuucauuua

SEQ ID NO: 1133028 - RNA, 22 nt, Human
aaguucuacuguggguaaaaug

SEQ ID NO: 1133029 - RNA, 22 nt, Human
uuaauaaacaggugcagcugaa

SEQ ID NO: 1133030 - RNA, 22 nt, Human
accccagcucugagccacacca

SEQ ID NO: 1133031 - RNA, 22 nt, Human
gccuccugagaagccacaggcu

SEQ ID NO: 1133032 - RNA, 22 nt, Human
gcugggagccguaccugucacg

SEQ ID NO: 1133033 - RNA, 22 nt, Human
ggcagcacugcagcuuguuggg

SEQ ID NO: 1133034 - RNA, 22 nt, Human
ggggagaguccuuuccaguucc

SEQ ID NO: 1133035 - RNA, 22 nt, Human
acaguguccuuguggucccugu

SEQ ID NO: 1133036 - RNA, 22 nt, Human
auaauaacaccugaauaggaaa

SEQ ID NO: 1133037 - RNA, 22 nt, Human
cucuccuggggagcacacacac

SEQ ID NO: 1133038 - RNA, 22 nt, Human
uuucuguaauuaaaagggcagg

SEQ ID NO: 1133039 - RNA, 22 nt, Human
ucacuuagauggggaucaucac

SEQ ID NO: 1133040 - RNA, 22 nt, Human
gagggggcgugcaaggcuccgc

SEQ ID NO: 1133041 - RNA, 22 nt, Human
ccugcuggccaguggagggcug

SEQ ID NO: 1133042 - RNA, 22 nt, Human
aggcccuggcacugccugggag

SEQ ID NO: 1133043 - RNA, 22 nt, Human
uccaauguuccaggguaaaugu

SEQ ID NO: 1133044 - RNA, 22 nt, Human
gaagcagcuagcccacuaguca

SEQ ID NO: 1133045 - RNA, 23 nt, Human
gcagacagagcagacuaagacaa

SEQ ID NO: 1133046 - RNA, 22 nt, Human
cugaagaugucugagaugcuca

SEQ ID NO: 1133047 - RNA, 22 nt, Human
cccagacucaucccugggagcu

SEQ ID NO: 1133048 - RNA, 22 nt, Human
agcagugggggaguguuaguuu

SEQ ID NO: 1133049 - RNA, 23 nt, Human
uggauaaagcugugcugcauagg

SEQ ID NO: 1133050 - RNA, 22 nt, Human
uugaagcaaggcgaaucuugug

SEQ ID NO: 1133051 - RNA, 19 nt, Human
ucuggagcugaugcaggug

SEQ ID NO: 1133052 - RNA, 22 nt, Human
ggggaggcugaugugggcaaag

SEQ ID NO: 1133053 - RNA, 22 nt, Human
aaaagaggagugguuuaugaca

SEQ ID NO: 1133054 - RNA, 22 nt, Human
agggggugcuacuuccagaguu

SEQ ID NO: 1133055 - RNA, 22 nt, Human
ccugaagagcacucuagaguug

SEQ ID NO: 1133056 - RNA, 20 nt, Human
aggcacuguugucuguaucc

SEQ ID NO: 1133057 - RNA, 22 nt, Human
aaggcaggaugcggacccaucu

SEQ ID NO: 1133058 - RNA, 22 nt, Human
ucaaaguuuguggcaauuuauu

SEQ ID NO: 1133059 - RNA, 22 nt, Human
ugucacuucaggaaugcaggga

SEQ ID NO: 1133060 - RNA, 22 nt, Human
gagagcugugguuugaccaggc

SEQ ID NO: 1133061 - RNA, 22 nt, Human
cugggagcugucaggagcgugu

SEQ ID NO: 1133062 - RNA, 22 nt, Human
uucucuuagcuguaaagucaau

SEQ ID NO: 1133063 - RNA, 19 nt, Human
ccaguagagacagcugcag

SEQ ID NO: 1133064 - RNA, 22 nt, Human
ucucagggaccaugaugaugac

SEQ ID NO: 1133065 - RNA, 18 nt, Human
uggagcaggaagccuggc

SEQ ID NO: 1133066 - RNA, 22 nt, Human
agggccugggauguccuccuag

SEQ ID NO: 1133067 - RNA, 22 nt, Human
gucauugcaguggcaaaucaca

SEQ ID NO: 1133068 - RNA, 17 nt, Human
ugagacagggcaggccc

SEQ ID NO: 1133069 - RNA, 22 nt, Human
ugcagggccuucuagaccaugg

SEQ ID NO: 1133070 - RNA, 18 nt, Human
caaagcucacguuccauc

SEQ ID NO: 1133071 - RNA, 22 nt, Human
ugcaagggcuuagggggcugug

SEQ ID NO: 1133072 - RNA, 22 nt, Human
aagccagggauuccugagggag

SEQ ID NO: 1133073 - RNA, 22 nt, Human
uguuauugagguuacuuauaag

SEQ ID NO: 1133074 - RNA, 22 nt, Human
uaaauccagcuucuaauuuaga

SEQ ID NO: 1133075 - RNA, 22 nt, Human
gcagggcucugcuguaguccua

SEQ ID NO: 1133076 - RNA, 21 nt, Human
gccucugcugucuuauuguga

SEQ ID NO: 1133077 - RNA, 22 nt, Human
ggccugcuccgggggcugagcu

SEQ ID NO: 1133078 - RNA, 22 nt, Human
gccuggagcucuccacuugggg

SEQ ID NO: 1133079 - RNA, 22 nt, Human
gcaggguaggugacagguaguc

SEQ ID NO: 1133080 - RNA, 22 nt, Human
aagggcugaaagaccuugggca

SEQ ID NO: 1133081 - RNA, 22 nt, Human
uucuuuggggaauauucugguu

SEQ ID NO: 1133082 - RNA, 22 nt, Human
gaaggaaaacagaucugccuga

SEQ ID NO: 1133083 - RNA, 22 nt, Human
ggccagagaauaugccuuacgu

SEQ ID NO: 1133084 - RNA, 22 nt, Human
gccagccugugggggcucugug

SEQ ID NO: 1133085 - RNA, 22 nt, Human
uggcccugacugauguggaggg

SEQ ID NO: 1133086 - RNA, 22 nt, Human
caacagaaggaagcagggucag

SEQ ID NO: 1133087 - RNA, 22 nt, Human
ccagagaccagaacauggggau

SEQ ID NO: 1133088 - RNA, 22 nt, Human
gggcccacuggcugucugaccc

SEQ ID NO: 1133089 - RNA, 22 nt, Human
auguauuucuauguagugaaga

SEQ ID NO: 1133090 - RNA, 22 nt, Human
uaaugcaguacugauauaaaca

SEQ ID NO: 1133091 - RNA, 22 nt, Human
cagacuugacggcagcugcuuu

SEQ ID NO: 1133092 - RNA, 22 nt, Human
ugcugggggugucucaccaggc

SEQ ID NO: 1133093 - RNA, 22 nt, Human
aaagaaauagauggcauuuaaa

SEQ ID NO: 1133094 - RNA, 22 nt, Human
ucucaagagggaggcaaucaug

SEQ ID NO: 1133095 - RNA, 19 nt, Human
gucacauuugucucccagg

SEQ ID NO: 1133096 - RNA, 22 nt, Human
guacauuucauuuaaaugaugu

SEQ ID NO: 1133097 - RNA, 22 nt, Human
aaaaguuaccucuguaauauaa

SEQ ID NO: 1133098 - RNA, 22 nt, Human
acacaguauuacaauaggugcu

SEQ ID NO: 1133099 - RNA, 22 nt, Human
agucauauguggcauuuucuaa

SEQ ID NO: 1133100 - RNA, 20 nt, Human
gguagcagcugcugucaucc

SEQ ID NO: 1133101 - RNA, 22 nt, Human
agucaguguucuccggagaggc

SEQ ID NO: 1133102 - RNA, 22 nt, Human
uuuauugcauacacaaauguca

SEQ ID NO: 1133103 - RNA, 22 nt, Human
agccuucacugggaccuuggau

SEQ ID NO: 1133104 - RNA, 22 nt, Human
aggacagaccuaggacuggagc

SEQ ID NO: 1133105 - RNA, 22 nt, Human
ucauugcaagcucauuuaucug

SEQ ID NO: 1133106 - RNA, 22 nt, Human
agucccagcucugccacuuacu

SEQ ID NO: 1133107 - RNA, 22 nt, Human
agcugcugcgccucacccuggc

SEQ ID NO: 1133108 - RNA, 22 nt, Human
gcugccaguguggcaugaugca

SEQ ID NO: 1133109 - RNA, 22 nt, Human
accugaggccuccccagcagac

SEQ ID NO: 1133110 - RNA, 21 nt, Human
guggcucugccaggacugaaa

SEQ ID NO: 1133111 - RNA, 22 nt, Human
caagggcucacggucugcuggg

SEQ ID NO: 1133112 - RNA, 22 nt, Human
uuguauuagcuguaaauuuucu

SEQ ID NO: 1133113 - RNA, 22 nt, Human
uuucuagaggcuccaggggagu

SEQ ID NO: 1133114 - RNA, 22 nt, Human
uaauacuuuugccuuguauuca

SEQ ID NO: 1133115 - RNA, 22 nt, Human
gaggcugcaggcaaugcugccc

SEQ ID NO: 1133116 - RNA, 22 nt, Human
aaguucaagagugacauauuag

SEQ ID NO: 1133117 - RNA, 17 nt, Human
aggugcagaggcagagc

SEQ ID NO: 1133118 - RNA, 22 nt, Human
ugggauggcauccugggccuug

SEQ ID NO: 1133119 - RNA, 22 nt, Human
cuggcagcauggagccugugcu

SEQ ID NO: 1133120 - RNA, 23 nt, Human
agacagaggcugaggcuggccgc

SEQ ID NO: 1133121 - RNA, 22 nt, Human
gggcugcuuuuaagggucucag

SEQ ID NO: 1133122 - RNA, 22 nt, Human
cugagcuggucuauggacuugg

SEQ ID NO: 1133123 - RNA, 22 nt, Human
uauuuccugcauggugauguaa

SEQ ID NO: 1133124 - RNA, 22 nt, Human
gagcuggcuccgccaugcugcu

SEQ ID NO: 1133125 - RNA, 22 nt, Human
agagcuggcugguagcccugau

SEQ ID NO: 1133126 - RNA, 22 nt, Human
agauacauauagaaaacaucaa

SEQ ID NO: 1133127 - RNA, 22 nt, Human
cagagccauccaggugccuguu

SEQ ID NO: 1133128 - RNA, 22 nt, Human
agccuccaguagcugaagagac

SEQ ID NO: 1133129 - RNA, 21 nt, Human
uuucaauguguucuuuguagu

SEQ ID NO: 1133130 - RNA, 22 nt, Human
agugaguggguuacagauggga

SEQ ID NO: 1133131 - RNA, 22 nt, Human
uaaaugugagugaugcggugaa

SEQ ID NO: 1133132 - RNA, 22 nt, Human
cagggcuggauccuccagacuc

SEQ ID NO: 1133133 - RNA, 22 nt, Human
cauggccucaaaggacugcaga

SEQ ID NO: 1133134 - RNA, 22 nt, Human
ucugcagcgugcaggcuggugc

SEQ ID NO: 1133135 - RNA, 21 nt, Human
uuugcauuuuacaugugggga

SEQ ID NO: 1133136 - RNA, 22 nt, Human
cuggccugaucucaugcugucc

SEQ ID NO: 1133137 - RNA, 22 nt, Human
ugggcugcugucugcacaugcu

SEQ ID NO: 1133138 - RNA, 17 nt, Human
uccuucagggccucaca

SEQ ID NO: 1133139 - RNA, 20 nt, Human
auaauuuacccugcaccacu

SEQ ID NO: 1133140 - RNA, 22 nt, Human
cuggacuuuggcccaucugcca

SEQ ID NO: 1133141 - RNA, 22 nt, Human
ucauccaguucacauggugagu

SEQ ID NO: 1133142 - RNA, 22 nt, Human
ugugcaguuucuauguugucca

SEQ ID NO: 1133143 - RNA, 22 nt, Human
uacauuaucuuguuaucuuuca

SEQ ID NO: 1133144 - RNA, 22 nt, Human
guggccugaugccagcccugug

SEQ ID NO: 1133145 - RNA, 22 nt, Human
ggaggccaucuggcuggaggcu

SEQ ID NO: 1133146 - RNA, 22 nt, Human
gguggggucacgacagagggaa

SEQ ID NO: 1133147 - RNA, 22 nt, Human
ggcugcaggcagaggcugucug

SEQ ID NO: 1133148 - RNA, 22 nt, Human
agggagacacaugaggaaguca

SEQ ID NO: 1133149 - RNA, 18 nt, Human
gcaggugccacugcuguu

SEQ ID NO: 1133150 - RNA, 22 nt, Human
aagcagccuggacuugggcugg

SEQ ID NO: 1133151 - RNA, 22 nt, Human
aauaauuuuagcucagaguugu

SEQ ID NO: 1133152 - RNA, 22 nt, Human
ugcuggccgugagcucucggga

SEQ ID NO: 1133153 - RNA, 21 nt, Human
ggggcagagcuaggcccugca

SEQ ID NO: 1133154 - RNA, 22 nt, Human
cagagcuggagaaguggauuua

SEQ ID NO: 1133155 - RNA, 22 nt, Human
cucuguccacagguuugucccu

SEQ ID NO: 1133156 - RNA, 22 nt, Human
ucccuuaaaacucauguguugu

SEQ ID NO: 1133157 - RNA, 22 nt, Human
ugaagacacauacaagggaaug

SEQ ID NO: 1133158 - RNA, 22 nt, Human
ccaggcugccgaggaaagaaag

SEQ ID NO: 1133159 - RNA, 22 nt, Human
caggaggaggugagguagaacu

SEQ ID NO: 1133160 - RNA, 22 nt, Human
ggacccugggcuugcuccuggg

SEQ ID NO: 1133161 - RNA, 22 nt, Human
gaggcucagagggagcaugguc

SEQ ID NO: 1133162 - RNA, 19 nt, Human
ugccagcauuaggcugaag

SEQ ID NO: 1133163 - RNA, 22 nt, Human
cacagaagaaucaugcuguguu

SEQ ID NO: 1133164 - RNA, 22 nt, Human
auuuugaaaccaaguuauuucc

SEQ ID NO: 1133165 - RNA, 21 nt, Human
acagaugggaugagcacacug

SEQ ID NO: 1133166 - RNA, 22 nt, Human
gauaugaaguggcauugugaag

SEQ ID NO: 1133167 - RNA, 22 nt, Human
ucuuuugugccaaguaaugaau

SEQ ID NO: 1133168 - RNA, 22 nt, Human
uuuccaauaaagugucauuguu

SEQ ID NO: 1133169 - RNA, 18 nt, Human
ugcucuguuuaaugauuu

SEQ ID NO: 1133170 - RNA, 22 nt, Human
uucccaggcugugcuaccagag

SEQ ID NO: 1133171 - RNA, 22 nt, Human
gcugcucugugacagccuccgg

SEQ ID NO: 1133172 - RNA, 20 nt, Human
cugagcccccagccugcagg

SEQ ID NO: 1133173 - RNA, 19 nt, Human
gaagaagcuugagaaguag

SEQ ID NO: 1133174 - RNA, 17 nt, Human
agugaaauuuacauugc

SEQ ID NO: 1133175 - RNA, 22 nt, Human
ggcgugggaaguggggcuucug

SEQ ID NO: 1133176 - RNA, 22 nt, Human
gcagagugaggaagagcuucca

SEQ ID NO: 1133177 - RNA, 22 nt, Human
cccagcuccuuggaugggcagg

SEQ ID NO: 1133178 - RNA, 22 nt, Human
gguuugcauucugaaaggcuca

SEQ ID NO: 1133179 - RNA, 22 nt, Human
cugggccucaaucucagaguuu

SEQ ID NO: 1133180 - RNA, 22 nt, Human
ucauuucuccgaccugcugucc

SEQ ID NO: 1133181 - RNA, 22 nt, Human
ucucaccaaagccuugaccaua

SEQ ID NO: 1133182 - RNA, 22 nt, Human
gccuuucaguuccaucaaagga

SEQ ID NO: 1133183 - RNA, 22 nt, Human
gcaggagccacuucagggaugc

SEQ ID NO: 1133184 - RNA, 22 nt, Human
cauucauuuaugaaauaucuau

SEQ ID NO: 1133185 - RNA, 22 nt, Human
acuuugcaauacuuaauacaaa

SEQ ID NO: 1133186 - RNA, 22 nt, Human
gaggcucugugaugugccaggc

SEQ ID NO: 1133187 - RNA, 22 nt, Human
gagcugaguuaccuccagauca

SEQ ID NO: 1133188 - RNA, 22 nt, Human
cccugggcagucugcacuucag

SEQ ID NO: 1133189 - RNA, 22 nt, Human
uccucaugccgggucucacgcu

SEQ ID NO: 1133190 - RNA, 22 nt, Human
guggcugcagagggcacagcau

SEQ ID NO: 1133191 - RNA, 22 nt, Human
ccugagggaggguauaggcugu

SEQ ID NO: 1133192 - RNA, 22 nt, Human
uacauucuggaaaggcacagac

SEQ ID NO: 1133193 - RNA, 22 nt, Human
cugucuguucagauucauuacu

SEQ ID NO: 1133194 - RNA, 22 nt, Human
ucugagagguuaagcaauuuga

SEQ ID NO: 1133195 - RNA, 22 nt, Human
ugggcuggugagggaucauuua

SEQ ID NO: 1133196 - RNA, 22 nt, Human
gugaaaucugaggcccaugaug

SEQ ID NO: 1133197 - RNA, 22 nt, Human
ucaaagucucugcuucuguaac

SEQ ID NO: 1133198 - RNA, 22 nt, Human
ugcuuuauuuauaaaauagcaa

SEQ ID NO: 1133199 - RNA, 22 nt, Human
aauguuuuguaugccucugagc

SEQ ID NO: 1133200 - RNA, 22 nt, Human
acauuucucuuagaguuggacu

SEQ ID NO: 1133201 - RNA, 22 nt, Human
gggaguggguuuggccuaggcc

SEQ ID NO: 1133202 - RNA, 22 nt, Human
cagcuugggucaggugccugcu

SEQ ID NO: 1133203 - RNA, 22 nt, Human
gagccagguuggaggcugcagu

SEQ ID NO: 1133204 - RNA, 22 nt, Human
agaaagcacucugucuuuuacc

SEQ ID NO: 1133205 - RNA, 22 nt, Human
ccagggcauccucacaucgcag

SEQ ID NO: 1133206 - RNA, 22 nt, Human
gcucaggaucccaggggugugc

SEQ ID NO: 1133207 - RNA, 22 nt, Human
ggccucucucccuggcuugcag

SEQ ID NO: 1133208 - RNA, 22 nt, Human
cugcagggcagggccuccuggc

SEQ ID NO: 1133209 - RNA, 22 nt, Human
gauuucaccugaucuugucauc

SEQ ID NO: 1133210 - RNA, 17 nt, Human
ugagcaguagaagaugc

SEQ ID NO: 1133211 - RNA, 22 nt, Human
uagggcuauaagagaauaagac

SEQ ID NO: 1133212 - RNA, 22 nt, Human
uagggcaguuauaacauuagug

SEQ ID NO: 1133213 - RNA, 22 nt, Human
cauuagaagaacaguuauauua

SEQ ID NO: 1133214 - RNA, 22 nt, Human
gcaggcugaugacuggaguugg

SEQ ID NO: 1133215 - RNA, 22 nt, Human
uccugggcugcagggaagagca

SEQ ID NO: 1133216 - RNA, 22 nt, Human
auguuuguugaacaucuacugc

SEQ ID NO: 1133217 - RNA, 22 nt, Human
ccuggcuuccuggagcucacaa

SEQ ID NO: 1133218 - RNA, 22 nt, Human
gagauuggccuggcuugccaac

SEQ ID NO: 1133219 - RNA, 22 nt, Human
ucucaggaauagaguggcagca

SEQ ID NO: 1133220 - RNA, 22 nt, Human
aagcaagacagaaguuacugcc

SEQ ID NO: 1133221 - RNA, 22 nt, Human
agccucuguagaaagcagugug

SEQ ID NO: 1133222 - RNA, 22 nt, Human
auaaggaaugauguaucaguuu

SEQ ID NO: 1133223 - RNA, 22 nt, Human
cucugugcccuacugcucagcu

SEQ ID NO: 1133224 - RNA, 22 nt, Human
ugggcagauguggcucuccuug

SEQ ID NO: 1133225 - RNA, 22 nt, Human
gcuaccugagcaagagcuucaa

SEQ ID NO: 1133226 - RNA, 22 nt, Human
uggcugggcccccaccugccuc

SEQ ID NO: 1133227 - RNA, 22 nt, Human
uuuuugcaccaaccuaauagaa

SEQ ID NO: 1133228 - RNA, 22 nt, Human
caagaauuguacaaacugggug

SEQ ID NO: 1133229 - RNA, 22 nt, Human
uacaagagguauauagaaacag

SEQ ID NO: 1133230 - RNA, 22 nt, Human
gaggcagcugaaggagugacag

SEQ ID NO: 1133231 - RNA, 22 nt, Human
aagcccaguuucacacugagac

SEQ ID NO: 1133232 - RNA, 22 nt, Human
ucauggagacuuugagccuguu

SEQ ID NO: 1133233 - RNA, 22 nt, Human
augagacuaccuguaauguggc

SEQ ID NO: 1133234 - RNA, 22 nt, Human
ccaggcagcaaauuuucugaau

SEQ ID NO: 1133235 - RNA, 22 nt, Human
uggccuggccacauccagcagg

SEQ ID NO: 1133236 - RNA, 22 nt, Human
ugucaugcagguuuguuauaga

SEQ ID NO: 1133237 - RNA, 22 nt, Human
gcugagucuugagcacugagca

SEQ ID NO: 1133238 - RNA, 22 nt, Human
gccuggagaauuaaaaggaagg

SEQ ID NO: 1133239 - RNA, 22 nt, Human
ggcaucuguccaucucuccagc

SEQ ID NO: 1133240 - RNA, 22 nt, Human
ucugcugcacaaauucaucucu

SEQ ID NO: 1133241 - RNA, 22 nt, Human
aaguuguauauaccgcuuuaag

SEQ ID NO: 1133242 - RNA, 22 nt, Human
ucaggaaagaagaugcucagug

SEQ ID NO: 1133243 - RNA, 22 nt, Human
ggcagcuggggcagugcccugu

SEQ ID NO: 1133244 - RNA, 22 nt, Human
cucccaggguagggagagacua

SEQ ID NO: 1133245 - RNA, 22 nt, Human
aacuucuugguccugagcuguu

SEQ ID NO: 1133246 - RNA, 22 nt, Human
gagccaggcccguacuugcugu

SEQ ID NO: 1133247 - RNA, 22 nt, Human
ggccucugcaacuggcuguggc

SEQ ID NO: 1133248 - RNA, 22 nt, Human
ggcagcuccucucagcaaaaga

SEQ ID NO: 1133249 - RNA, 22 nt, Human
aggcacugggggaugagcaagg

SEQ ID NO: 1133250 - RNA, 22 nt, Human
gucccuggaucugggacagcug

SEQ ID NO: 1133251 - RNA, 20 nt, Human
ccuggcugcauucaggacgg

SEQ ID NO: 1133252 - RNA, 22 nt, Human
agccccuuccaguucucagauc

SEQ ID NO: 1133253 - RNA, 20 nt, Human
acagaaagagagaaugucag

SEQ ID NO: 1133254 - RNA, 22 nt, Human
aguaucaaggaucuccagcacc

SEQ ID NO: 1133255 - RNA, 22 nt, Human
ugcccacauucaaaaggugaug

SEQ ID NO: 1133256 - RNA, 22 nt, Human
cugagccaaggggacagugaca

SEQ ID NO: 1133257 - RNA, 22 nt, Human
gcugaagagagaugcguccagc

SEQ ID NO: 1133258 - RNA, 22 nt, Human
ugccugggguuggcaaacugcu

SEQ ID NO: 1133259 - RNA, 22 nt, Human
aagcagccaccucaucuccacu

SEQ ID NO: 1133260 - RNA, 22 nt, Human
gcacccagaggucagcagugcu

SEQ ID NO: 1133261 - RNA, 22 nt, Human
ugcagaagcagagccgguggcc

SEQ ID NO: 1133262 - RNA, 22 nt, Human
ucucagagauuuauggaaaacu

SEQ ID NO: 1133263 - RNA, 22 nt, Human
ucucucuuuuuaaucauguaau

SEQ ID NO: 1133264 - RNA, 22 nt, Human
ccagggugugggcgucggcacg

SEQ ID NO: 1133265 - RNA, 22 nt, Human
cuugugcaauugacauugaauc

SEQ ID NO: 1133266 - RNA, 22 nt, Human
ggccugcugcuaugacuuccug

SEQ ID NO: 1133267 - RNA, 22 nt, Human
uaacagaagaaaacauauugga

SEQ ID NO: 1133268 - RNA, 21 nt, Human
agaugaggauacugaggccua

SEQ ID NO: 1133269 - RNA, 22 nt, Human
uugcauuguaggauguuagaag

SEQ ID NO: 1133270 - RNA, 22 nt, Human
uguguacucaauugagccauuu

SEQ ID NO: 1133271 - RNA, 17 nt, Human
agagagagcaugccacc

SEQ ID NO: 1133272 - RNA, 22 nt, Human
uaagcauaacuaaaaaugauuu

SEQ ID NO: 1133273 - RNA, 22 nt, Human
gccuccugaaaggaagagcucc

SEQ ID NO: 1133274 - RNA, 21 nt, Human
uggcccuggccacggcugcca

SEQ ID NO: 1133275 - RNA, 22 nt, Human
agaacagcagcacgucaagcug

SEQ ID NO: 1133276 - RNA, 22 nt, Human
gcccugugcgacucuagagguu

SEQ ID NO: 1133277 - RNA, 20 nt, Human
auugucagccuucagaggag

SEQ ID NO: 1133278 - RNA, 22 nt, Human
guguuuccucacuucucugacu

SEQ ID NO: 1133279 - RNA, 22 nt, Human
guuuuguuuugagucaacucca

SEQ ID NO: 1133280 - RNA, 22 nt, Human
aguguguguuugggcgguuuau

SEQ ID NO: 1133281 - RNA, 22 nt, Human
gggcagcucucacagcagccaa

SEQ ID NO: 1133282 - RNA, 22 nt, Human
uggcagaaguucacuaguagcu

SEQ ID NO: 1133283 - RNA, 22 nt, Human
cugggagcuagcucugagcuga

SEQ ID NO: 1133284 - RNA, 22 nt, Human
uuccauauuuguguggcaaaag

SEQ ID NO: 1133285 - RNA, 22 nt, Human
uguuaaucaaucaacaguauua

SEQ ID NO: 1133286 - RNA, 19 nt, Human
gcaggcacagcccugggug

SEQ ID NO: 1133287 - RNA, 22 nt, Human
ucagaguguggugagaugugca

SEQ ID NO: 1133288 - RNA, 22 nt, Human
cacagcuuaugccacugauugg

SEQ ID NO: 1133289 - RNA, 22 nt, Human
ugaagcaggcauugacugauga

SEQ ID NO: 1133290 - RNA, 20 nt, Human
gcagcugaaaguaugacacc

SEQ ID NO: 1133291 - RNA, 22 nt, Human
gagcccuccauggagccaggca

SEQ ID NO: 1133292 - RNA, 23 nt, Human
uggcuggcagaaacugaagcaug

SEQ ID NO: 1133293 - RNA, 22 nt, Human
cuggccuagcucucugcuugaa

SEQ ID NO: 1133294 - RNA, 22 nt, Human
caggaggccaacugugggacuu

SEQ ID NO: 1133295 - RNA, 22 nt, Human
agacagaacagaauaauuguug

SEQ ID NO: 1133296 - RNA, 22 nt, Human
aggcaggcucaggcccaugcuu

SEQ ID NO: 1133297 - RNA, 22 nt, Human
ccagucacagguguguuuauau

SEQ ID NO: 1133298 - RNA, 22 nt, Human
agggcccauagaucgucagcuu

SEQ ID NO: 1133299 - RNA, 22 nt, Human
ugcucugugguccaagauggcu

SEQ ID NO: 1133300 - RNA, 22 nt, Human
cucagggucugguccuuagauu

SEQ ID NO: 1133301 - RNA, 22 nt, Human
agccauggcgccacuagaggga

SEQ ID NO: 1133302 - RNA, 22 nt, Human
ccuagagcucugcuuuaucuaa

SEQ ID NO: 1133303 - RNA, 22 nt, Human
ucagaggaauaaugcugcauuu

SEQ ID NO: 1133304 - RNA, 22 nt, Human
uguuuuaagcucuagaagggga

SEQ ID NO: 1133305 - RNA, 22 nt, Human
cccagccucuguuugcuccucu

SEQ ID NO: 1133306 - RNA, 22 nt, Human
cucccagggccaucgagucacu

SEQ ID NO: 1133307 - RNA, 22 nt, Human
gcugccugucccaggaugagga

SEQ ID NO: 1133308 - RNA, 22 nt, Human
cuagaaauauuuuacagucaag

SEQ ID NO: 1133309 - RNA, 19 nt, Human
gagcacagcggcauuuggu

SEQ ID NO: 1133310 - RNA, 22 nt, Human
aaugaacaucaaaugccuacca

SEQ ID NO: 1133311 - RNA, 22 nt, Human
ggcagagaugugggucagaauc

SEQ ID NO: 1133312 - RNA, 22 nt, Human
agggaagaaaauccaucgcugc

SEQ ID NO: 1133313 - RNA, 22 nt, Human
aagugaguggccuggagaggug

SEQ ID NO: 1133314 - RNA, 22 nt, Human
ccuugcaggggaacaggcagug

SEQ ID NO: 1133315 - RNA, 22 nt, Human
cuggcagcugugugaagaacug

SEQ ID NO: 1133316 - RNA, 22 nt, Human
cugcaagauuggaagaugcaau

SEQ ID NO: 1133317 - RNA, 22 nt, Human
agaggccagggacacugcucaa

SEQ ID NO: 1133318 - RNA, 22 nt, Human
uaguuauuauuguuacuaucag

SEQ ID NO: 1133319 - RNA, 22 nt, Human
cugugcauugucuugucuguag

SEQ ID NO: 1133320 - RNA, 21 nt, Human
ggacuuacauagguaaggggu

SEQ ID NO: 1133321 - RNA, 22 nt, Human
acaaaguuauucuuucagagga

SEQ ID NO: 1133322 - RNA, 22 nt, Human
acaguaauaaguguuggugagg

SEQ ID NO: 1133323 - RNA, 22 nt, Human
gcuguccucugaucucuggagg

SEQ ID NO: 1133324 - RNA, 22 nt, Human
uucucuuucuacagugugauug

SEQ ID NO: 1133325 - RNA, 22 nt, Human
cugucaguucuuccagauagag

SEQ ID NO: 1133326 - RNA, 22 nt, Human
acaaagugaauugcaucgaguu

SEQ ID NO: 1133327 - RNA, 22 nt, Human
guguaauuauauaaagaucuac

SEQ ID NO: 1133328 - RNA, 22 nt, Human
cugaggccuaagacaugaauga

SEQ ID NO: 1133329 - RNA, 22 nt, Human
cugcugggcuccucaugugacu

SEQ ID NO: 1133330 - RNA, 20 nt, Human
gcugggggugugcugaguga

SEQ ID NO: 1133331 - RNA, 22 nt, Human
guuccacaaaauguacccaguu

SEQ ID NO: 1133332 - RNA, 22 nt, Human
gaaaucugaacucuguauccuu

SEQ ID NO: 1133333 - RNA, 22 nt, Human
acuuucucaggaauucacagac

SEQ ID NO: 1133334 - RNA, 22 nt, Human
ucuggcucaggagcuguguuca

SEQ ID NO: 1133335 - RNA, 22 nt, Human
gcccaugcucucaggcgggccu

SEQ ID NO: 1133336 - RNA, 22 nt, Human
uuccuggugguggugacagcac

SEQ ID NO: 1133337 - RNA, 19 nt, Human
ccagcagcuuugauucucu

SEQ ID NO: 1133338 - RNA, 22 nt, Human
aaggaggaauuucagggugaau

SEQ ID NO: 1133339 - RNA, 22 nt, Human
ggcggggguccaggagccugca

SEQ ID NO: 1133340 - RNA, 22 nt, Human
acugugugaaacaucaaugugu

SEQ ID NO: 1133341 - RNA, 22 nt, Human
cugggcuguaauguggcacuga

SEQ ID NO: 1133342 - RNA, 22 nt, Human
aggcacuguacuagguacaggg

SEQ ID NO: 1133343 - RNA, 21 nt, Human
ucucuacacuuucacuaggcu

SEQ ID NO: 1133344 - RNA, 22 nt, Human
ucccucuguguugggcaugccu

SEQ ID NO: 1133345 - RNA, 22 nt, Human
gagcagggagacaacucuggug

SEQ ID NO: 1133346 - RNA, 22 nt, Human
ucccuggcagcuaagggugguc

SEQ ID NO: 1133347 - RNA, 22 nt, Human
ggccuggcauggggacuaaggg

SEQ ID NO: 1133348 - RNA, 22 nt, Human
ggcugcaguuugucuuuugcuu

SEQ ID NO: 1133349 - RNA, 22 nt, Human
cuggcucacuagcccugcccug

SEQ ID NO: 1133350 - RNA, 22 nt, Human
ccaggggcuggugcugagcugg

SEQ ID NO: 1133351 - RNA, 22 nt, Human
ugggcaggauaauaucucaugu

SEQ ID NO: 1133352 - RNA, 22 nt, Human
agauacauagcugugagcacac

SEQ ID NO: 1133353 - RNA, 22 nt, Human
cuguacauauacauuuuuuucc

SEQ ID NO: 1133354 - RNA, 22 nt, Human
agcagcucuggcacuguagcau

SEQ ID NO: 1133355 - RNA, 22 nt, Human
ugugccuucucaguccugcuca

SEQ ID NO: 1133356 - RNA, 22 nt, Human
ggcagaggagcuggaaacaugg

SEQ ID NO: 1133357 - RNA, 21 nt, Human
aggugcagagccagggaccag

SEQ ID NO: 1133358 - RNA, 22 nt, Human
cacucccuucaggagccuagga

SEQ ID NO: 1133359 - RNA, 22 nt, Human
cugcccugugaggguccuuggg

SEQ ID NO: 1133360 - RNA, 22 nt, Human
gcagcagagcuuuguccuggcu

SEQ ID NO: 1133361 - RNA, 22 nt, Human
ucuggauggucagcucuuccug

SEQ ID NO: 1133362 - RNA, 22 nt, Human
agccuggagcuugaguuaugag

SEQ ID NO: 1133363 - RNA, 23 nt, Human
acacaauagaguacuauucagcc

SEQ ID NO: 1133364 - RNA, 22 nt, Human
uuugugaagggaacagaagugu

SEQ ID NO: 1133365 - RNA, 21 nt, Human
uagagaaaagaagcuguuccu

SEQ ID NO: 1133366 - RNA, 22 nt, Human
cucccagagaccaagcugagaa

SEQ ID NO: 1133367 - RNA, 22 nt, Human
caggagcugggucuggaagcag

SEQ ID NO: 1133368 - RNA, 22 nt, Human
ccagggcuggugggagaugcug

SEQ ID NO: 1133369 - RNA, 22 nt, Human
ccagcugcugugaggaccacag

SEQ ID NO: 1133370 - RNA, 22 nt, Human
gaggagcacaugaggcugaggg

SEQ ID NO: 1133371 - RNA, 22 nt, Human
gcuggggagggcgucaaggcca

SEQ ID NO: 1133372 - RNA, 22 nt, Human
uuugcauuauauuuauagaaga

SEQ ID NO: 1133373 - RNA, 22 nt, Human
cugucuguuucugauucaaccu

SEQ ID NO: 1133374 - RNA, 22 nt, Human
cugagccaaaaagcagagcuug

SEQ ID NO: 1133375 - RNA, 22 nt, Human
agagaggcgaguuaccugugcu

SEQ ID NO: 1133376 - RNA, 22 nt, Human
ugguacuuggaggcagaaaaau

SEQ ID NO: 1133377 - RNA, 22 nt, Human
aggaggccgcugaugggcuccc

SEQ ID NO: 1133378 - RNA, 22 nt, Human
agccaggaaccagcuacagucu

SEQ ID NO: 1133379 - RNA, 20 nt, Human
aggagaugauccagagucag

SEQ ID NO: 1133380 - RNA, 22 nt, Human
cuccaguaucuguaggaaaagg

SEQ ID NO: 1133381 - RNA, 22 nt, Human
gagguacagaguguuccaaugu

SEQ ID NO: 1133382 - RNA, 22 nt, Human
agcagcaacuuauuuuucuuau

SEQ ID NO: 1133383 - RNA, 22 nt, Human
ccagcuccccucagcagguaau

SEQ ID NO: 1133384 - RNA, 22 nt, Human
caggccugagacaucugagaua

SEQ ID NO: 1133385 - RNA, 22 nt, Human
uggcucagauaauucaaggggc

SEQ ID NO: 1133386 - RNA, 22 nt, Human
agaaaacauuacauaggugugu

SEQ ID NO: 1133387 - RNA, 22 nt, Human
aagcugccagcugagcugaggc

SEQ ID NO: 1133388 - RNA, 22 nt, Human
ggugccaggcucccagcucagg

SEQ ID NO: 1133389 - RNA, 22 nt, Human
ugugcucuggaguugccuucac

SEQ ID NO: 1133390 - RNA, 22 nt, Human
ucugcuggccuuagcaggucua

SEQ ID NO: 1133391 - RNA, 22 nt, Human
aucagcaaaaaugccuucagaa

SEQ ID NO: 1133392 - RNA, 22 nt, Human
ugggggucaggaugaggccuug

SEQ ID NO: 1133393 - RNA, 20 nt, Human
ucugugugccaucaccuaac

SEQ ID NO: 1133394 - RNA, 22 nt, Human
ugcugucugauucagggugauu

SEQ ID NO: 1133395 - RNA, 22 nt, Human
acagcagagacacucaggaggc

SEQ ID NO: 1133396 - RNA, 23 nt, Human
agcccagcagagaaccuaggucc

SEQ ID NO: 1133397 - RNA, 22 nt, Human
ccacugggcguuucuguccaau

SEQ ID NO: 1133398 - RNA, 22 nt, Human
guguaucaaagcacagacuuca

SEQ ID NO: 1133399 - RNA, 22 nt, Human
caauguuuuuccuuccuuaaua

SEQ ID NO: 1133400 - RNA, 22 nt, Human
ccaggccugcaucugcugcgca

SEQ ID NO: 1133401 - RNA, 22 nt, Human
ugauacagucagcucacaauug

SEQ ID NO: 1133402 - RNA, 22 nt, Human
ccaggagcauuaagagaacaua

SEQ ID NO: 1133403 - RNA, 22 nt, Human
ggcugagcucaggggcagcagg

SEQ ID NO: 1133404 - RNA, 22 nt, Human
cacagaggaaaggcaguuggua

SEQ ID NO: 1133405 - RNA, 22 nt, Human
gccugagcuacuagggagucug

SEQ ID NO: 1133406 - RNA, 22 nt, Human
agccugucugucuccaaagcug

SEQ ID NO: 1133407 - RNA, 22 nt, Human
aggccuggguguucaccagaag

SEQ ID NO: 1133408 - RNA, 22 nt, Human
uuguauauauucuuaaagaugu

SEQ ID NO: 1133409 - RNA, 21 nt, Human
cucaggauggcggccuggugg

SEQ ID NO: 1133410 - RNA, 22 nt, Human
aggagcccugcgggaggcagag

SEQ ID NO: 1133411 - RNA, 22 nt, Human
cagcccugccauggagccuccu

SEQ ID NO: 1133412 - RNA, 22 nt, Human
aaaucaguaaauguucauuaac

SEQ ID NO: 1133413 - RNA, 22 nt, Human
ggcauggcucggagucagaaca

SEQ ID NO: 1133414 - RNA, 22 nt, Human
auguguuugguuauaugguauu

SEQ ID NO: 1133415 - RNA, 22 nt, Human
cuggggcugcggacgggagccc

SEQ ID NO: 1133416 - RNA, 22 nt, Human
gcuggcugggucccugagaggc

SEQ ID NO: 1133417 - RNA, 22 nt, Human
ucccagggugcgccugcccucg

SEQ ID NO: 1133418 - RNA, 22 nt, Human
cagacagacagccguggccacc

SEQ ID NO: 1133419 - RNA, 22 nt, Human
uggcagagcccagaacugagca

SEQ ID NO: 1133420 - RNA, 22 nt, Human
aaaugcuguaacugauauucug

SEQ ID NO: 1133421 - RNA, 21 nt, Human
gcagccacagccaccaagcua

SEQ ID NO: 1133422 - RNA, 22 nt, Human
cuucccagacgggguggcagcc

SEQ ID NO: 1133423 - RNA, 22 nt, Human
caggaaggcccaccuguccugu

SEQ ID NO: 1133424 - RNA, 22 nt, Human
cuggagagauccuccugaaaaa

SEQ ID NO: 1133425 - RNA, 22 nt, Human
acccuuucuuacucacacgcuc

SEQ ID NO: 1133426 - RNA, 23 nt, Human
cugucuccugggcuagguggaau

SEQ ID NO: 1133427 - RNA, 22 nt, Human
ggguaauuggggccuugcagug

SEQ ID NO: 1133428 - RNA, 22 nt, Human
ggcaaaguuuucaucucauaac

SEQ ID NO: 1133429 - RNA, 22 nt, Human
cacaggcuuccaguccccagcu

SEQ ID NO: 1133430 - RNA, 22 nt, Human
cucuggagguggagguugcagu

SEQ ID NO: 1133431 - RNA, 22 nt, Human
uuuccucugggcccugccaccc

SEQ ID NO: 1133432 - RNA, 21 nt, Human
uucaaugaaaacaaagugagg

SEQ ID NO: 1133433 - RNA, 18 nt, Human
agggucagugucacuggc

SEQ ID NO: 1133434 - RNA, 22 nt, Human
gcucuuccauuucucuugaacu

SEQ ID NO: 1133435 - RNA, 19 nt, Human
uggcagggagugauauuag

SEQ ID NO: 1133436 - RNA, 22 nt, Human
ggugaaggcacaagagggcaag

SEQ ID NO: 1133437 - RNA, 21 nt, Human
agcuuccugcagugggagguc

SEQ ID NO: 1133438 - RNA, 22 nt, Human
uucuugauuucaugcaguuaag

SEQ ID NO: 1133439 - RNA, 22 nt, Human
cuagaaaugcucaagagaaagu

SEQ ID NO: 1133440 - RNA, 22 nt, Human
agccaggaauuggacaacacau

SEQ ID NO: 1133441 - RNA, 22 nt, Human
gccaccagggggcuccagugag

SEQ ID NO: 1133442 - RNA, 22 nt, Human
aaguucaaucagaugaaaaagc

SEQ ID NO: 1133443 - RNA, 22 nt, Human
ggcugcucugccuuccagcugg

SEQ ID NO: 1133444 - RNA, 20 nt, Human
augccucuaauuuugcaaac

SEQ ID NO: 1133445 - RNA, 22 nt, Human
ccaggccuagccccugagggua

SEQ ID NO: 1133446 - RNA, 22 nt, Human
aggguggggugcuacaucuuua

SEQ ID NO: 1133447 - RNA, 22 nt, Human
aaguaacaaugcuguugaauug

SEQ ID NO: 1133448 - RNA, 22 nt, Human
ugcugugcuggcggcagaggcc

SEQ ID NO: 1133449 - RNA, 22 nt, Human
ggcagcucugcuccacaugagu

SEQ ID NO: 1133450 - RNA, 22 nt, Human
cccugcagaaccacagacaaac

SEQ ID NO: 1133451 - RNA, 22 nt, Human
ccaaaguccuuucuccaccugc

SEQ ID NO: 1133452 - RNA, 22 nt, Human
uacauagcaaggaaaugacaga

SEQ ID NO: 1133453 - RNA, 22 nt, Human
cccagguggguuggccucuguc

SEQ ID NO: 1133454 - RNA, 22 nt, Human
aucuggcucaccuggguaaaua

SEQ ID NO: 1133455 - RNA, 21 nt, Human
aagggagauaggaaucaggcc

SEQ ID NO: 1133456 - RNA, 21 nt, Human
aacauuucaggauccaaauug

SEQ ID NO: 1133457 - RNA, 22 nt, Human
cagcuuggaggaggaucuaaga

SEQ ID NO: 1133458 - RNA, 22 nt, Human
ugaaaucuacccuauucagggu

SEQ ID NO: 1133459 - RNA, 22 nt, Human
guccucagggaauguggcgggu

SEQ ID NO: 1133460 - RNA, 22 nt, Human
ugggccuggagcccuggagagu

SEQ ID NO: 1133461 - RNA, 22 nt, Human
gaaaugugugacaaguuucaau

SEQ ID NO: 1133462 - RNA, 22 nt, Human
gcugauuauuacaugucugugg

SEQ ID NO: 1133463 - RNA, 22 nt, Human
gccagggaacccaagggccuca

SEQ ID NO: 1133464 - RNA, 22 nt, Human
cccugaggggaguggugaggug

SEQ ID NO: 1133465 - RNA, 22 nt, Human
cuggagcucuccagagccccgu

SEQ ID NO: 1133466 - RNA, 22 nt, Human
ucugagccguauggcuuggcua

SEQ ID NO: 1133467 - RNA, 22 nt, Human
gccuggcaggccuguuggggcu

SEQ ID NO: 1133468 - RNA, 22 nt, Human
ccugggcauucuuugaguucuc

SEQ ID NO: 1133469 - RNA, 22 nt, Human
uguacaguguagucaugagguu

SEQ ID NO: 1133470 - RNA, 22 nt, Human
gagccauacaaccuauaaagug

SEQ ID NO: 1133471 - RNA, 22 nt, Human
ucagacaguuugcagugugccu

SEQ ID NO: 1133472 - RNA, 22 nt, Human
cugccugggccggccacccucu

SEQ ID NO: 1133473 - RNA, 22 nt, Human
ucugccugcggcugcagguggc

SEQ ID NO: 1133474 - RNA, 22 nt, Human
gcauggcagugaggauggugcu

SEQ ID NO: 1133475 - RNA, 22 nt, Human
ggacaggguaaguacuagugug

SEQ ID NO: 1133476 - RNA, 22 nt, Human
ugcagaagaaugagcuuggagu

SEQ ID NO: 1133477 - RNA, 23 nt, Human
ugcagcugccucuggcgggccgg

SEQ ID NO: 1133478 - RNA, 22 nt, Human
gaagccaguacugugcucugca

SEQ ID NO: 1133479 - RNA, 22 nt, Human
acucuugucucaacuuuuguau

SEQ ID NO: 1133480 - RNA, 22 nt, Human
agagccugaggccaggaaaaug

SEQ ID NO: 1133481 - RNA, 22 nt, Human
cuggccugaggucggcuguagg

SEQ ID NO: 1133482 - RNA, 22 nt, Human
agccccucuguggcucugccuc

SEQ ID NO: 1133483 - RNA, 23 nt, Human
ucucaggacacacaugucuauca

SEQ ID NO: 1133484 - RNA, 22 nt, Human
uuguuuguaugcugagaagaau

SEQ ID NO: 1133485 - RNA, 17 nt, Human
cucagaguugcuuuguc

SEQ ID NO: 1133486 - RNA, 22 nt, Human
aucaauucuuaggaaaauagcu

SEQ ID NO: 1133487 - RNA, 22 nt, Human
ucuggcucccagccugcucuca

SEQ ID NO: 1133488 - RNA, 22 nt, Human
cuggcagcccaaccuagagucu

SEQ ID NO: 1133489 - RNA, 22 nt, Human
ucaggggcugugcauuucccag

SEQ ID NO: 1133490 - RNA, 22 nt, Human
ugugcccauuccacuugaguac

SEQ ID NO: 1133491 - RNA, 22 nt, Human
ucagggcaggcgagcagcugcu

SEQ ID NO: 1133492 - RNA, 22 nt, Human
gcugucugacuccaaguuggag

SEQ ID NO: 1133493 - RNA, 22 nt, Human
cagucccaugagcccagaacau

SEQ ID NO: 1133494 - RNA, 22 nt, Human
aagaaauuaaggaaugcaacga

SEQ ID NO: 1133495 - RNA, 22 nt, Human
cucuggagggaggcugagcugg

SEQ ID NO: 1133496 - RNA, 22 nt, Human
gcagcuggcccugacacgcaga

SEQ ID NO: 1133497 - RNA, 22 nt, Human
cucuggaguuagugaucugggc

SEQ ID NO: 1133498 - RNA, 22 nt, Human
ccucccacauccuagcucugcu

SEQ ID NO: 1133499 - RNA, 22 nt, Human
acauuuaggauguuuugagaga

SEQ ID NO: 1133500 - RNA, 20 nt, Human
accuuucaaaugauucagca

SEQ ID NO: 1133501 - RNA, 23 nt, Human
uaugugugggucuacuagaaguc

SEQ ID NO: 1133502 - RNA, 19 nt, Human
ugagaggcuuaaggcagcu

SEQ ID NO: 1133503 - RNA, 22 nt, Human
uacaguaacauguuguacaagc

SEQ ID NO: 1133504 - RNA, 20 nt, Human
agaggcuuccuugggaggag

SEQ ID NO: 1133505 - RNA, 23 nt, Human
uggggagaguuacccuggaagcg

SEQ ID NO: 1133506 - RNA, 22 nt, Human
gagcaggcuugcagagaagggg

SEQ ID NO: 1133507 - RNA, 22 nt, Human
ggcucuggguucugcaaugcgu

SEQ ID NO: 1133508 - RNA, 21 nt, Human
aaaaugugagcgugaugcuua

SEQ ID NO: 1133509 - RNA, 22 nt, Human
ccucccucuguuagagcugucu

SEQ ID NO: 1133510 - RNA, 22 nt, Human
gcaggaguuaggcgucguggau

SEQ ID NO: 1133511 - RNA, 22 nt, Human
caagagcugaggcuggagaggu

SEQ ID NO: 1133512 - RNA, 22 nt, Human
cugccugugccaccgccucauu

SEQ ID NO: 1133513 - RNA, 22 nt, Human
ucaucuaagagucuuacauuua

SEQ ID NO: 1133514 - RNA, 20 nt, Human
aggcucagcugagcucuugg

SEQ ID NO: 1133515 - RNA, 22 nt, Human
ggagccagagggaugcaguuga

SEQ ID NO: 1133516 - RNA, 22 nt, Human
gugccugccccacuccucagca

SEQ ID NO: 1133517 - RNA, 22 nt, Human
agggcagcacaaggcauggacu

SEQ ID NO: 1133518 - RNA, 22 nt, Human
augcaguaaauguucuaguuug

SEQ ID NO: 1133519 - RNA, 22 nt, Human
ucugcagauuuaucagcagcug

SEQ ID NO: 1133520 - RNA, 22 nt, Human
agaauaguggcaaugacugcac

SEQ ID NO: 1133521 - RNA, 21 nt, Human
gccugcagaccccaccaggcu

SEQ ID NO: 1133522 - RNA, 22 nt, Human
guggcagagguuccucagugug

SEQ ID NO: 1133523 - RNA, 22 nt, Human
gcugugcagccaagugccucug

SEQ ID NO: 1133524 - RNA, 22 nt, Human
uagggcuauucugaguaauaau

SEQ ID NO: 1133525 - RNA, 22 nt, Human
gguucacauauugagaguauuc

SEQ ID NO: 1133526 - RNA, 22 nt, Human
uguaggauuuucaccagaccuu

SEQ ID NO: 1133527 - RNA, 23 nt, Human
aggcuuccuaucuuagagcuggg

SEQ ID NO: 1133528 - RNA, 22 nt, Human
ucucugcugagaagggcuggca

SEQ ID NO: 1133529 - RNA, 22 nt, Human
aucaguuugauaauaaggcuug

SEQ ID NO: 1133530 - RNA, 22 nt, Human
gggcuucuagaccagcagugag

SEQ ID NO: 1133531 - RNA, 22 nt, Human
cuuacauuaaguaagagauuga

SEQ ID NO: 1133532 - RNA, 22 nt, Human
cuauuucugccuaaugaccugu

SEQ ID NO: 1133533 - RNA, 17 nt, Human
uauguguguuugcagca

SEQ ID NO: 1133534 - RNA, 22 nt, Human
ggcugcagaaguacuuccggau

SEQ ID NO: 1133535 - RNA, 22 nt, Human
aguuuuauuccaaugugcagca

SEQ ID NO: 1133536 - RNA, 22 nt, Human
agugugugcaugcauucgugca

SEQ ID NO: 1133537 - RNA, 23 nt, Human
uccuucagagccucccuccaagc

SEQ ID NO: 1133538 - RNA, 22 nt, Human
cacugaagccacuggaagagga

SEQ ID NO: 1133539 - RNA, 22 nt, Human
ugccuugguucucuacuuggag

SEQ ID NO: 1133540 - RNA, 22 nt, Human
ggugauuuucgaguuucauguu

SEQ ID NO: 1133541 - RNA, 22 nt, Human
auagucuuagucuauaguuuug

SEQ ID NO: 1133542 - RNA, 22 nt, Human
aaauaauugaguuggucaauau

SEQ ID NO: 1133543 - RNA, 22 nt, Human
cagaccugagguugaguaccag

SEQ ID NO: 1133544 - RNA, 17 nt, Human
gagagcugcugcuuccg

SEQ ID NO: 1133545 - RNA, 22 nt, Human
aggaccuguaccucagcaucua

SEQ ID NO: 1133546 - RNA, 22 nt, Human
gccuggaggaauguagcugagg

SEQ ID NO: 1133547 - RNA, 22 nt, Human
gcagcagaggcccuacucuuug

SEQ ID NO: 1133548 - RNA, 22 nt, Human
aggugaguugguaggaaguuug

SEQ ID NO: 1133549 - RNA, 20 nt, Human
auacacauauucuugcaacu

SEQ ID NO: 1133550 - RNA, 22 nt, Human
cagagggcucuuggcugccugc

SEQ ID NO: 1133551 - RNA, 22 nt, Human
ucaguuuucucaucugugaaau

SEQ ID NO: 1133552 - RNA, 22 nt, Human
ccugggcucaagugauccuccu

SEQ ID NO: 1133553 - RNA, 22 nt, Human
ccugggcuugcaucugugcugg

SEQ ID NO: 1133554 - RNA, 22 nt, Human
ggucaggguauaaucaagugag

SEQ ID NO: 1133555 - RNA, 22 nt, Human
aacucaguucuuuccacaaugc

SEQ ID NO: 1133556 - RNA, 22 nt, Human
aggccucacauugggcuucaag

SEQ ID NO: 1133557 - RNA, 22 nt, Human
ccaaggcuucccagagaugcuc

SEQ ID NO: 1133558 - RNA, 22 nt, Human
gggcagagguucaacuucaaca

SEQ ID NO: 1133559 - RNA, 22 nt, Human
cagcaucuuucucuucuggagu

SEQ ID NO: 1133560 - RNA, 22 nt, Human
auacauuagcucauaugauuaa

SEQ ID NO: 1133561 - RNA, 22 nt, Human
ucaacacucuuuggcacaguua

SEQ ID NO: 1133562 - RNA, 21 nt, Human
cagaaguaaggguaacuucuc

SEQ ID NO: 1133563 - RNA, 22 nt, Human
ggcugagcaauuuugaugacau

SEQ ID NO: 1133564 - RNA, 22 nt, Human
ucugggcuugguuagggcuguu

SEQ ID NO: 1133565 - RNA, 22 nt, Human
auggggugagacuaggauuaaa

SEQ ID NO: 1133566 - RNA, 22 nt, Human
gagagaagggggauaugagccu

SEQ ID NO: 1133567 - RNA, 19 nt, Human
ugagugggccccugcagac

SEQ ID NO: 1133568 - RNA, 22 nt, Human
ucaguguccggagccugagugc

SEQ ID NO: 1133569 - RNA, 22 nt, Human
aggggugugcauccuggaggau

SEQ ID NO: 1133570 - RNA, 22 nt, Human
cagggagaaaucuccaggaggu

SEQ ID NO: 1133571 - RNA, 15 nt, Human
ugggcagaucacuug

SEQ ID NO: 1133572 - RNA, 22 nt, Human
agcuggccuguuagagcugagu

SEQ ID NO: 1133573 - RNA, 22 nt, Human
uucuguauguacauauguguau

SEQ ID NO: 1133574 - RNA, 22 nt, Human
guugaauaucccguaucuuaaa

SEQ ID NO: 1133575 - RNA, 23 nt, Human
auguuuuaugucucuagcugcca

SEQ ID NO: 1133576 - RNA, 22 nt, Human
caucacagauguuguguggagu

SEQ ID NO: 1133577 - RNA, 22 nt, Human
gcaggaugggagcuucacuuug

SEQ ID NO: 1133578 - RNA, 22 nt, Human
ugguuuugcuccaguauaaaua

SEQ ID NO: 1133579 - RNA, 22 nt, Human
ccuuucucuuggauaccgauug

SEQ ID NO: 1133580 - RNA, 22 nt, Human
caggggcuuuuccucuauaagg

SEQ ID NO: 1133581 - RNA, 22 nt, Human
acuggcagagguuggacaccau

SEQ ID NO: 1133582 - RNA, 22 nt, Human
ccugucugcaugagugagcaua

SEQ ID NO: 1133583 - RNA, 22 nt, Human
gccugugcauagcagcggacuc

SEQ ID NO: 1133584 - RNA, 22 nt, Human
uacauucuacuuuuucacuccc

SEQ ID NO: 1133585 - RNA, 22 nt, Human
cuguagccaguuuggccucacc

SEQ ID NO: 1133586 - RNA, 22 nt, Human
cucuggaguggguggccgggag

SEQ ID NO: 1133587 - RNA, 22 nt, Human
cccugcugucaggugcugggag

SEQ ID NO: 1133588 - RNA, 22 nt, Human
gcucagaggaugcuccuuuaug

SEQ ID NO: 1133589 - RNA, 22 nt, Human
ccagggcaugggaagaacugaa

SEQ ID NO: 1133590 - RNA, 19 nt, Human
ugacaggcuguugccuuga

SEQ ID NO: 1133591 - RNA, 22 nt, Human
ggcuucucucuucacauggcuu

SEQ ID NO: 1133592 - RNA, 22 nt, Human
cagaggcugaugugggaugggc

SEQ ID NO: 1133593 - RNA, 22 nt, Human
cugagcugcucccgcugcagcg

SEQ ID NO: 1133594 - RNA, 22 nt, Human
uuacaugguuguuggaaaugcu

SEQ ID NO: 1133595 - RNA, 22 nt, Human
ccugggaagagcugacaggagg

SEQ ID NO: 1133596 - RNA, 22 nt, Human
gggcugacucugcacugagcca

SEQ ID NO: 1133597 - RNA, 18 nt, Human
uggccuggagacaacucu

SEQ ID NO: 1133598 - RNA, 22 nt, Human
gagaaagacguaggcugggagg

SEQ ID NO: 1133599 - RNA, 22 nt, Human
agucccagagaggucggggcca

SEQ ID NO: 1133600 - RNA, 22 nt, Human
ccucccacuucuugcugagguc

SEQ ID NO: 1133601 - RNA, 22 nt, Human
ucuggcucucauacucgccagu

SEQ ID NO: 1133602 - RNA, 22 nt, Human
caggagaagguuuggagugcag

SEQ ID NO: 1133603 - RNA, 22 nt, Human
ucacauuuucauauucucugag

SEQ ID NO: 1133604 - RNA, 22 nt, Human
gcugcccugucugcagcaggac

SEQ ID NO: 1133605 - RNA, 23 nt, Human
ccucagcauggcaggagcccagc

SEQ ID NO: 1133606 - RNA, 22 nt, Human
auuguacaugcagugagucauc

SEQ ID NO: 1133607 - RNA, 22 nt, Human
ugaggaugacgauggcaauggc

SEQ ID NO: 1133608 - RNA, 22 nt, Human
ugaagcaaacgcuucuguuccu

SEQ ID NO: 1133609 - RNA, 20 nt, Human
ugcagggcucugcuucucuc

SEQ ID NO: 1133610 - RNA, 22 nt, Human
uuuucuuauggugaagcacaaa

SEQ ID NO: 1133611 - RNA, 22 nt, Human
ccuuggaggacugcugcuucuu

SEQ ID NO: 1133612 - RNA, 22 nt, Human
augguugaagaccaguggaaaa

SEQ ID NO: 1133613 - RNA, 22 nt, Human
guggcaggucccauuggagcag

SEQ ID NO: 1133614 - RNA, 22 nt, Human
cagcagccuacaaugcacagaa

SEQ ID NO: 1133615 - RNA, 22 nt, Human
gcagggacugugaucucacaga

SEQ ID NO: 1133616 - RNA, 22 nt, Human
gcacagggcccugugcguaggu

SEQ ID NO: 1133617 - RNA, 20 nt, Human
ugagugauggaggcggguca

SEQ ID NO: 1133618 - RNA, 22 nt, Human
ccagggugaccagcuggccuag

SEQ ID NO: 1133619 - RNA, 18 nt, Human
ccugccagucuggagcag

SEQ ID NO: 1133620 - RNA, 22 nt, Human
uucacauuagugguucuauaua

SEQ ID NO: 1133621 - RNA, 22 nt, Human
agccagcuggugggucagcugg

SEQ ID NO: 1133622 - RNA, 22 nt, Human
uccuuugacuucuugcagucca

SEQ ID NO: 1133623 - RNA, 19 nt, Human
ugggcuuccccagggcaga

SEQ ID NO: 1133624 - RNA, 22 nt, Human
agcagagcccuuccauggccuu

SEQ ID NO: 1133625 - RNA, 22 nt, Human
agcugccugcuuaugagcucca

SEQ ID NO: 1133626 - RNA, 22 nt, Human
aacuagaacgucuaguugcugg

SEQ ID NO: 1133627 - RNA, 22 nt, Human
uccagaggcuccaaagggagau

SEQ ID NO: 1133628 - RNA, 20 nt, Human
agaauucuuacccuuugaug

SEQ ID NO: 1133629 - RNA, 22 nt, Human
gugagcagaacagguggcuucu

SEQ ID NO: 1133630 - RNA, 22 nt, Human
uccuucagggcugaccacaggc

SEQ ID NO: 1133631 - RNA, 22 nt, Human
agccugagagccaagcugugca

SEQ ID NO: 1133632 - RNA, 22 nt, Human
cagagccccucagcucucuccc

SEQ ID NO: 1133633 - RNA, 22 nt, Human
auccuucaaggggcugacagcu

SEQ ID NO: 1133634 - RNA, 22 nt, Human
uggcugcuagccagagcuucag

SEQ ID NO: 1133635 - RNA, 22 nt, Human
uaaggcaccuguccaggcuggg

SEQ ID NO: 1133636 - RNA, 22 nt, Human
uggcagaguucgcugugccuuu

SEQ ID NO: 1133637 - RNA, 22 nt, Human
aggcacugacucaagggagcca

SEQ ID NO: 1133638 - RNA, 22 nt, Human
cggcagagacggcgcuuugaac

SEQ ID NO: 1133639 - RNA, 22 nt, Human
ccagggcagaaaaagagggaau

SEQ ID NO: 1133640 - RNA, 22 nt, Human
cagcagcugauggggaagugau

SEQ ID NO: 1133641 - RNA, 22 nt, Human
ggugaagggccuuaggagacag

SEQ ID NO: 1133642 - RNA, 22 nt, Human
gucccagaaacauauugcuggu

SEQ ID NO: 1133643 - RNA, 22 nt, Human
aggcagaggaaggguggauuug

SEQ ID NO: 1133644 - RNA, 21 nt, Human
guuuuaagggagaaaaccuag

SEQ ID NO: 1133645 - RNA, 23 nt, Human
uacuuaggguuuagaucugacug

SEQ ID NO: 1133646 - RNA, 22 nt, Human
ccaggcaggcagcguucucagg

SEQ ID NO: 1133647 - RNA, 22 nt, Human
ggucucagcaguugcuuugacu

SEQ ID NO: 1133648 - RNA, 17 nt, Human
cugagcauccgugcucu

SEQ ID NO: 1133649 - RNA, 22 nt, Human
ccacccuggacaggccucugag

SEQ ID NO: 1133650 - RNA, 22 nt, Human
ggcugccugcucaggugcggcg

SEQ ID NO: 1133651 - RNA, 22 nt, Human
aacagaaugcaggggaugcugc

SEQ ID NO: 1133652 - RNA, 22 nt, Human
aggccaggcaacauucugaagu

SEQ ID NO: 1133653 - RNA, 22 nt, Human
acauuaucccuggcacaacugc

SEQ ID NO: 1133654 - RNA, 22 nt, Human
guccucagagugggcagguccu

SEQ ID NO: 1133655 - RNA, 22 nt, Human
cacagcagaaaguguaggagga

SEQ ID NO: 1133656 - RNA, 20 nt, Human
aaucagaaagugugagcucu

SEQ ID NO: 1133657 - RNA, 22 nt, Human
aggccuuccucggagacaggga

SEQ ID NO: 1133658 - RNA, 22 nt, Human
uggcagaguucgcuccuauuca

SEQ ID NO: 1133659 - RNA, 22 nt, Human
uccugccugcaaucccagcacu

SEQ ID NO: 1133660 - RNA, 22 nt, Human
uuugcuauaaaagggucacacg

SEQ ID NO: 1133661 - RNA, 22 nt, Human
uugcauaaaagaguauaucuua

SEQ ID NO: 1133662 - RNA, 22 nt, Human
agcaucuggucaugagugagaa

SEQ ID NO: 1133663 - RNA, 22 nt, Human
ccagcagcucccucaggguccg

SEQ ID NO: 1133664 - RNA, 22 nt, Human
ggccagagagccgcuguuagga

SEQ ID NO: 1133665 - RNA, 22 nt, Human
ccagguggugaaagugggcccu

SEQ ID NO: 1133666 - RNA, 22 nt, Human
acaggugguaaaauggacuguc

SEQ ID NO: 1133667 - RNA, 22 nt, Human
caugggagguuggcuuggcaug

SEQ ID NO: 1133668 - RNA, 22 nt, Human
gcucagagauguucaguagcuu

SEQ ID NO: 1133669 - RNA, 22 nt, Human
gaggagagagggacugucugca

SEQ ID NO: 1133670 - RNA, 23 nt, Human
gccugccugaccugugcaaaguc

SEQ ID NO: 1133671 - RNA, 22 nt, Human
agacaaagaaaccguagaagca

SEQ ID NO: 1133672 - RNA, 22 nt, Human
gcagggacaaggcagguguucu

SEQ ID NO: 1133673 - RNA, 22 nt, Human
gcugcccagcaggccccagggg

SEQ ID NO: 1133674 - RNA, 22 nt, Human
aaacaugagcaucucuucaagc

SEQ ID NO: 1133675 - RNA, 20 nt, Human
uugcagcagugaggugaagg

SEQ ID NO: 1133676 - RNA, 22 nt, Human
gaccagagaaaggcacuggaag

SEQ ID NO: 1133677 - RNA, 22 nt, Human
aauguguauacuggcaauuaag

SEQ ID NO: 1133678 - RNA, 22 nt, Human
cucaggauagauuguccucuca

SEQ ID NO: 1133679 - RNA, 22 nt, Human
uccuugaauugugccacuuacc

SEQ ID NO: 1133680 - RNA, 22 nt, Human
aagggcaggcacccacccucac

SEQ ID NO: 1133681 - RNA, 22 nt, Human
uuccauuuauucuuguccagau

SEQ ID NO: 1133682 - RNA, 22 nt, Human
cugggcagaauuuuaggauggc

SEQ ID NO: 1133683 - RNA, 22 nt, Human
cagucccaccaggaucgcucuu

SEQ ID NO: 1133684 - RNA, 22 nt, Human
cuggggcuggugaggcaggcuc

SEQ ID NO: 1133685 - RNA, 22 nt, Human
gcagggcugcugaaacuuguuu

SEQ ID NO: 1133686 - RNA, 22 nt, Human
ucucaggaucuaauacauggua

SEQ ID NO: 1133687 - RNA, 22 nt, Human
caggcagcguccugcuuccugu

SEQ ID NO: 1133688 - RNA, 22 nt, Human
aaaugccucugcuguacacaau

SEQ ID NO: 1133689 - RNA, 18 nt, Human
gucauugcaacauacugu

SEQ ID NO: 1133690 - RNA, 22 nt, Human
uaggccaguggcagguugugug

SEQ ID NO: 1133691 - RNA, 23 nt, Human
ggggccugcaccggucugcgcgg

SEQ ID NO: 1133692 - RNA, 21 nt, Human
gccacguuucagucuucucag

SEQ ID NO: 1133693 - RNA, 22 nt, Human
ggccugggcccacugucaagag

SEQ ID NO: 1133694 - RNA, 22 nt, Human
ggcuucucgugccgaagcaaga

SEQ ID NO: 1133695 - RNA, 22 nt, Human
aagcaaagaguuuaguggguga

SEQ ID NO: 1133696 - RNA, 22 nt, Human
auaauuuaaauuaguaugugau

SEQ ID NO: 1133697 - RNA, 22 nt, Human
ucuggcucuaacuaggcaucag

SEQ ID NO: 1133698 - RNA, 19 nt, Human
gccugagccagccaugcaa

SEQ ID NO: 1133699 - RNA, 21 nt, Human
gggaaauuaggauugcucauc

SEQ ID NO: 1133700 - RNA, 22 nt, Human
aauuuggcagugucuugaagua

SEQ ID NO: 1133701 - RNA, 22 nt, Human
ccugggagggcaagugcugaug

SEQ ID NO: 1133702 - RNA, 22 nt, Human
aggagcagcccacuccuguccu

SEQ ID NO: 1133703 - RNA, 22 nt, Human
aggcugggaaauguauuccagc

SEQ ID NO: 1133704 - RNA, 20 nt, Human
cucucuggaaggugggagcc

SEQ ID NO: 1133705 - RNA, 22 nt, Human
gcauucaucuuccuccaugcag

SEQ ID NO: 1133706 - RNA, 22 nt, Human
uguaccuuuuucugugcaugcu

SEQ ID NO: 1133707 - RNA, 22 nt, Human
ugccagccagguucugaggcua

SEQ ID NO: 1133708 - RNA, 22 nt, Human
gggcuacauugugagagaaguu

SEQ ID NO: 1133709 - RNA, 22 nt, Human
ugcaauaaagugcuauaaaucc

SEQ ID NO: 1133710 - RNA, 18 nt, Human
caguuuuuauaucuggca

SEQ ID NO: 1133711 - RNA, 23 nt, Human
uggcccugaaucuguccuggagg

SEQ ID NO: 1133712 - RNA, 22 nt, Human
ugcacagcgggugucugucagg

SEQ ID NO: 1133713 - RNA, 22 nt, Human
gauggcagguaguggucucauc

SEQ ID NO: 1133714 - RNA, 22 nt, Human
ugcagaccucccauggcugccu

SEQ ID NO: 1133715 - RNA, 22 nt, Human
ucccagcauuaaugccugucag

SEQ ID NO: 1133716 - RNA, 22 nt, Human
ucugccuguucaagucuucuag

SEQ ID NO: 1133717 - RNA, 22 nt, Human
ccaaggagaaaugcugugcuuu

SEQ ID NO: 1133718 - RNA, 22 nt, Human
agugacagcugggaaggugaaa

SEQ ID NO: 1133719 - RNA, 22 nt, Human
ucugucugagggagugacauuu

SEQ ID NO: 1133720 - RNA, 22 nt, Human
aacagaaaucauuuagggcucu

SEQ ID NO: 1133721 - RNA, 22 nt, Human
ucucagagccuaacuaaccuaa

SEQ ID NO: 1133722 - RNA, 22 nt, Human
ccugagguggcugcagcacugc

SEQ ID NO: 1133723 - RNA, 22 nt, Human
uuuugaaagccagguuuguaug

SEQ ID NO: 1133724 - RNA, 22 nt, Human
ccaauguuaggcucugguuuua

SEQ ID NO: 1133725 - RNA, 22 nt, Human
ggccugcuucucagugagcuug

SEQ ID NO: 1133726 - RNA, 18 nt, Human
aggaagcaggaggaaggc

SEQ ID NO: 1133727 - RNA, 22 nt, Human
accacuguaucuccagcacauu

SEQ ID NO: 1133728 - RNA, 22 nt, Human
cuggcaggaagaggaaagguca

SEQ ID NO: 1133729 - RNA, 22 nt, Human
ucucucuugaaguauuagcuag

SEQ ID NO: 1133730 - RNA, 22 nt, Human
cagcugugcuguauuaagcucu

SEQ ID NO: 1133731 - RNA, 22 nt, Human
aaguuuuaacaaguacuuacua

SEQ ID NO: 1133732 - RNA, 22 nt, Human
ccaagguuuauuuugauacauu

SEQ ID NO: 1133733 - RNA, 22 nt, Human
ccagcucuagccccauguggcu

SEQ ID NO: 1133734 - RNA, 22 nt, Human
uuugcauuuccagaguagcaga

SEQ ID NO: 1133735 - RNA, 22 nt, Human
ccaggagcagggcuggcugcac

SEQ ID NO: 1133736 - RNA, 22 nt, Human
ugacccugcuucuuggugcagg

SEQ ID NO: 1133737 - RNA, 23 nt, Human
uggugccucagaagcagugggcu

SEQ ID NO: 1133738 - RNA, 22 nt, Human
ugggccuccaauuccagcggga

SEQ ID NO: 1133739 - RNA, 22 nt, Human
aacaguaucuuuuaucagaaau

SEQ ID NO: 1133740 - RNA, 21 nt, Human
ugccagggauuuacagagccu

SEQ ID NO: 1133741 - RNA, 22 nt, Human
aaugagcuagaccugcuuccuc

SEQ ID NO: 1133742 - RNA, 22 nt, Human
cugggaggacaacuuggagcuc

SEQ ID NO: 1133743 - RNA, 22 nt, Human
agcucuccacacauaggacuag

SEQ ID NO: 1133744 - RNA, 21 nt, Human
ggagauggguaucgccugggc

SEQ ID NO: 1133745 - RNA, 22 nt, Human
ugcagccaccaccucugcugaa

SEQ ID NO: 1133746 - RNA, 17 nt, Human
gcugccaccuuuggagc

SEQ ID NO: 1133747 - RNA, 22 nt, Human
ggcaaaaaguucccaucagugu

SEQ ID NO: 1133748 - RNA, 22 nt, Human
cuguccuaugaguacucacuag

SEQ ID NO: 1133749 - RNA, 22 nt, Human
agccagccgggggaccacagug

SEQ ID NO: 1133750 - RNA, 22 nt, Human
caguacuuauuucuauuuaggg

SEQ ID NO: 1133751 - RNA, 22 nt, Human
cugguccuccuugccuucagau

SEQ ID NO: 1133752 - RNA, 22 nt, Human
cauguacacucauguaacuaua

SEQ ID NO: 1133753 - RNA, 22 nt, Human
aggauccuuuggccacuucuua

SEQ ID NO: 1133754 - RNA, 22 nt, Human
aggagagucuugagucacuggu

SEQ ID NO: 1133755 - RNA, 22 nt, Human
aacugcauucagaaagcucacu

SEQ ID NO: 1133756 - RNA, 22 nt, Human
aaaugcuguguuuuaacauaga

SEQ ID NO: 1133757 - RNA, 18 nt, Human
cagaaaucacaccagcac

SEQ ID NO: 1133758 - RNA, 22 nt, Human
ugugaaaggggucacagggaaa

SEQ ID NO: 1133759 - RNA, 22 nt, Human
cugggcuguucugccccugggu

SEQ ID NO: 1133760 - RNA, 22 nt, Human
agcuuccuguugagagagggag

SEQ ID NO: 1133761 - RNA, 22 nt, Human
ggugggcacccgagacuggauc

SEQ ID NO: 1133762 - RNA, 22 nt, Human
agcagagucugugugcacuuua

SEQ ID NO: 1133763 - RNA, 22 nt, Human
cagcucccaguggcagcuccuu

SEQ ID NO: 1133764 - RNA, 22 nt, Human
uaaaucaguuucucuuauuggu

SEQ ID NO: 1133765 - RNA, 22 nt, Human
ggcugcuggaagacugaacaag

SEQ ID NO: 1133766 - RNA, 22 nt, Human
ucugagggugggagaaggagcu

SEQ ID NO: 1133767 - RNA, 22 nt, Human
ccauuuguucgcccagcuccaa

SEQ ID NO: 1133768 - RNA, 22 nt, Human
aguaauaauuuauauuagggag

SEQ ID NO: 1133769 - RNA, 22 nt, Human
cuuagaaaugcagauucucagg

SEQ ID NO: 1133770 - RNA, 22 nt, Human
acuucuugggacccuggcaccg

SEQ ID NO: 1133771 - RNA, 22 nt, Human
agccacagucaaccuguccaua

SEQ ID NO: 1133772 - RNA, 22 nt, Human
augugacaauauuuggucuuau

SEQ ID NO: 1133773 - RNA, 23 nt, Human
gguggcaggaguggaugcugagc

SEQ ID NO: 1133774 - RNA, 22 nt, Human
acagguggagugguuagcaggc

SEQ ID NO: 1133775 - RNA, 22 nt, Human
gaagcagcaaguauaggacagg

SEQ ID NO: 1133776 - RNA, 22 nt, Human
ccugagugaauucccucacugu

SEQ ID NO: 1133777 - RNA, 22 nt, Human
ugcugaggagguggcugugcuu

SEQ ID NO: 1133778 - RNA, 22 nt, Human
aaagaugucauacacauuaaga

SEQ ID NO: 1133779 - RNA, 22 nt, Human
gugcauuucucauacacuaaau

SEQ ID NO: 1133780 - RNA, 22 nt, Human
aggauaauuggcauuuguaggc

SEQ ID NO: 1133781 - RNA, 22 nt, Human
cuccuugguguaguacugagca

SEQ ID NO: 1133782 - RNA, 22 nt, Human
aggaccaacauagcagcagugg

SEQ ID NO: 1133783 - RNA, 22 nt, Human
uggcagaggaaaaagucacugg

SEQ ID NO: 1133784 - RNA, 22 nt, Human
ucagagagccucaggcacugcc

SEQ ID NO: 1133785 - RNA, 22 nt, Human
uggccuuccuggugacucauga

SEQ ID NO: 1133786 - RNA, 22 nt, Human
uggagggcucuuucaccuggua

SEQ ID NO: 1133787 - RNA, 22 nt, Human
agcugcucugauaaaccuacuu

SEQ ID NO: 1133788 - RNA, 22 nt, Human
agagaugucgccuugcccaggg

SEQ ID NO: 1133789 - RNA, 19 nt, Human
uggcauugguccagauaaa

SEQ ID NO: 1133790 - RNA, 22 nt, Human
uuuuccucaggaaugcuaagcu

SEQ ID NO: 1133791 - RNA, 22 nt, Human
acagaagagcacauuuaguaug

SEQ ID NO: 1133792 - RNA, 22 nt, Human
cugcucugcagcuuggacuccc

SEQ ID NO: 1133793 - RNA, 22 nt, Human
uagugcacacgcauguagcagu

SEQ ID NO: 1133794 - RNA, 22 nt, Human
ucucucucagccauuacagaac

SEQ ID NO: 1133795 - RNA, 22 nt, Human
ucaucaaagcgcuuggaguagg

SEQ ID NO: 1133796 - RNA, 22 nt, Human
ucaggggcccuucccucagcag

SEQ ID NO: 1133797 - RNA, 22 nt, Human
agguacagcaauauaagagguc

SEQ ID NO: 1133798 - RNA, 22 nt, Human
ccagcugguuaaaauagagaaa

SEQ ID NO: 1133799 - RNA, 22 nt, Human
ggcuuccuggagaaggucugag

SEQ ID NO: 1133800 - RNA, 22 nt, Human
gcuaggagauugagcucugaag

SEQ ID NO: 1133801 - RNA, 22 nt, Human
cagcaucaccgccauuucugau

SEQ ID NO: 1133802 - RNA, 22 nt, Human
auguacaguggaaacuaacaaa

SEQ ID NO: 1133803 - RNA, 22 nt, Human
gcccugagggguggugucugua

SEQ ID NO: 1133804 - RNA, 22 nt, Human
cacugucuuuugugaagacaau

SEQ ID NO: 1133805 - RNA, 22 nt, Human
ucucuuccaguaagagucuuua

SEQ ID NO: 1133806 - RNA, 22 nt, Human
ggagccagcagggugacacuga

SEQ ID NO: 1133807 - RNA, 22 nt, Human
agaaugcauuuuguguagcuau

SEQ ID NO: 1133808 - RNA, 22 nt, Human
ccacugucagaggggcugugcc

SEQ ID NO: 1133809 - RNA, 22 nt, Human
cuguccuugcuggccagguaug

SEQ ID NO: 1133810 - RNA, 21 nt, Human
ucugucugguuuuagaguggc

SEQ ID NO: 1133811 - RNA, 22 nt, Human
cauggacucugguuuggggagc

SEQ ID NO: 1133812 - RNA, 22 nt, Human
ccuggagauuauuugguccaau

SEQ ID NO: 1133813 - RNA, 22 nt, Human
ccuggggagaagagcuuccccc

SEQ ID NO: 1133814 - RNA, 22 nt, Human
cacauuugaaggaauuagcauu

SEQ ID NO: 1133815 - RNA, 22 nt, Human
aaggcuaugaucuuuuucauga

SEQ ID NO: 1133816 - RNA, 22 nt, Human
ccaggccauucccagaguugcu

SEQ ID NO: 1133817 - RNA, 22 nt, Human
uaucuauuccaaauaucagcgu

SEQ ID NO: 1133818 - RNA, 22 nt, Human
agggagaaaauuggaugcacaa

SEQ ID NO: 1133819 - RNA, 22 nt, Human
caguuucugggcguucacaggu

SEQ ID NO: 1133820 - RNA, 22 nt, Human
agagugaaguuuuugaaaguga

SEQ ID NO: 1133821 - RNA, 22 nt, Human
guggccuggcgagcuggcgcgg

SEQ ID NO: 1133822 - RNA, 22 nt, Human
ggagaagggacagacucagcuu

SEQ ID NO: 1133823 - RNA, 22 nt, Human
aaguuugugguuauacuugauu

SEQ ID NO: 1133824 - RNA, 22 nt, Human
gcguaaggccucuggucucgga

SEQ ID NO: 1133825 - RNA, 21 nt, Human
agcaggaggcagucacagcuc

SEQ ID NO: 1133826 - RNA, 22 nt, Human
ugggcugcacccucagccucug

SEQ ID NO: 1133827 - RNA, 22 nt, Human
ugucugagugugccugggcauu

SEQ ID NO: 1133828 - RNA, 22 nt, Human
guggccaggccgacugccaggc

SEQ ID NO: 1133829 - RNA, 22 nt, Human
ccuggcagcuaagugcuuugag

SEQ ID NO: 1133830 - RNA, 22 nt, Human
agcaauaugacauugcuacauc

SEQ ID NO: 1133831 - RNA, 22 nt, Human
ggcuccugggaugggacugagc

SEQ ID NO: 1133832 - RNA, 21 nt, Human
uaaagaagaugaaugugauca

SEQ ID NO: 1133833 - RNA, 19 nt, Human
ccuuggaguuccaggugga

SEQ ID NO: 1133834 - RNA, 22 nt, Human
aggugccagugcuguggucccc

SEQ ID NO: 1133835 - RNA, 22 nt, Human
ucaagaaagggcuucaccagga

SEQ ID NO: 1133836 - RNA, 19 nt, Human
ugcaggaggacugagcaga

SEQ ID NO: 1133837 - RNA, 22 nt, Human
aagcugccuagaguugaauguc

SEQ ID NO: 1133838 - RNA, 22 nt, Human
auugaaagauuuugggcucaug

SEQ ID NO: 1133839 - RNA, 22 nt, Human
cagaagcaaaugccuugcugag

SEQ ID NO: 1133840 - RNA, 22 nt, Human
uggggaagggcacccuggagac

SEQ ID NO: 1133841 - RNA, 22 nt, Human
gcuuggaaguaggauugggaga

SEQ ID NO: 1133842 - RNA, 22 nt, Human
uagucucuggagacucuagggg

SEQ ID NO: 1133843 - RNA, 19 nt, Human
ccucccacggauuccuucc

SEQ ID NO: 1133844 - RNA, 22 nt, Human
cacagggcuuugauggcugagu

SEQ ID NO: 1133845 - RNA, 22 nt, Human
caguggcagagaacagagaccu

SEQ ID NO: 1133846 - RNA, 22 nt, Human
augauuuccaguuguugcuaag

SEQ ID NO: 1133847 - RNA, 22 nt, Human
ugcucuguaacaaauugacaug

SEQ ID NO: 1133848 - RNA, 22 nt, Human
acagcuguggggacucuugccc

SEQ ID NO: 1133849 - RNA, 22 nt, Human
ugcuccauucucuagccagugc

SEQ ID NO: 1133850 - RNA, 22 nt, Human
gaagcagcucagauugacugaa

SEQ ID NO: 1133851 - RNA, 22 nt, Human
aggcugucaucuuugcaggcag

SEQ ID NO: 1133852 - RNA, 22 nt, Human
cagcuucccuuggcugagcaga

SEQ ID NO: 1133853 - RNA, 22 nt, Human
cccagcaucuccaggcauggcc

SEQ ID NO: 1133854 - RNA, 22 nt, Human
agagccagccuucucagcuuac

SEQ ID NO: 1133855 - RNA, 22 nt, Human
uguggcccagaugagugugcua

SEQ ID NO: 1133856 - RNA, 22 nt, Human
cacugaagaugcgacuagugcu

SEQ ID NO: 1133857 - RNA, 20 nt, Human
cugccuggaggccucuaccu

SEQ ID NO: 1133858 - RNA, 22 nt, Human
uggcagcuccuggggccagcac

SEQ ID NO: 1133859 - RNA, 22 nt, Human
ccaggccuguguuguguggagg

SEQ ID NO: 1133860 - RNA, 22 nt, Human
aaggcacuagcagaauuaguga

SEQ ID NO: 1133861 - RNA, 22 nt, Human
acagggcagagggcaguuggua

SEQ ID NO: 1133862 - RNA, 22 nt, Human
cucugagaaagcugugagcuaa

SEQ ID NO: 1133863 - RNA, 22 nt, Human
gcuggccauauauuuugcuguu

SEQ ID NO: 1133864 - RNA, 22 nt, Human
gaagcccuauccucuccuggga

SEQ ID NO: 1133865 - RNA, 22 nt, Human
ugaggugaccgcagaugggaag

SEQ ID NO: 1133866 - RNA, 22 nt, Human
gaggccugucgcuaggccucug

SEQ ID NO: 1133867 - RNA, 22 nt, Human
ugcagcagacugaguaugagaa

SEQ ID NO: 1133868 - RNA, 22 nt, Human
gagccagccgcaagagcuguga

SEQ ID NO: 1133869 - RNA, 22 nt, Human
ucucugggugauggcagggcac

SEQ ID NO: 1133870 - RNA, 20 nt, Human
ccaauguuuacagauuacuu

SEQ ID NO: 1133871 - RNA, 22 nt, Human
ucuguuuaggcaaaauagcuac

SEQ ID NO: 1133872 - RNA, 22 nt, Human
gcccaggccggagagcagugcu

SEQ ID NO: 1133873 - RNA, 22 nt, Human
ccucagggacuccaugcugcag

SEQ ID NO: 1133874 - RNA, 22 nt, Human
ggagcuguaacgagccauugcu

SEQ ID NO: 1133875 - RNA, 18 nt, Human
aggcuucuuggcucaguc

SEQ ID NO: 1133876 - RNA, 22 nt, Human
aguaaugugccugaaauacuug

SEQ ID NO: 1133877 - RNA, 22 nt, Human
cuucucuucccagggacacagg

SEQ ID NO: 1133878 - RNA, 22 nt, Human
aauguuuugcauuaguuuucua

SEQ ID NO: 1133879 - RNA, 22 nt, Human
agcaagcuaccuagauagucua

SEQ ID NO: 1133880 - RNA, 17 nt, Human
ugguggcuggagucagg

SEQ ID NO: 1133881 - RNA, 22 nt, Human
auggacagugugucuguuucca

SEQ ID NO: 1133882 - RNA, 22 nt, Human
cagagguauugcaaaagccuag

SEQ ID NO: 1133883 - RNA, 22 nt, Human
agggcuggcaucucuaaugcug

SEQ ID NO: 1133884 - RNA, 22 nt, Human
guccuggggauuauagaguguu

SEQ ID NO: 1133885 - RNA, 22 nt, Human
uccuggagauaauugcagugaa

SEQ ID NO: 1133886 - RNA, 22 nt, Human
cugggggcaagcagacagcugu

SEQ ID NO: 1133887 - RNA, 22 nt, Human
agaaguuaccacauacuucucu

SEQ ID NO: 1133888 - RNA, 22 nt, Human
cccucaggagaugucagcugga

SEQ ID NO: 1133889 - RNA, 22 nt, Human
uggcucagugacauuccuccca

SEQ ID NO: 1133890 - RNA, 22 nt, Human
gcugucucauacaaggcccugc

SEQ ID NO: 1133891 - RNA, 22 nt, Human
cugccuuccaaccccagacucc

SEQ ID NO: 1133892 - RNA, 22 nt, Human
ggugaggcuaagugacacaggg

SEQ ID NO: 1133893 - RNA, 22 nt, Human
cagggacaugacuggucucugu

SEQ ID NO: 1133894 - RNA, 22 nt, Human
gaggucaggcuugcagcagggu

SEQ ID NO: 1133895 - RNA, 22 nt, Human
ucaugacaacuauauuauucca

SEQ ID NO: 1133896 - RNA, 22 nt, Human
cacagguggcuccaaguuagag

SEQ ID NO: 1133897 - RNA, 22 nt, Human
ugacagggugauuaugagagcu

SEQ ID NO: 1133898 - RNA, 22 nt, Human
uaaaugcaguacaaauuguucu

SEQ ID NO: 1133899 - RNA, 22 nt, Human
ugggcccaagagagucuccaac

SEQ ID NO: 1133900 - RNA, 22 nt, Human
aaaagcucuuucugcuguagau

SEQ ID NO: 1133901 - RNA, 17 nt, Human
gugcagggaugaaggau

SEQ ID NO: 1133902 - RNA, 22 nt, Human
agggcucugagugggaaagagg

SEQ ID NO: 1133903 - RNA, 22 nt, Human
aaaugaacaguugcauucucug

SEQ ID NO: 1133904 - RNA, 22 nt, Human
accagagcuuacaugcuagaaa

SEQ ID NO: 1133905 - RNA, 22 nt, Human
gaguguucccacaccccaguug

SEQ ID NO: 1133906 - RNA, 22 nt, Human
aauguuuuagauuacugcuggg

SEQ ID NO: 1133907 - RNA, 22 nt, Human
auucuggauuaucaguccacca

SEQ ID NO: 1133908 - RNA, 22 nt, Human
uaaggcacuucaauguuuagaa

SEQ ID NO: 1133909 - RNA, 19 nt, Human
aggugaugugacucuagaa

SEQ ID NO: 1133910 - RNA, 22 nt, Human
cagaagcacuaggaggaaacgu

SEQ ID NO: 1133911 - RNA, 22 nt, Human
uccuuuccagccucaccucagc

SEQ ID NO: 1133912 - RNA, 22 nt, Human
ccaaagucugcauuuuaacaug

SEQ ID NO: 1133913 - RNA, 22 nt, Human
aucuggcugcugugcuuaagcu

SEQ ID NO: 1133914 - RNA, 22 nt, Human
ccagaagucaggaaugagucuu

SEQ ID NO: 1133915 - RNA, 22 nt, Human
aggucauuacaauuaucauuuu

SEQ ID NO: 1133916 - RNA, 22 nt, Human
cagugcagccaaggacaggcac

SEQ ID NO: 1133917 - RNA, 22 nt, Human
uccuggagcuuccuucauggua

SEQ ID NO: 1133918 - RNA, 22 nt, Human
cucacaggcaucucaucaggcu

SEQ ID NO: 1133919 - RNA, 22 nt, Human
ugagcuucuuuauuuggccaga

SEQ ID NO: 1133920 - RNA, 22 nt, Human
acagagcaguucuggagcuggc

SEQ ID NO: 1133921 - RNA, 18 nt, Human
gauauauaggaggaaagu

SEQ ID NO: 1133922 - RNA, 22 nt, Human
ucauugaacgaagagcuccauu

SEQ ID NO: 1133923 - RNA, 22 nt, Human
agaguguaauaagggcaagggc

SEQ ID NO: 1133924 - RNA, 22 nt, Human
gagggcugaugcuuacuuauuu

SEQ ID NO: 1133925 - RNA, 18 nt, Human
gcagcugacacuggaguu

SEQ ID NO: 1133926 - RNA, 22 nt, Human
agguggcuccucccauggcugg

SEQ ID NO: 1133927 - RNA, 22 nt, Human
cagugcuccugauguacccuug

SEQ ID NO: 1133928 - RNA, 22 nt, Human
uuuccucuuugugacacagcug

SEQ ID NO: 1133929 - RNA, 21 nt, Human
ucagggcagugggagguuccu

SEQ ID NO: 1133930 - RNA, 22 nt, Human
gcaggaguguggugggacaucc

SEQ ID NO: 1133931 - RNA, 22 nt, Human
aauuuagauugauaaacaugga

SEQ ID NO: 1133932 - RNA, 22 nt, Human
uaagaacaucuguccccagauu

SEQ ID NO: 1133933 - RNA, 23 nt, Human
aaaguuugaagcaacaguaguug

SEQ ID NO: 1133934 - RNA, 22 nt, Human
ggcugccugugcccaggcacac

SEQ ID NO: 1133935 - RNA, 22 nt, Human
aggcacugcuucuaaguaggaa

SEQ ID NO: 1133936 - RNA, 22 nt, Human
auggggcugggauucuccucgg

SEQ ID NO: 1133937 - RNA, 22 nt, Human
uaacagaaacagauaaguguaa

SEQ ID NO: 1133938 - RNA, 22 nt, Human
aucugguuuggggauccuugug

SEQ ID NO: 1133939 - RNA, 22 nt, Human
caguagcacucugucagugaag

SEQ ID NO: 1133940 - RNA, 22 nt, Human
uggagccuguguuucugcccag

SEQ ID NO: 1133941 - RNA, 19 nt, Human
ugcucaggccaaggagccc

SEQ ID NO: 1133942 - RNA, 22 nt, Human
cacaggagguuaggaagugguc

SEQ ID NO: 1133943 - RNA, 22 nt, Human
agugggcagugcgcucggaugc

SEQ ID NO: 1133944 - RNA, 22 nt, Human
ucucagagcucacaccuccugg

SEQ ID NO: 1133945 - RNA, 22 nt, Human
ugucuucaucuccaugcacaga

SEQ ID NO: 1133946 - RNA, 22 nt, Human
auacagaaaaugaugcagaguu

SEQ ID NO: 1133947 - RNA, 22 nt, Human
gagccuguguuuccuguagcca

SEQ ID NO: 1133948 - RNA, 22 nt, Human
auuugucuuuggaccugugaga

SEQ ID NO: 1133949 - RNA, 22 nt, Human
agaggcugggaaggguccccgg

SEQ ID NO: 1133950 - RNA, 22 nt, Human
acucucagaggguggcagcaau

SEQ ID NO: 1133951 - RNA, 22 nt, Human
cauguuuucuaggcuuucacaa

SEQ ID NO: 1133952 - RNA, 22 nt, Human
uccuugaagagugggcggucga

SEQ ID NO: 1133953 - RNA, 20 nt, Human
ugcagaagaacguucugguu

SEQ ID NO: 1133954 - RNA, 22 nt, Human
ugcauauuuguaugauguuuag

SEQ ID NO: 1133955 - RNA, 22 nt, Human
cugggaguugacgaggcuugua

SEQ ID NO: 1133956 - RNA, 22 nt, Human
uggcagggccugaaucuuauac

SEQ ID NO: 1133957 - RNA, 22 nt, Human
aaucagaaaauucaguggaauu

SEQ ID NO: 1133958 - RNA, 22 nt, Human
cagggccugagggcugcucugc

SEQ ID NO: 1133959 - RNA, 22 nt, Human
ucugucugacaggguaugaacu

SEQ ID NO: 1133960 - RNA, 22 nt, Human
gaacaguaucaguagugccagu

SEQ ID NO: 1133961 - RNA, 22 nt, Human
ucuggcucucaacaaauauuua

SEQ ID NO: 1133962 - RNA, 22 nt, Human
ggugcagcugcagccugggagc

SEQ ID NO: 1133963 - RNA, 22 nt, Human
agggugggcuagacucuucccc

SEQ ID NO: 1133964 - RNA, 22 nt, Human
gugcaugugucuuuauaguagc

SEQ ID NO: 1133965 - RNA, 22 nt, Human
acguuuucagugacugugcuuc

SEQ ID NO: 1133966 - RNA, 22 nt, Human
uaacacugauuuguucucaggg

SEQ ID NO: 1133967 - RNA, 22 nt, Human
cucuggagaacuccuugugucu

SEQ ID NO: 1133968 - RNA, 22 nt, Human
augguugagaagguaagguacc

SEQ ID NO: 1133969 - RNA, 22 nt, Human
ucaggacagccagggugcagac

SEQ ID NO: 1133970 - RNA, 22 nt, Human
caggccacaaguuggguucaag

SEQ ID NO: 1133971 - RNA, 22 nt, Human
acagagaaagugggcugaagau

SEQ ID NO: 1133972 - RNA, 22 nt, Human
cucaguuucugacauuaaaauc

SEQ ID NO: 1133973 - RNA, 22 nt, Human
ggcaggagaauggcgugaacuc

SEQ ID NO: 1133974 - RNA, 22 nt, Human
gguguccaucaggcugugcuuc

SEQ ID NO: 1133975 - RNA, 22 nt, Human
acugucuccucaucaugccugg

SEQ ID NO: 1133976 - RNA, 22 nt, Human
guucauuuuacuguaaauagca

SEQ ID NO: 1133977 - RNA, 22 nt, Human
agggcugguauguccaugaaag

SEQ ID NO: 1133978 - RNA, 22 nt, Human
ggaggccaaagugugggcggcu

SEQ ID NO: 1133979 - RNA, 22 nt, Human
cagguggggagaguguggagca

SEQ ID NO: 1133980 - RNA, 23 nt, Human
uuacaguaggaguuggaaaacca

SEQ ID NO: 1133981 - RNA, 21 nt, Human
ucacaugcccauuacuggagc

SEQ ID NO: 1133982 - RNA, 19 nt, Human
agcuggggcgguguguguu

SEQ ID NO: 1133983 - RNA, 23 nt, Human
ucuccagugucucuucauugagu

SEQ ID NO: 1133984 - RNA, 22 nt, Human
uggcugccuagugucugagcag

SEQ ID NO: 1133985 - RNA, 22 nt, Human
cugugugcugaaaugcagugag

SEQ ID NO: 1133986 - RNA, 22 nt, Human
ggagggcaucaaucaggccugg

SEQ ID NO: 1133987 - RNA, 22 nt, Human
gcccagcaggacagagugguuu

SEQ ID NO: 1133988 - RNA, 22 nt, Human
cucaggaggaggaaguucauug

SEQ ID NO: 1133989 - RNA, 22 nt, Human
cuggcuggcaaguagaacacaa

SEQ ID NO: 1133990 - RNA, 22 nt, Human
gggagggaggugaugcuuggcu

SEQ ID NO: 1133991 - RNA, 22 nt, Human
aggcuggcuggcaggggacaca

SEQ ID NO: 1133992 - RNA, 22 nt, Human
agccagggauggcagugcccag

SEQ ID NO: 1133993 - RNA, 22 nt, Human
ugauuuccacagucaggggugc

SEQ ID NO: 1133994 - RNA, 22 nt, Human
gagcagaugugugccaggaugc

SEQ ID NO: 1133995 - RNA, 22 nt, Human
acagcagagugugagauagcca

SEQ ID NO: 1133996 - RNA, 22 nt, Human
agccuccaaaugucaggucccg

SEQ ID NO: 1133997 - RNA, 22 nt, Human
cucucugguacauagaguuugg

SEQ ID NO: 1133998 - RNA, 22 nt, Human
cucagagucugcauuucuguca

SEQ ID NO: 1133999 - RNA, 22 nt, Human
ggucucagcccucgccagcagc

SEQ ID NO: 1134000 - RNA, 22 nt, Human
gccuggcuccuaagagcacaac

SEQ ID NO: 1134001 - RNA, 22 nt, Human
ugguuucccauuaucugcagga

SEQ ID NO: 1134002 - RNA, 22 nt, Human
ccaggcaggcgauggugcagug

SEQ ID NO: 1134003 - RNA, 20 nt, Human
uccaguuuuggagacauucu

SEQ ID NO: 1134004 - RNA, 22 nt, Human
ccacuugugaaauaaucaaaua

SEQ ID NO: 1134005 - RNA, 22 nt, Human
cuggagcauccaugcccagggu

SEQ ID NO: 1134006 - RNA, 22 nt, Human
cuucuuuacuuucuagaaauaa

SEQ ID NO: 1134007 - RNA, 22 nt, Human
ggaaagaccugagauaggaaua

SEQ ID NO: 1134008 - RNA, 22 nt, Human
gccuggcccagggcuccgcagg

SEQ ID NO: 1134009 - RNA, 22 nt, Human
ccagcuccgggaguugcugcug

SEQ ID NO: 1134010 - RNA, 22 nt, Human
ucuuuccuaggugauaugcaau

SEQ ID NO: 1134011 - RNA, 22 nt, Human
ugcauauuuuauaaagauggaa

SEQ ID NO: 1134012 - RNA, 22 nt, Human
cuuggggcugucacucuggcau

SEQ ID NO: 1134013 - RNA, 22 nt, Human
agggcaaguugagugugcgugg

SEQ ID NO: 1134014 - RNA, 22 nt, Human
ucagcugccccaguggccccag

SEQ ID NO: 1134015 - RNA, 22 nt, Human
agcagcaugaugacagagucuc

SEQ ID NO: 1134016 - RNA, 22 nt, Human
cugcucugcaaggcacagugau

SEQ ID NO: 1134017 - RNA, 22 nt, Human
gaaaugcagauucugauucugu

SEQ ID NO: 1134018 - RNA, 22 nt, Human
ugaggugaagaguggagcucag

SEQ ID NO: 1134019 - RNA, 20 nt, Human
acuggagccaucucagccua

SEQ ID NO: 1134020 - RNA, 20 nt, Human
ucauccaggacaggaguggc

SEQ ID NO: 1134021 - RNA, 22 nt, Human
gccccagccaaggugacacgaa

SEQ ID NO: 1134022 - RNA, 22 nt, Human
uaauuuacuugcaaauaacaau

SEQ ID NO: 1134023 - RNA, 22 nt, Human
ugccuggcaacuguggugggcu

SEQ ID NO: 1134024 - RNA, 22 nt, Human
accagagcuggcucugagcacc

SEQ ID NO: 1134025 - RNA, 22 nt, Human
augguuuaaagaguaugacuuu

SEQ ID NO: 1134026 - RNA, 22 nt, Human
cuggcuggccggaggcaucccu

SEQ ID NO: 1134027 - RNA, 19 nt, Human
ggagccuggagcacgugcc

SEQ ID NO: 1134028 - RNA, 22 nt, Human
cugcccuggcagccuaccaugg

SEQ ID NO: 1134029 - RNA, 22 nt, Human
uuuccucuaaacgcauuugcuu

SEQ ID NO: 1134030 - RNA, 22 nt, Human
gggggcuggacuuucccacaca

SEQ ID NO: 1134031 - RNA, 22 nt, Human
augagcugggccauccagugau

SEQ ID NO: 1134032 - RNA, 17 nt, Human
ugaaggaaggaugaugu

SEQ ID NO: 1134033 - RNA, 18 nt, Human
gagcccugagucugcaca

SEQ ID NO: 1134034 - RNA, 18 nt, Human
gccugccuagagcuugcc

SEQ ID NO: 1134035 - RNA, 22 nt, Human
cccauuuaucccaagguuacuc

SEQ ID NO: 1134036 - RNA, 22 nt, Human
cauuucugucacguucuuuuau

SEQ ID NO: 1134037 - RNA, 22 nt, Human
agcagggccucuggcacugguc

SEQ ID NO: 1134038 - RNA, 22 nt, Human
uggcucaguuccaucaucugga

SEQ ID NO: 1134039 - RNA, 20 nt, Human
gggaguggugguagccugug

SEQ ID NO: 1134040 - RNA, 22 nt, Human
cacaaugcguacauauaucaaa

SEQ ID NO: 1134041 - RNA, 18 nt, Human
agcagagcccaugcauuc

SEQ ID NO: 1134042 - RNA, 22 nt, Human
ggccagaaguuggaaaagagcc

SEQ ID NO: 1134043 - RNA, 22 nt, Human
gucccagaggacagggucacau

SEQ ID NO: 1134044 - RNA, 22 nt, Human
uaaguucauuagacuacagaua

SEQ ID NO: 1134045 - RNA, 22 nt, Human
auauauuuugcggucacguggc

SEQ ID NO: 1134046 - RNA, 22 nt, Human
cacccaggcuagagugcagugg

SEQ ID NO: 1134047 - RNA, 22 nt, Human
cucagggcuugaguguccagga

SEQ ID NO: 1134048 - RNA, 22 nt, Human
cagagccaaaugcugugguuau

SEQ ID NO: 1134049 - RNA, 22 nt, Human
aucuggcugacuuugugggaca

SEQ ID NO: 1134050 - RNA, 22 nt, Human
uauguuuuucaagugcacacua

SEQ ID NO: 1134051 - RNA, 19 nt, Human
ggucacagggguuacaagg

SEQ ID NO: 1134052 - RNA, 22 nt, Human
cuuccucugcggcgccgggcgc

SEQ ID NO: 1134053 - RNA, 22 nt, Human
agcugaaggcuagaacagcugg

SEQ ID NO: 1134054 - RNA, 22 nt, Human
agaauuagucacaauuauagga

SEQ ID NO: 1134055 - RNA, 22 nt, Human
ccccagcugcauacuugccaag

SEQ ID NO: 1134056 - RNA, 22 nt, Human
aucuacagcugucugcacagua

SEQ ID NO: 1134057 - RNA, 22 nt, Human
aagagcuggauugugcugcaga

SEQ ID NO: 1134058 - RNA, 22 nt, Human
ucccugcucagcucaccuggca

SEQ ID NO: 1134059 - RNA, 22 nt, Human
gagugguaggcaguguuaggaa

SEQ ID NO: 1134060 - RNA, 22 nt, Human
agcagagccagaauuggaccag

SEQ ID NO: 1134061 - RNA, 22 nt, Human
gcccugucccuuggcuucuagg

SEQ ID NO: 1134062 - RNA, 22 nt, Human
caguagcaggcaggugcuuuug

SEQ ID NO: 1134063 - RNA, 21 nt, Human
aaguccaauaccuaaggcucc

SEQ ID NO: 1134064 - RNA, 22 nt, Human
ccugugucuuccccacuggugu

SEQ ID NO: 1134065 - RNA, 22 nt, Human
gggcccuggacguggcggcaga

SEQ ID NO: 1134066 - RNA, 22 nt, Human
gcagcugauggaaguccuauug

SEQ ID NO: 1134067 - RNA, 22 nt, Human
augaccccuaaaauuuacuguc

SEQ ID NO: 1134068 - RNA, 22 nt, Human
gaaugugugacucuauugagca

SEQ ID NO: 1134069 - RNA, 22 nt, Human
ucagagcuaaggggagagcaaa

SEQ ID NO: 1134070 - RNA, 23 nt, Human
aucaaacuggugagaaugucagu

SEQ ID NO: 1134071 - RNA, 22 nt, Human
ccucuccaguuuuaacgugacc

SEQ ID NO: 1134072 - RNA, 22 nt, Human
uguuaaauguuccuuuacugga

SEQ ID NO: 1134073 - RNA, 22 nt, Human
gcagccacagaggagggaugca

SEQ ID NO: 1134074 - RNA, 20 nt, Human
gagggcaggcacccauuuca

SEQ ID NO: 1134075 - RNA, 22 nt, Human
cccaggcugaguuagagguguc

SEQ ID NO: 1134076 - RNA, 22 nt, Human
uuccugaugcacacagucauuu

SEQ ID NO: 1134077 - RNA, 22 nt, Human
caggugaccuuuguccuaaguu

SEQ ID NO: 1134078 - RNA, 18 nt, Human
gccugggaggaggaaaug

SEQ ID NO: 1134079 - RNA, 22 nt, Human
ugccucagcugaggccgcucca

SEQ ID NO: 1134080 - RNA, 17 nt, Human
ggugaguguccaggugg

SEQ ID NO: 1134081 - RNA, 22 nt, Human
ucucuggagggcuccaggcggg

SEQ ID NO: 1134082 - RNA, 22 nt, Human
uuccaguucccaugaggauuaa

SEQ ID NO: 1134083 - RNA, 22 nt, Human
cugccuuggcccuaguucaugg

SEQ ID NO: 1134084 - RNA, 22 nt, Human
aaaugcacagaaaggaugugga

SEQ ID NO: 1134085 - RNA, 20 nt, Human
uccugggguaagccaugguc

SEQ ID NO: 1134086 - RNA, 22 nt, Human
ccaggagcaggagcuggacaga

SEQ ID NO: 1134087 - RNA, 22 nt, Human
acugaaggcuuucccaagguca

SEQ ID NO: 1134088 - RNA, 22 nt, Human
gagcucaggagcaucagaagaa

SEQ ID NO: 1134089 - RNA, 22 nt, Human
aggcuucuacguggucccaggg

SEQ ID NO: 1134090 - RNA, 22 nt, Human
aggcuucuaggguuggcagcgg

SEQ ID NO: 1134091 - RNA, 22 nt, Human
cauugcacuccacccuaggcaa

SEQ ID NO: 1134092 - RNA, 22 nt, Human
uuguaacagcugcuuaauagag

SEQ ID NO: 1134093 - RNA, 22 nt, Human
uggcacuggcgcaggauggcgg

SEQ ID NO: 1134094 - RNA, 22 nt, Human
caggauggucagaugcauuguc

SEQ ID NO: 1134095 - RNA, 20 nt, Human
guggccucucacauucugag

SEQ ID NO: 1134096 - RNA, 22 nt, Human
ucucaagcuuguugguauguuu

SEQ ID NO: 1134097 - RNA, 22 nt, Human
ugugucagagguagagauggca

SEQ ID NO: 1134098 - RNA, 22 nt, Human
uacagauacagaucuagauaca

SEQ ID NO: 1134099 - RNA, 22 nt, Human
gcucagagcaucccagugaaug

SEQ ID NO: 1134100 - RNA, 22 nt, Human
gaaaugcauaaucuuaguagau

SEQ ID NO: 1134101 - RNA, 22 nt, Human
uucaagauggccccagugagcc

SEQ ID NO: 1134102 - RNA, 22 nt, Human
gaggccugcagcguggucccug

SEQ ID NO: 1134103 - RNA, 22 nt, Human
uauaagccauccagccuguggu

SEQ ID NO: 1134104 - RNA, 22 nt, Human
ccacucugcugugcuccaugau

SEQ ID NO: 1134105 - RNA, 22 nt, Human
ucagaggaaaggucagauggcu

SEQ ID NO: 1134106 - RNA, 22 nt, Human
uccuggaggcaaaugagcacau

SEQ ID NO: 1134107 - RNA, 20 nt, Human
agggcagcuugaggagccgg

SEQ ID NO: 1134108 - RNA, 22 nt, Human
cugcagggcccgccugagcccu

SEQ ID NO: 1134109 - RNA, 22 nt, Human
uguauuagagcaguagaauuau

SEQ ID NO: 1134110 - RNA, 22 nt, Human
uccuucaggccucauucucaua

SEQ ID NO: 1134111 - RNA, 22 nt, Human
aaaugcacagguuuuaaauccu

SEQ ID NO: 1134112 - RNA, 22 nt, Human
caagcagagacuagauagcugu

SEQ ID NO: 1134113 - RNA, 22 nt, Human
ggagugggcagcacugcccugu

SEQ ID NO: 1134114 - RNA, 22 nt, Human
augcuguagaucuuagccucua

SEQ ID NO: 1134115 - RNA, 22 nt, Human
acagaauugaaaguauaaucug

SEQ ID NO: 1134116 - RNA, 22 nt, Human
ugccuggguccaggccaagccu

SEQ ID NO: 1134117 - RNA, 22 nt, Human
ugauuuccaguugcugggugcu

SEQ ID NO: 1134118 - RNA, 22 nt, Human
cugggaggcccacguugggaag

SEQ ID NO: 1134119 - RNA, 22 nt, Human
cuaaaugccuuuccuaccuaac

SEQ ID NO: 1134120 - RNA, 22 nt, Human
uaaggcacccgugagcugccag

SEQ ID NO: 1134121 - RNA, 22 nt, Human
ucagcugccucucccuggaaga

SEQ ID NO: 1134122 - RNA, 22 nt, Human
ugggaaauguguuucuggacca

SEQ ID NO: 1134123 - RNA, 22 nt, Human
agggccugcucuaucacucuca

SEQ ID NO: 1134124 - RNA, 22 nt, Human
cagggcagggccacacccccug

SEQ ID NO: 1134125 - RNA, 22 nt, Human
cuagagaggcagauguccugug

SEQ ID NO: 1134126 - RNA, 22 nt, Human
ggauauaugcauguuaucauuu

SEQ ID NO: 1134127 - RNA, 22 nt, Human
aagggccauaacuugcaguguu

SEQ ID NO: 1134128 - RNA, 22 nt, Human
gaugcugagagguggagggaac

SEQ ID NO: 1134129 - RNA, 22 nt, Human
ccagcuggugacauccccaacc

SEQ ID NO: 1134130 - RNA, 17 nt, Human
gaaagguccuagaaauc

SEQ ID NO: 1134131 - RNA, 22 nt, Human
ugcagggcuuccucuuggaguu

SEQ ID NO: 1134132 - RNA, 22 nt, Human
cuucaagauccauagauauugc

SEQ ID NO: 1134133 - RNA, 22 nt, Human
uggcucagagcagggacucugg

SEQ ID NO: 1134134 - RNA, 22 nt, Human
agccaggggauucaucagggac

SEQ ID NO: 1134135 - RNA, 22 nt, Human
uuucuucugagaucagggagaa

SEQ ID NO: 1134136 - RNA, 22 nt, Human
uguuuuaaagccauugccuuuc

SEQ ID NO: 1134137 - RNA, 22 nt, Human
uuguguccugauuugacacaau

SEQ ID NO: 1134138 - RNA, 22 nt, Human
gcacugaaugccaaaguguagg

SEQ ID NO: 1134139 - RNA, 22 nt, Human
cugucccucaucaccucugggu

SEQ ID NO: 1134140 - RNA, 19 nt, Human
agauggggaagagugugag

SEQ ID NO: 1134141 - RNA, 22 nt, Human
gccgaagcugccgucugguccu

SEQ ID NO: 1134142 - RNA, 22 nt, Human
gaggccugaaaggggaccuaug

SEQ ID NO: 1134143 - RNA, 22 nt, Human
uagaaaucagcaggcauaugua

SEQ ID NO: 1134144 - RNA, 22 nt, Human
ugcagggcccuugggguugaac

SEQ ID NO: 1134145 - RNA, 22 nt, Human
ucccaaagcuacucuucugacu

SEQ ID NO: 1134146 - RNA, 22 nt, Human
cugugcuugacagugggaagca

SEQ ID NO: 1134147 - RNA, 22 nt, Human
cuguggugagcaacugacugaa

SEQ ID NO: 1134148 - RNA, 22 nt, Human
auucuuggcaaggagauuuaaa

SEQ ID NO: 1134149 - RNA, 22 nt, Human
cugccagguuggcgcucgcucu

SEQ ID NO: 1134150 - RNA, 22 nt, Human
gccaggcugcuccagggaggcc

SEQ ID NO: 1134151 - RNA, 22 nt, Human
uuggcagggccaggcucucucu

SEQ ID NO: 1134152 - RNA, 19 nt, Human
uccugggcugggccagguc

SEQ ID NO: 1134153 - RNA, 22 nt, Human
ggaggccaggaaggcucggaga

SEQ ID NO: 1134154 - RNA, 18 nt, Human
gcccagaggucugggccc

SEQ ID NO: 1134155 - RNA, 22 nt, Human
ucagggcaagucucagaagguu

SEQ ID NO: 1134156 - RNA, 22 nt, Human
gcugugugcucacguaguggaa

SEQ ID NO: 1134157 - RNA, 22 nt, Human
gucacacuagggccaaguggag

SEQ ID NO: 1134158 - RNA, 22 nt, Human
ugggaggacuugugggcuucau

SEQ ID NO: 1134159 - RNA, 22 nt, Human
acauuucuuuucaucucuauau

SEQ ID NO: 1134160 - RNA, 22 nt, Human
cagcaugguggagcugcucuuu

SEQ ID NO: 1134161 - RNA, 22 nt, Human
agggcugccauuucuggcccaa

SEQ ID NO: 1134162 - RNA, 22 nt, Human
ugcaccauuuugucaggcuacu

SEQ ID NO: 1134163 - RNA, 22 nt, Human
aagauuuccuggauguaauucc

SEQ ID NO: 1134164 - RNA, 22 nt, Human
cggcagagcuuccugcucagcg

SEQ ID NO: 1134165 - RNA, 22 nt, Human
aaugauggauuuagacaagcug

SEQ ID NO: 1134166 - RNA, 22 nt, Human
gacauucacagguaaacauucc

SEQ ID NO: 1134167 - RNA, 22 nt, Human
uaauuuaauuucaugccagccu

SEQ ID NO: 1134168 - RNA, 22 nt, Human
aggccuggugaaugaaguaucu

SEQ ID NO: 1134169 - RNA, 23 nt, Human
uggcccugugcaugcugcuuccc

SEQ ID NO: 1134170 - RNA, 22 nt, Human
gaagcccagggcguggccgggc

SEQ ID NO: 1134171 - RNA, 22 nt, Human
cccaggaggcagagcuugcagu

SEQ ID NO: 1134172 - RNA, 22 nt, Human
ugucucagaguaucccugaacu

SEQ ID NO: 1134173 - RNA, 22 nt, Human
agccugguguggggcugcagag

SEQ ID NO: 1134174 - RNA, 22 nt, Human
uagucuuuuuaauaaauaaugc

SEQ ID NO: 1134175 - RNA, 22 nt, Human
ggcugccuacuuucccagaguu

SEQ ID NO: 1134176 - RNA, 22 nt, Human
ugcaggugccucuugagcuugu

SEQ ID NO: 1134177 - RNA, 22 nt, Human
ggccuuggggaggauggugucc

SEQ ID NO: 1134178 - RNA, 22 nt, Human
cugggaguguucuaggucacau

SEQ ID NO: 1134179 - RNA, 22 nt, Human
ucuuucagccacuuaccugucu

SEQ ID NO: 1134180 - RNA, 22 nt, Human
cagugggaagggcagaggcuuu

SEQ ID NO: 1134181 - RNA, 22 nt, Human
cuggaaggucuguccccacugc

SEQ ID NO: 1134182 - RNA, 22 nt, Human
ugugccaggcacuugcccaggc

SEQ ID NO: 1134183 - RNA, 22 nt, Human
agcaugcugguguucauggcag

SEQ ID NO: 1134184 - RNA, 23 nt, Human
aucaagauaauccagaugaccua

SEQ ID NO: 1134185 - RNA, 23 nt, Human
ggcuggcccggggcugcuccuga

SEQ ID NO: 1134186 - RNA, 22 nt, Human
agguggguccuggcucugccau

SEQ ID NO: 1134187 - RNA, 22 nt, Human
agggcagagggugccucaccug

SEQ ID NO: 1134188 - RNA, 22 nt, Human
ugacacaggcagcucccagcac

SEQ ID NO: 1134189 - RNA, 22 nt, Human
ucugagccaauuucugugucca

SEQ ID NO: 1134190 - RNA, 22 nt, Human
ucauugcaggcauuccccugcc

SEQ ID NO: 1134191 - RNA, 22 nt, Human
gcaggggcuacucugagcuucc

SEQ ID NO: 1134192 - RNA, 22 nt, Human
gagggagagugauggaccauug

SEQ ID NO: 1134193 - RNA, 20 nt, Human
caagcccucuuuagccugcc

SEQ ID NO: 1134194 - RNA, 21 nt, Human
agaggccuuacaggauagacc

SEQ ID NO: 1134195 - RNA, 22 nt, Human
uucagagcaucucuaaagccag

SEQ ID NO: 1134196 - RNA, 22 nt, Human
ugccugucuuaauaucuggaaa

SEQ ID NO: 1134197 - RNA, 22 nt, Human
cccucccagaugggcuugaggu

SEQ ID NO: 1134198 - RNA, 22 nt, Human
uaaagguaacaugaacugcuuu

SEQ ID NO: 1134199 - RNA, 22 nt, Human
gcuggcagaauuucuucuugcu

SEQ ID NO: 1134200 - RNA, 21 nt, Human
aguguccuugaucuugccuug

SEQ ID NO: 1134201 - RNA, 22 nt, Human
auugcagcuggucaggguaauu

SEQ ID NO: 1134202 - RNA, 22 nt, Human
gccagagccacuuuugggugau

SEQ ID NO: 1134203 - RNA, 22 nt, Human
uuagaaaggagcuuauuucuuu

SEQ ID NO: 1134204 - RNA, 22 nt, Human
ggcagcagggucuagauugaug

SEQ ID NO: 1134205 - RNA, 22 nt, Human
aucuggcuauuucuggucgggg

SEQ ID NO: 1134206 - RNA, 22 nt, Human
gggccucugugcagaggggccu

SEQ ID NO: 1134207 - RNA, 22 nt, Human
auguauguuaguguauuaucua

SEQ ID NO: 1134208 - RNA, 22 nt, Human
agcagccauuuaaaaugaauug

SEQ ID NO: 1134209 - RNA, 22 nt, Human
agggcagagcacugaauuggga

SEQ ID NO: 1134210 - RNA, 22 nt, Human
uagagcuggaauuugcagcaag

SEQ ID NO: 1134211 - RNA, 22 nt, Human
cucaggauuaaggaaucuaaau

SEQ ID NO: 1134212 - RNA, 23 nt, Human
ucuuuccucagcacacaccaaga

SEQ ID NO: 1134213 - RNA, 17 nt, Human
ccaggugggaggugggg

SEQ ID NO: 1134214 - RNA, 22 nt, Human
uaagacaugguugaucuagugu

SEQ ID NO: 1134215 - RNA, 22 nt, Human
gacacagcacuguacaaggaau

SEQ ID NO: 1134216 - RNA, 22 nt, Human
cuccagggaaaggggcguccgc

SEQ ID NO: 1134217 - RNA, 22 nt, Human
uagccgcuuaauuauuugguga

SEQ ID NO: 1134218 - RNA, 22 nt, Human
cuuccugaacaaugccaucaau

SEQ ID NO: 1134219 - RNA, 22 nt, Human
ugggagcucagaaagggagguc

SEQ ID NO: 1134220 - RNA, 22 nt, Human
acauuucucauaggagagccac

SEQ ID NO: 1134221 - RNA, 22 nt, Human
gccugguggugugcucaagugg

SEQ ID NO: 1134222 - RNA, 22 nt, Human
cccagggauuauaaaggugaaa

SEQ ID NO: 1134223 - RNA, 22 nt, Human
uaauguguccugaaagcuucug

SEQ ID NO: 1134224 - RNA, 22 nt, Human
ugccagaagugcuuuauaagug

SEQ ID NO: 1134225 - RNA, 22 nt, Human
uuaagucacuuaucuaaagaca

SEQ ID NO: 1134226 - RNA, 22 nt, Human
agcuggccuccgggugccuggg

SEQ ID NO: 1134227 - RNA, 19 nt, Human
uugguggugguuuugguuc

SEQ ID NO: 1134228 - RNA, 22 nt, Human
ugggccuggaguuuguccagag

SEQ ID NO: 1134229 - RNA, 22 nt, Human
caguccaggccuggaggagcca

SEQ ID NO: 1134230 - RNA, 22 nt, Human
gaggaggcuaagugggcucugg

SEQ ID NO: 1134231 - RNA, 22 nt, Human
ucaaaagucugcauucuucaca

SEQ ID NO: 1134232 - RNA, 22 nt, Human
uggcagcagacaaaaggccauu

SEQ ID NO: 1134233 - RNA, 22 nt, Human
aggggcuggaguucgagguuac

SEQ ID NO: 1134234 - RNA, 22 nt, Human
gcucucagguacaaagcugugu

SEQ ID NO: 1134235 - RNA, 22 nt, Human
auaagccugauucacuugucau

SEQ ID NO: 1134236 - RNA, 22 nt, Human
gugccugugcggacucagggaa

SEQ ID NO: 1134237 - RNA, 21 nt, Human
gugcucugggcagcagagggc

SEQ ID NO: 1134238 - RNA, 22 nt, Human
uguggucucguuauguugccca

SEQ ID NO: 1134239 - RNA, 22 nt, Human
cugagcugggaguggauagugg

SEQ ID NO: 1134240 - RNA, 22 nt, Human
uggcucagcugucacagccugg

SEQ ID NO: 1134241 - RNA, 22 nt, Human
auauauuuugaauagccucugu

SEQ ID NO: 1134242 - RNA, 22 nt, Human
ucucaggguuuccugggggcug

SEQ ID NO: 1134243 - RNA, 22 nt, Human
ccagggccucguguucugagug

SEQ ID NO: 1134244 - RNA, 22 nt, Human
ugcacuggggucccagcgcacg

SEQ ID NO: 1134245 - RNA, 22 nt, Human
agagacaggguuuugucguguu

SEQ ID NO: 1134246 - RNA, 22 nt, Human
cccagcuccagagccagaaaca

SEQ ID NO: 1134247 - RNA, 20 nt, Human
acagccagaggaggcagaca

SEQ ID NO: 1134248 - RNA, 22 nt, Human
uucaagaucuuccaaaggauac

SEQ ID NO: 1134249 - RNA, 22 nt, Human
ucuggaguccagauccauuugg

SEQ ID NO: 1134250 - RNA, 22 nt, Human
ggccuggaaugcuuuccuacca

SEQ ID NO: 1134251 - RNA, 19 nt, Human
gcugcucugggucucaucu

SEQ ID NO: 1134252 - RNA, 19 nt, Human
cucagcuguagcucaugug

SEQ ID NO: 1134253 - RNA, 22 nt, Human
cucagaguccccacaucugggu

SEQ ID NO: 1134254 - RNA, 22 nt, Human
cuugaaagucacaugcagcccu

SEQ ID NO: 1134255 - RNA, 22 nt, Human
ugcagggccagacuggguugga

SEQ ID NO: 1134256 - RNA, 22 nt, Human
gcucccagcauugcuucccagg

SEQ ID NO: 1134257 - RNA, 22 nt, Human
auuugucugcuugcugccuucc

SEQ ID NO: 1134258 - RNA, 22 nt, Human
cagauggccagaggcagcugca

SEQ ID NO: 1134259 - RNA, 22 nt, Human
aguaaugucccuuaaauguggu

SEQ ID NO: 1134260 - RNA, 23 nt, Human
uacauuguggauggaguccuggg

SEQ ID NO: 1134261 - RNA, 22 nt, Human
aucagcaaucaaauugcagagu

SEQ ID NO: 1134262 - RNA, 22 nt, Human
aagcugccugggaggaagggcu

SEQ ID NO: 1134263 - RNA, 22 nt, Human
uucacaggcuuggagguggggg

SEQ ID NO: 1134264 - RNA, 22 nt, Human
aaacugaauucccaagggcaug

SEQ ID NO: 1134265 - RNA, 22 nt, Human
ccaggagcuggagggugcagug

SEQ ID NO: 1134266 - RNA, 22 nt, Human
agcaggugacagggcuguggug

SEQ ID NO: 1134267 - RNA, 22 nt, Human
caaugauggcuaggcagcugcu

SEQ ID NO: 1134268 - RNA, 22 nt, Human
ugcagugccucggcagugcagc

SEQ ID NO: 1134269 - RNA, 22 nt, Human
agcuuuauauuuaaugaauucu

SEQ ID NO: 1134270 - RNA, 22 nt, Human
gaaggaaaggucucaugccuuu

SEQ ID NO: 1134271 - RNA, 22 nt, Human
uguggugagaaacugguagauu

SEQ ID NO: 1134272 - RNA, 22 nt, Human
ccaggcugugguuuagauagag

SEQ ID NO: 1134273 - RNA, 22 nt, Human
uuucauaaugucacagucaaaa

SEQ ID NO: 1134274 - RNA, 22 nt, Human
ucccagagacagagccuccucc

SEQ ID NO: 1134275 - RNA, 22 nt, Human
ugccuuccuggagcugaaggcu

SEQ ID NO: 1134276 - RNA, 22 nt, Human
agauacauuguucuaagcauug

SEQ ID NO: 1134277 - RNA, 22 nt, Human
cacccacccacugcucauuggc

SEQ ID NO: 1134278 - RNA, 22 nt, Human
gcucucugguuccagucaggaa

SEQ ID NO: 1134279 - RNA, 22 nt, Human
uccacugcagcuucugauggaa

SEQ ID NO: 1134280 - RNA, 22 nt, Human
cucaaggaaagucuggagaaga

SEQ ID NO: 1134281 - RNA, 22 nt, Human
ccugggcuuucaaaaccagccu

SEQ ID NO: 1134282 - RNA, 22 nt, Human
ccugggucuugguucaugcucu

SEQ ID NO: 1134283 - RNA, 22 nt, Human
cagagccagaacuagaccuugu

SEQ ID NO: 1134284 - RNA, 22 nt, Human
ugcugccuucuaggcgugcccu

SEQ ID NO: 1134285 - RNA, 22 nt, Human
caggcacucauucagagaggug

SEQ ID NO: 1134286 - RNA, 22 nt, Human
ccagggcuggguuugucggugu

SEQ ID NO: 1134287 - RNA, 18 nt, Human
gaaaggagagacaguagg

SEQ ID NO: 1134288 - RNA, 22 nt, Human
uggacucagaaguguucuuuua

SEQ ID NO: 1134289 - RNA, 22 nt, Human
ucagcaauaugauaggcuuugu

SEQ ID NO: 1134290 - RNA, 22 nt, Human
gcucccugcacucugcagcccu

SEQ ID NO: 1134291 - RNA, 21 nt, Human
uagggcaggcauuggaagaga

SEQ ID NO: 1134292 - RNA, 22 nt, Human
uacauuguuuuuucuugccauc

SEQ ID NO: 1134293 - RNA, 22 nt, Human
gcccaggcuggagugcaguagc

SEQ ID NO: 1134294 - RNA, 22 nt, Human
uaucuuuagaggaagagaaucu

SEQ ID NO: 1134295 - RNA, 22 nt, Human
uaguaacagauuuauacagucu

SEQ ID NO: 1134296 - RNA, 22 nt, Human
ccagguggaggugugagguccu

SEQ ID NO: 1134297 - RNA, 22 nt, Human
uagccucuggaauccuuucucu

SEQ ID NO: 1134298 - RNA, 22 nt, Human
gaggccugguuuccagcauccu

SEQ ID NO: 1134299 - RNA, 22 nt, Human
gccugguggacacugggcauca

SEQ ID NO: 1134300 - RNA, 19 nt, Human
cuguggcugaccucuggcc

SEQ ID NO: 1134301 - RNA, 22 nt, Human
guaaaugugcuucuuuuaacuu

SEQ ID NO: 1134302 - RNA, 22 nt, Human
ggaggccaccugaccugcuguu

SEQ ID NO: 1134303 - RNA, 22 nt, Human
agaaaguucugugaguuguuca

SEQ ID NO: 1134304 - RNA, 22 nt, Human
cccaggcugauguucagcgggu

SEQ ID NO: 1134305 - RNA, 22 nt, Human
uuacaaaguucugaguucaaac

SEQ ID NO: 1134306 - RNA, 22 nt, Human
cagggccagccauccugcuggg

SEQ ID NO: 1134307 - RNA, 22 nt, Human
caggcagcgcucguggccuggc

SEQ ID NO: 1134308 - RNA, 21 nt, Human
ugaagccugaggcauagcccc

SEQ ID NO: 1134309 - RNA, 22 nt, Human
uuuaaucaggcaaagcauaaua

SEQ ID NO: 1134310 - RNA, 22 nt, Human
uccacuuuagcaaugauugaau

SEQ ID NO: 1134311 - RNA, 22 nt, Human
ucaagagacaggacguguuuca

SEQ ID NO: 1134312 - RNA, 22 nt, Human
agcagagaagacacaggcuuca

SEQ ID NO: 1134313 - RNA, 22 nt, Human
aagccagggucaggggccuccu

SEQ ID NO: 1134314 - RNA, 22 nt, Human
guaggaagcucugaggcuaguu

SEQ ID NO: 1134315 - RNA, 22 nt, Human
uuucuuaggcucuaaaaugacu

SEQ ID NO: 1134316 - RNA, 22 nt, Human
ggagccuuccagacugcccaca

SEQ ID NO: 1134317 - RNA, 22 nt, Human
aucagcugaaaaacaggcagca

SEQ ID NO: 1134318 - RNA, 22 nt, Human
uagaucugauacaauucaucug

SEQ ID NO: 1134319 - RNA, 22 nt, Human
ugguggccaauucacagggcuc

SEQ ID NO: 1134320 - RNA, 22 nt, Human
gauuucaaccuaacaguaugac

SEQ ID NO: 1134321 - RNA, 22 nt, Human
agccuggccacucagggccuga

SEQ ID NO: 1134322 - RNA, 22 nt, Human
cacugcuuuaaggcugaguaac

SEQ ID NO: 1134323 - RNA, 22 nt, Human
gugcuuccaucuagagggucac

SEQ ID NO: 1134324 - RNA, 22 nt, Human
ggucccaggcugcgggcuggug

SEQ ID NO: 1134325 - RNA, 23 nt, Human
caguacuuaguguagcguuaauu

SEQ ID NO: 1134326 - RNA, 22 nt, Human
uaaggcaccauaauauauuuaa

SEQ ID NO: 1134327 - RNA, 18 nt, Human
ucacagugcucuugccua

SEQ ID NO: 1134328 - RNA, 22 nt, Human
aagcugccacacggugaguacu

SEQ ID NO: 1134329 - RNA, 22 nt, Human
uccaagggcagccauagaacuu

SEQ ID NO: 1134330 - RNA, 23 nt, Human
ucugcucugaaguucggcugagc

SEQ ID NO: 1134331 - RNA, 22 nt, Human
cauauaaauacaacauguguua

SEQ ID NO: 1134332 - RNA, 22 nt, Human
cugcaggcugagcgccugccgg

SEQ ID NO: 1134333 - RNA, 22 nt, Human
caggggcuuaagugacagaagg

SEQ ID NO: 1134334 - RNA, 22 nt, Human
auugucugaauccaaagcucug

SEQ ID NO: 1134335 - RNA, 22 nt, Human
cagcagagcauuugguaggagg

SEQ ID NO: 1134336 - RNA, 22 nt, Human
cucucucuuuagaagcgucugg

SEQ ID NO: 1134337 - RNA, 22 nt, Human
acucugugugaguagagccugu

SEQ ID NO: 1134338 - RNA, 22 nt, Human
cagagcugguguuacaagucca

SEQ ID NO: 1134339 - RNA, 22 nt, Human
cugucucugucuuaacucccag

SEQ ID NO: 1134340 - RNA, 22 nt, Human
gggcagggguagcauuccaagu

SEQ ID NO: 1134341 - RNA, 22 nt, Human
ucaucacuguaucauugauaga

SEQ ID NO: 1134342 - RNA, 22 nt, Human
gaggcugcccaacuggagugga

SEQ ID NO: 1134343 - RNA, 22 nt, Human
ggagcugggaauuggaucaucu

SEQ ID NO: 1134344 - RNA, 22 nt, Human
cucuccuccaacagcccugccg

SEQ ID NO: 1134345 - RNA, 22 nt, Human
gcaggggcugagcaccagcggg

SEQ ID NO: 1134346 - RNA, 22 nt, Human
ccugcagcuccggauuucuggg

SEQ ID NO: 1134347 - RNA, 22 nt, Human
ucacauuuuccuugguaucugu

SEQ ID NO: 1134348 - RNA, 22 nt, Human
uaaagucaucuuuacaucuuug

SEQ ID NO: 1134349 - RNA, 22 nt, Human
ucaggcugguggucagauggcu

SEQ ID NO: 1134350 - RNA, 22 nt, Human
gcugucaggaacaugccuuggu

SEQ ID NO: 1134351 - RNA, 22 nt, Human
ugggccuggguuccuccugggc

SEQ ID NO: 1134352 - RNA, 19 nt, Human
cagaacagaggucauggcc

SEQ ID NO: 1134353 - RNA, 22 nt, Human
ccagggcaaaugagaucauagc

SEQ ID NO: 1134354 - RNA, 22 nt, Human
ggcuccuggggaggugagcuug

SEQ ID NO: 1134355 - RNA, 22 nt, Human
accuggccauccagcuggcauc

SEQ ID NO: 1134356 - RNA, 22 nt, Human
gggaggcuggcucuggccacag

SEQ ID NO: 1134357 - RNA, 22 nt, Human
ucaaaugcuucuacuccuaaga

SEQ ID NO: 1134358 - RNA, 22 nt, Human
ccugccaggccagugagcuucc

SEQ ID NO: 1134359 - RNA, 22 nt, Human
aagagcuggucacagguccauu

SEQ ID NO: 1134360 - RNA, 22 nt, Human
cugggaggugcagcaaaaauca

SEQ ID NO: 1134361 - RNA, 22 nt, Human
ugggcacuauggcucugugcac

SEQ ID NO: 1134362 - RNA, 22 nt, Human
agggccagaggcaccuugcagc

SEQ ID NO: 1134363 - RNA, 22 nt, Human
cuguucaugcugauucuguaug

SEQ ID NO: 1134364 - RNA, 22 nt, Human
ugcuggccaauggcagaggcgg

SEQ ID NO: 1134365 - RNA, 22 nt, Human
gcagagcccuggggguauggug

SEQ ID NO: 1134366 - RNA, 22 nt, Human
agugaaaacacuaguucuugcc

SEQ ID NO: 1134367 - RNA, 22 nt, Human
gggugggaacaggaugccagga

SEQ ID NO: 1134368 - RNA, 21 nt, Human
ccaggcagagcugugaguucu

SEQ ID NO: 1134369 - RNA, 22 nt, Human
ucugggcucugucagcaccucu

SEQ ID NO: 1134370 - RNA, 22 nt, Human
aggcacugaauauccaguaaaa

SEQ ID NO: 1134371 - RNA, 22 nt, Human
uaaagguacgaagugagggauu

SEQ ID NO: 1134372 - RNA, 22 nt, Human
gcugucuggaggcucugaggga

SEQ ID NO: 1134373 - RNA, 22 nt, Human
cacugagaggucucauuuccaa

SEQ ID NO: 1134374 - RNA, 22 nt, Human
guuugauucaagaacaaagagu

SEQ ID NO: 1134375 - RNA, 22 nt, Human
uggcucaguaaucgagucuccu

SEQ ID NO: 1134376 - RNA, 22 nt, Human
caucagcacuaugauuaaagua

SEQ ID NO: 1134377 - RNA, 22 nt, Human
gcucugcuguguuuguucagca

SEQ ID NO: 1134378 - RNA, 22 nt, Human
ccuucugcuggucaucccagug

SEQ ID NO: 1134379 - RNA, 22 nt, Human
ugaaaucuucacuaagucucuu

SEQ ID NO: 1134380 - RNA, 17 nt, Human
cgagggcuugcuggcuc

SEQ ID NO: 1134381 - RNA, 22 nt, Human
agugaggcuaauaggcaauggu

SEQ ID NO: 1134382 - RNA, 22 nt, Human
cuggagccccagacagggagag

SEQ ID NO: 1134383 - RNA, 22 nt, Human
guaggcagucucucaggugauc

SEQ ID NO: 1134384 - RNA, 22 nt, Human
cauugcacuccagcuugggcaa

SEQ ID NO: 1134385 - RNA, 22 nt, Human
ggaaagagcuaaaagggugaga

SEQ ID NO: 1134386 - RNA, 22 nt, Human
gcaggcaguuugcuuuucccuc

SEQ ID NO: 1134387 - RNA, 22 nt, Human
agcagcucacaggauuccugaa

SEQ ID NO: 1134388 - RNA, 22 nt, Human
uaggagcuaaaauauuuuauau

SEQ ID NO: 1134389 - RNA, 22 nt, Human
aggcccuguuaugagccacugu

SEQ ID NO: 1134390 - RNA, 22 nt, Human
uauacuuuccugcaacuuugau

SEQ ID NO: 1134391 - RNA, 22 nt, Human
ccugccugcuuucugcuuugca

SEQ ID NO: 1134392 - RNA, 22 nt, Human
gcaaggcuuugugaauuuuaaa

SEQ ID NO: 1134393 - RNA, 22 nt, Human
gcaugggcaagaggacuggggg

SEQ ID NO: 1134394 - RNA, 22 nt, Human
aggcccugggcaguucuguagc

SEQ ID NO: 1134395 - RNA, 22 nt, Human
uggcucugugcuucuaguaucu

SEQ ID NO: 1134396 - RNA, 22 nt, Human
uggcccugccacucacugcuga

SEQ ID NO: 1134397 - RNA, 22 nt, Human
ccauaagguuuggggccaugca

SEQ ID NO: 1134398 - RNA, 22 nt, Human
gcaagauguuaacauagggaga

SEQ ID NO: 1134399 - RNA, 22 nt, Human
ucugucacuuuuauuuacugaa

SEQ ID NO: 1134400 - RNA, 22 nt, Human
cuuauaaaguccaucugaacaa

SEQ ID NO: 1134401 - RNA, 22 nt, Human
agacuuugagcucuuagagaag

SEQ ID NO: 1134402 - RNA, 22 nt, Human
uggccugggcaugaagcaucgu

SEQ ID NO: 1134403 - RNA, 23 nt, Human
ggcacugaagcuacaauggugag

SEQ ID NO: 1134404 - RNA, 23 nt, Human
ugaugggaaggaacgacuaccac

SEQ ID NO: 1134405 - RNA, 22 nt, Human
aggcccaguuauccuacuuguu

SEQ ID NO: 1134406 - RNA, 22 nt, Human
cacaggaggaggccagagcgua

SEQ ID NO: 1134407 - RNA, 22 nt, Human
ggcugggcugcugggucagagc

SEQ ID NO: 1134408 - RNA, 22 nt, Human
uggccucuuaggacauccucua

SEQ ID NO: 1134409 - RNA, 22 nt, Human
ggcugcagcagagggacucacg

SEQ ID NO: 1134410 - RNA, 22 nt, Human
auuugucuagugguauucacgu

SEQ ID NO: 1134411 - RNA, 22 nt, Human
ugaagcccugugucagcuucca

SEQ ID NO: 1134412 - RNA, 22 nt, Human
aagcaaaagguuacacuucugg

SEQ ID NO: 1134413 - RNA, 23 nt, Human
ucccagggaaggugagcgaggcu

SEQ ID NO: 1134414 - RNA, 23 nt, Human
ugcuucucugcuugacaguucug

SEQ ID NO: 1134415 - RNA, 22 nt, Human
caguguuccaggcggcagugaa

SEQ ID NO: 1134416 - RNA, 18 nt, Human
aggagccuuugcacugga

SEQ ID NO: 1134417 - RNA, 22 nt, Human
caaagugcuggaauuacaggug

SEQ ID NO: 1134418 - RNA, 22 nt, Human
ccagcagagcauggggaggaag

SEQ ID NO: 1134419 - RNA, 22 nt, Human
uuuccucuucuucccaugucau

SEQ ID NO: 1134420 - RNA, 22 nt, Human
aagggcagcuauuaucgucauc

SEQ ID NO: 1134421 - RNA, 22 nt, Human
cugccuggccugaucuccacgc

SEQ ID NO: 1134422 - RNA, 22 nt, Human
aagaacauguuaaaagauucac

SEQ ID NO: 1134423 - RNA, 22 nt, Human
ccugauggagcccugcugcaug

SEQ ID NO: 1134424 - RNA, 22 nt, Human
aagauuuccuucaguagagcua

SEQ ID NO: 1134425 - RNA, 22 nt, Human
ggcaaaaaccauaauuacuuuu

SEQ ID NO: 1134426 - RNA, 22 nt, Human
gcucccacgcaauucuuuucag

SEQ ID NO: 1134427 - RNA, 22 nt, Human
ccagguggacggcgaguacagg

SEQ ID NO: 1134428 - RNA, 22 nt, Human
ugcagaaggccugacauugcac

SEQ ID NO: 1134429 - RNA, 22 nt, Human
uaacagaaauuuuaguuagggg

SEQ ID NO: 1134430 - RNA, 22 nt, Human
gcucaggagcugacagccucaa

SEQ ID NO: 1134431 - RNA, 21 nt, Human
cagcuuugucugucuucgggg

SEQ ID NO: 1134432 - RNA, 22 nt, Human
ugcauccuuaaccagcaucacu

SEQ ID NO: 1134433 - RNA, 22 nt, Human
augggaggcagcagagcccagc

SEQ ID NO: 1134434 - RNA, 22 nt, Human
auguacauuuguaguaauauca

SEQ ID NO: 1134435 - RNA, 22 nt, Human
gggcagcagaggaucccuuaau

SEQ ID NO: 1134436 - RNA, 22 nt, Human
ugaugggaaaaugaggccuggg

SEQ ID NO: 1134437 - RNA, 22 nt, Human
gccuucugcgcucgugucuccg

SEQ ID NO: 1134438 - RNA, 22 nt, Human
guuguauagagggcaugaaucu

SEQ ID NO: 1134439 - RNA, 22 nt, Human
cagggcagcuuccuuuguuagg

SEQ ID NO: 1134440 - RNA, 22 nt, Human
auggacagugugaagcagauag

SEQ ID NO: 1134441 - RNA, 22 nt, Human
uuugcauuaucucacuuauaua

SEQ ID NO: 1134442 - RNA, 22 nt, Human
caggagcucucaucgucagggc

SEQ ID NO: 1134443 - RNA, 22 nt, Human
uagccucucuccuccacaaccu

SEQ ID NO: 1134444 - RNA, 22 nt, Human
cuguccuuacugcuucuggcuu

SEQ ID NO: 1134445 - RNA, 22 nt, Human
gggcuaggcuuggccagcacug

SEQ ID NO: 1134446 - RNA, 22 nt, Human
cccugccuacaggguuuucuuu

SEQ ID NO: 1134447 - RNA, 22 nt, Human
accaucagucacauguagagaa

SEQ ID NO: 1134448 - RNA, 22 nt, Human
cugccuguuagucuagcaguua

SEQ ID NO: 1134449 - RNA, 22 nt, Human
cuguauuuucaugccuacguac

SEQ ID NO: 1134450 - RNA, 22 nt, Human
uauguguacaucugguugagca

SEQ ID NO: 1134451 - RNA, 22 nt, Human
cugugucccccucagccaggug

SEQ ID NO: 1134452 - RNA, 22 nt, Human
auuuauuaugggauuuggcaca

SEQ ID NO: 1134453 - RNA, 22 nt, Human
gcagggacgccagggacagcaa

SEQ ID NO: 1134454 - RNA, 22 nt, Human
cuuggcagcuuuuggaggagcc

SEQ ID NO: 1134455 - RNA, 22 nt, Human
cagggccagccgcagcauccac

SEQ ID NO: 1134456 - RNA, 22 nt, Human
augauacaagcaaaacuaauca

SEQ ID NO: 1134457 - RNA, 22 nt, Human
aaggccugggaguacugggaca

SEQ ID NO: 1134458 - RNA, 22 nt, Human
ugagccagucugucugggugaa

SEQ ID NO: 1134459 - RNA, 22 nt, Human
ugggauggagccugaguauagu

SEQ ID NO: 1134460 - RNA, 22 nt, Human
aggggugaaggcccgauaggag

SEQ ID NO: 1134461 - RNA, 22 nt, Human
ugcugccaaaugcgagcucugu

SEQ ID NO: 1134462 - RNA, 22 nt, Human
gagccuggauagccuuguucca

SEQ ID NO: 1134463 - RNA, 22 nt, Human
caggagcccagaguccucagcu

SEQ ID NO: 1134464 - RNA, 22 nt, Human
caccaucagcagcaggugucaa

SEQ ID NO: 1134465 - RNA, 22 nt, Human
accuggagucauuugaggagua

SEQ ID NO: 1134466 - RNA, 22 nt, Human
ugugaaggcagcagcucugucc

SEQ ID NO: 1134467 - RNA, 22 nt, Human
gagggcugaagauuguggcccc

SEQ ID NO: 1134468 - RNA, 22 nt, Human
gugccugugccaggggugugcu

SEQ ID NO: 1134469 - RNA, 22 nt, Human
ugaugggaggugcugcaggacc

SEQ ID NO: 1134470 - RNA, 22 nt, Human
caaagcucaugcucuuagccau

SEQ ID NO: 1134471 - RNA, 22 nt, Human
ccacagagagugucagccuuug

SEQ ID NO: 1134472 - RNA, 22 nt, Human
acaaauguggacauggauaaug

SEQ ID NO: 1134473 - RNA, 22 nt, Human
uggucucugacucugaagaccc

SEQ ID NO: 1134474 - RNA, 22 nt, Human
cucuguagaaacagggcagaag

SEQ ID NO: 1134475 - RNA, 22 nt, Human
uucuaacucuguuauguguuuc

SEQ ID NO: 1134476 - RNA, 22 nt, Human
aaugcugcucucauaauuauag

SEQ ID NO: 1134477 - RNA, 22 nt, Human
uaaggcacccauguucauacag

SEQ ID NO: 1134478 - RNA, 20 nt, Human
gcugccagugccugaugcuu

SEQ ID NO: 1134479 - RNA, 22 nt, Human
gucuggaggaggaagaaggcac

SEQ ID NO: 1134480 - RNA, 21 nt, Human
ugcagagauaucugaagcaga

SEQ ID NO: 1134481 - RNA, 22 nt, Human
agccucugucaagcuuuucaaa

SEQ ID NO: 1134482 - RNA, 22 nt, Human
ccaggguggcguagaugcuggg

SEQ ID NO: 1134483 - RNA, 22 nt, Human
uccagccuuucuacucacugag

SEQ ID NO: 1134484 - RNA, 22 nt, Human
uaaagcaggccacauaugugau

SEQ ID NO: 1134485 - RNA, 22 nt, Human
augcaguaaauguuaagaaaaa

SEQ ID NO: 1134486 - RNA, 22 nt, Human
cuggggggagcugcguccagca

SEQ ID NO: 1134487 - RNA, 19 nt, Human
cagucccaaauucuuguca

SEQ ID NO: 1134488 - RNA, 22 nt, Human
uggcagagaauaaaucuugacu

SEQ ID NO: 1134489 - RNA, 22 nt, Human
ggcucaggccuguaauccuagc

SEQ ID NO: 1134490 - RNA, 22 nt, Human
uaggcaacaugucgaauacugu

SEQ ID NO: 1134491 - RNA, 22 nt, Human
agugucauuccagggacccucg

SEQ ID NO: 1134492 - RNA, 22 nt, Human
uggcagagguauauugggagga

SEQ ID NO: 1134493 - RNA, 20 nt, Human
agaaucugacccagagagac

SEQ ID NO: 1134494 - RNA, 22 nt, Human
cauuaucucuucuauaugcuag

SEQ ID NO: 1134495 - RNA, 22 nt, Human
aaguuugagagccuuuaguaua

SEQ ID NO: 1134496 - RNA, 22 nt, Human
guauauaucggcacuauuuuaa

SEQ ID NO: 1134497 - RNA, 22 nt, Human
gugcucaggaagcuguuccugc

SEQ ID NO: 1134498 - RNA, 22 nt, Human
caguuaaaggcccaauaucugg

SEQ ID NO: 1134499 - RNA, 22 nt, Human
uagacacaagagaaggguauaa

SEQ ID NO: 1134500 - RNA, 22 nt, Human
agccuucaguaaauccacugug

SEQ ID NO: 1134501 - RNA, 22 nt, Human
gcaggcagaucaccugucagga

SEQ ID NO: 1134502 - RNA, 19 nt, Human
uguuuuguuaaagcagucc

SEQ ID NO: 1134503 - RNA, 22 nt, Human
uguguguguccucauuugcaga

SEQ ID NO: 1134504 - RNA, 22 nt, Human
caggggacaguaugguggauga

SEQ ID NO: 1134505 - RNA, 22 nt, Human
cucuggagguugagcccagcaa

SEQ ID NO: 1134506 - RNA, 22 nt, Human
ccucucucuccugcacacacac

SEQ ID NO: 1134507 - RNA, 22 nt, Human
agagcuggguggacuuguaguu

SEQ ID NO: 1134508 - RNA, 22 nt, Human
cugugccuaagaugcaugucuc

SEQ ID NO: 1134509 - RNA, 17 nt, Human
gcaaucucagucuccuu

SEQ ID NO: 1134510 - RNA, 21 nt, Human
agggcagauuagcuguaagag

SEQ ID NO: 1134511 - RNA, 22 nt, Human
gcugagcugggacaguccuggg

SEQ ID NO: 1134512 - RNA, 22 nt, Human
aggauccugcgcuuugggggag

SEQ ID NO: 1134513 - RNA, 22 nt, Human
cucugaagggagggccaagccc

SEQ ID NO: 1134514 - RNA, 22 nt, Human
cuaggaggcgggggcugcagua

SEQ ID NO: 1134515 - RNA, 22 nt, Human
ugcagaggagcuggaaggcugg

SEQ ID NO: 1134516 - RNA, 22 nt, Human
cuguuuaucuaggaguugcagg

SEQ ID NO: 1134517 - RNA, 22 nt, Human
agaugcugucacacacacuguu

SEQ ID NO: 1134518 - RNA, 22 nt, Human
aggcuccuugcucacaggcuca

SEQ ID NO: 1134519 - RNA, 22 nt, Human
gcugccuuuugcuccucccacc

SEQ ID NO: 1134520 - RNA, 22 nt, Human
ucacauacacuaggauauuuuu

SEQ ID NO: 1134521 - RNA, 22 nt, Human
agacaaagacagcaucucaggu

SEQ ID NO: 1134522 - RNA, 22 nt, Human
agagccugaggaugucccagcu

SEQ ID NO: 1134523 - RNA, 22 nt, Human
agggcccuccccgcucagggca

SEQ ID NO: 1134524 - RNA, 22 nt, Human
cucucuucccgugaguguugca

SEQ ID NO: 1134525 - RNA, 22 nt, Human
ccuggagccccucuggccagcc

SEQ ID NO: 1134526 - RNA, 22 nt, Human
uggcucaguuucugcccagcug

SEQ ID NO: 1134527 - RNA, 22 nt, Human
cagcagugaugugugaggguuc

SEQ ID NO: 1134528 - RNA, 19 nt, Human
cagaguccuugaccagucc

SEQ ID NO: 1134529 - RNA, 22 nt, Human
ugcugggggcuuucuggauacc

SEQ ID NO: 1134530 - RNA, 22 nt, Human
ccagaagggcuauugcagugac

SEQ ID NO: 1134531 - RNA, 22 nt, Human
acugaaggguaaugugggagcc

SEQ ID NO: 1134532 - RNA, 22 nt, Human
ucagagguaagggcugagagga

SEQ ID NO: 1134533 - RNA, 22 nt, Human
uggcacugggacagaugcucuc

SEQ ID NO: 1134534 - RNA, 22 nt, Human
gcuggugagcaaaggagaagga

SEQ ID NO: 1134535 - RNA, 21 nt, Human
ugcuucucuagaucaacuacu

SEQ ID NO: 1134536 - RNA, 22 nt, Human
gcagggcuguucaggagggugg

SEQ ID NO: 1134537 - RNA, 22 nt, Human
gggcugcuuauacugaugauaa

SEQ ID NO: 1134538 - RNA, 22 nt, Human
caggaucccuggccuccgccca

SEQ ID NO: 1134539 - RNA, 22 nt, Human
gacacauagaucuaucucacuc

SEQ ID NO: 1134540 - RNA, 22 nt, Human
uuggccuuguuaaggaggcccu

SEQ ID NO: 1134541 - RNA, 21 nt, Human
ucucuggaauuagaccauguu

SEQ ID NO: 1134542 - RNA, 22 nt, Human
ccacagggucagccacucugca

SEQ ID NO: 1134543 - RNA, 22 nt, Human
acucugaggagugacuagaggu

SEQ ID NO: 1134544 - RNA, 22 nt, Human
cccagcaggucggugcugccug

SEQ ID NO: 1134545 - RNA, 22 nt, Human
gagggcagagucuaaugaugca

SEQ ID NO: 1134546 - RNA, 22 nt, Human
uggcacugccuggcagggcccc

SEQ ID NO: 1134547 - RNA, 22 nt, Human
agcugcugaaugacacugcaag

SEQ ID NO: 1134548 - RNA, 22 nt, Human
cuggaaggcucugcugccuguc

SEQ ID NO: 1134549 - RNA, 22 nt, Human
cuuggcagagggcugggcucag

SEQ ID NO: 1134550 - RNA, 22 nt, Human
gugucccagccccacaggccug

SEQ ID NO: 1134551 - RNA, 22 nt, Human
agcugcugugugcucaggcagg

SEQ ID NO: 1134552 - RNA, 20 nt, Human
ugcuugucaugcacucaggc

SEQ ID NO: 1134553 - RNA, 22 nt, Human
guccucagucaguuuggugggg

SEQ ID NO: 1134554 - RNA, 22 nt, Human
ccugucaggguuugccucagaa

SEQ ID NO: 1134555 - RNA, 22 nt, Human
agcagcugagccccagcuguga

SEQ ID NO: 1134556 - RNA, 22 nt, Human
ugcucuguauucuauggcaguu

SEQ ID NO: 1134557 - RNA, 19 nt, Human
auguuuuaugcugauggga

SEQ ID NO: 1134558 - RNA, 22 nt, Human
agcucccagcagagcuggccac

SEQ ID NO: 1134559 - RNA, 19 nt, Human
ucgagucaagacacuaggc

SEQ ID NO: 1134560 - RNA, 22 nt, Human
ugcagcuucuuguccugugauu

SEQ ID NO: 1134561 - RNA, 22 nt, Human
ggccaugguuggggaagacaug

SEQ ID NO: 1134562 - RNA, 22 nt, Human
gggaggugauggcaagcagcgg

SEQ ID NO: 1134563 - RNA, 22 nt, Human
uggcagcugucuguggggucuc

SEQ ID NO: 1134564 - RNA, 22 nt, Human
aggcuccaugcaaaggcuguuu

SEQ ID NO: 1134565 - RNA, 22 nt, Human
acuguacuguguauuguagaau

SEQ ID NO: 1134566 - RNA, 22 nt, Human
ggccaccuuccaguugccugca

SEQ ID NO: 1134567 - RNA, 22 nt, Human
cagagacaguuucacagggucu

SEQ ID NO: 1134568 - RNA, 23 nt, Human
cuuuuaacuugaucugagaccag

SEQ ID NO: 1134569 - RNA, 20 nt, Human
guggccuguccuguuguggg

SEQ ID NO: 1134570 - RNA, 20 nt, Human
gcucccagccugcagucccc

SEQ ID NO: 1134571 - RNA, 22 nt, Human
uaaaugcagcaguuucuguucu

SEQ ID NO: 1134572 - RNA, 22 nt, Human
uccacagaauguaagauccaca

SEQ ID NO: 1134573 - RNA, 22 nt, Human
uaugcacaauaugaucuauuug

SEQ ID NO: 1134574 - RNA, 22 nt, Human
ggcagaggaaggaugaauucac

SEQ ID NO: 1134575 - RNA, 17 nt, Human
uccagagcacagagcuc

SEQ ID NO: 1134576 - RNA, 18 nt, Human
cccacggugcuguagggc

SEQ ID NO: 1134577 - RNA, 22 nt, Human
cgccugggaguccacaccugcu

SEQ ID NO: 1134578 - RNA, 22 nt, Human
gggcuggcucccagguguugaa

SEQ ID NO: 1134579 - RNA, 22 nt, Human
caggggccaggcugucugcugu

SEQ ID NO: 1134580 - RNA, 22 nt, Human
ucaaaccaccuuguuacugggg

SEQ ID NO: 1134581 - RNA, 20 nt, Human
ucccuggaggugguggcauc

SEQ ID NO: 1134582 - RNA, 22 nt, Human
ugucaccaugccagcuucugcc

SEQ ID NO: 1134583 - RNA, 22 nt, Human
ccaaggcuccucagcuggucuu

SEQ ID NO: 1134584 - RNA, 22 nt, Human
gccccucccagucaggagcacu

SEQ ID NO: 1134585 - RNA, 22 nt, Human
aauuuagaauucgcuagcuaau

SEQ ID NO: 1134586 - RNA, 22 nt, Human
aaggcacugacugugcagggga

SEQ ID NO: 1134587 - RNA, 22 nt, Human
cagcaauaguguguuuguuuca

SEQ ID NO: 1134588 - RNA, 22 nt, Human
ccaggcugagcaugauuggagc

SEQ ID NO: 1134589 - RNA, 22 nt, Human
uccuugaacagagggccugggu

SEQ ID NO: 1134590 - RNA, 19 nt, Human
gcacugaagaguuggucac

SEQ ID NO: 1134591 - RNA, 19 nt, Human
uugaauaugcaaacugaag

SEQ ID NO: 1134592 - RNA, 22 nt, Human
ccuggcagcaggugggcccgug

SEQ ID NO: 1134593 - RNA, 22 nt, Human
augaugguggguaauguguaaa

SEQ ID NO: 1134594 - RNA, 22 nt, Human
cagagcuggguuugggaaaccu

SEQ ID NO: 1134595 - RNA, 22 nt, Human
auuuguaauuucuuaucugugu

SEQ ID NO: 1134596 - RNA, 22 nt, Human
uagaaagcuugggguguuuaaa

SEQ ID NO: 1134597 - RNA, 22 nt, Human
cugcccagaaucacucacucga

SEQ ID NO: 1134598 - RNA, 22 nt, Human
gagguggccucaagcagucuuc

SEQ ID NO: 1134599 - RNA, 18 nt, Human
agcagcugucagaaugcc

SEQ ID NO: 1134600 - RNA, 22 nt, Human
uuuucauuguaaaucaggaaac

SEQ ID NO: 1134601 - RNA, 22 nt, Human
gggaaccagccgcuuccgccuc

SEQ ID NO: 1134602 - RNA, 20 nt, Human
ugcuggggacauacagggug

SEQ ID NO: 1134603 - RNA, 19 nt, Human
augauggucccauucaccu

SEQ ID NO: 1134604 - RNA, 22 nt, Human
ggcuucagugacuggugcccuc

SEQ ID NO: 1134605 - RNA, 22 nt, Human
ucccaggcuaggccucugcguu

SEQ ID NO: 1134606 - RNA, 22 nt, Human
agauggggcagaauggagccau

SEQ ID NO: 1134607 - RNA, 22 nt, Human
ugcugccaggucuugcugucca

SEQ ID NO: 1134608 - RNA, 22 nt, Human
gaaaugcauggaucuuggcaga

SEQ ID NO: 1134609 - RNA, 22 nt, Human
uuugcauugccucugacuuaug

SEQ ID NO: 1134610 - RNA, 22 nt, Human
uggaggaaaauuacuggggucu

SEQ ID NO: 1134611 - RNA, 22 nt, Human
ugucagaacucuauugaugucc

SEQ ID NO: 1134612 - RNA, 22 nt, Human
uagaaaagaauuuuauuugaua

SEQ ID NO: 1134613 - RNA, 22 nt, Human
ucaguguaaguuauguagaugu

SEQ ID NO: 1134614 - RNA, 22 nt, Human
uggggccuggucagagcugcac

SEQ ID NO: 1134615 - RNA, 18 nt, Human
ugacagaaccuggagccu

SEQ ID NO: 1134616 - RNA, 22 nt, Human
ccagcugggauuaagggaaaau

SEQ ID NO: 1134617 - RNA, 22 nt, Human
uaagcuauuccugaagaagguu

SEQ ID NO: 1134618 - RNA, 22 nt, Human
cugaggccucuguucaccagaa

SEQ ID NO: 1134619 - RNA, 22 nt, Human
uggagcugacucacaccagcua

SEQ ID NO: 1134620 - RNA, 22 nt, Human
gucuuuauuugagauugucauu

SEQ ID NO: 1134621 - RNA, 22 nt, Human
uguggcuuaagaaugccuuuaa

SEQ ID NO: 1134622 - RNA, 22 nt, Human
uggccuuguguuuuagagaaag

SEQ ID NO: 1134623 - RNA, 22 nt, Human
auucucaaacaagugguuugau

SEQ ID NO: 1134624 - RNA, 22 nt, Human
cagggugcagugucgcugcuag

SEQ ID NO: 1134625 - RNA, 19 nt, Human
uccaaaggacccaccucca

SEQ ID NO: 1134626 - RNA, 22 nt, Human
uucaagaugacccagucacacg

SEQ ID NO: 1134627 - RNA, 22 nt, Human
cagggagaggcaucauagggaa

SEQ ID NO: 1134628 - RNA, 22 nt, Human
ugagccagaggaggcugugugg

SEQ ID NO: 1134629 - RNA, 22 nt, Human
agcugcucuugggugacuucaa

SEQ ID NO: 1134630 - RNA, 22 nt, Human
guacuuccguggacuaauuguu

SEQ ID NO: 1134631 - RNA, 22 nt, Human
uucacauugugcagauuauggu

SEQ ID NO: 1134632 - RNA, 22 nt, Human
uugaagcaugguacuuguucaa

SEQ ID NO: 1134633 - RNA, 17 nt, Human
ucugccgacugccagcu

SEQ ID NO: 1134634 - RNA, 22 nt, Human
gugcagcugugugagagcucca

SEQ ID NO: 1134635 - RNA, 22 nt, Human
ugcagaaggaggaggaaaucca

SEQ ID NO: 1134636 - RNA, 22 nt, Human
ggccuugggauguggcugcagc

SEQ ID NO: 1134637 - RNA, 22 nt, Human
agucucagggccacccggggaa

SEQ ID NO: 1134638 - RNA, 22 nt, Human
ucauugcacuccagccugggca

SEQ ID NO: 1134639 - RNA, 22 nt, Human
ggcagcucacugauuagcaauu

SEQ ID NO: 1134640 - RNA, 22 nt, Human
ggcuggcacucuguccaguguc

SEQ ID NO: 1134641 - RNA, 20 nt, Human
ugucauuguuucuaggaccu

SEQ ID NO: 1134642 - RNA, 22 nt, Human
cugcugagcccuggcacaggug

SEQ ID NO: 1134643 - RNA, 22 nt, Human
ggcugaaguguaguggcucacu

SEQ ID NO: 1134644 - RNA, 22 nt, Human
gaggucaggggagaggcugaug

SEQ ID NO: 1134645 - RNA, 22 nt, Human
auaugccauuagcuagaaauaa

SEQ ID NO: 1134646 - RNA, 22 nt, Human
gaaaaaugagcugaugucaggg

SEQ ID NO: 1134647 - RNA, 22 nt, Human
aggcacugaagaacucuuuuug

SEQ ID NO: 1134648 - RNA, 22 nt, Human
gaggcugcggggaggagccugc

SEQ ID NO: 1134649 - RNA, 22 nt, Human
uggcagagagacucuccuugau

SEQ ID NO: 1134650 - RNA, 22 nt, Human
auguguguguauauacacacau

SEQ ID NO: 1134651 - RNA, 22 nt, Human
aaguuuguguaguuuagcaucc

SEQ ID NO: 1134652 - RNA, 22 nt, Human
gccuucugugcuccuggccuuu

SEQ ID NO: 1134653 - RNA, 22 nt, Human
caagggaccugagauggucucu

SEQ ID NO: 1134654 - RNA, 22 nt, Human
guggagccaggaucuccgcaca

SEQ ID NO: 1134655 - RNA, 22 nt, Human
ggcugccagugagugcagaccg

SEQ ID NO: 1134656 - RNA, 18 nt, Human
uggagcugagugcugugc

SEQ ID NO: 1134657 - RNA, 22 nt, Human
ggcucuggugggaagguuagau

SEQ ID NO: 1134658 - RNA, 22 nt, Human
cuauugaaaguguacaauucaa

SEQ ID NO: 1134659 - RNA, 22 nt, Human
gcaggggaguggaugauggauu

SEQ ID NO: 1134660 - RNA, 22 nt, Human
cccugagagugagugccaccuu

SEQ ID NO: 1134661 - RNA, 22 nt, Human
ucuggcucacuucaggcuucac

SEQ ID NO: 1134662 - RNA, 22 nt, Human
cagagccugccaccuuucuccc

SEQ ID NO: 1134663 - RNA, 22 nt, Human
uccagggaugguaaugagcagu

SEQ ID NO: 1134664 - RNA, 22 nt, Human
uacaaagucaccagcuucuugc

SEQ ID NO: 1134665 - RNA, 22 nt, Human
ucuggcucugacacuacuguua

SEQ ID NO: 1134666 - RNA, 22 nt, Human
gcuucuggaggagcugggcuga

SEQ ID NO: 1134667 - RNA, 22 nt, Human
guuauaaaugacugcaaaaguu

SEQ ID NO: 1134668 - RNA, 22 nt, Human
acaguaaugauucugagucucu

SEQ ID NO: 1134669 - RNA, 22 nt, Human
acauuucucagguaagucauuu

SEQ ID NO: 1134670 - RNA, 22 nt, Human
ccagucugugugccagccugcg

SEQ ID NO: 1134671 - RNA, 22 nt, Human
gggccuccggggugagcugugg

SEQ ID NO: 1134672 - RNA, 22 nt, Human
cugagccauccauaccagcuua

SEQ ID NO: 1134673 - RNA, 22 nt, Human
aagcagggugucuugacccaug

SEQ ID NO: 1134674 - RNA, 22 nt, Human
cugcugccggcgagccucccuu

SEQ ID NO: 1134675 - RNA, 22 nt, Human
gucccuggucuaccguggcuuc

SEQ ID NO: 1134676 - RNA, 22 nt, Human
uugcauugggagugaggagacc

SEQ ID NO: 1134677 - RNA, 18 nt, Human
gaagggagcuggaaugca

SEQ ID NO: 1134678 - RNA, 19 nt, Human
accaggcuuauggucagug

SEQ ID NO: 1134679 - RNA, 22 nt, Human
uuggaaggagucaaccagcuga

SEQ ID NO: 1134680 - RNA, 22 nt, Human
uuuccucugacugcuccccugc

SEQ ID NO: 1134681 - RNA, 22 nt, Human
cagccaggcccccgagucguug

SEQ ID NO: 1134682 - RNA, 22 nt, Human
gcuggccugggcagaggcuaug

SEQ ID NO: 1134683 - RNA, 20 nt, Human
ucugucucugagcuagacuu

SEQ ID NO: 1134684 - RNA, 22 nt, Human
aaggcacugaaaaauugugugu

SEQ ID NO: 1134685 - RNA, 22 nt, Human
cccagcagaaucugaugagggc

SEQ ID NO: 1134686 - RNA, 20 nt, Human
auacaaagagauugauguau

SEQ ID NO: 1134687 - RNA, 22 nt, Human
cuucuccucugaguccugggag

SEQ ID NO: 1134688 - RNA, 22 nt, Human
gcacugcagccucagauggugg

SEQ ID NO: 1134689 - RNA, 22 nt, Human
caggccugcaggaaaggcuccc

SEQ ID NO: 1134690 - RNA, 22 nt, Human
agcccaaggcuucccugcuggc

SEQ ID NO: 1134691 - RNA, 22 nt, Human
agcuggagaugcccagcaccgg

SEQ ID NO: 1134692 - RNA, 22 nt, Human
cuuauaguaugauguugagaau

SEQ ID NO: 1134693 - RNA, 22 nt, Human
caggaaccuaaugaaggcucac

SEQ ID NO: 1134694 - RNA, 22 nt, Human
ccaaggaguagagcaggaagcu

SEQ ID NO: 1134695 - RNA, 22 nt, Human
ucuggcucuguguccucaccca

SEQ ID NO: 1134696 - RNA, 22 nt, Human
aggucacccguuugacuaucca

SEQ ID NO: 1134697 - RNA, 22 nt, Human
caaaugcagucccuuuguugcu

SEQ ID NO: 1134698 - RNA, 22 nt, Human
ggugggcacauucagucucugu

SEQ ID NO: 1134699 - RNA, 22 nt, Human
gagacauggcaaaagcacuggu

SEQ ID NO: 1134700 - RNA, 22 nt, Human
uggccuuggcagugagaagagu

SEQ ID NO: 1134701 - RNA, 22 nt, Human
guccucuggccuuucccaggac

SEQ ID NO: 1134702 - RNA, 20 nt, Human
uguacacaguacuuuacaau

SEQ ID NO: 1134703 - RNA, 22 nt, Human
uucuggagcuaaaguccacucu

SEQ ID NO: 1134704 - RNA, 18 nt, Human
cacaggcucccagugagg

SEQ ID NO: 1134705 - RNA, 22 nt, Human
gccugcagugagugcagaaggu

SEQ ID NO: 1134706 - RNA, 22 nt, Human
gagcagcucgagaaggaagcag

SEQ ID NO: 1134707 - RNA, 22 nt, Human
gcacacagccagcugagggcua

SEQ ID NO: 1134708 - RNA, 22 nt, Human
ggucauugucagagccuguacu

SEQ ID NO: 1134709 - RNA, 20 nt, Human
aagcaauauagugcaaaugu

SEQ ID NO: 1134710 - RNA, 22 nt, Human
gcagagccaugggagguuuuug

SEQ ID NO: 1134711 - RNA, 22 nt, Human
acuuagaacaggcagaauucca

SEQ ID NO: 1134712 - RNA, 22 nt, Human
ucugaggcauacccaggccccc

SEQ ID NO: 1134713 - RNA, 22 nt, Human
aaagauuugaaauuaggcauca

SEQ ID NO: 1134714 - RNA, 22 nt, Human
uacauguaagacaugagacucu

SEQ ID NO: 1134715 - RNA, 22 nt, Human
ucaggcagaccaccgugggcag

SEQ ID NO: 1134716 - RNA, 22 nt, Human
guguaauugaaauugagaacca

SEQ ID NO: 1134717 - RNA, 22 nt, Human
auuguggcuagacagucacaau

SEQ ID NO: 1134718 - RNA, 23 nt, Human
gugugccaagcacugugccagga

SEQ ID NO: 1134719 - RNA, 22 nt, Human
acuuucucaaaucagacuuuaa

SEQ ID NO: 1134720 - RNA, 22 nt, Human
cccaggaggccaagguugcagu

SEQ ID NO: 1134721 - RNA, 22 nt, Human
agccuccaucccaugcacaaag

SEQ ID NO: 1134722 - RNA, 22 nt, Human
aagcagccucauuugugguaag

SEQ ID NO: 1134723 - RNA, 22 nt, Human
uuguccuuggaugaagcuggga

SEQ ID NO: 1134724 - RNA, 22 nt, Human
cccagcucucucaguucugcuu

SEQ ID NO: 1134725 - RNA, 22 nt, Human
gcagaagggaauaaggagcuuu

SEQ ID NO: 1134726 - RNA, 22 nt, Human
guaaaguucuauuugaauuuag

SEQ ID NO: 1134727 - RNA, 22 nt, Human
cucugggcaggaccaguggacc

SEQ ID NO: 1134728 - RNA, 22 nt, Human
ccaaagugcugggguuacaggc

SEQ ID NO: 1134729 - RNA, 22 nt, Human
agaaaugcauuagcacauauag

SEQ ID NO: 1134730 - RNA, 22 nt, Human
aucagcaaucucguguauuagg

SEQ ID NO: 1134731 - RNA, 22 nt, Human
gugggacucuucuuuggcagug

SEQ ID NO: 1134732 - RNA, 22 nt, Human
uugugaaacauucauggauuug

SEQ ID NO: 1134733 - RNA, 22 nt, Human
ucaggauaaaauguaauggcaa

SEQ ID NO: 1134734 - RNA, 22 nt, Human
gcagugaaacaauaggaucaaa

SEQ ID NO: 1134735 - RNA, 22 nt, Human
ugcacacacgcggcacaucugu

SEQ ID NO: 1134736 - RNA, 22 nt, Human
acugccuugaaagauuguugag

SEQ ID NO: 1134737 - RNA, 22 nt, Human
ugaaaguugcacauaagagaau

SEQ ID NO: 1134738 - RNA, 22 nt, Human
ugagguggcuagggaggcacuc

SEQ ID NO: 1134739 - RNA, 20 nt, Human
ccucaagcagacugacagcu

SEQ ID NO: 1134740 - RNA, 22 nt, Human
gccuuccuuacaccugcucagc

SEQ ID NO: 1134741 - RNA, 22 nt, Human
ugucccucauugacgcugugcc

SEQ ID NO: 1134742 - RNA, 22 nt, Human
gcugucuugcucacucuugcag

SEQ ID NO: 1134743 - RNA, 22 nt, Human
uggcucaguuugggggauugaa

SEQ ID NO: 1134744 - RNA, 17 nt, Human
acaagcaguggccaugg

SEQ ID NO: 1134745 - RNA, 22 nt, Human
aaacuguaaacacagcaguaca

SEQ ID NO: 1134746 - RNA, 22 nt, Human
agccagagcugaugucauucuc

SEQ ID NO: 1134747 - RNA, 22 nt, Human
ccaggcuggagugcaauggugc

SEQ ID NO: 1134748 - RNA, 22 nt, Human
aagggcuggccacauucugggu

SEQ ID NO: 1134749 - RNA, 22 nt, Human
ggggcagaguagcuggggugug

SEQ ID NO: 1134750 - RNA, 22 nt, Human
cuguuuauaaauagaggggagu

SEQ ID NO: 1134751 - RNA, 22 nt, Human
aaugggagguaguaugggaggu

SEQ ID NO: 1134752 - RNA, 22 nt, Human
guugaauacuugagaaauccau

SEQ ID NO: 1134753 - RNA, 22 nt, Human
agugauggagcuuccucugcua

SEQ ID NO: 1134754 - RNA, 23 nt, Human
uuuuaauuuggacauaagaagau

SEQ ID NO: 1134755 - RNA, 22 nt, Human
uugaauucauuucucauugagu

SEQ ID NO: 1134756 - RNA, 22 nt, Human
cuccuggacauggagcggagga

SEQ ID NO: 1134757 - RNA, 22 nt, Human
gcucugcugcuuacuagauggu

SEQ ID NO: 1134758 - RNA, 22 nt, Human
gagguagccacagauagagacu

SEQ ID NO: 1134759 - RNA, 22 nt, Human
cuuagaaauaaugguuucaguu

SEQ ID NO: 1134760 - RNA, 22 nt, Human
ugcacacaguucucaggaaaga

SEQ ID NO: 1134761 - RNA, 22 nt, Human
uuguuucagcuguaugcuaugu

SEQ ID NO: 1134762 - RNA, 22 nt, Human
ggcauguuucaucacaucaaga

SEQ ID NO: 1134763 - RNA, 22 nt, Human
ccugggaggcagagguugcagu

SEQ ID NO: 1134764 - RNA, 22 nt, Human
aacucaguguguuucuuaguau

SEQ ID NO: 1134765 - RNA, 22 nt, Human
acagaguagcucaagaagauug

SEQ ID NO: 1134766 - RNA, 21 nt, Human
gccacugcacuccagccuggg

SEQ ID NO: 1134767 - RNA, 22 nt, Human
aucuggcucacuuagucuagga

SEQ ID NO: 1134768 - RNA, 21 nt, Human
uuacuuuugcagcaaccuaau

SEQ ID NO: 1134769 - RNA, 22 nt, Human
gcucacagccggcuggcagggg

SEQ ID NO: 1134770 - RNA, 22 nt, Human
caggaacacaaguucagggaug

SEQ ID NO: 1134771 - RNA, 17 nt, Human
gccuuccuuccuccaca

SEQ ID NO: 1134772 - RNA, 22 nt, Human
ccugcagagccacgugccagcg

SEQ ID NO: 1134773 - RNA, 22 nt, Human
gaggaagcagggcuuggcugag

SEQ ID NO: 1134774 - RNA, 22 nt, Human
agcagcugaccagugaguccug

SEQ ID NO: 1134775 - RNA, 22 nt, Human
uuucuuccuuaccuuacuagag

SEQ ID NO: 1134776 - RNA, 22 nt, Human
agugcagugguuaggagccagg

SEQ ID NO: 1134777 - RNA, 22 nt, Human
ccugucucuuucaaucugagag

SEQ ID NO: 1134778 - RNA, 22 nt, Human
cuggcugcaggaugaggcugcc

SEQ ID NO: 1134779 - RNA, 22 nt, Human
uggcucaggauaauuuucccaa

SEQ ID NO: 1134780 - RNA, 22 nt, Human
cugcccugcccaggccuugggc

SEQ ID NO: 1134781 - RNA, 22 nt, Human
cugggagggguagccaauccua

SEQ ID NO: 1134782 - RNA, 22 nt, Human
agucucugccagcuuguccucu

SEQ ID NO: 1134783 - RNA, 22 nt, Human
cagcucugaagaaaggugucua

SEQ ID NO: 1134784 - RNA, 22 nt, Human
gcucugcuugcaucaugacugc

SEQ ID NO: 1134785 - RNA, 17 nt, Human
gccucugcuugugucau

SEQ ID NO: 1134786 - RNA, 22 nt, Human
acacugcucacuucuucccuug

SEQ ID NO: 1134787 - RNA, 22 nt, Human
uuccucagagggcgcuggggaa

SEQ ID NO: 1134788 - RNA, 22 nt, Human
ucugcaggccucgacaaggcca

SEQ ID NO: 1134789 - RNA, 20 nt, Human
uuccagagaucugcauuuua

SEQ ID NO: 1134790 - RNA, 22 nt, Human
aaaucugguucaguaaguccuc

SEQ ID NO: 1134791 - RNA, 19 nt, Human
uggaggagaggaaaaguca

SEQ ID NO: 1134792 - RNA, 22 nt, Human
acagauugaucuugagaauuau

SEQ ID NO: 1134793 - RNA, 22 nt, Human
uggggguguccuggugcacaca

SEQ ID NO: 1134794 - RNA, 22 nt, Human
gccaggcagcagcgaggauggu

SEQ ID NO: 1134795 - RNA, 22 nt, Human
ccuaugccugucacucugcgcu

SEQ ID NO: 1134796 - RNA, 22 nt, Human
uacaugcaugucacagaaugaa

SEQ ID NO: 1134797 - RNA, 20 nt, Human
cuaucuccuggcgugccuuc

SEQ ID NO: 1134798 - RNA, 22 nt, Human
ggcagcuguaagaugagugaau

SEQ ID NO: 1134799 - RNA, 18 nt, Human
gcugccugcauuccucac

SEQ ID NO: 1134800 - RNA, 22 nt, Human
aaggucauugguucugaauucu

SEQ ID NO: 1134801 - RNA, 22 nt, Human
gugauuucagguuuuucauacu

SEQ ID NO: 1134802 - RNA, 22 nt, Human
ggucauugaaaucagaaggguu

SEQ ID NO: 1134803 - RNA, 22 nt, Human
ggcagccauggacacuggcuag

SEQ ID NO: 1134804 - RNA, 22 nt, Human
gcaucuucacacaaagccagug

SEQ ID NO: 1134805 - RNA, 18 nt, Human
ggcugagguugacuagaa

SEQ ID NO: 1134806 - RNA, 22 nt, Human
cacaugcauaaggauaauuacu

SEQ ID NO: 1134807 - RNA, 22 nt, Human
ggucacaggggagaagagugau

SEQ ID NO: 1134808 - RNA, 22 nt, Human
ccugagccugaguggugcaggg

SEQ ID NO: 1134809 - RNA, 22 nt, Human
ucagagucauugcaaguagaag

SEQ ID NO: 1134810 - RNA, 22 nt, Human
caggagugucuccacacagcaa

SEQ ID NO: 1134811 - RNA, 22 nt, Human
uacauacacaaauauacuguuu

SEQ ID NO: 1134812 - RNA, 22 nt, Human
uccugccuucauacugcuguau

SEQ ID NO: 1134813 - RNA, 22 nt, Human
cuguuuuugugcugugucuccc

SEQ ID NO: 1134814 - RNA, 23 nt, Human
agcacagacuagaaaggucuuuc

SEQ ID NO: 1134815 - RNA, 22 nt, Human
gauacaaauucaugucugaauu

SEQ ID NO: 1134816 - RNA, 22 nt, Human
ucacaggguguacaucaccuau

SEQ ID NO: 1134817 - RNA, 22 nt, Human
uucaagauccagcacaacagug

SEQ ID NO: 1134818 - RNA, 22 nt, Human
auaugucgcuacaucauuagau

SEQ ID NO: 1134819 - RNA, 22 nt, Human
guuuuguucuuguccagggaaa

SEQ ID NO: 1134820 - RNA, 22 nt, Human
uuugcauuaguuuagauuucaa

SEQ ID NO: 1134821 - RNA, 21 nt, Human
ucagggcagcugcucuucaga

SEQ ID NO: 1134822 - RNA, 22 nt, Human
ggccugcucugcagccucuaca

SEQ ID NO: 1134823 - RNA, 22 nt, Human
cauugacaguucuuuaaguugc

SEQ ID NO: 1134824 - RNA, 22 nt, Human
uagagcuggccgggacagcugg

SEQ ID NO: 1134825 - RNA, 22 nt, Human
aaauugugcucacacugauauu

SEQ ID NO: 1134826 - RNA, 22 nt, Human
aaaggucauugaaaaggaggaa

SEQ ID NO: 1134827 - RNA, 21 nt, Human
ucccugcuuucuggcccaguc

SEQ ID NO: 1134828 - RNA, 22 nt, Human
cccugcagccuugcaugccuuc

SEQ ID NO: 1134829 - RNA, 22 nt, Human
agguggggugagcugcagacua

SEQ ID NO: 1134830 - RNA, 22 nt, Human
acaggccugacacacagagggc

SEQ ID NO: 1134831 - RNA, 22 nt, Human
cugccagcucaaagcgcagcua

SEQ ID NO: 1134832 - RNA, 22 nt, Human
ggggcuguuuuuggaauggcug

SEQ ID NO: 1134833 - RNA, 22 nt, Human
aggcugucugaccccagagccc

SEQ ID NO: 1134834 - RNA, 22 nt, Human
ucagccugcuccaagugcugcc

SEQ ID NO: 1134835 - RNA, 22 nt, Human
agugauggugagugagaagcuc

SEQ ID NO: 1134836 - RNA, 22 nt, Human
agguugaacccccaagaccuau

SEQ ID NO: 1134837 - RNA, 22 nt, Human
uggaaggggagcuggaaagggg

SEQ ID NO: 1134838 - RNA, 22 nt, Human
uggccugauuuugcuaagagaa

SEQ ID NO: 1134839 - RNA, 22 nt, Human
ggaggugggagacauaggcggc

SEQ ID NO: 1134840 - RNA, 22 nt, Human
uauucacauguacauaugcuca

SEQ ID NO: 1134841 - RNA, 22 nt, Human
ugaagccuuguguggccucucu

SEQ ID NO: 1134842 - RNA, 22 nt, Human
gcacagggagacagccguggcc

SEQ ID NO: 1134843 - RNA, 22 nt, Human
ccagcagagggucuuggccauu

SEQ ID NO: 1134844 - RNA, 19 nt, Human
ucucaauguucagaaagcu

SEQ ID NO: 1134845 - RNA, 22 nt, Human
gauccuugcaacucugugaggu

SEQ ID NO: 1134846 - RNA, 22 nt, Human
cagagcuguccaaacccugaca

SEQ ID NO: 1134847 - RNA, 22 nt, Human
agcagcauguugggaugugaaa

SEQ ID NO: 1134848 - RNA, 22 nt, Human
gaggcugcugagagcccuguuu

SEQ ID NO: 1134849 - RNA, 22 nt, Human
aggccuguuggcgugggcucua

SEQ ID NO: 1134850 - RNA, 22 nt, Human
ucauugcagcuucagguguuca

SEQ ID NO: 1134851 - RNA, 22 nt, Human
cccagacugcagagcgggcaga

SEQ ID NO: 1134852 - RNA, 22 nt, Human
ggaggguuagcaaaggcacaga

SEQ ID NO: 1134853 - RNA, 22 nt, Human
agaagccauugaagcagaccuc

SEQ ID NO: 1134854 - RNA, 19 nt, Human
cugaagucuuuucagcugg

SEQ ID NO: 1134855 - RNA, 22 nt, Human
guaacaaaguuucuaggugcug

SEQ ID NO: 1134856 - RNA, 22 nt, Human
agggcugcuccuccuucaggcc

SEQ ID NO: 1134857 - RNA, 22 nt, Human
cugaggcuuggaggggucuggu

SEQ ID NO: 1134858 - RNA, 22 nt, Human
caagggccuccaccuugcucgu

SEQ ID NO: 1134859 - RNA, 22 nt, Human
aggcucagcugguggugaucgc

SEQ ID NO: 1134860 - RNA, 22 nt, Human
gagcaggccagcaauggaaggg

SEQ ID NO: 1134861 - RNA, 22 nt, Human
cagagcugggcauggugaaagg

SEQ ID NO: 1134862 - RNA, 22 nt, Human
uuccgcuggggccgccuggcgg

SEQ ID NO: 1134863 - RNA, 22 nt, Human
gccugucaauuuuguguacaau

SEQ ID NO: 1134864 - RNA, 22 nt, Human
cauguacaguuuuucuguccug

SEQ ID NO: 1134865 - RNA, 22 nt, Human
uuugcauugcauacaaggaacu

SEQ ID NO: 1134866 - RNA, 22 nt, Human
ccugcugggccugagcaaugag

SEQ ID NO: 1134867 - RNA, 22 nt, Human
ucugccuucgcugcucccugaa

SEQ ID NO: 1134868 - RNA, 22 nt, Human
gugcagugaaaaaagaaugucc

SEQ ID NO: 1134869 - RNA, 22 nt, Human
uauuucuguaugcauaaaagga

SEQ ID NO: 1134870 - RNA, 21 nt, Human
auuauuauuucuguguccagc

SEQ ID NO: 1134871 - RNA, 22 nt, Human
uacaguagacaauguuaguaug

SEQ ID NO: 1134872 - RNA, 17 nt, Human
ucuggccuuccugaacu

SEQ ID NO: 1134873 - RNA, 17 nt, Human
uauguguguguuuauac

SEQ ID NO: 1134874 - RNA, 22 nt, Human
uggcucagcgguggcagcagac

SEQ ID NO: 1134875 - RNA, 22 nt, Human
uggcucagagccuugagagcug

SEQ ID NO: 1134876 - RNA, 22 nt, Human
cuggagcccaggccuggugucu

SEQ ID NO: 1134877 - RNA, 17 nt, Human
ucuuuccugccaugcuc

SEQ ID NO: 1134878 - RNA, 22 nt, Human
cugcagagguugguucuaagau

SEQ ID NO: 1134879 - RNA, 22 nt, Human
guccucuguagggcugggccac

SEQ ID NO: 1134880 - RNA, 22 nt, Human
uauagagguggaaacugagguu

SEQ ID NO: 1134881 - RNA, 22 nt, Human
ggcugggcaggucugcacaggg

SEQ ID NO: 1134882 - RNA, 22 nt, Human
uggccaggggaguuccccucca

SEQ ID NO: 1134883 - RNA, 22 nt, Human
agaguguuucagucuuccuaga

SEQ ID NO: 1134884 - RNA, 22 nt, Human
cugagccagcgggcucacuuuu

SEQ ID NO: 1134885 - RNA, 22 nt, Human
uguguacauaucuauccuagau

SEQ ID NO: 1134886 - RNA, 22 nt, Human
uaauuuauuucaacugccaagg

SEQ ID NO: 1134887 - RNA, 20 nt, Human
ucaggcaguggggaaaggca

SEQ ID NO: 1134888 - RNA, 22 nt, Human
ccaggagccacucaggcccaca

SEQ ID NO: 1134889 - RNA, 17 nt, Human
agccccucagcgucacc

SEQ ID NO: 1134890 - RNA, 17 nt, Human
acagagguuauacagac

SEQ ID NO: 1134891 - RNA, 22 nt, Human
caguuucuguuuuaaauagcag

SEQ ID NO: 1134892 - RNA, 22 nt, Human
uggcucuggauuaaucuaggaa

SEQ ID NO: 1134893 - RNA, 22 nt, Human
gcugucugcugugcacugagca

SEQ ID NO: 1134894 - RNA, 17 nt, Human
agcagcuggguugaucu

SEQ ID NO: 1134895 - RNA, 22 nt, Human
ucuccuggauggaccuucucuu

SEQ ID NO: 1134896 - RNA, 22 nt, Human
caggaggaacaagagguucugg

SEQ ID NO: 1134897 - RNA, 22 nt, Human
ccagcucuggcuucuugcuggg

SEQ ID NO: 1134898 - RNA, 22 nt, Human
ugcauuaugcuacccagaagcu

SEQ ID NO: 1134899 - RNA, 22 nt, Human
ugggcuggcguggagaguuuag

SEQ ID NO: 1134900 - RNA, 22 nt, Human
ugcagaagaaaacagcugugug

SEQ ID NO: 1134901 - RNA, 22 nt, Human
aaaugucugagacuucugaacu

SEQ ID NO: 1134902 - RNA, 22 nt, Human
aaggcagauauaaagacuagag

SEQ ID NO: 1134903 - RNA, 22 nt, Human
aaguccauaguuugcauuacag

SEQ ID NO: 1134904 - RNA, 20 nt, Human
uccuucaggcagggccuagu

SEQ ID NO: 1134905 - RNA, 22 nt, Human
ugaagaugucagcagggguggu

SEQ ID NO: 1134906 - RNA, 22 nt, Human
cagggcuguuagcugcugcucu

SEQ ID NO: 1134907 - RNA, 22 nt, Human
aagccuuggcccuucauuauaa

SEQ ID NO: 1134908 - RNA, 22 nt, Human
ggcaaggccuugcccagcauuc

SEQ ID NO: 1134909 - RNA, 22 nt, Human
gcugugcagucuuuggugugcc

SEQ ID NO: 1134910 - RNA, 22 nt, Human
uagaauaugugguaggaucugg

SEQ ID NO: 1134911 - RNA, 22 nt, Human
uggcucuguuuguuaacuagac

SEQ ID NO: 1134912 - RNA, 22 nt, Human
aguggcagccgagcaggagaug

SEQ ID NO: 1134913 - RNA, 22 nt, Human
ugccacagaggugaagcccacu

SEQ ID NO: 1134914 - RNA, 22 nt, Human
cagacuuucaaggagugaaggc

SEQ ID NO: 1134915 - RNA, 22 nt, Human
cccuccagagcuugaccugcug

SEQ ID NO: 1134916 - RNA, 22 nt, Human
ggcugcugaguuggccaggaga

SEQ ID NO: 1134917 - RNA, 22 nt, Human
uggccucucuaccaggcagccu

SEQ ID NO: 1134918 - RNA, 20 nt, Human
aguguuccggaagacuggca

SEQ ID NO: 1134919 - RNA, 22 nt, Human
agagcagaggcauggccguggg

SEQ ID NO: 1134920 - RNA, 22 nt, Human
cccagcuccgagcuccgagccg

SEQ ID NO: 1134921 - RNA, 22 nt, Human
cuguccuggagggcauaggacg

SEQ ID NO: 1134922 - RNA, 22 nt, Human
aguggugcugcgcgcggagcuc

SEQ ID NO: 1134923 - RNA, 22 nt, Human
uagcauuuauggucaugugucc

SEQ ID NO: 1134924 - RNA, 22 nt, Human
ugucccaggcugaaguacagug

SEQ ID NO: 1134925 - RNA, 22 nt, Human
cucucucuuguguugcugcaga

SEQ ID NO: 1134926 - RNA, 22 nt, Human
gcguggugcugcccugcacaca

SEQ ID NO: 1134927 - RNA, 22 nt, Human
ggcagcugagcauggcuaccuu

SEQ ID NO: 1134928 - RNA, 22 nt, Human
guguguccaggcgggagucaag

SEQ ID NO: 1134929 - RNA, 22 nt, Human
uaaaugugaccuucauuuuaua

SEQ ID NO: 1134930 - RNA, 22 nt, Human
accagccugucugagucguggg

SEQ ID NO: 1134931 - RNA, 22 nt, Human
agcugcagagguuugugcaaca

SEQ ID NO: 1134932 - RNA, 22 nt, Human
uguauguguauguacauaugca

SEQ ID NO: 1134933 - RNA, 22 nt, Human
auacuuuggggguuaguguaga

SEQ ID NO: 1134934 - RNA, 22 nt, Human
caggccuggagugcaauggcac

SEQ ID NO: 1134935 - RNA, 23 nt, Human
uggcucuguggaucccucaggag

SEQ ID NO: 1134936 - RNA, 23 nt, Human
ugggggugcacgggccacaucuu

SEQ ID NO: 1134937 - RNA, 22 nt, Human
gagcuuccauggacgccaucug

SEQ ID NO: 1134938 - RNA, 22 nt, Human
auccaguucucagugcuuacag

SEQ ID NO: 1134939 - RNA, 22 nt, Human
cuuucucuguguuucacaugcu

SEQ ID NO: 1134940 - RNA, 22 nt, Human
auggcagggcagccucucagag

SEQ ID NO: 1134941 - RNA, 22 nt, Human
ugucaugcccaggagcaaggua

SEQ ID NO: 1134942 - RNA, 22 nt, Human
gacagggcgagacucagucuca

SEQ ID NO: 1134943 - RNA, 22 nt, Human
ucugggagagcugcugucagag

SEQ ID NO: 1134944 - RNA, 22 nt, Human
aggcucugugacaaucaagcug

SEQ ID NO: 1134945 - RNA, 22 nt, Human
ggcagcaggagccaucugguag

SEQ ID NO: 1134946 - RNA, 22 nt, Human
cccuggaggucagaggccuggg

SEQ ID NO: 1134947 - RNA, 22 nt, Human
aaaagagucuuaggcagucaua

SEQ ID NO: 1134948 - RNA, 22 nt, Human
uccugugccuccaccugcuccg

SEQ ID NO: 1134949 - RNA, 21 nt, Human
agcagagugcuuugacuuugu

SEQ ID NO: 1134950 - RNA, 22 nt, Human
uaggacaggugaggggcugugg

SEQ ID NO: 1134951 - RNA, 22 nt, Human
uugauacaggccuucuagauga

SEQ ID NO: 1134952 - RNA, 22 nt, Human
caggccagugugcuucccaggc

SEQ ID NO: 1134953 - RNA, 22 nt, Human
ccugggugaaaucucuccugca

SEQ ID NO: 1134954 - RNA, 22 nt, Human
cacugccugugagcugugugcc

SEQ ID NO: 1134955 - RNA, 22 nt, Human
ugagccagccuugcagcugugc

SEQ ID NO: 1134956 - RNA, 22 nt, Human
gcccauggacacccaagugcca

SEQ ID NO: 1134957 - RNA, 23 nt, Human
cagguggcuccacgagggguggg

SEQ ID NO: 1134958 - RNA, 22 nt, Human
uggagccagagcgcagccuggg

SEQ ID NO: 1134959 - RNA, 22 nt, Human
uccucaggucaaagcaggagaa

SEQ ID NO: 1134960 - RNA, 22 nt, Human
gagccuggccuccugccucagc

SEQ ID NO: 1134961 - RNA, 22 nt, Human
cccagcccccgagugucuggaa

SEQ ID NO: 1134962 - RNA, 22 nt, Human
aggcacugguccauuuucugca

SEQ ID NO: 1134963 - RNA, 19 nt, Human
cuguccuuggcugcacugu

SEQ ID NO: 1134964 - RNA, 22 nt, Human
ccagggugagugucauggguua

SEQ ID NO: 1134965 - RNA, 22 nt, Human
gugugugccaacuuuaugugca

SEQ ID NO: 1134966 - RNA, 19 nt, Human
cagagcugcuggccucguc

SEQ ID NO: 1134967 - RNA, 19 nt, Human
cuggcucuuggguggagga

SEQ ID NO: 1134968 - RNA, 22 nt, Human
ucaguuuuaagguuugagaauu

SEQ ID NO: 1134969 - RNA, 22 nt, Human
augcaguggcagcuccuggugu

SEQ ID NO: 1134970 - RNA, 22 nt, Human
gccaagagaaugugagagaaau

SEQ ID NO: 1134971 - RNA, 22 nt, Human
gaguuauuucagaaggaaagau

SEQ ID NO: 1134972 - RNA, 22 nt, Human
uauuucugauugcucaugaggc

SEQ ID NO: 1134973 - RNA, 22 nt, Human
caugcacuuaccugaaauucaa

SEQ ID NO: 1134974 - RNA, 22 nt, Human
ccucugccaccucccacgaggc

SEQ ID NO: 1134975 - RNA, 22 nt, Human
gguuugcaugugauguugggca

SEQ ID NO: 1134976 - RNA, 22 nt, Human
uacaugcucaguaacuuucagu

SEQ ID NO: 1134977 - RNA, 22 nt, Human
ccucaggggugcccacagcugc

SEQ ID NO: 1134978 - RNA, 22 nt, Human
gcagcuggagccagccagacac

SEQ ID NO: 1134979 - RNA, 22 nt, Human
caagccucagaaucuucuccau

SEQ ID NO: 1134980 - RNA, 22 nt, Human
acagagcucccagccaucuccu

SEQ ID NO: 1134981 - RNA, 22 nt, Human
cagggagaucuuggcuccuggu

SEQ ID NO: 1134982 - RNA, 22 nt, Human
cccuggaguagcacugggucgc

SEQ ID NO: 1134983 - RNA, 22 nt, Human
uuuccucuucgauuaaguuugg

SEQ ID NO: 1134984 - RNA, 21 nt, Human
guggcccugccgcagugucca

SEQ ID NO: 1134985 - RNA, 22 nt, Human
caagaaaugggauuugacugcc

SEQ ID NO: 1134986 - RNA, 22 nt, Human
cugggcugagccugggcugugu

SEQ ID NO: 1134987 - RNA, 22 nt, Human
agcagcagaggucagaaaggua

SEQ ID NO: 1134988 - RNA, 22 nt, Human
uguauguguccuaauucaagca

SEQ ID NO: 1134989 - RNA, 22 nt, Human
ccuggcugcuuucacuauggag

SEQ ID NO: 1134990 - RNA, 22 nt, Human
ugcauuguugaugaguugaaua

SEQ ID NO: 1134991 - RNA, 22 nt, Human
cagagccaugguaugggcuugu

SEQ ID NO: 1134992 - RNA, 22 nt, Human
aaagaacaucggagugggcggg

SEQ ID NO: 1134993 - RNA, 22 nt, Human
uucaaugagcccaagaacguga

SEQ ID NO: 1134994 - RNA, 22 nt, Human
ucaggcagagcuguggagcucu

SEQ ID NO: 1134995 - RNA, 22 nt, Human
aguguuccugcucucaggaagc

SEQ ID NO: 1134996 - RNA, 22 nt, Human
gcugcaggcgccugcggucucu

SEQ ID NO: 1134997 - RNA, 17 nt, Human
aucuggcugcuucuaga

SEQ ID NO: 1134998 - RNA, 22 nt, Human
uacaggaggauuaucaaaggau

SEQ ID NO: 1134999 - RNA, 22 nt, Human
gccucugcugcaagccugguug

SEQ ID NO: 1135000 - RNA, 22 nt, Human
uuucacaucagagguagauuag

SEQ ID NO: 1135001 - RNA, 22 nt, Human
uuaaacaguguuucaugugggg

SEQ ID NO: 1135002 - RNA, 22 nt, Human
cccuggagcuagucugagcaga

SEQ ID NO: 1135003 - RNA, 22 nt, Human
gggcuucucuuaugcuaacugg

SEQ ID NO: 1135004 - RNA, 22 nt, Human
gcucugcugucuucuugcaggc

SEQ ID NO: 1135005 - RNA, 22 nt, Human
ugagcugggcugggcugagcug

SEQ ID NO: 1135006 - RNA, 22 nt, Human
ccuggaagauucaccacuacca

SEQ ID NO: 1135007 - RNA, 22 nt, Human
agucccagccuguaggauuggg

SEQ ID NO: 1135008 - RNA, 22 nt, Human
ggagccuggccuggcucugugu

SEQ ID NO: 1135009 - RNA, 22 nt, Human
ccuccugggacaggcuggcaca

SEQ ID NO: 1135010 - RNA, 22 nt, Human
ggacagagcccugguggccuaa

SEQ ID NO: 1135011 - RNA, 22 nt, Human
ugcuggcuggccuggccuggac

SEQ ID NO: 1135012 - RNA, 22 nt, Human
ucacuuuugaucccuaugcagu

SEQ ID NO: 1135013 - RNA, 22 nt, Human
cuggagcugcuguccuugggug

SEQ ID NO: 1135014 - RNA, 22 nt, Human
agaggucauaucucagaagaga

SEQ ID NO: 1135015 - RNA, 22 nt, Human
ucagaagacuacuaggacacau

SEQ ID NO: 1135016 - RNA, 22 nt, Human
ggcugucugugguggagcguug

SEQ ID NO: 1135017 - RNA, 22 nt, Human
ccugccaggacauugcuugaag

SEQ ID NO: 1135018 - RNA, 22 nt, Human
gaggggcugggcagucccugga

SEQ ID NO: 1135019 - RNA, 22 nt, Human
uaauuauaacaguuacaucuua

SEQ ID NO: 1135020 - RNA, 22 nt, Human
aagauuuaccacuuuauucaag

SEQ ID NO: 1135021 - RNA, 22 nt, Human
uguacaauagcuauuaucucca

SEQ ID NO: 1135022 - RNA, 22 nt, Human
ccugggcagggcuggacucuca

SEQ ID NO: 1135023 - RNA, 20 nt, Human
ugcucugucuaaaacuuccc

SEQ ID NO: 1135024 - RNA, 22 nt, Human
uggcagaggagaauuaagauua

SEQ ID NO: 1135025 - RNA, 22 nt, Human
ugcuucaggagaugucaccaug

SEQ ID NO: 1135026 - RNA, 22 nt, Human
auguuuugauugguuaggucug

SEQ ID NO: 1135027 - RNA, 22 nt, Human
caggagcaaggagcagugggau

SEQ ID NO: 1135028 - RNA, 22 nt, Human
caguacuuguccucagguguua

SEQ ID NO: 1135029 - RNA, 22 nt, Human
uccagccaugcaugacaaucac

SEQ ID NO: 1135030 - RNA, 22 nt, Human
aauagguagccagauauauaaa

SEQ ID NO: 1135031 - RNA, 19 nt, Human
cccagagcauccugaacuu

SEQ ID NO: 1135032 - RNA, 23 nt, Human
uugugggcagauuccauggggag

SEQ ID NO: 1135033 - RNA, 22 nt, Human
gcaggcagagguggaggagaca

SEQ ID NO: 1135034 - RNA, 22 nt, Human
gccaggcagauaugugagcuua

SEQ ID NO: 1135035 - RNA, 22 nt, Human
acaggcugcugggcuccgugcu

SEQ ID NO: 1135036 - RNA, 22 nt, Human
cuggccuggucuggccucucca

SEQ ID NO: 1135037 - RNA, 22 nt, Human
uacauaguuccauuuacaggaa

SEQ ID NO: 1135038 - RNA, 22 nt, Human
ugucauugaggaaaacuaggug

SEQ ID NO: 1135039 - RNA, 22 nt, Human
aaauguguuuagaugguuuauu

SEQ ID NO: 1135040 - RNA, 20 nt, Human
uaacagaaguagaagugggu

SEQ ID NO: 1135041 - RNA, 22 nt, Human
gccaaagcagucuugccucugc

SEQ ID NO: 1135042 - RNA, 22 nt, Human
gugggggcaggcagugcuagga

SEQ ID NO: 1135043 - RNA, 22 nt, Human
acacaugcauaagccuucccuu

SEQ ID NO: 1135044 - RNA, 22 nt, Human
ugauuuccaauaaggagaaugu

SEQ ID NO: 1135045 - RNA, 22 nt, Human
aacauacagugagcaguggacu

SEQ ID NO: 1135046 - RNA, 19 nt, Human
gccagcagaaugaugaggc

SEQ ID NO: 1135047 - RNA, 22 nt, Human
aguccaugaugaaaccagaucc

SEQ ID NO: 1135048 - RNA, 18 nt, Human
aggccugggaagcugagg

SEQ ID NO: 1135049 - RNA, 22 nt, Human
ucugcagaaguggcugggccac

SEQ ID NO: 1135050 - RNA, 22 nt, Human
cagaacugggcagggagcagag

SEQ ID NO: 1135051 - RNA, 22 nt, Human
cuccucugucuggcccugagcc

SEQ ID NO: 1135052 - RNA, 22 nt, Human
ugcagaagugagucaugaggaa

SEQ ID NO: 1135053 - RNA, 22 nt, Human
gcagccuguuguaccagccugu

SEQ ID NO: 1135054 - RNA, 22 nt, Human
ucacagcaaaagugugcagagc

SEQ ID NO: 1135055 - RNA, 22 nt, Human
cagggccaccguguuugcugcu

SEQ ID NO: 1135056 - RNA, 22 nt, Human
caagacaagaucuaagcaugcu

SEQ ID NO: 1135057 - RNA, 22 nt, Human
caggguggaagcuguagagugg

SEQ ID NO: 1135058 - RNA, 22 nt, Human
gccuggaguggacuuggccccu

SEQ ID NO: 1135059 - RNA, 22 nt, Human
agcugguguccuccuggagcug

SEQ ID NO: 1135060 - RNA, 22 nt, Human
uugcaggggaaggagcagagcu

SEQ ID NO: 1135061 - RNA, 22 nt, Human
uccuucaguuaaagaucucaca

SEQ ID NO: 1135062 - RNA, 22 nt, Human
aaagaacagauguguggugcau

SEQ ID NO: 1135063 - RNA, 22 nt, Human
uccuggaggggacagcaugggc

SEQ ID NO: 1135064 - RNA, 22 nt, Human
acacagggcugcgccugacccc

SEQ ID NO: 1135065 - RNA, 22 nt, Human
agcuuaggaggaugaugaacau

SEQ ID NO: 1135066 - RNA, 22 nt, Human
ggaucauuaacacauccaucac

SEQ ID NO: 1135067 - RNA, 22 nt, Human
ugccagcaguagcaguaggcca

SEQ ID NO: 1135068 - RNA, 22 nt, Human
cugagccauaagggaggcuggg

SEQ ID NO: 1135069 - RNA, 22 nt, Human
uccagcucuaacaugcugggcc

SEQ ID NO: 1135070 - RNA, 22 nt, Human
cagcauggggcuuggagucagc

SEQ ID NO: 1135071 - RNA, 22 nt, Human
ugccucuguggaaauggugguc

SEQ ID NO: 1135072 - RNA, 22 nt, Human
acauuucuuugcuagacagcag

SEQ ID NO: 1135073 - RNA, 23 nt, Human
augcucugggcugugggaccugc

SEQ ID NO: 1135074 - RNA, 22 nt, Human
ugcacacaaaugugaacgugcc

SEQ ID NO: 1135075 - RNA, 22 nt, Human
ugaggcuguucuaccagggcca

SEQ ID NO: 1135076 - RNA, 22 nt, Human
agccuucauaaucuugggcuuu

SEQ ID NO: 1135077 - RNA, 22 nt, Human
agucccagcuacucaagaggcu

SEQ ID NO: 1135078 - RNA, 22 nt, Human
cugaggccagcugcagagcucu

SEQ ID NO: 1135079 - RNA, 22 nt, Human
gcccaugcacuuucugugaugg

SEQ ID NO: 1135080 - RNA, 22 nt, Human
uuccagggcuaauuccugugga

SEQ ID NO: 1135081 - RNA, 22 nt, Human
gcugucuguggugucagcugac

SEQ ID NO: 1135082 - RNA, 22 nt, Human
cuggcuuccucaggagcagugg

SEQ ID NO: 1135083 - RNA, 22 nt, Human
ccacugaaggucaacauagagc

SEQ ID NO: 1135084 - RNA, 22 nt, Human
gcagagacuccacugucuugug

SEQ ID NO: 1135085 - RNA, 22 nt, Human
gaaacccaaacuaagacaguag

SEQ ID NO: 1135086 - RNA, 22 nt, Human
uguggcucucaugcacucccag

SEQ ID NO: 1135087 - RNA, 21 nt, Human
uccacaaguuagaaggaaauu

SEQ ID NO: 1135088 - RNA, 22 nt, Human
ccuggcacgaagggcugagguu

SEQ ID NO: 1135089 - RNA, 22 nt, Human
gagccagccuucuucugagguc

SEQ ID NO: 1135090 - RNA, 20 nt, Human
aaaaacaguaaugcugaaga

SEQ ID NO: 1135091 - RNA, 22 nt, Human
gcuggggcugggcugaggaaga

SEQ ID NO: 1135092 - RNA, 22 nt, Human
acauuucucauucuccccuaac

SEQ ID NO: 1135093 - RNA, 22 nt, Human
aaaggucagacuuaggcugggc

SEQ ID NO: 1135094 - RNA, 22 nt, Human
agggcuggcuaggugcguuccc

SEQ ID NO: 1135095 - RNA, 21 nt, Human
ggcacugagccagauggacuc

SEQ ID NO: 1135096 - RNA, 22 nt, Human
aaggccugggaggccucucuuc

SEQ ID NO: 1135097 - RNA, 22 nt, Human
cccuggagggcagacagaugcc

SEQ ID NO: 1135098 - RNA, 22 nt, Human
gggcacuguacacugugcaugg

SEQ ID NO: 1135099 - RNA, 22 nt, Human
ucaguuuuguauguuguaaguc

SEQ ID NO: 1135100 - RNA, 22 nt, Human
ucagccacuacccaccuuaaca

SEQ ID NO: 1135101 - RNA, 22 nt, Human
accaugggucagccaccucagc

SEQ ID NO: 1135102 - RNA, 22 nt, Human
ucccagaaaaaggaggcuauga

SEQ ID NO: 1135103 - RNA, 18 nt, Human
acagaaauagcugugccu

SEQ ID NO: 1135104 - RNA, 22 nt, Human
gucaugccagcggagcucggga

SEQ ID NO: 1135105 - RNA, 22 nt, Human
agcacagaguugcagagagcgu

SEQ ID NO: 1135106 - RNA, 22 nt, Human
augcagguugggcaaguguggg

SEQ ID NO: 1135107 - RNA, 22 nt, Human
cuguauuuaguuaaaaugcuaa

SEQ ID NO: 1135108 - RNA, 23 nt, Human
ucagugauguugaaccuagcagu

SEQ ID NO: 1135109 - RNA, 22 nt, Human
cagagccaggucuaggagucuc

SEQ ID NO: 1135110 - RNA, 22 nt, Human
ccagggcacuuaggcccagccc

SEQ ID NO: 1135111 - RNA, 22 nt, Human
agcgggugcugugucagcccuc

SEQ ID NO: 1135112 - RNA, 22 nt, Human
caggcccugggcaggaucagcc

SEQ ID NO: 1135113 - RNA, 22 nt, Human
ugccugggccucugaggaaggc

SEQ ID NO: 1135114 - RNA, 19 nt, Human
agacagagcucaguggguu

SEQ ID NO: 1135115 - RNA, 22 nt, Human
ggccccacgggggaguccuagu

SEQ ID NO: 1135116 - RNA, 22 nt, Human
acccaggagguggaggcugcag

SEQ ID NO: 1135117 - RNA, 22 nt, Human
acacaggggaaaguggagcuga

SEQ ID NO: 1135118 - RNA, 22 nt, Human
ugcaccugagaggucucugagg

SEQ ID NO: 1135119 - RNA, 19 nt, Human
gccacuccugaugcugccc

SEQ ID NO: 1135120 - RNA, 22 nt, Human
ugcucugguaacucacuuccau

SEQ ID NO: 1135121 - RNA, 22 nt, Human
ugggaguguucuuggcuugcuu

SEQ ID NO: 1135122 - RNA, 23 nt, Human
cagggccaggcagcagcugucac

SEQ ID NO: 1135123 - RNA, 22 nt, Human
cccaucaggaacccaggagccc

SEQ ID NO: 1135124 - RNA, 18 nt, Human
uccugccugugccccagg

SEQ ID NO: 1135125 - RNA, 22 nt, Human
gugucacaugguuuacugcagc

SEQ ID NO: 1135126 - RNA, 22 nt, Human
uccugccucuccaugcuaacua

SEQ ID NO: 1135127 - RNA, 23 nt, Human
agaauuguaaauagaauauaccu

SEQ ID NO: 1135128 - RNA, 22 nt, Human
agaaaucaugacuaagagcagu

SEQ ID NO: 1135129 - RNA, 22 nt, Human
agaaauguacgauguuaugcag

SEQ ID NO: 1135130 - RNA, 22 nt, Human
cuggguggcagagccugcagug

SEQ ID NO: 1135131 - RNA, 22 nt, Human
uggcucugagacacaggcucuc

SEQ ID NO: 1135132 - RNA, 21 nt, Human
aagcuucccugcucuccaggg

SEQ ID NO: 1135133 - RNA, 22 nt, Human
aagaacaguugggaggugagcc

SEQ ID NO: 1135134 - RNA, 22 nt, Human
cugggaggugaacagaaaaacu

SEQ ID NO: 1135135 - RNA, 22 nt, Human
aggcuauuuccacucuucucau

SEQ ID NO: 1135136 - RNA, 23 nt, Human
gcugcagcuguggauguucucag

SEQ ID NO: 1135137 - RNA, 22 nt, Human
ggcugcagggcagcuggugugg

SEQ ID NO: 1135138 - RNA, 22 nt, Human
gguggcagaggugcaucagccc

SEQ ID NO: 1135139 - RNA, 22 nt, Human
ccagagcugauuccugggacuu

SEQ ID NO: 1135140 - RNA, 22 nt, Human
ccuggagcucacugggagccgg

SEQ ID NO: 1135141 - RNA, 19 nt, Human
augagcuggcauuucaggu

SEQ ID NO: 1135142 - RNA, 22 nt, Human
agccacagagagggagcugcaa

SEQ ID NO: 1135143 - RNA, 22 nt, Human
acaaaggugcgucccuucagcu

SEQ ID NO: 1135144 - RNA, 22 nt, Human
cugggcugugguguggcccaaa

SEQ ID NO: 1135145 - RNA, 22 nt, Human
ucagaguguuuuacuaaacaag

SEQ ID NO: 1135146 - RNA, 22 nt, Human
acauucaugucccacuucuagc

SEQ ID NO: 1135147 - RNA, 22 nt, Human
gacagguggggaaacuaaggua

SEQ ID NO: 1135148 - RNA, 22 nt, Human
acauuucugucuuagggacugu

SEQ ID NO: 1135149 - RNA, 22 nt, Human
uggcuggggagccccgacuccc

SEQ ID NO: 1135150 - RNA, 22 nt, Human
gccccugggagcagagccacca

SEQ ID NO: 1135151 - RNA, 22 nt, Human
uagagcauuuagaggggcagga

SEQ ID NO: 1135152 - RNA, 22 nt, Human
cagaccuggaaaacaggcuugc

SEQ ID NO: 1135153 - RNA, 22 nt, Human
cagggcccauggcucagguagg

SEQ ID NO: 1135154 - RNA, 22 nt, Human
gccuggaguagcauggcaagcc

SEQ ID NO: 1135155 - RNA, 21 nt, Human
auccauccaucuuggccuaac

SEQ ID NO: 1135156 - RNA, 22 nt, Human
gaugguuuaugauagaugggaa

SEQ ID NO: 1135157 - RNA, 22 nt, Human
uucacauuugcccuuaugugug

SEQ ID NO: 1135158 - RNA, 22 nt, Human
uccagggcuggguuggcucagc

SEQ ID NO: 1135159 - RNA, 22 nt, Human
ucuggcucuuugggugauugua

SEQ ID NO: 1135160 - RNA, 22 nt, Human
aaaugguguuucuaaugcuaga

SEQ ID NO: 1135161 - RNA, 18 nt, Human
uggcucagauggcuuuaa

SEQ ID NO: 1135162 - RNA, 22 nt, Human
gccuggagaaaggaagguggga

SEQ ID NO: 1135163 - RNA, 22 nt, Human
gucuggggaagucagggcauca

SEQ ID NO: 1135164 - RNA, 22 nt, Human
ucuagaaacaugacauugaucu

SEQ ID NO: 1135165 - RNA, 22 nt, Human
agagccuggucugagauaggac

SEQ ID NO: 1135166 - RNA, 22 nt, Human
gcaggggaguggcaggcccgga

SEQ ID NO: 1135167 - RNA, 20 nt, Human
acaauagauuugagcaaagu

SEQ ID NO: 1135168 - RNA, 22 nt, Human
ccucaggggcuuuucguuguug

SEQ ID NO: 1135169 - RNA, 22 nt, Human
aguggggagguccaggccaccc

SEQ ID NO: 1135170 - RNA, 21 nt, Human
ccuggcuucagggugcacugg

SEQ ID NO: 1135171 - RNA, 23 nt, Human
aacaauagguuuuggcagaauag

SEQ ID NO: 1135172 - RNA, 22 nt, Human
uaaaucucacuggguauauugg

SEQ ID NO: 1135173 - RNA, 22 nt, Human
ggaugcaggaguugaagaagga

SEQ ID NO: 1135174 - RNA, 22 nt, Human
augagcuucccagacaggaugg

SEQ ID NO: 1135175 - RNA, 22 nt, Human
ugggcugcagggguugagagcu

SEQ ID NO: 1135176 - RNA, 22 nt, Human
ggaguuggugagcaccaggcuu

SEQ ID NO: 1135177 - RNA, 22 nt, Human
aaguuuaagguggaaguggugg

SEQ ID NO: 1135178 - RNA, 22 nt, Human
cggagccugcuuguugcagcug

SEQ ID NO: 1135179 - RNA, 22 nt, Human
ugauuaacugucuauuaaucau

SEQ ID NO: 1135180 - RNA, 22 nt, Human
uagaaaucagguuuuuagaaag

SEQ ID NO: 1135181 - RNA, 22 nt, Human
acuucauuguaauauuauagca

SEQ ID NO: 1135182 - RNA, 22 nt, Human
uguaucaaggguuuauguaagc

SEQ ID NO: 1135183 - RNA, 22 nt, Human
aucaaaguaggcauauguuuuu

SEQ ID NO: 1135184 - RNA, 23 nt, Human
cucccuggaguuucuggaagaug

SEQ ID NO: 1135185 - RNA, 22 nt, Human
ccagagcccagggucaugcagg

SEQ ID NO: 1135186 - RNA, 22 nt, Human
ggccugagaaccauggggccaa

SEQ ID NO: 1135187 - RNA, 22 nt, Human
ccucagggaggccucuguggcu

SEQ ID NO: 1135188 - RNA, 22 nt, Human
ucagagugaggcccagcaaucu

SEQ ID NO: 1135189 - RNA, 18 nt, Human
uguuccaaggaaggaauc

SEQ ID NO: 1135190 - RNA, 22 nt, Human
guuugcauuuauuagucuucug

SEQ ID NO: 1135191 - RNA, 22 nt, Human
uguagcucuccagccagcaagg

SEQ ID NO: 1135192 - RNA, 22 nt, Human
uuucaguguaagguuuccagga

SEQ ID NO: 1135193 - RNA, 22 nt, Human
acugagcugcuugaagugaacu

SEQ ID NO: 1135194 - RNA, 22 nt, Human
augcagcaguuuacaaagcaau

SEQ ID NO: 1135195 - RNA, 22 nt, Human
caaagggcucuagacucagcag

SEQ ID NO: 1135196 - RNA, 22 nt, Human
uggacaggaucugagacugaga

SEQ ID NO: 1135197 - RNA, 22 nt, Human
acuauacauugaauguuaaggu

SEQ ID NO: 1135198 - RNA, 18 nt, Human
uggcagagugucuguucu

SEQ ID NO: 1135199 - RNA, 22 nt, Human
agcugccaucagccuuuggaug

SEQ ID NO: 1135200 - RNA, 22 nt, Human
uggggcuguccuuagucugaga

SEQ ID NO: 1135201 - RNA, 22 nt, Human
agaaaagguugaaaguaggauu

SEQ ID NO: 1135202 - RNA, 22 nt, Human
ccuuucucuaucgacccaucgc

SEQ ID NO: 1135203 - RNA, 22 nt, Human
agcugucugucuccugaggaga

SEQ ID NO: 1135204 - RNA, 22 nt, Human
ugcagcuguaacagaggccuca

SEQ ID NO: 1135205 - RNA, 22 nt, Human
agcugccacugagggugcacag

SEQ ID NO: 1135206 - RNA, 22 nt, Human
aggcaaaauuacaaaguuauua

SEQ ID NO: 1135207 - RNA, 22 nt, Human
cccuuucccuucuggcucaggg

SEQ ID NO: 1135208 - RNA, 22 nt, Human
aagagcuggaugaagaaaucaa

SEQ ID NO: 1135209 - RNA, 22 nt, Human
gggcugggaauggcuaaguaug

SEQ ID NO: 1135210 - RNA, 21 nt, Human
aucuuuauuacgcagagaaga

SEQ ID NO: 1135211 - RNA, 22 nt, Human
gcaaggcugugcacuuugcauu

SEQ ID NO: 1135212 - RNA, 22 nt, Human
ccuucucuacuccugaugcaug

SEQ ID NO: 1135213 - RNA, 21 nt, Human
gcaaggcuuuuguguuuccca

SEQ ID NO: 1135214 - RNA, 22 nt, Human
ugcaggugugguuccucagcca

SEQ ID NO: 1135215 - RNA, 23 nt, Human
gggagaauaugaggaugauggug

SEQ ID NO: 1135216 - RNA, 22 nt, Human
ugccuggcaagaggggcuggcu

SEQ ID NO: 1135217 - RNA, 22 nt, Human
agcugccaaguuggaguagcaa

SEQ ID NO: 1135218 - RNA, 22 nt, Human
acuuugaaggggaacauuuuaa

SEQ ID NO: 1135219 - RNA, 22 nt, Human
augaagucuagcaagcauugaa

SEQ ID NO: 1135220 - RNA, 22 nt, Human
ugggcugcccugaugguccuca

SEQ ID NO: 1135221 - RNA, 22 nt, Human
cugagccaugagccugcgccca

SEQ ID NO: 1135222 - RNA, 22 nt, Human
uugucuuaaauggauggacaau

SEQ ID NO: 1135223 - RNA, 22 nt, Human
ccaccagcuucagcagccgcgg

SEQ ID NO: 1135224 - RNA, 22 nt, Human
ucucuggaguauaaccagggau

SEQ ID NO: 1135225 - RNA, 17 nt, Human
uggacccuugggccucc

SEQ ID NO: 1135226 - RNA, 22 nt, Human
gcuucucucucagacugcaagc

SEQ ID NO: 1135227 - RNA, 22 nt, Human
gaucaaaagcuggguucuaaaa

SEQ ID NO: 1135228 - RNA, 20 nt, Human
agcagcuguguuuucauccu

SEQ ID NO: 1135229 - RNA, 22 nt, Human
ggcacugauaauguccucucuc

SEQ ID NO: 1135230 - RNA, 22 nt, Human
cucagaguccccaguggguuug

SEQ ID NO: 1135231 - RNA, 19 nt, Human
auuccucaaggacagaaau

SEQ ID NO: 1135232 - RNA, 23 nt, Human
ugcaggggaggcuuaaagcaggu

SEQ ID NO: 1135233 - RNA, 23 nt, Human
uccagggauuaaugaagucaguc

SEQ ID NO: 1135234 - RNA, 22 nt, Human
ugggcucugugccagguuggug

SEQ ID NO: 1135235 - RNA, 22 nt, Human
ccagggcaggagaaagacucac

SEQ ID NO: 1135236 - RNA, 22 nt, Human
caggacagagcccagacugugu

SEQ ID NO: 1135237 - RNA, 22 nt, Human
gccucccuggcccacagcagcg

SEQ ID NO: 1135238 - RNA, 22 nt, Human
aauaaacugcucaauugcauca

SEQ ID NO: 1135239 - RNA, 22 nt, Human
uacauauacugagugauuugcu

SEQ ID NO: 1135240 - RNA, 22 nt, Human
auauucacugagcauaaagcca

SEQ ID NO: 1135241 - RNA, 22 nt, Human
guggccaggacauugccaggca

SEQ ID NO: 1135242 - RNA, 22 nt, Human
ugggccuggacaaggccacuag

SEQ ID NO: 1135243 - RNA, 22 nt, Human
cccucuggcucuucucaggccg

SEQ ID NO: 1135244 - RNA, 22 nt, Human
accucugcucaagaccccuccg

SEQ ID NO: 1135245 - RNA, 22 nt, Human
aaggucauuuuuuccucuguug

SEQ ID NO: 1135246 - RNA, 22 nt, Human
ccuggcucuguccucgcgcaaa

SEQ ID NO: 1135247 - RNA, 22 nt, Human
gcaccaggcuuagagccccagg

SEQ ID NO: 1135248 - RNA, 22 nt, Human
cagcccuuuccuucucagcuuu

SEQ ID NO: 1135249 - RNA, 22 nt, Human
cagggccacccucugcugggug

SEQ ID NO: 1135250 - RNA, 22 nt, Human
aaaguguaaaagcauguuaggg

SEQ ID NO: 1135251 - RNA, 22 nt, Human
acaaaguuaacaguuggauagu

SEQ ID NO: 1135252 - RNA, 22 nt, Human
ccagcucugcagggccuggggu

SEQ ID NO: 1135253 - RNA, 22 nt, Human
cacagggcuucucauggggugc

SEQ ID NO: 1135254 - RNA, 22 nt, Human
ucacagugagccaugucagaga

SEQ ID NO: 1135255 - RNA, 22 nt, Human
ggcucaggcuggagugcagugg

SEQ ID NO: 1135256 - RNA, 22 nt, Human
ugcauuauacuuuuagaaauuu

SEQ ID NO: 1135257 - RNA, 22 nt, Human
gcaaaaaaugcuuguugcuuag

SEQ ID NO: 1135258 - RNA, 22 nt, Human
aaguuugugagguuaaucccuu

SEQ ID NO: 1135259 - RNA, 22 nt, Human
aguuacuugagacguuuaugaa

SEQ ID NO: 1135260 - RNA, 22 nt, Human
aaggcacugagccagccgucuc

SEQ ID NO: 1135261 - RNA, 23 nt, Human
uugcuucugugcaauucaguacu

SEQ ID NO: 1135262 - RNA, 22 nt, Human
cuggcucaggaaaguugcugcu

SEQ ID NO: 1135263 - RNA, 22 nt, Human
acugucugcccugagaugccag

SEQ ID NO: 1135264 - RNA, 22 nt, Human
cacagcuucuccuugauaucgc

SEQ ID NO: 1135265 - RNA, 23 nt, Human
auaaggcauaaagguacauugga

SEQ ID NO: 1135266 - RNA, 22 nt, Human
aggaaagggguagguguggacg

SEQ ID NO: 1135267 - RNA, 22 nt, Human
aggguagggcccggagacagac

SEQ ID NO: 1135268 - RNA, 22 nt, Human
ucccuggagauaacuucuggga

SEQ ID NO: 1135269 - RNA, 22 nt, Human
uagagcaguuggcagcuguauu

SEQ ID NO: 1135270 - RNA, 22 nt, Human
cugcccugggaguaccuguccu

SEQ ID NO: 1135271 - RNA, 22 nt, Human
ucccuggacagccuugccuggg

SEQ ID NO: 1135272 - RNA, 22 nt, Human
cacauuucuaggaaauuaaaug

SEQ ID NO: 1135273 - RNA, 22 nt, Human
gcuggccacacugcugauggag

SEQ ID NO: 1135274 - RNA, 22 nt, Human
cagguccccuccccuaccaggc

SEQ ID NO: 1135275 - RNA, 22 nt, Human
cacuggggugggccugguagag

SEQ ID NO: 1135276 - RNA, 22 nt, Human
gaggguccccaugcagagcuca

SEQ ID NO: 1135277 - RNA, 22 nt, Human
ucauucuccucuggaaaaggca

SEQ ID NO: 1135278 - RNA, 22 nt, Human
ucccagagcaguacuccaggag

SEQ ID NO: 1135279 - RNA, 22 nt, Human
cuguucucuggcgguggcuguu

SEQ ID NO: 1135280 - RNA, 22 nt, Human
acagaacugggaaaugcacaua

SEQ ID NO: 1135281 - RNA, 22 nt, Human
auugaaagagaauguagcucuu

SEQ ID NO: 1135282 - RNA, 19 nt, Human
gcaugcuugguggcuucug

SEQ ID NO: 1135283 - RNA, 22 nt, Human
guugaauauuuuaagaguuuug

SEQ ID NO: 1135284 - RNA, 22 nt, Human
ucugaaaguaucuggaucuuuu

SEQ ID NO: 1135285 - RNA, 22 nt, Human
gggaggucagggugccugcugg

SEQ ID NO: 1135286 - RNA, 22 nt, Human
uccagggguaccggccaggcag

SEQ ID NO: 1135287 - RNA, 22 nt, Human
guauauaugugugaacauguau

SEQ ID NO: 1135288 - RNA, 22 nt, Human
agggccuggcuucacuuucuca

SEQ ID NO: 1135289 - RNA, 19 nt, Human
ucuggcuccgccucuuagu

SEQ ID NO: 1135290 - RNA, 22 nt, Human
acagagcaauucuuggguguuu

SEQ ID NO: 1135291 - RNA, 22 nt, Human
ugccaggggaccuagggauguc

SEQ ID NO: 1135292 - RNA, 22 nt, Human
ugaaggaauggaggaucagagc

SEQ ID NO: 1135293 - RNA, 21 nt, Human
gaugaagcaaucuuucuguug

SEQ ID NO: 1135294 - RNA, 22 nt, Human
uccagccaccaccuugauugcc

SEQ ID NO: 1135295 - RNA, 22 nt, Human
uguaauggaagugggauugcau

SEQ ID NO: 1135296 - RNA, 23 nt, Human
aaggucacagaacuuagcaagcc

SEQ ID NO: 1135297 - RNA, 22 nt, Human
aaaggucaagcuggacucaggu

SEQ ID NO: 1135298 - RNA, 22 nt, Human
uggcugaaucugcagcaggaag

SEQ ID NO: 1135299 - RNA, 22 nt, Human
ugggugagugggaaaagcccag

SEQ ID NO: 1135300 - RNA, 22 nt, Human
gguggguuuggaagagcaggcu

SEQ ID NO: 1135301 - RNA, 22 nt, Human
uggaaagaugaagauguuuaag

SEQ ID NO: 1135302 - RNA, 22 nt, Human
ggcucugcaugugagugggugg

SEQ ID NO: 1135303 - RNA, 22 nt, Human
gcagcuggcucagagagguggg

SEQ ID NO: 1135304 - RNA, 22 nt, Human
ugggcugcagagcccggccuuc

SEQ ID NO: 1135305 - RNA, 22 nt, Human
agucucugcugguugugccuau

SEQ ID NO: 1135306 - RNA, 22 nt, Human
agucaaagcuacaggcauuuga

SEQ ID NO: 1135307 - RNA, 23 nt, Human
cccuggaguaaauucuuggaagg

SEQ ID NO: 1135308 - RNA, 22 nt, Human
caggugggagccacagcguaca

SEQ ID NO: 1135309 - RNA, 23 nt, Human
ugccagaggcagucacaguggug

SEQ ID NO: 1135310 - RNA, 22 nt, Human
aggagcugaagucucugcacuc

SEQ ID NO: 1135311 - RNA, 22 nt, Human
uguacaaugccgagacuaacuc

SEQ ID NO: 1135312 - RNA, 21 nt, Human
uccuccuucaaguccuggccu

SEQ ID NO: 1135313 - RNA, 22 nt, Human
cuggccaguuguccuggcuugg

SEQ ID NO: 1135314 - RNA, 22 nt, Human
ugggaugggaucucgcuguguc

SEQ ID NO: 1135315 - RNA, 22 nt, Human
agcucccauuaucuucugaaac

SEQ ID NO: 1135316 - RNA, 22 nt, Human
agauuucaauggauauugcaag

SEQ ID NO: 1135317 - RNA, 22 nt, Human
caguguacuuggaauguaacag

SEQ ID NO: 1135318 - RNA, 22 nt, Human
cagccaggacagggaaacuagu

SEQ ID NO: 1135319 - RNA, 20 nt, Human
gagauggcuaagugcugaac

SEQ ID NO: 1135320 - RNA, 22 nt, Human
accaaggaagaaucuauuugag

SEQ ID NO: 1135321 - RNA, 22 nt, Human
ccaggccuggaccaugccaggg

SEQ ID NO: 1135322 - RNA, 22 nt, Human
aauggcugggaguguauuuugg

SEQ ID NO: 1135323 - RNA, 22 nt, Human
acccugggcuuggccugcucag

SEQ ID NO: 1135324 - RNA, 22 nt, Human
auccaaaccuggacaugagugg

SEQ ID NO: 1135325 - RNA, 22 nt, Human
ggcugcuggcauugagguaggu

SEQ ID NO: 1135326 - RNA, 22 nt, Human
augugaaagagguguucagugg

SEQ ID NO: 1135327 - RNA, 22 nt, Human
aggggagaguuaaugugaaugu

SEQ ID NO: 1135328 - RNA, 22 nt, Human
acccugccgugggcugcuugug

SEQ ID NO: 1135329 - RNA, 22 nt, Human
ccucgaccuccccaggcucagg

SEQ ID NO: 1135330 - RNA, 23 nt, Human
gccuggccaccccagggcugcuu

SEQ ID NO: 1135331 - RNA, 20 nt, Human
ccugggcuccaggagccccg

SEQ ID NO: 1135332 - RNA, 22 nt, Human
aggcucagcaucugauucauau

SEQ ID NO: 1135333 - RNA, 22 nt, Human
aaaucuguaagcaauugcucag

SEQ ID NO: 1135334 - RNA, 22 nt, Human
cuccaggccauggcugcggagg

SEQ ID NO: 1135335 - RNA, 22 nt, Human
uugcaccauuucacuuccauua

SEQ ID NO: 1135336 - RNA, 18 nt, Human
ucugggcuucccgaggcu

SEQ ID NO: 1135337 - RNA, 22 nt, Human
aauaaauguuaagauugucuca

SEQ ID NO: 1135338 - RNA, 22 nt, Human
aguuggagugaacaugagauug

SEQ ID NO: 1135339 - RNA, 22 nt, Human
gggagagaugcugauugccaau

SEQ ID NO: 1135340 - RNA, 22 nt, Human
ucagaagaagagacuccacagc

SEQ ID NO: 1135341 - RNA, 22 nt, Human
agccucucuuucugguggcuaa

SEQ ID NO: 1135342 - RNA, 22 nt, Human
caggguacagaguuuucuaaac

SEQ ID NO: 1135343 - RNA, 22 nt, Human
aggugccaauuuucagugaaca

SEQ ID NO: 1135344 - RNA, 17 nt, Human
uagagcugguucaggag

SEQ ID NO: 1135345 - RNA, 22 nt, Human
ccagcagcuguggcuuugccuc

SEQ ID NO: 1135346 - RNA, 22 nt, Human
agauguuccagccaaugggaau

SEQ ID NO: 1135347 - RNA, 17 nt, Human
agcagcugaagcagcca

SEQ ID NO: 1135348 - RNA, 22 nt, Human
cucaggggaccuggcuccgagu

SEQ ID NO: 1135349 - RNA, 22 nt, Human
cucucuuuuucgugugccgaag

SEQ ID NO: 1135350 - RNA, 21 nt, Human
agcagccauggaugguaugua

SEQ ID NO: 1135351 - RNA, 22 nt, Human
uaaguccaaggguaugaguugg

SEQ ID NO: 1135352 - RNA, 22 nt, Human
uccucuggcccagcugccucug

SEQ ID NO: 1135353 - RNA, 22 nt, Human
ccuggccucagccuagggcuga

SEQ ID NO: 1135354 - RNA, 22 nt, Human
uucacagggcagcagcugagcc

SEQ ID NO: 1135355 - RNA, 21 nt, Human
ugguggagugugcugagcaug

SEQ ID NO: 1135356 - RNA, 22 nt, Human
aaugaugguuucaucacuugaa

SEQ ID NO: 1135357 - RNA, 22 nt, Human
ucaaaguaaaaguauagaguuu

SEQ ID NO: 1135358 - RNA, 22 nt, Human
gggauggcucaaaggagucagg

SEQ ID NO: 1135359 - RNA, 22 nt, Human
ugucauaaaacacaagcuguug

SEQ ID NO: 1135360 - RNA, 22 nt, Human
acaggcagcgucauugcugcuc

SEQ ID NO: 1135361 - RNA, 22 nt, Human
ucagaggugguaaaggacagca

SEQ ID NO: 1135362 - RNA, 22 nt, Human
aggagcuggguuccuuuggugg

SEQ ID NO: 1135363 - RNA, 22 nt, Human
uauauaagauggguaggcuugu

SEQ ID NO: 1135364 - RNA, 22 nt, Human
acaggugauucaggcucuggga

SEQ ID NO: 1135365 - RNA, 22 nt, Human
gaaaagagaacaucugaggauc

SEQ ID NO: 1135366 - RNA, 22 nt, Human
uuccuuccgggcaccaggcacu

SEQ ID NO: 1135367 - RNA, 22 nt, Human
gcugucagaaggugaaggguaa

SEQ ID NO: 1135368 - RNA, 22 nt, Human
cacagggcaccaguuggccauc

SEQ ID NO: 1135369 - RNA, 22 nt, Human
ggcugcuugcuguuucuuggau

SEQ ID NO: 1135370 - RNA, 22 nt, Human
gugccuuccccgguggucuguu

SEQ ID NO: 1135371 - RNA, 23 nt, Human
gggugggccaaauuagguagccu

SEQ ID NO: 1135372 - RNA, 22 nt, Human
cagcuccccucuguggggcagu

SEQ ID NO: 1135373 - RNA, 22 nt, Human
cucucuuucauuggucgccuug

SEQ ID NO: 1135374 - RNA, 22 nt, Human
gagcuguccuaccaggaguccu

SEQ ID NO: 1135375 - RNA, 22 nt, Human
uccaggaggguuuucugccuuc

SEQ ID NO: 1135376 - RNA, 22 nt, Human
uacaugaacaaaauagcagaaa

SEQ ID NO: 1135377 - RNA, 22 nt, Human
uggcucagcauucacuggucuu

SEQ ID NO: 1135378 - RNA, 22 nt, Human
gcucccaguucccaaagugacc

SEQ ID NO: 1135379 - RNA, 22 nt, Human
aaguuuguagcuggaugucugu

SEQ ID NO: 1135380 - RNA, 22 nt, Human
auugaaagguuuugagcagaua

SEQ ID NO: 1135381 - RNA, 22 nt, Human
ggaggaccccagcagcucccca

SEQ ID NO: 1135382 - RNA, 18 nt, Human
agcuggggccucuggucc

SEQ ID NO: 1135383 - RNA, 22 nt, Human
uuauuauugugaccugagaaug

SEQ ID NO: 1135384 - RNA, 22 nt, Human
caggcacuggccagucagcaca

SEQ ID NO: 1135385 - RNA, 22 nt, Human
aaguucaagaucaagguuccag

SEQ ID NO: 1135386 - RNA, 22 nt, Human
aagccagcauuuucccauuccu

SEQ ID NO: 1135387 - RNA, 22 nt, Human
ccugugugucugucacugcaca

SEQ ID NO: 1135388 - RNA, 22 nt, Human
ggaaaguggugguggaaagagg

SEQ ID NO: 1135389 - RNA, 22 nt, Human
agccuggcuguaaccucauggu

SEQ ID NO: 1135390 - RNA, 23 nt, Human
caggcaggaugaggacuacacuc

SEQ ID NO: 1135391 - RNA, 22 nt, Human
gaagagcuauguccagggagca

SEQ ID NO: 1135392 - RNA, 22 nt, Human
ugugugacccccagugaagccu

SEQ ID NO: 1135393 - RNA, 22 nt, Human
uccugccucuugccuucuucac

SEQ ID NO: 1135394 - RNA, 19 nt, Human
gcucugagaggggcauggg

SEQ ID NO: 1135395 - RNA, 22 nt, Human
cuggagccggcgagccccagcc

SEQ ID NO: 1135396 - RNA, 22 nt, Human
cugggcuggagugcaauggcgc

SEQ ID NO: 1135397 - RNA, 22 nt, Human
guggagacuucuacuagagacc

SEQ ID NO: 1135398 - RNA, 22 nt, Human
gcugaagcugcagcaggaggaa

SEQ ID NO: 1135399 - RNA, 22 nt, Human
cagagcagugaggaguugugua

SEQ ID NO: 1135400 - RNA, 22 nt, Human
uuauuuauggcacuguuggugg

SEQ ID NO: 1135401 - RNA, 22 nt, Human
agcccagcagaaaguccagccu

SEQ ID NO: 1135402 - RNA, 22 nt, Human
uuguaacagguacuaaauaacu

SEQ ID NO: 1135403 - RNA, 22 nt, Human
ccuggcagcuguuuggcuuggc

SEQ ID NO: 1135404 - RNA, 22 nt, Human
uggccugcccagagcagcucug

SEQ ID NO: 1135405 - RNA, 22 nt, Human
accaucagucauugucaguggg

SEQ ID NO: 1135406 - RNA, 22 nt, Human
agagauguucauucagcauguu

SEQ ID NO: 1135407 - RNA, 21 nt, Human
ggccucugucauccugggaag

SEQ ID NO: 1135408 - RNA, 22 nt, Human
uucaaaggcaggauagcagcug

SEQ ID NO: 1135409 - RNA, 20 nt, Human
gggcaguggcgcuaucucag

SEQ ID NO: 1135410 - RNA, 22 nt, Human
ggagagcagggaggcugcucug

SEQ ID NO: 1135411 - RNA, 20 nt, Human
ccuccaggcacacccaugug

SEQ ID NO: 1135412 - RNA, 22 nt, Human
auguuuuauuaccaacuuguac

SEQ ID NO: 1135413 - RNA, 22 nt, Human
caccagcagaagacugagggug

SEQ ID NO: 1135414 - RNA, 22 nt, Human
agccucuggcccuagacugcuu

SEQ ID NO: 1135415 - RNA, 22 nt, Human
auuauguagguuaggugguugu

SEQ ID NO: 1135416 - RNA, 22 nt, Human
gcuggccaguguggugaccacc

SEQ ID NO: 1135417 - RNA, 22 nt, Human
cccuguccuggaugggagcacu

SEQ ID NO: 1135418 - RNA, 18 nt, Human
ggcugugcguggaggcug

SEQ ID NO: 1135419 - RNA, 21 nt, Human
cagugcucaaucugacagugg

SEQ ID NO: 1135420 - RNA, 22 nt, Human
uggagccaugccuggccuuucc

SEQ ID NO: 1135421 - RNA, 22 nt, Human
acacagccgugaaucugcuucu

SEQ ID NO: 1135422 - RNA, 22 nt, Human
gaaggaagugcucauacuaguu

SEQ ID NO: 1135423 - RNA, 22 nt, Human
ccaggcagagugcuccagaaag

SEQ ID NO: 1135424 - RNA, 22 nt, Human
cuuccagagauagggccucaag

SEQ ID NO: 1135425 - RNA, 22 nt, Human
caggugggagcggagacugauu

SEQ ID NO: 1135426 - RNA, 22 nt, Human
acaggcugcugagccauuugcu

SEQ ID NO: 1135427 - RNA, 22 nt, Human
caggugccgggaaugcagcaau

SEQ ID NO: 1135428 - RNA, 22 nt, Human
ucuggcuccugaguccaugcuc

SEQ ID NO: 1135429 - RNA, 22 nt, Human
cugggccucauccucagaguuu

SEQ ID NO: 1135430 - RNA, 22 nt, Human
aauguuaaaaccuucagugcuu

SEQ ID NO: 1135431 - RNA, 22 nt, Human
agcaggagagcagugcgugguc

SEQ ID NO: 1135432 - RNA, 22 nt, Human
uuuccucuucuggcaggcaggg

SEQ ID NO: 1135433 - RNA, 22 nt, Human
aggaagcucggagagggcaaau

SEQ ID NO: 1135434 - RNA, 22 nt, Human
ugaugcuucacgcugaauaugc

SEQ ID NO: 1135435 - RNA, 22 nt, Human
gggagguucuguucgcacuuga

SEQ ID NO: 1135436 - RNA, 22 nt, Human
acagguggcuuauuggcugauu

SEQ ID NO: 1135437 - RNA, 22 nt, Human
uccaauguuccugcuuucagcu

SEQ ID NO: 1135438 - RNA, 22 nt, Human
uggguagaggaauugggcuacc

SEQ ID NO: 1135439 - RNA, 22 nt, Human
caggggcaggugugagaucauc

SEQ ID NO: 1135440 - RNA, 22 nt, Human
acagagcugggugcccccugga

SEQ ID NO: 1135441 - RNA, 22 nt, Human
gauuucaaggaguuuucacagu

SEQ ID NO: 1135442 - RNA, 22 nt, Human
ucaggauccauagacucccaaa

SEQ ID NO: 1135443 - RNA, 22 nt, Human
cccauuuaaacacaagcuuuca

SEQ ID NO: 1135444 - RNA, 20 nt, Human
ucucaggguucagcaaagua

SEQ ID NO: 1135445 - RNA, 22 nt, Human
cagacacagcaauucuguguug

SEQ ID NO: 1135446 - RNA, 22 nt, Human
uaugugugcuuuuuccaugcau

SEQ ID NO: 1135447 - RNA, 22 nt, Human
aacaguaaugugguguuggguu

SEQ ID NO: 1135448 - RNA, 22 nt, Human
ucccagcauaacaaacugcccg

SEQ ID NO: 1135449 - RNA, 22 nt, Human
caguuuuuagauuaguuggugg

SEQ ID NO: 1135450 - RNA, 22 nt, Human
acaaaugcuuaguucaccaaaa

SEQ ID NO: 1135451 - RNA, 22 nt, Human
aggcugccucgugagcucgcug

SEQ ID NO: 1135452 - RNA, 22 nt, Human
agugaccauuuucagcuagagg

SEQ ID NO: 1135453 - RNA, 20 nt, Human
ugguugaauuuuuagugacc

SEQ ID NO: 1135454 - RNA, 20 nt, Human
ugcuuccuggccacugcggg

SEQ ID NO: 1135455 - RNA, 22 nt, Human
agccacagagguugaugugguu

SEQ ID NO: 1135456 - RNA, 22 nt, Human
caguacuuaacuuauaggagag

SEQ ID NO: 1135457 - RNA, 22 nt, Human
acucccacuccagaguagaagc

SEQ ID NO: 1135458 - RNA, 22 nt, Human
ccugccucaucaacuugucgug

SEQ ID NO: 1135459 - RNA, 22 nt, Human
ucaugccacuuacaaaauaaug

SEQ ID NO: 1135460 - RNA, 22 nt, Human
uggcagcauuuuuuccagaaca

SEQ ID NO: 1135461 - RNA, 22 nt, Human
ugugugugacaaccuaguucag

SEQ ID NO: 1135462 - RNA, 18 nt, Human
ucaaagucuggcuccacu

SEQ ID NO: 1135463 - RNA, 22 nt, Human
agguacagggugaaaguuuaug

SEQ ID NO: 1135464 - RNA, 22 nt, Human
cuggcuccaucacugggugaug

SEQ ID NO: 1135465 - RNA, 22 nt, Human
cugggcacuuuggggagccuac

SEQ ID NO: 1135466 - RNA, 22 nt, Human
agcugggccugagcuggaagcu

SEQ ID NO: 1135467 - RNA, 22 nt, Human
cugaggcugcccagggccaggu

SEQ ID NO: 1135468 - RNA, 22 nt, Human
gcucccagggcagcgcagaaga

SEQ ID NO: 1135469 - RNA, 22 nt, Human
cugggccagggaggugucugua

SEQ ID NO: 1135470 - RNA, 21 nt, Human
agcugggccucagccugcagu

SEQ ID NO: 1135471 - RNA, 22 nt, Human
gggagggaggugcugguucacg

SEQ ID NO: 1135472 - RNA, 22 nt, Human
gagccucguggcggccacugcg

SEQ ID NO: 1135473 - RNA, 22 nt, Human
cuggcccuucucuugcuuccug

SEQ ID NO: 1135474 - RNA, 22 nt, Human
cggggcugcgcucuuccugccg

SEQ ID NO: 1135475 - RNA, 22 nt, Human
gccugucugcagggcugucauu

SEQ ID NO: 1135476 - RNA, 22 nt, Human
acuuguguaacacagaaagaac

SEQ ID NO: 1135477 - RNA, 23 nt, Human
agcaauaagaagggauacaugug

SEQ ID NO: 1135478 - RNA, 22 nt, Human
cugggcacaaguggcccuggau

SEQ ID NO: 1135479 - RNA, 22 nt, Human
cagggcaggaugcugugauuau

SEQ ID NO: 1135480 - RNA, 22 nt, Human
gcuguccugggaacaggcacua

SEQ ID NO: 1135481 - RNA, 22 nt, Human
ccagggcagugggagaaggugc

SEQ ID NO: 1135482 - RNA, 22 nt, Human
ucccagccggugccuggguccc

SEQ ID NO: 1135483 - RNA, 22 nt, Human
aggaaaaaagucugugauuaua

SEQ ID NO: 1135484 - RNA, 22 nt, Human
ucagggcaagauugguuaauaa

SEQ ID NO: 1135485 - RNA, 22 nt, Human
ccaggaguuggagguugcagug

SEQ ID NO: 1135486 - RNA, 22 nt, Human
uagcugccuagacagcuauagc

SEQ ID NO: 1135487 - RNA, 22 nt, Human
aaguuugucucauuugaucuuc

SEQ ID NO: 1135488 - RNA, 22 nt, Human
uguuuuguucacugcauugucc

SEQ ID NO: 1135489 - RNA, 22 nt, Human
gagggcagaaaauuaugcggug

SEQ ID NO: 1135490 - RNA, 22 nt, Human
cuuauguauaauguuccacaua

SEQ ID NO: 1135491 - RNA, 22 nt, Human
ccaggccugauugggaaucuug

SEQ ID NO: 1135492 - RNA, 22 nt, Human
cugcugggcagaggcugcauga

SEQ ID NO: 1135493 - RNA, 22 nt, Human
agauuguagaaacuguagcauu

SEQ ID NO: 1135494 - RNA, 22 nt, Human
agagcuuagaauuucagaugau

SEQ ID NO: 1135495 - RNA, 22 nt, Human
ugucaccagcugcuccucagga

SEQ ID NO: 1135496 - RNA, 22 nt, Human
uguguacagcaggauuucucaa

SEQ ID NO: 1135497 - RNA, 19 nt, Human
cauaauacaguggaucuga

SEQ ID NO: 1135498 - RNA, 22 nt, Human
ucuggcucaucucuccagguaa

SEQ ID NO: 1135499 - RNA, 22 nt, Human
acauuucuccuacuuguuauuu

SEQ ID NO: 1135500 - RNA, 22 nt, Human
agcaaaguagcugcuguucuua

SEQ ID NO: 1135501 - RNA, 23 nt, Human
ggccuguguuuugucugaaguac

SEQ ID NO: 1135502 - RNA, 22 nt, Human
cagagcagaagcgguccucaca

SEQ ID NO: 1135503 - RNA, 22 nt, Human
ggguuggggcccagcagucugc

SEQ ID NO: 1135504 - RNA, 22 nt, Human
aucuauuaugcugagaaacugu

SEQ ID NO: 1135505 - RNA, 22 nt, Human
uguggccuccuguuccugggua

SEQ ID NO: 1135506 - RNA, 22 nt, Human
agggucugacuccucuggcaag

SEQ ID NO: 1135507 - RNA, 22 nt, Human
cagagccacugucugccaggca

SEQ ID NO: 1135508 - RNA, 22 nt, Human
guggcuucuggcugggccucag

SEQ ID NO: 1135509 - RNA, 22 nt, Human
auuuagaaauuccaaaaguauu

SEQ ID NO: 1135510 - RNA, 19 nt, Human
ccugucugucuucagcuag

SEQ ID NO: 1135511 - RNA, 19 nt, Human
gagcagcugcacccauuga

SEQ ID NO: 1135512 - RNA, 22 nt, Human
cagaggcagaggucaucucugg

SEQ ID NO: 1135513 - RNA, 22 nt, Human
gagucacauuaauuuaauuuua

SEQ ID NO: 1135514 - RNA, 20 nt, Human
gagauuuccaaucaugccca

SEQ ID NO: 1135515 - RNA, 22 nt, Human
uccaaacacccuccaugcugca

SEQ ID NO: 1135516 - RNA, 22 nt, Human
uaaaaguuuuaguuguacauaa

SEQ ID NO: 1135517 - RNA, 20 nt, Human
uggagccaaggugugucugg

SEQ ID NO: 1135518 - RNA, 22 nt, Human
auguuuuacccuuugcacaaac

SEQ ID NO: 1135519 - RNA, 22 nt, Human
gaggcagcaugguaccuuggag

SEQ ID NO: 1135520 - RNA, 22 nt, Human
ugucacagggauaccauggggc

SEQ ID NO: 1135521 - RNA, 20 nt, Human
aggaagccaaaggcugucuu

SEQ ID NO: 1135522 - RNA, 22 nt, Human
caaaggcaguuacugaaugaag

SEQ ID NO: 1135523 - RNA, 22 nt, Human
gggauggggggaagcguccaug

SEQ ID NO: 1135524 - RNA, 22 nt, Human
ucagagaaguaagguggggugc

SEQ ID NO: 1135525 - RNA, 22 nt, Human
guuuuauaggugaaauauuacu

SEQ ID NO: 1135526 - RNA, 22 nt, Human
uucauguaauuccauaagguaa

SEQ ID NO: 1135527 - RNA, 20 nt, Human
aggcugccaggucucacauc

SEQ ID NO: 1135528 - RNA, 22 nt, Human
cagggccagcgcccaggcccag

SEQ ID NO: 1135529 - RNA, 22 nt, Human
ggagccaggggaccuucacaga

SEQ ID NO: 1135530 - RNA, 22 nt, Human
cagacuggccacaucugcacug

SEQ ID NO: 1135531 - RNA, 19 nt, Human
cccuggcaggcaagccugg

SEQ ID NO: 1135532 - RNA, 17 nt, Human
cagacagauauccuggg

SEQ ID NO: 1135533 - RNA, 22 nt, Human
agcugccaucugaagaacugca

SEQ ID NO: 1135534 - RNA, 22 nt, Human
uacuuacagagcuuauaaguua

SEQ ID NO: 1135535 - RNA, 22 nt, Human
cugaagcaaaggaucgagcuaa

SEQ ID NO: 1135536 - RNA, 22 nt, Human
ucucaggguuuguacaagugua

SEQ ID NO: 1135537 - RNA, 22 nt, Human
uccugggcugugugccacucug

SEQ ID NO: 1135538 - RNA, 22 nt, Human
caguauguacucuuaucaugua

SEQ ID NO: 1135539 - RNA, 22 nt, Human
agggcugggcugcuuguuguca

SEQ ID NO: 1135540 - RNA, 22 nt, Human
agggcagcagcggcccaggccu

SEQ ID NO: 1135541 - RNA, 22 nt, Human
ccugggagagucuguggucucc

SEQ ID NO: 1135542 - RNA, 22 nt, Human
cacuguguaagaagaugggcuu

SEQ ID NO: 1135543 - RNA, 22 nt, Human
acuuugcacuaaguuacucauu

SEQ ID NO: 1135544 - RNA, 22 nt, Human
agccacagugcaagagagaaaa

SEQ ID NO: 1135545 - RNA, 22 nt, Human
uauugucuguccgggucaaagc

SEQ ID NO: 1135546 - RNA, 22 nt, Human
cugggcagugguggcaucuuug

SEQ ID NO: 1135547 - RNA, 22 nt, Human
agaagaaacugucggggauauu

SEQ ID NO: 1135548 - RNA, 22 nt, Human
auaacagaguugggaagugaaa

SEQ ID NO: 1135549 - RNA, 22 nt, Human
ugaggcagaaauuccuguuuuc

SEQ ID NO: 1135550 - RNA, 22 nt, Human
gcugccuccugaaagcgcucug

SEQ ID NO: 1135551 - RNA, 22 nt, Human
gaggaguggaguugcuggguug

SEQ ID NO: 1135552 - RNA, 22 nt, Human
ugcagggccgcuggaggucaug

SEQ ID NO: 1135553 - RNA, 22 nt, Human
gcucugcuggaaguucucugga

SEQ ID NO: 1135554 - RNA, 22 nt, Human
auauacuugauuuaacugagca

SEQ ID NO: 1135555 - RNA, 22 nt, Human
cccagccuuugcuuccugguuc

SEQ ID NO: 1135556 - RNA, 22 nt, Human
gcugcucuuuucagagaugaga

SEQ ID NO: 1135557 - RNA, 22 nt, Human
agucccagugagaugagccacg

SEQ ID NO: 1135558 - RNA, 22 nt, Human
uuggagcccugaggaucuggau

SEQ ID NO: 1135559 - RNA, 22 nt, Human
caggaaugacugcagauggggc

SEQ ID NO: 1135560 - RNA, 22 nt, Human
gcccccucuuuggagccagcca

SEQ ID NO: 1135561 - RNA, 22 nt, Human
guccucugcuucaugcccugau

SEQ ID NO: 1135562 - RNA, 22 nt, Human
agcagggcuugccgcuuguccu

SEQ ID NO: 1135563 - RNA, 22 nt, Human
ccucagaguaggucucagcugu

SEQ ID NO: 1135564 - RNA, 20 nt, Human
aaagucuuaugguuaauuuu

SEQ ID NO: 1135565 - RNA, 22 nt, Human
ggcuggcaagugucugcucaug

SEQ ID NO: 1135566 - RNA, 22 nt, Human
acauuugucuucuuucagauua

SEQ ID NO: 1135567 - RNA, 22 nt, Human
ugggcuggcugaacuucaaccu

SEQ ID NO: 1135568 - RNA, 22 nt, Human
uggccugaggcucggcaugggu

SEQ ID NO: 1135569 - RNA, 22 nt, Human
augcauaauguauguauugacu

SEQ ID NO: 1135570 - RNA, 22 nt, Human
caaagugcuaggauuacaggcc

SEQ ID NO: 1135571 - RNA, 22 nt, Human
ucagggcaccaaaaaagaugcc

SEQ ID NO: 1135572 - RNA, 22 nt, Human
cccagguggcagaagcugcagu

SEQ ID NO: 1135573 - RNA, 22 nt, Human
ccagcuccuucugucuguggag

SEQ ID NO: 1135574 - RNA, 22 nt, Human
aaaugaccagaauacaggcuuc

SEQ ID NO: 1135575 - RNA, 22 nt, Human
ccaguuuuuccagugcuuucug

SEQ ID NO: 1135576 - RNA, 21 nt, Human
ggcuccugcuuugugaggggc

SEQ ID NO: 1135577 - RNA, 22 nt, Human
agcuguccuggcucaggcugug

SEQ ID NO: 1135578 - RNA, 22 nt, Human
ggcacugagcugccuuggggca

SEQ ID NO: 1135579 - RNA, 22 nt, Human
cugccuggggaaugugaggauu

SEQ ID NO: 1135580 - RNA, 22 nt, Human
aggucagaagugccagggaauu

SEQ ID NO: 1135581 - RNA, 19 nt, Human
acagaagcauagaaaagga

SEQ ID NO: 1135582 - RNA, 22 nt, Human
auuuguagugaagugaaaauaa

SEQ ID NO: 1135583 - RNA, 22 nt, Human
agcagggcagcugaugcgcacg

SEQ ID NO: 1135584 - RNA, 22 nt, Human
ccaaggcuggagugcaguggcg

SEQ ID NO: 1135585 - RNA, 22 nt, Human
gaggcagaaguugcagugagca

SEQ ID NO: 1135586 - RNA, 22 nt, Human
gcaugguggccuuaggguagcc

SEQ ID NO: 1135587 - RNA, 22 nt, Human
ucagaaauguaagcugaugacu

SEQ ID NO: 1135588 - RNA, 22 nt, Human
ccuguggcugccacuuggguga

SEQ ID NO: 1135589 - RNA, 22 nt, Human
gggacugggagauccuccuggc

SEQ ID NO: 1135590 - RNA, 22 nt, Human
caguacuuuucuggcuuucuac

SEQ ID NO: 1135591 - RNA, 22 nt, Human
aggcagcccacaggacacagga

SEQ ID NO: 1135592 - RNA, 22 nt, Human
uuugcauuuugauaagaucacu

SEQ ID NO: 1135593 - RNA, 22 nt, Human
acacagaaccucauagccucuc

SEQ ID NO: 1135594 - RNA, 22 nt, Human
cucccaagggguaagggagcug

SEQ ID NO: 1135595 - RNA, 22 nt, Human
gacagacauuuccugauccaau

SEQ ID NO: 1135596 - RNA, 22 nt, Human
agggccugagcuggcugaccuc

SEQ ID NO: 1135597 - RNA, 22 nt, Human
gagcagcuccagccgcaugacu

SEQ ID NO: 1135598 - RNA, 22 nt, Human
agugaaauagcauuuaugaagc

SEQ ID NO: 1135599 - RNA, 22 nt, Human
gccagggggucagcaggcacuu

SEQ ID NO: 1135600 - RNA, 22 nt, Human
cugcuggccuagcccauccucu

SEQ ID NO: 1135601 - RNA, 22 nt, Human
uauagaagagacaugugcauag

SEQ ID NO: 1135602 - RNA, 22 nt, Human
uuugacaguaauaaagcacaag

SEQ ID NO: 1135603 - RNA, 22 nt, Human
ucccuggacaacagacuucacu

SEQ ID NO: 1135604 - RNA, 22 nt, Human
cucucuuugauguauaaauaau

SEQ ID NO: 1135605 - RNA, 22 nt, Human
aacaaauguguuuuguaauuaa

SEQ ID NO: 1135606 - RNA, 22 nt, Human
ccuguguggaaaccgcaugacg

SEQ ID NO: 1135607 - RNA, 22 nt, Human
gcugagagcaaagcaugucuag

SEQ ID NO: 1135608 - RNA, 22 nt, Human
ccagccuccauguagauagcug

SEQ ID NO: 1135609 - RNA, 22 nt, Human
ugcaugcauaaauguacacaca

SEQ ID NO: 1135610 - RNA, 21 nt, Human
agagucugcauuucugacaag

SEQ ID NO: 1135611 - RNA, 22 nt, Human
ucuggagauaagacagacagau

SEQ ID NO: 1135612 - RNA, 22 nt, Human
gcuggggagcuagaccucagca

SEQ ID NO: 1135613 - RNA, 22 nt, Human
cuggcaggcggcagagcccagg

SEQ ID NO: 1135614 - RNA, 22 nt, Human
uugcauugaugucuauacgcug

SEQ ID NO: 1135615 - RNA, 21 nt, Human
ugcuuuaugggaaaaauguca

SEQ ID NO: 1135616 - RNA, 19 nt, Human
cagcucaguuugauucucu

SEQ ID NO: 1135617 - RNA, 22 nt, Human
guaacugaggcagcuuuuaaga

SEQ ID NO: 1135618 - RNA, 22 nt, Human
ugcaagcacucaaugcaaacag

SEQ ID NO: 1135619 - RNA, 22 nt, Human
acugcaucugaaacauggguca

SEQ ID NO: 1135620 - RNA, 22 nt, Human
cucaggauggaagccuacagga

SEQ ID NO: 1135621 - RNA, 22 nt, Human
uggcagcuuccugcucauagga

SEQ ID NO: 1135622 - RNA, 22 nt, Human
auuuuuccaugauacuuaucug

SEQ ID NO: 1135623 - RNA, 22 nt, Human
agcaggugacccaagcaggcug

SEQ ID NO: 1135624 - RNA, 22 nt, Human
gaaaguuucuucauuaagaugu

SEQ ID NO: 1135625 - RNA, 21 nt, Human
ucaaagcacauauuugcacau

SEQ ID NO: 1135626 - RNA, 22 nt, Human
guacuucccugggaggcaagca

SEQ ID NO: 1135627 - RNA, 22 nt, Human
gcuggagccauuggcuuggccu

SEQ ID NO: 1135628 - RNA, 22 nt, Human
gagcucagcccaaagagcagug

SEQ ID NO: 1135629 - RNA, 22 nt, Human
gaggacagugugaucugccagc

SEQ ID NO: 1135630 - RNA, 22 nt, Human
uaauuuaauccaaguguuacau

SEQ ID NO: 1135631 - RNA, 22 nt, Human
agccacagcauguguguaugua

SEQ ID NO: 1135632 - RNA, 20 nt, Human
cucaggauacugcaaaguug

SEQ ID NO: 1135633 - RNA, 22 nt, Human
acagccugcugccugcuucuug

SEQ ID NO: 1135634 - RNA, 22 nt, Human
cagggugacugcccuggccacu

SEQ ID NO: 1135635 - RNA, 21 nt, Human
gaaaggucuuaacuuacagag

SEQ ID NO: 1135636 - RNA, 22 nt, Human
ucuuagaaaugaaguucuuucu

SEQ ID NO: 1135637 - RNA, 22 nt, Human
uguguccauucaggcacugacc

SEQ ID NO: 1135638 - RNA, 21 nt, Human
cuugaaagguagagucuacag

SEQ ID NO: 1135639 - RNA, 22 nt, Human
gcagagccaggagagacccuug

SEQ ID NO: 1135640 - RNA, 23 nt, Human
gcugagguacauuuacaggaaga

SEQ ID NO: 1135641 - RNA, 19 nt, Human
ggaggccuggguauuugcc

SEQ ID NO: 1135642 - RNA, 22 nt, Human
uucaagaugucuucacaauagu

SEQ ID NO: 1135643 - RNA, 22 nt, Human
acuacuuugggccauuuguuua

SEQ ID NO: 1135644 - RNA, 19 nt, Human
agccuggagggcuggucac

SEQ ID NO: 1135645 - RNA, 22 nt, Human
gccaggcuguuuuuauuacugu

SEQ ID NO: 1135646 - RNA, 22 nt, Human
uguggccagcagguggcugugu

SEQ ID NO: 1135647 - RNA, 22 nt, Human
aggaccugacuggcuccugcuu

SEQ ID NO: 1135648 - RNA, 22 nt, Human
cuucuggaggacacuggcccca

SEQ ID NO: 1135649 - RNA, 22 nt, Human
gcaguggggaaugcuggggaga

SEQ ID NO: 1135650 - RNA, 22 nt, Human
guacaugucaaaaaaugcauaa

SEQ ID NO: 1135651 - RNA, 22 nt, Human
aaagaacaauguggaaucuccu

SEQ ID NO: 1135652 - RNA, 22 nt, Human
aucuggguucaccaugcuccug

SEQ ID NO: 1135653 - RNA, 22 nt, Human
agagacaccgcgcaucauggcu

SEQ ID NO: 1135654 - RNA, 22 nt, Human
cucccacuccuggcucaccaca

SEQ ID NO: 1135655 - RNA, 22 nt, Human
cccuggcaugcaugucccuggc

SEQ ID NO: 1135656 - RNA, 21 nt, Human
guauugcagaguuaugugcuc

SEQ ID NO: 1135657 - RNA, 22 nt, Human
acauuuguaugcguuuuuacug

SEQ ID NO: 1135658 - RNA, 22 nt, Human
ugcaggugaaaauuaugaggau

SEQ ID NO: 1135659 - RNA, 23 nt, Human
cccuggccuuggggcacaggcug

SEQ ID NO: 1135660 - RNA, 22 nt, Human
uuuuaauacugcuauuguagga

SEQ ID NO: 1135661 - RNA, 22 nt, Human
uggccugacugucaggcuguau

SEQ ID NO: 1135662 - RNA, 22 nt, Human
acaaggcugaacagugaagccg

SEQ ID NO: 1135663 - RNA, 21 nt, Human
gcccucaggggaggauggccu

SEQ ID NO: 1135664 - RNA, 22 nt, Human
cucagaauuacaucccauuuua

SEQ ID NO: 1135665 - RNA, 19 nt, Human
cccucaggucugagcaguc

SEQ ID NO: 1135666 - RNA, 22 nt, Human
gcacagggagcaggucucuggu

SEQ ID NO: 1135667 - RNA, 22 nt, Human
uguuuuguagcuaauagcuauu

SEQ ID NO: 1135668 - RNA, 22 nt, Human
ccuccuggcccugggccuggaa

SEQ ID NO: 1135669 - RNA, 22 nt, Human
agcaggcuuguuaugucugaga

SEQ ID NO: 1135670 - RNA, 22 nt, Human
auccuugaacuuagacacuagg

SEQ ID NO: 1135671 - RNA, 22 nt, Human
ggcagggaaacagcugauccca

SEQ ID NO: 1135672 - RNA, 22 nt, Human
gccugcuggcuguccauugcag

SEQ ID NO: 1135673 - RNA, 22 nt, Human
ccaagggcugcugaggugucca

SEQ ID NO: 1135674 - RNA, 20 nt, Human
ugcugcaguuucaugggacu

SEQ ID NO: 1135675 - RNA, 22 nt, Human
uaaauuguuuucuagaaguugu

SEQ ID NO: 1135676 - RNA, 22 nt, Human
uguccucuuccagugcuccuuc

SEQ ID NO: 1135677 - RNA, 22 nt, Human
aaguucaaggcagguccugagg

SEQ ID NO: 1135678 - RNA, 22 nt, Human
ccugugcccucagccuggcucu

SEQ ID NO: 1135679 - RNA, 22 nt, Human
gcugucuccauagcuguguguc

SEQ ID NO: 1135680 - RNA, 22 nt, Human
gggcacugcuuugcucugucac

SEQ ID NO: 1135681 - RNA, 22 nt, Human
caggcacuguguuaggcacugu

SEQ ID NO: 1135682 - RNA, 22 nt, Human
auucuccagcucacuguccaua

SEQ ID NO: 1135683 - RNA, 18 nt, Human
ucagagguacagaaaagu

SEQ ID NO: 1135684 - RNA, 22 nt, Human
ucaaauguucccuguacuggcc

SEQ ID NO: 1135685 - RNA, 22 nt, Human
ugcaggccggcccuaggccuca

SEQ ID NO: 1135686 - RNA, 22 nt, Human
ucugccugcaguguggcagggc

SEQ ID NO: 1135687 - RNA, 22 nt, Human
cuuucagagguuacucaggaaa

SEQ ID NO: 1135688 - RNA, 21 nt, Human
guugaauauccauguaugugu

SEQ ID NO: 1135689 - RNA, 22 nt, Human
caucaaauggcaagugaaagcu

SEQ ID NO: 1135690 - RNA, 22 nt, Human
ugccugucuuggaguccuggcc

SEQ ID NO: 1135691 - RNA, 22 nt, Human
gucccagaggcuuuggccacag

SEQ ID NO: 1135692 - RNA, 22 nt, Human
aaaucaguuaagaugaggccau

SEQ ID NO: 1135693 - RNA, 20 nt, Human
caccaggcgcucugagaaca

SEQ ID NO: 1135694 - RNA, 22 nt, Human
ugcagccaauucauucauucuu

SEQ ID NO: 1135695 - RNA, 22 nt, Human
agguggaacguucaggugcuag

SEQ ID NO: 1135696 - RNA, 22 nt, Human
cugaggugcuagggucccugcu

SEQ ID NO: 1135697 - RNA, 22 nt, Human
agacaacaccaaaugcuagugu

SEQ ID NO: 1135698 - RNA, 19 nt, Human
gcuucccaccagccagccc

SEQ ID NO: 1135699 - RNA, 22 nt, Human
aaauuuaagaagugugugcgug

SEQ ID NO: 1135700 - RNA, 22 nt, Human
auucuucauguugaagcuguca

SEQ ID NO: 1135701 - RNA, 22 nt, Human
cauugcaccacauugcaucccu

SEQ ID NO: 1135702 - RNA, 22 nt, Human
ggaggacaggggcugcagcaca

SEQ ID NO: 1135703 - RNA, 22 nt, Human
cagcugcaggaacaaaaaugug

SEQ ID NO: 1135704 - RNA, 19 nt, Human
aggcagcacccaguccuug

SEQ ID NO: 1135705 - RNA, 22 nt, Human
aaaaucaguacacuuuauuuug

SEQ ID NO: 1135706 - RNA, 20 nt, Human
cccuggagagaagcuccacg

SEQ ID NO: 1135707 - RNA, 22 nt, Human
ggccucagugggccgcugcagg

SEQ ID NO: 1135708 - RNA, 22 nt, Human
uccuggagaauccugccaccug

SEQ ID NO: 1135709 - RNA, 22 nt, Human
ucucugggaaugggccugggua

SEQ ID NO: 1135710 - RNA, 22 nt, Human
cucucugggcccaguuggcacc

SEQ ID NO: 1135711 - RNA, 22 nt, Human
ccugcucugguuuagucagucu

SEQ ID NO: 1135712 - RNA, 22 nt, Human
ggggcagagagaaggaagcuug

SEQ ID NO: 1135713 - RNA, 22 nt, Human
aagaggaaaugauugacuauau

SEQ ID NO: 1135714 - RNA, 22 nt, Human
ucugcaggaaaaaagugccugg

SEQ ID NO: 1135715 - RNA, 22 nt, Human
gccacugcacuccagcccaggc

SEQ ID NO: 1135716 - RNA, 22 nt, Human
ugcugcuccccagcacacagca

SEQ ID NO: 1135717 - RNA, 22 nt, Human
gcugugcagguccccacugccu

SEQ ID NO: 1135718 - RNA, 22 nt, Human
uccuucagaaaaccucagucuu

SEQ ID NO: 1135719 - RNA, 22 nt, Human
cagccacguagcccuuggccgu

SEQ ID NO: 1135720 - RNA, 22 nt, Human
uccauguggccagacacuggca

SEQ ID NO: 1135721 - RNA, 22 nt, Human
aaggacuccaauucuuucaucu

SEQ ID NO: 1135722 - RNA, 22 nt, Human
caggcagcagaggaguguggga

SEQ ID NO: 1135723 - RNA, 22 nt, Human
gccagcagccacagaagucacu

SEQ ID NO: 1135724 - RNA, 22 nt, Human
gagagcccugcuccuaucccag

SEQ ID NO: 1135725 - RNA, 22 nt, Human
caaugugugcuuacaggccagu

SEQ ID NO: 1135726 - RNA, 22 nt, Human
gcacccagcccagggcgugaug

SEQ ID NO: 1135727 - RNA, 22 nt, Human
uugugaaauguuucaaaauagu

SEQ ID NO: 1135728 - RNA, 22 nt, Human
ucccagggacugggcuaggcuu

SEQ ID NO: 1135729 - RNA, 16 nt, Human
agcagccagcacugga

SEQ ID NO: 1135730 - RNA, 22 nt, Human
augugaaacugaagcauccaua

SEQ ID NO: 1135731 - RNA, 22 nt, Human
aguacuuugcacuuugcucaga

SEQ ID NO: 1135732 - RNA, 22 nt, Human
aguacauuuauuaaugguaaaa

SEQ ID NO: 1135733 - RNA, 22 nt, Human
uggccugggccggcagauauac

SEQ ID NO: 1135734 - RNA, 22 nt, Human
auuuaaauuuucugauggagag

SEQ ID NO: 1135735 - RNA, 22 nt, Human
cagggccugcuuccuucuuguu

SEQ ID NO: 1135736 - RNA, 22 nt, Human
ugcugccagagagacagggacu

SEQ ID NO: 1135737 - RNA, 22 nt, Human
ggcagaguggagugcggccucc

SEQ ID NO: 1135738 - RNA, 22 nt, Human
agucucagcuacuugggaggcu

SEQ ID NO: 1135739 - RNA, 22 nt, Human
aaguuauuuccucgugacugaa

SEQ ID NO: 1135740 - RNA, 22 nt, Human
aagagcuggcccaaucugagca

SEQ ID NO: 1135741 - RNA, 22 nt, Human
auuuaaaugcuuaagaggguuu

SEQ ID NO: 1135742 - RNA, 22 nt, Human
aagaauguggguggauaugaug

SEQ ID NO: 1135743 - RNA, 22 nt, Human
acagagcaugcucaguguguga

SEQ ID NO: 1135744 - RNA, 22 nt, Human
cucucugguuucagcgaagggg

SEQ ID NO: 1135745 - RNA, 22 nt, Human
uuaaacagucccagaggcugac

SEQ ID NO: 1135746 - RNA, 23 nt, Human
uggagcugggcucagacccuggg

SEQ ID NO: 1135747 - RNA, 22 nt, Human
ugucucugcuuuccuugcaggg

SEQ ID NO: 1135748 - RNA, 22 nt, Human
aucaaaguuucccagaaguugu

SEQ ID NO: 1135749 - RNA, 22 nt, Human
aagauacugaugauguaggcua

SEQ ID NO: 1135750 - RNA, 22 nt, Human
agccacagagcaggagaccuuu

SEQ ID NO: 1135751 - RNA, 22 nt, Human
gcugucugucucugugacuuaa

SEQ ID NO: 1135752 - RNA, 22 nt, Human
caggcugagcucuggccugggc

SEQ ID NO: 1135753 - RNA, 22 nt, Human
aaggcacuuuuccugagaugau

SEQ ID NO: 1135754 - RNA, 22 nt, Human
ggagccugggcauuaguaauuu

SEQ ID NO: 1135755 - RNA, 22 nt, Human
agucucugcaugaugcagcaca

SEQ ID NO: 1135756 - RNA, 22 nt, Human
ucccagccuuccagucugguuu

SEQ ID NO: 1135757 - RNA, 22 nt, Human
acugccuugucucuugccuguu

SEQ ID NO: 1135758 - RNA, 22 nt, Human
ugaaagcucugucaucauuccu

SEQ ID NO: 1135759 - RNA, 22 nt, Human
ucaaaugcggucauggcuuuua

SEQ ID NO: 1135760 - RNA, 22 nt, Human
uggccagguugggcuuugcagc

SEQ ID NO: 1135761 - RNA, 22 nt, Human
ccugucaguugcugucagggau

SEQ ID NO: 1135762 - RNA, 22 nt, Human
aggcucaguuugguuuccauug

SEQ ID NO: 1135763 - RNA, 22 nt, Human
cuuaggcauccaggguucuucc

SEQ ID NO: 1135764 - RNA, 20 nt, Human
acaggagaucugaggaaagg

SEQ ID NO: 1135765 - RNA, 19 nt, Human
cugugcaggccgggcugag

SEQ ID NO: 1135766 - RNA, 22 nt, Human
cuggccuuggaagggagcccgu

SEQ ID NO: 1135767 - RNA, 22 nt, Human
aaaguucugggggagaagaacg

SEQ ID NO: 1135768 - RNA, 22 nt, Human
ggggcuggcucacuaagagacu

SEQ ID NO: 1135769 - RNA, 22 nt, Human
ugacagaacagguugggagcaa

SEQ ID NO: 1135770 - RNA, 22 nt, Human
aagggcaggcagagaucauaua

SEQ ID NO: 1135771 - RNA, 22 nt, Human
gguuuaaugggugaaggcauga

SEQ ID NO: 1135772 - RNA, 22 nt, Human
aucuaagaguuaacaucaagaa

SEQ ID NO: 1135773 - RNA, 22 nt, Human
ugggccaggauuucaagacccu

SEQ ID NO: 1135774 - RNA, 22 nt, Human
ccacagcaugcaggccugacac

SEQ ID NO: 1135775 - RNA, 22 nt, Human
cuggcccagagagcagagcuua

SEQ ID NO: 1135776 - RNA, 22 nt, Human
ugcuuuggccacuagaauucag

SEQ ID NO: 1135777 - RNA, 22 nt, Human
acagagaugcaaguguguauuu

SEQ ID NO: 1135778 - RNA, 22 nt, Human
gcucugucauuuugcagacacu

SEQ ID NO: 1135779 - RNA, 22 nt, Human
agccaucauuucugucacuggc

SEQ ID NO: 1135780 - RNA, 22 nt, Human
gagcagcuuaugucaagccaga

SEQ ID NO: 1135781 - RNA, 22 nt, Human
cuuuccuagauggccaucuuuc

SEQ ID NO: 1135782 - RNA, 21 nt, Human
ugcauaaagaaauacaaauac

SEQ ID NO: 1135783 - RNA, 22 nt, Human
ggugccagccuagugcaguggu

SEQ ID NO: 1135784 - RNA, 22 nt, Human
cugccucucaggucccugagau

SEQ ID NO: 1135785 - RNA, 23 nt, Human
cccuggagcuagucugagcagag

SEQ ID NO: 1135786 - RNA, 22 nt, Human
cccaagggagugccuggucaac

SEQ ID NO: 1135787 - RNA, 22 nt, Human
agcugccauccgaggugucaga

SEQ ID NO: 1135788 - RNA, 22 nt, Human
cugcaggcucgaagacacggau

SEQ ID NO: 1135789 - RNA, 22 nt, Human
agcccaagcuaugaggugaccu

SEQ ID NO: 1135790 - RNA, 22 nt, Human
gguugaaucauucuuugcaccg

SEQ ID NO: 1135791 - RNA, 18 nt, Human
aguggucuguuauaucau

SEQ ID NO: 1135792 - RNA, 22 nt, Human
gcccagcugucuggcagggaug

SEQ ID NO: 1135793 - RNA, 22 nt, Human
gccuggagugcaguggcgugau

SEQ ID NO: 1135794 - RNA, 22 nt, Human
ccugaggcuuaaucugucccaa

SEQ ID NO: 1135795 - RNA, 22 nt, Human
aggcaguggcugagaccagggg

SEQ ID NO: 1135796 - RNA, 22 nt, Human
uuuaaaaaacuagucugagucu

SEQ ID NO: 1135797 - RNA, 22 nt, Human
gucagaggaauggaugagugau

SEQ ID NO: 1135798 - RNA, 20 nt, Human
gcugaggucauuaugccuca

SEQ ID NO: 1135799 - RNA, 22 nt, Human
gagcaggcucugccuguguguc

SEQ ID NO: 1135800 - RNA, 22 nt, Human
ugugugccugagccgugccugg

SEQ ID NO: 1135801 - RNA, 22 nt, Human
ggagccagagucugcaguguaa

SEQ ID NO: 1135802 - RNA, 22 nt, Human
ccuggcagguggagguugcagu

SEQ ID NO: 1135803 - RNA, 22 nt, Human
ccagggugugagaaggaaguag

SEQ ID NO: 1135804 - RNA, 22 nt, Human
gcaggcagguggcaucuuguga

SEQ ID NO: 1135805 - RNA, 22 nt, Human
caaugguggugucagaagagau

SEQ ID NO: 1135806 - RNA, 22 nt, Human
ccuccagcugccucagucucuu

SEQ ID NO: 1135807 - RNA, 22 nt, Human
caggcacagaguuauucauuua

SEQ ID NO: 1135808 - RNA, 22 nt, Human
uaaagaacacagggaauagcac

SEQ ID NO: 1135809 - RNA, 20 nt, Human
ggccuuggguuucgccuguu

SEQ ID NO: 1135810 - RNA, 22 nt, Human
ccagcuccaggacugggagcug

SEQ ID NO: 1135811 - RNA, 22 nt, Human
ucucagggccucccucuguuuc

SEQ ID NO: 1135812 - RNA, 22 nt, Human
uucaaugagcccggggccauag

SEQ ID NO: 1135813 - RNA, 22 nt, Human
uggcugaauaaaauaugguguu

SEQ ID NO: 1135814 - RNA, 22 nt, Human
uagccgggugugguggaacucc

SEQ ID NO: 1135815 - RNA, 22 nt, Human
gcccuggccuucaucucagaca

SEQ ID NO: 1135816 - RNA, 22 nt, Human
cuccugggaauuuaguugugag

SEQ ID NO: 1135817 - RNA, 22 nt, Human
cugggaggauucauugagguga

SEQ ID NO: 1135818 - RNA, 22 nt, Human
uuguuucauggggauguuuauu

SEQ ID NO: 1135819 - RNA, 22 nt, Human
guuauaaauaccuaauaggauu

SEQ ID NO: 1135820 - RNA, 22 nt, Human
agugcauugcaucucugcuuca

SEQ ID NO: 1135821 - RNA, 22 nt, Human
cuggccugggagcugcuagcgu

SEQ ID NO: 1135822 - RNA, 22 nt, Human
ggcagugaaugaaacagaggcu

SEQ ID NO: 1135823 - RNA, 23 nt, Human
ucugggcaccuuguugacaugau

SEQ ID NO: 1135824 - RNA, 22 nt, Human
ucaggcugaggucaucugcauc

SEQ ID NO: 1135825 - RNA, 22 nt, Human
gcagauggcucagacacugggg

SEQ ID NO: 1135826 - RNA, 22 nt, Human
ucugcagcuucuugccagagag

SEQ ID NO: 1135827 - RNA, 20 nt, Human
uggagcugugguaaggagca

SEQ ID NO: 1135828 - RNA, 22 nt, Human
ucauguaaguauagaaagcagu

SEQ ID NO: 1135829 - RNA, 22 nt, Human
gccuggugguauccuggcaaga

SEQ ID NO: 1135830 - RNA, 21 nt, Human
cauuucuauugaugagaaaag

SEQ ID NO: 1135831 - RNA, 22 nt, Human
uggcucagaacuacuucuaguu

SEQ ID NO: 1135832 - RNA, 15 nt, Human
cagucccagggaccc

SEQ ID NO: 1135833 - RNA, 22 nt, Human
gcuggguggaucggaggcucug

SEQ ID NO: 1135834 - RNA, 22 nt, Human
agaagugccauacuguggucca

SEQ ID NO: 1135835 - RNA, 22 nt, Human
gagaggcugaaaucacaggagc

SEQ ID NO: 1135836 - RNA, 22 nt, Human
uggaggcaccacuggcugcccg

SEQ ID NO: 1135837 - RNA, 22 nt, Human
uagcagaaccagcagucaauuu

SEQ ID NO: 1135838 - RNA, 22 nt, Human
uauuuagaacagacaauagaaa

SEQ ID NO: 1135839 - RNA, 22 nt, Human
gggugggaucuguggagccuca

SEQ ID NO: 1135840 - RNA, 21 nt, Human
cagggcacacagaggauggua

SEQ ID NO: 1135841 - RNA, 20 nt, Human
cagcucugggaaagaggcca

SEQ ID NO: 1135842 - RNA, 18 nt, Human
guucaaggucaagagaga

SEQ ID NO: 1135843 - RNA, 22 nt, Human
ucgagucauguucucccauuaa

SEQ ID NO: 1135844 - RNA, 22 nt, Human
ggaggugguggcagugacaauu

SEQ ID NO: 1135845 - RNA, 22 nt, Human
ugggcagagucauacaggagac

SEQ ID NO: 1135846 - RNA, 22 nt, Human
uagagcugcuggacuguaacag

SEQ ID NO: 1135847 - RNA, 23 nt, Human
cugcagucgccggccugggugcc

SEQ ID NO: 1135848 - RNA, 22 nt, Human
cagggacauugguggccagguu

SEQ ID NO: 1135849 - RNA, 22 nt, Human
guggauggacaugggcaagagg

SEQ ID NO: 1135850 - RNA, 22 nt, Human
uccucccacauaggacaauggg

SEQ ID NO: 1135851 - RNA, 22 nt, Human
uaauacuugucauaaaggcauu

SEQ ID NO: 1135852 - RNA, 22 nt, Human
uuugcauuacuugacuuuaguu

SEQ ID NO: 1135853 - RNA, 22 nt, Human
ugaaaucugucccacuuuagcu

SEQ ID NO: 1135854 - RNA, 22 nt, Human
agagcuguuuggacaucugagu

SEQ ID NO: 1135855 - RNA, 22 nt, Human
uauaauccauucauugauuucu

SEQ ID NO: 1135856 - RNA, 18 nt, Human
uccagagcuacuguggug

SEQ ID NO: 1135857 - RNA, 22 nt, Human
gaggccuggagccgccuaggcg

SEQ ID NO: 1135858 - RNA, 22 nt, Human
gccuggguccacugaucaugcu

SEQ ID NO: 1135859 - RNA, 22 nt, Human
guggagcccugguagggacccc

SEQ ID NO: 1135860 - RNA, 22 nt, Human
gaguggggucugggcaucaguc

SEQ ID NO: 1135861 - RNA, 22 nt, Human
accagagaaaacacagcaggcu

SEQ ID NO: 1135862 - RNA, 18 nt, Human
ugcucuggucucacuugg

SEQ ID NO: 1135863 - RNA, 22 nt, Human
agaacagaugugggcagaccug

SEQ ID NO: 1135864 - RNA, 22 nt, Human
auuuucugguugagguuuaaca

SEQ ID NO: 1135865 - RNA, 22 nt, Human
gcugccuuuuaaagccucgcuu

SEQ ID NO: 1135866 - RNA, 22 nt, Human
auucuagaugcuguaaguagca

SEQ ID NO: 1135867 - RNA, 22 nt, Human
ucaaagucauggcaggcucaga

SEQ ID NO: 1135868 - RNA, 22 nt, Human
aggaaaaucgagucuggaggca

SEQ ID NO: 1135869 - RNA, 22 nt, Human
cugugcuuaccugcccagguga

SEQ ID NO: 1135870 - RNA, 22 nt, Human
ccagggagccuggugugucagc

SEQ ID NO: 1135871 - RNA, 22 nt, Human
uuucuggcagcgggacaggggu

SEQ ID NO: 1135872 - RNA, 22 nt, Human
ggcacugaauuucuuggcaucu

SEQ ID NO: 1135873 - RNA, 22 nt, Human
aagaugauaggacuugcuuaag

SEQ ID NO: 1135874 - RNA, 22 nt, Human
uagcacaucuggcgcuuauagg

SEQ ID NO: 1135875 - RNA, 22 nt, Human
agaaagaacgcacuugugcugc

SEQ ID NO: 1135876 - RNA, 22 nt, Human
agacaggacacaagcugcauaa

SEQ ID NO: 1135877 - RNA, 22 nt, Human
gcagagccugacgggauuuuuc

SEQ ID NO: 1135878 - RNA, 22 nt, Human
cagcaguguacaaggugucaga

SEQ ID NO: 1135879 - RNA, 18 nt, Human
gggcaagcggcugucacc

SEQ ID NO: 1135880 - RNA, 22 nt, Human
ggagauggcucugcaaggucua

SEQ ID NO: 1135881 - RNA, 22 nt, Human
ugaagcagcaaaugaugggaga

SEQ ID NO: 1135882 - RNA, 23 nt, Human
gccuucagcucgggaaggcuccc

SEQ ID NO: 1135883 - RNA, 23 nt, Human
gggagccauggguggucauggag

SEQ ID NO: 1135884 - RNA, 22 nt, Human
cuuuggcaugguccucacuaua

SEQ ID NO: 1135885 - RNA, 22 nt, Human
uuguaacagcuguuuauauagu

SEQ ID NO: 1135886 - RNA, 22 nt, Human
uagcugucagcaaucaaguggu

SEQ ID NO: 1135887 - RNA, 22 nt, Human
agugaaauuuguuuagauaggu

SEQ ID NO: 1135888 - RNA, 22 nt, Human
ggaaggaggggcaaagcaguuc

SEQ ID NO: 1135889 - RNA, 22 nt, Human
cagggcaguuugugccuaugag

SEQ ID NO: 1135890 - RNA, 22 nt, Human
ccucuggcuguaccacuggcac

SEQ ID NO: 1135891 - RNA, 22 nt, Human
gagagcacaugaacauggagga

SEQ ID NO: 1135892 - RNA, 22 nt, Human
cugagagccuccuguuggcuag

SEQ ID NO: 1135893 - RNA, 22 nt, Human
ccucucauagucuguauccuuu

SEQ ID NO: 1135894 - RNA, 22 nt, Human
aaagccuucaaguagauguaag

SEQ ID NO: 1135895 - RNA, 22 nt, Human
agugucugaaccaccggggcau

SEQ ID NO: 1135896 - RNA, 22 nt, Human
gugugccagacaugaugcuaug

SEQ ID NO: 1135897 - RNA, 23 nt, Human
ccugugugcccuuaauucacagc

SEQ ID NO: 1135898 - RNA, 22 nt, Human
gucaaguuaagauaaggucaug

SEQ ID NO: 1135899 - RNA, 22 nt, Human
agccagcuggagaccacuguuu

SEQ ID NO: 1135900 - RNA, 22 nt, Human
accucugcaacccuggaauggg

SEQ ID NO: 1135901 - RNA, 22 nt, Human
uccuucagugucccgcucaggu

SEQ ID NO: 1135902 - RNA, 22 nt, Human
aggaagccugcaggugacugcu

SEQ ID NO: 1135903 - RNA, 22 nt, Human
ugucucugguauuaggugaaaa

SEQ ID NO: 1135904 - RNA, 22 nt, Human
gcuguccagagcaugggagcaa

SEQ ID NO: 1135905 - RNA, 23 nt, Human
aaguucaagucacagccugucuu

SEQ ID NO: 1135906 - RNA, 18 nt, Human
uggagcagguaggcauga

SEQ ID NO: 1135907 - RNA, 22 nt, Human
uggcagcaaguucuugggaggu

SEQ ID NO: 1135908 - RNA, 22 nt, Human
ggcugcuguacugaugucaguu

SEQ ID NO: 1135909 - RNA, 22 nt, Human
agcccuccucacaucagcgucc

SEQ ID NO: 1135910 - RNA, 22 nt, Human
caggugggaccaugauagggca

SEQ ID NO: 1135911 - RNA, 22 nt, Human
ucaagagaagugcuccacagua

SEQ ID NO: 1135912 - RNA, 22 nt, Human
gagcucauccccaugguccguc

SEQ ID NO: 1135913 - RNA, 22 nt, Human
gagagucacugucugcauuucc

SEQ ID NO: 1135914 - RNA, 22 nt, Human
ccagggcugagcugugaccaug

SEQ ID NO: 1135915 - RNA, 22 nt, Human
ugauuuccaugaagcugaaggc

SEQ ID NO: 1135916 - RNA, 22 nt, Human
cuggccagaguuggagggugug

SEQ ID NO: 1135917 - RNA, 22 nt, Human
agauuuccaucuuuuucaugug

SEQ ID NO: 1135918 - RNA, 23 nt, Human
ccagcucccaggucugaggacug

SEQ ID NO: 1135919 - RNA, 22 nt, Human
caggggaagaugccaagggaga

SEQ ID NO: 1135920 - RNA, 22 nt, Human
ccuucagaccuagacaggaauc

SEQ ID NO: 1135921 - RNA, 22 nt, Human
uauaagucuggcauauguaugc

SEQ ID NO: 1135922 - RNA, 22 nt, Human
cucugguguccuuuagaauuua

SEQ ID NO: 1135923 - RNA, 22 nt, Human
ggccuuggugcucuguguugca

SEQ ID NO: 1135924 - RNA, 22 nt, Human
accugggagucacaccugagaa

SEQ ID NO: 1135925 - RNA, 22 nt, Human
agugaaauaugcccauugcugu

SEQ ID NO: 1135926 - RNA, 22 nt, Human
aagacccacaaggcugaauguu

SEQ ID NO: 1135927 - RNA, 22 nt, Human
ccacagggcucuaggcgcuucc

SEQ ID NO: 1135928 - RNA, 22 nt, Human
acccaggguagagugcaguggc

SEQ ID NO: 1135929 - RNA, 21 nt, Human
ucagcagcaucugccuagagu

SEQ ID NO: 1135930 - RNA, 22 nt, Human
uggggagugaugccucggauaa

SEQ ID NO: 1135931 - RNA, 22 nt, Human
ugcuucucccaaccagggccug

SEQ ID NO: 1135932 - RNA, 22 nt, Human
ucucucuugucaccccaucugc

SEQ ID NO: 1135933 - RNA, 22 nt, Human
cuggcucaguucuugguuuuca

SEQ ID NO: 1135934 - RNA, 22 nt, Human
ggccucugaggacagccuuggc

SEQ ID NO: 1135935 - RNA, 22 nt, Human
agcugcucuuugaaggacacuu

SEQ ID NO: 1135936 - RNA, 22 nt, Human
ccagcccugccagagagagcug

SEQ ID NO: 1135937 - RNA, 22 nt, Human
agccuggauccauguggcuacc

SEQ ID NO: 1135938 - RNA, 22 nt, Human
ggaaggagggcggcaaugauga

SEQ ID NO: 1135939 - RNA, 22 nt, Human
cagggccaaguuggugccuuuu

SEQ ID NO: 1135940 - RNA, 22 nt, Human
cccagcugcaccucuauggccu

SEQ ID NO: 1135941 - RNA, 22 nt, Human
ggcaggagaaaggucucuucuu

SEQ ID NO: 1135942 - RNA, 22 nt, Human
agaggcugcacuugcucaugau

SEQ ID NO: 1135943 - RNA, 22 nt, Human
caucaguguggcaguucacugu

SEQ ID NO: 1135944 - RNA, 22 nt, Human
ccugccugauuccaggauggcu

SEQ ID NO: 1135945 - RNA, 22 nt, Human
ggagagugggagcaacuguugc

SEQ ID NO: 1135946 - RNA, 22 nt, Human
uauguacaccggggaagguggg

SEQ ID NO: 1135947 - RNA, 22 nt, Human
aggcacugaaggaagcuugcgc

SEQ ID NO: 1135948 - RNA, 22 nt, Human
ugagcuucaaaauaugugaauc

SEQ ID NO: 1135949 - RNA, 22 nt, Human
ccagggcacguugggacaguac

SEQ ID NO: 1135950 - RNA, 22 nt, Human
aaggcagcagugcacgacugau

SEQ ID NO: 1135951 - RNA, 22 nt, Human
aggccuguuccaggccccuuuu

SEQ ID NO: 1135952 - RNA, 22 nt, Human
gaaaugugaccuacuuccuugu

SEQ ID NO: 1135953 - RNA, 22 nt, Human
acaggugggcuuaagagucggc

SEQ ID NO: 1135954 - RNA, 19 nt, Human
aguccaugaauggaggaug

SEQ ID NO: 1135955 - RNA, 22 nt, Human
uuccucugaaauggcuuggaaa

SEQ ID NO: 1135956 - RNA, 22 nt, Human
agggagagguugaaaccucagu

SEQ ID NO: 1135957 - RNA, 22 nt, Human
uaaacaugugagugugcauaua

SEQ ID NO: 1135958 - RNA, 22 nt, Human
ugucauuuucuaaucuguuguc

SEQ ID NO: 1135959 - RNA, 22 nt, Human
ccuggcugcauuuugcuggaug

SEQ ID NO: 1135960 - RNA, 22 nt, Human
aucaguuucuaccauguggaau

SEQ ID NO: 1135961 - RNA, 22 nt, Human
ccugggcuucugucuagauguu

SEQ ID NO: 1135962 - RNA, 22 nt, Human
agccagugcaacagcagugaag

SEQ ID NO: 1135963 - RNA, 22 nt, Human
agggcagaaauauugauacugu

SEQ ID NO: 1135964 - RNA, 22 nt, Human
ccucuggcaacuucacagccca

SEQ ID NO: 1135965 - RNA, 22 nt, Human
ggcagucagugugguucauaaa

SEQ ID NO: 1135966 - RNA, 22 nt, Human
uccuggagggaggcggugcuac

SEQ ID NO: 1135967 - RNA, 22 nt, Human
auguaaggcugccuaugacacu

SEQ ID NO: 1135968 - RNA, 22 nt, Human
ugagcccaggaguuggaggcug

SEQ ID NO: 1135969 - RNA, 21 nt, Human
gcagcuggucucagagcuugc

SEQ ID NO: 1135970 - RNA, 22 nt, Human
caggccugucugcacaugaggc

SEQ ID NO: 1135971 - RNA, 17 nt, Human
uucaagauauugaaaug

SEQ ID NO: 1135972 - RNA, 20 nt, Human
ucuggcucuuugcuccuccc

SEQ ID NO: 1135973 - RNA, 22 nt, Human
cugcagugaaaucaggaagcaa

SEQ ID NO: 1135974 - RNA, 22 nt, Human
aaaagguaguugccaaauaagg

SEQ ID NO: 1135975 - RNA, 22 nt, Human
aguauuucugcucaugaaagag

SEQ ID NO: 1135976 - RNA, 22 nt, Human
agcuucuggaagccuggcagca

SEQ ID NO: 1135977 - RNA, 22 nt, Human
ccagcagaagcucccgcugggu

SEQ ID NO: 1135978 - RNA, 20 nt, Human
ggaagcagagaacuguuuuc

SEQ ID NO: 1135979 - RNA, 22 nt, Human
ccuuuggguucaaucucggucu

SEQ ID NO: 1135980 - RNA, 22 nt, Human
gccucugcugacaagauggaca

SEQ ID NO: 1135981 - RNA, 22 nt, Human
uggccuggggaccugugagacc

SEQ ID NO: 1135982 - RNA, 22 nt, Human
uccauuggucucugugcccagg

SEQ ID NO: 1135983 - RNA, 22 nt, Human
ugggcagaaugugggauccaga

SEQ ID NO: 1135984 - RNA, 22 nt, Human
cagcccaggccgacaguuccuc

SEQ ID NO: 1135985 - RNA, 22 nt, Human
cuacccaggcuggagugcagua

SEQ ID NO: 1135986 - RNA, 22 nt, Human
agcugccuguccuaggccauca

SEQ ID NO: 1135987 - RNA, 22 nt, Human
uggcagagaugaagaguuguuu

SEQ ID NO: 1135988 - RNA, 22 nt, Human
cuccagggaugagacagaguag

SEQ ID NO: 1135989 - RNA, 22 nt, Human
ccagucccgcaugguccagaau

SEQ ID NO: 1135990 - RNA, 19 nt, Human
ggaugagggucaggcauag

SEQ ID NO: 1135991 - RNA, 22 nt, Human
gcugccacuuggucaugucaug

SEQ ID NO: 1135992 - RNA, 22 nt, Human
caguugcuacaguucaagugug

SEQ ID NO: 1135993 - RNA, 22 nt, Human
gugucaugcacacucaguguug

SEQ ID NO: 1135994 - RNA, 23 nt, Human
cuccucguaacucuguggugggu

SEQ ID NO: 1135995 - RNA, 22 nt, Human
aggucauuaaaguuaaaugagg

SEQ ID NO: 1135996 - RNA, 20 nt, Human
gugggcagcaggcauacugg

SEQ ID NO: 1135997 - RNA, 22 nt, Human
ucugucacugagcucaggauuc

SEQ ID NO: 1135998 - RNA, 22 nt, Human
cucugagagcggucuguggcuu

SEQ ID NO: 1135999 - RNA, 22 nt, Human
acuucucuucauagguggcaau

SEQ ID NO: 1136000 - RNA, 22 nt, Human
gacaucauagggugggaggaaa

SEQ ID NO: 1136001 - RNA, 18 nt, Human
accugccuguucuucucu

SEQ ID NO: 1136002 - RNA, 22 nt, Human
ugaaagguuaaaaguaguauug

SEQ ID NO: 1136003 - RNA, 22 nt, Human
gcugccuggagcucagccugcc

SEQ ID NO: 1136004 - RNA, 22 nt, Human
gagcugggcacacgccacuuga

SEQ ID NO: 1136005 - RNA, 22 nt, Human
uagagcuggaaaacugcaggua

SEQ ID NO: 1136006 - RNA, 22 nt, Human
ugguggcaauguccuggagaag

SEQ ID NO: 1136007 - RNA, 20 nt, Human
aucuggcucagauccugcag

SEQ ID NO: 1136008 - RNA, 22 nt, Human
uucuuucccaguagaugugaaa

SEQ ID NO: 1136009 - RNA, 22 nt, Human
gcagagccccucaagccagccu

SEQ ID NO: 1136010 - RNA, 22 nt, Human
gguucacacuuucaugauuuca

SEQ ID NO: 1136011 - RNA, 22 nt, Human
agcugagcucaggcugauguaa

SEQ ID NO: 1136012 - RNA, 22 nt, Human
ugucacauguguggcauuuuuc

SEQ ID NO: 1136013 - RNA, 22 nt, Human
uuucacauuuuauacuuaagcc

SEQ ID NO: 1136014 - RNA, 22 nt, Human
agcagcucugagaggccagcac

SEQ ID NO: 1136015 - RNA, 22 nt, Human
agaaaucuaagaugcucaagga

SEQ ID NO: 1136016 - RNA, 22 nt, Human
ugauuuccuaggucuggagaag

SEQ ID NO: 1136017 - RNA, 22 nt, Human
guggccuggaugagcuucgaca

SEQ ID NO: 1136018 - RNA, 18 nt, Human
cccucuccugcuaguggg

SEQ ID NO: 1136019 - RNA, 22 nt, Human
cuggugagacgguugacaggag

SEQ ID NO: 1136020 - RNA, 22 nt, Human
aaguucaagucuccugaguaua

SEQ ID NO: 1136021 - RNA, 22 nt, Human
cagggcucaucugugugaccag

SEQ ID NO: 1136022 - RNA, 22 nt, Human
gcucuguccagcgugcacagaa

SEQ ID NO: 1136023 - RNA, 22 nt, Human
aggccuggcaugagaccugaga

SEQ ID NO: 1136024 - RNA, 23 nt, Human
gagugcagaauagacaugcagug

SEQ ID NO: 1136025 - RNA, 22 nt, Human
ucagggcaucaucaugaauaua

SEQ ID NO: 1136026 - RNA, 22 nt, Human
gcucugagcacugugcggcugg

SEQ ID NO: 1136027 - RNA, 22 nt, Human
ugagccugcaauaagcacagcc

SEQ ID NO: 1136028 - RNA, 22 nt, Human
cacacaggagagugcuggaggu

SEQ ID NO: 1136029 - RNA, 22 nt, Human
cagcugcccugccuugcccuua

SEQ ID NO: 1136030 - RNA, 22 nt, Human
uccucuggggcgugguccugga

SEQ ID NO: 1136031 - RNA, 18 nt, Human
ugugguggagcugccuuc

SEQ ID NO: 1136032 - RNA, 22 nt, Human
cagagcaggcccacugcccucc

SEQ ID NO: 1136033 - RNA, 22 nt, Human
uuacauuagacccacuuucaug

SEQ ID NO: 1136034 - RNA, 22 nt, Human
cauuuagagucuugcaauuuua

SEQ ID NO: 1136035 - RNA, 23 nt, Human
ugcagagggacugaagccagcuu

SEQ ID NO: 1136036 - RNA, 22 nt, Human
ccucucaucauuaucgcuuugu

SEQ ID NO: 1136037 - RNA, 22 nt, Human
ccagggugcucuguggcgucgc

SEQ ID NO: 1136038 - RNA, 22 nt, Human
gaaaauguuagcuucauaguca

SEQ ID NO: 1136039 - RNA, 22 nt, Human
agcaucuggugagggccuaguu

SEQ ID NO: 1136040 - RNA, 22 nt, Human
acccagcucuuugauggucuug

SEQ ID NO: 1136041 - RNA, 22 nt, Human
uucuucaauuauuggaaagaaa

SEQ ID NO: 1136042 - RNA, 20 nt, Human
gccuguccugagugucaugg

SEQ ID NO: 1136043 - RNA, 22 nt, Human
gugaggggaguaaagccauguu

SEQ ID NO: 1136044 - RNA, 22 nt, Human
gcagccugaugaucuggguugu

SEQ ID NO: 1136045 - RNA, 22 nt, Human
cacagggcaggccccaggccuc

SEQ ID NO: 1136046 - RNA, 22 nt, Human
ccagagucuuuauauuccugaa

SEQ ID NO: 1136047 - RNA, 20 nt, Human
caggaggcaaggucaagguc

SEQ ID NO: 1136048 - RNA, 22 nt, Human
gcugucugcaucucuagagcuu

SEQ ID NO: 1136049 - RNA, 22 nt, Human
aucuacaggauuuuacagaguu

SEQ ID NO: 1136050 - RNA, 22 nt, Human
gguggggcccuggcacugguau

SEQ ID NO: 1136051 - RNA, 22 nt, Human
gccucaggacuggcauacucau

SEQ ID NO: 1136052 - RNA, 22 nt, Human
accaggggugucaacagcauuu

SEQ ID NO: 1136053 - RNA, 22 nt, Human
ucacaggagggagagacaccca

SEQ ID NO: 1136054 - RNA, 22 nt, Human
ugugcgcgugcagcggaguguu

SEQ ID NO: 1136055 - RNA, 22 nt, Human
ucauccaguaccauggaaggca

SEQ ID NO: 1136056 - RNA, 23 nt, Human
augcaguauaugucaguaguuua

SEQ ID NO: 1136057 - RNA, 22 nt, Human
uauguacacauacacuuguaau

SEQ ID NO: 1136058 - RNA, 19 nt, Human
ucacaggcaucuccccaga

SEQ ID NO: 1136059 - RNA, 22 nt, Human
cagcagagcuuauguuggguca

SEQ ID NO: 1136060 - RNA, 22 nt, Human
cugagauggaguuuugcucuug

SEQ ID NO: 1136061 - RNA, 22 nt, Human
cccuggaggcggagcuugcagu

SEQ ID NO: 1136062 - RNA, 19 nt, Human
guaagggcuaauggacuau

SEQ ID NO: 1136063 - RNA, 22 nt, Human
uuagcuaaacuguaacuagaau

SEQ ID NO: 1136064 - RNA, 18 nt, Human
acagacaaaauggaaaug

SEQ ID NO: 1136065 - RNA, 17 nt, Human
agcagaagucagaggga

SEQ ID NO: 1136066 - RNA, 21 nt, Human
agagagaaggccauauggucc

SEQ ID NO: 1136067 - RNA, 22 nt, Human
ccaggccucuggcugcuuaguc

SEQ ID NO: 1136068 - RNA, 22 nt, Human
agagggcauuaacucugucuug

SEQ ID NO: 1136069 - RNA, 22 nt, Human
uccaugguagguuucuuaaaga

SEQ ID NO: 1136070 - RNA, 22 nt, Human
cagaaagaccugggcucaagag

SEQ ID NO: 1136071 - RNA, 22 nt, Human
ucucccacugcaagcccaggcu

SEQ ID NO: 1136072 - RNA, 18 nt, Human
cucucugggugaggacaa

SEQ ID NO: 1136073 - RNA, 22 nt, Human
uuuucuuacugucugugauccu

SEQ ID NO: 1136074 - RNA, 22 nt, Human
ugcagaagcagagaguugccaa

SEQ ID NO: 1136075 - RNA, 22 nt, Human
agguagagcuccaguagaaaau

SEQ ID NO: 1136076 - RNA, 22 nt, Human
aaaugguauuuacucuguauua

SEQ ID NO: 1136077 - RNA, 22 nt, Human
ggcucugcuggauugaggccag

SEQ ID NO: 1136078 - RNA, 22 nt, Human
ucccuguccugggcaaucccag

SEQ ID NO: 1136079 - RNA, 22 nt, Human
aaggaagggaaauagugauguc

SEQ ID NO: 1136080 - RNA, 19 nt, Human
ucugcuggcagaauucccu

SEQ ID NO: 1136081 - RNA, 22 nt, Human
ggcuucuccccuuugagucuuc

SEQ ID NO: 1136082 - RNA, 22 nt, Human
uauuaucauugguaauaugguc

SEQ ID NO: 1136083 - RNA, 22 nt, Human
gaggccacgguuuuccuugggg

SEQ ID NO: 1136084 - RNA, 22 nt, Human
gccugaaguuucaugccucuau

SEQ ID NO: 1136085 - RNA, 22 nt, Human
gaggggcugggguugacuccaa

SEQ ID NO: 1136086 - RNA, 22 nt, Human
cacauuuaaagguugaagcuga

SEQ ID NO: 1136087 - RNA, 21 nt, Human
ugggggagaauugguugcuuu

SEQ ID NO: 1136088 - RNA, 22 nt, Human
aggggaggagcuuuucuugccu

SEQ ID NO: 1136089 - RNA, 22 nt, Human
gcuguggcuguacagagaccau

SEQ ID NO: 1136090 - RNA, 22 nt, Human
uggccucuuacgacauagccuu

SEQ ID NO: 1136091 - RNA, 22 nt, Human
gggauggggagcuggaaagggg

SEQ ID NO: 1136092 - RNA, 22 nt, Human
gcuugcuggugccugcaggcuc

SEQ ID NO: 1136093 - RNA, 22 nt, Human
gcaggguauaauacuuagguga

SEQ ID NO: 1136094 - RNA, 22 nt, Human
uccugggcuguggccccgggca

SEQ ID NO: 1136095 - RNA, 22 nt, Human
ugucuguacaaauuuucugugu

SEQ ID NO: 1136096 - RNA, 22 nt, Human
cgccaggcuugguagcucaugc

SEQ ID NO: 1136097 - RNA, 22 nt, Human
cagaggcuaagaugagugggug

SEQ ID NO: 1136098 - RNA, 22 nt, Human
gccuaauaacuagcuguguaac

SEQ ID NO: 1136099 - RNA, 22 nt, Human
gcacagaacuucucuuaguagg

SEQ ID NO: 1136100 - RNA, 22 nt, Human
ugcauugcaguuaacucaguau

SEQ ID NO: 1136101 - RNA, 22 nt, Human
ggcuggcauccagggaaaucca

SEQ ID NO: 1136102 - RNA, 22 nt, Human
ggaaggaggaugcucuggccuu

SEQ ID NO: 1136103 - RNA, 23 nt, Human
uggccugcagaguuucugcuggg

SEQ ID NO: 1136104 - RNA, 18 nt, Human
agucucagcggaggagua

SEQ ID NO: 1136105 - RNA, 20 nt, Human
gcugucuggauuagaagccu

SEQ ID NO: 1136106 - RNA, 22 nt, Human
gggcucugggaugcucuuagag

SEQ ID NO: 1136107 - RNA, 22 nt, Human
ggaggccaugaggcucuaggug

SEQ ID NO: 1136108 - RNA, 22 nt, Human
ucaccaggcuggaaugcagugg

SEQ ID NO: 1136109 - RNA, 22 nt, Human
agggccugacacccuugccagc

SEQ ID NO: 1136110 - RNA, 22 nt, Human
ccuggaaggugaugguacagca

SEQ ID NO: 1136111 - RNA, 19 nt, Human
caguggccuggaggucucu

SEQ ID NO: 1136112 - RNA, 22 nt, Human
cuggccuuuaaaaugaccuuau

SEQ ID NO: 1136113 - RNA, 22 nt, Human
aaggaagacacagaugaaguga

SEQ ID NO: 1136114 - RNA, 18 nt, Human
cagauccaggcagcuauu

SEQ ID NO: 1136115 - RNA, 22 nt, Human
cucacagguaccagcacccucc

SEQ ID NO: 1136116 - RNA, 22 nt, Human
uccaguucuaggucacucucug

SEQ ID NO: 1136117 - RNA, 22 nt, Human
auaagaaacauuauucuuucca

SEQ ID NO: 1136118 - RNA, 22 nt, Human
ccuggcaggcuggggacagugc

SEQ ID NO: 1136119 - RNA, 22 nt, Human
uggagggcaucuguggucaggc

SEQ ID NO: 1136120 - RNA, 22 nt, Human
accaucagagcacaguccgugc

SEQ ID NO: 1136121 - RNA, 22 nt, Human
augaaauaucuugaagaaauuc

SEQ ID NO: 1136122 - RNA, 22 nt, Human
gcugagcugaggcagggcuggg

SEQ ID NO: 1136123 - RNA, 22 nt, Human
cugaggucuagacaccccaggg

SEQ ID NO: 1136124 - RNA, 22 nt, Human
ccacacugaaccucagugucuu

SEQ ID NO: 1136125 - RNA, 17 nt, Human
gcacugaacaauccugu

SEQ ID NO: 1136126 - RNA, 22 nt, Human
aaggcacugcuuugcugcgccc

SEQ ID NO: 1136127 - RNA, 22 nt, Human
uauuaguagcuugaaauuggug

SEQ ID NO: 1136128 - RNA, 22 nt, Human
cagggccagcgucucgggcuau

SEQ ID NO: 1136129 - RNA, 22 nt, Human
ggcugagcacuuuaggcaggag

SEQ ID NO: 1136130 - RNA, 22 nt, Human
aggcugaggcagguggaucauu

SEQ ID NO: 1136131 - RNA, 17 nt, Human
ccugggaggaguuauga

SEQ ID NO: 1136132 - RNA, 22 nt, Human
ggcagccauacucagaccuggg

SEQ ID NO: 1136133 - RNA, 22 nt, Human
gagauuggauuuaauggccaaa

SEQ ID NO: 1136134 - RNA, 16 nt, Human
uguuagcugugcauua

SEQ ID NO: 1136135 - RNA, 22 nt, Human
ccuuagagaguacugggcugcc

SEQ ID NO: 1136136 - RNA, 21 nt, Human
uccagggaacuucucaggaau

SEQ ID NO: 1136137 - RNA, 22 nt, Human
cgaugguucuggcugcuuguau

SEQ ID NO: 1136138 - RNA, 22 nt, Human
acagagcuuaggaugacuccca

SEQ ID NO: 1136139 - RNA, 22 nt, Human
gauccuugcacuugacuuggca

SEQ ID NO: 1136140 - RNA, 22 nt, Human
aagauuucugcuuuuggaggca

SEQ ID NO: 1136141 - RNA, 19 nt, Human
ccuggaggugaagguucuc

SEQ ID NO: 1136142 - RNA, 22 nt, Human
ggguccaggucuucaggcagag

SEQ ID NO: 1136143 - RNA, 22 nt, Human
ggugucccaggccagcugugug

SEQ ID NO: 1136144 - RNA, 22 nt, Human
cagaagccugccucagaugcac

SEQ ID NO: 1136145 - RNA, 21 nt, Human
uggcugcuggcccucucucca

SEQ ID NO: 1136146 - RNA, 22 nt, Human
augccagucaaagaagaugaca

SEQ ID NO: 1136147 - RNA, 22 nt, Human
gcugucacucuccggccuuccc

SEQ ID NO: 1136148 - RNA, 22 nt, Human
gcucccugacucaguuccugag

SEQ ID NO: 1136149 - RNA, 22 nt, Human
uuuuuaagagauucuccagucu

SEQ ID NO: 1136150 - RNA, 22 nt, Human
gguugaauaucuuuauguuggu

SEQ ID NO: 1136151 - RNA, 22 nt, Human
ggcuggaaguccaagaucaagg

SEQ ID NO: 1136152 - RNA, 20 nt, Human
ucagugauuaucucugagug

SEQ ID NO: 1136153 - RNA, 18 nt, Human
aaguccauggguuuggga

SEQ ID NO: 1136154 - RNA, 22 nt, Human
agcaccaucagaugcaauaucu

SEQ ID NO: 1136155 - RNA, 23 nt, Human
guggccuccccggaaugccucgc

SEQ ID NO: 1136156 - RNA, 22 nt, Human
uuuucacacaaggugauaaguu

SEQ ID NO: 1136157 - RNA, 18 nt, Human
uccuccuuuggccuuuuc

SEQ ID NO: 1136158 - RNA, 22 nt, Human
cagccuccugggacacucaccg

SEQ ID NO: 1136159 - RNA, 22 nt, Human
ugcugcacaauuggaaaguauc

SEQ ID NO: 1136160 - RNA, 22 nt, Human
accucugcaguagggcugugcc

SEQ ID NO: 1136161 - RNA, 22 nt, Human
cccugccuugggguccacaccg

SEQ ID NO: 1136162 - RNA, 22 nt, Human
gcucccagggaccgcagggcag

SEQ ID NO: 1136163 - RNA, 22 nt, Human
ccaggagcagauauggacauaa

SEQ ID NO: 1136164 - RNA, 22 nt, Human
cugcaggcccccuuccuggagu

SEQ ID NO: 1136165 - RNA, 22 nt, Human
aguuuuucugcuggucucacua

SEQ ID NO: 1136166 - RNA, 22 nt, Human
agcugagcacauucaaacaggu

SEQ ID NO: 1136167 - RNA, 22 nt, Human
uacaaaguuugagaaugcuuuc

SEQ ID NO: 1136168 - RNA, 22 nt, Human
gugggaugguagguagguaaua

SEQ ID NO: 1136169 - RNA, 22 nt, Human
gggcagcagcaggaggucucug

SEQ ID NO: 1136170 - RNA, 22 nt, Human
cagucccaucucccagguggcu

SEQ ID NO: 1136171 - RNA, 23 nt, Human
ucucucuuagcuaugcuuauggc

SEQ ID NO: 1136172 - RNA, 22 nt, Human
acuuuggaucugauguaaucag

SEQ ID NO: 1136173 - RNA, 22 nt, Human
gagagcuggauucuggauaggu

SEQ ID NO: 1136174 - RNA, 22 nt, Human
cugagccacugcuuguucagug

SEQ ID NO: 1136175 - RNA, 21 nt, Human
ucagaguggaagacaguuuga

SEQ ID NO: 1136176 - RNA, 22 nt, Human
uggcugggugcuauccaguacu

SEQ ID NO: 1136177 - RNA, 22 nt, Human
auuucacucucccugccacuua

SEQ ID NO: 1136178 - RNA, 22 nt, Human
cuucucucccuggcacucagac

SEQ ID NO: 1136179 - RNA, 22 nt, Human
ggagcugcucagagccaguccc

SEQ ID NO: 1136180 - RNA, 22 nt, Human
gggggcuggaauauccaucaac

SEQ ID NO: 1136181 - RNA, 22 nt, Human
ccaggguguagggauuccagau

SEQ ID NO: 1136182 - RNA, 22 nt, Human
uggggcuggggaucuugagccu

SEQ ID NO: 1136183 - RNA, 22 nt, Human
cuccugggcucaagugauccuc

SEQ ID NO: 1136184 - RNA, 22 nt, Human
agggcucuguccccagaggccc

SEQ ID NO: 1136185 - RNA, 22 nt, Human
ucacugcaaucucugccuucca

SEQ ID NO: 1136186 - RNA, 22 nt, Human
cuccauugaacauccucucaga

SEQ ID NO: 1136187 - RNA, 22 nt, Human
aaaggucagcugccaucguucu

SEQ ID NO: 1136188 - RNA, 22 nt, Human
gcuuccugagaaacaaucugau

SEQ ID NO: 1136189 - RNA, 21 nt, Human
ugcucaugcaaugcaugucca

SEQ ID NO: 1136190 - RNA, 22 nt, Human
cugcucucuguuccccuggauc

SEQ ID NO: 1136191 - RNA, 22 nt, Human
uauguacaucguugaauucaaa

SEQ ID NO: 1136192 - RNA, 20 nt, Human
ccuggagccuggaaggaguc

SEQ ID NO: 1136193 - RNA, 19 nt, Human
acagagcucucugcuucug

SEQ ID NO: 1136194 - RNA, 22 nt, Human
caagaaauuucuuaagaacuaa

SEQ ID NO: 1136195 - RNA, 22 nt, Human
gggcuacagacaugcucuaagc

SEQ ID NO: 1136196 - RNA, 22 nt, Human
cacagggcagugcugcccacuc

SEQ ID NO: 1136197 - RNA, 21 nt, Human
guuugcaugaacaagucagcc

SEQ ID NO: 1136198 - RNA, 22 nt, Human
aagcagcagaccugauuuugaa

SEQ ID NO: 1136199 - RNA, 22 nt, Human
cuggcagccaagugggauacuc

SEQ ID NO: 1136200 - RNA, 22 nt, Human
ucaggcagaggauggggagcgu

SEQ ID NO: 1136201 - RNA, 22 nt, Human
uuucagaucauuuuuuaaguac

SEQ ID NO: 1136202 - RNA, 21 nt, Human
aagaagcaauuuauuggaagg

SEQ ID NO: 1136203 - RNA, 22 nt, Human
aaggcugagagucacaguccua

SEQ ID NO: 1136204 - RNA, 22 nt, Human
ggagccugugggaugagaugug

SEQ ID NO: 1136205 - RNA, 22 nt, Human
gcacacccucucaccagcacug

SEQ ID NO: 1136206 - RNA, 22 nt, Human
caggauccccaggucgccgucc

SEQ ID NO: 1136207 - RNA, 22 nt, Human
uuccauaacugaccgaaugcau

SEQ ID NO: 1136208 - RNA, 22 nt, Human
cugccuggcauggagaagagaa

SEQ ID NO: 1136209 - RNA, 22 nt, Human
ggcaugggguguauguggcacg

SEQ ID NO: 1136210 - RNA, 22 nt, Human
cacauacaaugguguuauuugg

SEQ ID NO: 1136211 - RNA, 19 nt, Human
agaggccucagcagcuggc

SEQ ID NO: 1136212 - RNA, 22 nt, Human
aagaauguucauuaaacuguug

SEQ ID NO: 1136213 - RNA, 22 nt, Human
ugaauggucacugagcaucugu

SEQ ID NO: 1136214 - RNA, 22 nt, Human
ugcagcaggcacaggacggaag

SEQ ID NO: 1136215 - RNA, 22 nt, Human
gagggcagugaauuuugaagcu

SEQ ID NO: 1136216 - RNA, 22 nt, Human
gagccuucaucgcagccuuguu

SEQ ID NO: 1136217 - RNA, 22 nt, Human
agaggcuccuagccacuggcuu

SEQ ID NO: 1136218 - RNA, 22 nt, Human
ccucaggguggcaucagaucuu

SEQ ID NO: 1136219 - RNA, 22 nt, Human
ggagcuggucagccuugagcau

SEQ ID NO: 1136220 - RNA, 21 nt, Human
uggagcugccacuuguccucc

SEQ ID NO: 1136221 - RNA, 22 nt, Human
aaccaggacaauuuugaaagua

SEQ ID NO: 1136222 - RNA, 22 nt, Human
guauucuugguuaucaaaauac

SEQ ID NO: 1136223 - RNA, 22 nt, Human
ucugcaggaggcuggcugcagg

SEQ ID NO: 1136224 - RNA, 22 nt, Human
ugugcagcuaguccuggacuug

SEQ ID NO: 1136225 - RNA, 19 nt, Human
ccaggccuccugggagguc

SEQ ID NO: 1136226 - RNA, 22 nt, Human
gccuuggcugaugugcgaauga

SEQ ID NO: 1136227 - RNA, 22 nt, Human
cuggggcugcgguggaggagcc

SEQ ID NO: 1136228 - RNA, 22 nt, Human
cauuguauugaggauacuuaag

SEQ ID NO: 1136229 - RNA, 22 nt, Human
uggggccugagguggagcugca

SEQ ID NO: 1136230 - RNA, 22 nt, Human
gagggcugauaaaugcgcaugg

SEQ ID NO: 1136231 - RNA, 22 nt, Human
caauguuuuguugaaugaauag

SEQ ID NO: 1136232 - RNA, 22 nt, Human
ggccucaguuucuucaacugua

SEQ ID NO: 1136233 - RNA, 22 nt, Human
auaaggcagucccuuaacaagg

SEQ ID NO: 1136234 - RNA, 22 nt, Human
gcagugcuaaguagcuggccca

SEQ ID NO: 1136235 - RNA, 22 nt, Human
uggccaggcagguagaacggcc

SEQ ID NO: 1136236 - RNA, 22 nt, Human
ugcugccaccccucaccagagc

SEQ ID NO: 1136237 - RNA, 22 nt, Human
gcuggcagucccaucagcuggg

SEQ ID NO: 1136238 - RNA, 22 nt, Human
agccucugguccucccucagcu

SEQ ID NO: 1136239 - RNA, 21 nt, Human
uggcagggguaguaguacagc

SEQ ID NO: 1136240 - RNA, 22 nt, Human
cuuagaaaucgaacucagguua

SEQ ID NO: 1136241 - RNA, 22 nt, Human
agucccaggcagccgagccggu

SEQ ID NO: 1136242 - RNA, 22 nt, Human
uggcuccuucauucuccugcca

SEQ ID NO: 1136243 - RNA, 22 nt, Human
aaaucaguucucccuuucuuca

SEQ ID NO: 1136244 - RNA, 22 nt, Human
uuuccucugucaugacagcuga

SEQ ID NO: 1136245 - RNA, 22 nt, Human
uucucuucuguucagugcccaa

SEQ ID NO: 1136246 - RNA, 22 nt, Human
augcucuggaguacgugaaauu

SEQ ID NO: 1136247 - RNA, 22 nt, Human
cacagcagaaauaugaaggcag

SEQ ID NO: 1136248 - RNA, 22 nt, Human
agcaggugcauggcgagcgcgg

SEQ ID NO: 1136249 - RNA, 21 nt, Human
ugggaugggucugggaccagc

SEQ ID NO: 1136250 - RNA, 22 nt, Human
ggcagggugccuggcuccuguu

SEQ ID NO: 1136251 - RNA, 22 nt, Human
gcuuccuucuaccacaucaugc

SEQ ID NO: 1136252 - RNA, 22 nt, Human
uggagccauaacccuuucguac

SEQ ID NO: 1136253 - RNA, 19 nt, Human
ugaagcaggcagagaagau

SEQ ID NO: 1136254 - RNA, 22 nt, Human
uccugcaggccuguucccagua

SEQ ID NO: 1136255 - RNA, 22 nt, Human
uuuuugaaggcugaugugauua

SEQ ID NO: 1136256 - RNA, 20 nt, Human
aagagcugacucacaguggu

SEQ ID NO: 1136257 - RNA, 22 nt, Human
cugaaggaagcagguggccugu

SEQ ID NO: 1136258 - RNA, 20 nt, Human
uccugagauuuaagggguuc

SEQ ID NO: 1136259 - RNA, 23 nt, Human
caugggagugagaaugccagcuc

SEQ ID NO: 1136260 - RNA, 22 nt, Human
gugcgccagcucaaggggaggc

SEQ ID NO: 1136261 - RNA, 22 nt, Human
guccagggcuaaaucagguucc

SEQ ID NO: 1136262 - RNA, 22 nt, Human
ugaaggaaugagggaguggguc

SEQ ID NO: 1136263 - RNA, 22 nt, Human
acauuucuugaugccucuguga

SEQ ID NO: 1136264 - RNA, 22 nt, Human
gcagaugguggggcaggaaaau

SEQ ID NO: 1136265 - RNA, 22 nt, Human
gccuuugccugcgacguggcug

SEQ ID NO: 1136266 - RNA, 22 nt, Human
ccuggcugucguuuugugaaau

SEQ ID NO: 1136267 - RNA, 22 nt, Human
cugagaggaugcugcaguggag

SEQ ID NO: 1136268 - RNA, 22 nt, Human
ucagagcuuuggagaccaggaa

SEQ ID NO: 1136269 - RNA, 21 nt, Human
aggccucuucauggccaugau

SEQ ID NO: 1136270 - RNA, 18 nt, Human
ucucuuuuccccucauug

SEQ ID NO: 1136271 - RNA, 23 nt, Human
uggcucugugucacauacaggau

SEQ ID NO: 1136272 - RNA, 22 nt, Human
caucagcagucacaugaugcug

SEQ ID NO: 1136273 - RNA, 22 nt, Human
ucaggagcagcaugggugagag

SEQ ID NO: 1136274 - RNA, 22 nt, Human
agccuggagguaaugaggaaac

SEQ ID NO: 1136275 - RNA, 21 nt, Human
gcccagcaaggugagaaggcc

SEQ ID NO: 1136276 - RNA, 22 nt, Human
ugccucugggugaccaaggagc

SEQ ID NO: 1136277 - RNA, 21 nt, Human
ugagagccuccaaccggcuac

SEQ ID NO: 1136278 - RNA, 22 nt, Human
ccucagcugcuucccuggagcc

SEQ ID NO: 1136279 - RNA, 22 nt, Human
uggaccugcuggaugggcaggu

SEQ ID NO: 1136280 - RNA, 22 nt, Human
gaaacuguauguaguuuuuggg

SEQ ID NO: 1136281 - RNA, 22 nt, Human
ugggcagagaucuggaucaaac

SEQ ID NO: 1136282 - RNA, 22 nt, Human
cagaaauguuuauauguggugu

SEQ ID NO: 1136283 - RNA, 22 nt, Human
ggcaggaggaagaguuagcacc

SEQ ID NO: 1136284 - RNA, 22 nt, Human
aagcagcauaauugcuauuuua

SEQ ID NO: 1136285 - RNA, 22 nt, Human
ccagcccuguaaggaugaggca

SEQ ID NO: 1136286 - RNA, 22 nt, Human
cagcagggaagcugugcuguuu

SEQ ID NO: 1136287 - RNA, 22 nt, Human
ugucaugccaggaaauaguccc

SEQ ID NO: 1136288 - RNA, 22 nt, Human
accaggcuggagugcaguggcg

SEQ ID NO: 1136289 - RNA, 22 nt, Human
agucccagccuaggcugugcug

SEQ ID NO: 1136290 - RNA, 22 nt, Human
ugcuucaggaagaaacgccagg

SEQ ID NO: 1136291 - RNA, 21 nt, Human
gcagagccugagguucuugag

SEQ ID NO: 1136292 - RNA, 22 nt, Human
cugagggccuuggcuccugccc

SEQ ID NO: 1136293 - RNA, 22 nt, Human
uuuauuaugauggacaccuucg

SEQ ID NO: 1136294 - RNA, 22 nt, Human
ggcuggaaaagacaaagcuauu

SEQ ID NO: 1136295 - RNA, 19 nt, Human
ccagcagacacagcugccc

SEQ ID NO: 1136296 - RNA, 22 nt, Human
uggcagaaguacacaagcaugc

SEQ ID NO: 1136297 - RNA, 22 nt, Human
uucacauuauaaucaguucugc

SEQ ID NO: 1136298 - RNA, 22 nt, Human
cccagcagaccgcugugauggc

SEQ ID NO: 1136299 - RNA, 22 nt, Human
accugccuaguugguucugccc

SEQ ID NO: 1136300 - RNA, 22 nt, Human
caguagcagggauuauuuuagg

SEQ ID NO: 1136301 - RNA, 22 nt, Human
ggucucuguugccuccaucaag

SEQ ID NO: 1136302 - RNA, 22 nt, Human
uuuauuauagugguggggacug

SEQ ID NO: 1136303 - RNA, 22 nt, Human
ucagagugaggcgucaacauga

SEQ ID NO: 1136304 - RNA, 22 nt, Human
ccuuggagcggucagcacuggu

SEQ ID NO: 1136305 - RNA, 19 nt, Human
auaaggcaggaggaaauuu

SEQ ID NO: 1136306 - RNA, 22 nt, Human
agaggcuggauugagcauagac

SEQ ID NO: 1136307 - RNA, 22 nt, Human
aaacauugcuaaauaaugcugc

SEQ ID NO: 1136308 - RNA, 22 nt, Human
aaggacagaaacagauugcugg

SEQ ID NO: 1136309 - RNA, 22 nt, Human
guggccucuguuggcuccuagg

SEQ ID NO: 1136310 - RNA, 22 nt, Human
cuggcucccucgcugaggugcu

SEQ ID NO: 1136311 - RNA, 22 nt, Human
ucaaaugcucuuugcagagagg

SEQ ID NO: 1136312 - RNA, 22 nt, Human
cagggcuggcuguggcaaucuc

SEQ ID NO: 1136313 - RNA, 22 nt, Human
ccaggagguggagauugcagug

SEQ ID NO: 1136314 - RNA, 22 nt, Human
aaaaccaggcguuuccuauuau

SEQ ID NO: 1136315 - RNA, 19 nt, Human
guuuuguuugcagaacuua

SEQ ID NO: 1136316 - RNA, 22 nt, Human
ggccaggagcaagccaggcucu

SEQ ID NO: 1136317 - RNA, 22 nt, Human
aagaggucauaccagauaaggg

SEQ ID NO: 1136318 - RNA, 22 nt, Human
ccucagccuuggccccaggcag

SEQ ID NO: 1136319 - RNA, 22 nt, Human
ccagccagucccgcaugaccgc

SEQ ID NO: 1136320 - RNA, 22 nt, Human
gaggcagcaucuauggugggaa

SEQ ID NO: 1136321 - RNA, 22 nt, Human
ugccugggaaccaauccuggcu

SEQ ID NO: 1136322 - RNA, 22 nt, Human
ugagcccaggaguuggagaccg

SEQ ID NO: 1136323 - RNA, 22 nt, Human
agaaaugggccuugggacacaa

SEQ ID NO: 1136324 - RNA, 22 nt, Human
gcucagaggcacgaccucuugg

SEQ ID NO: 1136325 - RNA, 19 nt, Human
ggcagaagguguaggggga

SEQ ID NO: 1136326 - RNA, 22 nt, Human
ucccuggggauguuggccugcc

SEQ ID NO: 1136327 - RNA, 19 nt, Human
acuuugcaugugugucuaa

SEQ ID NO: 1136328 - RNA, 22 nt, Human
caggacagguguucuagaucag

SEQ ID NO: 1136329 - RNA, 21 nt, Human
ccugggccaaauucccuggac

SEQ ID NO: 1136330 - RNA, 22 nt, Human
ugacagggcuagaggcaaugca

SEQ ID NO: 1136331 - RNA, 22 nt, Human
ucugagagcuguagaagccuau

SEQ ID NO: 1136332 - RNA, 22 nt, Human
uggguagagcaggcuggggcuu

SEQ ID NO: 1136333 - RNA, 22 nt, Human
gccugccugaaggcuguaccag

SEQ ID NO: 1136334 - RNA, 22 nt, Human
aacuuuaaggcuauaaauuaug

SEQ ID NO: 1136335 - RNA, 22 nt, Human
gggcacagagggucuugaagaa

SEQ ID NO: 1136336 - RNA, 22 nt, Human
cugggaggauacacaagaucag

SEQ ID NO: 1136337 - RNA, 22 nt, Human
aagaugauguuguguuuucacu

SEQ ID NO: 1136338 - RNA, 22 nt, Human
ugaagcagaggggucuugagcu

SEQ ID NO: 1136339 - RNA, 22 nt, Human
aagaaaugcagaaaugugcugg

SEQ ID NO: 1136340 - RNA, 18 nt, Human
ccagcaugccagaggcug

SEQ ID NO: 1136341 - RNA, 22 nt, Human
ucacguuuuacugagugagaua

SEQ ID NO: 1136342 - RNA, 22 nt, Human
gaaucacgguauucugcacggg

SEQ ID NO: 1136343 - RNA, 23 nt, Human
uugaaagguagcuggcagcuaga

SEQ ID NO: 1136344 - RNA, 22 nt, Human
uugcuauuuugagagucauagu

SEQ ID NO: 1136345 - RNA, 22 nt, Human
gcuggccuuugaggaagcugcg

SEQ ID NO: 1136346 - RNA, 22 nt, Human
gcagcugaagcugcaguuccag

SEQ ID NO: 1136347 - RNA, 22 nt, Human
ugggccuggcccuguggaggag

SEQ ID NO: 1136348 - RNA, 22 nt, Human
uaacagaaaggggacagaaaua

SEQ ID NO: 1136349 - RNA, 20 nt, Human
agcugguuaucuuaauucuu

SEQ ID NO: 1136350 - RNA, 22 nt, Human
uuguaacaggcacucugugcca

SEQ ID NO: 1136351 - RNA, 17 nt, Human
uuuuguucaucuucaaa

SEQ ID NO: 1136352 - RNA, 22 nt, Human
gugucccagcagcacauuggcu

SEQ ID NO: 1136353 - RNA, 22 nt, Human
agcacagauucugaagaguccu

SEQ ID NO: 1136354 - RNA, 23 nt, Human
gcucugagggcuuaucccuccca

SEQ ID NO: 1136355 - RNA, 18 nt, Human
acagaacucaggggcacc

SEQ ID NO: 1136356 - RNA, 20 nt, Human
agucccuuuggucagguauu

SEQ ID NO: 1136357 - RNA, 22 nt, Human
uaugugugcauguauacauuaa

SEQ ID NO: 1136358 - RNA, 22 nt, Human
gcugcccaguucugcugcugcc

SEQ ID NO: 1136359 - RNA, 22 nt, Human
agcagcuccugccaugagugcu

SEQ ID NO: 1136360 - RNA, 22 nt, Human
agcaggaguguccccuggcugu

SEQ ID NO: 1136361 - RNA, 22 nt, Human
auuccaguucuccucucuaaag

SEQ ID NO: 1136362 - RNA, 22 nt, Human
uaccuugggcuauuaucuuuga

SEQ ID NO: 1136363 - RNA, 22 nt, Human
gccucucucuacccaguaugau

SEQ ID NO: 1136364 - RNA, 22 nt, Human
gcagagccaggcuggggcaggu

SEQ ID NO: 1136365 - RNA, 22 nt, Human
uacaguaucuucuggcaagcau

SEQ ID NO: 1136366 - RNA, 22 nt, Human
cagggcaguuuuacuucucucu

SEQ ID NO: 1136367 - RNA, 22 nt, Human
ugagcccagagcccuuguaggg

SEQ ID NO: 1136368 - RNA, 22 nt, Human
cugugccuggggggcagagcug

SEQ ID NO: 1136369 - RNA, 22 nt, Human
cugccagcagaggccagcgcug

SEQ ID NO: 1136370 - RNA, 20 nt, Human
aaggcacuaugucugcuagc

SEQ ID NO: 1136371 - RNA, 22 nt, Human
acaaagucucuaauaaucuucu

SEQ ID NO: 1136372 - RNA, 22 nt, Human
ggcagcaguggcugcuauuguc

SEQ ID NO: 1136373 - RNA, 22 nt, Human
ucaggccacggcucacugagac

SEQ ID NO: 1136374 - RNA, 22 nt, Human
cccaggccccagggcuugucag

SEQ ID NO: 1136375 - RNA, 22 nt, Human
cuggccuguccugacccagccu

SEQ ID NO: 1136376 - RNA, 22 nt, Human
gggaugucacugugccuggcac

SEQ ID NO: 1136377 - RNA, 22 nt, Human
cuggccuggcaggggaccucua

SEQ ID NO: 1136378 - RNA, 22 nt, Human
auaaagucuaccguauuaaaga

SEQ ID NO: 1136379 - RNA, 21 nt, Human
ggugucaguuuuggucauuag

SEQ ID NO: 1136380 - RNA, 22 nt, Human
caggcugcggucggcucugguc

SEQ ID NO: 1136381 - RNA, 22 nt, Human
ugggcagauguccucugaagug

SEQ ID NO: 1136382 - RNA, 22 nt, Human
caguguguggauccucccagga

SEQ ID NO: 1136383 - RNA, 21 nt, Human
gaggccacuaauaggggcaga

SEQ ID NO: 1136384 - RNA, 22 nt, Human
acagccagguaaaggcauggca

SEQ ID NO: 1136385 - RNA, 22 nt, Human
gaaaccucuuagccucucuuug

SEQ ID NO: 1136386 - RNA, 22 nt, Human
ucugaggcauaaccuguucugc

SEQ ID NO: 1136387 - RNA, 22 nt, Human
uagcagggccaggcugggaacc

SEQ ID NO: 1136388 - RNA, 22 nt, Human
ucucagagcuucaguuauuuuc

SEQ ID NO: 1136389 - RNA, 22 nt, Human
cagcuuugauucuuucugccau

SEQ ID NO: 1136390 - RNA, 22 nt, Human
agguccagcuguugcagccucc

SEQ ID NO: 1136391 - RNA, 22 nt, Human
gccaggcuggugcaaggauauu

SEQ ID NO: 1136392 - RNA, 18 nt, Human
acauuucuaugcuucugg

SEQ ID NO: 1136393 - RNA, 22 nt, Human
gauuuagagaauguuuuguaag

SEQ ID NO: 1136394 - RNA, 22 nt, Human
aggagucauugagagggguccu

SEQ ID NO: 1136395 - RNA, 22 nt, Human
uauauuuuagacacccucacgc

SEQ ID NO: 1136396 - RNA, 22 nt, Human
gcuggccugcugggcaccaccg

SEQ ID NO: 1136397 - RNA, 17 nt, Human
guuugcaugguguuaac

SEQ ID NO: 1136398 - RNA, 22 nt, Human
caggccugaguguggaagucuu

SEQ ID NO: 1136399 - RNA, 22 nt, Human
cccuggccagcucaugucugag

SEQ ID NO: 1136400 - RNA, 22 nt, Human
gugauuucuaaucaucugaaug

SEQ ID NO: 1136401 - RNA, 22 nt, Human
ucccagcagucagagcuaugug

SEQ ID NO: 1136402 - RNA, 22 nt, Human
uccugcagagccgcccucaggu

SEQ ID NO: 1136403 - RNA, 22 nt, Human
gaaugcacuuccaacaucuauu

SEQ ID NO: 1136404 - RNA, 22 nt, Human
agggggcccuugcaggugagcg

SEQ ID NO: 1136405 - RNA, 22 nt, Human
ccugucuggccaccagggcgau

SEQ ID NO: 1136406 - RNA, 22 nt, Human
uggcuggcaguaggcuaguggc

SEQ ID NO: 1136407 - RNA, 22 nt, Human
ugaagccacagagcaucugccu

SEQ ID NO: 1136408 - RNA, 22 nt, Human
acacacaacucauuguguaaua

SEQ ID NO: 1136409 - RNA, 22 nt, Human
ugucccaguuuaucugggacug

SEQ ID NO: 1136410 - RNA, 22 nt, Human
gaugugggguugagggaccagc

SEQ ID NO: 1136411 - RNA, 22 nt, Human
auacaaguugugauaauguaaa

SEQ ID NO: 1136412 - RNA, 22 nt, Human
caaugugucaggaaaagggcca

SEQ ID NO: 1136413 - RNA, 22 nt, Human
uggccgggccgggcgccuccac

SEQ ID NO: 1136414 - RNA, 22 nt, Human
cugggacagcugagacaggaga

SEQ ID NO: 1136415 - RNA, 22 nt, Human
gccugguguccagaggcgagug

SEQ ID NO: 1136416 - RNA, 22 nt, Human
aaaugcagguaguauuuauuuu

SEQ ID NO: 1136417 - RNA, 22 nt, Human
uuaugacauaugaguacaagua

SEQ ID NO: 1136418 - RNA, 21 nt, Human
caggaaaagcggaagucuagc

SEQ ID NO: 1136419 - RNA, 23 nt, Human
uucuuucaagaaguucacagugc

SEQ ID NO: 1136420 - RNA, 22 nt, Human
acugggccuugccauggcagcc

SEQ ID NO: 1136421 - RNA, 22 nt, Human
uuguuuucacagcuuugcccgg

SEQ ID NO: 1136422 - RNA, 22 nt, Human
uggcuucagacuucugcuacgu

SEQ ID NO: 1136423 - RNA, 22 nt, Human
uuaagaauggaaugaggaauuu

SEQ ID NO: 1136424 - RNA, 22 nt, Human
ccaggcagcucugauuuauguc

SEQ ID NO: 1136425 - RNA, 22 nt, Human
ugcugucccuaagucucuucaa

SEQ ID NO: 1136426 - RNA, 22 nt, Human
agacccugucaguguuaggaaa

SEQ ID NO: 1136427 - RNA, 22 nt, Human
agcugcuaugacaacaccagcc

SEQ ID NO: 1136428 - RNA, 21 nt, Human
acagagccgggcacaaagcug

SEQ ID NO: 1136429 - RNA, 22 nt, Human
gaggaggaaacccuguuccucu

SEQ ID NO: 1136430 - RNA, 22 nt, Human
caagcagacaguaggccuagaa

SEQ ID NO: 1136431 - RNA, 22 nt, Human
uuugcauuguaauauuuaguuc

SEQ ID NO: 1136432 - RNA, 22 nt, Human
uguauuagaucugagaacuucu

SEQ ID NO: 1136433 - RNA, 22 nt, Human
cagaauaugacaagauuuuccu

SEQ ID NO: 1136434 - RNA, 22 nt, Human
uauuugaaaguguacaaaaacu

SEQ ID NO: 1136435 - RNA, 22 nt, Human
gaaggaaaaauacucuguaagg

SEQ ID NO: 1136436 - RNA, 22 nt, Human
gauuucuucauucauuagaugg

SEQ ID NO: 1136437 - RNA, 18 nt, Human
cccagcccaccauuucuc

SEQ ID NO: 1136438 - RNA, 22 nt, Human
gcuccugucuuggggcacuggc

SEQ ID NO: 1136439 - RNA, 22 nt, Human
uacaguauuaugagugauugaa

SEQ ID NO: 1136440 - RNA, 20 nt, Human
agugacagagacuguguggc

SEQ ID NO: 1136441 - RNA, 22 nt, Human
cugugcaagacuuacuuuaaua

SEQ ID NO: 1136442 - RNA, 22 nt, Human
agccucugcuggcccuggcacu

SEQ ID NO: 1136443 - RNA, 22 nt, Human
auuguggugucaguuauaggca

SEQ ID NO: 1136444 - RNA, 22 nt, Human
cugguuuagcuguaagguuccc

SEQ ID NO: 1136445 - RNA, 22 nt, Human
aagggcuggaucucucugagca

SEQ ID NO: 1136446 - RNA, 22 nt, Human
agagcuggauggucaagauggc

SEQ ID NO: 1136447 - RNA, 22 nt, Human
gccaggcaaauuaaggaaugca

SEQ ID NO: 1136448 - RNA, 22 nt, Human
agccagcaugaagacagaggcc

SEQ ID NO: 1136449 - RNA, 22 nt, Human
gugcccugaguggguaggagag

SEQ ID NO: 1136450 - RNA, 22 nt, Human
gagcagugaagacagaaguaca

SEQ ID NO: 1136451 - RNA, 22 nt, Human
ccucuggucccagcucugcugc

SEQ ID NO: 1136452 - RNA, 22 nt, Human
aaaugcauaucaaagacuugaa

SEQ ID NO: 1136453 - RNA, 22 nt, Human
aguggggacuuaugccagcauu

SEQ ID NO: 1136454 - RNA, 22 nt, Human
aauaugugagguauguucagug

SEQ ID NO: 1136455 - RNA, 22 nt, Human
gugugcgcgcucauaggugugu

SEQ ID NO: 1136456 - RNA, 21 nt, Human
aggcuguccuuugccagcccu

SEQ ID NO: 1136457 - RNA, 22 nt, Human
acccagaggugucuagcaagcu

SEQ ID NO: 1136458 - RNA, 22 nt, Human
ucucccacgguacaggauaaac

SEQ ID NO: 1136459 - RNA, 22 nt, Human
gugcaguggcagauccuagcuc

SEQ ID NO: 1136460 - RNA, 22 nt, Human
gcagacaggcccaguggaggga

SEQ ID NO: 1136461 - RNA, 22 nt, Human
uucuuuaaaauagugagaaaga

SEQ ID NO: 1136462 - RNA, 22 nt, Human
uaaaugcaguuaguacuugcca

SEQ ID NO: 1136463 - RNA, 22 nt, Human
caggccucccggugcacacuga

SEQ ID NO: 1136464 - RNA, 22 nt, Human
gccaggggacgcggagcgacga

SEQ ID NO: 1136465 - RNA, 22 nt, Human
gcucccaccuuugcuaucagua

SEQ ID NO: 1136466 - RNA, 22 nt, Human
ugcugccuuagcagccaggcaa

SEQ ID NO: 1136467 - RNA, 22 nt, Human
uuauuuucuccucagaaagugg

SEQ ID NO: 1136468 - RNA, 20 nt, Human
agggcagagggauuacaggc

SEQ ID NO: 1136469 - RNA, 22 nt, Human
cccagcacuuugaauaugucac

SEQ ID NO: 1136470 - RNA, 22 nt, Human
gccugagacagugugguccaau

SEQ ID NO: 1136471 - RNA, 22 nt, Human
ugucccagauacuggacauaga

SEQ ID NO: 1136472 - RNA, 19 nt, Human
augucuguugaauuucaua

SEQ ID NO: 1136473 - RNA, 22 nt, Human
uuauguaauuuguuugcucuuc

SEQ ID NO: 1136474 - RNA, 22 nt, Human
guaggcagauaggagugcagcc

SEQ ID NO: 1136475 - RNA, 22 nt, Human
aggccugucuggggcucagcca

SEQ ID NO: 1136476 - RNA, 22 nt, Human
gcugucugagaacaugguggaa

SEQ ID NO: 1136477 - RNA, 22 nt, Human
aagcuggcaauuaucaaaacug

SEQ ID NO: 1136478 - RNA, 20 nt, Human
ccagagcugauggcugcccg

SEQ ID NO: 1136479 - RNA, 22 nt, Human
gggccacauugaagggugggua

SEQ ID NO: 1136480 - RNA, 21 nt, Human
agacagagugcagucuacaua

SEQ ID NO: 1136481 - RNA, 22 nt, Human
gugccaggugcuaagcugugcu

SEQ ID NO: 1136482 - RNA, 22 nt, Human
gggccccuuguaucucuggcuc

SEQ ID NO: 1136483 - RNA, 22 nt, Human
auauauuuacucuccuguugca

SEQ ID NO: 1136484 - RNA, 22 nt, Human
guacauuuugagguuaaaacaa

SEQ ID NO: 1136485 - RNA, 22 nt, Human
cugaggcucccucgggucugcu

SEQ ID NO: 1136486 - RNA, 22 nt, Human
guggcugcuacagagcuggagg

SEQ ID NO: 1136487 - RNA, 22 nt, Human
augggaggcaggcucagaaccg

SEQ ID NO: 1136488 - RNA, 22 nt, Human
ugggacagagugagcuuuggcc

SEQ ID NO: 1136489 - RNA, 22 nt, Human
aucuggcucuuccuggaguucc

SEQ ID NO: 1136490 - RNA, 22 nt, Human
agcuggagcuucaagcagguaa

SEQ ID NO: 1136491 - RNA, 22 nt, Human
uagaaaguaaaucaguuuuauu

SEQ ID NO: 1136492 - RNA, 22 nt, Human
gcagugaaucuggcaagaauuu

SEQ ID NO: 1136493 - RNA, 22 nt, Human
ccacacagggggaugaguuauu

SEQ ID NO: 1136494 - RNA, 22 nt, Human
ucauugcaccccagucccagcu

SEQ ID NO: 1136495 - RNA, 22 nt, Human
uacaaagccugguagauaucug

SEQ ID NO: 1136496 - RNA, 22 nt, Human
uccuguaguugcuaaguuuguu

SEQ ID NO: 1136497 - RNA, 22 nt, Human
gagcuuggugaugccuccuggu

SEQ ID NO: 1136498 - RNA, 22 nt, Human
gcucaaggcaggcagacaugag

SEQ ID NO: 1136499 - RNA, 22 nt, Human
acagagcauuugggacagagag

SEQ ID NO: 1136500 - RNA, 22 nt, Human
ugucccagacacaguaugcgcu

SEQ ID NO: 1136501 - RNA, 22 nt, Human
cugccucaugcugccugcagcc

SEQ ID NO: 1136502 - RNA, 22 nt, Human
gcauuuaaauuugaacuucaga

SEQ ID NO: 1136503 - RNA, 22 nt, Human
ugcaggggcuugucugggccug

SEQ ID NO: 1136504 - RNA, 17 nt, Human
ggccuuggggccucagu

SEQ ID NO: 1136505 - RNA, 22 nt, Human
ucacagggauggaauagaaaua

SEQ ID NO: 1136506 - RNA, 22 nt, Human
uucacauuggugauauguuucu

SEQ ID NO: 1136507 - RNA, 22 nt, Human
guacaaaguggaccugauagua

SEQ ID NO: 1136508 - RNA, 22 nt, Human
ggacagcccauacacaugucug

SEQ ID NO: 1136509 - RNA, 22 nt, Human
auuauauugaguauaaccagag

SEQ ID NO: 1136510 - RNA, 22 nt, Human
ccacccugagccgcaagagcag

SEQ ID NO: 1136511 - RNA, 22 nt, Human
cugcuuugcauagcugccagag

SEQ ID NO: 1136512 - RNA, 22 nt, Human
gaguaagagcuggcuuuggugu

SEQ ID NO: 1136513 - RNA, 20 nt, Human
ucucaggccccaguuuucuu

SEQ ID NO: 1136514 - RNA, 23 nt, Human
agaggccaacuucuugccccucc

SEQ ID NO: 1136515 - RNA, 22 nt, Human
ucucucagucagaugcuaaaga

SEQ ID NO: 1136516 - RNA, 22 nt, Human
auccccagaaaauaggugccua

SEQ ID NO: 1136517 - RNA, 23 nt, Human
gagagcugacugucaagacuguu

SEQ ID NO: 1136518 - RNA, 22 nt, Human
uugaacauuaacuucagucuau

SEQ ID NO: 1136519 - RNA, 20 nt, Human
uccaauguaggauaaaugug

SEQ ID NO: 1136520 - RNA, 23 nt, Human
uacuuaggaauggggacggcaag

SEQ ID NO: 1136521 - RNA, 22 nt, Human
gcugccucccccauggcuggaa

SEQ ID NO: 1136522 - RNA, 22 nt, Human
caggugggcguggcgagaaggc

SEQ ID NO: 1136523 - RNA, 22 nt, Human
guccuggggaauacagaagccg

SEQ ID NO: 1136524 - RNA, 22 nt, Human
agaggcaggaagagcugauuuu

SEQ ID NO: 1136525 - RNA, 20 nt, Human
guccugggagccacagcaca

SEQ ID NO: 1136526 - RNA, 22 nt, Human
agcccugggaggccagcuugua

SEQ ID NO: 1136527 - RNA, 19 nt, Human
ccagcccugucacuucuug

SEQ ID NO: 1136528 - RNA, 20 nt, Human
uguguguguacuucuaaaua

SEQ ID NO: 1136529 - RNA, 22 nt, Human
cagagccugccucuggcugugg

SEQ ID NO: 1136530 - RNA, 22 nt, Human
aaguuuguucagggcuuacauu

SEQ ID NO: 1136531 - RNA, 21 nt, Human
uucagcaguccucuagagaua

SEQ ID NO: 1136532 - RNA, 22 nt, Human
ugccugccaugcagaaagcuga

SEQ ID NO: 1136533 - RNA, 22 nt, Human
ggcacugagaacaggcugacuu

SEQ ID NO: 1136534 - RNA, 22 nt, Human
cccugcagaccaaugccauaga

SEQ ID NO: 1136535 - RNA, 22 nt, Human
uugaaggaggcuccuuuuuaaa

SEQ ID NO: 1136536 - RNA, 21 nt, Human
aacugcuggucuuuucugucu

SEQ ID NO: 1136537 - RNA, 22 nt, Human
ccacagggauaggaauggggcu

SEQ ID NO: 1136538 - RNA, 22 nt, Human
gcucaggaucagccaccucuuu

SEQ ID NO: 1136539 - RNA, 19 nt, Human
ucccagagucuagagguug

SEQ ID NO: 1136540 - RNA, 22 nt, Human
ggugggcaacauuuggccugag

SEQ ID NO: 1136541 - RNA, 22 nt, Human
agugucauaugccacugcaucc

SEQ ID NO: 1136542 - RNA, 22 nt, Human
guuugcauauuugcacaggaau

SEQ ID NO: 1136543 - RNA, 22 nt, Human
augaugguuguccuaggugcau

SEQ ID NO: 1136544 - RNA, 22 nt, Human
ggggcagaaguagugccccuga

SEQ ID NO: 1136545 - RNA, 22 nt, Human
gccugccuagaauugcagcuuu

SEQ ID NO: 1136546 - RNA, 22 nt, Human
uguuuugucuaauagggcaggu

SEQ ID NO: 1136547 - RNA, 22 nt, Human
ugcagugguugagagcccagac

SEQ ID NO: 1136548 - RNA, 19 nt, Human
uccuccuuacuuccucuug

SEQ ID NO: 1136549 - RNA, 22 nt, Human
ggucccagcugcucaagaggcu

SEQ ID NO: 1136550 - RNA, 22 nt, Human
uggccugguccuugucaaggca

SEQ ID NO: 1136551 - RNA, 22 nt, Human
ggccuugggcagacacgucaca

SEQ ID NO: 1136552 - RNA, 22 nt, Human
uuuuaucaaucauuaagacauu

SEQ ID NO: 1136553 - RNA, 18 nt, Human
uuucacaaccuccagagg

SEQ ID NO: 1136554 - RNA, 19 nt, Human
agcagccauagacaauaug

SEQ ID NO: 1136555 - RNA, 22 nt, Human
guggccugucagaagccguggg

SEQ ID NO: 1136556 - RNA, 22 nt, Human
uguggccaccagagcugcuauu

SEQ ID NO: 1136557 - RNA, 22 nt, Human
ucugcaggacugaggccuguuu

SEQ ID NO: 1136558 - RNA, 23 nt, Human
gugcucugcggucugcuagucug

SEQ ID NO: 1136559 - RNA, 22 nt, Human
acugggccuggauuggcguguc

SEQ ID NO: 1136560 - RNA, 22 nt, Human
gcaaggagacuguagggccaag

SEQ ID NO: 1136561 - RNA, 22 nt, Human
uccugccucuuuucuuauucca

SEQ ID NO: 1136562 - RNA, 22 nt, Human
gcugagaggcacuaucuccgga

SEQ ID NO: 1136563 - RNA, 22 nt, Human
guguccagagaaacucacagcu

SEQ ID NO: 1136564 - RNA, 22 nt, Human
cagcacugcuucgcagccaggg

SEQ ID NO: 1136565 - RNA, 22 nt, Human
ugguggcuguugcagaacugag

SEQ ID NO: 1136566 - RNA, 22 nt, Human
uguaugcaccauuguauuaccu

SEQ ID NO: 1136567 - RNA, 22 nt, Human
gccuggugcuaugagggccagc

SEQ ID NO: 1136568 - RNA, 22 nt, Human
uacuuccagcaaucugcauauu

SEQ ID NO: 1136569 - RNA, 22 nt, Human
ugcagccauuuucugccaaugc

SEQ ID NO: 1136570 - RNA, 22 nt, Human
ucugcgcugccuugauccuugg

SEQ ID NO: 1136571 - RNA, 22 nt, Human
caguuucuuaucuucaaaauug

SEQ ID NO: 1136572 - RNA, 22 nt, Human
guggcuugaccaucccugcuac

SEQ ID NO: 1136573 - RNA, 22 nt, Human
ccagggcaauuauuuggagggu

SEQ ID NO: 1136574 - RNA, 22 nt, Human
acagagccacuuuggugccuac

SEQ ID NO: 1136575 - RNA, 22 nt, Human
gagugaaaaaggaagggccaua

SEQ ID NO: 1136576 - RNA, 22 nt, Human
gugcaggggaucagguugcagc

SEQ ID NO: 1136577 - RNA, 22 nt, Human
agcaaggcagucagcuggcugg

SEQ ID NO: 1136578 - RNA, 20 nt, Human
ccagguggugccuggagagg

SEQ ID NO: 1136579 - RNA, 23 nt, Human
aggcagguuugggcucuucuugu

SEQ ID NO: 1136580 - RNA, 22 nt, Human
ugucugccugcgggccggcaca

SEQ ID NO: 1136581 - RNA, 22 nt, Human
guugaguguugugcaugcacca

SEQ ID NO: 1136582 - RNA, 22 nt, Human
agguggucuuguggaugccgca

SEQ ID NO: 1136583 - RNA, 22 nt, Human
aagugcaggucucagcuacucu

SEQ ID NO: 1136584 - RNA, 22 nt, Human
cgugaugcucaggaggucauag

SEQ ID NO: 1136585 - RNA, 22 nt, Human
gugcugccuccauauccgucag

SEQ ID NO: 1136586 - RNA, 22 nt, Human
guuuuaguggguggccacugau

SEQ ID NO: 1136587 - RNA, 22 nt, Human
gucguucucugccagggcguug

SEQ ID NO: 1136588 - RNA, 22 nt, Human
uugcuugaacccaggaagugga

SEQ ID NO: 1136589 - RNA, 22 nt, Human
auuaguguuguggcuucauggc

SEQ ID NO: 1136590 - RNA, 22 nt, Human
agugacauuauuuuguguacua

SEQ ID NO: 1136591 - RNA, 19 nt, Human
auucuucucuuccugcugu

SEQ ID NO: 1136592 - RNA, 22 nt, Human
ugcccucagcagcagcuccugc

SEQ ID NO: 1136593 - RNA, 21 nt, Human
uugcuguuuucccaaugcagu

SEQ ID NO: 1136594 - RNA, 22 nt, Human
uuuggcgucucucaggagcuca

SEQ ID NO: 1136595 - RNA, 22 nt, Human
cagacucuugagcugauuguau

SEQ ID NO: 1136596 - RNA, 22 nt, Human
auggaguucugccagcgcugcu

SEQ ID NO: 1136597 - RNA, 22 nt, Human
aggcucucucugccagccgugc

SEQ ID NO: 1136598 - RNA, 22 nt, Human
caggaaugccaaccagugcaug

SEQ ID NO: 1136599 - RNA, 22 nt, Human
cagagcagaaaccugggugauu

SEQ ID NO: 1136600 - RNA, 19 nt, Human
ccugcugaagugaugcagc

SEQ ID NO: 1136601 - RNA, 22 nt, Human
guuucuccucugugucuuguuu

SEQ ID NO: 1136602 - RNA, 20 nt, Human
ugugugaauuagggcauguu

SEQ ID NO: 1136603 - RNA, 22 nt, Human
ucaugcaccucuccaugucccc

SEQ ID NO: 1136604 - RNA, 22 nt, Human
cacauuuaaagguugaagcuga

SEQ ID NO: 1136605 - RNA, 22 nt, Human
auguuguugaacucuuugcaug

SEQ ID NO: 1136606 - RNA, 22 nt, Human
auaguguguaaagugcagugau

SEQ ID NO: 1136607 - RNA, 23 nt, Human
gaaguucuguucagccagacaag

SEQ ID NO: 1136608 - RNA, 20 nt, Human
cuuguuaaauaugcagguag

SEQ ID NO: 1136609 - RNA, 22 nt, Human
ucuccucuauuucuguauguau

SEQ ID NO: 1136610 - RNA, 22 nt, Human
uugaccacugaaugguucugaa

SEQ ID NO: 1136611 - RNA, 22 nt, Human
cagcaugaauguguucguaggg

SEQ ID NO: 1136612 - RNA, 22 nt, Human
uuucuucucacccaggacagag

SEQ ID NO: 1136613 - RNA, 22 nt, Human
uccuuggagaaucuuguuuuac

SEQ ID NO: 1136614 - RNA, 22 nt, Human
cuucauuuggcaggcuggccuc

SEQ ID NO: 1136615 - RNA, 22 nt, Human
cccguguggaugcgcuggugcu

SEQ ID NO: 1136616 - RNA, 22 nt, Human
caaugcagauaccuuccagaga

SEQ ID NO: 1136617 - RNA, 22 nt, Human
ccaggcagccaagugugugugu

SEQ ID NO: 1136618 - RNA, 22 nt, Human
agggcccaccuuggugcugagg

SEQ ID NO: 1136619 - RNA, 23 nt, Human
uuguucuuggaucuuccugaagc

SEQ ID NO: 1136620 - RNA, 22 nt, Human
gugggccugaugcugccaugag

SEQ ID NO: 1136621 - RNA, 20 nt, Human
ugugguuuuugccaguugaa

SEQ ID NO: 1136622 - RNA, 19 nt, Human
ugguucuccuuccacaguc

SEQ ID NO: 1136623 - RNA, 22 nt, Human
uuccuuggaaagagacgucgcu

SEQ ID NO: 1136624 - RNA, 22 nt, Human
ugaggauggaaugcugugcaag

SEQ ID NO: 1136625 - RNA, 22 nt, Human
cacagcuucuccccgcugcggc

SEQ ID NO: 1136626 - RNA, 22 nt, Human
gcuuccuucuaccacaucaugc

SEQ ID NO: 1136627 - RNA, 22 nt, Human
gauggugcaggugaagugcugg

SEQ ID NO: 1136628 - RNA, 22 nt, Human
ggaaugcacuagacugugaaac

SEQ ID NO: 1136629 - RNA, 22 nt, Human
uguggguccuccugugugcccg

SEQ ID NO: 1136630 - RNA, 21 nt, Human
cugcacugugauuuaaaaugu

SEQ ID NO: 1136631 - RNA, 22 nt, Human
ugugguuuugguucagaaacaa

SEQ ID NO: 1136632 - RNA, 22 nt, Human
ucagccagaggcuucuugguuu

SEQ ID NO: 1136633 - RNA, 22 nt, Human
cucggaauggaacaacagcggu

SEQ ID NO: 1136634 - RNA, 18 nt, Human
cuuuagcugucaucuuug

SEQ ID NO: 1136635 - RNA, 22 nt, Human
uugcaggucuggggguccuggu

SEQ ID NO: 1136636 - RNA, 22 nt, Human
cuagcagcauucuucuaguuag

SEQ ID NO: 1136637 - RNA, 22 nt, Human
caauuuuuaaacuaugaaguug

SEQ ID NO: 1136638 - RNA, 22 nt, Human
ugaguguuguaaccauaugauu

SEQ ID NO: 1136639 - RNA, 22 nt, Human
uaacauuucggugacaguggga

SEQ ID NO: 1136640 - RNA, 22 nt, Human
auccuucaaaaggaauagcagg

SEQ ID NO: 1136641 - RNA, 22 nt, Human
ggcuuccuccuuccugcuguca

SEQ ID NO: 1136642 - RNA, 22 nt, Human
ucaagcggacugagauacucug

SEQ ID NO: 1136643 - RNA, 19 nt, Human
ugcagcuguaugagcuuaa

SEQ ID NO: 1136644 - RNA, 22 nt, Human
ccugguuugggugccagugagu

SEQ ID NO: 1136645 - RNA, 22 nt, Human
cugggcccacgagggcucuggg

SEQ ID NO: 1136646 - RNA, 22 nt, Human
cuuccucuguggccagagugua

SEQ ID NO: 1136647 - RNA, 22 nt, Human
guucuccaggggcuguucaucu

SEQ ID NO: 1136648 - RNA, 22 nt, Human
aauaguguauuuuucaaaauua

SEQ ID NO: 1136649 - RNA, 22 nt, Human
agcccucucccuuucuucuuag

SEQ ID NO: 1136650 - RNA, 22 nt, Human
aguguucuagcgcugugcuugu

SEQ ID NO: 1136651 - RNA, 22 nt, Human
gccuggcgccgggcugccuguc

SEQ ID NO: 1136652 - RNA, 19 nt, Human
agcagccaucgaccaugga

SEQ ID NO: 1136653 - RNA, 22 nt, Human
ggugaccagggucaguagcuuu

SEQ ID NO: 1136654 - RNA, 22 nt, Human
cuccuucacgcaggcugccaug

SEQ ID NO: 1136655 - RNA, 22 nt, Human
agcuccugaaaauccagacugg

SEQ ID NO: 1136656 - RNA, 22 nt, Human
ccccuuucucccgcgucuggcc

SEQ ID NO: 1136657 - RNA, 22 nt, Human
augugauacuccuucuagugga

SEQ ID NO: 1136658 - RNA, 19 nt, Human
aguguuuauguagugccua

SEQ ID NO: 1136659 - RNA, 20 nt, Human
ucugugugccaucaccuaac

SEQ ID NO: 1136660 - RNA, 22 nt, Human
uuuccaaggaugugucucucua

SEQ ID NO: 1136661 - RNA, 22 nt, Human
aagccuuccugagugcaaggcc

SEQ ID NO: 1136662 - RNA, 22 nt, Human
aucgaguucugaugucccuucu

SEQ ID NO: 1136663 - RNA, 22 nt, Human
aagccuucaguccguugcagag

SEQ ID NO: 1136664 - RNA, 22 nt, Human
auauaaguguguggcuguuagu

SEQ ID NO: 1136665 - RNA, 22 nt, Human
gcagcuuuggagguggaacucu

SEQ ID NO: 1136666 - RNA, 22 nt, Human
auauguggcauuauuucugagg

SEQ ID NO: 1136667 - RNA, 22 nt, Human
ggucagugccuaucaugugggc

SEQ ID NO: 1136668 - RNA, 22 nt, Human
agcggcgccggagggaggugcg

SEQ ID NO: 1136669 - RNA, 22 nt, Human
ggcagcugaagaggaacuuugg

SEQ ID NO: 1136670 - RNA, 22 nt, Human
ucucauacguuuccagguguca

SEQ ID NO: 1136671 - RNA, 22 nt, Human
caguuuuaugaaugcuuauuag

SEQ ID NO: 1136672 - RNA, 22 nt, Human
uagcuguucucuguaaauugga

SEQ ID NO: 1136673 - RNA, 22 nt, Human
uuaugcaaaggggccucuuccu

SEQ ID NO: 1136674 - RNA, 22 nt, Human
uugcuuuauuccuagcccuugu

SEQ ID NO: 1136675 - RNA, 22 nt, Human
acaguguuacuugauaguguau

SEQ ID NO: 1136676 - RNA, 22 nt, Human
aagcagccagccaucaugcccg

SEQ ID NO: 1136677 - RNA, 22 nt, Human
gcuucucauguuuauuuuuaca

SEQ ID NO: 1136678 - RNA, 22 nt, Human
ucuccucuccuuucauguuguu

SEQ ID NO: 1136679 - RNA, 21 nt, Human
uggacauuuacccuucaggga

SEQ ID NO: 1136680 - RNA, 22 nt, Human
guucuucagauuccauuucagu

SEQ ID NO: 1136681 - RNA, 22 nt, Human
ucugagugggaacucucaugac

SEQ ID NO: 1136682 - RNA, 22 nt, Human
acugugugccaggcgcuggucu

SEQ ID NO: 1136683 - RNA, 22 nt, Human
ccugguuuaaugcucacuguug

SEQ ID NO: 1136684 - RNA, 22 nt, Human
agacugugagaagauggcugcg

SEQ ID NO: 1136685 - RNA, 22 nt, Human
ccaggcagccugcuccauucug

SEQ ID NO: 1136686 - RNA, 22 nt, Human
ugguuuguauauguuugugaga

SEQ ID NO: 1136687 - RNA, 22 nt, Human
ggcagucuuucccuugagcucu

SEQ ID NO: 1136688 - RNA, 22 nt, Human
uuuguugguugcacuggugggu

SEQ ID NO: 1136689 - RNA, 22 nt, Human
uauagugucucuagaucaaaga

SEQ ID NO: 1136690 - RNA, 22 nt, Human
uuuaggcucaaaagaguuggug

SEQ ID NO: 1136691 - RNA, 22 nt, Human
agcggcgccgagcuuggccagg

SEQ ID NO: 1136692 - RNA, 22 nt, Human
ugcucagaauugcgcuggugga

SEQ ID NO: 1136693 - RNA, 22 nt, Human
uccuucaaucacccagugggga

SEQ ID NO: 1136694 - RNA, 22 nt, Human
aaagcagcagcacguggaagag

SEQ ID NO: 1136695 - RNA, 22 nt, Human
ugugugaacucucugauguaca

SEQ ID NO: 1136696 - RNA, 22 nt, Human
gaguuucuucauggugcagagg

SEQ ID NO: 1136697 - RNA, 22 nt, Human
caguuuuacccaagcuuauuuu

SEQ ID NO: 1136698 - RNA, 20 nt, Human
ugugggccuucggcgugcuc

SEQ ID NO: 1136699 - RNA, 18 nt, Human
gaaggcauucaguggcuu

SEQ ID NO: 1136700 - RNA, 22 nt, Human
auaaugacauucuuagacugga

SEQ ID NO: 1136701 - RNA, 22 nt, Human
ccaggcccugcuccucacacca

SEQ ID NO: 1136702 - RNA, 22 nt, Human
ccagcccuuagauaaaccuggc

SEQ ID NO: 1136703 - RNA, 19 nt, Human
ccagucccauacaggagau

SEQ ID NO: 1136704 - RNA, 22 nt, Human
ucuggcagcagcaucaguggcu

SEQ ID NO: 1136705 - RNA, 22 nt, Human
cuccuggcaggcugagugaaau

SEQ ID NO: 1136706 - RNA, 22 nt, Human
uccaggaggaggaaggcugcca

SEQ ID NO: 1136707 - RNA, 22 nt, Human
gcuggcaguuuccucaccgagg

SEQ ID NO: 1136708 - RNA, 19 nt, Human
ccuuccuccccagggccau

SEQ ID NO: 1136709 - RNA, 22 nt, Human
agggagacacaugaggaaguca

SEQ ID NO: 1136710 - RNA, 22 nt, Human
uggcaucuccgacagucuugau

SEQ ID NO: 1136711 - RNA, 20 nt, Human
aaaagagugcuucaacugcu

SEQ ID NO: 1136712 - RNA, 22 nt, Human
gccuccggagucacagugucuu

SEQ ID NO: 1136713 - RNA, 22 nt, Human
ggcaaggggucaggcugagaca

SEQ ID NO: 1136714 - RNA, 22 nt, Human
uuccaggcuauccggugaaggg

SEQ ID NO: 1136715 - RNA, 22 nt, Human
gccccaccuugagagcagaaac

SEQ ID NO: 1136716 - RNA, 22 nt, Human
cuggccucauagccaagcugug

SEQ ID NO: 1136717 - RNA, 21 nt, Human
ucuggcaguggucuuucaaau

SEQ ID NO: 1136718 - RNA, 22 nt, Human
ccaggcccaggguacugaccaa

SEQ ID NO: 1136719 - RNA, 22 nt, Human
ucaggcccagagucacggaucc

SEQ ID NO: 1136720 - RNA, 22 nt, Human
aggaggcugcaacccugaggcc

SEQ ID NO: 1136721 - RNA, 20 nt, Human
acuggcagccugccugcugu

SEQ ID NO: 1136722 - RNA, 22 nt, Human
gccuggcaggggccugggagug

SEQ ID NO: 1136723 - RNA, 23 nt, Human
uuggagagggugaguagugucag

SEQ ID NO: 1136724 - RNA, 22 nt, Human
guccuggcccaggaguacacau

SEQ ID NO: 1136725 - RNA, 22 nt, Human
ugggagaaacugucucucccac

SEQ ID NO: 1136726 - RNA, 22 nt, Human
ccugccucccagagguccucua

SEQ ID NO: 1136727 - RNA, 22 nt, Human
aggccacaguacuuugcagacc

SEQ ID NO: 1136728 - RNA, 22 nt, Human
ucuggcagugagcaacuugaca

SEQ ID NO: 1136729 - RNA, 22 nt, Human
gguucccggaucuccgaguccc

SEQ ID NO: 1136730 - RNA, 22 nt, Human
ucuggcagaggaaggaggccug

SEQ ID NO: 1136731 - RNA, 22 nt, Human
ccuccuggcuuuucccauugaa

SEQ ID NO: 1136732 - RNA, 22 nt, Human
ccuggcaggccccuccuggauu

SEQ ID NO: 1136733 - RNA, 22 nt, Human
uuccaggcaugucagacauagg

SEQ ID NO: 1136734 - RNA, 22 nt, Human
gaccugccugagcugccucugc

SEQ ID NO: 1136735 - RNA, 22 nt, Human
uacaaaaggaagagggaucuua

SEQ ID NO: 1136736 - RNA, 22 nt, Human
ggugccagugggucucaggaua

SEQ ID NO: 1136737 - RNA, 22 nt, Human
acuggcagagguuggacaccau

SEQ ID NO: 1136738 - RNA, 23 nt, Human
uuccaggcagagcagggauuaga

SEQ ID NO: 1136739 - RNA, 22 nt, Human
uauuacagaaucaggcauaacu

SEQ ID NO: 1136740 - RNA, 22 nt, Human
cccaggccagaacuugguugcu

SEQ ID NO: 1136741 - RNA, 22 nt, Human
ccacccuaacaauccuuacugu

SEQ ID NO: 1136742 - RNA, 22 nt, Human
ucuggcaguggaugagggcagc

SEQ ID NO: 1136743 - RNA, 22 nt, Human
gcuccaggugucccagguaaaa

SEQ ID NO: 1136744 - RNA, 22 nt, Human
uccaggcuagguuuacaggaca

SEQ ID NO: 1136745 - RNA, 22 nt, Human
acuggcaguggcagcagaaaga

SEQ ID NO: 1136746 - RNA, 21 nt, Human
cccuugccugcacuccucggc

SEQ ID NO: 1136747 - RNA, 20 nt, Human
gcuggcagaugucuugagau

SEQ ID NO: 1136748 - RNA, 22 nt, Human
cuugggaaugcuaacagaugac

SEQ ID NO: 1136749 - RNA, 22 nt, Human
uuggagagauuuaggucucagu

SEQ ID NO: 1136750 - RNA, 22 nt, Human
ugccucucuaacccaugcccaa

SEQ ID NO: 1136751 - RNA, 22 nt, Human
ucuggcagcucaguucaggucu

SEQ ID NO: 1136752 - RNA, 22 nt, Human
cccugccucugaagcugcucag

SEQ ID NO: 1136753 - RNA, 22 nt, Human
gugugggaaggcuaggaugcug

SEQ ID NO: 1136754 - RNA, 22 nt, Human
acagguggggcacuuggagccu

SEQ ID NO: 1136755 - RNA, 22 nt, Human
guugggaaggugaacaugaugc

SEQ ID NO: 1136756 - RNA, 22 nt, Human
cucucuccuuagcugcagacca

SEQ ID NO: 1136757 - RNA, 22 nt, Human
acuggcagcuguaggaugcaug

SEQ ID NO: 1136758 - RNA, 22 nt, Human
gcccucucuucugcagccucca

SEQ ID NO: 1136759 - RNA, 22 nt, Human
ccuggcagacagcacugaagcu

SEQ ID NO: 1136760 - RNA, 22 nt, Human
uccugccuguuuaccuguacuu

SEQ ID NO: 1136761 - RNA, 22 nt, Human
ccuggcaguggugaagaagagg

SEQ ID NO: 1136762 - RNA, 18 nt, Human
uccuggcagucagagagg

SEQ ID NO: 1136763 - RNA, 22 nt, Human
aggcugcuucagcugcagggag

SEQ ID NO: 1136764 - RNA, 22 nt, Human
guugggaagcagauggaugagc

SEQ ID NO: 1136765 - RNA, 22 nt, Human
acuggcagguccaucgcccuuu

SEQ ID NO: 1136766 - RNA, 22 nt, Human
acuggcagggggagccccgaga

SEQ ID NO: 1136767 - RNA, 22 nt, Human
ucuggcaguugccgcuucaguc

SEQ ID NO: 1136768 - RNA, 19 nt, Human
acuggcagggcugcggugg

SEQ ID NO: 1136769 - RNA, 22 nt, Human
gaaaagaguccugugugaggag

SEQ ID NO: 1136770 - RNA, 22 nt, Human
gaggagcugggacccugucauc

SEQ ID NO: 1136771 - RNA, 22 nt, Human
caugagauaauuuuucuccagu

SEQ ID NO: 1136772 - RNA, 22 nt, Human
ggagcugaaggggugggcucag

SEQ ID NO: 1136773 - RNA, 22 nt, Human
cccgagugucuacucacuccca

SEQ ID NO: 1136774 - RNA, 22 nt, Human
ugcacaggugagacucaggaag

SEQ ID NO: 1136775 - RNA, 22 nt, Human
gcuggcaggagaccauacccua

SEQ ID NO: 1136776 - RNA, 22 nt, Human
ccuggcugguggcagcgacaag

SEQ ID NO: 1136777 - RNA, 22 nt, Human
cucaccccacuaccccuuggug

SEQ ID NO: 1136778 - RNA, 22 nt, Human
ucccagccacaguuuccaccug

SEQ ID NO: 1136779 - RNA, 22 nt, Human
ucccuccccacuucugagcuuu

SEQ ID NO: 1136780 - RNA, 17 nt, Human
uugggagagaaagguau

SEQ ID NO: 1136781 - RNA, 22 nt, Human
gcagccucaaacuccccagcuc

SEQ ID NO: 1136782 - RNA, 18 nt, Human
uccugccugugccccagg

SEQ ID NO: 1136783 - RNA, 22 nt, Human
aggggugugcauccuggaggau

SEQ ID NO: 1136784 - RNA, 22 nt, Human
aggaaagauggaaggaggauaa

SEQ ID NO: 1136785 - RNA, 22 nt, Human
gcuggcaggguucucacugaaa

SEQ ID NO: 1136786 - RNA, 22 nt, Human
ccuggcagcaggugggcccgug

SEQ ID NO: 1136787 - RNA, 22 nt, Human
gcuccaggaggaugaccuuccu

SEQ ID NO: 1136788 - RNA, 22 nt, Human
cuccugaggacuucuauugggu

SEQ ID NO: 1136789 - RNA, 22 nt, Human
gaagagaaaggcaaggaguuuu

SEQ ID NO: 1136790 - RNA, 22 nt, Human
cucugagcagaggccguggcua

SEQ ID NO: 1136791 - RNA, 22 nt, Human
cuggcacgcccacguaggcacu

SEQ ID NO: 1136792 - RNA, 22 nt, Human
acccacccuacuagcagugucc

SEQ ID NO: 1136793 - RNA, 22 nt, Human
aggaggcuuuugcaggugccac

SEQ ID NO: 1136794 - RNA, 19 nt, Human
uccuggcauuuguaggaaa

SEQ ID NO: 1136795 - RNA, 19 nt, Human
ugccuggcaccagcuccac

SEQ ID NO: 1136796 - RNA, 22 nt, Human
cugagcagugguucuugagcgc

SEQ ID NO: 1136797 - RNA, 22 nt, Human
ucaggagcucuucccuggugug

SEQ ID NO: 1136798 - RNA, 22 nt, Human
agacacagcugcaggagguggg

SEQ ID NO: 1136799 - RNA, 22 nt, Human
uuggaaaguuuuuacugaagac

SEQ ID NO: 1136800 - RNA, 22 nt, Human
ugagggacucccggcccugcca

SEQ ID NO: 1136801 - RNA, 21 nt, Human
aaagagcccgcugagagguuc

SEQ ID NO: 1136802 - RNA, 22 nt, Human
uccuggcacuuugggggcucgc

SEQ ID NO: 1136803 - RNA, 23 nt, Human
cauccaggagcugagucugacug

SEQ ID NO: 1136804 - RNA, 22 nt, Human
acaggugguagaguggaaagag

SEQ ID NO: 1136805 - RNA, 22 nt, Human
ccuggcagcuaagugcuuugag

SEQ ID NO: 1136806 - RNA, 22 nt, Human
cuuggcaggguggaggaugcag

SEQ ID NO: 1136807 - RNA, 22 nt, Human
agcacagggacaaugccaggug

SEQ ID NO: 1136808 - RNA, 22 nt, Human
ccuggcaguuuugcccaggauu

SEQ ID NO: 1136809 - RNA, 22 nt, Human
uccaggcaaaaaccaacuacag

SEQ ID NO: 1136810 - RNA, 22 nt, Human
gaggagcuguucccucaccucu

SEQ ID NO: 1136811 - RNA, 22 nt, Human
agccagggucucucgcucuguu

SEQ ID NO: 1136812 - RNA, 22 nt, Human
ccccacccaccuaagagaaacu

SEQ ID NO: 1136813 - RNA, 22 nt, Human
gccuggcaggccuguuggggcu

SEQ ID NO: 1136814 - RNA, 22 nt, Human
uucuuucaauagcuggcauaug

SEQ ID NO: 1136815 - RNA, 22 nt, Human
acuggcagagggaaaaccauuc

SEQ ID NO: 1136816 - RNA, 22 nt, Human
ugggacucacucuuuuggccag

SEQ ID NO: 1136817 - RNA, 22 nt, Human
ucuggcaggucaaucauucuuu

SEQ ID NO: 1136818 - RNA, 22 nt, Human
ucuggcaggguguguauuuaca

SEQ ID NO: 1136819 - RNA, 22 nt, Human
ucccaccccggucaagggcuga

SEQ ID NO: 1136820 - RNA, 22 nt, Human
ccuggcagcccagagcgccgcu

SEQ ID NO: 1136821 - RNA, 22 nt, Human
ucuggcagguucccauguuaug

SEQ ID NO: 1136822 - RNA, 22 nt, Human
uccugagccugacaaucaccau

SEQ ID NO: 1136823 - RNA, 20 nt, Human
ugccuggccuuucucugccc

SEQ ID NO: 1136824 - RNA, 18 nt, Human
acaggcugugggaauggu

SEQ ID NO: 1136825 - RNA, 22 nt, Human
agcacaggaacauggagauggg

SEQ ID NO: 1136826 - RNA, 17 nt, Human
gcccacccuuaggagcu

SEQ ID NO: 1136827 - RNA, 22 nt, Human
ucccugccugacagcacccacc

SEQ ID NO: 1136828 - RNA, 22 nt, Human
ccucucccgggugccgcugggc

SEQ ID NO: 1136829 - RNA, 22 nt, Human
gacucugggcugagccagggcc

SEQ ID NO: 1136830 - RNA, 22 nt, Human
uccuggcagggucuaggucuag

SEQ ID NO: 1136831 - RNA, 22 nt, Human
ccuccagcgcgauccacuccgg

SEQ ID NO: 1136832 - RNA, 22 nt, Human
uuccuggcagaggccccgacag

SEQ ID NO: 1136833 - RNA, 22 nt, Human
uggcagugucuuaucaggagug

SEQ ID NO: 1136834 - RNA, 22 nt, Human
uugggaaguuuaaugacagacu

SEQ ID NO: 1136835 - RNA, 22 nt, Human
guccacagagggcugggcaggc

SEQ ID NO: 1136836 - RNA, 22 nt, Human
uccugagcaacacagcuaagug

SEQ ID NO: 1136837 - RNA, 22 nt, Human
gcugcgccggaucccacguucc

SEQ ID NO: 1136838 - RNA, 22 nt, Human
gacaaaaguguuuugaacaagg

SEQ ID NO: 1136839 - RNA, 22 nt, Human
gaggacucugggcguguauggg

SEQ ID NO: 1136840 - RNA, 22 nt, Human
gcuggcagagacaagaagacua

SEQ ID NO: 1136841 - RNA, 22 nt, Human
gucuggaaggaggagauggagc

SEQ ID NO: 1136842 - RNA, 22 nt, Human
ccuggcagacugugagggcagg

SEQ ID NO: 1136843 - RNA, 22 nt, Human
ccagcccuugcugaaggguggc

SEQ ID NO: 1136844 - RNA, 22 nt, Human
gacuguggggggcggacacaag

SEQ ID NO: 1136845 - RNA, 22 nt, Human
uucauugcaguucuucagguua

SEQ ID NO: 1136846 - RNA, 21 nt, Human
ccuagccucuuacccagcuuu

SEQ ID NO: 1136847 - RNA, 22 nt, Human
aggcuggauuuauggggacuuc

SEQ ID NO: 1136848 - RNA, 22 nt, Human
gcuggcaguaaaggguuuggca

SEQ ID NO: 1136849 - RNA, 22 nt, Human
cuggcaggagcauucacagagg

SEQ ID NO: 1136850 - RNA, 22 nt, Human
uggcaguagauccagucucucu

SEQ ID NO: 1136851 - RNA, 22 nt, Human
aagagcacuaacagagcugaua

SEQ ID NO: 1136852 - RNA, 22 nt, Human
cuccuggcucgcccccagcuga

SEQ ID NO: 1136853 - RNA, 22 nt, Human
ggaggacaggggcugcagcaca

SEQ ID NO: 1136854 - RNA, 22 nt, Human
cagugggggggccaugcugcag

SEQ ID NO: 1136855 - RNA, 22 nt, Human
ggccucucagggcagagacccu

SEQ ID NO: 1136856 - RNA, 22 nt, Human
cuuacaaauacacuuaggagag

SEQ ID NO: 1136857 - RNA, 22 nt, Human
ccuggcaggacuguuguaagaa

SEQ ID NO: 1136858 - RNA, 22 nt, Human
ccuggcagguagcauugaggag

SEQ ID NO: 1136859 - RNA, 22 nt, Human
gaaagacuuccuuugagaguac

SEQ ID NO: 1136860 - RNA, 22 nt, Human
auccuggcccagguguggaggg

SEQ ID NO: 1136861 - RNA, 19 nt, Human
cagcccucuuaccacugug

SEQ ID NO: 1136862 - RNA, 22 nt, Human
gagggugucugcguaacuggca

SEQ ID NO: 1136863 - RNA, 22 nt, Human
uggcaguggauaggggagcggu

SEQ ID NO: 1136864 - RNA, 22 nt, Human
ccucccuucaguagagcccaau

SEQ ID NO: 1136865 - RNA, 19 nt, Human
uccuggcacaguggaacca

SEQ ID NO: 1136866 - RNA, 19 nt, Human
agaggccucagcagcuggc

SEQ ID NO: 1136867 - RNA, 21 nt, Human
aggcugcuggcucaggguccu

SEQ ID NO: 1136868 - RNA, 22 nt, Human
uggccucugggaaagcagauuc

SEQ ID NO: 1136869 - RNA, 22 nt, Human
uuccaggccgggcaggaaacac

SEQ ID NO: 1136870 - RNA, 22 nt, Human
gagaggcuggcagugccagguu

SEQ ID NO: 1136871 - RNA, 22 nt, Human
ccuggcagcgugccgagcugcg

SEQ ID NO: 1136872 - RNA, 20 nt, Human
ucuggcaggugaacgagcug

SEQ ID NO: 1136873 - RNA, 22 nt, Human
ucuugggauagugucucauggc

SEQ ID NO: 1136874 - RNA, 22 nt, Human
aaaagagucuuaggcagucaua

SEQ ID NO: 1136875 - RNA, 22 nt, Human
aaaagagugacugauaaguaua

SEQ ID NO: 1136876 - RNA, 22 nt, Human
uccuggcagaaauggggcugug

SEQ ID NO: 1136877 - RNA, 22 nt, Human
ggaggacacuggcucugccuuc

SEQ ID NO: 1136878 - RNA, 22 nt, Human
aggcaguggagcuggaauaggc

SEQ ID NO: 1136879 - RNA, 18 nt, Human
acucugcggaggccccag

SEQ ID NO: 1136880 - RNA, 22 nt, Human
gcuggcaguguauuguuagcug

SEQ ID NO: 1136881 - RNA, 22 nt, Human
ucaggcccuucucccaggacuc

SEQ ID NO: 1136882 - RNA, 22 nt, Human
cccugagcucaggcccuugggg

SEQ ID NO: 1136883 - RNA, 22 nt, Human
gcuggcagaauuucuucuugcu

SEQ ID NO: 1136884 - RNA, 22 nt, Human
acuggcagaacuggugauuguc

SEQ ID NO: 1136885 - RNA, 17 nt, Human
gccuucucugcccucac

SEQ ID NO: 1136886 - RNA, 22 nt, Human
uccucuccaugucucacgccac

SEQ ID NO: 1136887 - RNA, 22 nt, Human
uccacccugcuuuugucuuuga

SEQ ID NO: 1136888 - RNA, 22 nt, Human
cccagcccacgguccugggugg

SEQ ID NO: 1136889 - RNA, 22 nt, Human
uccaggcucuaggcugcucucc

SEQ ID NO: 1136890 - RNA, 22 nt, Human
guugggaaggcaagaaguagaa

SEQ ID NO: 1136891 - RNA, 22 nt, Human
cugcaggacgaccgccucaucu

SEQ ID NO: 1136892 - RNA, 22 nt, Human
uccaggccauugacugcauccu

SEQ ID NO: 1136893 - RNA, 22 nt, Human
agcacaggcuuuggugugaggg

SEQ ID NO: 1136894 - RNA, 22 nt, Human
guggcaguuuugacaucacaaa

SEQ ID NO: 1136895 - RNA, 22 nt, Human
cccuuccugggugucccggagu

SEQ ID NO: 1136896 - RNA, 22 nt, Human
cccagccugugacagccguccu

SEQ ID NO: 1136897 - RNA, 22 nt, Human
uccuggcaguaauuugauguug

SEQ ID NO: 1136898 - RNA, 22 nt, Human
uggcaggaaaguaacagagcac

SEQ ID NO: 1136899 - RNA, 22 nt, Human
cagguuggggacuuaggaugac

SEQ ID NO: 1136900 - RNA, 22 nt, Human
ugcacaggaggcuguggagaag

SEQ ID NO: 1136901 - RNA, 22 nt, Human
gcuggcagccaagugaagaggg

SEQ ID NO: 1136902 - RNA, 22 nt, Human
agaggccugugugcuccagugg

SEQ ID NO: 1136903 - RNA, 22 nt, Human
cuccaggccauggcugcggagg

SEQ ID NO: 1136904 - RNA, 21 nt, Human
agagucugagugugcaagggc

SEQ ID NO: 1136905 - RNA, 22 nt, Human
ggagcugaguucuucagccggg

SEQ ID NO: 1136906 - RNA, 22 nt, Human
aaaaagucugcaaaggagguug

SEQ ID NO: 1136907 - RNA, 20 nt, Human
agggcugagaagggacuagc

SEQ ID NO: 1136908 - RNA, 22 nt, Human
ucuggcagagugauaggauaag

SEQ ID NO: 1136909 - RNA, 22 nt, Human
uccuggcauccgugggucugug

SEQ ID NO: 1136910 - RNA, 22 nt, Human
uccugagcugccgcaucagcag

SEQ ID NO: 1136911 - RNA, 22 nt, Human
ccuggcaggcuggggacagugc

SEQ ID NO: 1136912 - RNA, 22 nt, Human
ccuggcagcuccuccccggcgg

SEQ ID NO: 1136913 - RNA, 22 nt, Human
uguggggaagaguaugacuugg

SEQ ID NO: 1136914 - RNA, 22 nt, Human
auccaggccccaagaccccgac

SEQ ID NO: 1136915 - RNA, 22 nt, Human
ggggcugagucagugggaagag

SEQ ID NO: 1136916 - RNA, 22 nt, Human
gccucaggccgcccugcugcuc

SEQ ID NO: 1136917 - RNA, 22 nt, Human
acuggcagcagcagcccuuggg

SEQ ID NO: 1136918 - RNA, 22 nt, Human
uuggaacaugccgggguccagg

SEQ ID NO: 1136919 - RNA, 19 nt, Human
guccucucaacaacccggg

SEQ ID NO: 1136920 - RNA, 19 nt, Human
acuggcagcuguagucugu

SEQ ID NO: 1136921 - RNA, 22 nt, Human
ucuggcagggucagggcccagg

SEQ ID NO: 1136922 - RNA, 22 nt, Human
gccuggcaauggccucaggaag

SEQ ID NO: 1136923 - RNA, 22 nt, Human
caggagggcccgagacucuucc

SEQ ID NO: 1136924 - RNA, 22 nt, Human
ggcagagguagcuggaaccagg

SEQ ID NO: 1136925 - RNA, 22 nt, Human
ggagcugaaccccaucgugcug

SEQ ID NO: 1136926 - RNA, 22 nt, Human
ucccuccuggccgucaccgcug

SEQ ID NO: 1136927 - RNA, 22 nt, Human
ucuggcaguuugagaaaggcua

SEQ ID NO: 1136928 - RNA, 22 nt, Human
ugccugacugcugccaccacua

SEQ ID NO: 1136929 - RNA, 22 nt, Human
uuccuggcauagagagggcaca

SEQ ID NO: 1136930 - RNA, 22 nt, Human
gaggagcuggcagcgucuccgc

SEQ ID NO: 1136931 - RNA, 22 nt, Human
uuccuggccuaagguaggugac

SEQ ID NO: 1136932 - RNA, 22 nt, Human
cccugagcgugaggaggaagua

SEQ ID NO: 1136933 - RNA, 18 nt, Human
ccuagccuccaagcucau

SEQ ID NO: 1136934 - RNA, 20 nt, Human
aagagucuuuacugagcuaa

SEQ ID NO: 1136935 - RNA, 18 nt, Human
ggcagggaaaagauaggg

SEQ ID NO: 1136936 - RNA, 22 nt, Human
ccugaccuauuuuucucagcug

SEQ ID NO: 1136937 - RNA, 22 nt, Human
cccuuccucccaggcuucugug

SEQ ID NO: 1136938 - RNA, 22 nt, Human
uccacccugcuuucuuaucucc

SEQ ID NO: 1136939 - RNA, 22 nt, Human
agacacagucugucuggaggag

SEQ ID NO: 1136940 - RNA, 21 nt, Human
agaugcugaugcugcaggucc

SEQ ID NO: 1136941 - RNA, 22 nt, Human
gaggagcugcagggggagucua

SEQ ID NO: 1136942 - RNA, 22 nt, Human
gccgggaccaaggccacggagc

SEQ ID NO: 1136943 - RNA, 22 nt, Human
gggccccuuguaucucuggcuc

SEQ ID NO: 1136944 - RNA, 22 nt, Human
cuccuggcaguuccccuuguca

SEQ ID NO: 1136945 - RNA, 22 nt, Human
gcuggcagggugguugagagag

SEQ ID NO: 1136946 - RNA, 22 nt, Human
uuccaggcuucucuggggcguc

SEQ ID NO: 1136947 - RNA, 22 nt, Human
uggccugccacugccacgccac

SEQ ID NO: 1136948 - RNA, 22 nt, Human
cuccaggccccuggccuucugc

SEQ ID NO: 1136949 - RNA, 22 nt, Human
ucccagccuuccagucugguuu

SEQ ID NO: 1136950 - RNA, 22 nt, Human
cccacccucaagggugucuaua

SEQ ID NO: 1136951 - RNA, 22 nt, Human
agggccccauagucacugcccg

SEQ ID NO: 1136952 - RNA, 22 nt, Human
gcuggcagggacagcugcgugu

SEQ ID NO: 1136953 - RNA, 22 nt, Human
ugguaagaacccaucagagaag

SEQ ID NO: 1136954 - RNA, 22 nt, Human
cccagccuacucugccauagca

SEQ ID NO: 1136955 - RNA, 22 nt, Human
cuggcaguuggcauuggcaucu

SEQ ID NO: 1136956 - RNA, 22 nt, Human
ucuggcaggcaaucggcucugg

SEQ ID NO: 1136957 - RNA, 22 nt, Human
gcuccaggagagggaagcagau

SEQ ID NO: 1136958 - RNA, 22 nt, Human
auggccuggggauuccugagca

SEQ ID NO: 1136959 - RNA, 22 nt, Human
uccccaccuaagauacccaucu

SEQ ID NO: 1136960 - RNA, 22 nt, Human
gaggagcucaugaaagcggugu

SEQ ID NO: 1136961 - RNA, 22 nt, Human
ucuggcagcuauccucuggcca

SEQ ID NO: 1136962 - RNA, 22 nt, Human
gcuggcagagcucugggcuggg

SEQ ID NO: 1136963 - RNA, 22 nt, Human
uccaggcucccucaggaugcac

SEQ ID NO: 1136964 - RNA, 22 nt, Human
acuggcagagacccugauggcc

SEQ ID NO: 1136965 - RNA, 22 nt, Human
cccagccucuguuugcuccucu

SEQ ID NO: 1136966 - RNA, 22 nt, Human
accugccuucucaaggacauga

SEQ ID NO: 1136967 - RNA, 22 nt, Human
ucuggcaggauaucgaagugaa

SEQ ID NO: 1136968 - RNA, 22 nt, Human
cuccuggcacucaguguggaag

SEQ ID NO: 1136969 - RNA, 22 nt, Human
ucuggcagaucuucccacguuu

SEQ ID NO: 1136970 - RNA, 22 nt, Human
guccuggcccacuggcaggcug

SEQ ID NO: 1136971 - RNA, 22 nt, Human
gggccccuugcugcucugcugg

SEQ ID NO: 1136972 - RNA, 22 nt, Human
ucaggcccuuugcugcugcccc

SEQ ID NO: 1136973 - RNA, 22 nt, Human
gcuggcagacugggggcagaac

SEQ ID NO: 1136974 - RNA, 22 nt, Human
ccucuccuugcacccgucccgc

SEQ ID NO: 1136975 - RNA, 17 nt, Human
ugccagccugucccagg

SEQ ID NO: 1136976 - RNA, 17 nt, Human
agccugccccaugcugc

SEQ ID NO: 1136977 - RNA, 22 nt, Human
ucuggcagugaagucaugaggu

SEQ ID NO: 1136978 - RNA, 22 nt, Human
uccuggcauugugcagggugug

SEQ ID NO: 1136979 - RNA, 22 nt, Human
gagauggccagugccaggacaa

SEQ ID NO: 1136980 - RNA, 22 nt, Human
accugccucagugcagcuggau

SEQ ID NO: 1136981 - RNA, 22 nt, Human
uuccaggcugaugggccacagg

SEQ ID NO: 1136982 - RNA, 22 nt, Human
ucuggcaggccuugucaaucug

SEQ ID NO: 1136983 - RNA, 22 nt, Human
ccuggcagcuccguggccuucc

SEQ ID NO: 1136984 - RNA, 22 nt, Human
gaugccuggcacccagcaagga

SEQ ID NO: 1136985 - RNA, 22 nt, Human
ucuggcagaaggcagaaauuca

SEQ ID NO: 1136986 - RNA, 22 nt, Human
cugccugccuuggccuccagga

SEQ ID NO: 1136987 - RNA, 22 nt, Human
ucccaccccuugacucuuuaag

SEQ ID NO: 1136988 - RNA, 23 nt, Human
uccuuccuuugagaggcuccauc

SEQ ID NO: 1136989 - RNA, 22 nt, Human
gcacucuccuggcugccacagu

SEQ ID NO: 1136990 - RNA, 22 nt, Human
uggcacucacucucagagucug

SEQ ID NO: 1136991 - RNA, 22 nt, Human
uugggaucucaaauccagcuau

SEQ ID NO: 1136992 - RNA, 22 nt, Human
ccuggcagaauauuaaagugca

SEQ ID NO: 1136993 - RNA, 22 nt, Human
aggguagggcccggagacagac

SEQ ID NO: 1136994 - RNA, 22 nt, Human
ccagcccugccagagagagcug

SEQ ID NO: 1136995 - RNA, 22 nt, Human
uccaggcuugagaccaggcucu

SEQ ID NO: 1136996 - RNA, 22 nt, Human
cugccugcugcccuccagagcc

SEQ ID NO: 1136997 - RNA, 22 nt, Human
aguguggcaggaaugacuagaa

SEQ ID NO: 1136998 - RNA, 22 nt, Human
ccuggcagguggcgcccucggc

SEQ ID NO: 1136999 - RNA, 22 nt, Human
gguggcauaagaacacuaaaga

SEQ ID NO: 1137000 - RNA, 22 nt, Human
guggcagucgcugacagauaca

SEQ ID NO: 1137001 - RNA, 22 nt, Human
ugccugccucuggcagcccugc

SEQ ID NO: 1137002 - RNA, 22 nt, Human
ccuggcagggcugcaguaaugg

SEQ ID NO: 1137003 - RNA, 22 nt, Human
uccugcagccacugcaggcaga

SEQ ID NO: 1137004 - RNA, 22 nt, Human
cuccaggcucguccaagaucga

SEQ ID NO: 1137005 - RNA, 22 nt, Human
aggcacaggaggugguaagaag

SEQ ID NO: 1137006 - RNA, 22 nt, Human
cagccaggauggagaacuguug

SEQ ID NO: 1137007 - RNA, 20 nt, Human
ucccucccuccagcucuggg

SEQ ID NO: 1137008 - RNA, 22 nt, Human
gagaaagaugaagaguggcguu

SEQ ID NO: 1137009 - RNA, 22 nt, Human
aggccccaaagcagugcaagua

SEQ ID NO: 1137010 - RNA, 22 nt, Human
ccuggcagcagcacaugccuuc

SEQ ID NO: 1137011 - RNA, 18 nt, Human
aggaaagaaaggcaggug

SEQ ID NO: 1137012 - RNA, 21 nt, Human
ucuggcaggaagacggauggg

SEQ ID NO: 1137013 - RNA, 17 nt, Human
uuaagguggaucagcac

SEQ ID NO: 1137014 - RNA, 22 nt, Human
uuccuggcucacagcagugggg

SEQ ID NO: 1137015 - RNA, 22 nt, Human
gccuggcacaggaauuaggagg

SEQ ID NO: 1137016 - RNA, 18 nt, Human
cuccuggcugauggugag

SEQ ID NO: 1137017 - RNA, 22 nt, Human
ccauucauacaauuuuguucua

SEQ ID NO: 1137018 - RNA, 22 nt, Human
ccuggcagcgccgaagcuggcc

SEQ ID NO: 1137019 - RNA, 22 nt, Human
gccuccuguuaugccaugugcc

SEQ ID NO: 1137020 - RNA, 22 nt, Human
ccucucagcgauuccucuugga

SEQ ID NO: 1137021 - RNA, 22 nt, Human
gaggcugcuuugaugacaggag

SEQ ID NO: 1137022 - RNA, 22 nt, Human
ccuggcagcauugguagagauu

SEQ ID NO: 1137023 - RNA, 22 nt, Human
cagguggguguaugaaugcaaa

SEQ ID NO: 1137024 - RNA, 22 nt, Human
aaagagucguguuccagguuug

SEQ ID NO: 1137025 - RNA, 22 nt, Human
cagguugguauucaucuccaca

SEQ ID NO: 1137026 - RNA, 22 nt, Human
agagggugcuggagagacauug

SEQ ID NO: 1137027 - RNA, 22 nt, Human
gaggagcugagccacguccugg

SEQ ID NO: 1137028 - RNA, 22 nt, Human
gcuugggaagggcccuguguac

SEQ ID NO: 1137029 - RNA, 22 nt, Human
ccagcccugucaccaacuggag

SEQ ID NO: 1137030 - RNA, 22 nt, Human
ggccucucugagagcagacguu

SEQ ID NO: 1137031 - RNA, 22 nt, Human
ucuggcagcgaagcguguacuu

SEQ ID NO: 1137032 - RNA, 22 nt, Human
aggcaggggagcuggaagggua

SEQ ID NO: 1137033 - RNA, 22 nt, Human
ccugccuucagcccugaagucu

SEQ ID NO: 1137034 - RNA, 20 nt, Human
cccagccccuaccuguugcc

SEQ ID NO: 1137035 - RNA, 22 nt, Human
ucuggcagaagugcugucagua

SEQ ID NO: 1137036 - RNA, 22 nt, Human
cuggcagucugguggaaggccu

SEQ ID NO: 1137037 - RNA, 22 nt, Human
acuggcagugucguuuacauga

SEQ ID NO: 1137038 - RNA, 22 nt, Human
cccagccuuccacccuggacua

SEQ ID NO: 1137039 - RNA, 22 nt, Human
cuguccagcuuggcuccugggg

SEQ ID NO: 1137040 - RNA, 22 nt, Human
ucccugcccucagugcacccgg

SEQ ID NO: 1137041 - RNA, 20 nt, Human
aaagagcccuuggagcaggc

SEQ ID NO: 1137042 - RNA, 22 nt, Human
gaggggcuggguagggcaaccc

SEQ ID NO: 1137043 - RNA, 22 nt, Human
ccuccccaugacccggugcugg

SEQ ID NO: 1137044 - RNA, 22 nt, Human
cccagcccaucucaaaggucua

SEQ ID NO: 1137045 - RNA, 22 nt, Human
cccaggccuggucugggccagu

SEQ ID NO: 1137046 - RNA, 22 nt, Human
caccagggccccaggcugugcc

SEQ ID NO: 1137047 - RNA, 22 nt, Human
ucuggcagcaagauaacaaugg

SEQ ID NO: 1137048 - RNA, 22 nt, Human
cucucugggcccaguuggcacc

SEQ ID NO: 1137049 - RNA, 17 nt, Human
uccaggcagcaacugag

SEQ ID NO: 1137050 - RNA, 22 nt, Human
auggccugcagugcugccacag

SEQ ID NO: 1137051 - RNA, 22 nt, Human
ucuggcagcucuccucggcgga

SEQ ID NO: 1137052 - RNA, 22 nt, Human
gauggccuuguuuucucccuuc

SEQ ID NO: 1137053 - RNA, 22 nt, Human
gguguugggcucacugguccuu

SEQ ID NO: 1137054 - RNA, 22 nt, Human
guccuggcaccucacuggcuac

SEQ ID NO: 1137055 - RNA, 22 nt, Human
agggacucccugggccgacacg

SEQ ID NO: 1137056 - RNA, 21 nt, Human
uccacccucucugcucccagu

SEQ ID NO: 1137057 - RNA, 22 nt, Human
aggaggcugaacuagggucugg

SEQ ID NO: 1137058 - RNA, 22 nt, Human
gcuggcaggauaacuucuaagc

SEQ ID NO: 1137059 - RNA, 22 nt, Human
cugccugcucuauccaggccug

SEQ ID NO: 1137060 - RNA, 22 nt, Human
uggucucugcaggccaggcuca

SEQ ID NO: 1137061 - RNA, 22 nt, Human
guccuggcugguucuguggggc

SEQ ID NO: 1137062 - RNA, 22 nt, Human
cccuuccuugugacuggugggg

SEQ ID NO: 1137063 - RNA, 22 nt, Human
gcuggcagaagagcugguucaa

SEQ ID NO: 1137064 - RNA, 22 nt, Human
acuggcagaggauagcacuaau

SEQ ID NO: 1137065 - RNA, 22 nt, Human
uccaggcuaauuuugcauuguu

SEQ ID NO: 1137066 - RNA, 22 nt, Human
cugccucuauaggaguccacca

SEQ ID NO: 1137067 - RNA, 22 nt, Human
agucuagggugggguccacagg

SEQ ID NO: 1137068 - RNA, 19 nt, Human
gcuggcagaauuuugaacc

SEQ ID NO: 1137069 - RNA, 22 nt, Human
cccuuccuugauuuuaacugga

SEQ ID NO: 1137070 - RNA, 23 nt, Human
uugggaaauaguuaagacaugag

SEQ ID NO: 1137071 - RNA, 22 nt, Human
cggcuggugucgggcacagcaa

SEQ ID NO: 1137072 - RNA, 23 nt, Human
ugagggacaugguggcuucugag

SEQ ID NO: 1137073 - RNA, 22 nt, Human
gcacaggaugauggguugaggg

SEQ ID NO: 1137074 - RNA, 22 nt, Human
cagaaagaccugggcucaagag

SEQ ID NO: 1137075 - RNA, 22 nt, Human
ucuggcagcaagucuguuucuc

SEQ ID NO: 1137076 - RNA, 22 nt, Human
gguggcagaggugcaucagccc

SEQ ID NO: 1137077 - RNA, 22 nt, Human
ccagugcccagcugcccaggca

SEQ ID NO: 1137078 - RNA, 22 nt, Human
cucuccagccuuuagcccacgc

SEQ ID NO: 1137079 - RNA, 22 nt, Human
ggcaagagggcagauggagugc

SEQ ID NO: 1137080 - RNA, 22 nt, Human
cuggcaguauuaagagaaguga

SEQ ID NO: 1137081 - RNA, 22 nt, Human
uccuggcaaagauguugguguu

SEQ ID NO: 1137082 - RNA, 22 nt, Human
gagaaagacguaggcugggagg

SEQ ID NO: 1137083 - RNA, 22 nt, Human
gauggccuggguccccuuccgg

SEQ ID NO: 1137084 - RNA, 22 nt, Human
cuuggcagagggcugggcucag

SEQ ID NO: 1137085 - RNA, 21 nt, Human
gggagggauggaaaugauguu

SEQ ID NO: 1137086 - RNA, 22 nt, Human
acuggcagaacgugaugcgggu

SEQ ID NO: 1137087 - RNA, 22 nt, Human
gccacagguacuaugggagaga

SEQ ID NO: 1137088 - RNA, 22 nt, Human
gagacacacauucuggagagaa

SEQ ID NO: 1137089 - RNA, 22 nt, Human
ccuucucucugaagaccccaaa

SEQ ID NO: 1137090 - RNA, 22 nt, Human
cccacccugggaagcuaggcag

SEQ ID NO: 1137091 - RNA, 22 nt, Human
aaagagucaaaggcaugucucu

SEQ ID NO: 1137092 - RNA, 22 nt, Human
ccaggcuguaagagugauguug

SEQ ID NO: 1137093 - RNA, 20 nt, Human
uggccucugagaugccacgg

SEQ ID NO: 1137094 - RNA, 22 nt, Human
ggccucagagaaggcugugcgg

SEQ ID NO: 1137095 - RNA, 22 nt, Human
aagugccaucauagcauggcug

SEQ ID NO: 1137096 - RNA, 22 nt, Human
aagucguggcaggcuugcacga

SEQ ID NO: 1137097 - RNA, 20 nt, Human
ccuggcaggcggguuacuua

SEQ ID NO: 1137098 - RNA, 22 nt, Human
ccucagcugcuucccuggagcc

SEQ ID NO: 1137099 - RNA, 22 nt, Human
gagccugaugaaacaggcagac

SEQ ID NO: 1137100 - RNA, 22 nt, Human
agguagggaagaaggcaugaaa

SEQ ID NO: 1137101 - RNA, 23 nt, Human
gcccacccucagcguccucacgg

SEQ ID NO: 1137102 - RNA, 22 nt, Human
aagaggucauaccagauaaggg

SEQ ID NO: 1137103 - RNA, 22 nt, Human
gcuggcagcauuagacccuggg

SEQ ID NO: 1137104 - RNA, 22 nt, Human
ccaggccucuggcugcuuaguc

SEQ ID NO: 1137105 - RNA, 18 nt, Human
ccuggcagccaugcgcgc

SEQ ID NO: 1137106 - RNA, 22 nt, Human
cccugccuugggguccacaccg

SEQ ID NO: 1137107 - RNA, 22 nt, Human
uccaggcuuuuucaugcugucu

SEQ ID NO: 1137108 - RNA, 22 nt, Human
cacaaaaguaggaggcaggcgg

SEQ ID NO: 1137109 - RNA, 20 nt, Human
gagucacagaagaagcugaa

SEQ ID NO: 1137110 - RNA, 22 nt, Human
ggcugaguugagaggauuacuu

SEQ ID NO: 1137111 - RNA, 23 nt, Human
ccuggcagcaaacgaggagguua

SEQ ID NO: 1137112 - RNA, 22 nt, Human
ccuggcagguggagguugcagu

SEQ ID NO: 1137113 - RNA, 22 nt, Human
acagguggccccgagggagugg

SEQ ID NO: 1137114 - RNA, 22 nt, Human
gcuggcagagagcuggugagga

SEQ ID NO: 1137115 - RNA, 22 nt, Human
uggcagugguaccggcucucag

SEQ ID NO: 1137116 - RNA, 19 nt, Human
ccuugccugucccugcagc

SEQ ID NO: 1137117 - RNA, 22 nt, Human
acuggcaguuugagaaugcauu

SEQ ID NO: 1137118 - RNA, 22 nt, Human
cuugccucccucagcucacagc

SEQ ID NO: 1137119 - RNA, 22 nt, Human
gcuggcaggagaaacggggugc

SEQ ID NO: 1137120 - RNA, 22 nt, Human
ccuggcagccucagccaauucu

SEQ ID NO: 1137121 - RNA, 22 nt, Human
ucuggcaguaauaggggagaga

SEQ ID NO: 1137122 - RNA, 22 nt, Human
ucuggcaggaccaugaagcgua

SEQ ID NO: 1137123 - RNA, 22 nt, Human
ucuggcagagucagugcacaca

SEQ ID NO: 1137124 - RNA, 22 nt, Human
caggacaaagcccuuugagaaa

SEQ ID NO: 1137125 - RNA, 22 nt, Human
auccaggcgaaugcagaaggcc

SEQ ID NO: 1137126 - RNA, 22 nt, Human
aggaggcugggcacaguggccu

SEQ ID NO: 1137127 - RNA, 22 nt, Human
cuccuggcuuucccagaccagg

SEQ ID NO: 1137128 - RNA, 22 nt, Human
uggaaagagguagaggaucugg

SEQ ID NO: 1137129 - RNA, 22 nt, Human
gccuggcaaggcccuguugacu

SEQ ID NO: 1137130 - RNA, 22 nt, Human
uccugugccaucucuagagacu

SEQ ID NO: 1137131 - RNA, 22 nt, Human
cuccuggcacugucuugaccca

SEQ ID NO: 1137132 - RNA, 22 nt, Human
ggugccaggcuguagucagggu

SEQ ID NO: 1137133 - RNA, 22 nt, Human
ucccacccccuccaaggaggaa

SEQ ID NO: 1137134 - RNA, 22 nt, Human
aaagaaucagaagucucaaaca

SEQ ID NO: 1137135 - RNA, 22 nt, Human
ccuggcagcuguuuggcuuggc

SEQ ID NO: 1137136 - RNA, 22 nt, Human
uccugagcuacaguaguaugau

SEQ ID NO: 1137137 - RNA, 20 nt, Human
cugcuccacccggcucucag

SEQ ID NO: 1137138 - RNA, 21 nt, Human
agugccaguagguauggagga

SEQ ID NO: 1137139 - RNA, 22 nt, Human
cugccugccacguucagcugua

SEQ ID NO: 1137140 - RNA, 22 nt, Human
gcagggacagggcagggccuuu

SEQ ID NO: 1137141 - RNA, 22 nt, Human
cugcaggagcaaagccucugcu

SEQ ID NO: 1137142 - RNA, 22 nt, Human
gguuccuucugaggucccugua

SEQ ID NO: 1137143 - RNA, 22 nt, Human
ccagccucacuggcaucaccua

SEQ ID NO: 1137144 - RNA, 22 nt, Human
uccaaggcuccggcccuggcgu

SEQ ID NO: 1137145 - RNA, 22 nt, Human
gagaaagauuguccuucagggg

SEQ ID NO: 1137146 - RNA, 22 nt, Human
acuggcagaauugaauaguugu

SEQ ID NO: 1137147 - RNA, 22 nt, Human
gucacaggccuggaugaggggc

SEQ ID NO: 1137148 - RNA, 22 nt, Human
cuggccucuguguucaccauag

SEQ ID NO: 1137149 - RNA, 22 nt, Human
gccuggcacucaaucaucugcu

SEQ ID NO: 1137150 - RNA, 22 nt, Human
aacaaaagccgaaguagguguc

SEQ ID NO: 1137151 - RNA, 22 nt, Human
cugccugcaggacaccucgcua

SEQ ID NO: 1137152 - RNA, 22 nt, Human
augacugcucugggcucccaug

SEQ ID NO: 1137153 - RNA, 23 nt, Human
uccaggagcaugcuggcuggcga

SEQ ID NO: 1137154 - RNA, 22 nt, Human
gaaagaagcuuuagauggcuau

SEQ ID NO: 1137155 - RNA, 22 nt, Human
cuggcaugaaauggcaucucau

SEQ ID NO: 1137156 - RNA, 22 nt, Human
ggagucugcucccagacaugau

SEQ ID NO: 1137157 - RNA, 22 nt, Human
ccuggcaggcaagaggaaggga

SEQ ID NO: 1137158 - RNA, 22 nt, Human
gcaguguuuguguucucacaug

SEQ ID NO: 1137159 - RNA, 22 nt, Human
agggaagaagcugguaguaggu

SEQ ID NO: 1137160 - RNA, 22 nt, Human
ucuggcagagauauccauccca

SEQ ID NO: 1137161 - RNA, 21 nt, Human
ucuggcagcaguuuguugagu

SEQ ID NO: 1137162 - RNA, 22 nt, Human
agggcugaagggaggugcucau

SEQ ID NO: 1137163 - RNA, 22 nt, Human
agagcacagaagaauaggugcu

SEQ ID NO: 1137164 - RNA, 22 nt, Human
acagguggaggcuuuaggaggu

SEQ ID NO: 1137165 - RNA, 22 nt, Human
ucuggcagugauuucugugauc

SEQ ID NO: 1137166 - RNA, 22 nt, Human
gagagaaaagggggaauugauu

SEQ ID NO: 1137167 - RNA, 18 nt, Human
gacaaaaguacagacaga

SEQ ID NO: 1137168 - RNA, 22 nt, Human
agacaagaaacugggagucucu

SEQ ID NO: 1137169 - RNA, 22 nt, Human
gcuggcagguccaagauagagc

SEQ ID NO: 1137170 - RNA, 22 nt, Human
agcagguugugauacacucaga

SEQ ID NO: 1137171 - RNA, 22 nt, Human
aaagaucaauagauaaagcuac

SEQ ID NO: 1137172 - RNA, 22 nt, Human
aggccuccagccacaugccagu

SEQ ID NO: 1137173 - RNA, 22 nt, Human
cugagccagggccacacaugga

SEQ ID NO: 1137174 - RNA, 23 nt, Human
aguguugguugggaagccaagca

SEQ ID NO: 1137175 - RNA, 22 nt, Human
ccaggcugggcggggaaccugg

SEQ ID NO: 1137176 - RNA, 22 nt, Human
uggcagggugccaguugcgagu

SEQ ID NO: 1137177 - RNA, 22 nt, Human
acuggcaguagagggagcgcau

SEQ ID NO: 1137178 - RNA, 22 nt, Human
ucuccugggaggacaaggaagg

SEQ ID NO: 1137179 - RNA, 22 nt, Human
gcuccaggcagcauaguggaug

SEQ ID NO: 1137180 - RNA, 22 nt, Human
ggugccagaguggcccaggggc

SEQ ID NO: 1137181 - RNA, 22 nt, Human
uuccuggcgccacggagccggu

SEQ ID NO: 1137182 - RNA, 22 nt, Human
ucuuuuucugcacacguguccc

SEQ ID NO: 1137183 - RNA, 22 nt, Human
ggagacucggguucuagccuug

SEQ ID NO: 1137184 - RNA, 22 nt, Human
acaggugguaaaauggacuguc

SEQ ID NO: 1137185 - RNA, 22 nt, Human
cugccugcuuaccaugcaucag

SEQ ID NO: 1137186 - RNA, 22 nt, Human
ucccagccaggcucuaccacuu

SEQ ID NO: 1137187 - RNA, 22 nt, Human
agaggcuucucggauggggcag

SEQ ID NO: 1137188 - RNA, 22 nt, Human
uuccugccccugagagcuccca

SEQ ID NO: 1137189 - RNA, 22 nt, Human
gcuggcaggagccuuucccuuu

SEQ ID NO: 1137190 - RNA, 22 nt, Human
aggacaagcuaaaggacuuccu

SEQ ID NO: 1137191 - RNA, 22 nt, Human
uggccuccccuaacagccucuu

SEQ ID NO: 1137192 - RNA, 22 nt, Human
gaggagcucugcuccauccuuc

SEQ ID NO: 1137193 - RNA, 22 nt, Human
uggcaguggcucagagugcaga

SEQ ID NO: 1137194 - RNA, 20 nt, Human
agaggcuuccuugggaggag

SEQ ID NO: 1137195 - RNA, 22 nt, Human
gccuggcauauaguaguugugc

SEQ ID NO: 1137196 - RNA, 22 nt, Human
caggucccugcgccccggccuc

SEQ ID NO: 1137197 - RNA, 22 nt, Human
agcacaggaccaaggaagcugu

SEQ ID NO: 1137198 - RNA, 22 nt, Human
uccaggcuccccugcgugcucc

SEQ ID NO: 1137199 - RNA, 22 nt, Human
uuccuggccaagcagaguggaa

SEQ ID NO: 1137200 - RNA, 22 nt, Human
acuggcagccacaacuggcagg

SEQ ID NO: 1137201 - RNA, 22 nt, Human
aggaagaaccuaagaaagucuc

SEQ ID NO: 1137202 - RNA, 22 nt, Human
ucccugccuccuggcagugcca

SEQ ID NO: 1137203 - RNA, 22 nt, Human
ugccugccaugcagaaagcuga

SEQ ID NO: 1137204 - RNA, 22 nt, Human
auggccugaugcaccuguccca

SEQ ID NO: 1137205 - RNA, 22 nt, Human
ucuggcaguuccuuguugauau

SEQ ID NO: 1137206 - RNA, 22 nt, Human
agaaagaggaugcagaucucau

SEQ ID NO: 1137207 - RNA, 22 nt, Human
cagggacaauggcagagccuga

SEQ ID NO: 1137208 - RNA, 22 nt, Human
gcuggcagcuggaaguugggcu

SEQ ID NO: 1137209 - RNA, 22 nt, Human
uuccuggccccaccccuggaga

SEQ ID NO: 1137210 - RNA, 22 nt, Human
gccuccggaguugcagugucuu

SEQ ID NO: 1137211 - RNA, 22 nt, Human
gcuggcaggauagaagucuaau

SEQ ID NO: 1137212 - RNA, 22 nt, Human
cuccugaggaaaagcuugguca

SEQ ID NO: 1137213 - RNA, 22 nt, Human
gucacaggcaguaacuaggacc

SEQ ID NO: 1137214 - RNA, 22 nt, Human
uggccucugugggagcugagca

SEQ ID NO: 1137215 - RNA, 22 nt, Human
aggagcugcagauucugccuug

SEQ ID NO: 1137216 - RNA, 22 nt, Human
acuccugggugcugaccagcgu

SEQ ID NO: 1137217 - RNA, 22 nt, Human
gccuccuggaagucacauguuu

SEQ ID NO: 1137218 - RNA, 22 nt, Human
ccuggcaguucaucaaauggca

SEQ ID NO: 1137219 - RNA, 22 nt, Human
uccuggcagagggcggccucga

SEQ ID NO: 1137220 - RNA, 22 nt, Human
ccacaaaacugugugucaaaga

SEQ ID NO: 1137221 - RNA, 22 nt, Human
acagaguccuagcugcaaagaa

SEQ ID NO: 1137222 - RNA, 20 nt, Human
gcuccaggucagagaggacg

SEQ ID NO: 1137223 - RNA, 22 nt, Human
ccucugccaccucccacgaggc

SEQ ID NO: 1137224 - RNA, 22 nt, Human
ccagguccuguuuucaccacag

SEQ ID NO: 1137225 - RNA, 22 nt, Human
ugaccaggauacugcagggaug

SEQ ID NO: 1137226 - RNA, 22 nt, Human
gagaaagauguaggcugggagg

SEQ ID NO: 1137227 - RNA, 22 nt, Human
ggcacagggggcugaggacuag

SEQ ID NO: 1137228 - RNA, 22 nt, Human
caggcuggagugcaauggcaca

SEQ ID NO: 1137229 - RNA, 22 nt, Human
cccuggcagagggggcaggugc

SEQ ID NO: 1137230 - RNA, 22 nt, Human
cuuggcaguuucggaaggauga

SEQ ID NO: 1137231 - RNA, 22 nt, Human
ggagcugaggcugaggccucac

SEQ ID NO: 1137232 - RNA, 20 nt, Human
acaaagacuggaaaagcaag

SEQ ID NO: 1137233 - RNA, 22 nt, Human
uucaguuccauuucaggugggu

SEQ ID NO: 1137234 - RNA, 22 nt, Human
ucaggauggagggaagcacaga

SEQ ID NO: 1137235 - RNA, 22 nt, Human
aaagagucuggcacuguaccag

SEQ ID NO: 1137236 - RNA, 22 nt, Human
uugggaagaaacauguccauca

SEQ ID NO: 1137237 - RNA, 22 nt, Human
guuaggaacacuggagccuaaa

SEQ ID NO: 1137238 - RNA, 22 nt, Human
uggcagugggaauggacaaaca

SEQ ID NO: 1137239 - RNA, 22 nt, Human
aaagaucacgucccaggacucg

SEQ ID NO: 1137240 - RNA, 22 nt, Human
ggagagaauuccauggacaugu

SEQ ID NO: 1137241 - RNA, 22 nt, Human
gaggcugcggggaggagccugc

SEQ ID NO: 1137242 - RNA, 19 nt, Human
uggcagguagugagcaguc

SEQ ID NO: 1137243 - RNA, 22 nt, Human
ggccucucaugcccagagccaa

SEQ ID NO: 1137244 - RNA, 22 nt, Human
agggcugacagugaggagucaa

SEQ ID NO: 1137245 - RNA, 22 nt, Human
ugccagccagggaagcucaccc

SEQ ID NO: 1137246 - RNA, 17 nt, Human
cccaggccgccgggagc

SEQ ID NO: 1137247 - RNA, 22 nt, Human
cccagccuuugcuuccugguuc

SEQ ID NO: 1137248 - RNA, 22 nt, Human
uacaaaaguaauuacgguuuuu

SEQ ID NO: 1137249 - RNA, 23 nt, Human
acuccccagucucuucuugccaa

SEQ ID NO: 1137250 - RNA, 22 nt, Human
agaggccuccgaaaggugggcu

SEQ ID NO: 1137251 - RNA, 19 nt, Human
ucuggcagguaauuaggga

SEQ ID NO: 1137252 - RNA, 19 nt, Human
acuggcaguuucugcaugg

SEQ ID NO: 1137253 - RNA, 22 nt, Human
agucacaguuucccugagagag

SEQ ID NO: 1137254 - RNA, 22 nt, Human
uccugagcccuguaggacccug

SEQ ID NO: 1137255 - RNA, 22 nt, Human
ccccacccucgcuccauuucgg

SEQ ID NO: 1137256 - RNA, 22 nt, Human
ucuggcaggacaugcugaccau

SEQ ID NO: 1137257 - RNA, 22 nt, Human
caggaguggugugagggacucc

SEQ ID NO: 1137258 - RNA, 18 nt, Human
gccugcucugcucucccc

SEQ ID NO: 1137259 - RNA, 22 nt, Human
ggagaagaggagcuggaagccu

SEQ ID NO: 1137260 - RNA, 22 nt, Human
cugccugcucaccagggcucug

SEQ ID NO: 1137261 - RNA, 22 nt, Human
ggagccugaaaagucugcauuu

SEQ ID NO: 1137262 - RNA, 22 nt, Human
ugcuccagugccugccccacag

SEQ ID NO: 1137263 - RNA, 22 nt, Human
aguguugggucuuuagaauuua

SEQ ID NO: 1137264 - RNA, 22 nt, Human
accugccuaucagcugccugcu

SEQ ID NO: 1137265 - RNA, 21 nt, Human
ccuggcagaagccugauaugc

SEQ ID NO: 1137266 - RNA, 22 nt, Human
acagguggcuuauuggcugauu

SEQ ID NO: 1137267 - RNA, 22 nt, Human
gaggcacagucccgaggcaagg

SEQ ID NO: 1137268 - RNA, 22 nt, Human
ugcuggcacguggaccaggaga

SEQ ID NO: 1137269 - RNA, 22 nt, Human
acaagagcauugcagguguguu

SEQ ID NO: 1137270 - RNA, 22 nt, Human
uccuggcagcccgcaggugcug

SEQ ID NO: 1137271 - RNA, 22 nt, Human
cucuccagaauaugccgccgug

SEQ ID NO: 1137272 - RNA, 22 nt, Human
accugccuauggagccacaugg

SEQ ID NO: 1137273 - RNA, 21 nt, Human
ucacguggucacaugagcuuu

SEQ ID NO: 1137274 - RNA, 22 nt, Human
aggaagaacagauaauggacgc

SEQ ID NO: 1137275 - RNA, 22 nt, Human
uggaaagaggaagugcccagca

SEQ ID NO: 1137276 - RNA, 22 nt, Human
uuccaggcucccuuggaggugu

SEQ ID NO: 1137277 - RNA, 22 nt, Human
aguugggaguuauagacucuau

SEQ ID NO: 1137278 - RNA, 22 nt, Human
gaggcuguuaggagggacucug

SEQ ID NO: 1137279 - RNA, 22 nt, Human
gacugccucaguuucccugcag

SEQ ID NO: 1137280 - RNA, 19 nt, Human
gcuggcagauguggccgug

SEQ ID NO: 1137281 - RNA, 22 nt, Human
gugggagaaauuagcucuaguu

SEQ ID NO: 1137282 - RNA, 22 nt, Human
gaggcacauauauacagagccc

SEQ ID NO: 1137283 - RNA, 19 nt, Human
guccuggcgccgccacacc

SEQ ID NO: 1137284 - RNA, 22 nt, Human
acuggcaggcugcuggccggcg

SEQ ID NO: 1137285 - RNA, 22 nt, Human
gucaggacucugacccgucccg

SEQ ID NO: 1137286 - RNA, 19 nt, Human
gggagcugaggucuuuggu

SEQ ID NO: 1137287 - RNA, 22 nt, Human
uccuucccaggugucgccgccu

SEQ ID NO: 1137288 - RNA, 22 nt, Human
uccugagcacagagacaaggaa

SEQ ID NO: 1137289 - RNA, 22 nt, Human
uccaggcaagggaggagcaugg

SEQ ID NO: 1137290 - RNA, 22 nt, Human
aggcaguguguagcuggaagag

SEQ ID NO: 1137291 - RNA, 22 nt, Human
agugccccaugggugccugggg

SEQ ID NO: 1137292 - RNA, 22 nt, Human
ccuggcagucaggggaguccuu

SEQ ID NO: 1137293 - RNA, 22 nt, Human
caggauggucucgaucuccuga

SEQ ID NO: 1137294 - RNA, 22 nt, Human
gcuggcagucccaucagcuggg

SEQ ID NO: 1137295 - RNA, 22 nt, Human
ccugccuguacuagagacccag

SEQ ID NO: 1137296 - RNA, 22 nt, Human
aagagccagcuagugaagaggc

SEQ ID NO: 1137297 - RNA, 22 nt, Human
uguuggaauuaggauacagagg

SEQ ID NO: 1137298 - RNA, 22 nt, Human
guggcagugggaugcuaucagg

SEQ ID NO: 1137299 - RNA, 22 nt, Human
cuggcaguuugccaggagcucg

SEQ ID NO: 1137300 - RNA, 22 nt, Human
uccuggcacccuuggguuggag

SEQ ID NO: 1137301 - RNA, 22 nt, Human
agaggcuuggaggugcaagguu

SEQ ID NO: 1137302 - RNA, 22 nt, Human
gcuggcagguaaagccccgggg

SEQ ID NO: 1137303 - RNA, 22 nt, Human
ucccacccauccugcaucucuu

SEQ ID NO: 1137304 - RNA, 17 nt, Human
ugcuggcaacauacaaa

SEQ ID NO: 1137305 - RNA, 22 nt, Human
gccagguugcugacgacgaucu

SEQ ID NO: 1137306 - RNA, 22 nt, Human
guggcagugaaggucauagcau

SEQ ID NO: 1137307 - RNA, 21 nt, Human
ucuggcaggcacgggcccagc

SEQ ID NO: 1137308 - RNA, 22 nt, Human
ccuggcagaaagaguuacaccu

SEQ ID NO: 1137309 - RNA, 22 nt, Human
aaagaucaaguaggcauggccu

SEQ ID NO: 1137310 - RNA, 22 nt, Human
ucccagccuuucuuuucugcug

SEQ ID NO: 1137311 - RNA, 22 nt, Human
ugacaggaggcuugaggccagg

SEQ ID NO: 1137312 - RNA, 22 nt, Human
cuggcagguuuggugucuggug

SEQ ID NO: 1137313 - RNA, 22 nt, Human
gccuggcacaguagggacccaa

SEQ ID NO: 1137314 - RNA, 22 nt, Human
agggcugacaaauggcagugac

SEQ ID NO: 1137315 - RNA, 21 nt, Human
uccugccuuaguccagagcag

SEQ ID NO: 1137316 - RNA, 22 nt, Human
gcuggcagugugaaugacaagc

SEQ ID NO: 1137317 - RNA, 22 nt, Human
uugggaagaauggaggugguua

SEQ ID NO: 1137318 - RNA, 18 nt, Human
cuccuccacagccccugc

SEQ ID NO: 1137319 - RNA, 22 nt, Human
cagguuggucggcaaguacaca

SEQ ID NO: 1137320 - RNA, 22 nt, Human
ccuggcagguuacaaccaguua

SEQ ID NO: 1137321 - RNA, 22 nt, Human
aggaggcuguggagcacuccau

SEQ ID NO: 1137322 - RNA, 22 nt, Human
uccuggcagugcuuguuuugga

SEQ ID NO: 1137323 - RNA, 22 nt, Human
ucuggcagggguucugcacuug

SEQ ID NO: 1137324 - RNA, 22 nt, Human
gguguuguacauucuguggauu

SEQ ID NO: 1137325 - RNA, 22 nt, Human
ugaguguuguaaccauaugauu

SEQ ID NO: 1137326 - RNA, 22 nt, Human
aguuauguccucagcaaaucaa

SEQ ID NO: 1137327 - RNA, 21 nt, Human
guucaauagcucuuugaaugc

SEQ ID NO: 1137328 - RNA, 22 nt, Human
agaauaaccaguguuucacagu

SEQ ID NO: 1137329 - RNA, 22 nt, Human
cauuuagaagucuuagaacuau

SEQ ID NO: 1137330 - RNA, 22 nt, Human
ccuguauggcuauuccuuggac

SEQ ID NO: 1137331 - RNA, 20 nt, Human
uugagcuuuuaguacagaca

SEQ ID NO: 1137332 - RNA, 22 nt, Human
caagggcagaggcagggccccg

SEQ ID NO: 1137333 - RNA, 22 nt, Human
acaagucaguggaauuaauauu

SEQ ID NO: 1137334 - RNA, 22 nt, Human
ucauccugaagaaccugcuucc

SEQ ID NO: 1137335 - RNA, 22 nt, Human
guucuuaaagauucaucaagca

SEQ ID NO: 1137336 - RNA, 22 nt, Human
aucaacuuguccuugauguuaa

SEQ ID NO: 1137337 - RNA, 22 nt, Human
gacauuuauuggauuuuacgag

SEQ ID NO: 1137338 - RNA, 22 nt, Human
ugugaagcgugugcaggggaca

SEQ ID NO: 1137339 - RNA, 22 nt, Human
auugacuuucccuucuccucau

SEQ ID NO: 1137340 - RNA, 22 nt, Human
caguauguuuauuagaacugca

SEQ ID NO: 1137341 - RNA, 22 nt, Human
ccugguuuaaugcucacuguug

SEQ ID NO: 1137342 - RNA, 22 nt, Human
aggcaguguggagggcuguugc

SEQ ID NO: 1137343 - RNA, 22 nt, Human
auacuucuuuagcauauugaac

SEQ ID NO: 1137344 - RNA, 22 nt, Human
uuagacaucaagaagccaaugu

SEQ ID NO: 1137345 - RNA, 22 nt, Human
ccagcuugcuccucugcaaugg

SEQ ID NO: 1137346 - RNA, 18 nt, Human
agggcugaugaguuuggg

SEQ ID NO: 1137347 - RNA, 22 nt, Human
aaagacuaaccaguugucaaaa

SEQ ID NO: 1137348 - RNA, 22 nt, Human
uggaucugcucuaugaacugcu

SEQ ID NO: 1137349 - RNA, 22 nt, Human
uacauuuauaaggcuucucugu

SEQ ID NO: 1137350 - RNA, 22 nt, Human
aucauuaacccuugaugcuggg

SEQ ID NO: 1137351 - RNA, 22 nt, Human
cagguugaaaguggaggagcua

SEQ ID NO: 1137352 - RNA, 22 nt, Human
aguguuaaggcugguugcuaua

SEQ ID NO: 1137353 - RNA, 21 nt, Human
ucaauuauggaugugugcaaa

SEQ ID NO: 1137354 - RNA, 22 nt, Human
acugguuuuggaaaucaguaca

SEQ ID NO: 1137355 - RNA, 22 nt, Human
aacuuagagcucuccuaaauga

SEQ ID NO: 1137356 - RNA, 22 nt, Human
augcuugaaaguuauuucauuu

SEQ ID NO: 1137357 - RNA, 22 nt, Human
guaugucaugagccuugugcgu

SEQ ID NO: 1137358 - RNA, 22 nt, Human
ggcagaggaagcuggaaguggg

SEQ ID NO: 1137359 - RNA, 22 nt, Human
caucaggaauaaaugaggcugu

SEQ ID NO: 1137360 - RNA, 22 nt, Human
ucucugucucccguguguccgg

SEQ ID NO: 1137361 - RNA, 22 nt, Human
cugaagcugggcacuuccuuuu

SEQ ID NO: 1137362 - RNA, 20 nt, Human
uucaugcagugguugcugug

SEQ ID NO: 1137363 - RNA, 22 nt, Human
ccacugauucugccaggucucu

SEQ ID NO: 1137364 - RNA, 22 nt, Human
gcauuuaaauuugaacuucaga

SEQ ID NO: 1137365 - RNA, 22 nt, Human
uuugaaaggagcuuuauccaga

SEQ ID NO: 1137366 - RNA, 22 nt, Human
agcugcugcaaguggugcuaac

SEQ ID NO: 1137367 - RNA, 21 nt, Human
cuuuggcaagggagaagucac

SEQ ID NO: 1137368 - RNA, 22 nt, Human
cucagcuucuaccuccugagug

SEQ ID NO: 1137369 - RNA, 22 nt, Human
uuucaaguagagggaucgcuag

SEQ ID NO: 1137370 - RNA, 22 nt, Human
auauaugaagaagucuugauua

SEQ ID NO: 1137371 - RNA, 22 nt, Human
gauucugaaauuaacagacugg

SEQ ID NO: 1137372 - RNA, 22 nt, Human
aguaucagaugugauuaaaggg

SEQ ID NO: 1137373 - RNA, 22 nt, Human
cuggccagggugcgaucguggu

SEQ ID NO: 1137374 - RNA, 22 nt, Human
guggggacgggauggcucacug

SEQ ID NO: 1137375 - RNA, 22 nt, Human
ggcagaggagcuggaaacaugg

SEQ ID NO: 1137376 - RNA, 22 nt, Human
uguggccaccagagcugcuauu

SEQ ID NO: 1137377 - RNA, 22 nt, Human
ucaagaaagggcuucaccagga

SEQ ID NO: 1137378 - RNA, 21 nt, Human
ucagagggcccuggaggcuca

SEQ ID NO: 1137379 - RNA, 22 nt, Human
uaucuguagucucaugguuccu

SEQ ID NO: 1137380 - RNA, 22 nt, Human
cuugucugcuauaaaaauccag

SEQ ID NO: 1137381 - RNA, 23 nt, Human
ugucuggauucgacugugguugg

SEQ ID NO: 1137382 - RNA, 22 nt, Human
ugcugcgggacccacugugggc

SEQ ID NO: 1137383 - RNA, 22 nt, Human
uuugccaguauuuuauugauga

SEQ ID NO: 1137384 - RNA, 22 nt, Human
uguuaguauuggcaaauuuguu

SEQ ID NO: 1137385 - RNA, 22 nt, Human
uauaagaaacaaggcaaauuuu

SEQ ID NO: 1137386 - RNA, 22 nt, Human
caaucaaugcugcuaguuccuu

SEQ ID NO: 1137387 - RNA, 22 nt, Human
aguguauuugccuauaaaaaug

SEQ ID NO: 1137388 - RNA, 22 nt, Human
uugcaguugcuguauuuaagga

SEQ ID NO: 1137389 - RNA, 21 nt, Human
ucaggaagagccaguucaugc

SEQ ID NO: 1137390 - RNA, 22 nt, Human
ggcugcugcccaccccugcaug

SEQ ID NO: 1137391 - RNA, 22 nt, Human
guguaucaaagcacagacuuca

SEQ ID NO: 1137392 - RNA, 22 nt, Human
aauguuaaguuuagauuauaac

SEQ ID NO: 1137393 - RNA, 22 nt, Human
acaaguuucauuguuuagaacc

SEQ ID NO: 1137394 - RNA, 22 nt, Human
cacuuuuaacaggagaauuccc

SEQ ID NO: 1137395 - RNA, 22 nt, Human
uuugaaauguaucaguauaggu

SEQ ID NO: 1137396 - RNA, 22 nt, Human
uccuuagagugguugugcuaug

SEQ ID NO: 1137397 - RNA, 22 nt, Human
aucaucaucuaaauugugucgc

SEQ ID NO: 1137398 - RNA, 22 nt, Human
ugucaaguuguuaaguucuggg

SEQ ID NO: 1137399 - RNA, 22 nt, Human
uccugagauaggaguugaaggc

SEQ ID NO: 1137400 - RNA, 22 nt, Human
agauuauuuaagacaggaacca

SEQ ID NO: 1137401 - RNA, 22 nt, Human
cuauuuucccauaugguugaca

SEQ ID NO: 1137402 - RNA, 22 nt, Human
ugcagcuucucugcaacaggag

SEQ ID NO: 1137403 - RNA, 22 nt, Human
uccucuucaaaauagcucugaa

SEQ ID NO: 1137404 - RNA, 22 nt, Human
gcugucccgaaccccugguaau

SEQ ID NO: 1137405 - RNA, 22 nt, Human
aagaauaagaggauuuagaaca

SEQ ID NO: 1137406 - RNA, 22 nt, Human
uggauaaaaugacauuaccuga

SEQ ID NO: 1137407 - RNA, 22 nt, Human
caguuaaacagauugaguguua

SEQ ID NO: 1137408 - RNA, 22 nt, Human
uuaggaaguguguccagaagcg

SEQ ID NO: 1137409 - RNA, 22 nt, Human
gggaccugggccagaggacagu

SEQ ID NO: 1137410 - RNA, 22 nt, Human
auuauuaggugcucucugacaa

SEQ ID NO: 1137411 - RNA, 22 nt, Human
acaggacauguaccaggugguc

SEQ ID NO: 1137412 - RNA, 22 nt, Human
aaugauuuggcaaaggaaucca

SEQ ID NO: 1137413 - RNA, 22 nt, Human
cuggggaccagugucuguuugu

SEQ ID NO: 1137414 - RNA, 22 nt, Human
uauggaaacuaauucauuuuuc

SEQ ID NO: 1137415 - RNA, 22 nt, Human
uuucauaauacuguacaugaaa

SEQ ID NO: 1137416 - RNA, 20 nt, Human
agggucugaugugguggccc

SEQ ID NO: 1137417 - RNA, 22 nt, Human
cccugagcucaggcccuugggg

SEQ ID NO: 1137418 - RNA, 20 nt, Human
guauuaggagguaaauguaa

SEQ ID NO: 1137419 - RNA, 22 nt, Human
acuucacagauauuuauuuggu

SEQ ID NO: 1137420 - RNA, 22 nt, Human
uuaggaauauuuucugaguagu

SEQ ID NO: 1137421 - RNA, 22 nt, Human
cccacccugggcuacacaucca

SEQ ID NO: 1137422 - RNA, 22 nt, Human
uccaggcaugucugaguccuuc

SEQ ID NO: 1137423 - RNA, 23 nt, Human
agcuuuggugaugugacagauaa

SEQ ID NO: 1137424 - RNA, 22 nt, Human
ucccuccuggccgucaccgcug

SEQ ID NO: 1137425 - RNA, 22 nt, Human
uguaaaaccaaaucaaucuagu

SEQ ID NO: 1137426 - RNA, 22 nt, Human
caguagacacauuaauauggaa

SEQ ID NO: 1137427 - RNA, 22 nt, Human
agggcuacugccugccuucagg

SEQ ID NO: 1137428 - RNA, 22 nt, Human
ugcuucuguuucauugaucuua

SEQ ID NO: 1137429 - RNA, 22 nt, Human
uguagaaccuguuuauuauaga

SEQ ID NO: 1137430 - RNA, 22 nt, Human
ugggcugagaguaccuuauaaa

SEQ ID NO: 1137431 - RNA, 22 nt, Human
aagggacccuggaucaaaugga

SEQ ID NO: 1137432 - RNA, 22 nt, Human
uagggcucugcucaucaguugu

SEQ ID NO: 1137433 - RNA, 22 nt, Human
uucugucacuuuuuuggaaucu

SEQ ID NO: 1137434 - RNA, 22 nt, Human
guccucugagggggcugcacgc

SEQ ID NO: 1137435 - RNA, 19 nt, Human
cagcccucuuaccacugug

SEQ ID NO: 1137436 - RNA, 22 nt, Human
aauaauuuuagcucagaguugu

SEQ ID NO: 1137437 - RNA, 22 nt, Human
guggccagcaagugcugccucu

SEQ ID NO: 1137438 - RNA, 22 nt, Human
aagagagaacucccuucgccag

SEQ ID NO: 1137439 - RNA, 22 nt, Human
ccauacacacaccaaauuugua

SEQ ID NO: 1137440 - RNA, 22 nt, Human
uacacaacugacaaccauucug

SEQ ID NO: 1137441 - RNA, 22 nt, Human
aguaugaauugcuuugccugua

SEQ ID NO: 1137442 - RNA, 22 nt, Human
agguagggaagaaggcaugaaa

SEQ ID NO: 1137443 - RNA, 22 nt, Human
uuugaaauaugaggcauuauga

SEQ ID NO: 1137444 - RNA, 22 nt, Human
aauucuguuacuaaugugaugu

SEQ ID NO: 1137445 - RNA, 22 nt, Human
auacacauauguguguauaugu

SEQ ID NO: 1137446 - RNA, 22 nt, Human
ucagcuuucucuucuaucgaua

SEQ ID NO: 1137447 - RNA, 19 nt, Human
ugcuucuggaaccaugauc

SEQ ID NO: 1137448 - RNA, 22 nt, Human
ucccagccuccugacaguuuug

SEQ ID NO: 1137449 - RNA, 22 nt, Human
auaugaaguuacagguaagaaa

SEQ ID NO: 1137450 - RNA, 22 nt, Human
ugcucugcacaucccucacaaa

SEQ ID NO: 1137451 - RNA, 22 nt, Human
aggccacaguacuuugcagacc

SEQ ID NO: 1137452 - RNA, 22 nt, Human
uaugcauacaaugagauauucc

SEQ ID NO: 1137453 - RNA, 22 nt, Human
ugcuucuggcagauugagugag

SEQ ID NO: 1137454 - RNA, 22 nt, Human
agacaucagcuugugugcaggg

SEQ ID NO: 1137455 - RNA, 22 nt, Human
guccuggcccaggaguacacau

SEQ ID NO: 1137456 - RNA, 22 nt, Human
aacagcaugcuggguaacauug

SEQ ID NO: 1137457 - RNA, 22 nt, Human
ucagagagugcaaaauauagcu

SEQ ID NO: 1137458 - RNA, 22 nt, Human
ucugggcugguugugcuugcuu

SEQ ID NO: 1137459 - RNA, 22 nt, Human
ggggucccugcaccagcauguc

SEQ ID NO: 1137460 - RNA, 22 nt, Human
gugcuaaaggguuaugaacaag

SEQ ID NO: 1137461 - RNA, 23 nt, Human
aauguauguuaguaucuuagaga

SEQ ID NO: 1137462 - RNA, 23 nt, Human
acugggcuuaugaggaggcuugu

SEQ ID NO: 1137463 - RNA, 22 nt, Human
ugggaccuguuacauugaguua

SEQ ID NO: 1137464 - RNA, 22 nt, Human
aaguuucauuguucauguaaca

SEQ ID NO: 1137465 - RNA, 22 nt, Human
uccaagcuacugaagguuuggg

SEQ ID NO: 1137466 - RNA, 22 nt, Human
ggcuucugcucagccugcacgc

SEQ ID NO: 1137467 - RNA, 23 nt, Human
uaaauuaccuuuccagugcaggg

SEQ ID NO: 1137468 - RNA, 22 nt, Human
auugaaaaaugacuauugcuua

SEQ ID NO: 1137469 - RNA, 22 nt, Human
gggcugacaguuuccccugaaa

SEQ ID NO: 1137470 - RNA, 22 nt, Human
uauguacaugauuucauuugcu

SEQ ID NO: 1137471 - RNA, 21 nt, Human
acacacucugagucuucuauu

SEQ ID NO: 1137472 - RNA, 22 nt, Human
ggggaccuggccacccauccuu

SEQ ID NO: 1137473 - RNA, 21 nt, Human
auucugucaucccagcuacuu

SEQ ID NO: 1137474 - RNA, 22 nt, Human
uucucauggugucuuuauacau

SEQ ID NO: 1137475 - RNA, 22 nt, Human
aucugucuugccuugcauauuu

SEQ ID NO: 1137476 - RNA, 22 nt, Human
uucacauugugcagauuauggu

SEQ ID NO: 1137477 - RNA, 22 nt, Human
acuuuacaagcuuauagccuag

SEQ ID NO: 1137478 - RNA, 19 nt, Human
cauuuagaaguacauauua

SEQ ID NO: 1137479 - RNA, 22 nt, Human
ucauauaaguuuaaaacuaucu

SEQ ID NO: 1137480 - RNA, 22 nt, Human
ccugggcucaagcgaucuuguc

SEQ ID NO: 1137481 - RNA, 22 nt, Human
aguguggcugcguagggcucuc

SEQ ID NO: 1137482 - RNA, 22 nt, Human
augcuacagcaucucucaucag

SEQ ID NO: 1137483 - RNA, 22 nt, Human
guauuaggaggaacacaggccu

SEQ ID NO: 1137484 - RNA, 22 nt, Human
uuguauuucuccacuuucuguu

SEQ ID NO: 1137485 - RNA, 21 nt, Human
agaaaaacacgauauaagccc

SEQ ID NO: 1137486 - RNA, 22 nt, Human
cucugucaggcugcagaugcuc

SEQ ID NO: 1137487 - RNA, 22 nt, Human
gucugucacucaggggcuggag

SEQ ID NO: 1137488 - RNA, 22 nt, Human
cuuuucaugagucuguuauggg

SEQ ID NO: 1137489 - RNA, 22 nt, Human
cagcucugagacugaggcuaug

SEQ ID NO: 1137490 - RNA, 22 nt, Human
auguggcugguaguugacaacu

SEQ ID NO: 1137491 - RNA, 18 nt, Human
acuggcuuuagcaucaga

SEQ ID NO: 1137492 - RNA, 22 nt, Human
aaauauacuagaugaugaccca

SEQ ID NO: 1137493 - RNA, 16 nt, Human
ccugggcucuguugga

SEQ ID NO: 1137494 - RNA, 22 nt, Human
cuuucauuugauaagaaugcca

SEQ ID NO: 1137495 - RNA, 22 nt, Human
guggccagccccauggacaguu

SEQ ID NO: 1137496 - RNA, 22 nt, Human
cacaauguauauguauaucaaa

SEQ ID NO: 1137497 - RNA, 22 nt, Human
auuaauuuuucugacagccaca

SEQ ID NO: 1137498 - RNA, 22 nt, Human
ucagagaggauuuuaauaagug

SEQ ID NO: 1137499 - RNA, 22 nt, Human
aacauucaaaacccaguucagu

SEQ ID NO: 1137500 - RNA, 20 nt, Human
ccuggcaggcggguuacuua

SEQ ID NO: 1137501 - RNA, 22 nt, Human
uaaguuuuaagcaaucugauaa

SEQ ID NO: 1137502 - RNA, 22 nt, Human
gagaggcuggcagugccagguu

SEQ ID NO: 1137503 - RNA, 22 nt, Human
agaggcucugccgccucaggua

SEQ ID NO: 1137504 - RNA, 22 nt, Human
ucuguguugauaauuuuggaga

SEQ ID NO: 1137505 - RNA, 22 nt, Human
gugcaguggcagauccuagcuc

SEQ ID NO: 1137506 - RNA, 23 nt, Human
acucacaaagcaggaucauguug

SEQ ID NO: 1137507 - RNA, 22 nt, Human
gcagagaggaaugaagccaucc

SEQ ID NO: 1137508 - RNA, 22 nt, Human
cuugccucccucagcucacagc

SEQ ID NO: 1137509 - RNA, 22 nt, Human
cuacaaugacagaauugaguag

SEQ ID NO: 1137510 - RNA, 22 nt, Human
gucacaggcaguaacuaggacc

SEQ ID NO: 1137511 - RNA, 22 nt, Human
ugguauaaaacuuuuuauugaa

SEQ ID NO: 1137512 - RNA, 22 nt, Human
gacucugggcugagccagggcc

SEQ ID NO: 1137513 - RNA, 21 nt, Human
ccaggcugggagggcaguucc

SEQ ID NO: 1137514 - RNA, 22 nt, Human
gccaggcaaauuaaggaaugca

SEQ ID NO: 1137515 - RNA, 19 nt, Human
ccaggccugcgggcguugg

SEQ ID NO: 1137516 - RNA, 23 nt, Human
uguggcugagaaauugacaacuu

SEQ ID NO: 1137517 - RNA, 22 nt, Human
auucugucuuuuuaaaauaaua

SEQ ID NO: 1137518 - RNA, 20 nt, Human
uuccagagaucugcauuuua

SEQ ID NO: 1137519 - RNA, 22 nt, Human
caguguuucugaguuccagcuc

SEQ ID NO: 1137520 - RNA, 22 nt, Human
cuuuucacaggaggauaagccc

SEQ ID NO: 1137521 - RNA, 22 nt, Human
ggcuuuauauuguuugagcaga

SEQ ID NO: 1137522 - RNA, 22 nt, Human
cgcugauaaacgucacguuccc

SEQ ID NO: 1137523 - RNA, 22 nt, Human
auccccacgauauagccaaagc

SEQ ID NO: 1137524 - RNA, 22 nt, Human
auucacaugugcuucuuaucac

SEQ ID NO: 1137525 - RNA, 22 nt, Human
guguaugaggggagaauguuuu

SEQ ID NO: 1137526 - RNA, 22 nt, Human
uucugucuguaaacuucucaau

SEQ ID NO: 1137527 - RNA, 17 nt, Human
ccagagaguaguuagga

SEQ ID NO: 1137528 - RNA, 22 nt, Human
acuggggaauggaacugggaau

SEQ ID NO: 1137529 - RNA, 22 nt, Human
ggccucucaugcccagagccaa

SEQ ID NO: 1137530 - RNA, 22 nt, Human
aaauccuaaaaguuugacuuaa

SEQ ID NO: 1137531 - RNA, 22 nt, Human
caggauggucucgaucuccuga

SEQ ID NO: 1137532 - RNA, 22 nt, Human
cuggaaagaccugcuugcuuuu

SEQ ID NO: 1137533 - RNA, 22 nt, Human
ccagugcccagcugcccaggca

SEQ ID NO: 1137534 - RNA, 22 nt, Human
acaauucugaugguuucccagu

SEQ ID NO: 1137535 - RNA, 22 nt, Human
agagcacagaagaauaggugcu

SEQ ID NO: 1137536 - RNA, 22 nt, Human
accugccuucucaaggacauga

SEQ ID NO: 1137537 - RNA, 22 nt, Human
cagcaaucgggugauaugcaau

SEQ ID NO: 1137538 - RNA, 17 nt, Human
uuauuuuuugggcugag

SEQ ID NO: 1137539 - RNA, 22 nt, Human
gagcauuugguuauaguaauuu

SEQ ID NO: 1137540 - RNA, 22 nt, Human
ccacacagauaaguguuuucua

SEQ ID NO: 1137541 - RNA, 22 nt, Human
cugcucuaauaucagauagacu

SEQ ID NO: 1137542 - RNA, 22 nt, Human
augugaaagagguguucagugg

SEQ ID NO: 1137543 - RNA, 22 nt, Human
acuggcaguggcagcagaaaga

SEQ ID NO: 1137544 - RNA, 22 nt, Human
gcugggcucugucaugccuucc

SEQ ID NO: 1137545 - RNA, 22 nt, Human
ucauuuauaaggaugcaauuaa

SEQ ID NO: 1137546 - RNA, 22 nt, Human
aguaugaagauuauaauuuuuc

SEQ ID NO: 1137547 - RNA, 22 nt, Human
ucugugacugauggaggcuuuu

SEQ ID NO: 1137548 - RNA, 22 nt, Human
uccaggcuuuuucaugcugucu

SEQ ID NO: 1137549 - RNA, 22 nt, Human
caucacagggggcuagaagucu

SEQ ID NO: 1137550 - RNA, 22 nt, Human
aauaauuauuugagagcagacc

SEQ ID NO: 1137551 - RNA, 23 nt, Human
agcaggcugcuucuccacagcug

SEQ ID NO: 1137552 - RNA, 22 nt, Human
uuucacauaaauauuaugccua

SEQ ID NO: 1137553 - RNA, 22 nt, Human
acuggcaguuugagaaugcauu

SEQ ID NO: 1137554 - RNA, 22 nt, Human
uacauaaugagcuaguuaaguu

SEQ ID NO: 1137555 - RNA, 22 nt, Human
caugaagcucuugcaccucuag

SEQ ID NO: 1137556 - RNA, 22 nt, Human
uguuuauucauggcuaaugaaa

SEQ ID NO: 1137557 - RNA, 22 nt, Human
auuaaauuaaguggcuaauuua

SEQ ID NO: 1137558 - RNA, 20 nt, Human
uauuuacaacuuagagccuc

SEQ ID NO: 1137559 - RNA, 22 nt, Human
aagagcaucaaugacucgcagu

SEQ ID NO: 1137560 - RNA, 22 nt, Human
ccaggcucugcaaaaucaggcu

SEQ ID NO: 1137561 - RNA, 22 nt, Human
ugcuucugggccugguguuccc

SEQ ID NO: 1137562 - RNA, 22 nt, Human
agucuagggugggguccacagg

SEQ ID NO: 1137563 - RNA, 22 nt, Human
aauugcaauuuucuuaaggucu

SEQ ID NO: 1137564 - RNA, 22 nt, Human
guggcaggggcgggcuguuccg

SEQ ID NO: 1137565 - RNA, 23 nt, Human
auauuagggagauuagcccucua

SEQ ID NO: 1137566 - RNA, 22 nt, Human
aaacuucauggauaauauaaag

SEQ ID NO: 1137567 - RNA, 23 nt, Human
uuuuaauuuggacauaagaagau

SEQ ID NO: 1137568 - RNA, 22 nt, Human
ugggcuucugauguugagugcu

SEQ ID NO: 1137569 - RNA, 22 nt, Human
aaaaguauuuauggcuauguaa

SEQ ID NO: 1137570 - RNA, 22 nt, Human
cagcuuuaccuuuaggaguaac

SEQ ID NO: 1137571 - RNA, 22 nt, Human
ccugaggggcugcaggccagcu

SEQ ID NO: 1137572 - RNA, 22 nt, Human
ccacccuaacaauccuuacugu

SEQ ID NO: 1137573 - RNA, 22 nt, Human
ucucugaagauauuuauuauua

SEQ ID NO: 1137574 - RNA, 22 nt, Human
agggcccuagggaaugagacau

SEQ ID NO: 1137575 - RNA, 22 nt, Human
gcagcuuucuuuuugcaugucu

SEQ ID NO: 1137576 - RNA, 22 nt, Human
ugaauccagagcuauuucgucc

SEQ ID NO: 1137577 - RNA, 22 nt, Human
ccugcaggcugcaggccaguuc

SEQ ID NO: 1137578 - RNA, 22 nt, Human
aacaguaaaaaucauuuaguug

SEQ ID NO: 1137579 - RNA, 22 nt, Human
ugcuuuauagacaaggaaguag

SEQ ID NO: 1137580 - RNA, 22 nt, Human
acaccauacucauguugguucc

SEQ ID NO: 1137581 - RNA, 15 nt, Human
uccaggcauucauuc

SEQ ID NO: 1137582 - RNA, 22 nt, Human
ggagccugaaaagucugcauuu

SEQ ID NO: 1137583 - RNA, 22 nt, Human
guccucugacucagccuuggga

SEQ ID NO: 1137584 - RNA, 22 nt, Human
uccaggcauagaaggcacgcac

SEQ ID NO: 1137585 - RNA, 22 nt, Human
uucagagacagcaaccaggaca

SEQ ID NO: 1137586 - RNA, 22 nt, Human
gcugggcucaccaggccacuag

SEQ ID NO: 1137587 - RNA, 22 nt, Human
ucuguuuaggcaaaauagcuac

SEQ ID NO: 1137588 - RNA, 22 nt, Human
auuauuagugauguuguuacug

SEQ ID NO: 1137589 - RNA, 22 nt, Human
acaugauauuaaugucuuauuu

SEQ ID NO: 1137590 - RNA, 22 nt, Human
ucuccaggaagcccucccugac

SEQ ID NO: 1137591 - RNA, 22 nt, Human
uaugaacuguaacccucaccgc

SEQ ID NO: 1137592 - RNA, 22 nt, Human
auaugauuccacuauuguaugg

SEQ ID NO: 1137593 - RNA, 22 nt, Human
uuuacacaaaagauagcacacc

SEQ ID NO: 1137594 - RNA, 22 nt, Human
ggagcugaggcugaggccucac

SEQ ID NO: 1137595 - RNA, 19 nt, Human
uccuggcacaguggaacca

SEQ ID NO: 1137596 - RNA, 23 nt, Human
uuaggcacuuaguagggccagag

SEQ ID NO: 1137597 - RNA, 22 nt, Human
uccaagcuugcuuuagccacag

SEQ ID NO: 1137598 - RNA, 22 nt, Human
cauuuguaggaugcuucuuguu

SEQ ID NO: 1137599 - RNA, 23 nt, Human
aaaguuugaagcaacaguaguug

SEQ ID NO: 1137600 - RNA, 22 nt, Human
ggcaggcuggcuuuguuccagg

SEQ ID NO: 1137601 - RNA, 19 nt, Human
auguaugaggucuucugcu

SEQ ID NO: 1137602 - RNA, 22 nt, Human
aaauuagucgguuuaggaauuu

SEQ ID NO: 1137603 - RNA, 22 nt, Human
aaccugcaguuuuuauucugag

SEQ ID NO: 1137604 - RNA, 22 nt, Human
cuccaagucggcugcagcugga

SEQ ID NO: 1137605 - RNA, 22 nt, Human
gaaagaagcuuuagauggcuau

SEQ ID NO: 1137606 - RNA, 22 nt, Human
auccugugcaaugacugcaucu

SEQ ID NO: 1137607 - RNA, 22 nt, Human
uauucccagccucuuucuaucu

SEQ ID NO: 1137608 - RNA, 22 nt, Human
uacacagauuucaguaucauca

SEQ ID NO: 1137609 - RNA, 22 nt, Human
uuaugaaggaucagguacuugg

SEQ ID NO: 1137610 - RNA, 19 nt, Human
ucuuuucacgcauuuugaa

SEQ ID NO: 1137611 - RNA, 22 nt, Human
cccagccugugacagccguccu

SEQ ID NO: 1137612 - RNA, 22 nt, Human
auucucaauggcuacuuucaua

SEQ ID NO: 1137613 - RNA, 22 nt, Human
aagggcuccacuugaaucacac

SEQ ID NO: 1137614 - RNA, 22 nt, Human
cacacaucuuaucccaguuauu

SEQ ID NO: 1137615 - RNA, 22 nt, Human
cccaggcagcccuucugacgca

SEQ ID NO: 1137616 - RNA, 21 nt, Human
cccugcaggccagggcugagc

SEQ ID NO: 1137617 - RNA, 22 nt, Human
ggcuuugguagacacagauuga

SEQ ID NO: 1137618 - RNA, 22 nt, Human
auuauucuuaugucaucauggc

SEQ ID NO: 1137619 - RNA, 22 nt, Human
acuuaaaaccagacagcgucau

SEQ ID NO: 1137620 - RNA, 22 nt, Human
auuuauuaugggauuuggcuca

SEQ ID NO: 1137621 - RNA, 22 nt, Human
ugugugaaggagccacuguuca

SEQ ID NO: 1137622 - RNA, 19 nt, Human
uggccagguacugucugcu

SEQ ID NO: 1137623 - RNA, 22 nt, Human
ucugugcauuguaacaacuaaa

SEQ ID NO: 1137624 - RNA, 22 nt, Human
acugggcugccugguucuucua

SEQ ID NO: 1137625 - RNA, 22 nt, Human
auguaugagagauucuuuuauu

SEQ ID NO: 1137626 - RNA, 22 nt, Human
cugagggagcugcuggccuugg

SEQ ID NO: 1137627 - RNA, 20 nt, Human
ucacacaugguaagcuauga

SEQ ID NO: 1137628 - RNA, 22 nt, Human
ugaccuuauuugaaaauagaga

SEQ ID NO: 1137629 - RNA, 22 nt, Human
uuaguuaguggggcugucaguc

SEQ ID NO: 1137630 - RNA, 22 nt, Human
uuguaugaauguauccuaauuu

SEQ ID NO: 1137631 - RNA, 22 nt, Human
auguuucaucaguaagguuuug

SEQ ID NO: 1137632 - RNA, 22 nt, Human
ucacuguaccuuccauuucauu

SEQ ID NO: 1137633 - RNA, 22 nt, Human
uaugagaaucugcaguaugcuu

SEQ ID NO: 1137634 - RNA, 22 nt, Human
ucaucccuaaggacagcucugc

SEQ ID NO: 1137635 - RNA, 22 nt, Human
gacccagcuuaagucacauguu

SEQ ID NO: 1137636 - RNA, 22 nt, Human
ugggcuccaauuuguccuuuca

SEQ ID NO: 1137637 - RNA, 22 nt, Human
gcuccaggugucccagguaaaa

SEQ ID NO: 1137638 - RNA, 22 nt, Human
caugagauuugggaggggccag

SEQ ID NO: 1137639 - RNA, 20 nt, Human
uuaagaaaagcacauccugc

SEQ ID NO: 1137640 - RNA, 22 nt, Human
auucugucuuuuuauacaucua

SEQ ID NO: 1137641 - RNA, 22 nt, Human
cugggcugucaguuuuguuuua

SEQ ID NO: 1137642 - RNA, 22 nt, Human
ugggaccugcccuggccccauc

SEQ ID NO: 1137643 - RNA, 18 nt, Human
cauaauuuucuuucuuua

SEQ ID NO: 1137644 - RNA, 22 nt, Human
cagaagucacccucagaauaac

SEQ ID NO: 1137645 - RNA, 22 nt, Human
aauguaugugcaucauuuacau

SEQ ID NO: 1137646 - RNA, 20 nt, Human
cagcccuccaguggaggcag

SEQ ID NO: 1137647 - RNA, 22 nt, Human
aaauccuaagcagaggaauuua

SEQ ID NO: 1137648 - RNA, 22 nt, Human
agagcauccaucggccaggacc

SEQ ID NO: 1137649 - RNA, 22 nt, Human
uuucaaacauagaucugaauau

SEQ ID NO: 1137650 - RNA, 18 nt, Human
ccaaggccccugcugggg

SEQ ID NO: 1137651 - RNA, 22 nt, Human
gccugcagacguguuuuccuca

SEQ ID NO: 1137652 - RNA, 22 nt, Human
auacuuuggucacuauuauugg

SEQ ID NO: 1137653 - RNA, 22 nt, Human
aaguccaguuucauuugagguc

SEQ ID NO: 1137654 - RNA, 22 nt, Human
gcuccaggaggaugaccuuccu

SEQ ID NO: 1137655 - RNA, 22 nt, Human
ugcagggaaagggcacugggcu

SEQ ID NO: 1137656 - RNA, 22 nt, Human
auuaauuuccaggcacugugcu

SEQ ID NO: 1137657 - RNA, 22 nt, Human
uguaugaaagaacaagggcuua

SEQ ID NO: 1137658 - RNA, 22 nt, Human
ugaaugauuugggugcauucag

SEQ ID NO: 1137659 - RNA, 21 nt, Human
uccagaccucccucuccuagc

SEQ ID NO: 1137660 - RNA, 22 nt, Human
cccacacaaaucauggggagaa

SEQ ID NO: 1137661 - RNA, 22 nt, Human
cagggcuagugacaccccaguc

SEQ ID NO: 1137662 - RNA, 22 nt, Human
cagcauuuagaauuugaagugu

SEQ ID NO: 1137663 - RNA, 22 nt, Human
uaauuucaauagcuugcauaau

SEQ ID NO: 1137664 - RNA, 22 nt, Human
ugcuucuggcacuugagggggu

SEQ ID NO: 1137665 - RNA, 21 nt, Human
ugggaccuauuucaacuggau

SEQ ID NO: 1137666 - RNA, 22 nt, Human
uuggaacaugccgggguccagg

SEQ ID NO: 1137667 - RNA, 19 nt, Human
ugcuucuggggcuucucca

SEQ ID NO: 1137668 - RNA, 22 nt, Human
cugcucuagagagcauuaguca

SEQ ID NO: 1137669 - RNA, 22 nt, Human
uagcuuuagaaauauucucaga

SEQ ID NO: 1137670 - RNA, 22 nt, Human
agcagguugugauacacucaga

SEQ ID NO: 1137671 - RNA, 22 nt, Human
agcaggcuaaauaauaauacau

SEQ ID NO: 1137672 - RNA, 22 nt, Human
cagguggcuucucccuaggcca

SEQ ID NO: 1137673 - RNA, 22 nt, Human
cagaggcucagauggcccuggc

SEQ ID NO: 1137674 - RNA, 22 nt, Human
gccugcagaggugcugcuagcu

SEQ ID NO: 1137675 - RNA, 22 nt, Human
ccugggcuuacgaccucugacu

SEQ ID NO: 1137676 - RNA, 22 nt, Human
aaagaucaaguaggcauggccu

SEQ ID NO: 1137677 - RNA, 22 nt, Human
aaauacauacacuguacguggc

SEQ ID NO: 1137678 - RNA, 22 nt, Human
uucugucagcgucagaaauucu

SEQ ID NO: 1137679 - RNA, 22 nt, Human
cuuucauaaaggaaaugaugag

SEQ ID NO: 1137680 - RNA, 22 nt, Human
uuuagggaauagaagaucugaa

SEQ ID NO: 1137681 - RNA, 22 nt, Human
auggcagauggcuggagcaggu

SEQ ID NO: 1137682 - RNA, 22 nt, Human
agugaaccaggcugcgucccug

SEQ ID NO: 1137683 - RNA, 22 nt, Human
gcacccaggcuugggcagcaac

SEQ ID NO: 1137684 - RNA, 19 nt, Human
uugaaauuguuugauaugg

SEQ ID NO: 1137685 - RNA, 22 nt, Human
uugcaacaucugaacauuuauc

SEQ ID NO: 1137686 - RNA, 22 nt, Human
cagggcucccugcagccucugu

SEQ ID NO: 1137687 - RNA, 22 nt, Human
agacccucuccaugcccacugc

SEQ ID NO: 1137688 - RNA, 22 nt, Human
cugccugcaggacaccucgcua

SEQ ID NO: 1137689 - RNA, 22 nt, Human
acagugugguuugagcacuggg

SEQ ID NO: 1137690 - RNA, 22 nt, Human
ggcugcagagcugggugggccu

SEQ ID NO: 1137691 - RNA, 22 nt, Human
aaguauuucguucugaaaaagu

SEQ ID NO: 1137692 - RNA, 22 nt, Human
guccucugucccuggggcacgg

SEQ ID NO: 1137693 - RNA, 22 nt, Human
gccaagcucuuuaaaggccaaa

SEQ ID NO: 1137694 - RNA, 21 nt, Human
gggcagaggggccuccugggu

SEQ ID NO: 1137695 - RNA, 22 nt, Human
ccuggcagguagcauugaggag

SEQ ID NO: 1137696 - RNA, 22 nt, Human
ccagagagguagcuuacccucu

SEQ ID NO: 1137697 - RNA, 16 nt, Human
uucugucacguacggc

SEQ ID NO: 1137698 - RNA, 22 nt, Human
agaauccucuucaguaaauucu

SEQ ID NO: 1137699 - RNA, 22 nt, Human
ugaaacuucuaauaugaauagu

SEQ ID NO: 1137700 - RNA, 21 nt, Human
ccacuguagacucauucugag

SEQ ID NO: 1137701 - RNA, 22 nt, Human
gaagcacugccauaauucagac

SEQ ID NO: 1137702 - RNA, 22 nt, Human
acagcuuuguguuaaugggaag

SEQ ID NO: 1137703 - RNA, 22 nt, Human
ggcuccacugcugaccacucca

SEQ ID NO: 1137704 - RNA, 22 nt, Human
uuucagaugugugucucugaag

SEQ ID NO: 1137705 - RNA, 22 nt, Human
aaggccacacuugcuggccagc

SEQ ID NO: 1137706 - RNA, 22 nt, Human
auucacaguuuccucauauucu

SEQ ID NO: 1137707 - RNA, 22 nt, Human
ggccucucagggcagagacccu

SEQ ID NO: 1137708 - RNA, 22 nt, Human
cugggcugcaguuccugguccu

SEQ ID NO: 1137709 - RNA, 21 nt, Human
agaauaaugguaucauuugcu

SEQ ID NO: 1137710 - RNA, 22 nt, Human
gaggccagaaugagcugaaugc

SEQ ID NO: 1137711 - RNA, 22 nt, Human
auguagaaaguucauagaugcg

SEQ ID NO: 1137712 - RNA, 19 nt, Human
guccaguguuuuccaguca

SEQ ID NO: 1137713 - RNA, 22 nt, Human
aaugaagccagcugggaugcga

SEQ ID NO: 1137714 - RNA, 22 nt, Human
cagcuuuaccaauauuuggaaa

SEQ ID NO: 1137715 - RNA, 22 nt, Human
gcuccaagguauccaccagggu

SEQ ID NO: 1137716 - RNA, 22 nt, Human
agucacaguuccuacccaguaa

SEQ ID NO: 1137717 - RNA, 22 nt, Human
gcagcucucuggccugcccugg

SEQ ID NO: 1137718 - RNA, 22 nt, Human
ucuggcagugauuucugugauc

SEQ ID NO: 1137719 - RNA, 22 nt, Human
uauaauuuuaagugguaaauua

SEQ ID NO: 1137720 - RNA, 22 nt, Human
aucacagagauugcuuuuaaaa

SEQ ID NO: 1137721 - RNA, 22 nt, Human
ucauuuguucucauucucuacu

SEQ ID NO: 1137722 - RNA, 22 nt, Human
uugugcaauuuaaaaucuuccu

SEQ ID NO: 1137723 - RNA, 22 nt, Human
gcagagaggauauuauugucca

SEQ ID NO: 1137724 - RNA, 22 nt, Human
ccaggcccaggguacugaccaa

SEQ ID NO: 1137725 - RNA, 22 nt, Human
guucugggaagguggaccuguu

SEQ ID NO: 1137726 - RNA, 22 nt, Human
aaguccuuggagaauagaaagg

SEQ ID NO: 1137727 - RNA, 22 nt, Human
ccuggggaccugccucagcccu

SEQ ID NO: 1137728 - RNA, 18 nt, Human
ucuaggagaguaccuacc

SEQ ID NO: 1137729 - RNA, 22 nt, Human
cagcucaggcucuccaugcucc

SEQ ID NO: 1137730 - RNA, 22 nt, Human
uugcagcuucuaccacuguuuc

SEQ ID NO: 1137731 - RNA, 22 nt, Human
cacaugcaucugucauguuugg

SEQ ID NO: 1137732 - RNA, 22 nt, Human
cugcaggguuuuucaaggacaa

SEQ ID NO: 1137733 - RNA, 23 nt, Human
cagugugacgaggugaggcaggc

SEQ ID NO: 1137734 - RNA, 22 nt, Human
uccaggaggaggaaggcugcca

SEQ ID NO: 1137735 - RNA, 22 nt, Human
cuguaaauaugaagaauauaug

SEQ ID NO: 1137736 - RNA, 20 nt, Human
agacccucuggacugggccc

SEQ ID NO: 1137737 - RNA, 22 nt, Human
gcauacagagaggauguggcau

SEQ ID NO: 1137738 - RNA, 22 nt, Human
auguccagaguguccuggaaag

SEQ ID NO: 1137739 - RNA, 22 nt, Human
ccaggcucaggccugcucguug

SEQ ID NO: 1137740 - RNA, 22 nt, Human
acagcuuuucaauucugcugag

SEQ ID NO: 1137741 - RNA, 22 nt, Human
acacucucagcuuuucaacuua

SEQ ID NO: 1137742 - RNA, 22 nt, Human
uucuggggccccaguguccucg

SEQ ID NO: 1137743 - RNA, 23 nt, Human
gcugacugugaaauucuggagcu

SEQ ID NO: 1137744 - RNA, 22 nt, Human
auuucccuccagggaaagcuua

SEQ ID NO: 1137745 - RNA, 22 nt, Human
uacagagaguacagcauccaca

SEQ ID NO: 1137746 - RNA, 22 nt, Human
ucuggcagugagcaacuugaca

SEQ ID NO: 1137747 - RNA, 22 nt, Human
auuucacaaagaacagaugcag

SEQ ID NO: 1137748 - RNA, 22 nt, Human
ucagagaguuuucacuagggug

SEQ ID NO: 1137749 - RNA, 22 nt, Human
auguccagccaaccacuggauu

SEQ ID NO: 1137750 - RNA, 22 nt, Human
uggcuggagcauuccuugucuu

SEQ ID NO: 1137751 - RNA, 22 nt, Human
gggaccuggucuagcacugagc

SEQ ID NO: 1137752 - RNA, 22 nt, Human
gagggcucacugagaaagcagu

SEQ ID NO: 1137753 - RNA, 22 nt, Human
cauuuguaguaucuguuuauau

SEQ ID NO: 1137754 - RNA, 22 nt, Human
acauacuuaugcuaaaaauaua

SEQ ID NO: 1137755 - RNA, 22 nt, Human
augggcugacaagacaugcaua

SEQ ID NO: 1137756 - RNA, 22 nt, Human
auuuaaauuuucugauggagag

SEQ ID NO: 1137757 - RNA, 22 nt, Human
aguaugaaucucuuuauucugc

SEQ ID NO: 1137758 - RNA, 22 nt, Human
uccaugagacagauacuguaag

SEQ ID NO: 1137759 - RNA, 22 nt, Human
gcagccuccgcacugcgagucc

SEQ ID NO: 1137760 - RNA, 22 nt, Human
ucuccaggccuuucccaucuua

SEQ ID NO: 1137761 - RNA, 22 nt, Human
ucuggggaauguucauuucuga

SEQ ID NO: 1137762 - RNA, 22 nt, Human
acugauuacacgaguucugacu

SEQ ID NO: 1137763 - RNA, 22 nt, Human
uuaaauauuuucagcaggguca

SEQ ID NO: 1137764 - RNA, 22 nt, Human
uuccugggugguccugguagag

SEQ ID NO: 1137765 - RNA, 22 nt, Human
auggccuggggauuccugagca

SEQ ID NO: 1137766 - RNA, 22 nt, Human
uucuuucaauagcuggcauaug

SEQ ID NO: 1137767 - RNA, 22 nt, Human
cucccagguuccgacgccucuu

SEQ ID NO: 1137768 - RNA, 22 nt, Human
ucagagaggcaauacuguuuaa

SEQ ID NO: 1137769 - RNA, 22 nt, Human
gaaacauauuaauccagugaaa

SEQ ID NO: 1137770 - RNA, 22 nt, Human
ggcuuuaugcagggauagaaau

SEQ ID NO: 1137771 - RNA, 22 nt, Human
aggacuuagaacauuauguacu

SEQ ID NO: 1137772 - RNA, 22 nt, Human
aaggcucccucuucucgagugu

SEQ ID NO: 1137773 - RNA, 22 nt, Human
ugcuucugcugauauuuuguga

SEQ ID NO: 1137774 - RNA, 22 nt, Human
cccacacucugagaaaugcuga

SEQ ID NO: 1137775 - RNA, 22 nt, Human
ugcaggcuauccuuugcugcaa

SEQ ID NO: 1137776 - RNA, 22 nt, Human
uauuaaauuauggauuuaggag

SEQ ID NO: 1137777 - RNA, 22 nt, Human
uacaaaaguaauuacgguuuuu

SEQ ID NO: 1137778 - RNA, 23 nt, Human
aacagccaacuuuagcggguggc

SEQ ID NO: 1137779 - RNA, 18 nt, Human
cccacacagcaguagcuc

SEQ ID NO: 1137780 - RNA, 16 nt, Human
uccaggcauaucugag

SEQ ID NO: 1137781 - RNA, 22 nt, Human
agcuagaaguacagccauauga

SEQ ID NO: 1137782 - RNA, 21 nt, Human
uaaauaauaaguugcugagau

SEQ ID NO: 1137783 - RNA, 22 nt, Human
uauuagggaacugcaagacuaa

SEQ ID NO: 1137784 - RNA, 22 nt, Human
gaggcagcgggucaggaccgug

SEQ ID NO: 1137785 - RNA, 22 nt, Human
uauaauuuuagaagagauggaa

SEQ ID NO: 1137786 - RNA, 19 nt, Human
cucagagaggggcagugcc

SEQ ID NO: 1137787 - RNA, 22 nt, Human
ucuggcagaaggcagaaauuca

SEQ ID NO: 1137788 - RNA, 22 nt, Human
gcuucugggguucuggcaugcu

SEQ ID NO: 1137789 - RNA, 22 nt, Human
agagggugcuggagagacauug

SEQ ID NO: 1137790 - RNA, 22 nt, Human
ccuggggauucugacacggagu

SEQ ID NO: 1137791 - RNA, 22 nt, Human
agcucccagcagagcuggccac

SEQ ID NO: 1137792 - RNA, 22 nt, Human
uauuuaaaaagaggccagcugg

SEQ ID NO: 1137793 - RNA, 22 nt, Human
ucugucaaaugagcaaguaacu

SEQ ID NO: 1137794 - RNA, 22 nt, Human
gcugggcugagcuagacuuggc

SEQ ID NO: 1137795 - RNA, 22 nt, Human
gcaaacuguuggaguagagucu

SEQ ID NO: 1137796 - RNA, 22 nt, Human
ccugggcucaccaugccuugga

SEQ ID NO: 1137797 - RNA, 22 nt, Human
aggcugugacagggucauggag

SEQ ID NO: 1137798 - RNA, 22 nt, Human
cuccaggccauggcugcggagg

SEQ ID NO: 1137799 - RNA, 22 nt, Human
agcaggcuuuccacagaaggag

SEQ ID NO: 1137800 - RNA, 17 nt, Human
ugcaggcuguuauagcc

SEQ ID NO: 1137801 - RNA, 22 nt, Human
gcuuggaaguaggauugggaga

SEQ ID NO: 1137802 - RNA, 22 nt, Human
ugucuucaucuccaugcacaga

SEQ ID NO: 1137803 - RNA, 22 nt, Human
agggcuccaggggcugggugac

SEQ ID NO: 1137804 - RNA, 22 nt, Human
cuucugggcauggcagagccug

SEQ ID NO: 1137805 - RNA, 22 nt, Human
auggcuagcaccgcguugcugg

SEQ ID NO: 1137806 - RNA, 22 nt, Human
ucccacccccuccaaggaggaa

SEQ ID NO: 1137807 - RNA, 18 nt, Human
cccucuugcacaaagcaa

SEQ ID NO: 1137808 - RNA, 22 nt, Human
uauguacuacacuagaacauuu

SEQ ID NO: 1137809 - RNA, 22 nt, Human
accaggcaguauggugcugcaa

SEQ ID NO: 1137810 - RNA, 22 nt, Human
uggcgucucucauaaguaugug

SEQ ID NO: 1137811 - RNA, 22 nt, Human
gaggcacagucccgaggcaagg

SEQ ID NO: 1137812 - RNA, 22 nt, Human
ucagcucuguguacaguuagca

SEQ ID NO: 1137813 - RNA, 22 nt, Human
aggcuguguggaugagucuuac

SEQ ID NO: 1137814 - RNA, 22 nt, Human
uccugcagccaagggucaucga

SEQ ID NO: 1137815 - RNA, 22 nt, Human
uuuauugacccaaagcgagagu

SEQ ID NO: 1137816 - RNA, 22 nt, Human
cacauaauaaauguuccugaug

SEQ ID NO: 1137817 - RNA, 22 nt, Human
ccagagcccagggucaugcagg

SEQ ID NO: 1137818 - RNA, 21 nt, Human
ggccucagccaccuggcucug

SEQ ID NO: 1137819 - RNA, 20 nt, Human
aguuuauuccaggagaacug

SEQ ID NO: 1137820 - RNA, 22 nt, Human
ucaggcucucagaccaacagca

SEQ ID NO: 1137821 - RNA, 22 nt, Human
ugagcaucuuuuuacagguuua

SEQ ID NO: 1137822 - RNA, 22 nt, Human
uccugcagagucccacugauuu

SEQ ID NO: 1137823 - RNA, 22 nt, Human
ucccagggcacucacccucccu

SEQ ID NO: 1137824 - RNA, 22 nt, Human
aaauuucuggaagugucagagu

SEQ ID NO: 1137825 - RNA, 22 nt, Human
cauuuguaucugggcugcugug

SEQ ID NO: 1137826 - RNA, 22 nt, Human
cagauuuaccuaacuccaaguu

SEQ ID NO: 1137827 - RNA, 23 nt, Human
cugcagagaacugagggacagcc

SEQ ID NO: 1137828 - RNA, 22 nt, Human
ccucugccaccucccacgaggc

SEQ ID NO: 1137829 - RNA, 22 nt, Human
cagacccugggccacagaggag

SEQ ID NO: 1137830 - RNA, 22 nt, Human
aaaagguuuugaguacaaauau

SEQ ID NO: 1137831 - RNA, 22 nt, Human
uucaagauggcaccagugagug

SEQ ID NO: 1137832 - RNA, 23 nt, Human
ugagcaucacaggagaaccaggc

SEQ ID NO: 1137833 - RNA, 22 nt, Human
ucuggcaggcaaucggcucugg

SEQ ID NO: 1137834 - RNA, 22 nt, Human
ucauuuguucaucugcucuucu

SEQ ID NO: 1137835 - RNA, 22 nt, Human
agggcuccuaugccccauggac

SEQ ID NO: 1137836 - RNA, 22 nt, Human
uacacacaugcauuugccuuau

SEQ ID NO: 1137837 - RNA, 22 nt, Human
uuauuagcugggcuucagggug

SEQ ID NO: 1137838 - RNA, 22 nt, Human
agggaccucuucuugcagcuga

SEQ ID NO: 1137839 - RNA, 22 nt, Human
uuaucacuuaugagcuuuuugc

SEQ ID NO: 1137840 - RNA, 22 nt, Human
ccacccagcagaggaggcaaga

SEQ ID NO: 1137841 - RNA, 22 nt, Human
uccacacacauuucuaugugca

SEQ ID NO: 1137842 - RNA, 22 nt, Human
uagggcucugagaguucagccu

SEQ ID NO: 1137843 - RNA, 22 nt, Human
auacauucaaaggaaggauaga

SEQ ID NO: 1137844 - RNA, 22 nt, Human
cagugggggggccaugcugcag

SEQ ID NO: 1137845 - RNA, 22 nt, Human
cauuugcagagggugacacucu

SEQ ID NO: 1137846 - RNA, 22 nt, Human
ucugauuagagcauucuugagu

SEQ ID NO: 1137847 - RNA, 22 nt, Human
gggcugacuccuauuggaugaa

SEQ ID NO: 1137848 - RNA, 22 nt, Human
agaugguuuugucuuuaugauu

SEQ ID NO: 1137849 - RNA, 18 nt, Human
uagggcucuagggaguga

SEQ ID NO: 1137850 - RNA, 22 nt, Human
auaaacaguaaaugugagcagu

SEQ ID NO: 1137851 - RNA, 21 nt, Human
aauuacagauggaauuacaga

SEQ ID NO: 1137852 - RNA, 22 nt, Human
ccugggcuccacuccaagagca

SEQ ID NO: 1137853 - RNA, 22 nt, Human
uugcagcuucgagucuaucugu

SEQ ID NO: 1137854 - RNA, 22 nt, Human
guuaauuugcagcuuucgagcu

SEQ ID NO: 1137855 - RNA, 22 nt, Human
ccugccucccagagguccucua

SEQ ID NO: 1137856 - RNA, 22 nt, Human
agaggcuucucggauggggcag

SEQ ID NO: 1137857 - RNA, 22 nt, Human
gaugaagcuaaaucuaagguuu

SEQ ID NO: 1137858 - RNA, 22 nt, Human
aacccaggguggagguugcagu

SEQ ID NO: 1137859 - RNA, 22 nt, Human
ucucuuaaaggucuucagcuga

SEQ ID NO: 1137860 - RNA, 22 nt, Human
uuuucauuguuccucgagcauu

SEQ ID NO: 1137861 - RNA, 22 nt, Human
uuuugagauggugucucgcucc

SEQ ID NO: 1137862 - RNA, 22 nt, Human
gaauccaggguuguuugagcua

SEQ ID NO: 1137863 - RNA, 22 nt, Human
ucuccgaucacagguuuucaau

SEQ ID NO: 1137864 - RNA, 22 nt, Human
uuuauacuccacucugcaagcg

SEQ ID NO: 1137865 - RNA, 22 nt, Human
ugucaagucucugaaugaaaug

SEQ ID NO: 1137866 - RNA, 22 nt, Human
augugcaaauccaaugugaaug

SEQ ID NO: 1137867 - RNA, 22 nt, Human
ccacacuaaacugcucaaacca

SEQ ID NO: 1137868 - RNA, 22 nt, Human
caucacagaaauaaacauaccu

SEQ ID NO: 1137869 - RNA, 22 nt, Human
aaaauccucuaauucuagaaua

SEQ ID NO: 1137870 - RNA, 22 nt, Human
ugggacucacucuuuuggccag

SEQ ID NO: 1137871 - RNA, 22 nt, Human
agauacaaaagauaagauuuag

SEQ ID NO: 1137872 - RNA, 22 nt, Human
cucuuaaagcuuccaguuucaa

SEQ ID NO: 1137873 - RNA, 22 nt, Human
uaggccauucuuggagcuuacu

SEQ ID NO: 1137874 - RNA, 22 nt, Human
uuucacaagacagcuacuguug

SEQ ID NO: 1137875 - RNA, 22 nt, Human
cagaggcauacucccagucuug

SEQ ID NO: 1137876 - RNA, 22 nt, Human
guggcagugaaggucauagcau

SEQ ID NO: 1137877 - RNA, 22 nt, Human
ccuggcagguggagguugcagu

SEQ ID NO: 1137878 - RNA, 22 nt, Human
acuggcagguccaucgcccuuu

SEQ ID NO: 1137879 - RNA, 22 nt, Human
cccugcagaccaaugccauaga

SEQ ID NO: 1137880 - RNA, 22 nt, Human
aagggcucugggcuacgcacug

SEQ ID NO: 1137881 - RNA, 22 nt, Human
acacucacccucccacugccug

SEQ ID NO: 1137882 - RNA, 22 nt, Human
augcagcugugggcaagaaaug

SEQ ID NO: 1137883 - RNA, 22 nt, Human
agagacaggguuuugucguguu

SEQ ID NO: 1137884 - RNA, 22 nt, Human
uuucaugauuaacuuagugaau

SEQ ID NO: 1137885 - RNA, 22 nt, Human
cccaggcagucuggcucuaaag

SEQ ID NO: 1137886 - RNA, 22 nt, Human
cagcuuuauugagguauaauug

SEQ ID NO: 1137887 - RNA, 22 nt, Human
guuucgucaggcuuauucuauc

SEQ ID NO: 1137888 - RNA, 22 nt, Human
ugcaggcugcuggcaguagcuu

SEQ ID NO: 1137889 - RNA, 22 nt, Human
aagggcucugugcuugucccau

SEQ ID NO: 1137890 - RNA, 22 nt, Human
gggcaaaaccugggcaucauga

SEQ ID NO: 1137891 - RNA, 22 nt, Human
ccuggcagggcugcaguaaugg

SEQ ID NO: 1137892 - RNA, 22 nt, Human
agaggcuuggaggugcaagguu

SEQ ID NO: 1137893 - RNA, 22 nt, Human
ucagagaguuacacaaauuguu

SEQ ID NO: 1137894 - RNA, 20 nt, Human
ucacuguaauugccuacauu

SEQ ID NO: 1137895 - RNA, 22 nt, Human
uccaggagaggccugaccaggu

SEQ ID NO: 1137896 - RNA, 22 nt, Human
ggcggguguaaguaggacagcg

SEQ ID NO: 1137897 - RNA, 22 nt, Human
cccaggcagugcugaucccuca

SEQ ID NO: 1137898 - RNA, 22 nt, Human
agagucccagggacacuccaga

SEQ ID NO: 1137899 - RNA, 22 nt, Human
gcugggcugcgucggggaagcc

SEQ ID NO: 1137900 - RNA, 20 nt, Human
agcauuugaaauaugacuau

SEQ ID NO: 1137901 - RNA, 22 nt, Human
acagguggcuuauuggcugauu

SEQ ID NO: 1137902 - RNA, 22 nt, Human
cugagggucaacuugauuguau

SEQ ID NO: 1137903 - RNA, 18 nt, Human
cuccuccacagccccugc

SEQ ID NO: 1137904 - RNA, 22 nt, Human
cagauuuagaguggggcuugga

SEQ ID NO: 1137905 - RNA, 21 nt, Human
aggcugcuggcucaggguccu

SEQ ID NO: 1137906 - RNA, 22 nt, Human
gccuggcacaguagggacccaa

SEQ ID NO: 1137907 - RNA, 22 nt, Human
acauuuagaguucuuuacucca

SEQ ID NO: 1137908 - RNA, 22 nt, Human
aagcuuuaaggaauuuuaugga

SEQ ID NO: 1137909 - RNA, 22 nt, Human
ucacaggcuugugaacauugca

SEQ ID NO: 1137910 - RNA, 22 nt, Human
caggacugauguuccuccagcc

SEQ ID NO: 1137911 - RNA, 22 nt, Human
aggcuuuggggcauucuguguu

SEQ ID NO: 1137912 - RNA, 22 nt, Human
ucacauaaauuauacaauuuca

SEQ ID NO: 1137913 - RNA, 22 nt, Human
acaggcucgugcgcgcacgugu

SEQ ID NO: 1137914 - RNA, 20 nt, Human
auacacaugcagacagaugc

SEQ ID NO: 1137915 - RNA, 22 nt, Human
ugagugugcagggaaguggcgg

SEQ ID NO: 1137916 - RNA, 22 nt, Human
auugcuuaucuaucuuuaaguc

SEQ ID NO: 1137917 - RNA, 22 nt, Human
ucaggcucuacacuugacacac

SEQ ID NO: 1137918 - RNA, 22 nt, Human
acugauacgguuuuagagucca

SEQ ID NO: 1137919 - RNA, 22 nt, Human
cacauaagaaaugaauaugaga

SEQ ID NO: 1137920 - RNA, 22 nt, Human
cuguaugaaauugucauuuuua

SEQ ID NO: 1137921 - RNA, 22 nt, Human
cuguaugauuccauuucuauaa

SEQ ID NO: 1137922 - RNA, 22 nt, Human
ucuuccagaaugcauucucuuu

SEQ ID NO: 1137923 - RNA, 22 nt, Human
aaacaccagucccaguauacac

SEQ ID NO: 1137924 - RNA, 22 nt, Human
ugcauguuaagaaaauauugag

SEQ ID NO: 1137925 - RNA, 22 nt, Human
cagggacccuacuagcucacac

SEQ ID NO: 1137926 - RNA, 22 nt, Human
auauuaggugcucaauacaugc

SEQ ID NO: 1137927 - RNA, 22 nt, Human
aagaugcagcuuuacaauaagg

SEQ ID NO: 1137928 - RNA, 21 nt, Human
uccugcagaaugccuuccuac

SEQ ID NO: 1137929 - RNA, 22 nt, Human
ucugucaauauaugugcugcag

SEQ ID NO: 1137930 - RNA, 22 nt, Human
cacauacuuguguguacauaug

SEQ ID NO: 1137931 - RNA, 22 nt, Human
gccuccuguuaugccaugugcc

SEQ ID NO: 1137932 - RNA, 22 nt, Human
uccugggguuuuggccgcagcu

SEQ ID NO: 1137933 - RNA, 22 nt, Human
uacacagacucuucaauucaga

SEQ ID NO: 1137934 - RNA, 22 nt, Human
uggacuggaaugcugauccucu

SEQ ID NO: 1137935 - RNA, 22 nt, Human
acaugauuuuaguaucauaaua

SEQ ID NO: 1137936 - RNA, 22 nt, Human
cauuuauugguuaggccagcag

SEQ ID NO: 1137937 - RNA, 20 nt, Human
gcuccccuucucugggccuc

SEQ ID NO: 1137938 - RNA, 21 nt, Human
uccugccuuaguccagagcag

SEQ ID NO: 1137939 - RNA, 22 nt, Human
cuccaguggcaaguccgggcgg

SEQ ID NO: 1137940 - RNA, 22 nt, Human
agcaaucaccaccucuauauuu

SEQ ID NO: 1137941 - RNA, 22 nt, Human
uuccaagugcccauauuucauc

SEQ ID NO: 1137942 - RNA, 22 nt, Human
gcuccuggguguggcugccccu

SEQ ID NO: 1137943 - RNA, 22 nt, Human
ggcagggaguggagacucccua

SEQ ID NO: 1137944 - RNA, 22 nt, Human
ucuuugaugugguuaauuauga

SEQ ID NO: 1137945 - RNA, 22 nt, Human
uuuuaccugaaccacacaguau

SEQ ID NO: 1137946 - RNA, 22 nt, Human
gcugccacauuuucaggacuaa

SEQ ID NO: 1137947 - RNA, 22 nt, Human
cagcuauuuucucauuaaggau

SEQ ID NO: 1137948 - RNA, 22 nt, Human
cugguggagagugggcucugga

SEQ ID NO: 1137949 - RNA, 22 nt, Human
ccugggcucacagccaaggcuc

SEQ ID NO: 1137950 - RNA, 22 nt, Human
uuaacauuguccuuagcagauu

SEQ ID NO: 1137951 - RNA, 21 nt, Human
gaugaagcaaucuuucuguug

SEQ ID NO: 1137952 - RNA, 22 nt, Human
gggcucucgauuagacccuggg

SEQ ID NO: 1137953 - RNA, 22 nt, Human
aauguaugacaguucuaguggu

SEQ ID NO: 1137954 - RNA, 22 nt, Human
caguaaaagauggaaauagaau

SEQ ID NO: 1137955 - RNA, 22 nt, Human
ugucagaggcucagggucucag

SEQ ID NO: 1137956 - RNA, 21 nt, Human
ucuggcaggcacgggcccagc

SEQ ID NO: 1137957 - RNA, 22 nt, Human
gggggcucugacucccucagcu

SEQ ID NO: 1137958 - RNA, 22 nt, Human
cacccacauuccaucacucugc

SEQ ID NO: 1137959 - RNA, 22 nt, Human
cauuguuaccaucuuuuaccua

SEQ ID NO: 1137960 - RNA, 22 nt, Human
ggggcuccagucuucacauuuu

SEQ ID NO: 1137961 - RNA, 23 nt, Human
cuguaugauguuaaguggaaagc

SEQ ID NO: 1137962 - RNA, 22 nt, Human
ucauuacaguguuuauaugucu

SEQ ID NO: 1137963 - RNA, 21 nt, Human
cauuagggcagaagcaggaag

SEQ ID NO: 1137964 - RNA, 22 nt, Human
ggagcugaguucuucagccggg

SEQ ID NO: 1137965 - RNA, 22 nt, Human
cuucuggguauuccagauaccu

SEQ ID NO: 1137966 - RNA, 22 nt, Human
acauaaugagcucuuuauaaau

SEQ ID NO: 1137967 - RNA, 22 nt, Human
uuccuggcauagagagggcaca

SEQ ID NO: 1137968 - RNA, 22 nt, Human
gugggcuuguuuugaugagauc

SEQ ID NO: 1137969 - RNA, 22 nt, Human
cacaggccugucucuuucuaac

SEQ ID NO: 1137970 - RNA, 22 nt, Human
ccaggcucaggugcgagagaca

SEQ ID NO: 1137971 - RNA, 22 nt, Human
cacaauuuuaauacacagucaa

SEQ ID NO: 1137972 - RNA, 22 nt, Human
cuggggacugaaggauguugcu

SEQ ID NO: 1137973 - RNA, 22 nt, Human
aaaauccuuagccgagugaggu

SEQ ID NO: 1137974 - RNA, 23 nt, Human
ugcaggcuaggaagagagccuuc

SEQ ID NO: 1137975 - RNA, 21 nt, Human
acagauauuucauugaacauu

SEQ ID NO: 1137976 - RNA, 22 nt, Human
ucagagaguuagugucuuagcu

SEQ ID NO: 1137977 - RNA, 22 nt, Human
ccuggcaggccccuccuggauu

SEQ ID NO: 1137978 - RNA, 22 nt, Human
aauacuauguagccaaaauaau

SEQ ID NO: 1137979 - RNA, 22 nt, Human
uuaaaacugcaaauccuacuga

SEQ ID NO: 1137980 - RNA, 22 nt, Human
gcuggcagguccaagauagagc

SEQ ID NO: 1137981 - RNA, 22 nt, Human
cccugcagaaccacagacaaac

SEQ ID NO: 1137982 - RNA, 22 nt, Human
ucugggcuuuuccaugccugug

SEQ ID NO: 1137983 - RNA, 22 nt, Human
guggcagguuccguagacagca

SEQ ID NO: 1137984 - RNA, 22 nt, Human
acaaauuuauugaagggcauau

SEQ ID NO: 1137985 - RNA, 22 nt, Human
agccaccuucuccaaggccuag

SEQ ID NO: 1137986 - RNA, 22 nt, Human
uaacacaugguucugucaggaa

SEQ ID NO: 1137987 - RNA, 22 nt, Human
uugugaaauguuucaaaauagu

SEQ ID NO: 1137988 - RNA, 22 nt, Human
caguguuugcuuaaguuauaug

SEQ ID NO: 1137989 - RNA, 17 nt, Human
uccaggcagcaacugag

SEQ ID NO: 1137990 - RNA, 22 nt, Human
uggcacaguccugggugccugc

SEQ ID NO: 1137991 - RNA, 22 nt, Human
gcagccucaaacuccccagcuc

SEQ ID NO: 1137992 - RNA, 22 nt, Human
ucaggcucaggaauguguuuau

SEQ ID NO: 1137993 - RNA, 22 nt, Human
cuggaaagugucuccauccugg

SEQ ID NO: 1137994 - RNA, 22 nt, Human
gggcuccaccuagggacacugg

SEQ ID NO: 1137995 - RNA, 22 nt, Human
aggcaggggagcuggaagggua

SEQ ID NO: 1137996 - RNA, 22 nt, Human
ucugcagaauucgaggaagaaa

SEQ ID NO: 1137997 - RNA, 22 nt, Human
caugaagcacagcucucuuuuu

SEQ ID NO: 1137998 - RNA, 22 nt, Human
aagcuuuagagaugaguuccuu

SEQ ID NO: 1137999 - RNA, 22 nt, Human
acagcucuguugccagaucugc

SEQ ID NO: 1138000 - RNA, 22 nt, Human
cuggaucuguuugugcuugugg

SEQ ID NO: 1138001 - RNA, 22 nt, Human
ucccagccuuucuuuucugcug

SEQ ID NO: 1138002 - RNA, 23 nt, Human
ucugcagacgcuguucuauuguc

SEQ ID NO: 1138003 - RNA, 22 nt, Human
aaaauauuuuagggccaggaga

SEQ ID NO: 1138004 - RNA, 22 nt, Human
guccuggcaccucacuggcuac

SEQ ID NO: 1138005 - RNA, 22 nt, Human
caugaagcauguuuugucauga

SEQ ID NO: 1138006 - RNA, 22 nt, Human
ucaucacauguguagucauccc

SEQ ID NO: 1138007 - RNA, 22 nt, Human
cacugucccuguuuccuggaaa

SEQ ID NO: 1138008 - RNA, 22 nt, Human
cagcauuuucuuaauguaggug

SEQ ID NO: 1138009 - RNA, 20 nt, Human
uccaggcagacagcuauggg

SEQ ID NO: 1138010 - RNA, 22 nt, Human
uggccaggaggcugcuucugac

SEQ ID NO: 1138011 - RNA, 22 nt, Human
gaaucauuuagcucugcaugga

SEQ ID NO: 1138012 - RNA, 22 nt, Human
uaacacauauuugcaguaagca

SEQ ID NO: 1138013 - RNA, 22 nt, Human
uccagaccauggauggcugcaa

SEQ ID NO: 1138014 - RNA, 22 nt, Human
cagguuggucggcaaguacaca

SEQ ID NO: 1138015 - RNA, 20 nt, Human
uucaugggagcaaagaggcc

SEQ ID NO: 1138016 - RNA, 22 nt, Human
gguuucaaaguggacaguuagu

SEQ ID NO: 1138017 - RNA, 22 nt, Human
uuuuucauauuccccucucugg

SEQ ID NO: 1138018 - RNA, 22 nt, Human
agacaaguucugugggucaccu

SEQ ID NO: 1138019 - RNA, 22 nt, Human
cuccugcaagccuccccaagca

SEQ ID NO: 1138020 - RNA, 22 nt, Human
uacauugcuuucuaauacaucu

SEQ ID NO: 1138021 - RNA, 17 nt, Human
gcccacccuuaggagcu

SEQ ID NO: 1138022 - RNA, 22 nt, Human
cauguacaaaaggcaaaugccu

SEQ ID NO: 1138023 - RNA, 22 nt, Human
cugggccugucagggcuuuuug

SEQ ID NO: 1138024 - RNA, 22 nt, Human
cacucuccagcacaccccauuu

SEQ ID NO: 1138025 - RNA, 22 nt, Human
auuuuccucaagccucuggaag

SEQ ID NO: 1138026 - RNA, 22 nt, Human
aaauuucuguuguuuugagcca

SEQ ID NO: 1138027 - RNA, 22 nt, Human
aaaguucuuucucuuauuuggu

SEQ ID NO: 1138028 - RNA, 22 nt, Human
ugaccugcagucaagaggggaa

SEQ ID NO: 1138029 - RNA, 22 nt, Human
uagaauucaagauucaacaggc

SEQ ID NO: 1138030 - RNA, 22 nt, Human
uggcuaggaauccaugacucuc

SEQ ID NO: 1138031 - RNA, 22 nt, Human
ggcagggaagcuggcaucacgg

SEQ ID NO: 1138032 - RNA, 19 nt, Human
auauauguauacaaugugg

SEQ ID NO: 1138033 - RNA, 22 nt, Human
uccugcagguggaugauucucu

SEQ ID NO: 1138034 - RNA, 22 nt, Human
gguuccuucugaggucccugua

SEQ ID NO: 1138035 - RNA, 22 nt, Human
guucacaagaguuacagacaga

SEQ ID NO: 1138036 - RNA, 22 nt, Human
uacauguuugguaaaugauggc

SEQ ID NO: 1138037 - RNA, 22 nt, Human
uguuuauuacaguucuuggaau

SEQ ID NO: 1138038 - RNA, 22 nt, Human
cuguccagcuuggcuccugggg

SEQ ID NO: 1138039 - RNA, 22 nt, Human
uuucugaaaucucuuuugagga

SEQ ID NO: 1138040 - RNA, 22 nt, Human
cacccagcacagagggaggcga

SEQ ID NO: 1138041 - RNA, 22 nt, Human
gcuggcagggacagcugcgugu

SEQ ID NO: 1138042 - RNA, 22 nt, Human
gcacauacugcaaagauuacua

SEQ ID NO: 1138043 - RNA, 22 nt, Human
ucugggcuuuaguuuguuaucu

SEQ ID NO: 1138044 - RNA, 22 nt, Human
ccagcuuuggaguguuguugcu

SEQ ID NO: 1138045 - RNA, 22 nt, Human
uuccaaguagaagcauuugcau

SEQ ID NO: 1138046 - RNA, 22 nt, Human
uugugaaacauucauggauuug

SEQ ID NO: 1138047 - RNA, 22 nt, Human
guccaggucuggacccugagcc

SEQ ID NO: 1138048 - RNA, 22 nt, Human
uugguuccuucugaaaguauug

SEQ ID NO: 1138049 - RNA, 22 nt, Human
gagcuuuaagggcacuggucuu

SEQ ID NO: 1138050 - RNA, 20 nt, Human
acuggcagccugccugcugu

SEQ ID NO: 1138051 - RNA, 22 nt, Human
ucacacacauuugcugucugau

SEQ ID NO: 1138052 - RNA, 22 nt, Human
acagagagaaacaaucagcagc

SEQ ID NO: 1138053 - RNA, 22 nt, Human
ugcuucuguauugaaauuguua

SEQ ID NO: 1138054 - RNA, 22 nt, Human
caugaaugcuggguucauguaa

SEQ ID NO: 1138055 - RNA, 22 nt, Human
uuguaaacugcugcaggagugc

SEQ ID NO: 1138056 - RNA, 22 nt, Human
uggcaguggauaggggagcggu

SEQ ID NO: 1138057 - RNA, 22 nt, Human
guguaugagccuccagcugggc

SEQ ID NO: 1138058 - RNA, 22 nt, Human
cacauaauacauguuccacuua

SEQ ID NO: 1138059 - RNA, 22 nt, Human
ucaaggagcccacagucuaaug

SEQ ID NO: 1138060 - RNA, 22 nt, Human
aagggcucucugcauugaaauu

SEQ ID NO: 1138061 - RNA, 22 nt, Human
cccagcuugucugauucagccu

SEQ ID NO: 1138062 - RNA, 22 nt, Human
ugaccugcguaggugguuucug

SEQ ID NO: 1138063 - RNA, 19 nt, Human
ccaggccuccugggagguc

SEQ ID NO: 1138064 - RNA, 22 nt, Human
cucuccaggacuuuggcccaau

SEQ ID NO: 1138065 - RNA, 17 nt, Human
cccaggccgccgggagc

SEQ ID NO: 1138066 - RNA, 22 nt, Human
ucauuguuucugcuuuucauga

SEQ ID NO: 1138067 - RNA, 22 nt, Human
gaaaacacuuugaucugaaagu

SEQ ID NO: 1138068 - RNA, 22 nt, Human
caggcccucaggcaagggcucu

SEQ ID NO: 1138069 - RNA, 22 nt, Human
ucuggcagagauauccauccca

SEQ ID NO: 1138070 - RNA, 22 nt, Human
ggcucugcagugacuugagggg

SEQ ID NO: 1138071 - RNA, 22 nt, Human
uccaggccauugacugcauccu

SEQ ID NO: 1138072 - RNA, 22 nt, Human
gaacacaucacauuuuacagug

SEQ ID NO: 1138073 - RNA, 22 nt, Human
uucacuuaacaucauaucauga

SEQ ID NO: 1138074 - RNA, 22 nt, Human
ucuggggaugaggaccuagaug

SEQ ID NO: 1138075 - RNA, 21 nt, Human
acacacugaguuuuccacugu

SEQ ID NO: 1138076 - RNA, 22 nt, Human
ccaggccuagccccugagggua

SEQ ID NO: 1138077 - RNA, 22 nt, Human
uaugucaaaguuaagaaauagg

SEQ ID NO: 1138078 - RNA, 22 nt, Human
aauuagggagagguagcuaggu

SEQ ID NO: 1138079 - RNA, 22 nt, Human
cagguggccaguacucaaggau

SEQ ID NO: 1138080 - RNA, 22 nt, Human
ucauuuguaccauuuuuuaaga

SEQ ID NO: 1138081 - RNA, 22 nt, Human
uaauuuuaacugugcuguuugg

SEQ ID NO: 1138082 - RNA, 22 nt, Human
gcaggcucguuggaaguccccu

SEQ ID NO: 1138083 - RNA, 22 nt, Human
aauacugccugugagguaacuc

SEQ ID NO: 1138084 - RNA, 22 nt, Human
aaaccaucagauaauucauacu

SEQ ID NO: 1138085 - RNA, 22 nt, Human
cagugaggaguccagggcagag

SEQ ID NO: 1138086 - RNA, 22 nt, Human
ugcaggcuggcagugcugaaau

SEQ ID NO: 1138087 - RNA, 22 nt, Human
ccaggccugcaucugcugcgca

SEQ ID NO: 1138088 - RNA, 22 nt, Human
uucugucacuuaggaggucaua

SEQ ID NO: 1138089 - RNA, 22 nt, Human
ugcuucugacugggucaguuga

SEQ ID NO: 1138090 - RNA, 22 nt, Human
guggggacgggauggcucacug

SEQ ID NO: 1138091 - RNA, 22 nt, Human
ucuuuauuuuaugcuugugcaa

SEQ ID NO: 1138092 - RNA, 22 nt, Human
ugaaugauguauaauauugaga

SEQ ID NO: 1138093 - RNA, 18 nt, Human
cucucuuuccacucuuug

SEQ ID NO: 1138094 - RNA, 22 nt, Human
cacacacucuuccuggcaccua

SEQ ID NO: 1138095 - RNA, 19 nt, Human
cccucuugcacaaagcaaa

SEQ ID NO: 1138096 - RNA, 22 nt, Human
gguguugggcucacugguccuu

SEQ ID NO: 1138097 - RNA, 22 nt, Human
uggcagugucuuaucaggagug

SEQ ID NO: 1138098 - RNA, 22 nt, Human
uuagggaaggcugcugucagcu

SEQ ID NO: 1138099 - RNA, 22 nt, Human
cauuuguauguuccuccuuagg

SEQ ID NO: 1138100 - RNA, 18 nt, Human
agcagguggcgucugcag

SEQ ID NO: 1138101 - RNA, 22 nt, Human
gcacccagcccagggcgugaug

SEQ ID NO: 1138102 - RNA, 22 nt, Human
uaauaguugugacuuuguaaag

SEQ ID NO: 1138103 - RNA, 22 nt, Human
agggccccauagucacugcccg

SEQ ID NO: 1138104 - RNA, 22 nt, Human
ugcagggaauccagucuagggu

SEQ ID NO: 1138105 - RNA, 22 nt, Human
gcagggguuuucugacuugagu

SEQ ID NO: 1138106 - RNA, 22 nt, Human
cagagcauaauugacaugaggu

SEQ ID NO: 1138107 - RNA, 22 nt, Human
ucuggcagaggaaggaggccug

SEQ ID NO: 1138108 - RNA, 22 nt, Human
cacacaguaggcacucauuaau

SEQ ID NO: 1138109 - RNA, 22 nt, Human
aauuucuccaagaaugcuuaga

SEQ ID NO: 1138110 - RNA, 22 nt, Human
acaaauccagugaacuccagug

SEQ ID NO: 1138111 - RNA, 19 nt, Human
cacacccaugcuugccaag

SEQ ID NO: 1138112 - RNA, 22 nt, Human
cacaaaaguaggaggcaggcgg

SEQ ID NO: 1138113 - RNA, 22 nt, Human
cuacauaaauauuuaugugucu

SEQ ID NO: 1138114 - RNA, 22 nt, Human
cuuccaagaugaacagcaagcg

SEQ ID NO: 1138115 - RNA, 22 nt, Human
gaauuucuggacccuuugagaa

SEQ ID NO: 1138116 - RNA, 22 nt, Human
gggaccugaggcccugcuccac

SEQ ID NO: 1138117 - RNA, 22 nt, Human
uucauacaaugggauauuauga

SEQ ID NO: 1138118 - RNA, 22 nt, Human
cucccaagauaaauaaggcagu

SEQ ID NO: 1138119 - RNA, 22 nt, Human
gguuucaaauuaaagucuuaag

SEQ ID NO: 1138120 - RNA, 22 nt, Human
cuccugaggaaaagcuugguca

SEQ ID NO: 1138121 - RNA, 22 nt, Human
cagcuuugccaaguaaggucuu

SEQ ID NO: 1138122 - RNA, 22 nt, Human
ucuggggagucaaagagaccug

SEQ ID NO: 1138123 - RNA, 22 nt, Human
uggcagagaacacggcugaucu

SEQ ID NO: 1138124 - RNA, 22 nt, Human
aagguuaaauagguauuuucca

SEQ ID NO: 1138125 - RNA, 22 nt, Human
agauuucucuuucccuggcuga

SEQ ID NO: 1138126 - RNA, 22 nt, Human
auuaagggccaauccuccagcc

SEQ ID NO: 1138127 - RNA, 22 nt, Human
agcacugugauuuauaacauuu

SEQ ID NO: 1138128 - RNA, 22 nt, Human
ccugggcuuuggaacaguacuu

SEQ ID NO: 1138129 - RNA, 22 nt, Human
cagcucuggguaggaggaaucu

SEQ ID NO: 1138130 - RNA, 22 nt, Human
aaacacaucauucaugucguca

SEQ ID NO: 1138131 - RNA, 22 nt, Human
uuguaaauaguaguaagaugcc

SEQ ID NO: 1138132 - RNA, 22 nt, Human
cccagggaagggcuaccugagg

SEQ ID NO: 1138133 - RNA, 22 nt, Human
guagggacuguucucaccugag

SEQ ID NO: 1138134 - RNA, 22 nt, Human
uuagggacaaauuugcagaacc

SEQ ID NO: 1138135 - RNA, 22 nt, Human
aucaguuauuuuuaagcuauaa

SEQ ID NO: 1138136 - RNA, 22 nt, Human
uugaaaaaauugguagaggaug

SEQ ID NO: 1138137 - RNA, 22 nt, Human
ggcaggcuugauauggggggac

SEQ ID NO: 1138138 - RNA, 22 nt, Human
acaggccugagauuuugcauuu

SEQ ID NO: 1138139 - RNA, 22 nt, Human
uaugacuuauuucaucaguucu

SEQ ID NO: 1138140 - RNA, 22 nt, Human
auuauaaagaacaugugugugg

SEQ ID NO: 1138141 - RNA, 21 nt, Human
uucaaaguuugccuaaagauu

SEQ ID NO: 1138142 - RNA, 22 nt, Human
gcuggcagggugguugagagag

SEQ ID NO: 1138143 - RNA, 22 nt, Human
ucucacagugcaggucugucuc

SEQ ID NO: 1138144 - RNA, 22 nt, Human
cauaauuucacugucguauggc

SEQ ID NO: 1138145 - RNA, 22 nt, Human
gggcuaggcuuggccagcacug

SEQ ID NO: 1138146 - RNA, 19 nt, Human
acuggcaguuucugcaugg

SEQ ID NO: 1138147 - RNA, 22 nt, Human
cugggcuguuuguucuggucuc

SEQ ID NO: 1138148 - RNA, 22 nt, Human
caccugcagggggagucaagag

SEQ ID NO: 1138149 - RNA, 22 nt, Human
ccuggcagaaagaguuacaccu

SEQ ID NO: 1138150 - RNA, 22 nt, Human
aucuccagauugugaucaucag

SEQ ID NO: 1138151 - RNA, 22 nt, Human
uucugucauuuagcauugucau

SEQ ID NO: 1138152 - RNA, 22 nt, Human
uguauaaaccauggacagcuuu

SEQ ID NO: 1138153 - RNA, 22 nt, Human
cuaaaauuaucaagauaauucc

SEQ ID NO: 1138154 - RNA, 20 nt, Human
cccacacccuucccacuugg

SEQ ID NO: 1138155 - RNA, 23 nt, Human
ggacacauuuauuucagaauuca

SEQ ID NO: 1138156 - RNA, 22 nt, Human
ucugucaucucuaaaauagaaa

SEQ ID NO: 1138157 - RNA, 22 nt, Human
ccagcuuucugggugguuucug

SEQ ID NO: 1138158 - RNA, 22 nt, Human
ucaggcucccugcugggcucug

SEQ ID NO: 1138159 - RNA, 22 nt, Human
uccaggcaaagccuuguagacg

SEQ ID NO: 1138160 - RNA, 22 nt, Human
acauacacaugaauauauuuuu

SEQ ID NO: 1138161 - RNA, 22 nt, Human
ugcuuuaucugacuuggcgcug

SEQ ID NO: 1138162 - RNA, 22 nt, Human
acaucuucacugguuucuggaa

SEQ ID NO: 1138163 - RNA, 22 nt, Human
cagcuuuguggccuugaccucg

SEQ ID NO: 1138164 - RNA, 22 nt, Human
ccaggcuccgcauagaccccac

SEQ ID NO: 1138165 - RNA, 22 nt, Human
uggccaggcuggucuggaacgc

SEQ ID NO: 1138166 - RNA, 22 nt, Human
uguguuuugaacucaucuacug

SEQ ID NO: 1138167 - RNA, 22 nt, Human
augggcuggggaagcucacucc

SEQ ID NO: 1138168 - RNA, 22 nt, Human
cugggcuggauaauucuuugcu

SEQ ID NO: 1138169 - RNA, 22 nt, Human
uuuaaaaaacuagucugagucu

SEQ ID NO: 1138170 - RNA, 22 nt, Human
guccucugggcuuugagcaguc

SEQ ID NO: 1138171 - RNA, 22 nt, Human
ggcuccaaagggcagugugagg

SEQ ID NO: 1138172 - RNA, 22 nt, Human
ucagcuuuuuacaugugaaaua

SEQ ID NO: 1138173 - RNA, 22 nt, Human
caacuuuaugauugguuuguca

SEQ ID NO: 1138174 - RNA, 22 nt, Human
uagucaaaccucagaauacccc

SEQ ID NO: 1138175 - RNA, 22 nt, Human
ugcagggacaggcucuggggau

SEQ ID NO: 1138176 - RNA, 22 nt, Human
cagcauuuggugaucaucuuaa

SEQ ID NO: 1138177 - RNA, 19 nt, Human
gcuggggaauggauauuga

SEQ ID NO: 1138178 - RNA, 22 nt, Human
acagauuuuaaaugacacuccc

SEQ ID NO: 1138179 - RNA, 22 nt, Human
gaaauauuacaguggaggggau

SEQ ID NO: 1138180 - RNA, 20 nt, Human
uggccucugagaugccacgg

SEQ ID NO: 1138181 - RNA, 19 nt, Human
cuuuucaucaacagccaau

SEQ ID NO: 1138182 - RNA, 20 nt, Human
ccaggccugggccugcucua

SEQ ID NO: 1138183 - RNA, 22 nt, Human
uucugggggccaggacaguggu

SEQ ID NO: 1138184 - RNA, 22 nt, Human
aacuuucaggcaaugaauauuu

SEQ ID NO: 1138185 - RNA, 23 nt, Human
caggacaugggaggaaguauggc

SEQ ID NO: 1138186 - RNA, 22 nt, Human
gccagguugcugacgacgaucu

SEQ ID NO: 1138187 - RNA, 22 nt, Human
auuuucaucauggguuuaacau

SEQ ID NO: 1138188 - RNA, 22 nt, Human
cuaugagaagaaaacaagauua

SEQ ID NO: 1138189 - RNA, 22 nt, Human
uuaguuagucccugguaccuuu

SEQ ID NO: 1138190 - RNA, 22 nt, Human
ccugccugucuuuauccccugu

SEQ ID NO: 1138191 - RNA, 22 nt, Human
ucuuugaaguugaaguaguugg

SEQ ID NO: 1138192 - RNA, 22 nt, Human
aagcuuuaugacuuggagacag

SEQ ID NO: 1138193 - RNA, 19 nt, Human
ccaaaagcaauuccaagua

SEQ ID NO: 1138194 - RNA, 22 nt, Human
aucuguuccccuaugcucucua

SEQ ID NO: 1138195 - RNA, 22 nt, Human
ugcaggcugcagucucaggugg

SEQ ID NO: 1138196 - RNA, 22 nt, Human
acagagagaggcccgaggcugc

SEQ ID NO: 1138197 - RNA, 22 nt, Human
uguagaaauuaguaagaucaac

SEQ ID NO: 1138198 - RNA, 19 nt, Human
cacaucagcagggcugugg

SEQ ID NO: 1138199 - RNA, 22 nt, Human
ucuugggauagugucucauggc

SEQ ID NO: 1138200 - RNA, 22 nt, Human
ggggcugagaauucagucucgg

SEQ ID NO: 1138201 - RNA, 22 nt, Human
gcuggcaguaaaggguuuggca

SEQ ID NO: 1138202 - RNA, 22 nt, Human
ccugccuguacuagagacccag

SEQ ID NO: 1138203 - RNA, 22 nt, Human
uggcagagagacucuccuugau

SEQ ID NO: 1138204 - RNA, 22 nt, Human
cagccucuuuccacaucaggca

SEQ ID NO: 1138205 - RNA, 22 nt, Human
agaggccuccgaaaggugggcu

SEQ ID NO: 1138206 - RNA, 22 nt, Human
cuuagggaauugggaggaugcc

SEQ ID NO: 1138207 - RNA, 22 nt, Human
agcaggugggaucaagcuggca

SEQ ID NO: 1138208 - RNA, 22 nt, Human
caggcugccuggaagaggacug

SEQ ID NO: 1138209 - RNA, 21 nt, Human
ccuggcagaagccugauaugc

SEQ ID NO: 1138210 - RNA, 22 nt, Human
auagauauuugaguuguuucca

SEQ ID NO: 1138211 - RNA, 22 nt, Human
ugucagagcaaugagguucagc

SEQ ID NO: 1138212 - RNA, 22 nt, Human
uccccaccccagaacuacuagg

SEQ ID NO: 1138213 - RNA, 22 nt, Human
cacccagcauuggcuaagagag

SEQ ID NO: 1138214 - RNA, 22 nt, Human
ugggcuucuggaguggggcaga

SEQ ID NO: 1138215 - RNA, 22 nt, Human
cuuccuccgaagaaguugcugg

SEQ ID NO: 1138216 - RNA, 22 nt, Human
ugcaggcucugugugugccugg

SEQ ID NO: 1138217 - RNA, 22 nt, Human
acacucuguaaugucacacucc

SEQ ID NO: 1138218 - RNA, 22 nt, Human
aagggcucugcugucucucccc

SEQ ID NO: 1138219 - RNA, 22 nt, Human
uugcagcuuagugauguuaucu

SEQ ID NO: 1138220 - RNA, 21 nt, Human
caguguggugaccagggucuc

SEQ ID NO: 1138221 - RNA, 22 nt, Human
uaugaacuguacuguacuaagc

SEQ ID NO: 1138222 - RNA, 22 nt, Human
agcuuuaugaggagaccuuagu

SEQ ID NO: 1138223 - RNA, 23 nt, Human
uugggcuggcucucgaugccucu

SEQ ID NO: 1138224 - RNA, 22 nt, Human
acaggcucaguucacuggauuu

SEQ ID NO: 1138225 - RNA, 22 nt, Human
uauaauuuggggaaaguggugu

SEQ ID NO: 1138226 - RNA, 22 nt, Human
uuuagacauggcuugcucacuu

SEQ ID NO: 1138227 - RNA, 22 nt, Human
ggcuuuauuuugcaugaaugcu

SEQ ID NO: 1138228 - RNA, 22 nt, Human
agugccccaugggugccugggg

SEQ ID NO: 1138229 - RNA, 22 nt, Human
ccuggcagacugugagggcagg

SEQ ID NO: 1138230 - RNA, 22 nt, Human
ucacacaugcuaagccagagau

SEQ ID NO: 1138231 - RNA, 22 nt, Human
cuuccucccggcccaugcucug

SEQ ID NO: 1138232 - RNA, 22 nt, Human
guaaaauucuagcaucugaaag

SEQ ID NO: 1138233 - RNA, 22 nt, Human
aauuaguaaccuaauuccaucu

SEQ ID NO: 1138234 - RNA, 22 nt, Human
ccugggcuuugcuggcaaggcc

SEQ ID NO: 1138235 - RNA, 22 nt, Human
cccaggcagccccagaagcuug

SEQ ID NO: 1138236 - RNA, 22 nt, Human
ugagagucucagaccuccuggu

SEQ ID NO: 1138237 - RNA, 22 nt, Human
agggccucugacgcccccagcc

SEQ ID NO: 1138238 - RNA, 22 nt, Human
cuauugaauuaacuauuaaagu

SEQ ID NO: 1138239 - RNA, 22 nt, Human
uuauuagguuuacauaaagguu

SEQ ID NO: 1138240 - RNA, 22 nt, Human
cccugcagccggccagcucauu

SEQ ID NO: 1138241 - RNA, 22 nt, Human
uagcuuuaccauagaagaguau

SEQ ID NO: 1138242 - RNA, 22 nt, Human
aauaacuuaagaaauuucccca

SEQ ID NO: 1138243 - RNA, 22 nt, Human
guuuuauaauugcuucauaaga

SEQ ID NO: 1138244 - RNA, 22 nt, Human
ugcuucugacuaagcugcauga

SEQ ID NO: 1138245 - RNA, 22 nt, Human
caaauaguaugagcaaugauuc

SEQ ID NO: 1138246 - RNA, 22 nt, Human
cuuaauuuaagccuagaaugca

SEQ ID NO: 1138247 - RNA, 22 nt, Human
ugcuccagugccugccccacag

SEQ ID NO: 1138248 - RNA, 22 nt, Human
cauucccacguguucuuugcuu

SEQ ID NO: 1138249 - RNA, 22 nt, Human
gaccucagugaauggucaugua

SEQ ID NO: 1138250 - RNA, 23 nt, Human
uagaaugucauucaaugauaugg

SEQ ID NO: 1138251 - RNA, 22 nt, Human
cucuggggaagcagccagcugg

SEQ ID NO: 1138252 - RNA, 20 nt, Human
guggcaggcagugaaggagc

SEQ ID NO: 1138253 - RNA, 20 nt, Human
cagagaccaggccagguguc

SEQ ID NO: 1138254 - RNA, 18 nt, Human
gcuuuauuucuuggggaa

SEQ ID NO: 1138255 - RNA, 22 nt, Human
ucuccaagaaaagaucucagcu

SEQ ID NO: 1138256 - RNA, 22 nt, Human
augggcugugagguccggcagg

SEQ ID NO: 1138257 - RNA, 22 nt, Human
uuacauuuugggguaaggauaa

SEQ ID NO: 1138258 - RNA, 22 nt, Human
cagucucucuuguagugcagcu

SEQ ID NO: 1138259 - RNA, 22 nt, Human
guccucuggugaaagcauuccc

SEQ ID NO: 1138260 - RNA, 22 nt, Human
ccaggaccuggagcucuaugaa

SEQ ID NO: 1138261 - RNA, 22 nt, Human
cucagagaaccuaagcggagga

SEQ ID NO: 1138262 - RNA, 22 nt, Human
uuugaaaagaaccaucgccuua

SEQ ID NO: 1138263 - RNA, 22 nt, Human
uugucaaguaaggcugacauuu

SEQ ID NO: 1138264 - RNA, 22 nt, Human
ucuucauauauaaaguggaaua

SEQ ID NO: 1138265 - RNA, 22 nt, Human
gcagcuuuggagguggaacucu

SEQ ID NO: 1138266 - RNA, 20 nt, Human
uuuacauuuugaaacaguga

SEQ ID NO: 1138267 - RNA, 22 nt, Human
cacacacuguuaauguaggagu

SEQ ID NO: 1138268 - RNA, 22 nt, Human
ucugggcugaaaugaaggccuu

SEQ ID NO: 1138269 - RNA, 17 nt, Human
gccugcaggcccgcaga

SEQ ID NO: 1138270 - RNA, 22 nt, Human
uccugcagcucugagaagcauc

SEQ ID NO: 1138271 - RNA, 22 nt, Human
guaugaaggcgagagcccacua

SEQ ID NO: 1138272 - RNA, 22 nt, Human
ucacauacacuaggauauuuuu

SEQ ID NO: 1138273 - RNA, 18 nt, Human
uguagagccagguuugcc

SEQ ID NO: 1138274 - RNA, 22 nt, Human
uucagagaagcaaaggcagauu

SEQ ID NO: 1138275 - RNA, 22 nt, Human
agauauauuuaagguaauaagu

SEQ ID NO: 1138276 - RNA, 22 nt, Human
acagcucuguguauugucaucu

SEQ ID NO: 1138277 - RNA, 22 nt, Human
cagugagguggauggauggccu

SEQ ID NO: 1138278 - RNA, 22 nt, Human
cauuuacuuaaaucuuuacaag

SEQ ID NO: 1138279 - RNA, 22 nt, Human
accaggcagucaccguccagga

SEQ ID NO: 1138280 - RNA, 22 nt, Human
ugcuuuauuaagagagaaauuu

SEQ ID NO: 1138281 - RNA, 22 nt, Human
cucagcucugacaggaggcauc

SEQ ID NO: 1138282 - RNA, 22 nt, Human
ucauuuguugaacuuuagugcg

SEQ ID NO: 1138283 - RNA, 22 nt, Human
acagguggggcacuuggagccu

SEQ ID NO: 1138284 - RNA, 23 nt, Human
auguuauuauuagcagucuugcc

SEQ ID NO: 1138285 - RNA, 22 nt, Human
ggcuucuguccucuggaucugu

SEQ ID NO: 1138286 - RNA, 23 nt, Human
ucacauaauccuucauccacagg

SEQ ID NO: 1138287 - RNA, 21 nt, Human
uccugcaggaggccugagagg

SEQ ID NO: 1138288 - RNA, 20 nt, Human
ggcugcaggacucauuggcu

SEQ ID NO: 1138289 - RNA, 22 nt, Human
ccuggggaaucuugcaggggaa

SEQ ID NO: 1138290 - RNA, 22 nt, Human
acacagaugcauuacacaucua

SEQ ID NO: 1138291 - RNA, 22 nt, Human
gaggagcugagccacguccugg

SEQ ID NO: 1138292 - RNA, 22 nt, Human
cuaaaauuaccuaccaguuuag

SEQ ID NO: 1138293 - RNA, 22 nt, Human
acuuuauuuccuauugcaucca

SEQ ID NO: 1138294 - RNA, 22 nt, Human
uaaauucugaucaaguuccuuc

SEQ ID NO: 1138295 - RNA, 22 nt, Human
ccugggcugcucauggggauga

SEQ ID NO: 1138296 - RNA, 22 nt, Human
agauauguuuguauauauuugu

SEQ ID NO: 1138297 - RNA, 22 nt, Human
ucccagccaggcucuaccacuu

SEQ ID NO: 1138298 - RNA, 22 nt, Human
agagggaucacccuguuucugg

SEQ ID NO: 1138299 - RNA, 22 nt, Human
agcuuuaucagaggagucucua

SEQ ID NO: 1138300 - RNA, 22 nt, Human
accacccauucagaaacacuga

SEQ ID NO: 1138301 - RNA, 20 nt, Human
gcugggcuaccacuggcccu

SEQ ID NO: 1138302 - RNA, 22 nt, Human
cuggccucagagggucauggug

SEQ ID NO: 1138303 - RNA, 20 nt, Human
ucuguacacucaucuucugc

SEQ ID NO: 1138304 - RNA, 22 nt, Human
uacauaugaacuuuauaacuug

SEQ ID NO: 1138305 - RNA, 22 nt, Human
uccgccaggacugagggcccau

SEQ ID NO: 1138306 - RNA, 22 nt, Human
aacagccacugauacugaauag

SEQ ID NO: 1138307 - RNA, 22 nt, Human
gcagcuuucuacuuccuacagc

SEQ ID NO: 1138308 - RNA, 22 nt, Human
aggcuuuaauuaucuacaggag

SEQ ID NO: 1138309 - RNA, 22 nt, Human
ucauuucuguugugcaucacug

SEQ ID NO: 1138310 - RNA, 22 nt, Human
ggggcucaguucggacagccug

SEQ ID NO: 1138311 - RNA, 22 nt, Human
ucuggcagcuauccucuggcca

SEQ ID NO: 1138312 - RNA, 22 nt, Human
aggcagcaauugaaaucauugu

SEQ ID NO: 1138313 - RNA, 22 nt, Human
ugcaggcugugucauuuaguga

SEQ ID NO: 1138314 - RNA, 22 nt, Human
ucccacauuacccugacugaca

SEQ ID NO: 1138315 - RNA, 22 nt, Human
cccagcucugcagaccugcccu

SEQ ID NO: 1138316 - RNA, 21 nt, Human
aauguauguuuaucucacagu

SEQ ID NO: 1138317 - RNA, 22 nt, Human
caaaguuuuaguaaacauauau

SEQ ID NO: 1138318 - RNA, 22 nt, Human
uacauguuauuucacuauuggu

SEQ ID NO: 1138319 - RNA, 22 nt, Human
ccaggcuccccaggaggcccuu

SEQ ID NO: 1138320 - RNA, 22 nt, Human
cagguuuagguggacgugcagg

SEQ ID NO: 1138321 - RNA, 20 nt, Human
uuaucugucaaucugucuca

SEQ ID NO: 1138322 - RNA, 22 nt, Human
auuauuucucacucacauaaua

SEQ ID NO: 1138323 - RNA, 22 nt, Human
uuauucagauuggcuacaggau

SEQ ID NO: 1138324 - RNA, 22 nt, Human
ucucuuaauuuuggaauagugu

SEQ ID NO: 1138325 - RNA, 22 nt, Human
ugcuucugcucagcuuccuacu

SEQ ID NO: 1138326 - RNA, 22 nt, Human
gugugggaaggcuaggaugcug

SEQ ID NO: 1138327 - RNA, 22 nt, Human
uaauuucuucaucucugcagcu

SEQ ID NO: 1138328 - RNA, 22 nt, Human
ucuggggcaguuacuggggccu

SEQ ID NO: 1138329 - RNA, 22 nt, Human
ugaggccagugacauauauuaa

SEQ ID NO: 1138330 - RNA, 22 nt, Human
ugcagggauuguuggcauccau

SEQ ID NO: 1138331 - RNA, 17 nt, Human
uuucagauucacuuucu

SEQ ID NO: 1138332 - RNA, 22 nt, Human
uugcagcugcaguaaauguuca

SEQ ID NO: 1138333 - RNA, 22 nt, Human
auguuagaaggaauguuaaaag

SEQ ID NO: 1138334 - RNA, 22 nt, Human
ccugggcuugcaucugugcugg

SEQ ID NO: 1138335 - RNA, 19 nt, Human
gcaucagagcagaaggggu

SEQ ID NO: 1138336 - RNA, 22 nt, Human
ugagcagagucgcuccagagug

SEQ ID NO: 1138337 - RNA, 22 nt, Human
guggagcaggacuagcugagaa

SEQ ID NO: 1138338 - RNA, 22 nt, Human
agcagcuccugccaugagugcu

SEQ ID NO: 1138339 - RNA, 22 nt, Human
aacacauauuuauauaugcaca

SEQ ID NO: 1138340 - RNA, 22 nt, Human
uuucacaugguacugccuguuu

SEQ ID NO: 1138341 - RNA, 22 nt, Human
cuggcaguuugccaggagcucg

SEQ ID NO: 1138342 - RNA, 22 nt, Human
aauuacuuaagagaaacuuuga

SEQ ID NO: 1138343 - RNA, 22 nt, Human
uucuggggacauaacaguaagc

SEQ ID NO: 1138344 - RNA, 22 nt, Human
uggcacagggcuuggucgcuca

SEQ ID NO: 1138345 - RNA, 22 nt, Human
uggaaacaucucugccuuuauu

SEQ ID NO: 1138346 - RNA, 23 nt, Human
cuggggcuuucaaaucugggcag

SEQ ID NO: 1138347 - RNA, 22 nt, Human
ccuggcaguucaucaaauggca

SEQ ID NO: 1138348 - RNA, 22 nt, Human
uggaagagaaaauccacccuua

SEQ ID NO: 1138349 - RNA, 22 nt, Human
ucagagagcuggugggcagagg

SEQ ID NO: 1138350 - RNA, 22 nt, Human
ucagccucagguguucagauuu

SEQ ID NO: 1138351 - RNA, 22 nt, Human
gugauaaagacgugucauaauu

SEQ ID NO: 1138352 - RNA, 22 nt, Human
ccuagaugggauggcggccggg

SEQ ID NO: 1138353 - RNA, 22 nt, Human
cccaggcagggacgugcucugg

SEQ ID NO: 1138354 - RNA, 22 nt, Human
aggcucccaagcacugacccca

SEQ ID NO: 1138355 - RNA, 22 nt, Human
gacugccucaguuucccugcag

SEQ ID NO: 1138356 - RNA, 22 nt, Human
cuauuaggcuuccauuucaugc

SEQ ID NO: 1138357 - RNA, 22 nt, Human
gcacacauucggauucuuaacc

SEQ ID NO: 1138358 - RNA, 19 nt, Human
uuuuccuucuauauguuuc

SEQ ID NO: 1138359 - RNA, 22 nt, Human
uaacacaugguuaguacacaau

SEQ ID NO: 1138360 - RNA, 22 nt, Human
aaagagucguguuccagguuug

SEQ ID NO: 1138361 - RNA, 22 nt, Human
ucaauaaaauuguuuuccuauc

SEQ ID NO: 1138362 - RNA, 22 nt, Human
ugagaaaugggucugcugaaga

SEQ ID NO: 1138363 - RNA, 22 nt, Human
uuccaggcaugucagacauagg

SEQ ID NO: 1138364 - RNA, 22 nt, Human
ucuggggagcagcccuggugag

SEQ ID NO: 1138365 - RNA, 22 nt, Human
ccuacucugagcgccuccgcau

SEQ ID NO: 1138366 - RNA, 23 nt, Human
ucagagaggcccccugcagagau

SEQ ID NO: 1138367 - RNA, 22 nt, Human
acacuaauuaagcugcuuuacu

SEQ ID NO: 1138368 - RNA, 22 nt, Human
gggucuccauguuaacaucacu

SEQ ID NO: 1138369 - RNA, 22 nt, Human
gaggcugcggggaggagccugc

SEQ ID NO: 1138370 - RNA, 22 nt, Human
gagggugucugcguaacuggca

SEQ ID NO: 1138371 - RNA, 22 nt, Human
cugagagaucaagccacaggau

SEQ ID NO: 1138372 - RNA, 22 nt, Human
uaaucuguguaccuucaucgga

SEQ ID NO: 1138373 - RNA, 22 nt, Human
gacacagaauuuacucccgaua

SEQ ID NO: 1138374 - RNA, 22 nt, Human
ccuggcagcuccguggccuucc

SEQ ID NO: 1138375 - RNA, 23 nt, Human
agagcaucaugaugcuaagucug

SEQ ID NO: 1138376 - RNA, 20 nt, Human
ucuggcaggugaacgagcug

SEQ ID NO: 1138377 - RNA, 22 nt, Human
gugcuaggauuacaggcauggg

SEQ ID NO: 1138378 - RNA, 22 nt, Human
auguaaacaagguuauugucca

SEQ ID NO: 1138379 - RNA, 22 nt, Human
gggcugacucugcacugagcca

SEQ ID NO: 1138380 - RNA, 22 nt, Human
ugaaccacaugcaaagugaaua

SEQ ID NO: 1138381 - RNA, 22 nt, Human
uccuggcauugugcagggugug

SEQ ID NO: 1138382 - RNA, 22 nt, Human
gccuggggaacuugauccuguc

SEQ ID NO: 1138383 - RNA, 22 nt, Human
acagcuuuguuuucccugcuga

SEQ ID NO: 1138384 - RNA, 22 nt, Human
agcugccaaguuucucaguuua

SEQ ID NO: 1138385 - RNA, 22 nt, Human
gggaccuggcgagggucacaca

SEQ ID NO: 1138386 - RNA, 22 nt, Human
uccaggcagucauuaaucucua

SEQ ID NO: 1138387 - RNA, 22 nt, Human
cucugguuucgcaggaaauaga

SEQ ID NO: 1138388 - RNA, 22 nt, Human
uucccaguuagucauuuuuaca

SEQ ID NO: 1138389 - RNA, 22 nt, Human
guccaguguguuuaucuuggau

SEQ ID NO: 1138390 - RNA, 22 nt, Human
uauguacacacacaugcaugua

SEQ ID NO: 1138391 - RNA, 22 nt, Human
agcaggcuuaugguugaaggga

SEQ ID NO: 1138392 - RNA, 18 nt, Human
ugucauaauauaucaccu

SEQ ID NO: 1138393 - RNA, 22 nt, Human
uagauacaggcucucugagccu

SEQ ID NO: 1138394 - RNA, 22 nt, Human
ucuggcaggguguguauuuaca

SEQ ID NO: 1138395 - RNA, 19 nt, Human
gggaccugacuaauuggca

SEQ ID NO: 1138396 - RNA, 22 nt, Human
uggguacuccuauuaguucagu

SEQ ID NO: 1138397 - RNA, 19 nt, Human
cucuuaaauugucucuugc

SEQ ID NO: 1138398 - RNA, 21 nt, Human
cagaggcaggcucugugugug

SEQ ID NO: 1138399 - RNA, 22 nt, Human
agcucccaggcagucaugagga

SEQ ID NO: 1138400 - RNA, 22 nt, Human
gccagccuucuguggccugcaa

SEQ ID NO: 1138401 - RNA, 21 nt, Human
acauacauaccuuaccaccuu

SEQ ID NO: 1138402 - RNA, 22 nt, Human
gugggcuggauuugcuugcaga

SEQ ID NO: 1138403 - RNA, 22 nt, Human
caggcagcugcgacaagagagc

SEQ ID NO: 1138404 - RNA, 19 nt, Human
aaacacagauuucuuacca

SEQ ID NO: 1138405 - RNA, 17 nt, Human
gaauuucuuggucaaaa

SEQ ID NO: 1138406 - RNA, 22 nt, Human
gaugaagcuuugaagucuaauc

SEQ ID NO: 1138407 - RNA, 22 nt, Human
guauuagguuggugcaaaagua

SEQ ID NO: 1138408 - RNA, 22 nt, Human
gugggagaaauuagcucuaguu

SEQ ID NO: 1138409 - RNA, 22 nt, Human
uucuaccuacccucugcauaca

SEQ ID NO: 1138410 - RNA, 22 nt, Human
acagauauaaacuauaguagug

SEQ ID NO: 1138411 - RNA, 22 nt, Human
ugcaggcuccaugaggacaggc

SEQ ID NO: 1138412 - RNA, 16 nt, Human
ucacauacuuccuugc

SEQ ID NO: 1138413 - RNA, 22 nt, Human
ucaggauggagggaagcacaga

SEQ ID NO: 1138414 - RNA, 22 nt, Human
gaauauuuuuaaagggacuaau

SEQ ID NO: 1138415 - RNA, 22 nt, Human
guccucuguuagaaaugugcuu

SEQ ID NO: 1138416 - RNA, 22 nt, Human
auaaacagaguaguugcuacug

SEQ ID NO: 1138417 - RNA, 22 nt, Human
guuaaauucgaugauggauaaa

SEQ ID NO: 1138418 - RNA, 22 nt, Human
ggccucaguuucuccauggguu

SEQ ID NO: 1138419 - RNA, 22 nt, Human
gccaggcauguccucugcagaa

SEQ ID NO: 1138420 - RNA, 23 nt, Human
acuuuauugaccccaggucaguu

SEQ ID NO: 1138421 - RNA, 22 nt, Human
ucuggcagaagugcugucagua

SEQ ID NO: 1138422 - RNA, 22 nt, Human
ugcuucuguuacauaccagaac

SEQ ID NO: 1138423 - RNA, 22 nt, Human
uuugaaaauuagacacaggcua

SEQ ID NO: 1138424 - RNA, 21 nt, Human
auucagaaagggaauaaacuc

SEQ ID NO: 1138425 - RNA, 22 nt, Human
ugcaggcuguuugguggaucuc

SEQ ID NO: 1138426 - RNA, 22 nt, Human
cacacagaaccgcucgccacuu

SEQ ID NO: 1138427 - RNA, 22 nt, Human
ucuccugggaggacaaggaagg

SEQ ID NO: 1138428 - RNA, 22 nt, Human
uaugacauuauaaaggauuauu

SEQ ID NO: 1138429 - RNA, 19 nt, Human
ccagucccauacaggagau

SEQ ID NO: 1138430 - RNA, 22 nt, Human
gaccugccugagcugccucugc

SEQ ID NO: 1138431 - RNA, 22 nt, Human
ggccucagaaauagaguaaaau

SEQ ID NO: 1138432 - RNA, 22 nt, Human
uuucacauguggaaugccaggu

SEQ ID NO: 1138433 - RNA, 22 nt, Human
ggaagaaagcacacaaacuuga

SEQ ID NO: 1138434 - RNA, 21 nt, Human
cccuugccugcacuccucggc

SEQ ID NO: 1138435 - RNA, 22 nt, Human
ugcuacaauucacaucuggaua

SEQ ID NO: 1138436 - RNA, 22 nt, Human
accugccuauggagccacaugg

SEQ ID NO: 1138437 - RNA, 22 nt, Human
gcccacaccauuuauucuuugu

SEQ ID NO: 1138438 - RNA, 22 nt, Human
ugcauaaagugccauaguauua

SEQ ID NO: 1138439 - RNA, 22 nt, Human
cccaggcaucccauuaaggagc

SEQ ID NO: 1138440 - RNA, 22 nt, Human
ugggcuccucgucacucgcugu

SEQ ID NO: 1138441 - RNA, 22 nt, Human
ugaaacauugcacuguaugaau

SEQ ID NO: 1138442 - RNA, 22 nt, Human
aacaaccaaaaagaugaaugua

SEQ ID NO: 1138443 - RNA, 22 nt, Human
ugugaaauucuugaaaugcaca

SEQ ID NO: 1138444 - RNA, 22 nt, Human
uaacacauauuucaagaguagu

SEQ ID NO: 1138445 - RNA, 22 nt, Human
agggaccucauguaaguggauu

SEQ ID NO: 1138446 - RNA, 22 nt, Human
aggcuggauuuauggggacuuc

SEQ ID NO: 1138447 - RNA, 22 nt, Human
uagcauuucacugaucuucacu

SEQ ID NO: 1138448 - RNA, 22 nt, Human
cccacccugggaagcuaggcag

SEQ ID NO: 1138449 - RNA, 22 nt, Human
gccugcagcaugcuaggucuug

SEQ ID NO: 1138450 - RNA, 22 nt, Human
gguggccaggccagcucuggcc

SEQ ID NO: 1138451 - RNA, 22 nt, Human
aaauacugcugcuauuccuuuu

SEQ ID NO: 1138452 - RNA, 22 nt, Human
uuuuccuucuagagcagauuuc

SEQ ID NO: 1138453 - RNA, 21 nt, Human
agaaaauggcguuuuagauuu

SEQ ID NO: 1138454 - RNA, 22 nt, Human
ucuggcagggguucugcacuug

SEQ ID NO: 1138455 - RNA, 22 nt, Human
cagcuuuaggacucauaauaaa

SEQ ID NO: 1138456 - RNA, 22 nt, Human
ucccaggccauaaaacucagag

SEQ ID NO: 1138457 - RNA, 23 nt, Human
ugagggacaugguggcuucugag

SEQ ID NO: 1138458 - RNA, 22 nt, Human
auaacuuucuucacccuugcug

SEQ ID NO: 1138459 - RNA, 22 nt, Human
uguaugaaaaggaauagauuga

SEQ ID NO: 1138460 - RNA, 22 nt, Human
gcacacacaugugaguacaugc

SEQ ID NO: 1138461 - RNA, 22 nt, Human
auguaugaagcuuuguuuggga

SEQ ID NO: 1138462 - RNA, 22 nt, Human
ugcauacacaagcauacaugua

SEQ ID NO: 1138463 - RNA, 22 nt, Human
ucuggggagugccuaaguggaa

SEQ ID NO: 1138464 - RNA, 22 nt, Human
augggcugacccagucguggca

SEQ ID NO: 1138465 - RNA, 22 nt, Human
uuuuucuugugcuggaucuaau

SEQ ID NO: 1138466 - RNA, 22 nt, Human
augggcugcuuggcuuccaccc

SEQ ID NO: 1138467 - RNA, 22 nt, Human
ucccacccauccugcaucucuu

SEQ ID NO: 1138468 - RNA, 22 nt, Human
agggccucuaccauccaagguu

SEQ ID NO: 1138469 - RNA, 22 nt, Human
aggacaguguggaagagggugc

SEQ ID NO: 1138470 - RNA, 18 nt, Human
guuaauuuugaaguucau

SEQ ID NO: 1138471 - RNA, 22 nt, Human
uuucagauuaucucaacuuugg

SEQ ID NO: 1138472 - RNA, 22 nt, Human
caggagggcccgagacucuucc

SEQ ID NO: 1138473 - RNA, 22 nt, Human
uccugcagagacagaggccuca

SEQ ID NO: 1138474 - RNA, 22 nt, Human
auucacagaauaguuuuaccag

SEQ ID NO: 1138475 - RNA, 22 nt, Human
ugcagggauuauguagggguug

SEQ ID NO: 1138476 - RNA, 22 nt, Human
ugcagccccugaaaauggcagc

SEQ ID NO: 1138477 - RNA, 22 nt, Human
cauacauuuauacacaucuaug

SEQ ID NO: 1138478 - RNA, 22 nt, Human
acuggagcugagagcaugggua

SEQ ID NO: 1138479 - RNA, 22 nt, Human
uuuucuuauggugaagcacaaa

SEQ ID NO: 1138480 - RNA, 22 nt, Human
uguaugaauauguauuuucaua

SEQ ID NO: 1138481 - RNA, 22 nt, Human
gccuggcaggggccugggagug

SEQ ID NO: 1138482 - RNA, 22 nt, Human
guccucugauuucuagguauau

SEQ ID NO: 1138483 - RNA, 22 nt, Human
gcaggugaugugaugugagcau

SEQ ID NO: 1138484 - RNA, 22 nt, Human
uggcagagagagugcagucgac

SEQ ID NO: 1138485 - RNA, 22 nt, Human
gcagcuuuaaacauuggaaaua

SEQ ID NO: 1138486 - RNA, 22 nt, Human
ggagagaauuccauggacaugu

SEQ ID NO: 1138487 - RNA, 22 nt, Human
gauuuauuuuuaaucagcaggg

SEQ ID NO: 1138488 - RNA, 22 nt, Human
ugcuagaauuagguuaaacaaa

SEQ ID NO: 1138489 - RNA, 22 nt, Human
cacauaaucaccaaguccuuuc

SEQ ID NO: 1138490 - RNA, 22 nt, Human
aaguaugaaucaaagacuaucu

SEQ ID NO: 1138491 - RNA, 19 nt, Human
guccuggcgccgccacacc

SEQ ID NO: 1138492 - RNA, 22 nt, Human
aacuacauuguccuuucugaag

SEQ ID NO: 1138493 - RNA, 22 nt, Human
uaaauuguuuucuagaaguugu

SEQ ID NO: 1138494 - RNA, 22 nt, Human
gcugucugccgcaggcugccac

SEQ ID NO: 1138495 - RNA, 22 nt, Human
gccaggcagagccccgugcagc

SEQ ID NO: 1138496 - RNA, 22 nt, Human
aggcccaaaagaaaccacuggg

SEQ ID NO: 1138497 - RNA, 19 nt, Human
agcauuuggaauucuacac

SEQ ID NO: 1138498 - RNA, 22 nt, Human
ugggaccugcuccuggaaugag

SEQ ID NO: 1138499 - RNA, 20 nt, Human
gcuggcagaugucuugagau

SEQ ID NO: 1138500 - RNA, 22 nt, Human
cucuccagaauaugccgccgug

SEQ ID NO: 1138501 - RNA, 22 nt, Human
ccagccucacuggcaucaccua

SEQ ID NO: 1138502 - RNA, 22 nt, Human
aaaaaucuaugacugcuucucc

SEQ ID NO: 1138503 - RNA, 22 nt, Human
augggcugaggugggauagaag

SEQ ID NO: 1138504 - RNA, 20 nt, Human
cucuuaaauguaaaguaggc

SEQ ID NO: 1138505 - RNA, 22 nt, Human
ccagagagaaauggauuugagu

SEQ ID NO: 1138506 - RNA, 22 nt, Human
uguuagaauauuguaauauucg

SEQ ID NO: 1138507 - RNA, 22 nt, Human
cuuauaaaguccaucugaacaa

SEQ ID NO: 1138508 - RNA, 22 nt, Human
agucacccuccaacucuccacu

SEQ ID NO: 1138509 - RNA, 22 nt, Human
uuccaagugucagaucagauuu

SEQ ID NO: 1138510 - RNA, 22 nt, Human
ccagcuuuugcacuggacuggg

SEQ ID NO: 1138511 - RNA, 22 nt, Human
gcucugagaggaugcugagcag

SEQ ID NO: 1138512 - RNA, 21 nt, Human
ugacugaggcuucuucacaca

SEQ ID NO: 1138513 - RNA, 22 nt, Human
ucacuguauuuggaagggaugg

SEQ ID NO: 1138514 - RNA, 22 nt, Human
ugggaccugcucuuggaaugag

SEQ ID NO: 1138515 - RNA, 18 nt, Human
ugcuuuaugcuuauauaa

SEQ ID NO: 1138516 - RNA, 22 nt, Human
augaacuuauuucugaacuuuu

SEQ ID NO: 1138517 - RNA, 21 nt, Human
uggccaaaaccauauuauuaa

SEQ ID NO: 1138518 - RNA, 22 nt, Human
uagcuuuacaaagugcugcacc

SEQ ID NO: 1138519 - RNA, 22 nt, Human
gguucccggaucuccgaguccc

SEQ ID NO: 1138520 - RNA, 18 nt, Human
acucugcggaggccccag

SEQ ID NO: 1138521 - RNA, 22 nt, Human
acaugauucuugauaggcauug

SEQ ID NO: 1138522 - RNA, 22 nt, Human
aaauaguucagcuuguaaaccc

SEQ ID NO: 1138523 - RNA, 22 nt, Human
acccagcuguuucccgugucau

SEQ ID NO: 1138524 - RNA, 22 nt, Human
uuggcagggccaggcucucucu

SEQ ID NO: 1138525 - RNA, 22 nt, Human
caugaguucaucugcuucucuu

SEQ ID NO: 1138526 - RNA, 22 nt, Human
aucccacaccccuacaacauau

SEQ ID NO: 1138527 - RNA, 23 nt, Human
aaauaugucugagggcaaagaau

SEQ ID NO: 1138528 - RNA, 22 nt, Human
guccagugacaaguagcuggcc

SEQ ID NO: 1138529 - RNA, 22 nt, Human
uccuccuccucacagucaccug

SEQ ID NO: 1138530 - RNA, 22 nt, Human
uaguuaggaaaguccagggagc

SEQ ID NO: 1138531 - RNA, 21 nt, Human
uauuugcugccaucuuugagg

SEQ ID NO: 1138532 - RNA, 22 nt, Human
cccacacacauuuaugauagga

SEQ ID NO: 1138533 - RNA, 22 nt, Human
gcuggcagugugaaugacaagc

SEQ ID NO: 1138534 - RNA, 22 nt, Human
guguuuuaucagacaaaguaua

SEQ ID NO: 1138535 - RNA, 22 nt, Human
uuucuugacugcuuaggaaugc

SEQ ID NO: 1138536 - RNA, 22 nt, Human
uaacuuucuucauaugugaacc

SEQ ID NO: 1138537 - RNA, 22 nt, Human
acagcucugcauggcaguuauu

SEQ ID NO: 1138538 - RNA, 22 nt, Human
gaggagcucugcuccauccuuc

SEQ ID NO: 1138539 - RNA, 22 nt, Human
accaggcagcugggggugaugu

SEQ ID NO: 1138540 - RNA, 22 nt, Human
ugggcugagcagugaagcucau

SEQ ID NO: 1138541 - RNA, 22 nt, Human
aagucguggcaggcuugcacga

SEQ ID NO: 1138542 - RNA, 22 nt, Human
cuucuggggauggagcccagaa

SEQ ID NO: 1138543 - RNA, 22 nt, Human
ugcuccagugagcuggccaucc

SEQ ID NO: 1138544 - RNA, 22 nt, Human
gcagcucuuuucuuaaagagau

SEQ ID NO: 1138545 - RNA, 22 nt, Human
guccucuguagggcugggccac

SEQ ID NO: 1138546 - RNA, 22 nt, Human
cuuucacacacauacauuugga

SEQ ID NO: 1138547 - RNA, 22 nt, Human
guugggaagcagauggaugagc

SEQ ID NO: 1138548 - RNA, 22 nt, Human
cuuagggaaucuuagagcugga

SEQ ID NO: 1138549 - RNA, 22 nt, Human
ccccacacucuuuacauucaua

SEQ ID NO: 1138550 - RNA, 22 nt, Human
gcuaggaaucggacccaggaag

SEQ ID NO: 1138551 - RNA, 22 nt, Human
cauuagggccaccauaacaaaa

SEQ ID NO: 1138552 - RNA, 19 nt, Human
ccaggccucuggggccugu

SEQ ID NO: 1138553 - RNA, 22 nt, Human
gccuccuggaagucacauguuu

SEQ ID NO: 1138554 - RNA, 21 nt, Human
aaaaagcuggggcaugcaugc

SEQ ID NO: 1138555 - RNA, 22 nt, Human
ugcuucugaaguggaugggugc

SEQ ID NO: 1138556 - RNA, 20 nt, Human
cucuuuugacucuuugcaag

SEQ ID NO: 1138557 - RNA, 22 nt, Human
uagaauucauguuacuguuagc

SEQ ID NO: 1138558 - RNA, 22 nt, Human
agaauaugaucggaauacagau

SEQ ID NO: 1138559 - RNA, 22 nt, Human
ugcaggcuccacguuguugucc

SEQ ID NO: 1138560 - RNA, 22 nt, Human
cuaggaauccuuuuagaguugg

SEQ ID NO: 1138561 - RNA, 22 nt, Human
gguggcauaagaacacuaaaga

SEQ ID NO: 1138562 - RNA, 22 nt, Human
ccaggccuucugaggacacucu

SEQ ID NO: 1138563 - RNA, 22 nt, Human
cuguccuccagacgacaguccc

SEQ ID NO: 1138564 - RNA, 22 nt, Human
uccaggagguagugcuuaauuu

SEQ ID NO: 1138565 - RNA, 22 nt, Human
ccccuguguuguucaaggguca

SEQ ID NO: 1138566 - RNA, 22 nt, Human
aaauccuaccaagaaauucccu

SEQ ID NO: 1138567 - RNA, 22 nt, Human
uucauugcaguucuucagguua

SEQ ID NO: 1138568 - RNA, 22 nt, Human
gagguggcuccuucagggaaua

SEQ ID NO: 1138569 - RNA, 22 nt, Human
gggcucucaugaguguguggua

SEQ ID NO: 1138570 - RNA, 22 nt, Human
gccaaaucuggauuuagcaaga

SEQ ID NO: 1138571 - RNA, 22 nt, Human
acaggcucuggggcaggauggc

SEQ ID NO: 1138572 - RNA, 22 nt, Human
ucacacaugaguaaauacaggg

SEQ ID NO: 1138573 - RNA, 22 nt, Human
uaaaguuuggcagacaauaaca

SEQ ID NO: 1138574 - RNA, 22 nt, Human
cuuucucaaugccggaaggcac

SEQ ID NO: 1138575 - RNA, 21 nt, Human
ugcuuuaugggaaaaauguca

SEQ ID NO: 1138576 - RNA, 17 nt, Human
uauauguaugccucucc

SEQ ID NO: 1138577 - RNA, 22 nt, Human
uguccagguggccucugcugcu

SEQ ID NO: 1138578 - RNA, 22 nt, Human
agcuuuauagaaaggaucagug

SEQ ID NO: 1138579 - RNA, 22 nt, Human
gcagcuuuaaucugaauaagua

SEQ ID NO: 1138580 - RNA, 22 nt, Human
uuuucguuuauuugacauguaa

SEQ ID NO: 1138581 - RNA, 19 nt, Human
gcuggcagaauuuugaacc

SEQ ID NO: 1138582 - RNA, 22 nt, Human
cagggcucugccuugagggaug

SEQ ID NO: 1138583 - RNA, 22 nt, Human
aguuauuucaguaacauaauag

SEQ ID NO: 1138584 - RNA, 22 nt, Human
uuauuuacaacucuucucuucc

SEQ ID NO: 1138585 - RNA, 22 nt, Human
ugagaauuuucaguuucacuuu

SEQ ID NO: 1138586 - RNA, 20 nt, Human
auaaaauaacugccacaaga

SEQ ID NO: 1138587 - RNA, 22 nt, Human
augaaugcugggacaaauauau

SEQ ID NO: 1138588 - RNA, 22 nt, Human
accaagcuguauauuauugguu

SEQ ID NO: 1138589 - RNA, 20 nt, Human
agccugccagcuggcccaga

SEQ ID NO: 1138590 - RNA, 22 nt, Human
agagcagauggagcuggaagag

SEQ ID NO: 1138591 - RNA, 19 nt, Human
guccucucaacaacccggg

SEQ ID NO: 1138592 - RNA, 20 nt, Human
ucccaaggaugccugggugu

SEQ ID NO: 1138593 - RNA, 22 nt, Human
aaacaaacauagguuugaaagu

SEQ ID NO: 1138594 - RNA, 19 nt, Human
uucuggggccuggccuugg

SEQ ID NO: 1138595 - RNA, 22 nt, Human
auuauaaaccuuugaggguggg

SEQ ID NO: 1138596 - RNA, 22 nt, Human
ggcaggcucuuggccuuaugag

SEQ ID NO: 1138597 - RNA, 22 nt, Human
uguaugaagacuucuucugugu

SEQ ID NO: 1138598 - RNA, 22 nt, Human
cuggggacuuugguucuccaug

SEQ ID NO: 1138599 - RNA, 22 nt, Human
gucaaaaaguagucauuucugu

SEQ ID NO: 1138600 - RNA, 22 nt, Human
accaagcuucguggaggaaguu

SEQ ID NO: 1138601 - RNA, 22 nt, Human
aagggcucccaacucaucuuuu

SEQ ID NO: 1138602 - RNA, 22 nt, Human
cagguugguauucaucuccaca

SEQ ID NO: 1138603 - RNA, 22 nt, Human
acugggcuuauuucuugugaac

SEQ ID NO: 1138604 - RNA, 22 nt, Human
acugggcuagaguggaagcugg

SEQ ID NO: 1138605 - RNA, 22 nt, Human
auuuaaaugcuuaagaggguuu

SEQ ID NO: 1138606 - RNA, 22 nt, Human
acugggcugguuaguuuuacua

SEQ ID NO: 1138607 - RNA, 22 nt, Human
auuaauuuuaccuuuguaaaca

SEQ ID NO: 1138608 - RNA, 22 nt, Human
ugguccuggaagguccugaggg

SEQ ID NO: 1138609 - RNA, 22 nt, Human
cccuuccugggugucccggagu

SEQ ID NO: 1138610 - RNA, 20 nt, Human
ccugggcuccaggagccccg

SEQ ID NO: 1138611 - RNA, 22 nt, Human
agggcuccgggccaccggccug

SEQ ID NO: 1138612 - RNA, 22 nt, Human
gcuggcagcauuagacccuggg

SEQ ID NO: 1138613 - RNA, 22 nt, Human
acuccaggcaucugcuucugcu

SEQ ID NO: 1138614 - RNA, 22 nt, Human
gguauaaaugaucagaucgcug

SEQ ID NO: 1138615 - RNA, 22 nt, Human
auucagcaaugagcuuggauuu

SEQ ID NO: 1138616 - RNA, 22 nt, Human
uugaagcagagaaauacuugaa

SEQ ID NO: 1138617 - RNA, 22 nt, Human
uucuuugcccuuaaugaaauaa

SEQ ID NO: 1138618 - RNA, 22 nt, Human
accauuugacucucuaaggaua

SEQ ID NO: 1138619 - RNA, 22 nt, Human
acacacagguaaaggagccugg

SEQ ID NO: 1138620 - RNA, 22 nt, Human
ucagagagcagaacuuuuuuac

SEQ ID NO: 1138621 - RNA, 22 nt, Human
ugccaaauugcccuauaaauga

SEQ ID NO: 1138622 - RNA, 22 nt, Human
ggcucccugccuguccucaguc

SEQ ID NO: 1138623 - RNA, 22 nt, Human
agcaggcuuguuaugucugaga

SEQ ID NO: 1138624 - RNA, 22 nt, Human
uaggaaaugcuccauugcauaa

SEQ ID NO: 1138625 - RNA, 22 nt, Human
uaugagguagguauuauacuua

SEQ ID NO: 1138626 - RNA, 22 nt, Human
ucagggaccccucugaguggag

SEQ ID NO: 1138627 - RNA, 22 nt, Human
guggcagggcuuugcuguucuu

SEQ ID NO: 1138628 - RNA, 22 nt, Human
aggcugugggaguugagagucu

SEQ ID NO: 1138629 - RNA, 22 nt, Human
cacacagacagcucucugaaga

SEQ ID NO: 1138630 - RNA, 22 nt, Human
gcuggcagucccaucagcuggg

SEQ ID NO: 1138631 - RNA, 22 nt, Human
guagggacccacagucuauauu

SEQ ID NO: 1138632 - RNA, 22 nt, Human
gcuggggagcaagaguagugag

SEQ ID NO: 1138633 - RNA, 22 nt, Human
caaauauuccagguacaucccu

SEQ ID NO: 1138634 - RNA, 20 nt, Human
uccaggcagcucagaguguc

SEQ ID NO: 1138635 - RNA, 22 nt, Human
ucugucacccaggcuggagugc

SEQ ID NO: 1138636 - RNA, 17 nt, Human
aggccucccuccaggcc

SEQ ID NO: 1138637 - RNA, 22 nt, Human
cuucuggguguggagugaggac

SEQ ID NO: 1138638 - RNA, 22 nt, Human
auuucucacucacaguccaugu

SEQ ID NO: 1138639 - RNA, 22 nt, Human
aaaguuaguuucuuauaugucu

SEQ ID NO: 1138640 - RNA, 22 nt, Human
uggcagagucaucacaucugga

SEQ ID NO: 1138641 - RNA, 22 nt, Human
cucugagcagaggccguggcua

SEQ ID NO: 1138642 - RNA, 22 nt, Human
cacucugaugguuucuguucaa

SEQ ID NO: 1138643 - RNA, 22 nt, Human
guccucugcuucaugcccugau

SEQ ID NO: 1138644 - RNA, 22 nt, Human
uuuguuagagugugggaggcug

SEQ ID NO: 1138645 - RNA, 22 nt, Human
caagauaagaucauuuacacua

SEQ ID NO: 1138646 - RNA, 22 nt, Human
aaacacauuagcccuguggaaa

SEQ ID NO: 1138647 - RNA, 22 nt, Human
ugcauacacaugugcacauacg

SEQ ID NO: 1138648 - RNA, 22 nt, Human
uacauugacuuggauuguuaga

SEQ ID NO: 1138649 - RNA, 20 nt, Human
accccacagaguccauugca

SEQ ID NO: 1138650 - RNA, 22 nt, Human
agacacauaggaccacacugug

SEQ ID NO: 1138651 - RNA, 17 nt, Human
ugcuucuguauugcugg

SEQ ID NO: 1138652 - RNA, 21 nt, Human
uuuaauuugcauguaugacgc

SEQ ID NO: 1138653 - RNA, 22 nt, Human
gugggcuucccuuaagccagag

SEQ ID NO: 1138654 - RNA, 22 nt, Human
ugccucucuaacccaugcccaa

SEQ ID NO: 1138655 - RNA, 22 nt, Human
ugcuuuauaacuuaguuuaugg

SEQ ID NO: 1138656 - RNA, 22 nt, Human
cagcauuuggaggagaggcuuu

SEQ ID NO: 1138657 - RNA, 22 nt, Human
agggcuccgggcaggcgaugga

SEQ ID NO: 1138658 - RNA, 22 nt, Human
aggaccuguguuuuccuugaau

SEQ ID NO: 1138659 - RNA, 22 nt, Human
gacaggcuuugagucccagaac

SEQ ID NO: 1138660 - RNA, 22 nt, Human
uagaaacaaugacaugcuugua

SEQ ID NO: 1138661 - RNA, 22 nt, Human
gcauuauuaauagcugcaugag

SEQ ID NO: 1138662 - RNA, 22 nt, Human
caguggugaagagcaggggcuc

SEQ ID NO: 1138663 - RNA, 22 nt, Human
gggcugacucaaccuugcaaag

SEQ ID NO: 1138664 - RNA, 22 nt, Human
caaauacuacgauucuugcagu

SEQ ID NO: 1138665 - RNA, 22 nt, Human
uuuccacaauguuuuugcagga

SEQ ID NO: 1138666 - RNA, 22 nt, Human
aauauaaugcuguuuuaugcca

SEQ ID NO: 1138667 - RNA, 22 nt, Human
cuuacaaauacacuuaggagag

SEQ ID NO: 1138668 - RNA, 23 nt, Human
ugaaauauucuuuugcaugagcu

SEQ ID NO: 1138669 - RNA, 22 nt, Human
acuuggcaaguaucuauaaagu

SEQ ID NO: 1138670 - RNA, 21 nt, Human
ccagagagagggaaguggguu

SEQ ID NO: 1138671 - RNA, 22 nt, Human
cagagcauuaaaaccagcucug

SEQ ID NO: 1138672 - RNA, 22 nt, Human
cuauuagguaugcagccuauuu

SEQ ID NO: 1138673 - RNA, 22 nt, Human
cagcuugaaauauuaggagaug

SEQ ID NO: 1138674 - RNA, 22 nt, Human
gaggcucugugaugugccaggc

SEQ ID NO: 1138675 - RNA, 22 nt, Human
ucacauuuuuuacuggacuuaa

SEQ ID NO: 1138676 - RNA, 22 nt, Human
ggaccugccagaacucaggcua

SEQ ID NO: 1138677 - RNA, 18 nt, Human
uccuggcagucagagagg

SEQ ID NO: 1138678 - RNA, 22 nt, Human
cugggagaggaaccucgagggu

SEQ ID NO: 1138679 - RNA, 22 nt, Human
cccagcccccgagugucuggaa

SEQ ID NO: 1138680 - RNA, 22 nt, Human
uccugcagccacugcaggcaga

SEQ ID NO: 1138681 - RNA, 22 nt, Human
ugaauaaucuuggguauuaaua

SEQ ID NO: 1138682 - RNA, 22 nt, Human
auaugcauuuaccuggcauaua

SEQ ID NO: 1138683 - RNA, 22 nt, Human
cuggaaaggguccucauucugu

SEQ ID NO: 1138684 - RNA, 22 nt, Human
agcucccagaaggcccugcgcc

SEQ ID NO: 1138685 - RNA, 22 nt, Human
cugggcuugaguuccugcucgu

SEQ ID NO: 1138686 - RNA, 22 nt, Human
aggaccuguaccucagcaucua

SEQ ID NO: 1138687 - RNA, 22 nt, Human
gugccaaaagcuauaauuuggu

SEQ ID NO: 1138688 - RNA, 22 nt, Human
ccaggcccugcuccucacacca

SEQ ID NO: 1138689 - RNA, 22 nt, Human
gagggcucuaccaaguaacucu

SEQ ID NO: 1138690 - RNA, 22 nt, Human
ucuucacaugaccuucaugucu

SEQ ID NO: 1138691 - RNA, 22 nt, Human
aauuagggaaaauuuacuugua

SEQ ID NO: 1138692 - RNA, 22 nt, Human
aucugucaucagcaccacaggu

SEQ ID NO: 1138693 - RNA, 22 nt, Human
uuugacaaauccuucagcaaug

SEQ ID NO: 1138694 - RNA, 19 nt, Human
uccaggaggcugccauuga

SEQ ID NO: 1138695 - RNA, 17 nt, Human
agguauaaaaugguagc

SEQ ID NO: 1138696 - RNA, 22 nt, Human
cagugagggcccccuuccaggu

SEQ ID NO: 1138697 - RNA, 22 nt, Human
uaacuacauuucacugcaauua

SEQ ID NO: 1138698 - RNA, 22 nt, Human
uguagaaagcucuucugaaauc

SEQ ID NO: 1138699 - RNA, 22 nt, Human
accugcagcugagaaaaugacu

SEQ ID NO: 1138700 - RNA, 22 nt, Human
agcuuuauuaacucuccaggug

SEQ ID NO: 1138701 - RNA, 22 nt, Human
aacccagccguguagcugccgc

SEQ ID NO: 1138702 - RNA, 22 nt, Human
guuuuccugaaacugauggugu

SEQ ID NO: 1138703 - RNA, 22 nt, Human
cuuauuagugucugucugaguu

SEQ ID NO: 1138704 - RNA, 22 nt, Human
uugggaaguuuaaugacagacu

SEQ ID NO: 1138705 - RNA, 21 nt, Human
uaugaacaugaccaauagucc

SEQ ID NO: 1138706 - RNA, 22 nt, Human
ggggaccugggcuucaaggguu

SEQ ID NO: 1138707 - RNA, 19 nt, Human
ucugcagaaggcauacaug

SEQ ID NO: 1138708 - RNA, 22 nt, Human
aauguaugugauuauuccucua

SEQ ID NO: 1138709 - RNA, 22 nt, Human
aggcuccugcaggugaggugcu

SEQ ID NO: 1138710 - RNA, 22 nt, Human
ucuggggacggggcccagcaau

SEQ ID NO: 1138711 - RNA, 22 nt, Human
gguuucaacucagcuaguaagg

SEQ ID NO: 1138712 - RNA, 22 nt, Human
gaggacucugggcguguauggg

SEQ ID NO: 1138713 - RNA, 22 nt, Human
uggcacucacucucagagucug

SEQ ID NO: 1138714 - RNA, 22 nt, Human
agauuuauguggucacacucag

SEQ ID NO: 1138715 - RNA, 22 nt, Human
ccuggcagccucagccaauucu

SEQ ID NO: 1138716 - RNA, 22 nt, Human
cagaugagaguggccaggguuc

SEQ ID NO: 1138717 - RNA, 22 nt, Human
aggcuuuguaccuggggucuua

SEQ ID NO: 1138718 - RNA, 22 nt, Human
aucugggggagcugcucaugga

SEQ ID NO: 1138719 - RNA, 22 nt, Human
agcuuuggagacugacuccauc

SEQ ID NO: 1138720 - RNA, 22 nt, Human
cuggggacucauucagagcaua

SEQ ID NO: 1138721 - RNA, 22 nt, Human
cccaggccuggucugggccagu

SEQ ID NO: 1138722 - RNA, 22 nt, Human
gagggcuccauuccccgugccc

SEQ ID NO: 1138723 - RNA, 22 nt, Human
ggcuuuaugcacagcagauggu

SEQ ID NO: 1138724 - RNA, 22 nt, Human
guagggacuuguuuuacuagua

SEQ ID NO: 1138725 - RNA, 22 nt, Human
ggcuuugggcccucaagucucc

SEQ ID NO: 1138726 - RNA, 22 nt, Human
agcucccauuaucuucugaaac

SEQ ID NO: 1138727 - RNA, 22 nt, Human
ugguuccuucugcauuuucagc

SEQ ID NO: 1138728 - RNA, 22 nt, Human
gagccaccuucaacucaggaau

SEQ ID NO: 1138729 - RNA, 22 nt, Human
acugcuuacccggccugacuuc

SEQ ID NO: 1138730 - RNA, 22 nt, Human
ucaaaguuacuugugguuuucu

SEQ ID NO: 1138731 - RNA, 22 nt, Human
ucacacagcugacagagccuuu

SEQ ID NO: 1138732 - RNA, 22 nt, Human
gcaaauacauguugagcaccua

SEQ ID NO: 1138733 - RNA, 22 nt, Human
ugaacacugccauauuuaagaa

SEQ ID NO: 1138734 - RNA, 22 nt, Human
auuucuacaguacacaugcauu

SEQ ID NO: 1138735 - RNA, 22 nt, Human
ccugggcucaagugauccuccu

SEQ ID NO: 1138736 - RNA, 22 nt, Human
ugauugacuuuagaauagcacu

SEQ ID NO: 1138737 - RNA, 20 nt, Human
ugccuggccuuucucugccc

SEQ ID NO: 1138738 - RNA, 22 nt, Human
ugcacaggaggcuguggagaag

SEQ ID NO: 1138739 - RNA, 22 nt, Human
ccagccacagcuuccagcuccu

SEQ ID NO: 1138740 - RNA, 22 nt, Human
guuuauuagaguuuucugucug

SEQ ID NO: 1138741 - RNA, 22 nt, Human
ugugaaaagcguguguucuagg

SEQ ID NO: 1138742 - RNA, 22 nt, Human
auguaauuugcccucaaguuaa

SEQ ID NO: 1138743 - RNA, 22 nt, Human
agacaagaaacugggagucucu

SEQ ID NO: 1138744 - RNA, 22 nt, Human
cacaacuuuaggaaccacauuc

SEQ ID NO: 1138745 - RNA, 22 nt, Human
auuucucagcacuuccuaucuc

SEQ ID NO: 1138746 - RNA, 22 nt, Human
ugcuucuguuuguuucugucau

SEQ ID NO: 1138747 - RNA, 21 nt, Human
uucucuccauaugcccagccc

SEQ ID NO: 1138748 - RNA, 22 nt, Human
ucugggcugcugugcagugacc

SEQ ID NO: 1138749 - RNA, 22 nt, Human
cuacugaguccuucagcugcca

SEQ ID NO: 1138750 - RNA, 22 nt, Human
cugccuggccacaacccagggu

SEQ ID NO: 1138751 - RNA, 18 nt, Human
gggcucacacaggucauc

SEQ ID NO: 1138752 - RNA, 17 nt, Human
ucgguuugccaggcuuc

SEQ ID NO: 1138753 - RNA, 22 nt, Human
ugcaggcuauaucuuauuugac

SEQ ID NO: 1138754 - RNA, 22 nt, Human
cauuuguaucauauguaucuua

SEQ ID NO: 1138755 - RNA, 22 nt, Human
uucuagcagagggcaucugcug

SEQ ID NO: 1138756 - RNA, 20 nt, Human
cccaggcagagcuagcggca

SEQ ID NO: 1138757 - RNA, 22 nt, Human
uacagagacuuuauggcacaaa

SEQ ID NO: 1138758 - RNA, 22 nt, Human
uuucacauuuaggcgugaauug

SEQ ID NO: 1138759 - RNA, 22 nt, Human
ugguuuaccccuguccuauauc

SEQ ID NO: 1138760 - RNA, 22 nt, Human
aucuagcaguguuauaauugga

SEQ ID NO: 1138761 - RNA, 22 nt, Human
aagggcuccaagagguagcugg

SEQ ID NO: 1138762 - RNA, 22 nt, Human
auuacaguaacagcuacaaugc

SEQ ID NO: 1138763 - RNA, 22 nt, Human
uaggaagcugagcagcauuccu

SEQ ID NO: 1138764 - RNA, 21 nt, Human
auuuucauuuccaggggagga

SEQ ID NO: 1138765 - RNA, 22 nt, Human
cuccugaggacuucuauugggu

SEQ ID NO: 1138766 - RNA, 22 nt, Human
cagcuuugugcaaugcagucuc

SEQ ID NO: 1138767 - RNA, 22 nt, Human
uaauaucuggcauucaaacaug

SEQ ID NO: 1138768 - RNA, 22 nt, Human
ugcuagaaaucugaaacuagca

SEQ ID NO: 1138769 - RNA, 22 nt, Human
uccugagccugacaaucaccau

SEQ ID NO: 1138770 - RNA, 22 nt, Human
aaaguucuaaaacucuuuguga

SEQ ID NO: 1138771 - RNA, 22 nt, Human
uggaacacaagucauugagggg

SEQ ID NO: 1138772 - RNA, 22 nt, Human
cugggcuuucaggcccuaaggc

SEQ ID NO: 1138773 - RNA, 22 nt, Human
uccaggcauguugggaagauga

SEQ ID NO: 1138774 - RNA, 22 nt, Human
uuagaacuuaagaauacugucu

SEQ ID NO: 1138775 - RNA, 20 nt, Human
ucuggggaugaggucuagga

SEQ ID NO: 1138776 - RNA, 22 nt, Human
guuagggaagcgcuguguucuu

SEQ ID NO: 1138777 - RNA, 22 nt, Human
acaagagcauugcagguguguu

SEQ ID NO: 1138778 - RNA, 22 nt, Human
ugggcuucauaauugguccuag

SEQ ID NO: 1138779 - RNA, 22 nt, Human
ucaccagggcuccagccagccu

SEQ ID NO: 1138780 - RNA, 22 nt, Human
acucugaaugugcauguaaauc

SEQ ID NO: 1138781 - RNA, 22 nt, Human
guaguuuucugaaaauuacuuu

SEQ ID NO: 1138782 - RNA, 22 nt, Human
uuguucaugguuguaaguuuga

SEQ ID NO: 1138783 - RNA, 22 nt, Human
aaucuuuuaggggauccugagg

SEQ ID NO: 1138784 - RNA, 22 nt, Human
uuucacaaucaaauggugaaau

SEQ ID NO: 1138785 - RNA, 22 nt, Human
ugcuucugauucaugguuauug

SEQ ID NO: 1138786 - RNA, 22 nt, Human
gccaggcaggugucggagcccu

SEQ ID NO: 1138787 - RNA, 22 nt, Human
ggagcugaaccccaucgugcug

SEQ ID NO: 1138788 - RNA, 21 nt, Human
uccaaaucccauucuguaguc

SEQ ID NO: 1138789 - RNA, 22 nt, Human
guaugaaaauuguaaaguucuu

SEQ ID NO: 1138790 - RNA, 22 nt, Human
uguuaggguccugugcaggggc

SEQ ID NO: 1138791 - RNA, 23 nt, Human
ccucucucccuguuuggcaaaua

SEQ ID NO: 1138792 - RNA, 22 nt, Human
ugcaggcucaccugccagggcc

SEQ ID NO: 1138793 - RNA, 22 nt, Human
ugcauaaacagauacuucaugu

SEQ ID NO: 1138794 - RNA, 22 nt, Human
gcuucuauuauuuggagcugag

SEQ ID NO: 1138795 - RNA, 22 nt, Human
cuguagaacgauccaggcauuu

SEQ ID NO: 1138796 - RNA, 23 nt, Human
uuccaagugcuuuacuuaauccu

SEQ ID NO: 1138797 - RNA, 17 nt, Human
cagcuuuaugcuacugu

SEQ ID NO: 1138798 - RNA, 22 nt, Human
gacacauaugcguauaguuuag

SEQ ID NO: 1138799 - RNA, 22 nt, Human
ucaucaguuuagaaaaaauaug

SEQ ID NO: 1138800 - RNA, 22 nt, Human
cauaauuugauaugcuugaugg

SEQ ID NO: 1138801 - RNA, 22 nt, Human
caguguggugagauuccaggug

SEQ ID NO: 1138802 - RNA, 22 nt, Human
cagggcucaccacugggauccu

SEQ ID NO: 1138803 - RNA, 22 nt, Human
caggcauggugagaacucagcc

SEQ ID NO: 1138804 - RNA, 22 nt, Human
acuauaaaaggauaaaccagaa

SEQ ID NO: 1138805 - RNA, 20 nt, Human
cagggcucugggccuggccu

SEQ ID NO: 1138806 - RNA, 22 nt, Human
cucuugcagauaccuugaagga

SEQ ID NO: 1138807 - RNA, 20 nt, Human
uuucuggguacucucccucu

SEQ ID NO: 1138808 - RNA, 22 nt, Human
ugcaguggaaagacucagacuu

SEQ ID NO: 1138809 - RNA, 19 nt, Human
ugccuggcaccagcuccac

SEQ ID NO: 1138810 - RNA, 22 nt, Human
aacaugauuuaguauaaugcag

SEQ ID NO: 1138811 - RNA, 22 nt, Human
aaucugucguaguaaaaagcag

SEQ ID NO: 1138812 - RNA, 22 nt, Human
gcuggggagaauuggguuaucu

SEQ ID NO: 1138813 - RNA, 22 nt, Human
cacacacaguuuuguauucugu

SEQ ID NO: 1138814 - RNA, 22 nt, Human
cuguccagaaagggggcaacaa

SEQ ID NO: 1138815 - RNA, 22 nt, Human
cuguaugauauccaaauugaua

SEQ ID NO: 1138816 - RNA, 22 nt, Human
cagccaggauggagaacuguug

SEQ ID NO: 1138817 - RNA, 22 nt, Human
ugaauaugugacuuugauuuca

SEQ ID NO: 1138818 - RNA, 22 nt, Human
ccaggcucagcgcgcacgucug

SEQ ID NO: 1138819 - RNA, 22 nt, Human
uugggcucaggaguuugagacc

SEQ ID NO: 1138820 - RNA, 22 nt, Human
uccugcaguuacaucccagcca

SEQ ID NO: 1138821 - RNA, 22 nt, Human
cauuagggacugaggaauaagg

SEQ ID NO: 1138822 - RNA, 22 nt, Human
ggcccaaacggguccagugaaa

SEQ ID NO: 1138823 - RNA, 22 nt, Human
cuucuggguaauucuucuucau

SEQ ID NO: 1138824 - RNA, 22 nt, Human
ugggcugaaaugcuguggacua

SEQ ID NO: 1138825 - RNA, 20 nt, Human
gccucagccaacccaugggg

SEQ ID NO: 1138826 - RNA, 22 nt, Human
ucugauuagcaguuuagggaaa

SEQ ID NO: 1138827 - RNA, 22 nt, Human
cauaauuuuccaugguuugcua

SEQ ID NO: 1138828 - RNA, 22 nt, Human
gguggcagagaggagguaguuu

SEQ ID NO: 1138829 - RNA, 22 nt, Human
cagcucagucuggagagaugca

SEQ ID NO: 1138830 - RNA, 22 nt, Human
auaugaagucagacaaacuggg

SEQ ID NO: 1138831 - RNA, 21 nt, Human
uccugcagggcagcagagugg

SEQ ID NO: 1138832 - RNA, 19 nt, Human
gggagcugaggucuuuggu

SEQ ID NO: 1138833 - RNA, 22 nt, Human
uuauuuuuaaaaguucacacag

SEQ ID NO: 1138834 - RNA, 22 nt, Human
uguuucuuuguagauauucuuu

SEQ ID NO: 1138835 - RNA, 22 nt, Human
gcuaggagugggauggaagucg

SEQ ID NO: 1138836 - RNA, 22 nt, Human
uuuaauuuuccucuuccuggag

SEQ ID NO: 1138837 - RNA, 22 nt, Human
gguuucaacuaaaucaagaagg

SEQ ID NO: 1138838 - RNA, 22 nt, Human
gaaguucuuagucucauuugca

SEQ ID NO: 1138839 - RNA, 18 nt, Human
ggacaucaucaggugcuu

SEQ ID NO: 1138840 - RNA, 22 nt, Human
acagaguccuagcugcaaagaa

SEQ ID NO: 1138841 - RNA, 22 nt, Human
uuauucuucuucucuugccagg

SEQ ID NO: 1138842 - RNA, 22 nt, Human
ugcuuuauuggaaccucauccu

SEQ ID NO: 1138843 - RNA, 22 nt, Human
augugaaaaauuucuuauuaca

SEQ ID NO: 1138844 - RNA, 22 nt, Human
aaacaugcauucaagaaaaucu

SEQ ID NO: 1138845 - RNA, 20 nt, Human
uauaaauucagagcuuuggu

SEQ ID NO: 1138846 - RNA, 22 nt, Human
acaaguaccaaaugcucaagua

SEQ ID NO: 1138847 - RNA, 22 nt, Human
uucugucaaagacuuuuucagg

SEQ ID NO: 1138848 - RNA, 22 nt, Human
ugcuuuauucccuucugaugug

SEQ ID NO: 1138849 - RNA, 22 nt, Human
ggcuccaagucucagagugaag

SEQ ID NO: 1138850 - RNA, 22 nt, Human
ucuggggaugagguccagugau

SEQ ID NO: 1138851 - RNA, 17 nt, Human
cucuggggacaguucua

SEQ ID NO: 1138852 - RNA, 22 nt, Human
gguaugaauucacuacuuccaa

SEQ ID NO: 1138853 - RNA, 22 nt, Human
acaggcagagaacucagccaga

SEQ ID NO: 1138854 - RNA, 22 nt, Human
uuugcuuguucaagauuucugu

SEQ ID NO: 1138855 - RNA, 22 nt, Human
uuugcaaauauguguuucuauu

SEQ ID NO: 1138856 - RNA, 22 nt, Human
uuccaggcucccuuggaggugu

SEQ ID NO: 1138857 - RNA, 23 nt, Human
uccugcugaaagcuccagcuggc

SEQ ID NO: 1138858 - RNA, 22 nt, Human
aaacucuguagcuaaacauaau

SEQ ID NO: 1138859 - RNA, 22 nt, Human
caugaaauugcuccuuuggugc

SEQ ID NO: 1138860 - RNA, 23 nt, Human
acuccccagucucuucuugccaa

SEQ ID NO: 1138861 - RNA, 22 nt, Human
acacacucaauugcauaagcac

SEQ ID NO: 1138862 - RNA, 22 nt, Human
uucugucacagugcugguauca

SEQ ID NO: 1138863 - RNA, 22 nt, Human
uuaguuuucccaucuuuauggu

SEQ ID NO: 1138864 - RNA, 22 nt, Human
cuucugggccauggccuuccuc

SEQ ID NO: 1138865 - RNA, 22 nt, Human
uacccaggggcugagcagaggu

SEQ ID NO: 1138866 - RNA, 22 nt, Human
acagauuuguucuuuugggcua

SEQ ID NO: 1138867 - RNA, 22 nt, Human
aguguuugucccguuagaaaug

SEQ ID NO: 1138868 - RNA, 22 nt, Human
agcauucauugcuagaauguaa

SEQ ID NO: 1138869 - RNA, 22 nt, Human
ucagcuuucucucgccaucagg

SEQ ID NO: 1138870 - RNA, 18 nt, Human
aguuccuuaaauuggugu

SEQ ID NO: 1138871 - RNA, 23 nt, Human
accaugaugggagugcaaauaag

SEQ ID NO: 1138872 - RNA, 22 nt, Human
aaacacaccuuuggaacuguga

SEQ ID NO: 1138873 - RNA, 22 nt, Human
uuuucauuguaaaucaggaaac

SEQ ID NO: 1138874 - RNA, 22 nt, Human
uccagaccaugugagaggcgca

SEQ ID NO: 1138875 - RNA, 22 nt, Human
uggccuccccuaacagccucuu

SEQ ID NO: 1138876 - RNA, 22 nt, Human
uuuaguagaaugauacagggca

SEQ ID NO: 1138877 - RNA, 22 nt, Human
agaggccugugugcuccagugg

SEQ ID NO: 1138878 - RNA, 22 nt, Human
aaagauucgagcgauguauaaa

SEQ ID NO: 1138879 - RNA, 19 nt, Human
uccuggcauuuguaggaaa

SEQ ID NO: 1138880 - RNA, 22 nt, Human
aagauauagauaaaacuaugca

SEQ ID NO: 1138881 - RNA, 22 nt, Human
auguccagggcacacagcagug

SEQ ID NO: 1138882 - RNA, 22 nt, Human
aucagagauuguaguaugugca

SEQ ID NO: 1138883 - RNA, 22 nt, Human
ucugaaauagaagugucuuucu

SEQ ID NO: 1138884 - RNA, 22 nt, Human
gcacacaguagggauucaauga

SEQ ID NO: 1138885 - RNA, 22 nt, Human
cacacauuucagaugcuacaau

SEQ ID NO: 1138886 - RNA, 22 nt, Human
uagggacacugcucaugaguuc

SEQ ID NO: 1138887 - RNA, 22 nt, Human
gcagcuuucuugcccuaaucuu

SEQ ID NO: 1138888 - RNA, 22 nt, Human
uuaaauuccagccucauaauag

SEQ ID NO: 1138889 - RNA, 22 nt, Human
ccugggcuucugucuagauguu

SEQ ID NO: 1138890 - RNA, 22 nt, Human
cuucugggcagaaguuuugaga

SEQ ID NO: 1138891 - RNA, 22 nt, Human
ccuggcagcaggugggcccgug

SEQ ID NO: 1138892 - RNA, 22 nt, Human
uuguaugaguaugguguauagg

SEQ ID NO: 1138893 - RNA, 17 nt, Human
acaggccugcuugcacu

SEQ ID NO: 1138894 - RNA, 22 nt, Human
uccugccuguuuaccuguacuu

SEQ ID NO: 1138895 - RNA, 22 nt, Human
ucagccuccgaaagugcuggga

SEQ ID NO: 1138896 - RNA, 22 nt, Human
augggcuggccuuucccgcucu

SEQ ID NO: 1138897 - RNA, 22 nt, Human
uuccaggccgggcaggaaacac

SEQ ID NO: 1138898 - RNA, 22 nt, Human
cuccuggcaguuccccuuguca

SEQ ID NO: 1138899 - RNA, 18 nt, Human
ugaggcagucagugaugg

SEQ ID NO: 1138900 - RNA, 23 nt, Human
ucagagagcuguugagagcugcc

SEQ ID NO: 1138901 - RNA, 22 nt, Human
ccacacagggggaugaguuauu

SEQ ID NO: 1138902 - RNA, 22 nt, Human
gggcugacaaccaucugacaag

SEQ ID NO: 1138903 - RNA, 22 nt, Human
uuggcuucuugugaaaucugag

SEQ ID NO: 1138904 - RNA, 22 nt, Human
auuauuagacuuauaugguagu

SEQ ID NO: 1138905 - RNA, 22 nt, Human
ucccagccuuccuuguggugaa

SEQ ID NO: 1138906 - RNA, 22 nt, Human
aaaauuuugcccuauccuucau

SEQ ID NO: 1138907 - RNA, 22 nt, Human
auauuugucaauucacuguuca

SEQ ID NO: 1138908 - RNA, 22 nt, Human
uccuaguucucugccagucgcu

SEQ ID NO: 1138909 - RNA, 22 nt, Human
ucuuugaaaagggagauagaaa

SEQ ID NO: 1138910 - RNA, 22 nt, Human
ggcaggcugcuugggucauguc

SEQ ID NO: 1138911 - RNA, 22 nt, Human
aguaugaaaguuaaucaauuua

SEQ ID NO: 1138912 - RNA, 22 nt, Human
uuuaaaauuuagaccucuccac

SEQ ID NO: 1138913 - RNA, 18 nt, Human
acacugcagcagucugcu

SEQ ID NO: 1138914 - RNA, 22 nt, Human
aggaagaaccuaagaaagucuc

SEQ ID NO: 1138915 - RNA, 19 nt, Human
guagggacagugguucuga

SEQ ID NO: 1138916 - RNA, 21 nt, Human
ucagcuuugcaacugcacauc

SEQ ID NO: 1138917 - RNA, 22 nt, Human
gagugaugucuguagugaagaa

SEQ ID NO: 1138918 - RNA, 21 nt, Human
gaaaagcaagggaguagaaca

SEQ ID NO: 1138919 - RNA, 22 nt, Human
uccuggcauccgugggucugug

SEQ ID NO: 1138920 - RNA, 22 nt, Human
cuggcagggugggcuuugcuuu

SEQ ID NO: 1138921 - RNA, 22 nt, Human
ucuaggagcuuaaaggaggcca

SEQ ID NO: 1138922 - RNA, 22 nt, Human
augaucucauucuuucaaaggg

SEQ ID NO: 1138923 - RNA, 22 nt, Human
uucuacaauaugaauaaugaag

SEQ ID NO: 1138924 - RNA, 22 nt, Human
uguaaagaaagacgcagaguua

SEQ ID NO: 1138925 - RNA, 22 nt, Human
gaagccucaacaucucugcguc

SEQ ID NO: 1138926 - RNA, 22 nt, Human
uaugacauuggccaaguucugu

SEQ ID NO: 1138927 - RNA, 22 nt, Human
gcuggcagagcucugggcuggg

SEQ ID NO: 1138928 - RNA, 22 nt, Human
ccagagagggcgccaccuggag

SEQ ID NO: 1138929 - RNA, 22 nt, Human
gacauaauaaucugaccuagau

SEQ ID NO: 1138930 - RNA, 22 nt, Human
uaugcacauucacacaaaaaug

SEQ ID NO: 1138931 - RNA, 22 nt, Human
aagggcucuguugccauuucag

SEQ ID NO: 1138932 - RNA, 22 nt, Human
cugcagggaugugaggcccguu

SEQ ID NO: 1138933 - RNA, 22 nt, Human
ccuugcucaagcuagugacggg

SEQ ID NO: 1138934 - RNA, 22 nt, Human
uuauucugcacuuuuaaaauau

SEQ ID NO: 1138935 - RNA, 22 nt, Human
ugcuagaagauagcuagaagau

SEQ ID NO: 1138936 - RNA, 22 nt, Human
ugugcauguauugauuuguacc

SEQ ID NO: 1138937 - RNA, 22 nt, Human
auucugucauuucaagaaaaac

SEQ ID NO: 1138938 - RNA, 22 nt, Human
cccugcagacgucuugaugccu

SEQ ID NO: 1138939 - RNA, 22 nt, Human
agagcaauggcauccagcugau

SEQ ID NO: 1138940 - RNA, 22 nt, Human
caauacugaguuuacauucauc

SEQ ID NO: 1138941 - RNA, 22 nt, Human
acauccagaucucagcauggcu

SEQ ID NO: 1138942 - RNA, 21 nt, Human
ugggaccuagcuuugcacagg

SEQ ID NO: 1138943 - RNA, 22 nt, Human
uuuauuagugcuuguaucacug

SEQ ID NO: 1138944 - RNA, 22 nt, Human
gagccugaugaaacaggcagac

SEQ ID NO: 1138945 - RNA, 22 nt, Human
aaugaagccagguagaagagaa

SEQ ID NO: 1138946 - RNA, 22 nt, Human
gccaggcauuauuccgaucccu

SEQ ID NO: 1138947 - RNA, 22 nt, Human
ccagagagucgaugggggacac

SEQ ID NO: 1138948 - RNA, 22 nt, Human
uguaggcugaagaugaagugga

SEQ ID NO: 1138949 - RNA, 19 nt, Human
ucuggcagguaauuaggga

SEQ ID NO: 1138950 - RNA, 19 nt, Human
gugggacagacauuacaua

SEQ ID NO: 1138951 - RNA, 22 nt, Human
agggacccugaugacugaggag

SEQ ID NO: 1138952 - RNA, 22 nt, Human
cacacacugacaccuuaucuug

SEQ ID NO: 1138953 - RNA, 20 nt, Human
ucagagagagggugccacuu

SEQ ID NO: 1138954 - RNA, 22 nt, Human
uuaacacaucccugcucuaccc

SEQ ID NO: 1138955 - RNA, 22 nt, Human
ucaguuaacaacuauuuauuga

SEQ ID NO: 1138956 - RNA, 22 nt, Human
uuacaauaccacaucaccucau

SEQ ID NO: 1138957 - RNA, 22 nt, Human
gcacucuccuggcugccacagu

SEQ ID NO: 1138958 - RNA, 22 nt, Human
gagggguccaggaggcacuuac

SEQ ID NO: 1138959 - RNA, 22 nt, Human
cugcagggaccacaagcagguu

SEQ ID NO: 1138960 - RNA, 23 nt, Human
agcuucauugaccuccgcagggg

SEQ ID NO: 1138961 - RNA, 22 nt, Human
agacacagucugucuggaggag

SEQ ID NO: 1138962 - RNA, 22 nt, Human
cagggggugcaggcccugugac

SEQ ID NO: 1138963 - RNA, 22 nt, Human
cuaauguaucauggcucucagc

SEQ ID NO: 1138964 - RNA, 22 nt, Human
uacacagaaccugguguacagu

SEQ ID NO: 1138965 - RNA, 22 nt, Human
uuuuccuuucaucaggacaaag

SEQ ID NO: 1138966 - RNA, 22 nt, Human
ccagcuuuaucaagucugagcu

SEQ ID NO: 1138967 - RNA, 22 nt, Human
gagcucagcaaaggucugugug

SEQ ID NO: 1138968 - RNA, 22 nt, Human
acaguguucacuuaacaaugga

SEQ ID NO: 1138969 - RNA, 22 nt, Human
agaauaugaugguuggagaauu

SEQ ID NO: 1138970 - RNA, 22 nt, Human
ugcuuuauucaggguuuacccc

SEQ ID NO: 1138971 - RNA, 22 nt, Human
cccugcagggaggauucugaag

SEQ ID NO: 1138972 - RNA, 22 nt, Human
cccugagcgugaggaggaagua

SEQ ID NO: 1138973 - RNA, 22 nt, Human
gcuaggaguggugggucaagga

SEQ ID NO: 1138974 - RNA, 17 nt, Human
acaggcagaucaccuga

SEQ ID NO: 1138975 - RNA, 19 nt, Human
ccugccugagcugucccuc

SEQ ID NO: 1138976 - RNA, 22 nt, Human
ucuauaaauuaugcagucucag

SEQ ID NO: 1138977 - RNA, 22 nt, Human
cauaauaucuccgauuacuugc

SEQ ID NO: 1138978 - RNA, 22 nt, Human
aauguauuccucaugcaagagu

SEQ ID NO: 1138979 - RNA, 22 nt, Human
agggcugacaaauggcagugac

SEQ ID NO: 1138980 - RNA, 22 nt, Human
ggaccugcccuggcucagaugc

SEQ ID NO: 1138981 - RNA, 22 nt, Human
uaacacauuuuccucauacgga

SEQ ID NO: 1138982 - RNA, 22 nt, Human
accagugggaaguggaaaauga

SEQ ID NO: 1138983 - RNA, 22 nt, Human
aagcaacucccuccucauuuuu

SEQ ID NO: 1138984 - RNA, 22 nt, Human
uaucaauugggccaaaugguac

SEQ ID NO: 1138985 - RNA, 22 nt, Human
aggcaauccccugaggauacuu

SEQ ID NO: 1138986 - RNA, 18 nt, Human
gccugcucugcucucccc

SEQ ID NO: 1138987 - RNA, 22 nt, Human
augcuauacauaugacaucaca

SEQ ID NO: 1138988 - RNA, 22 nt, Human
uaauuucuggagggagaaagag

SEQ ID NO: 1138989 - RNA, 22 nt, Human
uugaaauacugcauuguucagu

SEQ ID NO: 1138990 - RNA, 22 nt, Human
ccagcccugccagagagagcug

SEQ ID NO: 1138991 - RNA, 22 nt, Human
caggcagcugacugucagauau

SEQ ID NO: 1138992 - RNA, 22 nt, Human
cugccugcaugcugccauagcu

SEQ ID NO: 1138993 - RNA, 22 nt, Human
uuucuagagugggcaugucuua

SEQ ID NO: 1138994 - RNA, 22 nt, Human
gcagcuuugucacggagugucg

SEQ ID NO: 1138995 - RNA, 18 nt, Human
uuuuacucauagcaggcc

SEQ ID NO: 1138996 - RNA, 22 nt, Human
ccacaucauggauacaguuaug

SEQ ID NO: 1138997 - RNA, 22 nt, Human
aacaaagucguugccuagaaga

SEQ ID NO: 1138998 - RNA, 22 nt, Human
cugggcugaaaguguuccuuga

SEQ ID NO: 1138999 - RNA, 22 nt, Human
ccagugcauaaucaauacagcc

SEQ ID NO: 1139000 - RNA, 22 nt, Human
aauucuguaacuuuacugaauu

SEQ ID NO: 1139001 - RNA, 22 nt, Human
agggggucguccggaagaccug

SEQ ID NO: 1139002 - RNA, 22 nt, Human
agagggcugcugcacagugcuc

SEQ ID NO: 1139003 - RNA, 22 nt, Human
gaacugaguuuucugccuggac

SEQ ID NO: 1139004 - RNA, 23 nt, Human
auguaucucauccaaggaagcuc

SEQ ID NO: 1139005 - RNA, 20 nt, Human
cccagagccauagccagaca

SEQ ID NO: 1139006 - RNA, 22 nt, Human
ggcugaguugagaggauuacuu

SEQ ID NO: 1139007 - RNA, 22 nt, Human
uccugcagaucaaagccuuuga

SEQ ID NO: 1139008 - RNA, 22 nt, Human
gaagagaaaggcaaggaguuuu

SEQ ID NO: 1139009 - RNA, 22 nt, Human
gccaggcagacaggucaucagg

SEQ ID NO: 1139010 - RNA, 20 nt, Human
uagggcucauuaugaucucc

SEQ ID NO: 1139011 - RNA, 22 nt, Human
cagcacagugaccagacccacu

SEQ ID NO: 1139012 - RNA, 23 nt, Human
uugugggcagauuccauggggag

SEQ ID NO: 1139013 - RNA, 22 nt, Human
gauucuuacuucuaagcaagcu

SEQ ID NO: 1139014 - RNA, 22 nt, Human
cuguccagucuuuagcaagcug

SEQ ID NO: 1139015 - RNA, 22 nt, Human
acuuaaaaagaaucuuuucacg

SEQ ID NO: 1139016 - RNA, 22 nt, Human
ccaaguacagauuccuccacug

SEQ ID NO: 1139017 - RNA, 22 nt, Human
uuggcaggaauauugcagaggu

SEQ ID NO: 1139018 - RNA, 22 nt, Human
gggcaaguccggugcccagagc

SEQ ID NO: 1139019 - RNA, 22 nt, Human
cugaaccaucucuguucuguau

SEQ ID NO: 1139020 - RNA, 22 nt, Human
ugguccugccccgugcacagag

SEQ ID NO: 1139021 - RNA, 22 nt, Human
uguaaaauaauucuccauguuu

SEQ ID NO: 1139022 - RNA, 22 nt, Human
cagcccaaagccccaggcuaga

SEQ ID NO: 1139023 - RNA, 22 nt, Human
aggaggcugaacuagggucugg

SEQ ID NO: 1139024 - RNA, 20 nt, Human
ucugugcaccugcuacaagg

SEQ ID NO: 1139025 - RNA, 22 nt, Human
cccagcccacgguccugggugg

SEQ ID NO: 1139026 - RNA, 22 nt, Human
ucuccaggagcaagucacccag

SEQ ID NO: 1139027 - RNA, 22 nt, Human
ccauucauacaauuuuguucua

SEQ ID NO: 1139028 - RNA, 19 nt, Human
aauuagggagucgguuaag

SEQ ID NO: 1139029 - RNA, 22 nt, Human
uuguaaaugaccuuuucuaauu

SEQ ID NO: 1139030 - RNA, 17 nt, Human
uccaggcauaucuccua

SEQ ID NO: 1139031 - RNA, 22 nt, Human
gccagaagggguggauccaggc

SEQ ID NO: 1139032 - RNA, 22 nt, Human
aacagcauaccaauguacauau

SEQ ID NO: 1139033 - RNA, 22 nt, Human
acaggcaggcuucggccagagc

SEQ ID NO: 1139034 - RNA, 22 nt, Human
gaugggcguggcgcguuuggug

SEQ ID NO: 1139035 - RNA, 22 nt, Human
uuuuucaugagacuagaaguca

SEQ ID NO: 1139036 - RNA, 22 nt, Human
uucacaauagcuggcaucaucu

SEQ ID NO: 1139037 - RNA, 22 nt, Human
ccagcuuucauaucaugaggua

SEQ ID NO: 1139038 - RNA, 22 nt, Human
cuggcuuucauuucaagcacgu

SEQ ID NO: 1139039 - RNA, 22 nt, Human
cuuaaauuggaugaguuaaguu

SEQ ID NO: 1139040 - RNA, 22 nt, Human
gggccccuuguaucucuggcuc

SEQ ID NO: 1139041 - RNA, 22 nt, Human
cauuuguaauacugacuugcag

SEQ ID NO: 1139042 - RNA, 22 nt, Human
guuucauuuacaucuguaggua

SEQ ID NO: 1139043 - RNA, 19 nt, Human
ggcaggcuggauagagagg

SEQ ID NO: 1139044 - RNA, 22 nt, Human
cagcccagccuugucucuuuau

SEQ ID NO: 1139045 - RNA, 22 nt, Human
uuuccuaagguagugauaauuu

SEQ ID NO: 1139046 - RNA, 22 nt, Human
agacaucauguuacagauuaag

SEQ ID NO: 1139047 - RNA, 22 nt, Human
agaccugcagggccaggccugc

SEQ ID NO: 1139048 - RNA, 22 nt, Human
aaugaaugaaccacauauaaca

SEQ ID NO: 1139049 - RNA, 22 nt, Human
agagggcuuugauucucaguuc

SEQ ID NO: 1139050 - RNA, 22 nt, Human
cugccugccacguucagcugua

SEQ ID NO: 1139051 - RNA, 22 nt, Human
gugggcuucuguuagggaggcu

SEQ ID NO: 1139052 - RNA, 22 nt, Human
aucagagacaaaaccagcacuu

SEQ ID NO: 1139053 - RNA, 22 nt, Human
guuuuuaucuaauagcaguuau

SEQ ID NO: 1139054 - RNA, 22 nt, Human
aaaaugacauuccagugauauu

SEQ ID NO: 1139055 - RNA, 22 nt, Human
ccaggcucugagaggaauguga

SEQ ID NO: 1139056 - RNA, 22 nt, Human
ggcaggcuccaagcauccuaug

SEQ ID NO: 1139057 - RNA, 22 nt, Human
uucacacacagcuuccuauugu

SEQ ID NO: 1139058 - RNA, 22 nt, Human
cuggcagucugguggaaggccu

SEQ ID NO: 1139059 - RNA, 22 nt, Human
gccuggcaggccuguuggggcu

SEQ ID NO: 1139060 - RNA, 22 nt, Human
uagcuagaaugcuucgugauau

SEQ ID NO: 1139061 - RNA, 22 nt, Human
gccaggggugcccacccaagga

SEQ ID NO: 1139062 - RNA, 22 nt, Human
augcuacauuuugguuuauaaa

SEQ ID NO: 1139063 - RNA, 22 nt, Human
cagagcugcuucccaguuugug

SEQ ID NO: 1139064 - RNA, 22 nt, Human
uguugauuaguguuuagacuua

SEQ ID NO: 1139065 - RNA, 22 nt, Human
gcccaggccggagagcagugcu

SEQ ID NO: 1139066 - RNA, 22 nt, Human
gcagggacagggcagggccuuu

SEQ ID NO: 1139067 - RNA, 20 nt, Human
uuucacaucugucccuuuaa

SEQ ID NO: 1139068 - RNA, 22 nt, Human
accaugaugcauccuuaaggaa

SEQ ID NO: 1139069 - RNA, 18 nt, Human
ucuggaacaacuucaugu

SEQ ID NO: 1139070 - RNA, 22 nt, Human
aaacacagggauauauauucca

SEQ ID NO: 1139071 - RNA, 22 nt, Human
uccccacaucucugcaucaggc

SEQ ID NO: 1139072 - RNA, 22 nt, Human
cugaaaauguuacacaggaaga

SEQ ID NO: 1139073 - RNA, 22 nt, Human
uccaggcaggguuaaggguccu

SEQ ID NO: 1139074 - RNA, 22 nt, Human
cugagcagugguucuugagcgc

SEQ ID NO: 1139075 - RNA, 20 nt, Human
gccugcagagaaggucagag

SEQ ID NO: 1139076 - RNA, 22 nt, Human
aaauacagauuccagggucuua

SEQ ID NO: 1139077 - RNA, 22 nt, Human
cugggcugcaggaguggggcaa

SEQ ID NO: 1139078 - RNA, 22 nt, Human
cucagagaaaaggagcaagggu

SEQ ID NO: 1139079 - RNA, 22 nt, Human
aucugucaggagcaaggacuac

SEQ ID NO: 1139080 - RNA, 22 nt, Human
cucugauuuccuuauucuguca

SEQ ID NO: 1139081 - RNA, 22 nt, Human
acacacacaagcagguugugga

SEQ ID NO: 1139082 - RNA, 22 nt, Human
uauguaaaaauucaucaggcug

SEQ ID NO: 1139083 - RNA, 22 nt, Human
uguaugaauauguuggggaggu

SEQ ID NO: 1139084 - RNA, 22 nt, Human
guuagggagggugcauaugugu

SEQ ID NO: 1139085 - RNA, 22 nt, Human
ucugcucuguggcuucagcuaa

SEQ ID NO: 1139086 - RNA, 20 nt, Human
guauuagguguuccucuuuc

SEQ ID NO: 1139087 - RNA, 22 nt, Human
cugggcuuugaagccaggcugc

SEQ ID NO: 1139088 - RNA, 22 nt, Human
uucuggggcuaauacagagguc

SEQ ID NO: 1139089 - RNA, 22 nt, Human
ugcaggcucaucucaagaguag

SEQ ID NO: 1139090 - RNA, 22 nt, Human
uugauuucuuacucuuccaagg

SEQ ID NO: 1139091 - RNA, 22 nt, Human
aaagaguucuaugaucuuucca

SEQ ID NO: 1139092 - RNA, 22 nt, Human
gcccagccuccaagcuccaagg

SEQ ID NO: 1139093 - RNA, 22 nt, Human
uccaggcaguuuuccagguugu

SEQ ID NO: 1139094 - RNA, 22 nt, Human
ccaggcucuaucccuccuucuu

SEQ ID NO: 1139095 - RNA, 22 nt, Human
ggcagugagaggucuccugguc

SEQ ID NO: 1139096 - RNA, 22 nt, Human
caccagggccccaggcugugcc

SEQ ID NO: 1139097 - RNA, 22 nt, Human
uucuagaggggagauacuagua

SEQ ID NO: 1139098 - RNA, 22 nt, Human
ucauguuauugacucauaauau

SEQ ID NO: 1139099 - RNA, 22 nt, Human
ccagagaccagaacauggggau

SEQ ID NO: 1139100 - RNA, 22 nt, Human
cuggggacgucgggcaguguuc

SEQ ID NO: 1139101 - RNA, 22 nt, Human
uggccaggccucuuggugccca

SEQ ID NO: 1139102 - RNA, 22 nt, Human
ucccacacuacacgguuguugg

SEQ ID NO: 1139103 - RNA, 20 nt, Human
uucuuaaagaccucacuuug

SEQ ID NO: 1139104 - RNA, 22 nt, Human
ugcuauaaguagacauucaaca

SEQ ID NO: 1139105 - RNA, 21 nt, Human
ugcauaaagaaauacaaauac

SEQ ID NO: 1139106 - RNA, 22 nt, Human
gcccggcagucacacacccagg

SEQ ID NO: 1139107 - RNA, 19 nt, Human
ugcauaaauuauauacuuu

SEQ ID NO: 1139108 - RNA, 22 nt, Human
gggccccuugcugcucugcugg

SEQ ID NO: 1139109 - RNA, 22 nt, Human
aaagucuuuauuuuguaucuuu

SEQ ID NO: 1139110 - RNA, 22 nt, Human
uuccuggcagaggccccgacag

SEQ ID NO: 1139111 - RNA, 22 nt, Human
uucagagagaaaccagugggaa

SEQ ID NO: 1139112 - RNA, 22 nt, Human
acacaucucaggggacacucuc

SEQ ID NO: 1139113 - RNA, 22 nt, Human
caggcuggagugcaauggcaca

SEQ ID NO: 1139114 - RNA, 22 nt, Human
ugacaaaacugcaauuacuuuu

SEQ ID NO: 1139115 - RNA, 22 nt, Human
cuuacaaaggagaggagauagg

SEQ ID NO: 1139116 - RNA, 20 nt, Human
agaggcuuccuugggaggag

SEQ ID NO: 1139117 - RNA, 22 nt, Human
ggcuucuggugggagcaugacu

SEQ ID NO: 1139118 - RNA, 22 nt, Human
guuagggaucaggaacaagagc

SEQ ID NO: 1139119 - RNA, 22 nt, Human
gcuggcagaagagcugguucaa

SEQ ID NO: 1139120 - RNA, 22 nt, Human
cuuggcaggguggaggaugcag

SEQ ID NO: 1139121 - RNA, 22 nt, Human
ucuuugaaaagauauuccuccu

SEQ ID NO: 1139122 - RNA, 22 nt, Human
gcagggcucaacaggacacccc

SEQ ID NO: 1139123 - RNA, 20 nt, Human
augggcugguuaggaagugu

SEQ ID NO: 1139124 - RNA, 17 nt, Human
agccugccccaugcugc

SEQ ID NO: 1139125 - RNA, 22 nt, Human
acaauacuuaccaauguuuuug

SEQ ID NO: 1139126 - RNA, 22 nt, Human
cugguggaggugccaggauuug

SEQ ID NO: 1139127 - RNA, 22 nt, Human
gccaggcagcuagcaaccccug

SEQ ID NO: 1139128 - RNA, 21 nt, Human
ggcuuuaugcucacccagccu

SEQ ID NO: 1139129 - RNA, 22 nt, Human
gaaaacuauuggccuagaacaa

SEQ ID NO: 1139130 - RNA, 22 nt, Human
ugggcugaggggccuugaugac

SEQ ID NO: 1139131 - RNA, 22 nt, Human
ccugggcuguaccugugcgcgg

SEQ ID NO: 1139132 - RNA, 17 nt, Human
ugcuggcaacauacaaa

SEQ ID NO: 1139133 - RNA, 22 nt, Human
uucugggguuaugggugauucu

SEQ ID NO: 1139134 - RNA, 22 nt, Human
gcuucuggaggagcugggcuga

SEQ ID NO: 1139135 - RNA, 22 nt, Human
cacauacaaggcacacuggagg

SEQ ID NO: 1139136 - RNA, 22 nt, Human
acagcuuuaguguggguggugc

SEQ ID NO: 1139137 - RNA, 22 nt, Human
gaggguggccuuuagagcccau

SEQ ID NO: 1139138 - RNA, 22 nt, Human
ucacauaaauuuaccagaugau

SEQ ID NO: 1139139 - RNA, 22 nt, Human
agcuuuauauaaaagaguacau

SEQ ID NO: 1139140 - RNA, 22 nt, Human
gcuuucuugguucugcaggggc

SEQ ID NO: 1139141 - RNA, 22 nt, Human
uuuucauuuuuguagaugcaag

SEQ ID NO: 1139142 - RNA, 22 nt, Human
uucacauaaugauacaaagcuu

SEQ ID NO: 1139143 - RNA, 22 nt, Human
ccuggcagcgugccgagcugcg

SEQ ID NO: 1139144 - RNA, 22 nt, Human
cuuauuagaaagaaaagacaug

SEQ ID NO: 1139145 - RNA, 22 nt, Human
uguccaggucagcagcagggac

SEQ ID NO: 1139146 - RNA, 22 nt, Human
acaugauuaaaagauuuuaaag

SEQ ID NO: 1139147 - RNA, 22 nt, Human
auguagaacagguuaaugacag

SEQ ID NO: 1139148 - RNA, 22 nt, Human
cagcuuuuuagaaucuagggca

SEQ ID NO: 1139149 - RNA, 22 nt, Human
cccugccuugggguccacaccg

SEQ ID NO: 1139150 - RNA, 22 nt, Human
uuauuagggugguuuauguucu

SEQ ID NO: 1139151 - RNA, 22 nt, Human
ccagagaguaggaggcauuauu

SEQ ID NO: 1139152 - RNA, 22 nt, Human
uccaggcucccucaggaugcac

SEQ ID NO: 1139153 - RNA, 18 nt, Human
acacacacaccuguguau

SEQ ID NO: 1139154 - RNA, 22 nt, Human
cuacauaaucuggauuugucug

SEQ ID NO: 1139155 - RNA, 22 nt, Human
cagggcucagggacugcagaaa

SEQ ID NO: 1139156 - RNA, 22 nt, Human
acuggaaaacacuacuacaugc

SEQ ID NO: 1139157 - RNA, 22 nt, Human
cuuugaaaggaagccacacagc

SEQ ID NO: 1139158 - RNA, 22 nt, Human
ucugaacauccagcaaugcaca

SEQ ID NO: 1139159 - RNA, 22 nt, Human
cgcaggcuggcgcggaguggca

SEQ ID NO: 1139160 - RNA, 22 nt, Human
aggcaguggagcuggaauaggc

SEQ ID NO: 1139161 - RNA, 22 nt, Human
cguguggucccggcaaggcaag

SEQ ID NO: 1139162 - RNA, 22 nt, Human
aaggcuuucagcuaacuugauu

SEQ ID NO: 1139163 - RNA, 22 nt, Human
ggcaggcuccagagcccucucc

SEQ ID NO: 1139164 - RNA, 22 nt, Human
cccaguuucaacuuuccagugg

SEQ ID NO: 1139165 - RNA, 22 nt, Human
ugagcagaacacgggauccaug

SEQ ID NO: 1139166 - RNA, 22 nt, Human
auuuaugauuagccuauuguug

SEQ ID NO: 1139167 - RNA, 22 nt, Human
uauucacaugaaaacaaauuuu

SEQ ID NO: 1139168 - RNA, 21 nt, Human
ccagcuuucccaagucccuuu

SEQ ID NO: 1139169 - RNA, 22 nt, Human
aaggcuuuugggaauuuucaac

SEQ ID NO: 1139170 - RNA, 22 nt, Human
acacaucagaaauaugaaugag

SEQ ID NO: 1139171 - RNA, 22 nt, Human
uaugaagcugauaaucacugau

SEQ ID NO: 1139172 - RNA, 22 nt, Human
uuguaugaucaaaagaaaugua

SEQ ID NO: 1139173 - RNA, 22 nt, Human
uuggcaggaggcuucaguuccu

SEQ ID NO: 1139174 - RNA, 18 nt, Human
ucauuuguuuugcaugaa

SEQ ID NO: 1139175 - RNA, 22 nt, Human
acaguguguuggaggagacugu

SEQ ID NO: 1139176 - RNA, 22 nt, Human
ugucuuuagccagcagucuucu

SEQ ID NO: 1139177 - RNA, 22 nt, Human
ugauguucuguauaucauauag

SEQ ID NO: 1139178 - RNA, 22 nt, Human
augggcugagaaucaagaauau

SEQ ID NO: 1139179 - RNA, 22 nt, Human
ccugcagggaaucgaggcagaa

SEQ ID NO: 1139180 - RNA, 22 nt, Human
gagacaucauaaugaaguuucc

SEQ ID NO: 1139181 - RNA, 23 nt, Human
ucuuuucaaugguucuuuaugug

SEQ ID NO: 1139182 - RNA, 22 nt, Human
cuccagggggcauccacacagc

SEQ ID NO: 1139183 - RNA, 22 nt, Human
acagagagggagugauaaaucc

SEQ ID NO: 1139184 - RNA, 22 nt, Human
gccuccggaguugcagugucuu

SEQ ID NO: 1139185 - RNA, 22 nt, Human
acugggcuguuuuuugagugga

SEQ ID NO: 1139186 - RNA, 22 nt, Human
ugggcucagucugcuugguccu

SEQ ID NO: 1139187 - RNA, 22 nt, Human
ggggaccuaggcucugucucuu

SEQ ID NO: 1139188 - RNA, 22 nt, Human
caauuucucuuuauaucucaca

SEQ ID NO: 1139189 - RNA, 22 nt, Human
cagucacauagguauacacaua

SEQ ID NO: 1139190 - RNA, 22 nt, Human
ccagggggcuuggugaggccau

SEQ ID NO: 1139191 - RNA, 22 nt, Human
cccaggcacagauuaucccaau

SEQ ID NO: 1139192 - RNA, 22 nt, Human
aaggccaucuacuuacggaauu

SEQ ID NO: 1139193 - RNA, 20 nt, Human
gcaaaauaggcucuguuggu

SEQ ID NO: 1139194 - RNA, 22 nt, Human
uuucaaacuuuacucuugaauc

SEQ ID NO: 1139195 - RNA, 22 nt, Human
aggggugugcauccuggaggau

SEQ ID NO: 1139196 - RNA, 22 nt, Human
aggcaguguguagcuggaagag

SEQ ID NO: 1139197 - RNA, 22 nt, Human
ggcuuuauuugcagccauuguu

SEQ ID NO: 1139198 - RNA, 22 nt, Human
auuagggaaggauuuggccuga

SEQ ID NO: 1139199 - RNA, 22 nt, Human
uuugucauaucacacaauuuug

SEQ ID NO: 1139200 - RNA, 22 nt, Human
uuggaaauggcuguaguuauga

SEQ ID NO: 1139201 - RNA, 22 nt, Human
guccucugcccaggucaagguu

SEQ ID NO: 1139202 - RNA, 22 nt, Human
ggcaaggggucaggcugagaca

SEQ ID NO: 1139203 - RNA, 22 nt, Human
uuuagggacaagggucuggggu

SEQ ID NO: 1139204 - RNA, 22 nt, Human
gcuaggagauugagcucugaag

SEQ ID NO: 1139205 - RNA, 22 nt, Human
aauguaugagcgugaaagcacu

SEQ ID NO: 1139206 - RNA, 22 nt, Human
ccaguguucauaauuuuacacu

SEQ ID NO: 1139207 - RNA, 22 nt, Human
gccuggaagugugucgugggaa

SEQ ID NO: 1139208 - RNA, 22 nt, Human
ggcuucugaaccaggcccugga

SEQ ID NO: 1139209 - RNA, 22 nt, Human
caggcucuuuugguggcaagga

SEQ ID NO: 1139210 - RNA, 22 nt, Human
gacacuucaccuuucccagccu

SEQ ID NO: 1139211 - RNA, 22 nt, Human
ucagcuuucucaaagaagcugg

SEQ ID NO: 1139212 - RNA, 20 nt, Human
gagucacagaagaagcugaa

SEQ ID NO: 1139213 - RNA, 22 nt, Human
ugcuucuggaguaacaggguga

SEQ ID NO: 1139214 - RNA, 22 nt, Human
guggccagccagggugcugaug

SEQ ID NO: 1139215 - RNA, 22 nt, Human
guuaauuuaguagaguccagau

SEQ ID NO: 1139216 - RNA, 22 nt, Human
uauugaggaucuccugcuaauu

SEQ ID NO: 1139217 - RNA, 22 nt, Human
ugcuuuaucugugagaaccuga

SEQ ID NO: 1139218 - RNA, 22 nt, Human
uucuggggccaauugccacugc

SEQ ID NO: 1139219 - RNA, 22 nt, Human
aagcuuccugaaugcucauuua

SEQ ID NO: 1139220 - RNA, 22 nt, Human
gaacacauguccuccuuggauu

SEQ ID NO: 1139221 - RNA, 22 nt, Human
uccugcaggcuugaguccucag

SEQ ID NO: 1139222 - RNA, 22 nt, Human
uacagcauguccuuagcaaggc

SEQ ID NO: 1139223 - RNA, 22 nt, Human
uuuugagauggagucuugcucu

SEQ ID NO: 1139224 - RNA, 22 nt, Human
uccuggcagaaauggggcugug

SEQ ID NO: 1139225 - RNA, 22 nt, Human
acuggcagaauugaauaguugu

SEQ ID NO: 1139226 - RNA, 22 nt, Human
agggaccuugauggguuuggga

SEQ ID NO: 1139227 - RNA, 22 nt, Human
auaugaagaauuccaauuugga

SEQ ID NO: 1139228 - RNA, 22 nt, Human
cuuuucauuguuuguacaugca

SEQ ID NO: 1139229 - RNA, 22 nt, Human
uggcagggugccaguugcgagu

SEQ ID NO: 1139230 - RNA, 22 nt, Human
gccacauagaggaggauauuaa

SEQ ID NO: 1139231 - RNA, 21 nt, Human
guccagagagccggcuccuga

SEQ ID NO: 1139232 - RNA, 22 nt, Human
ugugucaauuuucauuccuacu

SEQ ID NO: 1139233 - RNA, 22 nt, Human
gcaguccaaaguggcucucacc

SEQ ID NO: 1139234 - RNA, 22 nt, Human
ugcagagagauccucaggguuu

SEQ ID NO: 1139235 - RNA, 22 nt, Human
uaauuuuacuuccugagcaccu

SEQ ID NO: 1139236 - RNA, 22 nt, Human
aaguguuuggggaucauuuuaa

SEQ ID NO: 1139237 - RNA, 22 nt, Human
cuucuggguugcaggucuuggc

SEQ ID NO: 1139238 - RNA, 21 nt, Human
agaugcugaugcugcaggucc

SEQ ID NO: 1139239 - RNA, 22 nt, Human
uggaaagaggaagugcccagca

SEQ ID NO: 1139240 - RNA, 20 nt, Human
agcaggcugcagggugaaau

SEQ ID NO: 1139241 - RNA, 22 nt, Human
guaugcaucgacucaagucuga

SEQ ID NO: 1139242 - RNA, 22 nt, Human
cagggcucccaaauaucucuuc

SEQ ID NO: 1139243 - RNA, 22 nt, Human
uaaucuguauuccuacuuugca

SEQ ID NO: 1139244 - RNA, 22 nt, Human
acaauacuauuuucaguauccu

SEQ ID NO: 1139245 - RNA, 22 nt, Human
aaugauugcaaacauugagaac

SEQ ID NO: 1139246 - RNA, 22 nt, Human
caguauuuguucccuaucaaug

SEQ ID NO: 1139247 - RNA, 22 nt, Human
uuaaagaugcagcuuuagagaa

SEQ ID NO: 1139248 - RNA, 22 nt, Human
guuuucauuacugcugugauuu

SEQ ID NO: 1139249 - RNA, 22 nt, Human
auuugaaaucccuucuacugua

SEQ ID NO: 1139250 - RNA, 22 nt, Human
uuucacauucagauauagacuu

SEQ ID NO: 1139251 - RNA, 22 nt, Human
agcccggcuuccccgguugcua

SEQ ID NO: 1139252 - RNA, 22 nt, Human
uccaggcaagggaggagcaugg

SEQ ID NO: 1139253 - RNA, 22 nt, Human
uaucauuguguuauuucuucca

SEQ ID NO: 1139254 - RNA, 22 nt, Human
uuucacauuuguuuuaagaagu

SEQ ID NO: 1139255 - RNA, 22 nt, Human
ccauaaucuggcuuugagagag

SEQ ID NO: 1139256 - RNA, 22 nt, Human
aauguaugcugugguaucuucu

SEQ ID NO: 1139257 - RNA, 22 nt, Human
uagggcucgggcacaggacagg

SEQ ID NO: 1139258 - RNA, 22 nt, Human
ugcuuaaaaugaugauuauuuu

SEQ ID NO: 1139259 - RNA, 23 nt, Human
auggaagucacuguuuucuuguc

SEQ ID NO: 1139260 - RNA, 21 nt, Human
ucagagagucacagugaacug

SEQ ID NO: 1139261 - RNA, 22 nt, Human
cagggcuccaugcagggacucc

SEQ ID NO: 1139262 - RNA, 22 nt, Human
ucuucaaauccuacagugucug

SEQ ID NO: 1139263 - RNA, 22 nt, Human
ugaaauuaugcauuguuguacc

SEQ ID NO: 1139264 - RNA, 22 nt, Human
gaggggucacaugggcuggcuu

SEQ ID NO: 1139265 - RNA, 22 nt, Human
uccacccugcuuucuuaucucc

SEQ ID NO: 1139266 - RNA, 22 nt, Human
uagcaauagaaacauauaaagu

SEQ ID NO: 1139267 - RNA, 22 nt, Human
auguguuuguaccuuuaaauau

SEQ ID NO: 1139268 - RNA, 22 nt, Human
gaaauauuguacuggagauguu

SEQ ID NO: 1139269 - RNA, 23 nt, Human
aucuguucaucugacacagauuc

SEQ ID NO: 1139270 - RNA, 22 nt, Human
ccagcucucagcgggagacuca

SEQ ID NO: 1139271 - RNA, 22 nt, Human
aaaguuuguugcuuacaaagaa

SEQ ID NO: 1139272 - RNA, 22 nt, Human
ugggcacuguagcuggugcugg

SEQ ID NO: 1139273 - RNA, 22 nt, Human
gagggaccuuuacacagacauu

SEQ ID NO: 1139274 - RNA, 22 nt, Human
ccaggccuuccaguacgcagaa

SEQ ID NO: 1139275 - RNA, 22 nt, Human
agcaggcuacuccuguguucgu

SEQ ID NO: 1139276 - RNA, 22 nt, Human
gucuggaaggaggagauggagc

SEQ ID NO: 1139277 - RNA, 22 nt, Human
acagcuuuaucucagggaucag

SEQ ID NO: 1139278 - RNA, 22 nt, Human
ccaggcugggcggggaaccugg

SEQ ID NO: 1139279 - RNA, 22 nt, Human
gguaugaaaugauuccauguua

SEQ ID NO: 1139280 - RNA, 22 nt, Human
cuagggaccucagcuccuggag

SEQ ID NO: 1139281 - RNA, 21 nt, Human
uuucugaaggcaacaucuauc

SEQ ID NO: 1139282 - RNA, 22 nt, Human
auuuugcuggucugaauuacuu

SEQ ID NO: 1139283 - RNA, 22 nt, Human
cuuagggagaaugccucugcag

SEQ ID NO: 1139284 - RNA, 22 nt, Human
ugcaggcucacccuggagcuga

SEQ ID NO: 1139285 - RNA, 22 nt, Human
aaaguuugucacuuggcuagaa

SEQ ID NO: 1139286 - RNA, 22 nt, Human
uuccaggcuucucuggggcguc

SEQ ID NO: 1139287 - RNA, 21 nt, Human
uguguuuuaaugauauucugu

SEQ ID NO: 1139288 - RNA, 22 nt, Human
cagguggguguaugaaugcaaa

SEQ ID NO: 1139289 - RNA, 22 nt, Human
gagggcucugaaaggaggucac

SEQ ID NO: 1139290 - RNA, 22 nt, Human
ccacacagucaguuuccaagaa

SEQ ID NO: 1139291 - RNA, 22 nt, Human
uucugucagcugcuuugucuca

SEQ ID NO: 1139292 - RNA, 22 nt, Human
ucaucacauaugucaugauuug

SEQ ID NO: 1139293 - RNA, 22 nt, Human
acacccaggcuggcgugcagug

SEQ ID NO: 1139294 - RNA, 22 nt, Human
cccaaguuaauuuguagcugaa

SEQ ID NO: 1139295 - RNA, 22 nt, Human
caggaguccagagugucauuuu

SEQ ID NO: 1139296 - RNA, 22 nt, Human
agcuuuguggcuuugcaagacu

SEQ ID NO: 1139297 - RNA, 22 nt, Human
aucauuuuuaagagacucuucu

SEQ ID NO: 1139298 - RNA, 22 nt, Human
uccaggcagcccuuccugacuc

SEQ ID NO: 1139299 - RNA, 22 nt, Human
gccuggaaugcaaugugacgaa

SEQ ID NO: 1139300 - RNA, 19 nt, Human
uuaugaaggcuggggggag

SEQ ID NO: 1139301 - RNA, 22 nt, Human
acccagcaugacaccugcacau

SEQ ID NO: 1139302 - RNA, 17 nt, Human
cagugaggccuuuccuc

SEQ ID NO: 1139303 - RNA, 22 nt, Human
gcagggacaucuucagaucacu

SEQ ID NO: 1139304 - RNA, 22 nt, Human
cccugcagagggaugggggcag

SEQ ID NO: 1139305 - RNA, 22 nt, Human
uccucuccaugucucacgccac

SEQ ID NO: 1139306 - RNA, 22 nt, Human
cccagcaugcacgcugacacuc

SEQ ID NO: 1139307 - RNA, 22 nt, Human
acacagaguuugacacauggga

SEQ ID NO: 1139308 - RNA, 20 nt, Human
cauauauaccuagaagugga

SEQ ID NO: 1139309 - RNA, 22 nt, Human
gcuggcaguguauuguuagcug

SEQ ID NO: 1139310 - RNA, 22 nt, Human
gggaccugcgccacucacuguc

SEQ ID NO: 1139311 - RNA, 22 nt, Human
ggccucagggucacucuguaga

SEQ ID NO: 1139312 - RNA, 22 nt, Human
acugggcucccaggcuugucau

SEQ ID NO: 1139313 - RNA, 21 nt, Human
uucauaaaccauucucaugca

SEQ ID NO: 1139314 - RNA, 22 nt, Human
cagcucagucuugaagcacugg

SEQ ID NO: 1139315 - RNA, 22 nt, Human
cagagacuggagugcaguggcg

SEQ ID NO: 1139316 - RNA, 23 nt, Human
uugggaaauaguuaagacaugag

SEQ ID NO: 1139317 - RNA, 22 nt, Human
cagggagcuuucccaggacccu

SEQ ID NO: 1139318 - RNA, 23 nt, Human
cccagagcacagccuccagaugc

SEQ ID NO: 1139319 - RNA, 22 nt, Human
agcacaggcuuuggugugaggg

SEQ ID NO: 1139320 - RNA, 22 nt, Human
uggcaucuccgacagucuugau

SEQ ID NO: 1139321 - RNA, 22 nt, Human
cugguggagggacaggcuuagc

SEQ ID NO: 1139322 - RNA, 22 nt, Human
cacaugaugguggaagccauag

SEQ ID NO: 1139323 - RNA, 22 nt, Human
ccaccccaaaugaagaccucuc

SEQ ID NO: 1139324 - RNA, 22 nt, Human
uuucauugaugggugauagaaa

SEQ ID NO: 1139325 - RNA, 22 nt, Human
ccugggcugggcgucucauggg

SEQ ID NO: 1139326 - RNA, 18 nt, Human
gccaggcaggguggggaa

SEQ ID NO: 1139327 - RNA, 18 nt, Human
ggcagggaaaagauaggg

SEQ ID NO: 1139328 - RNA, 22 nt, Human
uagacauuucugguuauugaca

SEQ ID NO: 1139329 - RNA, 21 nt, Human
acagauuuuauaucucugcug

SEQ ID NO: 1139330 - RNA, 22 nt, Human
auaacuuagaguaggcaaaagu

SEQ ID NO: 1139331 - RNA, 22 nt, Human
cuccuggcaggcugagugaaau

SEQ ID NO: 1139332 - RNA, 22 nt, Human
ggaaacugcuuacacuagaggg

SEQ ID NO: 1139333 - RNA, 22 nt, Human
aaauuacagaucaccaaugcau

SEQ ID NO: 1139334 - RNA, 19 nt, Human
uccaggcauccuucaggcu

SEQ ID NO: 1139335 - RNA, 22 nt, Human
ucaggcucagguuaggggccaa

SEQ ID NO: 1139336 - RNA, 22 nt, Human
acaggugguagaguggaaagag

SEQ ID NO: 1139337 - RNA, 22 nt, Human
ucuggcaguaauaggggagaga

SEQ ID NO: 1139338 - RNA, 23 nt, Human
acagaaaguucugcuggacagag

SEQ ID NO: 1139339 - RNA, 21 nt, Human
gccugcagaccccaccaggcu

SEQ ID NO: 1139340 - RNA, 22 nt, Human
gcaguguuuacauauuagaaac

SEQ ID NO: 1139341 - RNA, 22 nt, Human
gucacuguauccagguuccagc

SEQ ID NO: 1139342 - RNA, 22 nt, Human
ucccagccacaguuuccaccug

SEQ ID NO: 1139343 - RNA, 22 nt, Human
ugggcuuuaucaugggucuggu

SEQ ID NO: 1139344 - RNA, 22 nt, Human
acaaaguuugugguauuccaag

SEQ ID NO: 1139345 - RNA, 22 nt, Human
ccuggcagaauauuaaagugca

SEQ ID NO: 1139346 - RNA, 22 nt, Human
cagcuuguuaccgagggagggu

SEQ ID NO: 1139347 - RNA, 22 nt, Human
ccuucucucugaagaccccaaa

SEQ ID NO: 1139348 - RNA, 22 nt, Human
ucagcuuugccaccagcuguaa

SEQ ID NO: 1139349 - RNA, 22 nt, Human
aaauuucuugaggcucucuagc

SEQ ID NO: 1139350 - RNA, 22 nt, Human
auuuucauuuugcagggugaga

SEQ ID NO: 1139351 - RNA, 22 nt, Human
aaauaguuagcccugcauauau

SEQ ID NO: 1139352 - RNA, 22 nt, Human
agugugagccuacaggccaaag

SEQ ID NO: 1139353 - RNA, 22 nt, Human
aaauauagcaauuaugccuacu

SEQ ID NO: 1139354 - RNA, 22 nt, Human
ugaaaucaaugucuucugucuc

SEQ ID NO: 1139355 - RNA, 22 nt, Human
aaguaugugauacauguuaauu

SEQ ID NO: 1139356 - RNA, 22 nt, Human
cuccagggaugagacagaguag

SEQ ID NO: 1139357 - RNA, 22 nt, Human
gugggcuuugcuggauccuucc

SEQ ID NO: 1139358 - RNA, 22 nt, Human
caauguaucaaccagaaaguuc

SEQ ID NO: 1139359 - RNA, 22 nt, Human
acacauaagaaacuacaaagag

SEQ ID NO: 1139360 - RNA, 22 nt, Human
uuuuauuaguggcuagaugggg

SEQ ID NO: 1139361 - RNA, 22 nt, Human
acaguucccgucuugcacagcu

SEQ ID NO: 1139362 - RNA, 22 nt, Human
uacaaaaggaagagggaucuua

SEQ ID NO: 1139363 - RNA, 22 nt, Human
agugauuugggugucagaaagu

SEQ ID NO: 1139364 - RNA, 22 nt, Human
auaaucuuucuuuuccagauag

SEQ ID NO: 1139365 - RNA, 22 nt, Human
ucagaaagaacacaggcaguag

SEQ ID NO: 1139366 - RNA, 22 nt, Human
aggccucugcuggaaagaguug

SEQ ID NO: 1139367 - RNA, 22 nt, Human
guccucugggagccuugagccu

SEQ ID NO: 1139368 - RNA, 22 nt, Human
guggcagggugcucaucaugca

SEQ ID NO: 1139369 - RNA, 22 nt, Human
acaggugguaaaauggacuguc

SEQ ID NO: 1139370 - RNA, 22 nt, Human
cuugggcucugugggccuuagu

SEQ ID NO: 1139371 - RNA, 22 nt, Human
uuucuacagcuggugcaacuuu

SEQ ID NO: 1139372 - RNA, 22 nt, Human
auugggaugccggcugauaaga

SEQ ID NO: 1139373 - RNA, 22 nt, Human
aauauguuccacuuaaagcugg

SEQ ID NO: 1139374 - RNA, 22 nt, Human
uccuggcagcccgcaggugcug

SEQ ID NO: 1139375 - RNA, 22 nt, Human
auaguguuacccuucuuaaagu

SEQ ID NO: 1139376 - RNA, 22 nt, Human
agcuuuauggugccucacuuga

SEQ ID NO: 1139377 - RNA, 22 nt, Human
uacauguuuacuccaagucagg

SEQ ID NO: 1139378 - RNA, 22 nt, Human
gaccaccagagguccgugggua

SEQ ID NO: 1139379 - RNA, 22 nt, Human
gacccagcuaaccaggugggga

SEQ ID NO: 1139380 - RNA, 22 nt, Human
agaauauugaaaguucuugaca

SEQ ID NO: 1139381 - RNA, 21 nt, Human
acauucacaggauauuaucau

SEQ ID NO: 1139382 - RNA, 22 nt, Human
gugcaggguagcgacggcagga

SEQ ID NO: 1139383 - RNA, 22 nt, Human
guacacacaaucucuggucagu

SEQ ID NO: 1139384 - RNA, 22 nt, Human
gcugcgccggaucccacguucc

SEQ ID NO: 1139385 - RNA, 22 nt, Human
ggugccagaguggcccaggggc

SEQ ID NO: 1139386 - RNA, 22 nt, Human
uaugaagcucucacuguguguc

SEQ ID NO: 1139387 - RNA, 22 nt, Human
ugaagccaaucugccaggcaga

SEQ ID NO: 1139388 - RNA, 22 nt, Human
uacccagcaaucccuagagguu

SEQ ID NO: 1139389 - RNA, 22 nt, Human
aaaguugugaaaccgaacaugu

SEQ ID NO: 1139390 - RNA, 22 nt, Human
ucaggagcugcacugggcccac

SEQ ID NO: 1139391 - RNA, 22 nt, Human
ccugcagguugcagaggcggaa

SEQ ID NO: 1139392 - RNA, 22 nt, Human
agaagaaaugaggccguucugc

SEQ ID NO: 1139393 - RNA, 22 nt, Human
gacacagacaguuagagguaau

SEQ ID NO: 1139394 - RNA, 22 nt, Human
ccuggcagcccagagcgccgcu

SEQ ID NO: 1139395 - RNA, 22 nt, Human
ggcaggcuuucagcaucaaguc

SEQ ID NO: 1139396 - RNA, 22 nt, Human
ugcaggcuuggaucacaucucc

SEQ ID NO: 1139397 - RNA, 18 nt, Human
ccuggcagccaugcgcgc

SEQ ID NO: 1139398 - RNA, 22 nt, Human
uucagugucaauuuuuaaauau

SEQ ID NO: 1139399 - RNA, 22 nt, Human
cccaggcacacugaagugacau

SEQ ID NO: 1139400 - RNA, 22 nt, Human
cagguacauucguagacccauu

SEQ ID NO: 1139401 - RNA, 22 nt, Human
cccugcagugugaccucaccua

SEQ ID NO: 1139402 - RNA, 17 nt, Human
ggagaucuggcagaggg

SEQ ID NO: 1139403 - RNA, 22 nt, Human
uggguaggaccagaaaugcacu

SEQ ID NO: 1139404 - RNA, 22 nt, Human
uuuaaauuuguguuuagagggu

SEQ ID NO: 1139405 - RNA, 22 nt, Human
gcagcucuccucugugaggaac

SEQ ID NO: 1139406 - RNA, 22 nt, Human
gggacccugggaggcuggcgca

SEQ ID NO: 1139407 - RNA, 22 nt, Human
ccuuuauucaauuaguccuaau

SEQ ID NO: 1139408 - RNA, 22 nt, Human
ugcagggaagcaaggguggcuc

SEQ ID NO: 1139409 - RNA, 22 nt, Human
ucuggcagcucuccucggcgga

SEQ ID NO: 1139410 - RNA, 22 nt, Human
cuguuauuucugccaggugagu

SEQ ID NO: 1139411 - RNA, 22 nt, Human
uucugucucuguguuuacauua

SEQ ID NO: 1139412 - RNA, 22 nt, Human
uccuggcaguaauuugauguug

SEQ ID NO: 1139413 - RNA, 22 nt, Human
guuauuaguaagacucgcacau

SEQ ID NO: 1139414 - RNA, 20 nt, Human
acuccagguggcaugaggac

SEQ ID NO: 1139415 - RNA, 22 nt, Human
accugcagguguuuccacacuu

SEQ ID NO: 1139416 - RNA, 22 nt, Human
aguaaaauuucugcugaggaga

SEQ ID NO: 1139417 - RNA, 22 nt, Human
ugcuucugcauucaauguugga

SEQ ID NO: 1139418 - RNA, 22 nt, Human
ugcuucugcuuuacuugguuca

SEQ ID NO: 1139419 - RNA, 22 nt, Human
ugccuacauuccuugcuuaugg

SEQ ID NO: 1139420 - RNA, 22 nt, Human
uccugcagcugaagcucaugug

SEQ ID NO: 1139421 - RNA, 22 nt, Human
cuccaaguauguuaaaaucuaa

SEQ ID NO: 1139422 - RNA, 22 nt, Human
ucacauuuucuacuacuguacg

SEQ ID NO: 1139423 - RNA, 22 nt, Human
ugcaggcugaggcuggcucaac

SEQ ID NO: 1139424 - RNA, 22 nt, Human
uuugugcagauguauauuugug

SEQ ID NO: 1139425 - RNA, 22 nt, Human
auauacuuggagacuaucauug

SEQ ID NO: 1139426 - RNA, 22 nt, Human
uuacuucuuacaaaagaaauau

SEQ ID NO: 1139427 - RNA, 22 nt, Human
gccaagcuguuuuucagagacg

SEQ ID NO: 1139428 - RNA, 22 nt, Human
cugggcucaccuguggcuggca

SEQ ID NO: 1139429 - RNA, 22 nt, Human
ccagcccugucaccaacuggag

SEQ ID NO: 1139430 - RNA, 22 nt, Human
uaguuaggguucugcagagaca

SEQ ID NO: 1139431 - RNA, 22 nt, Human
ugcagggaggccccgcagcccu

SEQ ID NO: 1139432 - RNA, 22 nt, Human
gacccggcuccaggcccagcag

SEQ ID NO: 1139433 - RNA, 22 nt, Human
uguuccaauaaggaguugaaau

SEQ ID NO: 1139434 - RNA, 21 nt, Human
cacacagugaucuauccacau

SEQ ID NO: 1139435 - RNA, 22 nt, Human
auaugcauguacgugugcacaa

SEQ ID NO: 1139436 - RNA, 21 nt, Human
gcaaguacuaucaucauuauc

SEQ ID NO: 1139437 - RNA, 22 nt, Human
cuuggcaguuucggaaggauga

SEQ ID NO: 1139438 - RNA, 22 nt, Human
aggaaacuguccccucauccua

SEQ ID NO: 1139439 - RNA, 22 nt, Human
auggccugcagugcugccacag

SEQ ID NO: 1139440 - RNA, 21 nt, Human
acugggcuagccugacuucug

SEQ ID NO: 1139441 - RNA, 22 nt, Human
ugcaggcucucugcugccagau

SEQ ID NO: 1139442 - RNA, 22 nt, Human
caguuuauaugucagagcugua

SEQ ID NO: 1139443 - RNA, 22 nt, Human
aagcacauuguacauuugugcu

SEQ ID NO: 1139444 - RNA, 22 nt, Human
caggacaaagcccuuugagaaa

SEQ ID NO: 1139445 - RNA, 22 nt, Human
cagggcucuuccggagcaggga

SEQ ID NO: 1139446 - RNA, 22 nt, Human
ugucauaacuuagugacaaauc

SEQ ID NO: 1139447 - RNA, 22 nt, Human
uguaaacagccccauggagagc

SEQ ID NO: 1139448 - RNA, 22 nt, Human
cagggcucagaagacagaccuc

SEQ ID NO: 1139449 - RNA, 21 nt, Human
agccugcaauguagguaccgg

SEQ ID NO: 1139450 - RNA, 22 nt, Human
cccacccucaagggugucuaua

SEQ ID NO: 1139451 - RNA, 22 nt, Human
uuguaugaucccauuuagugaa

SEQ ID NO: 1139452 - RNA, 21 nt, Human
uagggcucuauuuuuauuuca

SEQ ID NO: 1139453 - RNA, 22 nt, Human
uacauaauugucuuuguccuca

SEQ ID NO: 1139454 - RNA, 19 nt, Human
cgcaggcuucgggucgcuc

SEQ ID NO: 1139455 - RNA, 21 nt, Human
ccacucaugacuccacucacc

SEQ ID NO: 1139456 - RNA, 22 nt, Human
accugcagcuaaagauguaggg

SEQ ID NO: 1139457 - RNA, 22 nt, Human
gaaucauuggaaccacauccaa

SEQ ID NO: 1139458 - RNA, 22 nt, Human
auguaugauauuuccaguauca

SEQ ID NO: 1139459 - RNA, 22 nt, Human
ggguaccaagcugcuugggggc

SEQ ID NO: 1139460 - RNA, 22 nt, Human
aagcuuuaugaucucucagcua

SEQ ID NO: 1139461 - RNA, 22 nt, Human
augugaaaauccaauggcagca

SEQ ID NO: 1139462 - RNA, 22 nt, Human
cuuauuagaguuguguucuguu

SEQ ID NO: 1139463 - RNA, 22 nt, Human
uggcagugggaauggacaaaca

SEQ ID NO: 1139464 - RNA, 22 nt, Human
uagaacauaagucauucauuug

SEQ ID NO: 1139465 - RNA, 22 nt, Human
aacaaacaaacauuuugucauc

SEQ ID NO: 1139466 - RNA, 22 nt, Human
guacacacuauguauuguacac

SEQ ID NO: 1139467 - RNA, 16 nt, Human
gcacacacaucaauga

SEQ ID NO: 1139468 - RNA, 22 nt, Human
gaaacaugucugacaauuuacc

SEQ ID NO: 1139469 - RNA, 22 nt, Human
gccaaugacagucucaguucug

SEQ ID NO: 1139470 - RNA, 22 nt, Human
guuguuuuuguucucuauagcu

SEQ ID NO: 1139471 - RNA, 22 nt, Human
gcuucuaucccuccacugcacu

SEQ ID NO: 1139472 - RNA, 22 nt, Human
gcccagcuggcuuccagcacau

SEQ ID NO: 1139473 - RNA, 22 nt, Human
uuggguaggagaaagaacagau

SEQ ID NO: 1139474 - RNA, 22 nt, Human
agcucccagaagccagagucgg

SEQ ID NO: 1139475 - RNA, 22 nt, Human
aauuugauuuucuuaaaccaua

SEQ ID NO: 1139476 - RNA, 22 nt, Human
aaaguuugcaauuuauguuaau

SEQ ID NO: 1139477 - RNA, 22 nt, Human
uucaagauggccccagugagcc

SEQ ID NO: 1139478 - RNA, 22 nt, Human
ucaucacaauuuuaugacccuc

SEQ ID NO: 1139479 - RNA, 21 nt, Human
aggcucucauccagggaccca

SEQ ID NO: 1139480 - RNA, 22 nt, Human
augccaaauucucagccucuuu

SEQ ID NO: 1139481 - RNA, 22 nt, Human
ccaggcucuguuccccgaggag

SEQ ID NO: 1139482 - RNA, 22 nt, Human
ccuggcaggcuggggacagugc

SEQ ID NO: 1139483 - RNA, 22 nt, Human
cagggacaauggcagagccuga

SEQ ID NO: 1139484 - RNA, 22 nt, Human
uccaggaggugaggggaccaaa

SEQ ID NO: 1139485 - RNA, 22 nt, Human
ggaccaggccagccucccugcg

SEQ ID NO: 1139486 - RNA, 22 nt, Human
ugcuuuauucgacaucugguag

SEQ ID NO: 1139487 - RNA, 22 nt, Human
ugcuuuauaucucucuucuuag

SEQ ID NO: 1139488 - RNA, 17 nt, Human
accaggcaacacgccca

SEQ ID NO: 1139489 - RNA, 22 nt, Human
auguuauuaaaguacagauucu

SEQ ID NO: 1139490 - RNA, 22 nt, Human
uacccagggcuuuucugaugca

SEQ ID NO: 1139491 - RNA, 22 nt, Human
ccugcagagccacgugccagcg

SEQ ID NO: 1139492 - RNA, 22 nt, Human
aacacauaggcagagcaugaca

SEQ ID NO: 1139493 - RNA, 22 nt, Human
uggccagguugggcuuugcagc

SEQ ID NO: 1139494 - RNA, 22 nt, Human
ugcaggcuccaggugcacauau

SEQ ID NO: 1139495 - RNA, 22 nt, Human
agcaggcuaagggaccuguuua

SEQ ID NO: 1139496 - RNA, 22 nt, Human
acuggcagagggaaaaccauuc

SEQ ID NO: 1139497 - RNA, 22 nt, Human
cuaggaaugguaccucuuacaa

SEQ ID NO: 1139498 - RNA, 22 nt, Human
ccugaccuauuuuucucagcug

SEQ ID NO: 1139499 - RNA, 22 nt, Human
gugcaggggccuccccuugcug

SEQ ID NO: 1139500 - RNA, 21 nt, Human
ucuagaauccuguauaagacu

SEQ ID NO: 1139501 - RNA, 22 nt, Human
uaugaacuuuugaugugacaug

SEQ ID NO: 1139502 - RNA, 22 nt, Human
aucucauaacucauuugaagac

SEQ ID NO: 1139503 - RNA, 22 nt, Human
cggcuggugucgggcacagcaa

SEQ ID NO: 1139504 - RNA, 22 nt, Human
agaauaauacugaaaugcugaa

SEQ ID NO: 1139505 - RNA, 22 nt, Human
ccuggcagguuacaaccaguua

SEQ ID NO: 1139506 - RNA, 22 nt, Human
gcuggcagcuggaaguugggcu

SEQ ID NO: 1139507 - RNA, 22 nt, Human
acauaugugcuuauauccauga

SEQ ID NO: 1139508 - RNA, 22 nt, Human
cugccugcucuauccaggccug

SEQ ID NO: 1139509 - RNA, 22 nt, Human
ccagcuuuucuuaucauuauaa

SEQ ID NO: 1139510 - RNA, 22 nt, Human
accaggcaacugugaaugggcu

SEQ ID NO: 1139511 - RNA, 22 nt, Human
ucucaaaucaaacuuugagcuu

SEQ ID NO: 1139512 - RNA, 22 nt, Human
uccaggcacagaguuggucagu

SEQ ID NO: 1139513 - RNA, 22 nt, Human
augauuucuauauaaacuuaaa

SEQ ID NO: 1139514 - RNA, 22 nt, Human
cacacaucaaccuagacauugu

SEQ ID NO: 1139515 - RNA, 22 nt, Human
uucugucaaacucacaggccga

SEQ ID NO: 1139516 - RNA, 22 nt, Human
agggaccugucaaugacaguua

SEQ ID NO: 1139517 - RNA, 16 nt, Human
cuacccagugagaagg

SEQ ID NO: 1139518 - RNA, 22 nt, Human
uucugucagaagcuagcuccug

SEQ ID NO: 1139519 - RNA, 22 nt, Human
uuuucauuagaaugacugagaa

SEQ ID NO: 1139520 - RNA, 22 nt, Human
gcagcuuuguaaaguaugaagc

SEQ ID NO: 1139521 - RNA, 22 nt, Human
uaacacauuaguucuccuagau

SEQ ID NO: 1139522 - RNA, 22 nt, Human
auuuggcaacauuaauugaauc

SEQ ID NO: 1139523 - RNA, 22 nt, Human
cagucucucuccuugcaggcgu

SEQ ID NO: 1139524 - RNA, 22 nt, Human
ucaaucacguguuccauguucu

SEQ ID NO: 1139525 - RNA, 22 nt, Human
acaggcucucagccaguuggca

SEQ ID NO: 1139526 - RNA, 20 nt, Human
ugcuuuaugcuauacuuugu

SEQ ID NO: 1139527 - RNA, 18 nt, Human
gaugaagcugcuggggau

SEQ ID NO: 1139528 - RNA, 22 nt, Human
uaugaaacauucauacaaauaa

SEQ ID NO: 1139529 - RNA, 22 nt, Human
ggcucccacccauagggcgagu

SEQ ID NO: 1139530 - RNA, 22 nt, Human
ugcaggcugcaccccugcccug

SEQ ID NO: 1139531 - RNA, 22 nt, Human
uuucugaacaaagccauuauca

SEQ ID NO: 1139532 - RNA, 22 nt, Human
uuguuaaagaugcagauuccau

SEQ ID NO: 1139533 - RNA, 22 nt, Human
cuggggaccgagcaagcucugg

SEQ ID NO: 1139534 - RNA, 22 nt, Human
uuggaagacagugaaacagcac

SEQ ID NO: 1139535 - RNA, 22 nt, Human
acuggggauuagggacucagug

SEQ ID NO: 1139536 - RNA, 22 nt, Human
gcugcuaagcguuucuguucca

SEQ ID NO: 1139537 - RNA, 22 nt, Human
aaauacauaaagguuguaccag

SEQ ID NO: 1139538 - RNA, 22 nt, Human
ucuggcagcgaagcguguacuu

SEQ ID NO: 1139539 - RNA, 22 nt, Human
aguaugaagaauacauagauga

SEQ ID NO: 1139540 - RNA, 22 nt, Human
uucucagugaaguuuagaacau

SEQ ID NO: 1139541 - RNA, 22 nt, Human
acaggcaggcgggacagcccga

SEQ ID NO: 1139542 - RNA, 22 nt, Human
ucccacacuugaaacaaggcug

SEQ ID NO: 1139543 - RNA, 22 nt, Human
ggauuucuuccuuccucagaag

SEQ ID NO: 1139544 - RNA, 22 nt, Human
uagcuuuaaugaguugguaaga

SEQ ID NO: 1139545 - RNA, 22 nt, Human
ccaggcucacugacuaccacau

SEQ ID NO: 1139546 - RNA, 22 nt, Human
uucauaguguuuccuuccagug

SEQ ID NO: 1139547 - RNA, 22 nt, Human
acccagccacagcauugaggga

SEQ ID NO: 1139548 - RNA, 22 nt, Human
ccagcuuuuccucucauugcuu

SEQ ID NO: 1139549 - RNA, 22 nt, Human
aaaaagucugcaaaggagguug

SEQ ID NO: 1139550 - RNA, 22 nt, Human
acccacaccuccguauaucacu

SEQ ID NO: 1139551 - RNA, 22 nt, Human
cugugggaacacugaggacuuc

SEQ ID NO: 1139552 - RNA, 22 nt, Human
ccacuguagagauuugaaugcc

SEQ ID NO: 1139553 - RNA, 22 nt, Human
augacacuuggugauacuuugu

SEQ ID NO: 1139554 - RNA, 22 nt, Human
auuacaaucgagagaaacaaau

SEQ ID NO: 1139555 - RNA, 22 nt, Human
aucuguaaaugcaaauguagcu

SEQ ID NO: 1139556 - RNA, 22 nt, Human
uuucacauggaagcucucgaga

SEQ ID NO: 1139557 - RNA, 22 nt, Human
cuuacacagucuggcacuucuu

SEQ ID NO: 1139558 - RNA, 22 nt, Human
gccaagcuggaugaagagguug

SEQ ID NO: 1139559 - RNA, 22 nt, Human
ucuccacacuuucucucccagg

SEQ ID NO: 1139560 - RNA, 22 nt, Human
cauacaagcguucaauagaugu

SEQ ID NO: 1139561 - RNA, 22 nt, Human
ggcuucugagugcucugcuguu

SEQ ID NO: 1139562 - RNA, 18 nt, Human
gaguguggcacugggccc

SEQ ID NO: 1139563 - RNA, 22 nt, Human
auuguugggucucacuccuaga

SEQ ID NO: 1139564 - RNA, 22 nt, Human
gcagcuuuuuggaugucaguua

SEQ ID NO: 1139565 - RNA, 22 nt, Human
gaggagcugcagggggagucua

SEQ ID NO: 1139566 - RNA, 22 nt, Human
gcacauaaagggcaugggaggu

SEQ ID NO: 1139567 - RNA, 22 nt, Human
ucuuuauuucugaaucccccau

SEQ ID NO: 1139568 - RNA, 22 nt, Human
uccaggcauuccagccauucca

SEQ ID NO: 1139569 - RNA, 22 nt, Human
ccaggcucugucuggucagaag

SEQ ID NO: 1139570 - RNA, 22 nt, Human
agcacagggacaaugccaggug

SEQ ID NO: 1139571 - RNA, 19 nt, Human
guuucauuaagauaggaaa

SEQ ID NO: 1139572 - RNA, 22 nt, Human
ucccaggcugggggccugaagu

SEQ ID NO: 1139573 - RNA, 23 nt, Human
uuuauuuauuuaggcugagggau

SEQ ID NO: 1139574 - RNA, 22 nt, Human
cauuuauucaugaucuguagcu

SEQ ID NO: 1139575 - RNA, 22 nt, Human
aauuagggaaguauuuaguagu

SEQ ID NO: 1139576 - RNA, 22 nt, Human
agggcugacagugaggagucaa

SEQ ID NO: 1139577 - RNA, 22 nt, Human
gacuguggggggcggacacaag

SEQ ID NO: 1139578 - RNA, 22 nt, Human
ucacaauacucacucaauggcu

SEQ ID NO: 1139579 - RNA, 21 nt, Human
acaggcucacgauccauuucu

SEQ ID NO: 1139580 - RNA, 22 nt, Human
caggccuccacuccacgcagac

SEQ ID NO: 1139581 - RNA, 23 nt, Human
uuggagagggugaguagugucag

SEQ ID NO: 1139582 - RNA, 22 nt, Human
uccaggaggccucauuuccugu

SEQ ID NO: 1139583 - RNA, 22 nt, Human
guggcuuggaccagucacagug

SEQ ID NO: 1139584 - RNA, 22 nt, Human
cauucacaucuuguuccaucac

SEQ ID NO: 1139585 - RNA, 20 nt, Human
uucugucagauuauauggga

SEQ ID NO: 1139586 - RNA, 22 nt, Human
auccuggcccagguguggaggg

SEQ ID NO: 1139587 - RNA, 22 nt, Human
auuucacaucuaucucagauuu

SEQ ID NO: 1139588 - RNA, 22 nt, Human
cagagagcuuagugugcugcau

SEQ ID NO: 1139589 - RNA, 22 nt, Human
uccaggcagggcagccaucaag

SEQ ID NO: 1139590 - RNA, 22 nt, Human
ccagagagauugcuucuaaaga

SEQ ID NO: 1139591 - RNA, 22 nt, Human
cagcuuuauuaaugauugucuu

SEQ ID NO: 1139592 - RNA, 22 nt, Human
ucagggacugcagagggaagcu

SEQ ID NO: 1139593 - RNA, 22 nt, Human
acaguuugcccugacauucucc

SEQ ID NO: 1139594 - RNA, 22 nt, Human
cauuaggguaauugaacacuua

SEQ ID NO: 1139595 - RNA, 22 nt, Human
aucugcuuuugagaauuuacuu

SEQ ID NO: 1139596 - RNA, 22 nt, Human
aacaugauggggaagaacaaga

SEQ ID NO: 1139597 - RNA, 22 nt, Human
cauuuguauagugcuuagacca

SEQ ID NO: 1139598 - RNA, 22 nt, Human
gucuucuguucugugaggcuuc

SEQ ID NO: 1139599 - RNA, 22 nt, Human
cuucugggugccugugaguguu

SEQ ID NO: 1139600 - RNA, 18 nt, Human
uuucacaaccuccagagg

SEQ ID NO: 1139601 - RNA, 22 nt, Human
gccuggcaaggcccuguugacu

SEQ ID NO: 1139602 - RNA, 22 nt, Human
aauuagggaggacaaagguaca

SEQ ID NO: 1139603 - RNA, 17 nt, Human
ugccagccugucccagg

SEQ ID NO: 1139604 - RNA, 22 nt, Human
cacccaggacaggccagaugug

SEQ ID NO: 1139605 - RNA, 22 nt, Human
gcugggcuugguuucccugcuu

SEQ ID NO: 1139606 - RNA, 22 nt, Human
uucaguuccauuucaggugggu

SEQ ID NO: 1139607 - RNA, 22 nt, Human
cuuaggaacgcucugccuagug

SEQ ID NO: 1139608 - RNA, 22 nt, Human
ucuggggauaagacccagguau

SEQ ID NO: 1139609 - RNA, 22 nt, Human
ucccugccuccuggcagugcca

SEQ ID NO: 1139610 - RNA, 22 nt, Human
auuucauacuaaggcucaaaaa

SEQ ID NO: 1139611 - RNA, 23 nt, Human
uccaggcaugagcucuggaugga

SEQ ID NO: 1139612 - RNA, 22 nt, Human
gcguccagggaaggcccagcug

SEQ ID NO: 1139613 - RNA, 22 nt, Human
uuucacacugcagcaucagaga

SEQ ID NO: 1139614 - RNA, 22 nt, Human
ucuucaaacugaaaauuuagaa

SEQ ID NO: 1139615 - RNA, 22 nt, Human
ggagugugggauggagcucagg

SEQ ID NO: 1139616 - RNA, 22 nt, Human
ucaagagaaggggaaauagacu

SEQ ID NO: 1139617 - RNA, 22 nt, Human
acauuucucuugaugucucuau

SEQ ID NO: 1139618 - RNA, 22 nt, Human
gggcugaccaaugccuugcuuu

SEQ ID NO: 1139619 - RNA, 22 nt, Human
gugggguagaucuuucucagga

SEQ ID NO: 1139620 - RNA, 22 nt, Human
auuucauugaaguuaauucuuc

SEQ ID NO: 1139621 - RNA, 22 nt, Human
ugcauuuuuaacaaggcuaauu

SEQ ID NO: 1139622 - RNA, 22 nt, Human
acuggcuugaaguagauucaaa

SEQ ID NO: 1139623 - RNA, 22 nt, Human
agucccuucucaaagugugcgg

SEQ ID NO: 1139624 - RNA, 22 nt, Human
gaaagacuuccuuugagaguac

SEQ ID NO: 1139625 - RNA, 22 nt, Human
uucugcaucugaauuuaaguac

SEQ ID NO: 1139626 - RNA, 22 nt, Human
ucaugaacaucucaaauaacca

SEQ ID NO: 1139627 - RNA, 22 nt, Human
acccagcaaagauaaacuuaug

SEQ ID NO: 1139628 - RNA, 22 nt, Human
gccugcagugagugcagaaggu

SEQ ID NO: 1139629 - RNA, 22 nt, Human
auuuucauggcuucugcucagu

SEQ ID NO: 1139630 - RNA, 22 nt, Human
auuuauuaccucggaguuucug

SEQ ID NO: 1139631 - RNA, 22 nt, Human
ggcugcaggcagaggcugucug

SEQ ID NO: 1139632 - RNA, 22 nt, Human
ucuuccaggagggcauuucuuu

SEQ ID NO: 1139633 - RNA, 22 nt, Human
uuucugaagauacagcuuugcu

SEQ ID NO: 1139634 - RNA, 22 nt, Human
gaacuguaguuaauacuacaca

SEQ ID NO: 1139635 - RNA, 22 nt, Human
uuccuggccaagcagaguggaa

SEQ ID NO: 1139636 - RNA, 22 nt, Human
acuguccauucacucauauuca

SEQ ID NO: 1139637 - RNA, 22 nt, Human
aaaaauaggucaaccguguaug

SEQ ID NO: 1139638 - RNA, 22 nt, Human
agcccagcuuugaaccauauca

SEQ ID NO: 1139639 - RNA, 22 nt, Human
gggcuguaggagcuggaauggg

SEQ ID NO: 1139640 - RNA, 22 nt, Human
uaugacaagguggaguaugagu

SEQ ID NO: 1139641 - RNA, 22 nt, Human
gaauaguucuauggcugcaggg

SEQ ID NO: 1139642 - RNA, 22 nt, Human
uuccagagaaaagguuuauuuc

SEQ ID NO: 1139643 - RNA, 22 nt, Human
uauugacaauuugugaaacuau

SEQ ID NO: 1139644 - RNA, 17 nt, Human
uuuagaauacaauguuu

SEQ ID NO: 1139645 - RNA, 22 nt, Human
acagauuuuauuauucagguau

SEQ ID NO: 1139646 - RNA, 22 nt, Human
ggcucugcaugugagugggugg

SEQ ID NO: 1139647 - RNA, 22 nt, Human
ucuuuauugcuacugguuuguc

SEQ ID NO: 1139648 - RNA, 22 nt, Human
ucugggcuuuugcacuggccau

SEQ ID NO: 1139649 - RNA, 22 nt, Human
caguguuuguauagaauaugca

SEQ ID NO: 1139650 - RNA, 22 nt, Human
uuaugaaguuccuguuacagug

SEQ ID NO: 1139651 - RNA, 22 nt, Human
uccaggcaaggauaauaaacau

SEQ ID NO: 1139652 - RNA, 22 nt, Human
acaggccuuggcaggcauguga

SEQ ID NO: 1139653 - RNA, 22 nt, Human
aaaguuugagugauuugacaca

SEQ ID NO: 1139654 - RNA, 22 nt, Human
gcuucuggaagcauaugcaaga

SEQ ID NO: 1139655 - RNA, 22 nt, Human
gcaggcuccaggccggccccuu

SEQ ID NO: 1139656 - RNA, 20 nt, Human
ucccaggcuccacccuagac

SEQ ID NO: 1139657 - RNA, 22 nt, Human
uccugagcacagagacaaggaa

SEQ ID NO: 1139658 - RNA, 22 nt, Human
aaguccagcucuaaauaucuga

SEQ ID NO: 1139659 - RNA, 22 nt, Human
guccucugaaagaugaaccaug

SEQ ID NO: 1139660 - RNA, 22 nt, Human
aauaacuucauguaacauuuaa

SEQ ID NO: 1139661 - RNA, 22 nt, Human
ggaccugcauuuuaacaagauc

SEQ ID NO: 1139662 - RNA, 22 nt, Human
agggacccauagagagaccagu

SEQ ID NO: 1139663 - RNA, 22 nt, Human
uggguaggggacguggaagaaa

SEQ ID NO: 1139664 - RNA, 22 nt, Human
guccucuggccuuucccaggac

SEQ ID NO: 1139665 - RNA, 22 nt, Human
uacccagcuucaagucaggacu

SEQ ID NO: 1139666 - RNA, 22 nt, Human
acuggcagaacgugaugcgggu

SEQ ID NO: 1139667 - RNA, 22 nt, Human
agccagagcagggaauuggaca

SEQ ID NO: 1139668 - RNA, 22 nt, Human
uacauucccccaauuaccaaug

SEQ ID NO: 1139669 - RNA, 22 nt, Human
uaaacaucugucauguguuuau

SEQ ID NO: 1139670 - RNA, 22 nt, Human
agucacaguuucccugagagag

SEQ ID NO: 1139671 - RNA, 22 nt, Human
gaaauauugggacucagagcuu

SEQ ID NO: 1139672 - RNA, 22 nt, Human
cauguuaaugaauuuuugcagu

SEQ ID NO: 1139673 - RNA, 22 nt, Human
ggggcugaaccuggaggugguc

SEQ ID NO: 1139674 - RNA, 17 nt, Human
gcaucacagauaacacg

SEQ ID NO: 1139675 - RNA, 22 nt, Human
uguaaagguaggugcaaaauga

SEQ ID NO: 1139676 - RNA, 22 nt, Human
uuucuuuguuguuaucacauca

SEQ ID NO: 1139677 - RNA, 22 nt, Human
ccucuccuugcacccgucccgc

SEQ ID NO: 1139678 - RNA, 22 nt, Human
ugaagcuugagugucaguuccu

SEQ ID NO: 1139679 - RNA, 22 nt, Human
uuccaggcuauccggugaaggg

SEQ ID NO: 1139680 - RNA, 22 nt, Human
augggcugaaagaguaagcugu

SEQ ID NO: 1139681 - RNA, 22 nt, Human
aaguauuucuggccugugaaag

SEQ ID NO: 1139682 - RNA, 22 nt, Human
guacccagaggcaugaucccag

SEQ ID NO: 1139683 - RNA, 22 nt, Human
agcaggcuccuuccuucucugg

SEQ ID NO: 1139684 - RNA, 22 nt, Human
auauuucaugggguuccauacu

SEQ ID NO: 1139685 - RNA, 22 nt, Human
acugggcuuaugcuguggagua

SEQ ID NO: 1139686 - RNA, 22 nt, Human
ucagagagccucaggcacugcc

SEQ ID NO: 1139687 - RNA, 22 nt, Human
aaguuucaugauguaauuauug

SEQ ID NO: 1139688 - RNA, 22 nt, Human
auaauauaauccuacuucccau

SEQ ID NO: 1139689 - RNA, 22 nt, Human
agacuucuuugugagcauuuuc

SEQ ID NO: 1139690 - RNA, 22 nt, Human
agguauauauucugguccuuau

SEQ ID NO: 1139691 - RNA, 17 nt, Human
gugaagagucauugaau

SEQ ID NO: 1139692 - RNA, 22 nt, Human
aacagcauaaguauuuauuuca

SEQ ID NO: 1139693 - RNA, 22 nt, Human
ccagagaguaaacauuuuccgg

SEQ ID NO: 1139694 - RNA, 22 nt, Human
cugccugcuuaccaugcaucag

SEQ ID NO: 1139695 - RNA, 22 nt, Human
gcugggcuucucaaugcugccu

SEQ ID NO: 1139696 - RNA, 22 nt, Human
ggaggugggcuaaggacucucu

SEQ ID NO: 1139697 - RNA, 22 nt, Human
accaugaucugcucugguguuu

SEQ ID NO: 1139698 - RNA, 22 nt, Human
gagacagaguuucacucuuguu

SEQ ID NO: 1139699 - RNA, 22 nt, Human
agcuuuaugcuuccuacaagcu

SEQ ID NO: 1139700 - RNA, 22 nt, Human
uuguaugaccacaaucugacgu

SEQ ID NO: 1139701 - RNA, 22 nt, Human
gauggcagguaguggucucauc

SEQ ID NO: 1139702 - RNA, 22 nt, Human
uaccugcacagccagccaugug

SEQ ID NO: 1139703 - RNA, 22 nt, Human
aauguuguuuuucugcaugucu

SEQ ID NO: 1139704 - RNA, 22 nt, Human
gagggcucaacuacuacuaggc

SEQ ID NO: 1139705 - RNA, 22 nt, Human
gaaauauuucucuugagccccu

SEQ ID NO: 1139706 - RNA, 22 nt, Human
augcuuuuaugucacaugguca

SEQ ID NO: 1139707 - RNA, 23 nt, Human
ccuggcagcaaacgaggagguua

SEQ ID NO: 1139708 - RNA, 22 nt, Human
cagggagcuggugccagccgac

SEQ ID NO: 1139709 - RNA, 22 nt, Human
ugggcugaacuucaucugauga

SEQ ID NO: 1139710 - RNA, 22 nt, Human
ucccagccuggacccugccagu

SEQ ID NO: 1139711 - RNA, 22 nt, Human
cugggcugagccugggcugugu

SEQ ID NO: 1139712 - RNA, 22 nt, Human
ugauuucuuccuugucauuaga

SEQ ID NO: 1139713 - RNA, 22 nt, Human
uguaacacucaaucuguuuaac

SEQ ID NO: 1139714 - RNA, 21 nt, Human
guagggacagagaguugguga

SEQ ID NO: 1139715 - RNA, 21 nt, Human
cagacccucuagaggccaccu

SEQ ID NO: 1139716 - RNA, 22 nt, Human
agccauccuacuaccucagcau

SEQ ID NO: 1139717 - RNA, 22 nt, Human
cccgagugucuacucacuccca

SEQ ID NO: 1139718 - RNA, 22 nt, Human
gaacacaugauuauaaaugcua

SEQ ID NO: 1139719 - RNA, 22 nt, Human
caggucuguuuccaucagugcu

SEQ ID NO: 1139720 - RNA, 22 nt, Human
acacauaagccuaaucaucucc

SEQ ID NO: 1139721 - RNA, 22 nt, Human
gcacccagagggcagggucucc

SEQ ID NO: 1139722 - RNA, 22 nt, Human
cuccucuguauugauugggacu

SEQ ID NO: 1139723 - RNA, 19 nt, Human
agaggccucagcagcuggc

SEQ ID NO: 1139724 - RNA, 22 nt, Human
auauaauuguucugaaguguuu

SEQ ID NO: 1139725 - RNA, 21 nt, Human
aauuagggugccucuuauaau

SEQ ID NO: 1139726 - RNA, 22 nt, Human
uacuuuuagccuauuugauucu

SEQ ID NO: 1139727 - RNA, 22 nt, Human
uucucuuuucaccaguugcuaa

SEQ ID NO: 1139728 - RNA, 22 nt, Human
cccagccuacucugccauagca

SEQ ID NO: 1139729 - RNA, 22 nt, Human
auguuaaaugguuuauuauuaa

SEQ ID NO: 1139730 - RNA, 22 nt, Human
ucaauauauuccauguuuucuc

SEQ ID NO: 1139731 - RNA, 23 nt, Human
gggcuccagucucugcucaguug

SEQ ID NO: 1139732 - RNA, 22 nt, Human
acaggcucacagucauuucauu

SEQ ID NO: 1139733 - RNA, 21 nt, Human
acugugauaaugcuuuuucug

SEQ ID NO: 1139734 - RNA, 22 nt, Human
uuauauaucuugauuuguucca

SEQ ID NO: 1139735 - RNA, 18 nt, Human
cuccagggaacucaguca

SEQ ID NO: 1139736 - RNA, 22 nt, Human
gcagcuuugaagacuuauuugc

SEQ ID NO: 1139737 - RNA, 22 nt, Human
agugcuccuauggaucaguugu

SEQ ID NO: 1139738 - RNA, 22 nt, Human
auucagugugagguuuucaagu

SEQ ID NO: 1139739 - RNA, 21 nt, Human
aacacauccagaguauuugac

SEQ ID NO: 1139740 - RNA, 22 nt, Human
ugggcuccguugccuggggcag

SEQ ID NO: 1139741 - RNA, 22 nt, Human
uuuaaagugcugcuccuauccu

SEQ ID NO: 1139742 - RNA, 22 nt, Human
gacccagaaggagugcccuaga

SEQ ID NO: 1139743 - RNA, 22 nt, Human
aauuauguagccauaugaaaca

SEQ ID NO: 1139744 - RNA, 22 nt, Human
aguaugaaucuuucagaccgua

SEQ ID NO: 1139745 - RNA, 22 nt, Human
gcacccaguuugucucaggguu

SEQ ID NO: 1139746 - RNA, 22 nt, Human
ucaggcccagagucacggaucc

SEQ ID NO: 1139747 - RNA, 23 nt, Human
cugggcugcuugagucccuggcu

SEQ ID NO: 1139748 - RNA, 22 nt, Human
auuaaauuuucacuaggcuccc

SEQ ID NO: 1139749 - RNA, 22 nt, Human
gccugcagcugcuuccacacac

SEQ ID NO: 1139750 - RNA, 21 nt, Human
aaagagcccgcugagagguuc

SEQ ID NO: 1139751 - RNA, 22 nt, Human
uucuuaaagaggcaaaacacag

SEQ ID NO: 1139752 - RNA, 22 nt, Human
aaguuuaacuugaauucuuucu

SEQ ID NO: 1139753 - RNA, 22 nt, Human
ugcugagcgcauccggcggccg

SEQ ID NO: 1139754 - RNA, 22 nt, Human
gccugcagggugaugggcugcc

SEQ ID NO: 1139755 - RNA, 22 nt, Human
aaacagauaaugcuauaaaugg

SEQ ID NO: 1139756 - RNA, 22 nt, Human
ugcuuaaacccugaucaugugu

SEQ ID NO: 1139757 - RNA, 22 nt, Human
cauuuucagcacccaucugaaa

SEQ ID NO: 1139758 - RNA, 21 nt, Human
augugaaaccuuccacgcuga

SEQ ID NO: 1139759 - RNA, 22 nt, Human
uaauuucuaauucauuuucagu

SEQ ID NO: 1139760 - RNA, 22 nt, Human
agcaggcuaaucuugcugaaca

SEQ ID NO: 1139761 - RNA, 22 nt, Human
guauuaggagguggagccuuug

SEQ ID NO: 1139762 - RNA, 22 nt, Human
uauucauaguaaacaaaagugg

SEQ ID NO: 1139763 - RNA, 22 nt, Human
ggcccagccucagacaugcccu

SEQ ID NO: 1139764 - RNA, 21 nt, Human
agcaggcuuuggaguggggcu

SEQ ID NO: 1139765 - RNA, 22 nt, Human
uguacuaaggcuguguagaugu

SEQ ID NO: 1139766 - RNA, 22 nt, Human
auguccagaguaaagcacauuc

SEQ ID NO: 1139767 - RNA, 22 nt, Human
gcuucugguagaauucaauaga

SEQ ID NO: 1139768 - RNA, 22 nt, Human
ucugggcuuggauuggcucugc

SEQ ID NO: 1139769 - RNA, 19 nt, Human
cuccaaguuaagagggagg

SEQ ID NO: 1139770 - RNA, 22 nt, Human
cuuuucaugccagcccaucaca

SEQ ID NO: 1139771 - RNA, 22 nt, Human
acaucacagagcccagauaaag

SEQ ID NO: 1139772 - RNA, 22 nt, Human
ugaaacaaugugaaguugcuga

SEQ ID NO: 1139773 - RNA, 22 nt, Human
cugugggaugggaccucagcug

SEQ ID NO: 1139774 - RNA, 22 nt, Human
cucagccccaauucuccccauu

SEQ ID NO: 1139775 - RNA, 22 nt, Human
auggcagaccuccuggccacaa

SEQ ID NO: 1139776 - RNA, 22 nt, Human
uucaaauuaccacauuugcuua

SEQ ID NO: 1139777 - RNA, 22 nt, Human
auguaugaugcuaggcucucag

SEQ ID NO: 1139778 - RNA, 22 nt, Human
ugucagagcaaggccaggccag

SEQ ID NO: 1139779 - RNA, 22 nt, Human
acaggcucucuauugagugcag

SEQ ID NO: 1139780 - RNA, 22 nt, Human
uccaaguccauuaugguggucu

SEQ ID NO: 1139781 - RNA, 22 nt, Human
ucacacagcuccuuuccuuagu

SEQ ID NO: 1139782 - RNA, 22 nt, Human
cucauuaaaggaaaucaccugc

SEQ ID NO: 1139783 - RNA, 22 nt, Human
uccugugccaucucuagagacu

SEQ ID NO: 1139784 - RNA, 22 nt, Human
cagaguuuuaucauacguggau

SEQ ID NO: 1139785 - RNA, 22 nt, Human
uuagaacuuaaacuucagaaag

SEQ ID NO: 1139786 - RNA, 22 nt, Human
uucacaauggcaaaccauuaaa

SEQ ID NO: 1139787 - RNA, 22 nt, Human
aguggcugccaagagcaaugcu

SEQ ID NO: 1139788 - RNA, 22 nt, Human
acuggcagcagcagcccuuggg

SEQ ID NO: 1139789 - RNA, 22 nt, Human
uggcuaggacucauccuguuuc

SEQ ID NO: 1139790 - RNA, 22 nt, Human
gaggccugucgcuaggccucug

SEQ ID NO: 1139791 - RNA, 16 nt, Human
ugggaccuguggccaa

SEQ ID NO: 1139792 - RNA, 22 nt, Human
cuguaugaggaucagacuggac

SEQ ID NO: 1139793 - RNA, 22 nt, Human
ggccucaguuucuucaacugua

SEQ ID NO: 1139794 - RNA, 22 nt, Human
auaugcaagcacauagaauacu

SEQ ID NO: 1139795 - RNA, 22 nt, Human
aauuuagauugauaaacaugga

SEQ ID NO: 1139796 - RNA, 20 nt, Human
ucauuacagugcuaagaugu

SEQ ID NO: 1139797 - RNA, 22 nt, Human
ugcagggagcucuggggugcag

SEQ ID NO: 1139798 - RNA, 21 nt, Human
ccuuuacaauuuugcauuccu

SEQ ID NO: 1139799 - RNA, 20 nt, Human
ugccaggcacggagugcaug

SEQ ID NO: 1139800 - RNA, 22 nt, Human
gcuggggacuccccaccauagc

SEQ ID NO: 1139801 - RNA, 22 nt, Human
uccugcaggggcugaggaacca

SEQ ID NO: 1139802 - RNA, 22 nt, Human
agggcuccaggggaccaucagu

SEQ ID NO: 1139803 - RNA, 22 nt, Human
cagggcucccucuggcucccag

SEQ ID NO: 1139804 - RNA, 22 nt, Human
aaauccuaaugacaaguuuagu

SEQ ID NO: 1139805 - RNA, 22 nt, Human
aaauuauuaugccccucuauaa

SEQ ID NO: 1139806 - RNA, 22 nt, Human
gugaaacacccuccaaugcaca

SEQ ID NO: 1139807 - RNA, 22 nt, Human
aagaauacguaucaacaauggu

SEQ ID NO: 1139808 - RNA, 22 nt, Human
acaggacaggcugggcuagacu

SEQ ID NO: 1139809 - RNA, 22 nt, Human
aagagcaucgguggagccccca

SEQ ID NO: 1139810 - RNA, 22 nt, Human
acauuuagcuguacaaucuaug

SEQ ID NO: 1139811 - RNA, 22 nt, Human
cagcuuuggcccagucgggagg

SEQ ID NO: 1139812 - RNA, 22 nt, Human
agcacaggaacauggagauggg

SEQ ID NO: 1139813 - RNA, 22 nt, Human
cagccucugagccuuggcagau

SEQ ID NO: 1139814 - RNA, 22 nt, Human
cuuggcagagggcugggcucag

SEQ ID NO: 1139815 - RNA, 22 nt, Human
acacacagcgccuaccaugugc

SEQ ID NO: 1139816 - RNA, 22 nt, Human
ugccagccagggaagcucaccc

SEQ ID NO: 1139817 - RNA, 22 nt, Human
gaacacauuucucugacuguag

SEQ ID NO: 1139818 - RNA, 21 nt, Human
ucacguggucacaugagcuuu

SEQ ID NO: 1139819 - RNA, 22 nt, Human
gcaaguacaaacgcaucggcug

SEQ ID NO: 1139820 - RNA, 22 nt, Human
gagggcucuacucaccacccug

SEQ ID NO: 1139821 - RNA, 22 nt, Human
cuccagugcacccagaggauuu

SEQ ID NO: 1139822 - RNA, 22 nt, Human
uucucuuagcuguaaagucaau

SEQ ID NO: 1139823 - RNA, 18 nt, Human
ggcaggcucucuggguca

SEQ ID NO: 1139824 - RNA, 19 nt, Human
uuugugaagaaaaugaugc

SEQ ID NO: 1139825 - RNA, 22 nt, Human
ucugggcuugguuagggcuguu

SEQ ID NO: 1139826 - RNA, 22 nt, Human
aggaccugaaauucuugcuuuu

SEQ ID NO: 1139827 - RNA, 23 nt, Human
gcccacccucagcguccucacgg

SEQ ID NO: 1139828 - RNA, 22 nt, Human
uggaacacugaucauugccuuu

SEQ ID NO: 1139829 - RNA, 22 nt, Human
auggccugaugcaccuguccca

SEQ ID NO: 1139830 - RNA, 22 nt, Human
uagcuuuaggcacguuugaauu

SEQ ID NO: 1139831 - RNA, 22 nt, Human
uuuuacuuaauucuuggucaug

SEQ ID NO: 1139832 - RNA, 22 nt, Human
guaugaaguaagauauuguuca

SEQ ID NO: 1139833 - RNA, 22 nt, Human
uguggggaagaguaugacuugg

SEQ ID NO: 1139834 - RNA, 22 nt, Human
ccuggggagagaaagcccagcc

SEQ ID NO: 1139835 - RNA, 22 nt, Human
aggacaagcuaaaggacuuccu

SEQ ID NO: 1139836 - RNA, 22 nt, Human
ggcauccaguucugaucaacaa

SEQ ID NO: 1139837 - RNA, 22 nt, Human
cucucuggaagggggagcugau

SEQ ID NO: 1139838 - RNA, 22 nt, Human
uauacacaaggugugcauuugu

SEQ ID NO: 1139839 - RNA, 22 nt, Human
cuuaauuuaaaauaguucaggc

SEQ ID NO: 1139840 - RNA, 22 nt, Human
caggcccucgcccgcagcgacc

SEQ ID NO: 1139841 - RNA, 22 nt, Human
ugggggcugugcacaggcucac

SEQ ID NO: 1139842 - RNA, 22 nt, Human
caguauagaaaguuuuaaauug

SEQ ID NO: 1139843 - RNA, 22 nt, Human
ccaggccucuggcugcuuaguc

SEQ ID NO: 1139844 - RNA, 22 nt, Human
uuugauuuacuggauauucuca

SEQ ID NO: 1139845 - RNA, 22 nt, Human
ugcacaggugagacucaggaag

SEQ ID NO: 1139846 - RNA, 22 nt, Human
uucacauuucauaccacagcuu

SEQ ID NO: 1139847 - RNA, 22 nt, Human
acacacaugguauuguucagaa

SEQ ID NO: 1139848 - RNA, 22 nt, Human
gcuggcaggagaaacggggugc

SEQ ID NO: 1139849 - RNA, 22 nt, Human
uuauuuaggagaaggaacccug

SEQ ID NO: 1139850 - RNA, 22 nt, Human
ggcugcagggcagcuggugugg

SEQ ID NO: 1139851 - RNA, 22 nt, Human
gacacagaaggucacauguuca

SEQ ID NO: 1139852 - RNA, 22 nt, Human
ggggcugauggaacucaggccu

SEQ ID NO: 1139853 - RNA, 22 nt, Human
ggcuuuauuauguggccaugug

SEQ ID NO: 1139854 - RNA, 22 nt, Human
aaucuucagugucuaaaaagca

SEQ ID NO: 1139855 - RNA, 22 nt, Human
auguccagagccggccugcuga

SEQ ID NO: 1139856 - RNA, 22 nt, Human
cagggcucgcucgcucgcucgc

SEQ ID NO: 1139857 - RNA, 22 nt, Human
ccaggccugugcaaggagggag

SEQ ID NO: 1139858 - RNA, 22 nt, Human
ugcagggaaucuguggcuggac

SEQ ID NO: 1139859 - RNA, 22 nt, Human
ugaagcacaggcauacacaacc

SEQ ID NO: 1139860 - RNA, 22 nt, Human
acaguaaaucaacagaauaucu

SEQ ID NO: 1139861 - RNA, 22 nt, Human
aaaguucuggggguguuucugg

SEQ ID NO: 1139862 - RNA, 22 nt, Human
agcaggcuuucaagagucuucu

SEQ ID NO: 1139863 - RNA, 22 nt, Human
ucuggcaguuccuuguugauau

SEQ ID NO: 1139864 - RNA, 22 nt, Human
ucagggacagggugcugcugcg

SEQ ID NO: 1139865 - RNA, 22 nt, Human
gccuggcacucaaucaucugcu

SEQ ID NO: 1139866 - RNA, 22 nt, Human
uacauuccuucguuuagagauu

SEQ ID NO: 1139867 - RNA, 22 nt, Human
uggccucugggaaagcagauuc

SEQ ID NO: 1139868 - RNA, 17 nt, Human
aggcauggucuggggug

SEQ ID NO: 1139869 - RNA, 21 nt, Human
uaaaucucuguauucuucagu

SEQ ID NO: 1139870 - RNA, 22 nt, Human
ugucaacacaccuaucucaauu

SEQ ID NO: 1139871 - RNA, 22 nt, Human
ccagcuuuuagugggcuuauua

SEQ ID NO: 1139872 - RNA, 22 nt, Human
auguagaagugggcauuauaga

SEQ ID NO: 1139873 - RNA, 22 nt, Human
aauaacuuuuaaaagacccugg

SEQ ID NO: 1139874 - RNA, 22 nt, Human
uucugugcccauuuuaaaaugg

SEQ ID NO: 1139875 - RNA, 22 nt, Human
agguauaagucucauuucuguu

SEQ ID NO: 1139876 - RNA, 22 nt, Human
augggcugaggaagcuccugag

SEQ ID NO: 1139877 - RNA, 22 nt, Human
uccugcagaccucagucagguc

SEQ ID NO: 1139878 - RNA, 22 nt, Human
cuuucuuauaccugucagggcc

SEQ ID NO: 1139879 - RNA, 22 nt, Human
uccaagcuguauguuccuagag

SEQ ID NO: 1139880 - RNA, 22 nt, Human
ucagagaguuggaaagaauuaa

SEQ ID NO: 1139881 - RNA, 22 nt, Human
uacauugcuagaaauguauuuu

SEQ ID NO: 1139882 - RNA, 22 nt, Human
gcagggacgcagcacucuccgu

SEQ ID NO: 1139883 - RNA, 21 nt, Human
uccacccucucugcucccagu

SEQ ID NO: 1139884 - RNA, 22 nt, Human
ugagagcacacagaaauauuuu

SEQ ID NO: 1139885 - RNA, 22 nt, Human
gccugcagccccucugcaguag

SEQ ID NO: 1139886 - RNA, 22 nt, Human
gacccaggguauccagagcugc

SEQ ID NO: 1139887 - RNA, 22 nt, Human
auguccaguuucuacacacaua

SEQ ID NO: 1139888 - RNA, 22 nt, Human
ugaacacauaaggcuuuccugu

SEQ ID NO: 1139889 - RNA, 22 nt, Human
ccaggcucagggcagacuuuca

SEQ ID NO: 1139890 - RNA, 22 nt, Human
uucaaaauuguucuaagcucug

SEQ ID NO: 1139891 - RNA, 18 nt, Human
gacaaaaguacagacaga

SEQ ID NO: 1139892 - RNA, 22 nt, Human
augcauugucugguuucauuuu

SEQ ID NO: 1139893 - RNA, 22 nt, Human
ugcagggaaugcuugcagcaug

SEQ ID NO: 1139894 - RNA, 19 nt, Human
aggcuuggcuagauuuacu

SEQ ID NO: 1139895 - RNA, 22 nt, Human
ucacauuucugauuauaccaaa

SEQ ID NO: 1139896 - RNA, 22 nt, Human
cagucucuuuauccaccaagcc

SEQ ID NO: 1139897 - RNA, 22 nt, Human
ucucugaaggggagcuguuuaa

SEQ ID NO: 1139898 - RNA, 18 nt, Human
gccugcaggcacgggggu

SEQ ID NO: 1139899 - RNA, 22 nt, Human
gccaggcauucuagaaguagug

SEQ ID NO: 1139900 - RNA, 21 nt, Human
uccaagcucaacucccuuccu

SEQ ID NO: 1139901 - RNA, 22 nt, Human
cacacugucagguaaauaacac

SEQ ID NO: 1139902 - RNA, 22 nt, Human
caggagcaaggagcagugggau

SEQ ID NO: 1139903 - RNA, 22 nt, Human
aucucuguaaaccauaaauuga

SEQ ID NO: 1139904 - RNA, 22 nt, Human
aaauggauggaauugacauuua

SEQ ID NO: 1139905 - RNA, 22 nt, Human
cgcaggcucgguucacagagca

SEQ ID NO: 1139906 - RNA, 22 nt, Human
uccugcagagccgcccucaggu

SEQ ID NO: 1139907 - RNA, 22 nt, Human
augaccagccgagauaaacaga

SEQ ID NO: 1139908 - RNA, 22 nt, Human
gagggcuccucacauucucuau

SEQ ID NO: 1139909 - RNA, 22 nt, Human
uuaaauuagucaagcuucucug

SEQ ID NO: 1139910 - RNA, 22 nt, Human
ugggcugagcacugaggaagga

SEQ ID NO: 1139911 - RNA, 22 nt, Human
gaggagcucaugaaagcggugu

SEQ ID NO: 1139912 - RNA, 22 nt, Human
ucauuuaauugguuuugcucgu

SEQ ID NO: 1139913 - RNA, 22 nt, Human
auccaagucagggauaguuuga

SEQ ID NO: 1139914 - RNA, 22 nt, Human
uacacacuuacuggagaugaag

SEQ ID NO: 1139915 - RNA, 22 nt, Human
aggugaguugguaggaaguuug

SEQ ID NO: 1139916 - RNA, 22 nt, Human
ccugggcuuucggcggcuuccu

SEQ ID NO: 1139917 - RNA, 22 nt, Human
ucacauuuuauaucucugguuu

SEQ ID NO: 1139918 - RNA, 22 nt, Human
aauguauguguauaucaaauca

SEQ ID NO: 1139919 - RNA, 22 nt, Human
ugcuucugcaacuugaauguac

SEQ ID NO: 1139920 - RNA, 22 nt, Human
acugggcuccaaggaccuggag

SEQ ID NO: 1139921 - RNA, 22 nt, Human
ggcaggcugggagucaucagag

SEQ ID NO: 1139922 - RNA, 22 nt, Human
agcccaggucuggcccagccug

SEQ ID NO: 1139923 - RNA, 22 nt, Human
gacacagagcucacagucuccu

SEQ ID NO: 1139924 - RNA, 22 nt, Human
aauaguauuuauuuggaaaaag

SEQ ID NO: 1139925 - RNA, 22 nt, Human
aauacuauguugugacacauga

SEQ ID NO: 1139926 - RNA, 22 nt, Human
guuuuacacaccuaugaaagac

SEQ ID NO: 1139927 - RNA, 22 nt, Human
agcaggcugaugggcaugcuug

SEQ ID NO: 1139928 - RNA, 22 nt, Human
aguaugaagaugaugaaaaaua

SEQ ID NO: 1139929 - RNA, 20 nt, Human
aguguacagacacuagaaau

SEQ ID NO: 1139930 - RNA, 22 nt, Human
gcucucagaugcuccagcagcc

SEQ ID NO: 1139931 - RNA, 22 nt, Human
ugggccagcaauugcugcucag

SEQ ID NO: 1139932 - RNA, 22 nt, Human
uggccugccacugccacgccac

SEQ ID NO: 1139933 - RNA, 21 nt, Human
acaaacugaaaugaguuuccu

SEQ ID NO: 1139934 - RNA, 23 nt, Human
ggccucagcgcacagaaacugcu

SEQ ID NO: 1139935 - RNA, 22 nt, Human
ucuagggaacaugggucaagcu

SEQ ID NO: 1139936 - RNA, 22 nt, Human
uuguacaaguauuaugugaaca

SEQ ID NO: 1139937 - RNA, 22 nt, Human
ccugggcugcaugauggcauuu

SEQ ID NO: 1139938 - RNA, 22 nt, Human
uggaaagagguagaggaucugg

SEQ ID NO: 1139939 - RNA, 22 nt, Human
uacaaaugaguuguaugaacca

SEQ ID NO: 1139940 - RNA, 22 nt, Human
aagauaauauucauuaacuaga

SEQ ID NO: 1139941 - RNA, 22 nt, Human
cuucacauguuggaguccuuug

SEQ ID NO: 1139942 - RNA, 22 nt, Human
gaaauauucuugucuuguuuuc

SEQ ID NO: 1139943 - RNA, 22 nt, Human
gcugcaggcggccgugguggcg

SEQ ID NO: 1139944 - RNA, 22 nt, Human
gcuucugggcaccugaacagga

SEQ ID NO: 1139945 - RNA, 21 nt, Human
uagcuuuaauauucccacauu

SEQ ID NO: 1139946 - RNA, 22 nt, Human
acauaugauauugaggaucuca

SEQ ID NO: 1139947 - RNA, 22 nt, Human
uccaggcaaagugcugggcugc

SEQ ID NO: 1139948 - RNA, 22 nt, Human
ucucuuaaaagauuuuaaugac

SEQ ID NO: 1139949 - RNA, 22 nt, Human
ugcacagcuggcucuccuuuuc

SEQ ID NO: 1139950 - RNA, 22 nt, Human
uuccuggccccaccccuggaga

SEQ ID NO: 1139951 - RNA, 22 nt, Human
gagcuuuaagggauaaaaugau

SEQ ID NO: 1139952 - RNA, 22 nt, Human
ggcuuuauuaacucauccguaa

SEQ ID NO: 1139953 - RNA, 22 nt, Human
cagagagcaugggaggcccgag

SEQ ID NO: 1139954 - RNA, 22 nt, Human
gauauguauugaaugaucauuu

SEQ ID NO: 1139955 - RNA, 22 nt, Human
ugaaugaugcaguauaaugaua

SEQ ID NO: 1139956 - RNA, 22 nt, Human
uguaugaaccuuuaauauagug

SEQ ID NO: 1139957 - RNA, 22 nt, Human
uuuaauauucugcauucuccuu

SEQ ID NO: 1139958 - RNA, 22 nt, Human
cuuuggaauauuuuauugagaa

SEQ ID NO: 1139959 - RNA, 22 nt, Human
agcaggcugccuuccaaagccu

SEQ ID NO: 1139960 - RNA, 22 nt, Human
ugaagccacuuuccagaaucac

SEQ ID NO: 1139961 - RNA, 22 nt, Human
uagcauuucccaaaugcauuug

SEQ ID NO: 1139962 - RNA, 22 nt, Human
gcacauacccacugucaagcac

SEQ ID NO: 1139963 - RNA, 22 nt, Human
uuguuucauggggauguuuauu

SEQ ID NO: 1139964 - RNA, 22 nt, Human
aagggcucacccaacucacuuc

SEQ ID NO: 1139965 - RNA, 22 nt, Human
ggcacagggggcugaggacuag

SEQ ID NO: 1139966 - RNA, 22 nt, Human
cauuacaaccccaaauuacaaa

SEQ ID NO: 1139967 - RNA, 22 nt, Human
uccaggcucuaggcugcucucc

SEQ ID NO: 1139968 - RNA, 22 nt, Human
uguaugaagccagaaucuguuu

SEQ ID NO: 1139969 - RNA, 22 nt, Human
ucuggcagggucagggcccagg

SEQ ID NO: 1139970 - RNA, 22 nt, Human
aagucucucauggcugacagca

SEQ ID NO: 1139971 - RNA, 19 nt, Human
uuuacucuccaaggugagu

SEQ ID NO: 1139972 - RNA, 22 nt, Human
ggcaggcuugguggcaccgguu

SEQ ID NO: 1139973 - RNA, 22 nt, Human
auguuucaaauauauagaguug

SEQ ID NO: 1139974 - RNA, 18 nt, Human
ugagaggcuauuuuuugc

SEQ ID NO: 1139975 - RNA, 22 nt, Human
acugggcugcuugagugccuuc

SEQ ID NO: 1139976 - RNA, 22 nt, Human
aaaguuguaauggaagaaaugc

SEQ ID NO: 1139977 - RNA, 22 nt, Human
uaauauuucuacccugcugccu

SEQ ID NO: 1139978 - RNA, 22 nt, Human
gcucugagacaguagagauggc

SEQ ID NO: 1139979 - RNA, 22 nt, Human
gcagagcacccugcagugguau

SEQ ID NO: 1139980 - RNA, 22 nt, Human
gcuccaggcagcauaguggaug

SEQ ID NO: 1139981 - RNA, 22 nt, Human
ucccucuaaacuguaagauucu

SEQ ID NO: 1139982 - RNA, 22 nt, Human
gccugcagccucaagggcugag

SEQ ID NO: 1139983 - RNA, 22 nt, Human
uggcagagaacacacaugauuc

SEQ ID NO: 1139984 - RNA, 22 nt, Human
cacaucagggcugcuugggggu

SEQ ID NO: 1139985 - RNA, 22 nt, Human
ccucagcugcuucccuggagcc

SEQ ID NO: 1139986 - RNA, 22 nt, Human
ucuaggagcaugaagggaaggc

SEQ ID NO: 1139987 - RNA, 20 nt, Human
uauuuguauuugggaaaguu

SEQ ID NO: 1139988 - RNA, 22 nt, Human
acaucacacgccuuccaggagg

SEQ ID NO: 1139989 - RNA, 22 nt, Human
uaacacaugaaagcaccuucuu

SEQ ID NO: 1139990 - RNA, 22 nt, Human
ugauucuauggaaggcauaagg

SEQ ID NO: 1139991 - RNA, 22 nt, Human
ugcccccuuuucuuguuacacu

SEQ ID NO: 1139992 - RNA, 23 nt, Human
cgcccagccucagugaccugggc

SEQ ID NO: 1139993 - RNA, 22 nt, Human
cagucccaugagcccagaacau

SEQ ID NO: 1139994 - RNA, 22 nt, Human
uaugaacuagcugauuuaguuu

SEQ ID NO: 1139995 - RNA, 22 nt, Human
auuucauagauuguaaaucccu

SEQ ID NO: 1139996 - RNA, 22 nt, Human
ccccuuccuuccucagacagcc

SEQ ID NO: 1139997 - RNA, 22 nt, Human
uuccugccccugagagcuccca

SEQ ID NO: 1139998 - RNA, 22 nt, Human
acaggcacugucaagucaugaa

SEQ ID NO: 1139999 - RNA, 22 nt, Human
ccaggcucaccuggagccccug

SEQ ID NO: 1140000 - RNA, 22 nt, Human
cagagcagggguuucccagguu

SEQ ID NO: 1140001 - RNA, 20 nt, Human
aaaggaauauaugaaguaua

SEQ ID NO: 1140002 - RNA, 22 nt, Human
ugucuucaguaaaauacacuau

SEQ ID NO: 1140003 - RNA, 22 nt, Human
uucccacaguguugaauccucu

SEQ ID NO: 1140004 - RNA, 22 nt, Human
gaugaagccccaguguaaguaa

SEQ ID NO: 1140005 - RNA, 18 nt, Human
gacacauccccaggccuc

SEQ ID NO: 1140006 - RNA, 22 nt, Human
cacacagaugguaagggaggga

SEQ ID NO: 1140007 - RNA, 21 nt, Human
gaauaguucuguggcagcagu

SEQ ID NO: 1140008 - RNA, 22 nt, Human
uacacaucucugucaguaguga

SEQ ID NO: 1140009 - RNA, 22 nt, Human
uuggaaaaacacgauagugguu

SEQ ID NO: 1140010 - RNA, 22 nt, Human
cauccagggcagccauggccug

SEQ ID NO: 1140011 - RNA, 20 nt, Human
cccagccccuaccuguugcc

SEQ ID NO: 1140012 - RNA, 22 nt, Human
aaugaagcaguuuucaucaagu

SEQ ID NO: 1140013 - RNA, 22 nt, Human
ugccugccaugcagaaagcuga

SEQ ID NO: 1140014 - RNA, 22 nt, Human
guuuauuauucaacuucauguu

SEQ ID NO: 1140015 - RNA, 22 nt, Human
uuguuucaggaugguuuguuac

SEQ ID NO: 1140016 - RNA, 22 nt, Human
ucaggcucugccaccuagauua

SEQ ID NO: 1140017 - RNA, 22 nt, Human
cagaguuuugugaacaacuugg

SEQ ID NO: 1140018 - RNA, 22 nt, Human
uuucaaauagaaucuuuccaaa

SEQ ID NO: 1140019 - RNA, 22 nt, Human
cagagcucagagcagggcacuc

SEQ ID NO: 1140020 - RNA, 22 nt, Human
cccugcaguccuuucuuggcuc

SEQ ID NO: 1140021 - RNA, 22 nt, Human
uccaggcacuauauauacuuuu

SEQ ID NO: 1140022 - RNA, 22 nt, Human
acagagcaugcucaguguguga

SEQ ID NO: 1140023 - RNA, 22 nt, Human
ggugccagugggucucaggaua

SEQ ID NO: 1140024 - RNA, 22 nt, Human
cauaauuucuguaucagcacca

SEQ ID NO: 1140025 - RNA, 22 nt, Human
auuucucaguguacauuauguu

SEQ ID NO: 1140026 - RNA, 22 nt, Human
cauuagggucucucagcugaau

SEQ ID NO: 1140027 - RNA, 22 nt, Human
aucuuuuacauuacugcccaga

SEQ ID NO: 1140028 - RNA, 22 nt, Human
uguuucaggaccuaucuuuuag

SEQ ID NO: 1140029 - RNA, 22 nt, Human
cacauaauugaacgugaugagu

SEQ ID NO: 1140030 - RNA, 22 nt, Human
uacaaagucacauugaaaugaa

SEQ ID NO: 1140031 - RNA, 22 nt, Human
uucccacauucuuuacauucau

SEQ ID NO: 1140032 - RNA, 22 nt, Human
guuuauuauacaacaaaagcua

SEQ ID NO: 1140033 - RNA, 22 nt, Human
uuauuugcccauguuuagcaga

SEQ ID NO: 1140034 - RNA, 22 nt, Human
ccaggccuggaccaugccaggg

SEQ ID NO: 1140035 - RNA, 22 nt, Human
caauuucuggaacuaauucuga

SEQ ID NO: 1140036 - RNA, 22 nt, Human
aaguuucaaauguugauuaugc

SEQ ID NO: 1140037 - RNA, 22 nt, Human
cucugaauggacacuccagugu

SEQ ID NO: 1140038 - RNA, 22 nt, Human
gacccaggcccaaggcugccag

SEQ ID NO: 1140039 - RNA, 22 nt, Human
aaauauguauggaguucaugaa

SEQ ID NO: 1140040 - RNA, 22 nt, Human
uuggaaauacagcaguuacuuu

SEQ ID NO: 1140041 - RNA, 22 nt, Human
gcccacacagcagauccuuugg

SEQ ID NO: 1140042 - RNA, 22 nt, Human
uggaccugcuggaugggcaggu

SEQ ID NO: 1140043 - RNA, 22 nt, Human
uaauuucacugauaugaaguca

SEQ ID NO: 1140044 - RNA, 22 nt, Human
acugagagucaagauagcaugg

SEQ ID NO: 1140045 - RNA, 22 nt, Human
uaaaggguagguuuuacuguaa

SEQ ID NO: 1140046 - RNA, 22 nt, Human
ugcaggcugccuucacagagcc

SEQ ID NO: 1140047 - RNA, 22 nt, Human
cacauacauacguauguauaca

SEQ ID NO: 1140048 - RNA, 21 nt, Human
uccccacauuucuaaacagac

SEQ ID NO: 1140049 - RNA, 22 nt, Human
gugcagggcuggcaccggaggc

SEQ ID NO: 1140050 - RNA, 19 nt, Human
acauucccaucagcaaugu

SEQ ID NO: 1140051 - RNA, 22 nt, Human
cacauacugagaaucacaccca

SEQ ID NO: 1140052 - RNA, 22 nt, Human
cuaggaaucaccaagauucuag

SEQ ID NO: 1140053 - RNA, 22 nt, Human
uguguugugacauucuuggaug

SEQ ID NO: 1140054 - RNA, 22 nt, Human
cccugcagaucagugagaacuu

SEQ ID NO: 1140055 - RNA, 22 nt, Human
ccagagagaguacugggcucug

SEQ ID NO: 1140056 - RNA, 21 nt, Human
auuuucauuaauucagugugg

SEQ ID NO: 1140057 - RNA, 22 nt, Human
gcaaacuggcaaaccugucugu

SEQ ID NO: 1140058 - RNA, 22 nt, Human
guccaaguacauguguguacau

SEQ ID NO: 1140059 - RNA, 22 nt, Human
uuauuuugguaaauguuugccu

SEQ ID NO: 1140060 - RNA, 22 nt, Human
ugcagagaagaggacaguucua

SEQ ID NO: 1140061 - RNA, 22 nt, Human
cagaggcugcucuggguggcau

SEQ ID NO: 1140062 - RNA, 22 nt, Human
uauugaaauucuucauguccuc

SEQ ID NO: 1140063 - RNA, 22 nt, Human
aaucacaugugcucaauuuuaa

SEQ ID NO: 1140064 - RNA, 22 nt, Human
guuucauuaccugacccaugag

SEQ ID NO: 1140065 - RNA, 22 nt, Human
gggaccuggcaccuuugcucug

SEQ ID NO: 1140066 - RNA, 22 nt, Human
gccaggcauuuauugauugaau

SEQ ID NO: 1140067 - RNA, 19 nt, Human
caggucuucuuggaggacu

SEQ ID NO: 1140068 - RNA, 21 nt, Human
uggaccuguccuucucgcugu

SEQ ID NO: 1140069 - RNA, 22 nt, Human
caccugcaaggagcuuucauuu

SEQ ID NO: 1140070 - RNA, 22 nt, Human
uuagccauguugaagauuuaga

SEQ ID NO: 1140071 - RNA, 22 nt, Human
ugcuuuauguggcugauacuca

SEQ ID NO: 1140072 - RNA, 17 nt, Human
ccauacugacauauuga

SEQ ID NO: 1140073 - RNA, 22 nt, Human
gacuuuggcaucuagacauugu

SEQ ID NO: 1140074 - RNA, 22 nt, Human
auguuucaugacugagcaaaau

SEQ ID NO: 1140075 - RNA, 22 nt, Human
uauacaaugaguacauucuggg

SEQ ID NO: 1140076 - RNA, 22 nt, Human
augugaaacugaagcauccaua

SEQ ID NO: 1140077 - RNA, 22 nt, Human
ucuggcaggacaugcugaccau

SEQ ID NO: 1140078 - RNA, 22 nt, Human
ucccaaggccaggcaucuagaa

SEQ ID NO: 1140079 - RNA, 22 nt, Human
gcuggcagagacaagaagacua

SEQ ID NO: 1140080 - RNA, 22 nt, Human
ccaggcaggcuagaauguaaau

SEQ ID NO: 1140081 - RNA, 22 nt, Human
cccaggcacauccacucuguga

SEQ ID NO: 1140082 - RNA, 22 nt, Human
uccugcagucugcacucugccu

SEQ ID NO: 1140083 - RNA, 22 nt, Human
uuucaaaccuacuuguauguuu

SEQ ID NO: 1140084 - RNA, 22 nt, Human
uggcagugguaccggcucucag

SEQ ID NO: 1140085 - RNA, 22 nt, Human
aaacaucauaggcaugcaugau

SEQ ID NO: 1140086 - RNA, 22 nt, Human
ccuggcaguggugaagaagagg

SEQ ID NO: 1140087 - RNA, 22 nt, Human
ccuggggagccgccugagcccc

SEQ ID NO: 1140088 - RNA, 22 nt, Human
aaaagagugacugauaaguaua

SEQ ID NO: 1140089 - RNA, 22 nt, Human
uuccagccaugguuucccuaug

SEQ ID NO: 1140090 - RNA, 22 nt, Human
uuucauaaccucaagcuacagu

SEQ ID NO: 1140091 - RNA, 22 nt, Human
uaccugcaaaguuccuuuugcc

SEQ ID NO: 1140092 - RNA, 22 nt, Human
guccacagagggcugggcaggc

SEQ ID NO: 1140093 - RNA, 22 nt, Human
aguaugaauacagauuuucucu

SEQ ID NO: 1140094 - RNA, 22 nt, Human
uguauacaggauuacucauagc

SEQ ID NO: 1140095 - RNA, 22 nt, Human
cgacccuacagacagugcugag

SEQ ID NO: 1140096 - RNA, 22 nt, Human
ugcuuuaucaaagcuauaguga

SEQ ID NO: 1140097 - RNA, 22 nt, Human
aggcuuuggaaucagaguucug

SEQ ID NO: 1140098 - RNA, 22 nt, Human
gguuucaacuucaaccucucca

SEQ ID NO: 1140099 - RNA, 22 nt, Human
uucugucaugcucauguaauug

SEQ ID NO: 1140100 - RNA, 22 nt, Human
acuucacagaaauuuuaugagg

SEQ ID NO: 1140101 - RNA, 22 nt, Human
acuuaaaaacagauccagcagg

SEQ ID NO: 1140102 - RNA, 22 nt, Human
ccugggcuuccacgagcagagg

SEQ ID NO: 1140103 - RNA, 22 nt, Human
ucaucaguguccuuaucacuua

SEQ ID NO: 1140104 - RNA, 18 nt, Human
uaaauauauuucccccuu

SEQ ID NO: 1140105 - RNA, 22 nt, Human
gaggcugcuuugaugacaggag

SEQ ID NO: 1140106 - RNA, 22 nt, Human
cacccagccuucacacaggagu

SEQ ID NO: 1140107 - RNA, 22 nt, Human
agcuagaauauugaucugaaau

SEQ ID NO: 1140108 - RNA, 22 nt, Human
ucuacuauguuucuuaaauaga

SEQ ID NO: 1140109 - RNA, 22 nt, Human
cccuuccucccaggcuucugug

SEQ ID NO: 1140110 - RNA, 22 nt, Human
gagcuuuaggagaaggagguca

SEQ ID NO: 1140111 - RNA, 22 nt, Human
ucuggcaguggaugagggcagc

SEQ ID NO: 1140112 - RNA, 22 nt, Human
uccugagcaacacagcuaagug

SEQ ID NO: 1140113 - RNA, 22 nt, Human
uagauauggccgucuguuuuaa

SEQ ID NO: 1140114 - RNA, 22 nt, Human
gauuuucugagccuucaaauuu

SEQ ID NO: 1140115 - RNA, 21 nt, Human
gggagggauggaaaugauguu

SEQ ID NO: 1140116 - RNA, 22 nt, Human
cugcucuaacugcauuaguuuu

SEQ ID NO: 1140117 - RNA, 22 nt, Human
ccaggcucagcuauuaagaaac

SEQ ID NO: 1140118 - RNA, 22 nt, Human
guucuuaagaccacaauaaaaa

SEQ ID NO: 1140119 - RNA, 22 nt, Human
ggcagagguagcuggaaccagg

SEQ ID NO: 1140120 - RNA, 22 nt, Human
gcccacacaccagcucaggagg

SEQ ID NO: 1140121 - RNA, 22 nt, Human
gagagaaaagggggaauugauu

SEQ ID NO: 1140122 - RNA, 22 nt, Human
auuguuaugaaaauaagauguu

SEQ ID NO: 1140123 - RNA, 22 nt, Human
gccuggaaucaugcagggguua

SEQ ID NO: 1140124 - RNA, 22 nt, Human
cccuuccuccucgccugucaga

SEQ ID NO: 1140125 - RNA, 22 nt, Human
aggacacacagaauacaaaucc

SEQ ID NO: 1140126 - RNA, 22 nt, Human
ugcagggaaaguguuggcagca

SEQ ID NO: 1140127 - RNA, 22 nt, Human
ccaggcucugccaggcccuuga

SEQ ID NO: 1140128 - RNA, 22 nt, Human
ccagcucucaaggcucccuggg

SEQ ID NO: 1140129 - RNA, 22 nt, Human
uuucuuauacuauauugucauc

SEQ ID NO: 1140130 - RNA, 20 nt, Human
aagagucuuuacugagcuaa

SEQ ID NO: 1140131 - RNA, 22 nt, Human
ucaggcucaaagggccggauga

SEQ ID NO: 1140132 - RNA, 22 nt, Human
ccccuuccacagugcuuccuaa

SEQ ID NO: 1140133 - RNA, 22 nt, Human
cacagcuucccaaaguggaccu

SEQ ID NO: 1140134 - RNA, 23 nt, Human
uguaaacaucacccccuggaguu

SEQ ID NO: 1140135 - RNA, 21 nt, Human
augugaaauaucaucagagca

SEQ ID NO: 1140136 - RNA, 22 nt, Human
augggcugggaauacacagggg

SEQ ID NO: 1140137 - RNA, 20 nt, Human
ugcaaacacagaguguauga

SEQ ID NO: 1140138 - RNA, 23 nt, Human
caggcucccggaccaggauccgc

SEQ ID NO: 1140139 - RNA, 19 nt, Human
aggugagugugggaaaggg

SEQ ID NO: 1140140 - RNA, 22 nt, Human
gaggguggggaauagacugcua

SEQ ID NO: 1140141 - RNA, 22 nt, Human
cuugggaaugcuaacagaugac

SEQ ID NO: 1140142 - RNA, 22 nt, Human
ucccugcccucagugcacccgg

SEQ ID NO: 1140143 - RNA, 22 nt, Human
ggguuucaugguucucacaaug

SEQ ID NO: 1140144 - RNA, 22 nt, Human
aauguaugggugagaaaguuga

SEQ ID NO: 1140145 - RNA, 22 nt, Human
ucaggcccuuugcugcugcccc

SEQ ID NO: 1140146 - RNA, 22 nt, Human
auguccaggaucuauccccaga

SEQ ID NO: 1140147 - RNA, 22 nt, Human
uauaauuuaucaugucacaguu

SEQ ID NO: 1140148 - RNA, 18 nt, Human
uccugccugugccccagg

SEQ ID NO: 1140149 - RNA, 22 nt, Human
ccuacauucucugaguuuuccu

SEQ ID NO: 1140150 - RNA, 22 nt, Human
acccaggguagaaccucagagc

SEQ ID NO: 1140151 - RNA, 22 nt, Human
ggcuuuggggugugcagagaug

SEQ ID NO: 1140152 - RNA, 22 nt, Human
ucagcauaucuugagcuucaug

SEQ ID NO: 1140153 - RNA, 22 nt, Human
ccugcaguuuguugugaccccg

SEQ ID NO: 1140154 - RNA, 22 nt, Human
uuucucauagucaugccucuua

SEQ ID NO: 1140155 - RNA, 22 nt, Human
aggcuccauaccaucuccggag

SEQ ID NO: 1140156 - RNA, 22 nt, Human
ccaggcuccucaugaucuuguu

SEQ ID NO: 1140157 - RNA, 22 nt, Human
augggcugacuaaugguaaacu

SEQ ID NO: 1140158 - RNA, 22 nt, Human
ccaggccuggccaggggaugcc

SEQ ID NO: 1140159 - RNA, 22 nt, Human
cauuuguacagaacagcuuuau

SEQ ID NO: 1140160 - RNA, 22 nt, Human
gccgggaccaaggccacggagc

SEQ ID NO: 1140161 - RNA, 22 nt, Human
auucucuguuuccaagaugaaa

SEQ ID NO: 1140162 - RNA, 22 nt, Human
uuuagggaugucagaacaggga

SEQ ID NO: 1140163 - RNA, 23 nt, Human
gcugggcuuacucuuucagugag

SEQ ID NO: 1140164 - RNA, 22 nt, Human
ugggccagcugaagugccgccc

SEQ ID NO: 1140165 - RNA, 22 nt, Human
aauaaucucccuuuuuguaugu

SEQ ID NO: 1140166 - RNA, 20 nt, Human
cagcuuuagaucuuugauua

SEQ ID NO: 1140167 - RNA, 22 nt, Human
guauuaggugguggaauuguag

SEQ ID NO: 1140168 - RNA, 22 nt, Human
gcuccugggcccugggcuaacu

SEQ ID NO: 1140169 - RNA, 22 nt, Human
augaacugcaguauaaacuugg

SEQ ID NO: 1140170 - RNA, 22 nt, Human
ucauauaacuggauauuuucaa

SEQ ID NO: 1140171 - RNA, 22 nt, Human
cccaggcaguagaaagaagagg

SEQ ID NO: 1140172 - RNA, 22 nt, Human
uccaggcaaaaggaacugcuug

SEQ ID NO: 1140173 - RNA, 22 nt, Human
cagaguggcgacccccucagcu

SEQ ID NO: 1140174 - RNA, 22 nt, Human
agucuacaaagaaaaguuauug

SEQ ID NO: 1140175 - RNA, 22 nt, Human
aaaguuguucaguaagaaacuc

SEQ ID NO: 1140176 - RNA, 22 nt, Human
cauuuauugaguggccacagug

SEQ ID NO: 1140177 - RNA, 22 nt, Human
ucuagaauuuugccauauagcu

SEQ ID NO: 1140178 - RNA, 22 nt, Human
auuuagcaaaaaaugaugaagc

SEQ ID NO: 1140179 - RNA, 22 nt, Human
cgcauacauagaaacacacaga

SEQ ID NO: 1140180 - RNA, 22 nt, Human
agcagguguauauaaggcugag

SEQ ID NO: 1140181 - RNA, 22 nt, Human
uguuugaaacuuugaucacuaa

SEQ ID NO: 1140182 - RNA, 22 nt, Human
acuaaauacacacauuuguuca

SEQ ID NO: 1140183 - RNA, 22 nt, Human
caauuucugggccucacacaag

SEQ ID NO: 1140184 - RNA, 23 nt, Human
ugggaccuguuugcccacagaug

SEQ ID NO: 1140185 - RNA, 22 nt, Human
aagggcucuucuauuuauggcc

SEQ ID NO: 1140186 - RNA, 22 nt, Human
ccugggcucaagugaugguccc

SEQ ID NO: 1140187 - RNA, 23 nt, Human
acagugugguggacaaggagcag

SEQ ID NO: 1140188 - RNA, 22 nt, Human
agccuccaucucccaucuguga

SEQ ID NO: 1140189 - RNA, 22 nt, Human
uucugucacuugcaaucaagag

SEQ ID NO: 1140190 - RNA, 22 nt, Human
ucuggcagugaagucaugaggu

SEQ ID NO: 1140191 - RNA, 22 nt, Human
ugagagucuguuccucuugcag

SEQ ID NO: 1140192 - RNA, 23 nt, Human
uguaugaauaugccacaguuuaa

SEQ ID NO: 1140193 - RNA, 23 nt, Human
ccaggcucuuucaccugcuauuc

SEQ ID NO: 1140194 - RNA, 22 nt, Human
acugggcuguaaagagaggcaa

SEQ ID NO: 1140195 - RNA, 18 nt, Human
ggccucagccuggccgga

SEQ ID NO: 1140196 - RNA, 22 nt, Human
cucugaccauucccuugauuuu

SEQ ID NO: 1140197 - RNA, 22 nt, Human
ucauggcacuuagcacaguccu

SEQ ID NO: 1140198 - RNA, 22 nt, Human
cuagaauugcauucuaugaaua

SEQ ID NO: 1140199 - RNA, 22 nt, Human
agauuucugucaccuucuaugc

SEQ ID NO: 1140200 - RNA, 22 nt, Human
cugggcuguucugccccugggu

SEQ ID NO: 1140201 - RNA, 20 nt, Human
augugaaagaucaguugucu

SEQ ID NO: 1140202 - RNA, 22 nt, Human
ucagcuuuugucagaaauugua

SEQ ID NO: 1140203 - RNA, 22 nt, Human
ugcuuuauguuaucagaagggu

SEQ ID NO: 1140204 - RNA, 22 nt, Human
cugcagggcagaagggcauaga

SEQ ID NO: 1140205 - RNA, 22 nt, Human
uacacauccauguuuugacuuu

SEQ ID NO: 1140206 - RNA, 22 nt, Human
ucccacauaugcaauccugaau

SEQ ID NO: 1140207 - RNA, 22 nt, Human
cagugagggaagaucucagcac

SEQ ID NO: 1140208 - RNA, 22 nt, Human
aguuagaaaguaaaucauuuga

SEQ ID NO: 1140209 - RNA, 22 nt, Human
guuauuagaagugaaggauugu

SEQ ID NO: 1140210 - RNA, 22 nt, Human
agggcccuaaggaaggcacaca

SEQ ID NO: 1140211 - RNA, 22 nt, Human
uaugaacauguucauugacuua

SEQ ID NO: 1140212 - RNA, 22 nt, Human
gcuggggaggcagcagagaaca

SEQ ID NO: 1140213 - RNA, 19 nt, Human
uccugcagguggcuugcag

SEQ ID NO: 1140214 - RNA, 22 nt, Human
ccagagagcuacaaggcauaaa

SEQ ID NO: 1140215 - RNA, 22 nt, Human
uuuguaaauagcaguacucaug

SEQ ID NO: 1140216 - RNA, 22 nt, Human
ggcuuuauuucacuguaccaua

SEQ ID NO: 1140217 - RNA, 22 nt, Human
agagugaaaagcuagagcagua

SEQ ID NO: 1140218 - RNA, 22 nt, Human
gccuccggagucacagugucuu

SEQ ID NO: 1140219 - RNA, 22 nt, Human
ccaggcucugugugggcuagag

SEQ ID NO: 1140220 - RNA, 22 nt, Human
uuucauaauagugcaguuuguu

SEQ ID NO: 1140221 - RNA, 22 nt, Human
gauucacucauauuuuacguuu

SEQ ID NO: 1140222 - RNA, 22 nt, Human
ucagcucuaaguuuuaugcaaa

SEQ ID NO: 1140223 - RNA, 22 nt, Human
accuggagaaagccucucccug

SEQ ID NO: 1140224 - RNA, 21 nt, Human
agugccaguagguauggagga

SEQ ID NO: 1140225 - RNA, 22 nt, Human
ugggagaaacugucucucccac

SEQ ID NO: 1140226 - RNA, 22 nt, Human
agucuucugaauaagaaucacu

SEQ ID NO: 1140227 - RNA, 22 nt, Human
gcagcucugacaaugccuggaa

SEQ ID NO: 1140228 - RNA, 22 nt, Human
auauauuugagaauauucauga

SEQ ID NO: 1140229 - RNA, 22 nt, Human
ugaccaggauacugcagggaug

SEQ ID NO: 1140230 - RNA, 22 nt, Human
guagggacaugccauuaucuca

SEQ ID NO: 1140231 - RNA, 22 nt, Human
uguauaaauuuaaauuccugcu

SEQ ID NO: 1140232 - RNA, 15 nt, Human
cacacagacagcuug

SEQ ID NO: 1140233 - RNA, 22 nt, Human
caccuaggguuucgccuuucuu

SEQ ID NO: 1140234 - RNA, 22 nt, Human
cgaggcagggaagcugcaaaag

SEQ ID NO: 1140235 - RNA, 23 nt, Human
agcuuugugaaagcagacauggg

SEQ ID NO: 1140236 - RNA, 22 nt, Human
uacccagcuccucagaagacca

SEQ ID NO: 1140237 - RNA, 22 nt, Human
cccugcagagccagcccugacc

SEQ ID NO: 1140238 - RNA, 22 nt, Human
agcuuuauuugucauucacggc

SEQ ID NO: 1140239 - RNA, 22 nt, Human
uccccacacagauacagaguag

SEQ ID NO: 1140240 - RNA, 22 nt, Human
guuaacacaggacucucugccu

SEQ ID NO: 1140241 - RNA, 22 nt, Human
ucuuuauuuaagucuguuguaa

SEQ ID NO: 1140242 - RNA, 22 nt, Human
uguggagacuauagccauaaca

SEQ ID NO: 1140243 - RNA, 22 nt, Human
aggccuccagccacaugccagu

SEQ ID NO: 1140244 - RNA, 22 nt, Human
agcucugcuucuugggaagaug

SEQ ID NO: 1140245 - RNA, 22 nt, Human
ucccacaccugucuauuccuag

SEQ ID NO: 1140246 - RNA, 22 nt, Human
gguuucaacuuuugugaggaau

SEQ ID NO: 1140247 - RNA, 21 nt, Human
ccaggcuccugaggcugguca

SEQ ID NO: 1140248 - RNA, 18 nt, Human
ugcaggcuguugaaacug

SEQ ID NO: 1140249 - RNA, 17 nt, Human
gcauccaguaacaugcc

SEQ ID NO: 1140250 - RNA, 22 nt, Human
ucagcuuuccugcagcuaaggg

SEQ ID NO: 1140251 - RNA, 22 nt, Human
gccuccuggccuuugcuccuca

SEQ ID NO: 1140252 - RNA, 22 nt, Human
cuucuuaaauuggauugcuauu

SEQ ID NO: 1140253 - RNA, 22 nt, Human
ccagcucucuuugaagcauaaa

SEQ ID NO: 1140254 - RNA, 22 nt, Human
gcacacacuguuuuccucacau

SEQ ID NO: 1140255 - RNA, 22 nt, Human
cuccuggcacugucuugaccca

SEQ ID NO: 1140256 - RNA, 22 nt, Human
uguagaaacuacacaugcaaca

SEQ ID NO: 1140257 - RNA, 22 nt, Human
acagcuuuuaugggaccagcca

SEQ ID NO: 1140258 - RNA, 22 nt, Human
uagcuuuaggaugguucucuug

SEQ ID NO: 1140259 - RNA, 22 nt, Human
uauuugauagagauaaaugaua

SEQ ID NO: 1140260 - RNA, 22 nt, Human
aauacauauggaauuccauguu

SEQ ID NO: 1140261 - RNA, 22 nt, Human
aagggcucugugugccucccca

SEQ ID NO: 1140262 - RNA, 22 nt, Human
aggaccugcuaaugugccaagu

SEQ ID NO: 1140263 - RNA, 22 nt, Human
uaaacauuuguuauucuuguuu

SEQ ID NO: 1140264 - RNA, 20 nt, Human
ugcaggcuucgcucuaggag

SEQ ID NO: 1140265 - RNA, 22 nt, Human
uuccaggcugaugggccacagg

SEQ ID NO: 1140266 - RNA, 20 nt, Human
agcuuugguuaagccagugg

SEQ ID NO: 1140267 - RNA, 22 nt, Human
caucacagguccugaugacauu

SEQ ID NO: 1140268 - RNA, 19 nt, Human
ggcauccagaacuaccagu

SEQ ID NO: 1140269 - RNA, 22 nt, Human
aaaguucuggcauuuucugucu

SEQ ID NO: 1140270 - RNA, 22 nt, Human
uaugaccuuaggaagcaagaag

SEQ ID NO: 1140271 - RNA, 22 nt, Human
gcuggcaggagaccauacccua

SEQ ID NO: 1140272 - RNA, 22 nt, Human
aguaugaaccuggguucuggau

SEQ ID NO: 1140273 - RNA, 22 nt, Human
uuagaauuauuguuuccuucua

SEQ ID NO: 1140274 - RNA, 22 nt, Human
caggcccugccuugagggaccu

SEQ ID NO: 1140275 - RNA, 22 nt, Human
gaaacaauuuuuguugucuaag

SEQ ID NO: 1140276 - RNA, 22 nt, Human
ccugggcuggaguacagcagug

SEQ ID NO: 1140277 - RNA, 22 nt, Human
uuccagcccgcgacuuguucag

SEQ ID NO: 1140278 - RNA, 22 nt, Human
aagaggucauaccagauaaggg

SEQ ID NO: 1140279 - RNA, 22 nt, Human
gagauggccagugccaggacaa

SEQ ID NO: 1140280 - RNA, 22 nt, Human
ccugcagggugcugccacagau

SEQ ID NO: 1140281 - RNA, 22 nt, Human
uuauuacacugaaagaauugcg

SEQ ID NO: 1140282 - RNA, 19 nt, Human
cuuauuagagugagagcuu

SEQ ID NO: 1140283 - RNA, 22 nt, Human
gcagcuuucugcaaugucaucc

SEQ ID NO: 1140284 - RNA, 22 nt, Human
cuggccagagguuccucugccc

SEQ ID NO: 1140285 - RNA, 22 nt, Human
gccaggcagcaggaagccagug

SEQ ID NO: 1140286 - RNA, 22 nt, Human
cagccaagaaccacagacccag

SEQ ID NO: 1140287 - RNA, 22 nt, Human
uuucaaauaccauaaaccuaau

SEQ ID NO: 1140288 - RNA, 22 nt, Human
uuaauuuuuauguauagugugu

SEQ ID NO: 1140289 - RNA, 22 nt, Human
uuucuuagcgaugcuugauaaa

SEQ ID NO: 1140290 - RNA, 22 nt, Human
auaauucagguuuucuggcaca

SEQ ID NO: 1140291 - RNA, 22 nt, Human
ggcaggguuuacaauagcaaua

SEQ ID NO: 1140292 - RNA, 22 nt, Human
cagucuggaggucagcuggcuu

SEQ ID NO: 1140293 - RNA, 22 nt, Human
aaaguuuguuauaugauaagga

SEQ ID NO: 1140294 - RNA, 22 nt, Human
caggcugccgugaagcaggccu

SEQ ID NO: 1140295 - RNA, 22 nt, Human
ucaggcucuggguacaccugac

SEQ ID NO: 1140296 - RNA, 18 nt, Human
ucaggcucucuggcuaga

SEQ ID NO: 1140297 - RNA, 22 nt, Human
gcacacaugcaugcacaggagu

SEQ ID NO: 1140298 - RNA, 22 nt, Human
caggucuuuucuacugguggag

SEQ ID NO: 1140299 - RNA, 22 nt, Human
gcagggguagugucuuccugag

SEQ ID NO: 1140300 - RNA, 20 nt, Human
guguuucaugugauacaaug

SEQ ID NO: 1140301 - RNA, 22 nt, Human
cuguaugaacccauauacuuau

SEQ ID NO: 1140302 - RNA, 22 nt, Human
cauaauuuuuuuaagucagaac

SEQ ID NO: 1140303 - RNA, 22 nt, Human
ucugcagauuuaucagcagcug

SEQ ID NO: 1140304 - RNA, 22 nt, Human
aguuagaauagucagauuguag

SEQ ID NO: 1140305 - RNA, 22 nt, Human
uguuagaaguuaaucacuaauu

SEQ ID NO: 1140306 - RNA, 22 nt, Human
uacaaagucagaauaacaggug

SEQ ID NO: 1140307 - RNA, 22 nt, Human
gacccagccugguuuuuauagg

SEQ ID NO: 1140308 - RNA, 22 nt, Human
cagggcucccuugcaaggaggg

SEQ ID NO: 1140309 - RNA, 22 nt, Human
acaucccacagaaacauacaua

SEQ ID NO: 1140310 - RNA, 22 nt, Human
uagggcuccacucccagagauu

SEQ ID NO: 1140311 - RNA, 22 nt, Human
gccugcagauauauaggauggu

SEQ ID NO: 1140312 - RNA, 22 nt, Human
uuguaauuugcaaauguauugu

SEQ ID NO: 1140313 - RNA, 21 nt, Human
cagcccagcccauugacagug

SEQ ID NO: 1140314 - RNA, 22 nt, Human
aaugaucuggcucaggauauca

SEQ ID NO: 1140315 - RNA, 22 nt, Human
uggaaauauacaaugugucucu

SEQ ID NO: 1140316 - RNA, 22 nt, Human
uuccaaguguugagauuagagg

SEQ ID NO: 1140317 - RNA, 22 nt, Human
cuuccucuagccuaguaaugcc

SEQ ID NO: 1140318 - RNA, 22 nt, Human
cuggggcuggugaggcaggcuc

SEQ ID NO: 1140319 - RNA, 22 nt, Human
aagacauugucauuuuauaauu

SEQ ID NO: 1140320 - RNA, 22 nt, Human
uauauguaagcuauguaagagu

SEQ ID NO: 1140321 - RNA, 20 nt, Human
aaagagcccuuggagcaggc

SEQ ID NO: 1140322 - RNA, 22 nt, Human
uuuauuagauuaucaaagaggu

SEQ ID NO: 1140323 - RNA, 22 nt, Human
cucccaagcugugcugaacugu

SEQ ID NO: 1140324 - RNA, 22 nt, Human
agcaggcugcuggcguugaagu

SEQ ID NO: 1140325 - RNA, 20 nt, Human
gcuccaggucagagaggacg

SEQ ID NO: 1140326 - RNA, 22 nt, Human
gcacauaacugaccacaucuaa

SEQ ID NO: 1140327 - RNA, 22 nt, Human
cuuucacagcacaagccugccu

SEQ ID NO: 1140328 - RNA, 23 nt, Human
gggaccugguaggaggugauugg

SEQ ID NO: 1140329 - RNA, 22 nt, Human
gccugcaguucugugcuaggca

SEQ ID NO: 1140330 - RNA, 22 nt, Human
uccaaggcuccggcccuggcgu

SEQ ID NO: 1140331 - RNA, 22 nt, Human
gagugcaggccugagcaccauc

SEQ ID NO: 1140332 - RNA, 22 nt, Human
gcuucuggugaggccucaggaa

SEQ ID NO: 1140333 - RNA, 22 nt, Human
gcuggcagaauuucuucuugcu

SEQ ID NO: 1140334 - RNA, 22 nt, Human
accugcaggcacaggugugcgc

SEQ ID NO: 1140335 - RNA, 22 nt, Human
acacauacauggggaagaugag

SEQ ID NO: 1140336 - RNA, 20 nt, Human
ccuuuauuauuuguaugaug

SEQ ID NO: 1140337 - RNA, 22 nt, Human
aaaagagucuuaggcagucaua

SEQ ID NO: 1140338 - RNA, 22 nt, Human
aauagauacuacuuagauguag

SEQ ID NO: 1140339 - RNA, 22 nt, Human
ugggcugaguggcagccagagu

SEQ ID NO: 1140340 - RNA, 22 nt, Human
acugugauguucucuaucuugg

SEQ ID NO: 1140341 - RNA, 22 nt, Human
cagggcucacucggcuggcguc

SEQ ID NO: 1140342 - RNA, 22 nt, Human
cugggcuuugguacugugauua

SEQ ID NO: 1140343 - RNA, 22 nt, Human
gccaggcauuuguuaggugcug

SEQ ID NO: 1140344 - RNA, 22 nt, Human
uuauucagucugucuagggagu

SEQ ID NO: 1140345 - RNA, 22 nt, Human
ggcaggcucagcagccaaggag

SEQ ID NO: 1140346 - RNA, 21 nt, Human
aguuugaugcaauuucugaga

SEQ ID NO: 1140347 - RNA, 22 nt, Human
gauuuuucaguauaaaauauau

SEQ ID NO: 1140348 - RNA, 22 nt, Human
ugggcuccagcaccugugcucu

SEQ ID NO: 1140349 - RNA, 22 nt, Human
aucagagaaauggagggcgcuu

SEQ ID NO: 1140350 - RNA, 22 nt, Human
guccaagucuuccuucccaaac

SEQ ID NO: 1140351 - RNA, 23 nt, Human
acacugucucauggauagacugc

SEQ ID NO: 1140352 - RNA, 22 nt, Human
aucagagauggcuccagugcuc

SEQ ID NO: 1140353 - RNA, 22 nt, Human
guauuagggccaaaggcaggaa

SEQ ID NO: 1140354 - RNA, 22 nt, Human
cagggcucgcucuugcccuucg

SEQ ID NO: 1140355 - RNA, 22 nt, Human
uucugggggaauacagcuauga

SEQ ID NO: 1140356 - RNA, 22 nt, Human
uuauuagguuauucucuguacu

SEQ ID NO: 1140357 - RNA, 22 nt, Human
uuucugaagggcagcagacucu

SEQ ID NO: 1140358 - RNA, 22 nt, Human
cccugcagcuuuugcauaguca

SEQ ID NO: 1140359 - RNA, 22 nt, Human
gagccucguggcggccacugcg

SEQ ID NO: 1140360 - RNA, 22 nt, Human
ucugggcuuuguaaugggaggu

SEQ ID NO: 1140361 - RNA, 22 nt, Human
agguuuaugccuuggagcuggg

SEQ ID NO: 1140362 - RNA, 22 nt, Human
aaggcucuggguuucauaggug

SEQ ID NO: 1140363 - RNA, 22 nt, Human
auaaagauuucuuuuucucuac

SEQ ID NO: 1140364 - RNA, 22 nt, Human
uacauucagcaaaagaaugguu

SEQ ID NO: 1140365 - RNA, 22 nt, Human
ucuccaagcagggcugcaaggc

SEQ ID NO: 1140366 - RNA, 22 nt, Human
cuccaggccccuggccuucugc

SEQ ID NO: 1140367 - RNA, 22 nt, Human
cuacccagcaccuaggcugccu

SEQ ID NO: 1140368 - RNA, 19 nt, Human
ccaggccuggcgucuccgc

SEQ ID NO: 1140369 - RNA, 22 nt, Human
uucaaauacauucuuugccacu

SEQ ID NO: 1140370 - RNA, 22 nt, Human
agaaaauauucauugagaggcu

SEQ ID NO: 1140371 - RNA, 22 nt, Human
cugccugcucaccagggcucug

SEQ ID NO: 1140372 - RNA, 22 nt, Human
gacccaggguggucaccugaaa

SEQ ID NO: 1140373 - RNA, 22 nt, Human
ucacaauauuuaucuuccaauu

SEQ ID NO: 1140374 - RNA, 22 nt, Human
cuguacaaguccuucaucaggg

SEQ ID NO: 1140375 - RNA, 22 nt, Human
gcacacaggcaguuuccagcca

SEQ ID NO: 1140376 - RNA, 22 nt, Human
aggaccugacauuguguuuucu

SEQ ID NO: 1140377 - RNA, 22 nt, Human
ugaaacuuauaagaauaugaau

SEQ ID NO: 1140378 - RNA, 22 nt, Human
ccaaugauggugcccacgauga

SEQ ID NO: 1140379 - RNA, 22 nt, Human
ccacagaccuuggcuuccaccu

SEQ ID NO: 1140380 - RNA, 21 nt, Human
aaauuucugcaagccucaacu

SEQ ID NO: 1140381 - RNA, 22 nt, Human
aaagaaucagaagucucaaaca

SEQ ID NO: 1140382 - RNA, 22 nt, Human
gcaaaucaccaccuagcuggau

SEQ ID NO: 1140383 - RNA, 22 nt, Human
agggacucccugggccgacacg

SEQ ID NO: 1140384 - RNA, 22 nt, Human
augcaacaaaugcuacgaaucg

SEQ ID NO: 1140385 - RNA, 22 nt, Human
uucugucaaauuugccauaugg

SEQ ID NO: 1140386 - RNA, 22 nt, Human
uucaauaucauuguuuagucuc

SEQ ID NO: 1140387 - RNA, 22 nt, Human
uuccaagucacccuuaggguca

SEQ ID NO: 1140388 - RNA, 22 nt, Human
auacacacugcuauccuuuuuu

SEQ ID NO: 1140389 - RNA, 22 nt, Human
gacccugccaugagugacaggg

SEQ ID NO: 1140390 - RNA, 22 nt, Human
ccaucacaguccccaucgugau

SEQ ID NO: 1140391 - RNA, 22 nt, Human
ugcuuuauucagucucugccau

SEQ ID NO: 1140392 - RNA, 20 nt, Human
cuguuaaaagguaugaauuc

SEQ ID NO: 1140393 - RNA, 22 nt, Human
aggaagcuuggggcagggcuac

SEQ ID NO: 1140394 - RNA, 22 nt, Human
uuagaacugaagaagauuaagg

SEQ ID NO: 1140395 - RNA, 23 nt, Human
ugaaacauuuaggguagaauuuc

SEQ ID NO: 1140396 - RNA, 22 nt, Human
uuccuggcucacagcagugggg

SEQ ID NO: 1140397 - RNA, 22 nt, Human
gcagcuuucuaagcuuuauugc

SEQ ID NO: 1140398 - RNA, 22 nt, Human
uuucacauuggcuucuauuucu

SEQ ID NO: 1140399 - RNA, 22 nt, Human
cucagagaaaugucacaacaau

SEQ ID NO: 1140400 - RNA, 22 nt, Human
auaugugaaguggguuauuuug

SEQ ID NO: 1140401 - RNA, 22 nt, Human
gcuuuuaauuaguugcuuccau

SEQ ID NO: 1140402 - RNA, 22 nt, Human
acacacuggcccccaguacuga

SEQ ID NO: 1140403 - RNA, 22 nt, Human
ucacuguaauagguuugaagau

SEQ ID NO: 1140404 - RNA, 22 nt, Human
ucucuuucuauugcaccaugcu

SEQ ID NO: 1140405 - RNA, 22 nt, Human
aggguagggcccggagacagac

SEQ ID NO: 1140406 - RNA, 22 nt, Human
aaguguuuauuuauaacgaucu

SEQ ID NO: 1140407 - RNA, 22 nt, Human
ugcagggaaaacccaggaugcu

SEQ ID NO: 1140408 - RNA, 22 nt, Human
ucccacacagcccgcucaccgg

SEQ ID NO: 1140409 - RNA, 19 nt, Human
cugagagaugcuucacaca

SEQ ID NO: 1140410 - RNA, 22 nt, Human
acaauguaggauauguacuugu

SEQ ID NO: 1140411 - RNA, 22 nt, Human
ggcuccacccugcuuccagaag

SEQ ID NO: 1140412 - RNA, 22 nt, Human
ccagcucugcauguuucccuug

SEQ ID NO: 1140413 - RNA, 22 nt, Human
ccagcuuuccaggguugacugg

SEQ ID NO: 1140414 - RNA, 22 nt, Human
aagggcucgguagcaguccuga

SEQ ID NO: 1140415 - RNA, 23 nt, Human
acugggcugaaauuuuucauggc

SEQ ID NO: 1140416 - RNA, 22 nt, Human
augggcuggcagccugaacagc

SEQ ID NO: 1140417 - RNA, 22 nt, Human
ucuggcaguuugagaaaggcua

SEQ ID NO: 1140418 - RNA, 22 nt, Human
aaaguuagacagcaucauuucu

SEQ ID NO: 1140419 - RNA, 22 nt, Human
cccaggcaggagugugguggcu

SEQ ID NO: 1140420 - RNA, 22 nt, Human
agcaaacuaauugcaguucugg

SEQ ID NO: 1140421 - RNA, 22 nt, Human
ugaacuuagugggaauaucucu

SEQ ID NO: 1140422 - RNA, 22 nt, Human
ggcaggcuguucaccugcuuuu

SEQ ID NO: 1140423 - RNA, 22 nt, Human
agcaggcuugguccccagccuc

SEQ ID NO: 1140424 - RNA, 22 nt, Human
gaaacuuacuuacucacauuuc

SEQ ID NO: 1140425 - RNA, 22 nt, Human
ggcucccaggagggccuggagg

SEQ ID NO: 1140426 - RNA, 22 nt, Human
gaggagcuggcagcgucuccgc

SEQ ID NO: 1140427 - RNA, 22 nt, Human
ccagcccugaacccugcugcau

SEQ ID NO: 1140428 - RNA, 22 nt, Human
acagguccucaagucagcuggg

SEQ ID NO: 1140429 - RNA, 22 nt, Human
uauacaauggcugaaucaucca

SEQ ID NO: 1140430 - RNA, 20 nt, Human
ccagagaguagguuagugau

SEQ ID NO: 1140431 - RNA, 22 nt, Human
ugaguagagaauucagcuaagg

SEQ ID NO: 1140432 - RNA, 22 nt, Human
auuuguagugaagugaaaauaa

SEQ ID NO: 1140433 - RNA, 22 nt, Human
accugcaguggccacuccuaau

SEQ ID NO: 1140434 - RNA, 22 nt, Human
cuguaugaguugggaauagaau

SEQ ID NO: 1140435 - RNA, 22 nt, Human
ggcuuuauuaagcaggguaagu

SEQ ID NO: 1140436 - RNA, 22 nt, Human
aaucuuucccuauuaaaugugg

SEQ ID NO: 1140437 - RNA, 22 nt, Human
cccacacauuuuucacuuaccg

SEQ ID NO: 1140438 - RNA, 23 nt, Human
gccaggcacaugguggacacgca

SEQ ID NO: 1140439 - RNA, 22 nt, Human
caacacauugaagcuaugauga

SEQ ID NO: 1140440 - RNA, 22 nt, Human
gagcauuuuugucugcauuuua

SEQ ID NO: 1140441 - RNA, 22 nt, Human
ucccuccccacuucugagcuuu

SEQ ID NO: 1140442 - RNA, 22 nt, Human
augggcugcuucuccagcaccu

SEQ ID NO: 1140443 - RNA, 22 nt, Human
gcuggcagacugggggcagaac

SEQ ID NO: 1140444 - RNA, 21 nt, Human
cuguccaguaauuccuggcac

SEQ ID NO: 1140445 - RNA, 22 nt, Human
augugagggaaaucagucagaa

SEQ ID NO: 1140446 - RNA, 22 nt, Human
cauacuuuugcccugacauucu

SEQ ID NO: 1140447 - RNA, 22 nt, Human
uguaaacauauguauguaugua

SEQ ID NO: 1140448 - RNA, 22 nt, Human
ugugaucugccuuggaucugca

SEQ ID NO: 1140449 - RNA, 22 nt, Human
uuaugcaacaggugagcagaca

SEQ ID NO: 1140450 - RNA, 22 nt, Human
gcagcuuuguggagaggcccau

SEQ ID NO: 1140451 - RNA, 23 nt, Human
cuucacaaucaaaaucaguucug

SEQ ID NO: 1140452 - RNA, 22 nt, Human
gcuuggccagcagccgggaugc

SEQ ID NO: 1140453 - RNA, 19 nt, Human
agugcagggagcacccuca

SEQ ID NO: 1140454 - RNA, 22 nt, Human
auagggccuaaaaaguauugcu

SEQ ID NO: 1140455 - RNA, 22 nt, Human
ccacccagaccagggaucuggg

SEQ ID NO: 1140456 - RNA, 22 nt, Human
accaggcacucuuguggcagug

SEQ ID NO: 1140457 - RNA, 22 nt, Human
uacauguauguguacgugcaug

SEQ ID NO: 1140458 - RNA, 22 nt, Human
aaauuaguacauugcaaagucc

SEQ ID NO: 1140459 - RNA, 21 nt, Human
cuugggcuuguagauggugga

SEQ ID NO: 1140460 - RNA, 22 nt, Human
ucccaggcaaaggcagcucauu

SEQ ID NO: 1140461 - RNA, 17 nt, Human
ucugcagaggcaaaccu

SEQ ID NO: 1140462 - RNA, 22 nt, Human
gagggcucugucuggaagggaa

SEQ ID NO: 1140463 - RNA, 22 nt, Human
uugauacaggccuucuagauga

SEQ ID NO: 1140464 - RNA, 22 nt, Human
ccagagaggggaagggcuugcc

SEQ ID NO: 1140465 - RNA, 22 nt, Human
uggaccugcguaggugcugggc

SEQ ID NO: 1140466 - RNA, 22 nt, Human
ucuggcaguugccgcuucaguc

SEQ ID NO: 1140467 - RNA, 22 nt, Human
cagagcauuuggaagccacgug

SEQ ID NO: 1140468 - RNA, 22 nt, Human
uuucugaauaacucuaugauau

SEQ ID NO: 1140469 - RNA, 22 nt, Human
ucagagagguuaaauaucuugu

SEQ ID NO: 1140470 - RNA, 22 nt, Human
auaauggccgggggcugaaugc

SEQ ID NO: 1140471 - RNA, 22 nt, Human
auguuugaaauuguaaguauau

SEQ ID NO: 1140472 - RNA, 22 nt, Human
gcuggcagguaaagccccgggg

SEQ ID NO: 1140473 - RNA, 22 nt, Human
ugcaggcuguaaucugaggcua

SEQ ID NO: 1140474 - RNA, 22 nt, Human
uuugucaucccuuuugaaacug

SEQ ID NO: 1140475 - RNA, 23 nt, Human
ugugaaauuugaggucagugcuu

SEQ ID NO: 1140476 - RNA, 19 nt, Human
cccagcuugaccaccugcu

SEQ ID NO: 1140477 - RNA, 22 nt, Human
gaaugaauagguguccagaugg

SEQ ID NO: 1140478 - RNA, 22 nt, Human
acagagagaauuggguuuacag

SEQ ID NO: 1140479 - RNA, 22 nt, Human
guuucuuagguaaauucuuuga

SEQ ID NO: 1140480 - RNA, 22 nt, Human
ugcuuaaaauaguucauuuuug

SEQ ID NO: 1140481 - RNA, 22 nt, Human
gccccacagccugcggucucag

SEQ ID NO: 1140482 - RNA, 22 nt, Human
aaacaugagcauuucuguuuaa

SEQ ID NO: 1140483 - RNA, 22 nt, Human
cccugcaggcucagacuggagu

SEQ ID NO: 1140484 - RNA, 22 nt, Human
uucagagauggaaggcagaaug

SEQ ID NO: 1140485 - RNA, 22 nt, Human
ccugggcugaagucaagugugg

SEQ ID NO: 1140486 - RNA, 22 nt, Human
uagggcucagcucuagcuccug

SEQ ID NO: 1140487 - RNA, 22 nt, Human
cccagcuugcgggcggcaggag

SEQ ID NO: 1140488 - RNA, 22 nt, Human
ccuccuggcuuuucccauugaa

SEQ ID NO: 1140489 - RNA, 17 nt, Human
aaguccagaguugagca

SEQ ID NO: 1140490 - RNA, 22 nt, Human
caugagauaauuuuucuccagu

SEQ ID NO: 1140491 - RNA, 22 nt, Human
cagaugaggggcauauaacaau

SEQ ID NO: 1140492 - RNA, 22 nt, Human
ugugaaaagggcuuuguacaaa

SEQ ID NO: 1140493 - RNA, 22 nt, Human
cccuuccuugauuuuaacugga

SEQ ID NO: 1140494 - RNA, 22 nt, Human
uauuucccagggagcaacaagc

SEQ ID NO: 1140495 - RNA, 23 nt, Human
uuuuccuguggagacaugacugg

SEQ ID NO: 1140496 - RNA, 22 nt, Human
aggaagaacagauaauggacgc

SEQ ID NO: 1140497 - RNA, 22 nt, Human
auuucucaucaagugccaacuc

SEQ ID NO: 1140498 - RNA, 22 nt, Human
ccugggcuuucaaaaccagccu

SEQ ID NO: 1140499 - RNA, 22 nt, Human
uggcuagguagcuuucugcugu

SEQ ID NO: 1140500 - RNA, 19 nt, Human
acacauuugcacaauccac

SEQ ID NO: 1140501 - RNA, 22 nt, Human
guguauaaugcuguuuguacau

SEQ ID NO: 1140502 - RNA, 22 nt, Human
caguguggagggagagagccug

SEQ ID NO: 1140503 - RNA, 22 nt, Human
agagggcugccucagucagcua

SEQ ID NO: 1140504 - RNA, 22 nt, Human
uucauaaugagguccuagaggc

SEQ ID NO: 1140505 - RNA, 22 nt, Human
acuggcaguagagggagcgcau

SEQ ID NO: 1140506 - RNA, 22 nt, Human
aaaacaggugucagcaaacuau

SEQ ID NO: 1140507 - RNA, 22 nt, Human
cagggcucaggcucugggauuc

SEQ ID NO: 1140508 - RNA, 22 nt, Human
gagacugcauagauggccacaa

SEQ ID NO: 1140509 - RNA, 22 nt, Human
uguuugaauuuugcuaacgugu

SEQ ID NO: 1140510 - RNA, 22 nt, Human
cuucugggagagcuuuugcuuc

SEQ ID NO: 1140511 - RNA, 22 nt, Human
gcaggcuccaaggccugggaga

SEQ ID NO: 1140512 - RNA, 22 nt, Human
aaacagcaggaacaucuugcca

SEQ ID NO: 1140513 - RNA, 22 nt, Human
uccaagcuuuccaugcccucac

SEQ ID NO: 1140514 - RNA, 22 nt, Human
cuucugggauuaauuuuuccug

SEQ ID NO: 1140515 - RNA, 22 nt, Human
uuuacucuugcuacacaacugu

SEQ ID NO: 1140516 - RNA, 22 nt, Human
ucagggacgugagcucagaguc

SEQ ID NO: 1140517 - RNA, 18 nt, Human
cuguccaguagacucugc

SEQ ID NO: 1140518 - RNA, 19 nt, Human
gagggcucauuugaacaau

SEQ ID NO: 1140519 - RNA, 22 nt, Human
uguaggaaaaacaaugaucugc

SEQ ID NO: 1140520 - RNA, 22 nt, Human
cugcagccuccuccagcuacgu

SEQ ID NO: 1140521 - RNA, 22 nt, Human
ucaggguugcugugaucagucc

SEQ ID NO: 1140522 - RNA, 22 nt, Human
gggaccugccauugcucacagg

SEQ ID NO: 1140523 - RNA, 22 nt, Human
ugggcugaguguggaacuaguu

SEQ ID NO: 1140524 - RNA, 22 nt, Human
aucacagagcucccuuccacug

SEQ ID NO: 1140525 - RNA, 22 nt, Human
acuggcagccacaacuggcagg

SEQ ID NO: 1140526 - RNA, 22 nt, Human
acagauuuaggacuguagcgau

SEQ ID NO: 1140527 - RNA, 22 nt, Human
uggcaggaaaguaacagagcac

SEQ ID NO: 1140528 - RNA, 22 nt, Human
ugggccaggucugugucagcug

SEQ ID NO: 1140529 - RNA, 22 nt, Human
guccucuggaagaugaguucuu

SEQ ID NO: 1140530 - RNA, 22 nt, Human
uccaggcaugguguaauuuugc

SEQ ID NO: 1140531 - RNA, 22 nt, Human
uugaauuagacuuugcuacagg

SEQ ID NO: 1140532 - RNA, 22 nt, Human
gagcucagauucuggugucaga

SEQ ID NO: 1140533 - RNA, 22 nt, Human
acacauauauacauauuugugc

SEQ ID NO: 1140534 - RNA, 20 nt, Human
gccaggcacuguucucaaua

SEQ ID NO: 1140535 - RNA, 22 nt, Human
aucaaguuuucuuaguugacug

SEQ ID NO: 1140536 - RNA, 22 nt, Human
caugaagcuugaagcaguccac

SEQ ID NO: 1140537 - RNA, 22 nt, Human
ugcuuaaacauacuauuuauau

SEQ ID NO: 1140538 - RNA, 22 nt, Human
uagaaacagaaaacuguaauag

SEQ ID NO: 1140539 - RNA, 22 nt, Human
uuugugaauagguuggcuucca

SEQ ID NO: 1140540 - RNA, 22 nt, Human
auugaaaaauucacaauucugg

SEQ ID NO: 1140541 - RNA, 22 nt, Human
uuccaaguuaggcgagcuggug

SEQ ID NO: 1140542 - RNA, 22 nt, Human
auuaaauuggaucugcauaguu

SEQ ID NO: 1140543 - RNA, 22 nt, Human
cucugucacuucuccagcugag

SEQ ID NO: 1140544 - RNA, 22 nt, Human
ggugccaggcuguagucagggu

SEQ ID NO: 1140545 - RNA, 23 nt, Human
uggaccugaaccagugccucugu

SEQ ID NO: 1140546 - RNA, 22 nt, Human
ccagcccuugcugaaggguggc

SEQ ID NO: 1140547 - RNA, 22 nt, Human
auuuauuaugggauuuggcaca

SEQ ID NO: 1140548 - RNA, 22 nt, Human
ucuccugcucagaacagccuca

SEQ ID NO: 1140549 - RNA, 22 nt, Human
uuuuucaucugauugauaacuc

SEQ ID NO: 1140550 - RNA, 22 nt, Human
ucugggcugcuaugaggcagag

SEQ ID NO: 1140551 - RNA, 22 nt, Human
aaugaagcaguccaucugcucu

SEQ ID NO: 1140552 - RNA, 22 nt, Human
accugccuaucagcugccugcu

SEQ ID NO: 1140553 - RNA, 22 nt, Human
ucccaggcuaggccucugcguu

SEQ ID NO: 1140554 - RNA, 22 nt, Human
ggggccuuuucugaauguggaa

SEQ ID NO: 1140555 - RNA, 22 nt, Human
ucccaccccuugacucuuuaag

SEQ ID NO: 1140556 - RNA, 22 nt, Human
cagggcucaucugugugaccag

SEQ ID NO: 1140557 - RNA, 22 nt, Human
cugggcuucucccccuggcaga

SEQ ID NO: 1140558 - RNA, 22 nt, Human
uauguacuaacuuucauucuag

SEQ ID NO: 1140559 - RNA, 18 nt, Human
ucagagagcagcuuuauu

SEQ ID NO: 1140560 - RNA, 22 nt, Human
uucuagauagagugcaaauuau

SEQ ID NO: 1140561 - RNA, 22 nt, Human
uaauuucaccguugcuagaaau

SEQ ID NO: 1140562 - RNA, 22 nt, Human
cacuuagucucaccaguucagu

SEQ ID NO: 1140563 - RNA, 22 nt, Human
uacacacagaggccaugggauu

SEQ ID NO: 1140564 - RNA, 22 nt, Human
auauuagguuggugcaaaagua

SEQ ID NO: 1140565 - RNA, 22 nt, Human
gugugaaaaugugcacaauaug

SEQ ID NO: 1140566 - RNA, 22 nt, Human
gcugggcuguaguuugcugacc

SEQ ID NO: 1140567 - RNA, 22 nt, Human
gaugaagcuauuugguuggcac

SEQ ID NO: 1140568 - RNA, 22 nt, Human
uguguaaagcuuguuccagaaa

SEQ ID NO: 1140569 - RNA, 22 nt, Human
cugggaggcagucucucuagaa

SEQ ID NO: 1140570 - RNA, 23 nt, Human
uccuuuaaugcuggaauggcuag

SEQ ID NO: 1140571 - RNA, 22 nt, Human
uccaggcauaaugcccaguggu

SEQ ID NO: 1140572 - RNA, 22 nt, Human
augcagcuucaggauuaugaug

SEQ ID NO: 1140573 - RNA, 22 nt, Human
uacaaaguaauguauaauaucg

SEQ ID NO: 1140574 - RNA, 22 nt, Human
cugccucuauaggaguccacca

SEQ ID NO: 1140575 - RNA, 22 nt, Human
acuuugcagggcuugauaucca

SEQ ID NO: 1140576 - RNA, 18 nt, Human
agacccucuaagggcagu

SEQ ID NO: 1140577 - RNA, 22 nt, Human
acuggcaggcugcuggccggcg

SEQ ID NO: 1140578 - RNA, 22 nt, Human
uuuguucaugccuauauucuca

SEQ ID NO: 1140579 - RNA, 22 nt, Human
cugaaccacuaauauuuugauu

SEQ ID NO: 1140580 - RNA, 22 nt, Human
auuuucaugacuaccuuaaaua

SEQ ID NO: 1140581 - RNA, 22 nt, Human
uacccagcccaugccuaccuca

SEQ ID NO: 1140582 - RNA, 22 nt, Human
agucagugaaaacuagaauguu

SEQ ID NO: 1140583 - RNA, 19 nt, Human
ugcuagaaauucugugacu

SEQ ID NO: 1140584 - RNA, 22 nt, Human
augcauaauguauguauugacu

SEQ ID NO: 1140585 - RNA, 23 nt, Human
ucugggcugagacuuggaagguc

SEQ ID NO: 1140586 - RNA, 22 nt, Human
uuagacauagaauauugucuag

SEQ ID NO: 1140587 - RNA, 20 nt, Human
gaggccucagccucagcucc

SEQ ID NO: 1140588 - RNA, 22 nt, Human
guacacacuguuugaucauuuc

SEQ ID NO: 1140589 - RNA, 22 nt, Human
ccacauacaaauggggugcugu

SEQ ID NO: 1140590 - RNA, 22 nt, Human
augcuuuauuauuuugcaggga

SEQ ID NO: 1140591 - RNA, 17 nt, Human
cucugggcagccugggg

SEQ ID NO: 1140592 - RNA, 22 nt, Human
uggaccugaagaauaggaagua

SEQ ID NO: 1140593 - RNA, 22 nt, Human
aagucuguuugagugucacacu

SEQ ID NO: 1140594 - RNA, 17 nt, Human
ugaauucaaucugcacu

SEQ ID NO: 1140595 - RNA, 20 nt, Human
gcugggcuuugacugacaca

SEQ ID NO: 1140596 - RNA, 22 nt, Human
aaucaagaaaaugaggauucuu

SEQ ID NO: 1140597 - RNA, 19 nt, Human
gggguggcuggggcuccag

SEQ ID NO: 1140598 - RNA, 22 nt, Human
cccaaggccuucaagccagcuc

SEQ ID NO: 1140599 - RNA, 22 nt, Human
cacuguccaauagauacauaau

SEQ ID NO: 1140600 - RNA, 22 nt, Human
accaagcucucuucccggcucu

SEQ ID NO: 1140601 - RNA, 22 nt, Human
agucccagcuucccccaugcag

SEQ ID NO: 1140602 - RNA, 22 nt, Human
ucuggucaguaauaagaagugg

SEQ ID NO: 1140603 - RNA, 22 nt, Human
accaugaugggaagcucagggc

SEQ ID NO: 1140604 - RNA, 21 nt, Human
ucuggcaggaagacggauggg

SEQ ID NO: 1140605 - RNA, 22 nt, Human
uagaacacuugaccacugcucc

SEQ ID NO: 1140606 - RNA, 22 nt, Human
auuagagguacaaaccuucacu

SEQ ID NO: 1140607 - RNA, 22 nt, Human
aaccucaggcucucuggacaau

SEQ ID NO: 1140608 - RNA, 22 nt, Human
aggccccaaagcagugcaagua

SEQ ID NO: 1140609 - RNA, 22 nt, Human
ccuccagcgcgauccacuccgg

SEQ ID NO: 1140610 - RNA, 22 nt, Human
guccagagauggacgagcagau

SEQ ID NO: 1140611 - RNA, 22 nt, Human
ccuucuucuguguggcccaaga

SEQ ID NO: 1140612 - RNA, 22 nt, Human
auugacuuccauagcuaccugg

SEQ ID NO: 1140613 - RNA, 22 nt, Human
ggcuuuaucaaaugagacccug

SEQ ID NO: 1140614 - RNA, 20 nt, Human
ccagcuuucccugcagcauc

SEQ ID NO: 1140615 - RNA, 22 nt, Human
gcuuuauuuugugagggauuac

SEQ ID NO: 1140616 - RNA, 22 nt, Human
uugggaucucaaauccagcuau

SEQ ID NO: 1140617 - RNA, 22 nt, Human
gaugccuggcacccagcaagga

SEQ ID NO: 1140618 - RNA, 22 nt, Human
cugcagagcagccaguccccca

SEQ ID NO: 1140619 - RNA, 22 nt, Human
ggggcugagucagugggaagag

SEQ ID NO: 1140620 - RNA, 22 nt, Human
acaguguuuuagaaaagcuuga

SEQ ID NO: 1140621 - RNA, 22 nt, Human
auugguggugaggacaugccag

SEQ ID NO: 1140622 - RNA, 22 nt, Human
gccaggcacaguucuaggugcu

SEQ ID NO: 1140623 - RNA, 22 nt, Human
ggagucugcucccagacaugau

SEQ ID NO: 1140624 - RNA, 22 nt, Human
agaaagaggaugcagaucucau

SEQ ID NO: 1140625 - RNA, 20 nt, Human
uccugcagucgcuagcgccc

SEQ ID NO: 1140626 - RNA, 22 nt, Human
cucugggcugccuuuuagcucu

SEQ ID NO: 1140627 - RNA, 22 nt, Human
gcacaggaugauggguugaggg

SEQ ID NO: 1140628 - RNA, 22 nt, Human
aauugcaacagguagacuuuuc

SEQ ID NO: 1140629 - RNA, 22 nt, Human
uuaauacaagcauaugcacaca

SEQ ID NO: 1140630 - RNA, 20 nt, Human
agguuccuuuguggagaauu

SEQ ID NO: 1140631 - RNA, 22 nt, Human
cuucaaaugugauuuuaauaac

SEQ ID NO: 1140632 - RNA, 22 nt, Human
uacaacauguaaagugguuuaa

SEQ ID NO: 1140633 - RNA, 19 nt, Human
ggcggguggacuggagccc

SEQ ID NO: 1140634 - RNA, 21 nt, Human
ggcuaggaugcugggguuucc

SEQ ID NO: 1140635 - RNA, 22 nt, Human
auauauuuacucuccuguugca

SEQ ID NO: 1140636 - RNA, 22 nt, Human
accaggcaaaaccacaggagca

SEQ ID NO: 1140637 - RNA, 17 nt, Human
gggcugacaguggccuc

SEQ ID NO: 1140638 - RNA, 22 nt, Human
cugccugccuuggccuccagga

SEQ ID NO: 1140639 - RNA, 22 nt, Human
cagcuuuauuucacguguuugu

SEQ ID NO: 1140640 - RNA, 22 nt, Human
cccuggcagagggggcaggugc

SEQ ID NO: 1140641 - RNA, 22 nt, Human
agcuuuaucccuugcccaucga

SEQ ID NO: 1140642 - RNA, 22 nt, Human
ccugggcuugguuguugagaac

SEQ ID NO: 1140643 - RNA, 22 nt, Human
cuuaauuucaaacugcuaguga

SEQ ID NO: 1140644 - RNA, 22 nt, Human
aucucccagccacagcauucuu

SEQ ID NO: 1140645 - RNA, 22 nt, Human
cuuaaauuuucaucuacaagaa

SEQ ID NO: 1140646 - RNA, 23 nt, Human
cuuuucauugccuuagcgcagag

SEQ ID NO: 1140647 - RNA, 22 nt, Human
uuucacaucagagguagauuag

SEQ ID NO: 1140648 - RNA, 22 nt, Human
uuaaacauuuauggaggcagca

SEQ ID NO: 1140649 - RNA, 22 nt, Human
aguccagucucacucuuggcag

SEQ ID NO: 1140650 - RNA, 22 nt, Human
agaaaguuuugugcuauauaug

SEQ ID NO: 1140651 - RNA, 22 nt, Human
agggagacacaugaggaaguca

SEQ ID NO: 1140652 - RNA, 22 nt, Human
agccagaguugaaugugagucu

SEQ ID NO: 1140653 - RNA, 22 nt, Human
aggugaguccugggcacaggua

SEQ ID NO: 1140654 - RNA, 22 nt, Human
uuccaaguccagccaggccaaa

SEQ ID NO: 1140655 - RNA, 20 nt, Human
cugcuccacccggcucucag

SEQ ID NO: 1140656 - RNA, 22 nt, Human
ugcuucuggaaacaguggcugu

SEQ ID NO: 1140657 - RNA, 23 nt, Human
acaagauagggauaaaaagauaa

SEQ ID NO: 1140658 - RNA, 22 nt, Human
gcaggcucuucuuucugcccag

SEQ ID NO: 1140659 - RNA, 22 nt, Human
acccacccuacuagcagugucc

SEQ ID NO: 1140660 - RNA, 22 nt, Human
uacauauguaaacauguauaaa

SEQ ID NO: 1140661 - RNA, 22 nt, Human
gaugaagccugacuucucggug

SEQ ID NO: 1140662 - RNA, 22 nt, Human
uaacacauaagcugagaccaug

SEQ ID NO: 1140663 - RNA, 22 nt, Human
ccagcuuucucagaggcuucua

SEQ ID NO: 1140664 - RNA, 18 nt, Human
cucugucauaagugucau

SEQ ID NO: 1140665 - RNA, 22 nt, Human
guccucuguuuccaucugacuu

SEQ ID NO: 1140666 - RNA, 22 nt, Human
uauuaggguuuugaagguuugu

SEQ ID NO: 1140667 - RNA, 21 nt, Human
uuuagggaccaggucauaggc

SEQ ID NO: 1140668 - RNA, 22 nt, Human
ugaaaaaccucaguccgcuuua

SEQ ID NO: 1140669 - RNA, 22 nt, Human
uccaaguugauguuucuuaaau

SEQ ID NO: 1140670 - RNA, 22 nt, Human
guccucugaaguugugcaaugc

SEQ ID NO: 1140671 - RNA, 22 nt, Human
aaauaguuuagcucucauuuca

SEQ ID NO: 1140672 - RNA, 22 nt, Human
cgggcuccgggucuuugcaguc

SEQ ID NO: 1140673 - RNA, 22 nt, Human
cagggcacggagaagucacccc

SEQ ID NO: 1140674 - RNA, 22 nt, Human
cuagaaauauuuuacagucaag

SEQ ID NO: 1140675 - RNA, 22 nt, Human
ugcuagaauuugcagaagcaua

SEQ ID NO: 1140676 - RNA, 22 nt, Human
cgcaggcuuuagaaucugcuac

SEQ ID NO: 1140677 - RNA, 22 nt, Human
gagaaagauuguccuucagggg

SEQ ID NO: 1140678 - RNA, 22 nt, Human
ucuggggauggucuacuuucug

SEQ ID NO: 1140679 - RNA, 22 nt, Human
agccuauuccaggaugagcuca

SEQ ID NO: 1140680 - RNA, 22 nt, Human
cugcaggcccccuuccuggagu

SEQ ID NO: 1140681 - RNA, 22 nt, Human
uaugcacacauguaugcaugug

SEQ ID NO: 1140682 - RNA, 22 nt, Human
caggcagcccugcaccaagugu

SEQ ID NO: 1140683 - RNA, 22 nt, Human
aaagagucaaaggcaugucucu

SEQ ID NO: 1140684 - RNA, 22 nt, Human
acauuucacuguucacagcagg

SEQ ID NO: 1140685 - RNA, 22 nt, Human
gcuggggaccagcugucucuga

SEQ ID NO: 1140686 - RNA, 22 nt, Human
gacacagauaucucugagauua

SEQ ID NO: 1140687 - RNA, 22 nt, Human
acagcuuuugaaaaauuacugg

SEQ ID NO: 1140688 - RNA, 22 nt, Human
ugucacuuuggggagaguuuug

SEQ ID NO: 1140689 - RNA, 22 nt, Human
cccaggacucuucacugcagcc

SEQ ID NO: 1140690 - RNA, 22 nt, Human
uaacacaugucugggaugugaa

SEQ ID NO: 1140691 - RNA, 22 nt, Human
cagaagaggacuggguagcuca

SEQ ID NO: 1140692 - RNA, 22 nt, Human
ugcuucuguauuuugggcuuga

SEQ ID NO: 1140693 - RNA, 22 nt, Human
caggccucuuccaugcagcagc

SEQ ID NO: 1140694 - RNA, 23 nt, Human
cauccaggagcugagucugacug

SEQ ID NO: 1140695 - RNA, 22 nt, Human
aaauuugauaagccauuguuac

SEQ ID NO: 1140696 - RNA, 22 nt, Human
uccaggcauaagccuugagugu

SEQ ID NO: 1140697 - RNA, 22 nt, Human
gccaggcaugggcuucugggcg

SEQ ID NO: 1140698 - RNA, 21 nt, Human
ccuagccucuuacccagcuuu

SEQ ID NO: 1140699 - RNA, 21 nt, Human
caugaagccgguucccuguuu

SEQ ID NO: 1140700 - RNA, 22 nt, Human
ucacuguagugagcagaauaua

SEQ ID NO: 1140701 - RNA, 22 nt, Human
aguccggggucuggacaccugg

SEQ ID NO: 1140702 - RNA, 22 nt, Human
auauuagggucucuaaauucua

SEQ ID NO: 1140703 - RNA, 22 nt, Human
cuuaaaaucuggcaguuagcua

SEQ ID NO: 1140704 - RNA, 22 nt, Human
cagagccucagaauccugugga

SEQ ID NO: 1140705 - RNA, 22 nt, Human
ucuucuuaugugccauuaucuc

SEQ ID NO: 1140706 - RNA, 22 nt, Human
agagaguugaggaagcaacacu

SEQ ID NO: 1140707 - RNA, 22 nt, Human
acacacaauuaguuuuaugcuu

SEQ ID NO: 1140708 - RNA, 22 nt, Human
ucagagagaaauaguuuuugac

SEQ ID NO: 1140709 - RNA, 22 nt, Human
aggaccugacuggcuccugcuu

SEQ ID NO: 1140710 - RNA, 22 nt, Human
cugggcugcggugguagguugu

SEQ ID NO: 1140711 - RNA, 22 nt, Human
acuggcagagacccugauggcc

SEQ ID NO: 1140712 - RNA, 22 nt, Human
uacaaaguagaaauucaguaaa

SEQ ID NO: 1140713 - RNA, 21 nt, Human
ucauuugugaucugauuucca

SEQ ID NO: 1140714 - RNA, 22 nt, Human
uuauuauagauuaugcaagauu

SEQ ID NO: 1140715 - RNA, 22 nt, Human
uacauaauaaggggcauggugu

SEQ ID NO: 1140716 - RNA, 22 nt, Human
gcagcuuucugggacagaaagg

SEQ ID NO: 1140717 - RNA, 22 nt, Human
aagaacuuccuaauauauuuuc

SEQ ID NO: 1140718 - RNA, 22 nt, Human
aaugaucuacucucauuaucuc

SEQ ID NO: 1140719 - RNA, 20 nt, Human
acaauauguagaugaauagc

SEQ ID NO: 1140720 - RNA, 22 nt, Human
ggcaggcaggucuucauggccc

SEQ ID NO: 1140721 - RNA, 22 nt, Human
cagcucuguucauagauggugc

SEQ ID NO: 1140722 - RNA, 22 nt, Human
cugccugcugcccuccagagcc

SEQ ID NO: 1140723 - RNA, 22 nt, Human
uuuauuuggcauccagggagaa

SEQ ID NO: 1140724 - RNA, 22 nt, Human
uuggaaagauuauuauuaugaa

SEQ ID NO: 1140725 - RNA, 22 nt, Human
ggaccugaacauaaaacgaggc

SEQ ID NO: 1140726 - RNA, 22 nt, Human
acacaucuuagacugaaauaug

SEQ ID NO: 1140727 - RNA, 22 nt, Human
auaucauuauguuaugagcaca

SEQ ID NO: 1140728 - RNA, 22 nt, Human
gcuggcaguuuccucaccgagg

SEQ ID NO: 1140729 - RNA, 22 nt, Human
aacacaaagaagcugcaggauc

SEQ ID NO: 1140730 - RNA, 17 nt, Human
uauacacagacagacug

SEQ ID NO: 1140731 - RNA, 22 nt, Human
uuuccuuugcccaauacauguc

SEQ ID NO: 1140732 - RNA, 22 nt, Human
cccaggcagugugugcaugcgu

SEQ ID NO: 1140733 - RNA, 22 nt, Human
gaaaacuaacggaaaaguuagg

SEQ ID NO: 1140734 - RNA, 22 nt, Human
ucuggcaggucaaucauucuuu

SEQ ID NO: 1140735 - RNA, 22 nt, Human
uaguauuuaaucacuuuugucu

SEQ ID NO: 1140736 - RNA, 22 nt, Human
cccagccuuugcuuccugguuc

SEQ ID NO: 1140737 - RNA, 22 nt, Human
cucucuccuuagcugcagacca

SEQ ID NO: 1140738 - RNA, 22 nt, Human
ugaaauaucauuuucaucuccc

SEQ ID NO: 1140739 - RNA, 22 nt, Human
gccugcagggcccuuguggguc

SEQ ID NO: 1140740 - RNA, 22 nt, Human
gagaaagacguaggcugggagg

SEQ ID NO: 1140741 - RNA, 22 nt, Human
ccagauagaaaagaaggcagga

SEQ ID NO: 1140742 - RNA, 22 nt, Human
cugcagggagaggggacagccu

SEQ ID NO: 1140743 - RNA, 22 nt, Human
ccuggcagcagcacaugccuuc

SEQ ID NO: 1140744 - RNA, 20 nt, Human
ucccucccuccagcucuggg

SEQ ID NO: 1140745 - RNA, 20 nt, Human
cuaggaacuauggucuggcu

SEQ ID NO: 1140746 - RNA, 22 nt, Human
acagguggccccgagggagugg

SEQ ID NO: 1140747 - RNA, 22 nt, Human
aacaguaacgagauguccuaac

SEQ ID NO: 1140748 - RNA, 22 nt, Human
uauuuguauguguguacauaua

SEQ ID NO: 1140749 - RNA, 22 nt, Human
gcuggcaggauagaagucuaau

SEQ ID NO: 1140750 - RNA, 22 nt, Human
cauccaggcaccacaaccagcu

SEQ ID NO: 1140751 - RNA, 19 nt, Human
acuggcagggcugcggugg

SEQ ID NO: 1140752 - RNA, 22 nt, Human
aagcgccaugguuccugcgcag

SEQ ID NO: 1140753 - RNA, 22 nt, Human
cccaggcauuuucaacuuuagu

SEQ ID NO: 1140754 - RNA, 22 nt, Human
uuuucauugagcaccugaguaa

SEQ ID NO: 1140755 - RNA, 22 nt, Human
aaagcagggaugaggcuagagg

SEQ ID NO: 1140756 - RNA, 22 nt, Human
auucugucuaagcuggcuacgu

SEQ ID NO: 1140757 - RNA, 22 nt, Human
agcuuugggcagaagaggauuc

SEQ ID NO: 1140758 - RNA, 22 nt, Human
guuuuauaugucucugcugaca

SEQ ID NO: 1140759 - RNA, 22 nt, Human
uuauuucauguaaaauuuaugu

SEQ ID NO: 1140760 - RNA, 22 nt, Human
acuggcagugucguuuacauga

SEQ ID NO: 1140761 - RNA, 22 nt, Human
agguaugagauaaaucaaugaa

SEQ ID NO: 1140762 - RNA, 22 nt, Human
cuguggcuucugcuugggccuc

SEQ ID NO: 1140763 - RNA, 22 nt, Human
ugcagggcuaagucagagccug

SEQ ID NO: 1140764 - RNA, 22 nt, Human
uacacaucccagacucccagga

SEQ ID NO: 1140765 - RNA, 22 nt, Human
uuucauaaacaguagaagacua

SEQ ID NO: 1140766 - RNA, 22 nt, Human
augggcugugggacccuggacc

SEQ ID NO: 1140767 - RNA, 17 nt, Human
aguguuuccuuaucauu

SEQ ID NO: 1140768 - RNA, 22 nt, Human
gguggcagaggugcaucagccc

SEQ ID NO: 1140769 - RNA, 22 nt, Human
uccaggcuaauuuugcauuguu

SEQ ID NO: 1140770 - RNA, 22 nt, Human
cuuaaauucuuaaugcccucau

SEQ ID NO: 1140771 - RNA, 22 nt, Human
agaaaauuagauuuuacugugu

SEQ ID NO: 1140772 - RNA, 22 nt, Human
agaauccuguuuuacuucauca

SEQ ID NO: 1140773 - RNA, 22 nt, Human
cagcucugcugggaggaugcag

SEQ ID NO: 1140774 - RNA, 22 nt, Human
ugcccccugguggccagagccg

SEQ ID NO: 1140775 - RNA, 22 nt, Human
ggccucucugagagcagacguu

SEQ ID NO: 1140776 - RNA, 22 nt, Human
agcuuuauucaugauuucaggg

SEQ ID NO: 1140777 - RNA, 22 nt, Human
gcauguuuugcaacaagugacc

SEQ ID NO: 1140778 - RNA, 22 nt, Human
uuuaauuuguauuucuagaggg

SEQ ID NO: 1140779 - RNA, 22 nt, Human
ccagagagagaggucaauggca

SEQ ID NO: 1140780 - RNA, 21 nt, Human
auaaaguuuuacaggaaugca

SEQ ID NO: 1140781 - RNA, 22 nt, Human
ccagcuuuuggggugacaauuu

SEQ ID NO: 1140782 - RNA, 22 nt, Human
ugggcuccuugggagcaaguga

SEQ ID NO: 1140783 - RNA, 22 nt, Human
ucugggcuggcuuuaugcugac

SEQ ID NO: 1140784 - RNA, 22 nt, Human
ccuggggaaaagcaggcauuua

SEQ ID NO: 1140785 - RNA, 22 nt, Human
uaauuuuaugacaguguauuuu

SEQ ID NO: 1140786 - RNA, 22 nt, Human
aguccagugucaaggugccauu

SEQ ID NO: 1140787 - RNA, 23 nt, Human
acaggcucuuaaucagugcuccu

SEQ ID NO: 1140788 - RNA, 22 nt, Human
cagagaaagggugaauuccuuc

SEQ ID NO: 1140789 - RNA, 20 nt, Human
ggcaggcuuuauauggaggg

SEQ ID NO: 1140790 - RNA, 22 nt, Human
acccagcuaacccuacccugga

SEQ ID NO: 1140791 - RNA, 22 nt, Human
cagcccaggccgacaguuccuc

SEQ ID NO: 1140792 - RNA, 22 nt, Human
ccaggccucccuuuuccagcca

SEQ ID NO: 1140793 - RNA, 22 nt, Human
uuuaauuuucugggcccagcag

SEQ ID NO: 1140794 - RNA, 22 nt, Human
uuaucauugucgcagucuaauu

SEQ ID NO: 1140795 - RNA, 22 nt, Human
augucaaaucaguuuuaucaga

SEQ ID NO: 1140796 - RNA, 22 nt, Human
cauaauuugugguaguggggga

SEQ ID NO: 1140797 - RNA, 22 nt, Human
ucuuuuucugcacacguguccc

SEQ ID NO: 1140798 - RNA, 22 nt, Human
agaggccggccgagcccauggg

SEQ ID NO: 1140799 - RNA, 22 nt, Human
uaauacuguauacugcaaauuu

SEQ ID NO: 1140800 - RNA, 22 nt, Human
ucauacaauucaaucucugauu

SEQ ID NO: 1140801 - RNA, 22 nt, Human
uggcagagcccagacuccaguc

SEQ ID NO: 1140802 - RNA, 22 nt, Human
gagaggcugaaaucacaggagc

SEQ ID NO: 1140803 - RNA, 22 nt, Human
acauuuuuauucaucaaagcag

SEQ ID NO: 1140804 - RNA, 22 nt, Human
cccaggaguaagugacauuguu

SEQ ID NO: 1140805 - RNA, 22 nt, Human
uagcuuuaagacauggugaaug

SEQ ID NO: 1140806 - RNA, 23 nt, Human
guccucuggagagaaaggcagua

SEQ ID NO: 1140807 - RNA, 22 nt, Human
uccugagcugccgcaucagcag

SEQ ID NO: 1140808 - RNA, 22 nt, Human
auuugcuuuuacuauguuaaaa

SEQ ID NO: 1140809 - RNA, 22 nt, Human
uccaggcaaagggacuagcagg

SEQ ID NO: 1140810 - RNA, 22 nt, Human
acaugauuuuuaaagagauaau

SEQ ID NO: 1140811 - RNA, 22 nt, Human
aacaaaagccgaaguagguguc

SEQ ID NO: 1140812 - RNA, 22 nt, Human
ugcuuuauuuauaaaauagcaa

SEQ ID NO: 1140813 - RNA, 22 nt, Human
ggcaggcuagcacugauguccu

SEQ ID NO: 1140814 - RNA, 22 nt, Human
cuagggacugggaccuuaguua

SEQ ID NO: 1140815 - RNA, 22 nt, Human
augaaaauguacauguguauaa

SEQ ID NO: 1140816 - RNA, 22 nt, Human
uaugaacugugagugugauggg

SEQ ID NO: 1140817 - RNA, 22 nt, Human
agcaggcuaggaaccucacugc

SEQ ID NO: 1140818 - RNA, 22 nt, Human
ugaagccauaggacagaggaua

SEQ ID NO: 1140819 - RNA, 22 nt, Human
agcuuuaccugccuuggggcac

SEQ ID NO: 1140820 - RNA, 23 nt, Human
agggcuccuuguugauuagcauu

SEQ ID NO: 1140821 - RNA, 22 nt, Human
gcaggcucacucuguuuggcuc

SEQ ID NO: 1140822 - RNA, 22 nt, Human
aaugaagcaagcugcuguguuu

SEQ ID NO: 1140823 - RNA, 23 nt, Human
ccaggccucucagagggugugcc

SEQ ID NO: 1140824 - RNA, 21 nt, Human
gcccccuggacuccucaucca

SEQ ID NO: 1140825 - RNA, 22 nt, Human
ugagggacucccggcccugcca

SEQ ID NO: 1140826 - RNA, 22 nt, Human
caaaugcagauucaggaguucu

SEQ ID NO: 1140827 - RNA, 22 nt, Human
agggcucugagcuggaccaccu

SEQ ID NO: 1140828 - RNA, 22 nt, Human
gccuggcaauggccucaggaag

SEQ ID NO: 1140829 - RNA, 22 nt, Human
ucauaaaugcagugucauaaau

SEQ ID NO: 1140830 - RNA, 20 nt, Human
aucugcuugccuguccucgg

SEQ ID NO: 1140831 - RNA, 21 nt, Human
agagucugagugugcaagggc

SEQ ID NO: 1140832 - RNA, 22 nt, Human
uacuuacagaaggaagcaauug

SEQ ID NO: 1140833 - RNA, 21 nt, Human
aaaugaaugugguagugcaag

SEQ ID NO: 1140834 - RNA, 22 nt, Human
auaaaguuuaaaagucaauagu

SEQ ID NO: 1140835 - RNA, 19 nt, Human
ccagagacauuggcaucuu

SEQ ID NO: 1140836 - RNA, 22 nt, Human
uuggaaauugcaagugauuugc

SEQ ID NO: 1140837 - RNA, 22 nt, Human
aguguggcaggaaugacuagaa

SEQ ID NO: 1140838 - RNA, 22 nt, Human
gccccaccuugagagcagaaac

SEQ ID NO: 1140839 - RNA, 22 nt, Human
acccacacaucucuaauucagu

SEQ ID NO: 1140840 - RNA, 22 nt, Human
caauuucuuguuaauucucagg

SEQ ID NO: 1140841 - RNA, 22 nt, Human
cuggccucauagccaagcugug

SEQ ID NO: 1140842 - RNA, 22 nt, Human
caauuucucgaacucuaaucca

SEQ ID NO: 1140843 - RNA, 22 nt, Human
uccaggcuagguuuacaggaca

SEQ ID NO: 1140844 - RNA, 22 nt, Human
acagacuggccugucucgcacc

SEQ ID NO: 1140845 - RNA, 22 nt, Human
ccaggcagagggaauagcaagu

SEQ ID NO: 1140846 - RNA, 22 nt, Human
gaauauuuucaguacagauggu

SEQ ID NO: 1140847 - RNA, 22 nt, Human
guccuggcugguucuguggggc

SEQ ID NO: 1140848 - RNA, 22 nt, Human
gccaagcucaccuucugaugga

SEQ ID NO: 1140849 - RNA, 20 nt, Human
uaguauuugcauaaggauag

SEQ ID NO: 1140850 - RNA, 22 nt, Human
uuaugacaggaaaaucacagaa

SEQ ID NO: 1140851 - RNA, 22 nt, Human
agggcuccaaggaaguguagcu

SEQ ID NO: 1140852 - RNA, 22 nt, Human
ccaucuccaaauaccaucacau

SEQ ID NO: 1140853 - RNA, 22 nt, Human
uagaaacauguucuguucuguu

SEQ ID NO: 1140854 - RNA, 22 nt, Human
uuccuugaaugagucauggaaa

SEQ ID NO: 1140855 - RNA, 23 nt, Human
aaauuauugcucuucaauugccu

SEQ ID NO: 1140856 - RNA, 22 nt, Human
uccauucuaugcuuacauuuau

SEQ ID NO: 1140857 - RNA, 22 nt, Human
ucuggcaggaccaugaagcgua

SEQ ID NO: 1140858 - RNA, 22 nt, Human
uuuaaauuuagaagaaacacug

SEQ ID NO: 1140859 - RNA, 22 nt, Human
gccugcagccucagagaauuuu

SEQ ID NO: 1140860 - RNA, 22 nt, Human
cauuuauucauuugcuagggcu

SEQ ID NO: 1140861 - RNA, 22 nt, Human
uucucuuuuagaggcuccauga

SEQ ID NO: 1140862 - RNA, 17 nt, Human
ucugggcuucagugguc

SEQ ID NO: 1140863 - RNA, 18 nt, Human
gcagcuuuugauucaccc

SEQ ID NO: 1140864 - RNA, 22 nt, Human
augacaugaccugguagagaca

SEQ ID NO: 1140865 - RNA, 19 nt, Human
cugcagggaugugcagagu

SEQ ID NO: 1140866 - RNA, 21 nt, Human
gccugcaguuuugaagcccuu

SEQ ID NO: 1140867 - RNA, 22 nt, Human
agguauaagaagauuauuuaua

SEQ ID NO: 1140868 - RNA, 22 nt, Human
uccugcagccuugggcuggagc

SEQ ID NO: 1140869 - RNA, 22 nt, Human
uuaacacauauuuaucaauugc

SEQ ID NO: 1140870 - RNA, 22 nt, Human
auacaaauuuauagaugcauuu

SEQ ID NO: 1140871 - RNA, 22 nt, Human
agauuugcggcuuuacuuugca

SEQ ID NO: 1140872 - RNA, 22 nt, Human
ucugcagaaggaaucagcugag

SEQ ID NO: 1140873 - RNA, 22 nt, Human
ccuggcagucaggggaguccuu

SEQ ID NO: 1140874 - RNA, 22 nt, Human
acuggggagugguuuugggaag

SEQ ID NO: 1140875 - RNA, 21 nt, Human
cagugagguccccagccuagg

SEQ ID NO: 1140876 - RNA, 22 nt, Human
aucuacauaaaacgaauacaua

SEQ ID NO: 1140877 - RNA, 22 nt, Human
gaggggcuggguagggcaaccc

SEQ ID NO: 1140878 - RNA, 22 nt, Human
ggccucagagaaggcugugcgg

SEQ ID NO: 1140879 - RNA, 22 nt, Human
ggcagaccucuccagccccaca

SEQ ID NO: 1140880 - RNA, 22 nt, Human
uuucaaaugcaugucuuuccuc

SEQ ID NO: 1140881 - RNA, 22 nt, Human
ugucuuuauauauuuggaaaau

SEQ ID NO: 1140882 - RNA, 22 nt, Human
agggacuauuuacccaucucac

SEQ ID NO: 1140883 - RNA, 22 nt, Human
gaggcuccccaugaggccccag

SEQ ID NO: 1140884 - RNA, 22 nt, Human
auguagaauggugauuggcagg

SEQ ID NO: 1140885 - RNA, 22 nt, Human
ugaaguuguuaagguugccauu

SEQ ID NO: 1140886 - RNA, 22 nt, Human
cucugcagauucaucccuucac

SEQ ID NO: 1140887 - RNA, 22 nt, Human
cauuuguagcuauuuacuguau

SEQ ID NO: 1140888 - RNA, 22 nt, Human
gccaggcagcagcgaggauggu

SEQ ID NO: 1140889 - RNA, 22 nt, Human
ugggaccugaagcagguuggca

SEQ ID NO: 1140890 - RNA, 22 nt, Human
cccaggcagccugcagggaagg

SEQ ID NO: 1140891 - RNA, 22 nt, Human
ccagagaggcaaaacuccuucc

SEQ ID NO: 1140892 - RNA, 22 nt, Human
caucaaauaggaauauuuggca

SEQ ID NO: 1140893 - RNA, 20 nt, Human
auuuggcaugaaguauugau

SEQ ID NO: 1140894 - RNA, 22 nt, Human
gggaccugccaaggccacccag

SEQ ID NO: 1140895 - RNA, 22 nt, Human
ugcagggagggcccagcaaucu

SEQ ID NO: 1140896 - RNA, 21 nt, Human
acacagaggcaucaucacuuu

SEQ ID NO: 1140897 - RNA, 22 nt, Human
agguauuauuagcaucucuauu

SEQ ID NO: 1140898 - RNA, 22 nt, Human
gugcauuugugcaugcacaugu

SEQ ID NO: 1140899 - RNA, 22 nt, Human
guguaugaacgaaagaauggau

SEQ ID NO: 1140900 - RNA, 22 nt, Human
aaauccuaaggagaauaugauu

SEQ ID NO: 1140901 - RNA, 22 nt, Human
auaugugaaugauaucacuuug

SEQ ID NO: 1140902 - RNA, 22 nt, Human
augggcugggaucugaguguca

SEQ ID NO: 1140903 - RNA, 22 nt, Human
gaaagauauuuauuggcaacag

SEQ ID NO: 1140904 - RNA, 22 nt, Human
agcaggcuuacuuucugauuag

SEQ ID NO: 1140905 - RNA, 19 nt, Human
uucuaccuuacuguaggcu

SEQ ID NO: 1140906 - RNA, 22 nt, Human
uccaggcaugucccaagccgga

SEQ ID NO: 1140907 - RNA, 22 nt, Human
cucugagauaguuucuaucaau

SEQ ID NO: 1140908 - RNA, 22 nt, Human
uuucacauaucaacucuauccu

SEQ ID NO: 1140909 - RNA, 22 nt, Human
caaugaaaauuuaaguugcagc

SEQ ID NO: 1140910 - RNA, 22 nt, Human
uggaccugagccuggcccugcc

SEQ ID NO: 1140911 - RNA, 22 nt, Human
caagcucugggauagcagagag

SEQ ID NO: 1140912 - RNA, 22 nt, Human
gcauagucaguaggauucucaa

SEQ ID NO: 1140913 - RNA, 22 nt, Human
uuuagggaaauugaggguuaag

SEQ ID NO: 1140914 - RNA, 22 nt, Human
uguuuuucaaauauugcucugu

SEQ ID NO: 1140915 - RNA, 22 nt, Human
uguacauagaucuugaaaauua

SEQ ID NO: 1140916 - RNA, 22 nt, Human
gucaggacucugacccgucccg

SEQ ID NO: 1140917 - RNA, 22 nt, Human
gcccaggcuggagugcaguagc

SEQ ID NO: 1140918 - RNA, 22 nt, Human
aagagcauauuaauaguggaga

SEQ ID NO: 1140919 - RNA, 22 nt, Human
agagccaggugcugcuguuuga

SEQ ID NO: 1140920 - RNA, 22 nt, Human
uccaagcucucuaugccaugau

SEQ ID NO: 1140921 - RNA, 22 nt, Human
uacauugaauuuuuuagcaugu

SEQ ID NO: 1140922 - RNA, 22 nt, Human
ccagagacgucggucagggcgc

SEQ ID NO: 1140923 - RNA, 22 nt, Human
gugggcuuuugacagugccugg

SEQ ID NO: 1140924 - RNA, 22 nt, Human
uuuaauuugaaaugaguaaccc

SEQ ID NO: 1140925 - RNA, 22 nt, Human
gcacacagcuagauuaccauuc

SEQ ID NO: 1140926 - RNA, 22 nt, Human
gccugcagaacugugaggcaau

SEQ ID NO: 1140927 - RNA, 22 nt, Human
cuggccucuguguucaccauag

SEQ ID NO: 1140928 - RNA, 22 nt, Human
cagcuugugcaaagguccuggg

SEQ ID NO: 1140929 - RNA, 22 nt, Human
cacacacuggagcaaggagaug

SEQ ID NO: 1140930 - RNA, 22 nt, Human
ucagcuuugcaaguuagaaaau

SEQ ID NO: 1140931 - RNA, 22 nt, Human
acagguggaggcuuuaggaggu

SEQ ID NO: 1140932 - RNA, 17 nt, Human
gccuucucugcccucac

SEQ ID NO: 1140933 - RNA, 22 nt, Human
cauguuaaaauauacauucuga

SEQ ID NO: 1140934 - RNA, 19 nt, Human
ccacacagugugcaauuua

SEQ ID NO: 1140935 - RNA, 22 nt, Human
acccagcuggaugcauggaggc

SEQ ID NO: 1140936 - RNA, 22 nt, Human
cuauuagguaugugguugcuau

SEQ ID NO: 1140937 - RNA, 20 nt, Human
uccugcaguuccuaggaggg

SEQ ID NO: 1140938 - RNA, 22 nt, Human
uuagcauuucaguacacauguu

SEQ ID NO: 1140939 - RNA, 22 nt, Human
uccccacacuuucacuccuggc

SEQ ID NO: 1140940 - RNA, 22 nt, Human
auauuauucuagcucuugugug

SEQ ID NO: 1140941 - RNA, 22 nt, Human
uccccaccuaagauacccaucu

SEQ ID NO: 1140942 - RNA, 22 nt, Human
agcaggugggcaugaaagcuga

SEQ ID NO: 1140943 - RNA, 22 nt, Human
ugggcagggagcuggaaccaca

SEQ ID NO: 1140944 - RNA, 22 nt, Human
uagaauaugauuaauuuucuua

SEQ ID NO: 1140945 - RNA, 22 nt, Human
ugucuuuagagucacaaaacca

SEQ ID NO: 1140946 - RNA, 18 nt, Human
uuucacagauucaugacu

SEQ ID NO: 1140947 - RNA, 22 nt, Human
gccagggaaacugcagaccagc

SEQ ID NO: 1140948 - RNA, 22 nt, Human
gccaggcacugcucuaagcccu

SEQ ID NO: 1140949 - RNA, 22 nt, Human
cacccagcuuuugcauccuccg

SEQ ID NO: 1140950 - RNA, 22 nt, Human
auaucauucugauguauaucuu

SEQ ID NO: 1140951 - RNA, 22 nt, Human
cccagcccaucucaaaggucua

SEQ ID NO: 1140952 - RNA, 22 nt, Human
ugcaggcuggcagauaucucau

SEQ ID NO: 1140953 - RNA, 23 nt, Human
uccuuccuuugagaggcuccauc

SEQ ID NO: 1140954 - RNA, 22 nt, Human
gcagagaccccgcagugaggcc

SEQ ID NO: 1140955 - RNA, 22 nt, Human
agcucugacugaagagaugcaa

SEQ ID NO: 1140956 - RNA, 19 nt, Human
agcaggcuaggcugccucu

SEQ ID NO: 1140957 - RNA, 22 nt, Human
gcuggcaggauaacuucuaagc

SEQ ID NO: 1140958 - RNA, 22 nt, Human
guggcagucgcugacagauaca

SEQ ID NO: 1140959 - RNA, 22 nt, Human
gagccuccuccuggugugccga

SEQ ID NO: 1140960 - RNA, 22 nt, Human
acuggcagaacuggugauuguc

SEQ ID NO: 1140961 - RNA, 22 nt, Human
acaagauagcuuagaagauuca

SEQ ID NO: 1140962 - RNA, 22 nt, Human
uuuguaaaggccugaauuucag

SEQ ID NO: 1140963 - RNA, 22 nt, Human
guuagggagucagguggcucuu

SEQ ID NO: 1140964 - RNA, 22 nt, Human
cauucacaaagcugauugaugg

SEQ ID NO: 1140965 - RNA, 22 nt, Human
accauugccuagaaaaauuccu

SEQ ID NO: 1140966 - RNA, 22 nt, Human
uagggcucagaguccaguuucu

SEQ ID NO: 1140967 - RNA, 22 nt, Human
aggaaagauggaaggaggauaa

SEQ ID NO: 1140968 - RNA, 22 nt, Human
aagagagagugcgcucacagaa

SEQ ID NO: 1140969 - RNA, 22 nt, Human
gcaggcucccuugcagagcagg

SEQ ID NO: 1140970 - RNA, 22 nt, Human
gcaaggaccuuugagcgugcca

SEQ ID NO: 1140971 - RNA, 22 nt, Human
cccuuccuugugacuggugggg

SEQ ID NO: 1140972 - RNA, 22 nt, Human
gcuaggaggaagaaugugaauu

SEQ ID NO: 1140973 - RNA, 22 nt, Human
aacacagcuaauuucugucaau

SEQ ID NO: 1140974 - RNA, 22 nt, Human
gccugcagggccugggccuacc

SEQ ID NO: 1140975 - RNA, 22 nt, Human
uuauuuaaaagugguaagauuc

SEQ ID NO: 1140976 - RNA, 22 nt, Human
auuuauuaagcaucugcuaugu

SEQ ID NO: 1140977 - RNA, 22 nt, Human
ugucuuuagaaagaagcagaca

SEQ ID NO: 1140978 - RNA, 22 nt, Human
gccugcagccagggaguucucu

SEQ ID NO: 1140979 - RNA, 22 nt, Human
gacccauauaggacccuccaaa

SEQ ID NO: 1140980 - RNA, 22 nt, Human
uuuuccuguccaggcaauuauu

SEQ ID NO: 1140981 - RNA, 22 nt, Human
cccagcuugcccaggacugagg

SEQ ID NO: 1140982 - RNA, 19 nt, Human
cagguggcgcucuacaggg

SEQ ID NO: 1140983 - RNA, 20 nt, Human
gcucugaccauaucaagaca

SEQ ID NO: 1140984 - RNA, 20 nt, Human
cuggggacagcaauggcugu

SEQ ID NO: 1140985 - RNA, 22 nt, Human
aggaggcugggcacaguggccu

SEQ ID NO: 1140986 - RNA, 22 nt, Human
auguuugacugaguuuggcaga

SEQ ID NO: 1140987 - RNA, 22 nt, Human
gucacaggccuggaugaggggc

SEQ ID NO: 1140988 - RNA, 22 nt, Human
auaugaagaaucuaggauaggc

SEQ ID NO: 1140989 - RNA, 22 nt, Human
auuauuagauucuuaauuguaa

SEQ ID NO: 1140990 - RNA, 22 nt, Human
ccugggcucugaggagggaguc

SEQ ID NO: 1140991 - RNA, 21 nt, Human
acagagcauaaugguguggca

SEQ ID NO: 1140992 - RNA, 22 nt, Human
aucacauugccagugauuaccc

SEQ ID NO: 1140993 - RNA, 22 nt, Human
cagcuuguuuuauuuggggacc

SEQ ID NO: 1140994 - RNA, 20 nt, Human
ccugggcucaaagcauccuc

SEQ ID NO: 1140995 - RNA, 22 nt, Human
aggaccuggaucacagagaucu

SEQ ID NO: 1140996 - RNA, 22 nt, Human
guccaagagucaagaagggggc

SEQ ID NO: 1140997 - RNA, 16 nt, Human
gcagggguggguggag

SEQ ID NO: 1140998 - RNA, 22 nt, Human
uguuagaaauuauuaguaauau

SEQ ID NO: 1140999 - RNA, 22 nt, Human
gaaugaauucagcacauggaau

SEQ ID NO: 1141000 - RNA, 22 nt, Human
ccucccuucaguagagcccaau

SEQ ID NO: 1141001 - RNA, 22 nt, Human
ccaggcaggcgauggugcagug

SEQ ID NO: 1141002 - RNA, 22 nt, Human
cagugagggcauucagugcugg

SEQ ID NO: 1141003 - RNA, 22 nt, Human
cccugcaggggaccugcagccu

SEQ ID NO: 1141004 - RNA, 22 nt, Human
auauucuuccaaaacaucauuu

SEQ ID NO: 1141005 - RNA, 20 nt, Human
aaaagagugcuucaacugcu

SEQ ID NO: 1141006 - RNA, 22 nt, Human
uccuggcaaagauguugguguu

SEQ ID NO: 1141007 - RNA, 22 nt, Human
ccuggcagcuaagugcuuugag

SEQ ID NO: 1141008 - RNA, 21 nt, Human
uuuagggaggauauuuaacuu

SEQ ID NO: 1141009 - RNA, 22 nt, Human
agggcuccugaggcccuucugg

SEQ ID NO: 1141010 - RNA, 22 nt, Human
ugggcugcuucuauuggugguc

SEQ ID NO: 1141011 - RNA, 22 nt, Human
auuccacacaguaauacucaau

SEQ ID NO: 1141012 - RNA, 22 nt, Human
ucacuguauuugcugaugcaua

SEQ ID NO: 1141013 - RNA, 22 nt, Human
uccugaggcacaauccuagaau

SEQ ID NO: 1141014 - RNA, 22 nt, Human
aaauuauuacaagcuaguuggc

SEQ ID NO: 1141015 - RNA, 22 nt, Human
uuccagcuaacucacaucccuu

SEQ ID NO: 1141016 - RNA, 21 nt, Human
ugcaggcuguuuaagaggcaa

SEQ ID NO: 1141017 - RNA, 22 nt, Human
ugggcuuaggucggaggcggcc

SEQ ID NO: 1141018 - RNA, 22 nt, Human
ccuggcagcuccuccccggcgg

SEQ ID NO: 1141019 - RNA, 22 nt, Human
ucagcuuucuauguugcuaaac

SEQ ID NO: 1141020 - RNA, 22 nt, Human
cagggcuccccagagagccucu

SEQ ID NO: 1141021 - RNA, 20 nt, Human
cugcagggugagugggcgau

SEQ ID NO: 1141022 - RNA, 22 nt, Human
agguggcucugacagcucuggu

SEQ ID NO: 1141023 - RNA, 22 nt, Human
ucaaagagcuauucaguugugg

SEQ ID NO: 1141024 - RNA, 22 nt, Human
gccuggcauauaguaguugugc

SEQ ID NO: 1141025 - RNA, 22 nt, Human
cagcccaggucucucuuccagu

SEQ ID NO: 1141026 - RNA, 19 nt, Human
acauuuagaauguacuugc

SEQ ID NO: 1141027 - RNA, 22 nt, Human
uguaugaaucucauuuguuuaa

SEQ ID NO: 1141028 - RNA, 22 nt, Human
gagggaccccaggcuggcccuu

SEQ ID NO: 1141029 - RNA, 23 nt, Human
uauuagggccaggacuggcaaau

SEQ ID NO: 1141030 - RNA, 22 nt, Human
uuuaugaacuacagauauaacu

SEQ ID NO: 1141031 - RNA, 22 nt, Human
guccucugggcagcugccccac

SEQ ID NO: 1141032 - RNA, 22 nt, Human
cauuguuauagcauuacacacc

SEQ ID NO: 1141033 - RNA, 22 nt, Human
ugcaggcuuuagccccauggcu

SEQ ID NO: 1141034 - RNA, 19 nt, Human
gacuccaacuuuaagcaug

SEQ ID NO: 1141035 - RNA, 22 nt, Human
guuuuauaggcuguugcuauau

SEQ ID NO: 1141036 - RNA, 22 nt, Human
guguaugauuucaaauggcuag

SEQ ID NO: 1141037 - RNA, 22 nt, Human
cuccagugagcgcggggcaugg

SEQ ID NO: 1141038 - RNA, 22 nt, Human
cuccuggcacucaguguggaag

SEQ ID NO: 1141039 - RNA, 22 nt, Human
gacagccaucagcacacgcugc

SEQ ID NO: 1141040 - RNA, 22 nt, Human
gcaggcucaaaagcugguagga

SEQ ID NO: 1141041 - RNA, 22 nt, Human
ggaaucagaauuaggauuugaa

SEQ ID NO: 1141042 - RNA, 22 nt, Human
gggacaauggaggccucucucc

SEQ ID NO: 1141043 - RNA, 22 nt, Human
uuuucucuuguuaauguacuga

SEQ ID NO: 1141044 - RNA, 22 nt, Human
aaugaagccacugaagacaauc

SEQ ID NO: 1141045 - RNA, 22 nt, Human
uuuguacauccuaauucugagu

SEQ ID NO: 1141046 - RNA, 22 nt, Human
uuccaagugggggaagcugagu

SEQ ID NO: 1141047 - RNA, 22 nt, Human
cuggauuuaauuaacuguugcu

SEQ ID NO: 1141048 - RNA, 22 nt, Human
ccaggcucacagcaucccagga

SEQ ID NO: 1141049 - RNA, 22 nt, Human
aaaugcuagggagaaacucucc

SEQ ID NO: 1141050 - RNA, 22 nt, Human
ugcaggcucugguuuauagugc

SEQ ID NO: 1141051 - RNA, 22 nt, Human
uguaugaaugggaaaaggaaac

SEQ ID NO: 1141052 - RNA, 22 nt, Human
aaaguguggucguucauuuugu

SEQ ID NO: 1141053 - RNA, 19 nt, Human
uccugcagaccagaccugu

SEQ ID NO: 1141054 - RNA, 22 nt, Human
ucagcuuuuuggauugcccaag

SEQ ID NO: 1141055 - RNA, 22 nt, Human
ucuguggaaauuuccugaggca

SEQ ID NO: 1141056 - RNA, 22 nt, Human
gggucaggcucagcagggcagc

SEQ ID NO: 1141057 - RNA, 22 nt, Human
ucuggcagaucuucccacguuu

SEQ ID NO: 1141058 - RNA, 22 nt, Human
uaucaauacauguuaucagugu

SEQ ID NO: 1141059 - RNA, 22 nt, Human
ugugaaauauuuauauacucaa

SEQ ID NO: 1141060 - RNA, 19 nt, Human
gcagagugggguggagggu

SEQ ID NO: 1141061 - RNA, 22 nt, Human
cccagcuucugagggggccuug

SEQ ID NO: 1141062 - RNA, 22 nt, Human
ccagagaggccuuggcaagaca

SEQ ID NO: 1141063 - RNA, 22 nt, Human
ggaccugcucucccaguucucu

SEQ ID NO: 1141064 - RNA, 22 nt, Human
uccuuucccuuuccauccuggc

SEQ ID NO: 1141065 - RNA, 22 nt, Human
ucuggcagguucccauguuaug

SEQ ID NO: 1141066 - RNA, 22 nt, Human
acuaaagaagccaaaguuuucu

SEQ ID NO: 1141067 - RNA, 22 nt, Human
cagggacccgcacagguagcau

SEQ ID NO: 1141068 - RNA, 22 nt, Human
ccccacccaccuaagagaaacu

SEQ ID NO: 1141069 - RNA, 22 nt, Human
aaacauuguaauuuuagcaugg

SEQ ID NO: 1141070 - RNA, 22 nt, Human
guugggaaggugaacaugaugc

SEQ ID NO: 1141071 - RNA, 22 nt, Human
acagcuuugggcaaugcuauga

SEQ ID NO: 1141072 - RNA, 22 nt, Human
ucgggcucgcucuccuagcgga

SEQ ID NO: 1141073 - RNA, 22 nt, Human
ucuggcagcaagauaacaaugg

SEQ ID NO: 1141074 - RNA, 22 nt, Human
cuggcaugaaauggcaucucau

SEQ ID NO: 1141075 - RNA, 22 nt, Human
augcuacagaguuugaauaugu

SEQ ID NO: 1141076 - RNA, 22 nt, Human
uccuucccaggugucgccgccu

SEQ ID NO: 1141077 - RNA, 22 nt, Human
gacugccagaaugugaggccug

SEQ ID NO: 1141078 - RNA, 22 nt, Human
uuucacauaugguuguugauug

SEQ ID NO: 1141079 - RNA, 22 nt, Human
uagauauguguuuauuaugcug

SEQ ID NO: 1141080 - RNA, 22 nt, Human
ugggcuuccuggagccugugcu

SEQ ID NO: 1141081 - RNA, 22 nt, Human
aauguauggauucaugucugug

SEQ ID NO: 1141082 - RNA, 22 nt, Human
ugaaagauugugauucaauaug

SEQ ID NO: 1141083 - RNA, 22 nt, Human
uauuccuauuucuaaacauaug

SEQ ID NO: 1141084 - RNA, 22 nt, Human
agcuuuaugggagcuuagauaa

SEQ ID NO: 1141085 - RNA, 22 nt, Human
aaacaucaauugcaucucccaa

SEQ ID NO: 1141086 - RNA, 22 nt, Human
cgucacuucuuagucuauuuuc

SEQ ID NO: 1141087 - RNA, 22 nt, Human
uuguacaaaggauuuggaagag

SEQ ID NO: 1141088 - RNA, 22 nt, Human
ugaguacucggagugcuuugga

SEQ ID NO: 1141089 - RNA, 22 nt, Human
uucauauaaauggaaucagaau

SEQ ID NO: 1141090 - RNA, 22 nt, Human
ucccaggcuggcaggcagcagu

SEQ ID NO: 1141091 - RNA, 22 nt, Human
gcagcuuuagaaacaagggcug

SEQ ID NO: 1141092 - RNA, 22 nt, Human
ccucucagcgauuccucuugga

SEQ ID NO: 1141093 - RNA, 22 nt, Human
ucagcuuugggggucucaggag

SEQ ID NO: 1141094 - RNA, 22 nt, Human
ccugggcuguugcaucauccuu

SEQ ID NO: 1141095 - RNA, 22 nt, Human
uuuugcuuuuguaacacagugu

SEQ ID NO: 1141096 - RNA, 22 nt, Human
ggggcugacgggcauguggcuu

SEQ ID NO: 1141097 - RNA, 19 nt, Human
ccuuccuccccagggccau

SEQ ID NO: 1141098 - RNA, 22 nt, Human
auaaaauuugcuacuguuaaau

SEQ ID NO: 1141099 - RNA, 22 nt, Human
aguaugaagcugaaugauuuua

SEQ ID NO: 1141100 - RNA, 22 nt, Human
uucacaauaggagcaugcaaau

SEQ ID NO: 1141101 - RNA, 22 nt, Human
caggggccaaggguccagaccu

SEQ ID NO: 1141102 - RNA, 22 nt, Human
cucuuaaagaauguuccagcug

SEQ ID NO: 1141103 - RNA, 23 nt, Human
cucccuggcccuugggagaccug

SEQ ID NO: 1141104 - RNA, 20 nt, Human
cacaacuguccacaugcucc

SEQ ID NO: 1141105 - RNA, 22 nt, Human
uccaggcuugagaccaggcucu

SEQ ID NO: 1141106 - RNA, 22 nt, Human
caggaguggugugagggacucc

SEQ ID NO: 1141107 - RNA, 22 nt, Human
ugcuucuguucuuucaccuacg

SEQ ID NO: 1141108 - RNA, 22 nt, Human
uccuggcagugcuuguuuugga

SEQ ID NO: 1141109 - RNA, 22 nt, Human
aaacuucagugaaugacuuaug

SEQ ID NO: 1141110 - RNA, 22 nt, Human
gggaccugaggagggguuucag

SEQ ID NO: 1141111 - RNA, 22 nt, Human
guuuauuaacugucaagugauu

SEQ ID NO: 1141112 - RNA, 17 nt, Human
uuaagguggaucagcac

SEQ ID NO: 1141113 - RNA, 22 nt, Human
agucacuuccagacaccugccu

SEQ ID NO: 1141114 - RNA, 22 nt, Human
aaugauuggcacuagauacaca

SEQ ID NO: 1141115 - RNA, 22 nt, Human
acaguaaaaagccuuagaauuu

SEQ ID NO: 1141116 - RNA, 21 nt, Human
uuacaaagcaagugcuguguc

SEQ ID NO: 1141117 - RNA, 22 nt, Human
uuuacauugcauuagguauuau

SEQ ID NO: 1141118 - RNA, 22 nt, Human
gcacccagggacuuggcuggcc

SEQ ID NO: 1141119 - RNA, 22 nt, Human
gggguggccaaggacucugacc

SEQ ID NO: 1141120 - RNA, 22 nt, Human
aggccuccuggcuccaggccuu

SEQ ID NO: 1141121 - RNA, 22 nt, Human
gggcugaccccaccccucacuc

SEQ ID NO: 1141122 - RNA, 18 nt, Human
ugcaggcugggguuccuc

SEQ ID NO: 1141123 - RNA, 22 nt, Human
acgugcaggaucugguuggcga

SEQ ID NO: 1141124 - RNA, 23 nt, Human
gagggcucugagugcuugggcca

SEQ ID NO: 1141125 - RNA, 22 nt, Human
gcuggaguuggcaaggcaugua

SEQ ID NO: 1141126 - RNA, 22 nt, Human
auauuaggaguuaaauguauua

SEQ ID NO: 1141127 - RNA, 22 nt, Human
cuguugcaucauggcucuuaau

SEQ ID NO: 1141128 - RNA, 22 nt, Human
guacacacuauuuaaaguguuu

SEQ ID NO: 1141129 - RNA, 22 nt, Human
accaagcuagaacauuacaggc

SEQ ID NO: 1141130 - RNA, 20 nt, Human
gccugcagguuggaugggau

SEQ ID NO: 1141131 - RNA, 22 nt, Human
cugcaggggccucgagcacagg

SEQ ID NO: 1141132 - RNA, 22 nt, Human
gcuggcagccaagugaagaggg

SEQ ID NO: 1141133 - RNA, 22 nt, Human
uaugacauugcuuuuuagaacu

SEQ ID NO: 1141134 - RNA, 22 nt, Human
ggcaggcuuugagaaagagcau

SEQ ID NO: 1141135 - RNA, 22 nt, Human
ucagcuuuuaaaaacaagaagu

SEQ ID NO: 1141136 - RNA, 22 nt, Human
ugcuucugaguugcaggacuug

SEQ ID NO: 1141137 - RNA, 22 nt, Human
agggacuugaugucagggagau

SEQ ID NO: 1141138 - RNA, 22 nt, Human
aaucacuuuucucuaauguagc

SEQ ID NO: 1141139 - RNA, 22 nt, Human
gaaacauaguugagacacugcu

SEQ ID NO: 1141140 - RNA, 22 nt, Human
augugaaauagcuggauaugaa

SEQ ID NO: 1141141 - RNA, 22 nt, Human
accugcagccacuucucuccuu

SEQ ID NO: 1141142 - RNA, 22 nt, Human
gcagagaguugggcugcgccag

SEQ ID NO: 1141143 - RNA, 18 nt, Human
ucagagagaauaguaauu

SEQ ID NO: 1141144 - RNA, 22 nt, Human
aucacaauguacguuaaaaugu

SEQ ID NO: 1141145 - RNA, 19 nt, Human
gcuggcagauguggccgug

SEQ ID NO: 1141146 - RNA, 22 nt, Human
aaggcuuuaugugaccaaaaga

SEQ ID NO: 1141147 - RNA, 22 nt, Human
agggcucccgugaggugacugc

SEQ ID NO: 1141148 - RNA, 22 nt, Human
gagcacccuuugcacaucaguc

SEQ ID NO: 1141149 - RNA, 22 nt, Human
uauaauguuuuccauggacuga

SEQ ID NO: 1141150 - RNA, 22 nt, Human
acaaucauuccguucacaacag

SEQ ID NO: 1141151 - RNA, 22 nt, Human
agacaucaaugaucagagguag

SEQ ID NO: 1141152 - RNA, 23 nt, Human
aguaugaauucauuguuuuaguu

SEQ ID NO: 1141153 - RNA, 22 nt, Human
gccugcaggcuguaguuuguga

SEQ ID NO: 1141154 - RNA, 22 nt, Human
cucugggcaaguuucuucauga

SEQ ID NO: 1141155 - RNA, 22 nt, Human
auggcagagggauugaacagcu

SEQ ID NO: 1141156 - RNA, 22 nt, Human
ucugcucugggccagcuauuaa

SEQ ID NO: 1141157 - RNA, 22 nt, Human
uuaauuuucucaucugugaaau

SEQ ID NO: 1141158 - RNA, 22 nt, Human
uuuagggaagaagcccauggcc

SEQ ID NO: 1141159 - RNA, 22 nt, Human
uuuuauuaucuuugaaugggac

SEQ ID NO: 1141160 - RNA, 22 nt, Human
gcacacaggggaguucucagaa

SEQ ID NO: 1141161 - RNA, 22 nt, Human
cuccuggcucgcccccagcuga

SEQ ID NO: 1141162 - RNA, 22 nt, Human
accaggcagcaccaaagccggu

SEQ ID NO: 1141163 - RNA, 22 nt, Human
gccucaggccgcccugcugcuc

SEQ ID NO: 1141164 - RNA, 20 nt, Human
uuucacaaugaacaugucuc

SEQ ID NO: 1141165 - RNA, 23 nt, Human
uuucacaaugagcauuacagaau

SEQ ID NO: 1141166 - RNA, 22 nt, Human
ugcaggcugggaagagggacaa

SEQ ID NO: 1141167 - RNA, 22 nt, Human
guggcagguggagccuccugca

SEQ ID NO: 1141168 - RNA, 18 nt, Human
uccucucuuuccccaggg

SEQ ID NO: 1141169 - RNA, 20 nt, Human
uuccacaucuuugcacaugc

SEQ ID NO: 1141170 - RNA, 22 nt, Human
ugcuucugcaggagcuccugau

SEQ ID NO: 1141171 - RNA, 22 nt, Human
cuuuauuccuacaagauuuucu

SEQ ID NO: 1141172 - RNA, 22 nt, Human
auuaaauuggacgcugggggaa

SEQ ID NO: 1141173 - RNA, 22 nt, Human
guggcaguuuugacaucacaaa

SEQ ID NO: 1141174 - RNA, 22 nt, Human
gagcacugauuuauuuuugucu

SEQ ID NO: 1141175 - RNA, 22 nt, Human
cacagucacauaucuaugugug

SEQ ID NO: 1141176 - RNA, 22 nt, Human
auucaagagcccauguuuccug

SEQ ID NO: 1141177 - RNA, 22 nt, Human
cagaagaguagcugaacaaguu

SEQ ID NO: 1141178 - RNA, 22 nt, Human
uccaggcauuggagagauaaug

SEQ ID NO: 1141179 - RNA, 22 nt, Human
aagagcacuaacagagcugaua

SEQ ID NO: 1141180 - RNA, 20 nt, Human
cugcaggguuagaggcucca

SEQ ID NO: 1141181 - RNA, 22 nt, Human
auaugagaauuggaaaauauca

SEQ ID NO: 1141182 - RNA, 19 nt, Human
agacaaguuuccagaagcc

SEQ ID NO: 1141183 - RNA, 22 nt, Human
uuuaaaaucagaugggaguugg

SEQ ID NO: 1141184 - RNA, 22 nt, Human
agcaccaucacagcuguauguc

SEQ ID NO: 1141185 - RNA, 22 nt, Human
cauauguauuucucauaauuag

SEQ ID NO: 1141186 - RNA, 22 nt, Human
cgcaggcugcagccaagaagag

SEQ ID NO: 1141187 - RNA, 22 nt, Human
aacaggcaggagaauucugccu

SEQ ID NO: 1141188 - RNA, 22 nt, Human
gaaacauacgauuuaggagaaa

SEQ ID NO: 1141189 - RNA, 22 nt, Human
caggcagcugcuggguucagcc

SEQ ID NO: 1141190 - RNA, 22 nt, Human
agggcgacaauggagagcguuu

SEQ ID NO: 1141191 - RNA, 22 nt, Human
cagagcaugaauaaaaguuaca

SEQ ID NO: 1141192 - RNA, 22 nt, Human
aaauccuaauaaugcacuagug

SEQ ID NO: 1141193 - RNA, 21 nt, Human
uaacacauuuugguacuuugg

SEQ ID NO: 1141194 - RNA, 22 nt, Human
auguuagaaucucugaaugugg

SEQ ID NO: 1141195 - RNA, 22 nt, Human
uccaggaggguuuucugccuuc

SEQ ID NO: 1141196 - RNA, 18 nt, Human
acauuucuccuucugacc

SEQ ID NO: 1141197 - RNA, 22 nt, Human
ucauuuguggaagugauugugg

SEQ ID NO: 1141198 - RNA, 22 nt, Human
aucugcuugaguuugaagucag

SEQ ID NO: 1141199 - RNA, 22 nt, Human
guaaaauugcaauuacuuuugc

SEQ ID NO: 1141200 - RNA, 22 nt, Human
agcuuuaucuucaccugggaau

SEQ ID NO: 1141201 - RNA, 20 nt, Human
gagggcucguggauggauaa

SEQ ID NO: 1141202 - RNA, 22 nt, Human
aggaccugagaguuggaaaucc

SEQ ID NO: 1141203 - RNA, 20 nt, Human
acccagcucugugcccuggg

SEQ ID NO: 1141204 - RNA, 22 nt, Human
auuuauuauugugguuacuucu

SEQ ID NO: 1141205 - RNA, 22 nt, Human
agacacagcugcaggagguggg

SEQ ID NO: 1141206 - RNA, 22 nt, Human
uaagaacaguagaacaguaggu

SEQ ID NO: 1141207 - RNA, 22 nt, Human
ucugugcaggaagucauuauga

SEQ ID NO: 1141208 - RNA, 22 nt, Human
uggcaguagauccagucucucu

SEQ ID NO: 1141209 - RNA, 22 nt, Human
aaagcuuuucaguauguucaug

SEQ ID NO: 1141210 - RNA, 22 nt, Human
uagcauuaucugucuuaucauu

SEQ ID NO: 1141211 - RNA, 22 nt, Human
uuuaaauucugucugccgcuua

SEQ ID NO: 1141212 - RNA, 22 nt, Human
gccaggcagauaugugagcuua

SEQ ID NO: 1141213 - RNA, 22 nt, Human
uggccucugugggagcugagca

SEQ ID NO: 1141214 - RNA, 22 nt, Human
uagcuuuagugaaaaauaucag

SEQ ID NO: 1141215 - RNA, 22 nt, Human
ggaaccacagcccccagcaggc

SEQ ID NO: 1141216 - RNA, 22 nt, Human
cccaggcacucuuggucauuuu

SEQ ID NO: 1141217 - RNA, 22 nt, Human
cccagccuuccacccuggacua

SEQ ID NO: 1141218 - RNA, 22 nt, Human
ugcuuuauugcaucaguguggg

SEQ ID NO: 1141219 - RNA, 22 nt, Human
cugcaggacgaccgccucaucu

SEQ ID NO: 1141220 - RNA, 18 nt, Human
aggaaagaaaggcaggug

SEQ ID NO: 1141221 - RNA, 21 nt, Human
ccugggcugugguuuggagac

SEQ ID NO: 1141222 - RNA, 18 nt, Human
cuacauucauaggaaagg

SEQ ID NO: 1141223 - RNA, 22 nt, Human
gugggcuuuggccucuuucucc

SEQ ID NO: 1141224 - RNA, 22 nt, Human
accaggcacuccugaggucuga

SEQ ID NO: 1141225 - RNA, 20 nt, Human
agaaauauugaguucagagg

SEQ ID NO: 1141226 - RNA, 22 nt, Human
ccaggccucaccugcccaccua

SEQ ID NO: 1141227 - RNA, 22 nt, Human
uuuuccuucugauacuccauuu

SEQ ID NO: 1141228 - RNA, 22 nt, Human
ugagaauuuuuugucaugcauu

SEQ ID NO: 1141229 - RNA, 22 nt, Human
agggcucccgcgguguccggga

SEQ ID NO: 1141230 - RNA, 22 nt, Human
cccugcagcauucucuaacugg

SEQ ID NO: 1141231 - RNA, 22 nt, Human
cuuucauucuuagauauuagug

SEQ ID NO: 1141232 - RNA, 19 nt, Human
ccuugccugucccugcagc

SEQ ID NO: 1141233 - RNA, 22 nt, Human
uauuaggguaaauuugacaugc

SEQ ID NO: 1141234 - RNA, 20 nt, Human
cccugcagccaugggagugg

SEQ ID NO: 1141235 - RNA, 22 nt, Human
gagaagcaaucaguggccaccc

SEQ ID NO: 1141236 - RNA, 21 nt, Human
acaggcucuggggaugcuggg

SEQ ID NO: 1141237 - RNA, 22 nt, Human
uagacacaucuucauccacaau

SEQ ID NO: 1141238 - RNA, 22 nt, Human
agccauccucccaccucagccu

SEQ ID NO: 1141239 - RNA, 22 nt, Human
gcaggcucagagcagauuagca

SEQ ID NO: 1141240 - RNA, 22 nt, Human
ccagguccuguuuucaccacag

SEQ ID NO: 1141241 - RNA, 22 nt, Human
auuacaauaagguuuauuugua

SEQ ID NO: 1141242 - RNA, 23 nt, Human
aguguugguugggaagccaagca

SEQ ID NO: 1141243 - RNA, 22 nt, Human
agggcacccucucugcaguacc

SEQ ID NO: 1141244 - RNA, 22 nt, Human
uaauaguuaugguugguucuca

SEQ ID NO: 1141245 - RNA, 22 nt, Human
cagggcuccccgcaccgcagcc

SEQ ID NO: 1141246 - RNA, 22 nt, Human
uguuggaauuaggauacagagg

SEQ ID NO: 1141247 - RNA, 22 nt, Human
cugggcuuagcagcuccugguc

SEQ ID NO: 1141248 - RNA, 22 nt, Human
cuccaggcucguccaagaucga

SEQ ID NO: 1141249 - RNA, 22 nt, Human
guuaggaacacuggagccuaaa

SEQ ID NO: 1141250 - RNA, 22 nt, Human
aucugucaagauagacucugca

SEQ ID NO: 1141251 - RNA, 22 nt, Human
cccaggcacaccccgaacggaa

SEQ ID NO: 1141252 - RNA, 22 nt, Human
uccagacccaugacccugggga

SEQ ID NO: 1141253 - RNA, 22 nt, Human
gcagggacaacugugcaccuga

SEQ ID NO: 1141254 - RNA, 22 nt, Human
acacagccgugaaucugcuucu

SEQ ID NO: 1141255 - RNA, 22 nt, Human
cucugggcacuguauggguucu

SEQ ID NO: 1141256 - RNA, 22 nt, Human
cccugcagagagugcuuuugug

SEQ ID NO: 1141257 - RNA, 22 nt, Human
cugcagggugacguugcccacc

SEQ ID NO: 1141258 - RNA, 22 nt, Human
gcuaggagccgcugcacuaggu

SEQ ID NO: 1141259 - RNA, 22 nt, Human
cacuguccaugcuugcuaaccc

SEQ ID NO: 1141260 - RNA, 22 nt, Human
uggaacacuguggaugagaaga

SEQ ID NO: 1141261 - RNA, 22 nt, Human
aaaauccugcugacucgagaug

SEQ ID NO: 1141262 - RNA, 22 nt, Human
auguuucagauacagaucaaau

SEQ ID NO: 1141263 - RNA, 22 nt, Human
gagaacucagacgcaggucaug

SEQ ID NO: 1141264 - RNA, 22 nt, Human
cucugucagaguguugucccca

SEQ ID NO: 1141265 - RNA, 22 nt, Human
gagaccucuugguaucgcuagg

SEQ ID NO: 1141266 - RNA, 22 nt, Human
agcaggcugagcacccaggggg

SEQ ID NO: 1141267 - RNA, 22 nt, Human
ccaggcuguaagagugauguug

SEQ ID NO: 1141268 - RNA, 22 nt, Human
aucugucagccugggauuaggg

SEQ ID NO: 1141269 - RNA, 22 nt, Human
gccacagguacuaugggagaga

SEQ ID NO: 1141270 - RNA, 19 nt, Human
ggcauccacgaaugcagag

SEQ ID NO: 1141271 - RNA, 22 nt, Human
ccacaaaacugugugucaaaga

SEQ ID NO: 1141272 - RNA, 22 nt, Human
guugggaaggcaagaaguagaa

SEQ ID NO: 1141273 - RNA, 22 nt, Human
uuaacacagggggagacaaagu

SEQ ID NO: 1141274 - RNA, 22 nt, Human
uuggagagcaguaaaccacacu

SEQ ID NO: 1141275 - RNA, 22 nt, Human
uccugcagugugucuccugcac

SEQ ID NO: 1141276 - RNA, 22 nt, Human
ugccugacugcugccaccacua

SEQ ID NO: 1141277 - RNA, 22 nt, Human
aaauaguuguuuggaucaauaa

SEQ ID NO: 1141278 - RNA, 22 nt, Human
gaauacauuggaaaucagaaua

SEQ ID NO: 1141279 - RNA, 22 nt, Human
ccacacugucuaacaaggcaua

SEQ ID NO: 1141280 - RNA, 22 nt, Human
ccuaggaacccccaggcuucug

SEQ ID NO: 1141281 - RNA, 22 nt, Human
uuguuucaaauauuucagaaua

SEQ ID NO: 1141282 - RNA, 22 nt, Human
ccuccccaugacccggugcugg

SEQ ID NO: 1141283 - RNA, 22 nt, Human
aggaggcuguggagcacuccau

SEQ ID NO: 1141284 - RNA, 22 nt, Human
agcuuuauauguuguuucucca

SEQ ID NO: 1141285 - RNA, 22 nt, Human
ccuuuaaagacugcauaacuuc

SEQ ID NO: 1141286 - RNA, 22 nt, Human
ggccucagaggaggugugaguc

SEQ ID NO: 1141287 - RNA, 22 nt, Human
caugaagcccucaucagucuga

SEQ ID NO: 1141288 - RNA, 22 nt, Human
cauuuguaguuaaaaaugucuc

SEQ ID NO: 1141289 - RNA, 22 nt, Human
agcacaggaccaaggaagcugu

SEQ ID NO: 1141290 - RNA, 22 nt, Human
acauacacaagcguacaugaac

SEQ ID NO: 1141291 - RNA, 21 nt, Human
uugaccaagggugcgugcucc

SEQ ID NO: 1141292 - RNA, 22 nt, Human
gggaccuggggacuccuuguuc

SEQ ID NO: 1141293 - RNA, 22 nt, Human
aaacacauuuuaggaaaaucua

SEQ ID NO: 1141294 - RNA, 22 nt, Human
aauauaauuuuauuccuagagu

SEQ ID NO: 1141295 - RNA, 22 nt, Human
aggaggcuuuugcaggugccac

SEQ ID NO: 1141296 - RNA, 18 nt, Human
cccagcuuagcgccccuc

SEQ ID NO: 1141297 - RNA, 22 nt, Human
caguauuuauggcuugaguauu

SEQ ID NO: 1141298 - RNA, 22 nt, Human
uuucuacauucaaaaacuacca

SEQ ID NO: 1141299 - RNA, 22 nt, Human
acuguccaagcaugccuggcuu

SEQ ID NO: 1141300 - RNA, 22 nt, Human
uggcaggcaaguucagcuccac

SEQ ID NO: 1141301 - RNA, 22 nt, Human
ggcuuuauaggguagaggauca

SEQ ID NO: 1141302 - RNA, 22 nt, Human
guggcagugggaugcuaucagg

SEQ ID NO: 1141303 - RNA, 22 nt, Human
aucacuguuaucuagaagcaca

SEQ ID NO: 1141304 - RNA, 22 nt, Human
ugucagaugcgauaaacuagug

SEQ ID NO: 1141305 - RNA, 22 nt, Human
gcaguguuaggaauaaaaauga

SEQ ID NO: 1141306 - RNA, 22 nt, Human
uaucuguuaugggcugaauugc

SEQ ID NO: 1141307 - RNA, 22 nt, Human
uuacaguuuaguccaagccaga

SEQ ID NO: 1141308 - RNA, 22 nt, Human
acaagguauccacauuaaaugu

SEQ ID NO: 1141309 - RNA, 22 nt, Human
cuggcagguuuggugucuggug

SEQ ID NO: 1141310 - RNA, 22 nt, Human
auguagaauuccuucuacuuug

SEQ ID NO: 1141311 - RNA, 22 nt, Human
ucugggcugggagcguguggac

SEQ ID NO: 1141312 - RNA, 22 nt, Human
ucuauuuuauacucaaaucuuc

SEQ ID NO: 1141313 - RNA, 19 nt, Human
agaugucuauuugacuauc

SEQ ID NO: 1141314 - RNA, 22 nt, Human
gccaagcuuugcaggaguguug

SEQ ID NO: 1141315 - RNA, 22 nt, Human
cucauaaugugacuguauuuga

SEQ ID NO: 1141316 - RNA, 20 nt, Human
ugggcugaggaucaggugcc

SEQ ID NO: 1141317 - RNA, 22 nt, Human
gccaggcagcugggagggugcc

SEQ ID NO: 1141318 - RNA, 22 nt, Human
gcuggggagcuagaccucagca

SEQ ID NO: 1141319 - RNA, 22 nt, Human
aauacuuuccuauauaaggugc

SEQ ID NO: 1141320 - RNA, 22 nt, Human
uagggaccuuagaauuguaugu

SEQ ID NO: 1141321 - RNA, 22 nt, Human
aauauuuguuaguguuuuaaug

SEQ ID NO: 1141322 - RNA, 22 nt, Human
ggcaggcugggugucauggagu

SEQ ID NO: 1141323 - RNA, 22 nt, Human
cccaggcagaauuaguguuuca

SEQ ID NO: 1141324 - RNA, 22 nt, Human
uuagacauguuugcuaaaauga

SEQ ID NO: 1141325 - RNA, 21 nt, Human
guacacacagguggaugggcu

SEQ ID NO: 1141326 - RNA, 22 nt, Human
aaaguuugaaugauauauuagu

SEQ ID NO: 1141327 - RNA, 22 nt, Human
augucaaacacaacaccagugg

SEQ ID NO: 1141328 - RNA, 22 nt, Human
ccacuguauuuuggaagcagau

SEQ ID NO: 1141329 - RNA, 23 nt, Human
cuuucauugugguuucacagagc

SEQ ID NO: 1141330 - RNA, 22 nt, Human
ccugccuucagcccugaagucu

SEQ ID NO: 1141331 - RNA, 22 nt, Human
uccuggcacuuugggggcucgc

SEQ ID NO: 1141332 - RNA, 22 nt, Human
acacacagaguuuauacaggca

SEQ ID NO: 1141333 - RNA, 22 nt, Human
uguacaaagguacuuugauguu

SEQ ID NO: 1141334 - RNA, 22 nt, Human
cuucuuaacuguauauacuaug

SEQ ID NO: 1141335 - RNA, 19 nt, Human
gcugggcuuggguuuguag

SEQ ID NO: 1141336 - RNA, 22 nt, Human
augacucuuagcuaaagguaag

SEQ ID NO: 1141337 - RNA, 22 nt, Human
aauggcagaggcaaagauggua

SEQ ID NO: 1141338 - RNA, 22 nt, Human
ucauuuguugcuguuaccugag

SEQ ID NO: 1141339 - RNA, 22 nt, Human
ggcccagcgaggccaccuacag

SEQ ID NO: 1141340 - RNA, 22 nt, Human
aaggcuuuuaacuacuguuuua

SEQ ID NO: 1141341 - RNA, 22 nt, Human
caggcccugggcaggcacagag

SEQ ID NO: 1141342 - RNA, 21 nt, Human
ccagcccagcugugucccagc

SEQ ID NO: 1141343 - RNA, 22 nt, Human
ccccaggcagggccuaacagag

SEQ ID NO: 1141344 - RNA, 22 nt, Human
cccugccucugaagcugcucag

SEQ ID NO: 1141345 - RNA, 22 nt, Human
ccuggggaauagagucaagggg

SEQ ID NO: 1141346 - RNA, 22 nt, Human
uguaugaagguuuaccugcugu

SEQ ID NO: 1141347 - RNA, 21 nt, Human
agcaacucugacuagaugagg

SEQ ID NO: 1141348 - RNA, 22 nt, Human
gcaguguuuguguucucacaug

SEQ ID NO: 1141349 - RNA, 22 nt, Human
aagagccagcuagugaagaggc

SEQ ID NO: 1141350 - RNA, 22 nt, Human
uggcagaaagaaccaugugcaa

SEQ ID NO: 1141351 - RNA, 22 nt, Human
acagugugaugggccugccuga

SEQ ID NO: 1141352 - RNA, 22 nt, Human
uuauuaggaacucaggauuuuu

SEQ ID NO: 1141353 - RNA, 19 nt, Human
ccagagagcuagguacaga

SEQ ID NO: 1141354 - RNA, 22 nt, Human
uuacaagauaaccugaugcugu

SEQ ID NO: 1141355 - RNA, 22 nt, Human
uuucuugaccacuauguugaua

SEQ ID NO: 1141356 - RNA, 19 nt, Human
gucuucugaauguggcugc

SEQ ID NO: 1141357 - RNA, 22 nt, Human
uccugagcccuguaggacccug

SEQ ID NO: 1141358 - RNA, 23 nt, Human
cacacccaucacuaagagcuccu

SEQ ID NO: 1141359 - RNA, 22 nt, Human
acuggggagagucaugccagca

SEQ ID NO: 1141360 - RNA, 22 nt, Human
gggcucucaaggcagggcccca

SEQ ID NO: 1141361 - RNA, 22 nt, Human
augauugcagcccuacagcugu

SEQ ID NO: 1141362 - RNA, 22 nt, Human
uucagagagaccaaguggcgug

SEQ ID NO: 1141363 - RNA, 22 nt, Human
uguauaaacuuaagcaggaacc

SEQ ID NO: 1141364 - RNA, 22 nt, Human
agaaucucuacucaaguacuug

SEQ ID NO: 1141365 - RNA, 22 nt, Human
ugcuucugacauguucuugguu

SEQ ID NO: 1141366 - RNA, 22 nt, Human
ugcuucuggcuuaucucgugcc

SEQ ID NO: 1141367 - RNA, 23 nt, Human
gagugcagaauagacaugcagug

SEQ ID NO: 1141368 - RNA, 22 nt, Human
ugacuagaccuauaucuuuuug

SEQ ID NO: 1141369 - RNA, 22 nt, Human
aaguaugacauuuaagacaauu

SEQ ID NO: 1141370 - RNA, 22 nt, Human
cuucuacacaucccucuugcuu

SEQ ID NO: 1141371 - RNA, 22 nt, Human
guccucuguguaggcugcagac

SEQ ID NO: 1141372 - RNA, 20 nt, Human
caccacagaauuggggacag

SEQ ID NO: 1141373 - RNA, 22 nt, Human
gcuucuggcagugcagccacca

SEQ ID NO: 1141374 - RNA, 22 nt, Human
aucaaauauaauaauuuucgcu

SEQ ID NO: 1141375 - RNA, 22 nt, Human
uguucauaucauuuugaaagcu

SEQ ID NO: 1141376 - RNA, 22 nt, Human
ccacccagccagaugcaggaag

SEQ ID NO: 1141377 - RNA, 20 nt, Human
aauuuacucacagaaugaau

SEQ ID NO: 1141378 - RNA, 22 nt, Human
cccugcagccuugcaugccuuc

SEQ ID NO: 1141379 - RNA, 19 nt, Human
uuagggacaugaauucuag

SEQ ID NO: 1141380 - RNA, 19 nt, Human
ugcuucuggaaugcaaggc

SEQ ID NO: 1141381 - RNA, 22 nt, Human
uaugaagcuuugaaaagcuuac

SEQ ID NO: 1141382 - RNA, 22 nt, Human
agcagguggacagaggaagaaa

SEQ ID NO: 1141383 - RNA, 23 nt, Human
gaauaguuuuagaaauuggagaa

SEQ ID NO: 1141384 - RNA, 22 nt, Human
ucaggcucugagcugaugcuaa

SEQ ID NO: 1141385 - RNA, 22 nt, Human
ggaggacaggggcugcagcaca

SEQ ID NO: 1141386 - RNA, 22 nt, Human
auccacagucuuagccaucaaa

SEQ ID NO: 1141387 - RNA, 22 nt, Human
uuuuggaaugaggaacauccag

SEQ ID NO: 1141388 - RNA, 22 nt, Human
augcugucgaaaccaaacaucu

SEQ ID NO: 1141389 - RNA, 22 nt, Human
uguacauacauagauauacaca

SEQ ID NO: 1141390 - RNA, 22 nt, Human
uucacaguggcugugccauuug

SEQ ID NO: 1141391 - RNA, 22 nt, Human
ggcacagagcuuugucccaguu

SEQ ID NO: 1141392 - RNA, 22 nt, Human
gggcugcaaugcuucaguuguu

SEQ ID NO: 1141393 - RNA, 22 nt, Human
gugagagggcugggcucaugau

SEQ ID NO: 1141394 - RNA, 22 nt, Human
uuaugcaaaggggccucuuccu

SEQ ID NO: 1141395 - RNA, 22 nt, Human
cucuccagccuuuagcccacgc

SEQ ID NO: 1141396 - RNA, 22 nt, Human
cagcuucuggcguggagccuga

SEQ ID NO: 1141397 - RNA, 22 nt, Human
aauuaugagguagauaucacau

SEQ ID NO: 1141398 - RNA, 22 nt, Human
agaucuuuagugaagcuaaauc

SEQ ID NO: 1141399 - RNA, 22 nt, Human
agccagggucucucgcucuguu

SEQ ID NO: 1141400 - RNA, 22 nt, Human
aggaccauccuaagguaggcaa

SEQ ID NO: 1141401 - RNA, 22 nt, Human
cuucuuaaucccuuauauauuu

SEQ ID NO: 1141402 - RNA, 17 nt, Human
uguuuucauucauugcu

SEQ ID NO: 1141403 - RNA, 22 nt, Human
guuucauucggcagcucauaag

SEQ ID NO: 1141404 - RNA, 22 nt, Human
gaggcacauauauacagagccc

SEQ ID NO: 1141405 - RNA, 21 nt, Human
uccuguaagcuuggguggcuc

SEQ ID NO: 1141406 - RNA, 22 nt, Human
gcacacaguauaugcucauuaa

SEQ ID NO: 1141407 - RNA, 22 nt, Human
ugacaggaggcuugaggccagg

SEQ ID NO: 1141408 - RNA, 22 nt, Human
aucagagaaguuucacuggcau

SEQ ID NO: 1141409 - RNA, 22 nt, Human
acaguguguucugggaccucca

SEQ ID NO: 1141410 - RNA, 22 nt, Human
ucacacacauggauaguauuuu

SEQ ID NO: 1141411 - RNA, 22 nt, Human
cuggcaguuggcauuggcaucu

SEQ ID NO: 1141412 - RNA, 22 nt, Human
ucaggagcuugguagugugauu

SEQ ID NO: 1141413 - RNA, 22 nt, Human
cuuaauuuuuguaguagaugga

SEQ ID NO: 1141414 - RNA, 22 nt, Human
gguuuccugcauugggaaauuu

SEQ ID NO: 1141415 - RNA, 22 nt, Human
ugccugccucuggcagcccugc

SEQ ID NO: 1141416 - RNA, 21 nt, Human
uagggcucucugugucaggug

SEQ ID NO: 1141417 - RNA, 22 nt, Human
ccagccuuacugcccuucagug

SEQ ID NO: 1141418 - RNA, 22 nt, Human
aggcugcuucagcugcagggag

SEQ ID NO: 1141419 - RNA, 22 nt, Human
auuuguuccacacauauuuacu

SEQ ID NO: 1141420 - RNA, 22 nt, Human
agagcaucuaacacauaagccu

SEQ ID NO: 1141421 - RNA, 22 nt, Human
ugucagagagcaggcaguagaa

SEQ ID NO: 1141422 - RNA, 20 nt, Human
uggaaguucuguugcauugg

SEQ ID NO: 1141423 - RNA, 22 nt, Human
gccaggcagccacccucugcga

SEQ ID NO: 1141424 - RNA, 22 nt, Human
ucacauacugaaaguccaguga

SEQ ID NO: 1141425 - RNA, 22 nt, Human
auacuguacgucccagauagga

SEQ ID NO: 1141426 - RNA, 22 nt, Human
aggcacaggaggugguaagaag

SEQ ID NO: 1141427 - RNA, 22 nt, Human
ugcagggauuagaggccgggga

SEQ ID NO: 1141428 - RNA, 22 nt, Human
uccaggcauguggccaguacuc

SEQ ID NO: 1141429 - RNA, 22 nt, Human
ccuggcugguggcagcgacaag

SEQ ID NO: 1141430 - RNA, 22 nt, Human
caguguuuaaucauugugaauu

SEQ ID NO: 1141431 - RNA, 22 nt, Human
gcuccaggagagggaagcagau

SEQ ID NO: 1141432 - RNA, 22 nt, Human
uaacacauagauauuuuaacuu

SEQ ID NO: 1141433 - RNA, 22 nt, Human
cagcucuuugaguauuccauuu

SEQ ID NO: 1141434 - RNA, 22 nt, Human
ugcuuuauaggggauugcaggc

SEQ ID NO: 1141435 - RNA, 22 nt, Human
agggaccugcucacugccuggc

SEQ ID NO: 1141436 - RNA, 19 nt, Human
agaaucaggucaggugaca

SEQ ID NO: 1141437 - RNA, 22 nt, Human
guagggacaauauguuauuaga

SEQ ID NO: 1141438 - RNA, 22 nt, Human
acccagccuacaaagcucaccu

SEQ ID NO: 1141439 - RNA, 22 nt, Human
gcauccaaaccauucaucagcc

SEQ ID NO: 1141440 - RNA, 23 nt, Human
uccaggagcaugcuggcuggcga

SEQ ID NO: 1141441 - RNA, 22 nt, Human
cauuuacacuucuaaccacaag

SEQ ID NO: 1141442 - RNA, 22 nt, Human
gcuugggaagggcccuguguac

SEQ ID NO: 1141443 - RNA, 22 nt, Human
ugugaaaagcaggcuacuuucu

SEQ ID NO: 1141444 - RNA, 22 nt, Human
ccuggggagaagagcuuccccc

SEQ ID NO: 1141445 - RNA, 22 nt, Human
acaaacugaauggguuuucugu

SEQ ID NO: 1141446 - RNA, 22 nt, Human
uccugcagacauuuacaccuuu

SEQ ID NO: 1141447 - RNA, 22 nt, Human
cucagagauauagucccugcuu

SEQ ID NO: 1141448 - RNA, 22 nt, Human
aauauguugagucuaucuuuau

SEQ ID NO: 1141449 - RNA, 22 nt, Human
ccagcuuuucagaaucugccug

SEQ ID NO: 1141450 - RNA, 22 nt, Human
aaagaauagccuuuguccaaau

SEQ ID NO: 1141451 - RNA, 17 nt, Human
gcuaggagagggaggag

SEQ ID NO: 1141452 - RNA, 22 nt, Human
cagguuggggacuuaggaugac

SEQ ID NO: 1141453 - RNA, 22 nt, Human
ucaaauauuggcuauuucacau

SEQ ID NO: 1141454 - RNA, 22 nt, Human
ugcaaaauaaugaacgauuuuu

SEQ ID NO: 1141455 - RNA, 22 nt, Human
caauaguucgguccugaaggcc

SEQ ID NO: 1141456 - RNA, 22 nt, Human
gacaggcuuccuaagugccaga

SEQ ID NO: 1141457 - RNA, 18 nt, Human
ucucugaauauuuuaugu

SEQ ID NO: 1141458 - RNA, 22 nt, Human
ugcuuuauggauuuguguccug

SEQ ID NO: 1141459 - RNA, 18 nt, Human
ucagcuuuugaaaaccaa

SEQ ID NO: 1141460 - RNA, 22 nt, Human
cagggccagcgcccaggcccag

SEQ ID NO: 1141461 - RNA, 22 nt, Human
ugcuucugaaaugcaggucuuc

SEQ ID NO: 1141462 - RNA, 22 nt, Human
aguugggaguuauagacucuau

SEQ ID NO: 1141463 - RNA, 22 nt, Human
aggacagugguguucuggagug

SEQ ID NO: 1141464 - RNA, 22 nt, Human
gaggagcuguucccucaccucu

SEQ ID NO: 1141465 - RNA, 22 nt, Human
auuauuaggacuacugggguug

SEQ ID NO: 1141466 - RNA, 22 nt, Human
cacaccagagguuaccugcaaa

SEQ ID NO: 1141467 - RNA, 22 nt, Human
aggaccugccaggugcaaagca

SEQ ID NO: 1141468 - RNA, 22 nt, Human
ugcuucuggguaggccucagga

SEQ ID NO: 1141469 - RNA, 23 nt, Human
acauacauggagauaaagugaug

SEQ ID NO: 1141470 - RNA, 22 nt, Human
cccaggccagaacuugguugcu

SEQ ID NO: 1141471 - RNA, 22 nt, Human
ccugggcucaggcuugggcagc

SEQ ID NO: 1141472 - RNA, 20 nt, Human
auacacauucauagaaaaau

SEQ ID NO: 1141473 - RNA, 22 nt, Human
acacacagaaggaagccccacu

SEQ ID NO: 1141474 - RNA, 22 nt, Human
gagccagguuugaaucucaguc

SEQ ID NO: 1141475 - RNA, 20 nt, Human
ugcagggcugccucccagcu

SEQ ID NO: 1141476 - RNA, 22 nt, Human
uuucucuugcgauaugcuacac

SEQ ID NO: 1141477 - RNA, 22 nt, Human
ucuggcaggauaucgaagugaa

SEQ ID NO: 1141478 - RNA, 22 nt, Human
cgaggcucagagagggugacuu

SEQ ID NO: 1141479 - RNA, 22 nt, Human
ucccacaggaaaguagacauug

SEQ ID NO: 1141480 - RNA, 22 nt, Human
uugauaaaaugauaucuucuuu

SEQ ID NO: 1141481 - RNA, 22 nt, Human
gugugagggacagagaaagggg

SEQ ID NO: 1141482 - RNA, 22 nt, Human
aaacacagauuucuuuguccca

SEQ ID NO: 1141483 - RNA, 22 nt, Human
ugucuuuaaaauuaaacacauc

SEQ ID NO: 1141484 - RNA, 22 nt, Human
uccugcaggccuguucccagua

SEQ ID NO: 1141485 - RNA, 22 nt, Human
accugccucagugcagcuggau

SEQ ID NO: 1141486 - RNA, 22 nt, Human
ccugggcuuugagggcaggaug

SEQ ID NO: 1141487 - RNA, 22 nt, Human
uuccacauuccuuacauucaua

SEQ ID NO: 1141488 - RNA, 22 nt, Human
aucagagaccggucaagucaug

SEQ ID NO: 1141489 - RNA, 22 nt, Human
aagggcucccugccugaggugg

SEQ ID NO: 1141490 - RNA, 22 nt, Human
uagggcucagagaaguggggcc

SEQ ID NO: 1141491 - RNA, 17 nt, Human
gcuucuggagcuucugu

SEQ ID NO: 1141492 - RNA, 22 nt, Human
gcagggaccuugcccacccucc

SEQ ID NO: 1141493 - RNA, 22 nt, Human
uucuuuuacauuaagauuucag

SEQ ID NO: 1141494 - RNA, 22 nt, Human
ucuggggagggagccacagguc

SEQ ID NO: 1141495 - RNA, 22 nt, Human
gaauuugaaaagugaugggaau

SEQ ID NO: 1141496 - RNA, 22 nt, Human
ggaggacacuggcucugccuuc

SEQ ID NO: 1141497 - RNA, 22 nt, Human
ucccugccugacagcacccacc

SEQ ID NO: 1141498 - RNA, 22 nt, Human
uauuagguaaaggacuugcagg

SEQ ID NO: 1141499 - RNA, 22 nt, Human
auguauuucuauguagugaaga

SEQ ID NO: 1141500 - RNA, 22 nt, Human
ggccucagaccggagcuggcca

SEQ ID NO: 1141501 - RNA, 22 nt, Human
cacccagggcugugccugccca

SEQ ID NO: 1141502 - RNA, 22 nt, Human
caagcuuguuucuccugggggu

SEQ ID NO: 1141503 - RNA, 22 nt, Human
ccugcagaaaggguccccagga

SEQ ID NO: 1141504 - RNA, 22 nt, Human
uagcuuuaauaagcugcugaau

SEQ ID NO: 1141505 - RNA, 22 nt, Human
ccagcuuuauagcuucaaagga

SEQ ID NO: 1141506 - RNA, 22 nt, Human
gcacccagaggucagcagugcu

SEQ ID NO: 1141507 - RNA, 22 nt, Human
gagaaagauguaggcugggagg

SEQ ID NO: 1141508 - RNA, 22 nt, Human
gagcucagacucgggccugggg

SEQ ID NO: 1141509 - RNA, 22 nt, Human
uuuguacauauauaaaaucugu

SEQ ID NO: 1141510 - RNA, 22 nt, Human
cuucccacuaguaucacagagc

SEQ ID NO: 1141511 - RNA, 22 nt, Human
uagcuuuaaaaaucaucaaagc

SEQ ID NO: 1141512 - RNA, 22 nt, Human
gagcuuuacuucugacuggugc

SEQ ID NO: 1141513 - RNA, 22 nt, Human
uuuaugagcaaugcugagggga

SEQ ID NO: 1141514 - RNA, 22 nt, Human
guaaacaucgacccaacagggg

SEQ ID NO: 1141515 - RNA, 22 nt, Human
ggcaagagggcagauggagugc

SEQ ID NO: 1141516 - RNA, 22 nt, Human
gauggccuuguuuucucccuuc

SEQ ID NO: 1141517 - RNA, 22 nt, Human
acuggaaaugagaugauaucag

SEQ ID NO: 1141518 - RNA, 22 nt, Human
aggccuuaccauagcuguagca

SEQ ID NO: 1141519 - RNA, 22 nt, Human
acuggcagcuguaggaugcaug

SEQ ID NO: 1141520 - RNA, 22 nt, Human
cuuuauuagauguagacuuucu

SEQ ID NO: 1141521 - RNA, 22 nt, Human
gccaaaucuugcacacucuugu

SEQ ID NO: 1141522 - RNA, 22 nt, Human
ugcagagagaccccugggccag

SEQ ID NO: 1141523 - RNA, 22 nt, Human
aaagacuuggcuuaugauuugc

SEQ ID NO: 1141524 - RNA, 22 nt, Human
agcucccaauugacuugaacua

SEQ ID NO: 1141525 - RNA, 22 nt, Human
aauuagggaaaacauuugcuuu

SEQ ID NO: 1141526 - RNA, 17 nt, Human
uugggagagaaagguau

SEQ ID NO: 1141527 - RNA, 22 nt, Human
ucagcuuuggucacauugaguu

SEQ ID NO: 1141528 - RNA, 22 nt, Human
auguagaagcugacagugcugu

SEQ ID NO: 1141529 - RNA, 22 nt, Human
gcuucuggagucuucagaggaa

SEQ ID NO: 1141530 - RNA, 22 nt, Human
ucauuugugugagugauuugac

SEQ ID NO: 1141531 - RNA, 22 nt, Human
gggcugacaaucucuuuacuua

SEQ ID NO: 1141532 - RNA, 22 nt, Human
ucauuuugggguuugucaucuu

SEQ ID NO: 1141533 - RNA, 22 nt, Human
uccuggcagggucuaggucuag

SEQ ID NO: 1141534 - RNA, 22 nt, Human
aaggcuuuuguuccuauuuagu

SEQ ID NO: 1141535 - RNA, 22 nt, Human
gggacccagguaauccugugcu

SEQ ID NO: 1141536 - RNA, 22 nt, Human
acugggcucaagugauuguccu

SEQ ID NO: 1141537 - RNA, 22 nt, Human
gcccaagcuggacugcaguggc

SEQ ID NO: 1141538 - RNA, 22 nt, Human
ugucaaagccugaaucacauag

SEQ ID NO: 1141539 - RNA, 22 nt, Human
cagcuuugcaggcuggucagug

SEQ ID NO: 1141540 - RNA, 22 nt, Human
uccaagaugguugguguggugg

SEQ ID NO: 1141541 - RNA, 22 nt, Human
cagagaaagaagcccauucauu

SEQ ID NO: 1141542 - RNA, 22 nt, Human
aggcaccuugagagcaggagcu

SEQ ID NO: 1141543 - RNA, 22 nt, Human
ucuggcagcaagucuguuucuc

SEQ ID NO: 1141544 - RNA, 22 nt, Human
uaccugcagcgggaauccauua

SEQ ID NO: 1141545 - RNA, 22 nt, Human
uccugagcuacaguaguaugau

SEQ ID NO: 1141546 - RNA, 22 nt, Human
ucuaggagaaccaucagggagg

SEQ ID NO: 1141547 - RNA, 22 nt, Human
gacacauagaucuaucucacuc

SEQ ID NO: 1141548 - RNA, 22 nt, Human
gggcugacaccacccaggcgca

SEQ ID NO: 1141549 - RNA, 22 nt, Human
uagggcucuggugggcucuguu

SEQ ID NO: 1141550 - RNA, 22 nt, Human
uccaggcaaaaaccaacuacag

SEQ ID NO: 1141551 - RNA, 22 nt, Human
agcuuuauauuuaaugaauucu

SEQ ID NO: 1141552 - RNA, 22 nt, Human
uccugcagccauuagaggucaa

SEQ ID NO: 1141553 - RNA, 22 nt, Human
cugagccagggccacacaugga

SEQ ID NO: 1141554 - RNA, 22 nt, Human
uccagaccuagggcaccccagu

SEQ ID NO: 1141555 - RNA, 22 nt, Human
ggagacucggguucuagccuug

SEQ ID NO: 1141556 - RNA, 22 nt, Human
aguuagaauauaauuauguuaa

SEQ ID NO: 1141557 - RNA, 22 nt, Human
ugcuucugggcaaaugugugug

SEQ ID NO: 1141558 - RNA, 22 nt, Human
cccacacacuggcugcugccaa

SEQ ID NO: 1141559 - RNA, 22 nt, Human
agagugaaguucaucgugcagc

SEQ ID NO: 1141560 - RNA, 22 nt, Human
aaaguaguuagucaugugaaaa

SEQ ID NO: 1141561 - RNA, 22 nt, Human
ucagcuuucucagaggccuaac

SEQ ID NO: 1141562 - RNA, 22 nt, Human
uggaacacuuuguugaaaugca

SEQ ID NO: 1141563 - RNA, 22 nt, Human
cuauuagguuggugcaaaagua

SEQ ID NO: 1141564 - RNA, 19 nt, Human
uggcagguagugagcaguc

SEQ ID NO: 1141565 - RNA, 22 nt, Human
ggccucagugggccgcugcagg

SEQ ID NO: 1141566 - RNA, 22 nt, Human
gucacacagggccuccaaauca

SEQ ID NO: 1141567 - RNA, 22 nt, Human
cagaggcagacccuccagggcg

SEQ ID NO: 1141568 - RNA, 22 nt, Human
uaugaaaugguaguaggaaggg

SEQ ID NO: 1141569 - RNA, 22 nt, Human
gaacaucagucauaauuuaacg

SEQ ID NO: 1141570 - RNA, 22 nt, Human
agcaguccaacugagguggcau

SEQ ID NO: 1141571 - RNA, 22 nt, Human
uucacauuugaaaggaaagaua

SEQ ID NO: 1141572 - RNA, 22 nt, Human
uggcagggccuaccccaauauc

SEQ ID NO: 1141573 - RNA, 22 nt, Human
aaagcagguugcaauuacagug

SEQ ID NO: 1141574 - RNA, 22 nt, Human
caguguggugugcacagcuuag

SEQ ID NO: 1141575 - RNA, 20 nt, Human
uaacuuucuaugcuuucagc

SEQ ID NO: 1141576 - RNA, 22 nt, Human
cucagagagggcaccagggcca

SEQ ID NO: 1141577 - RNA, 19 nt, Human
uggaccugugcccauggcu

SEQ ID NO: 1141578 - RNA, 22 nt, Human
agagggcaugcuugguggccug

SEQ ID NO: 1141579 - RNA, 22 nt, Human
aaagaucacgucccaggacucg

SEQ ID NO: 1141580 - RNA, 22 nt, Human
acagagagcugugauugaguua

SEQ ID NO: 1141581 - RNA, 20 nt, Human
ucccaggcugggcuccagcu

SEQ ID NO: 1141582 - RNA, 22 nt, Human
gcuggcaggagccuuucccuuu

SEQ ID NO: 1141583 - RNA, 22 nt, Human
uucuaucauacuugaauacauu

SEQ ID NO: 1141584 - RNA, 22 nt, Human
cuggcaguauuaagagaaguga

SEQ ID NO: 1141585 - RNA, 22 nt, Human
cuucauuaaugucuauaaguuu

SEQ ID NO: 1141586 - RNA, 22 nt, Human
auccugucaucauaguacuuga

SEQ ID NO: 1141587 - RNA, 22 nt, Human
caaagucagccagcuaguaggu

SEQ ID NO: 1141588 - RNA, 22 nt, Human
gacacagagggcaccagauaug

SEQ ID NO: 1141589 - RNA, 22 nt, Human
uacaauauguggccuuuuguga

SEQ ID NO: 1141590 - RNA, 22 nt, Human
ccucucccgggugccgcugggc

SEQ ID NO: 1141591 - RNA, 22 nt, Human
cucuuaaauaacaucauugcuu

SEQ ID NO: 1141592 - RNA, 22 nt, Human
ugcagugguugagagcccagac

SEQ ID NO: 1141593 - RNA, 22 nt, Human
ucacacauuucucaaguguagg

SEQ ID NO: 1141594 - RNA, 23 nt, Human
gaggcagcuccugcagugcccug

SEQ ID NO: 1141595 - RNA, 22 nt, Human
ugauucacagacuucacaaggc

SEQ ID NO: 1141596 - RNA, 22 nt, Human
ucagagaguccuggucauuugc

SEQ ID NO: 1141597 - RNA, 22 nt, Human
caaugauugcuauuuacauaaa

SEQ ID NO: 1141598 - RNA, 22 nt, Human
uggggaccagauuagaccaugg

SEQ ID NO: 1141599 - RNA, 23 nt, Human
uccaggcacgcauuucuucuagc

SEQ ID NO: 1141600 - RNA, 22 nt, Human
cagccucuguggcugccacacc

SEQ ID NO: 1141601 - RNA, 22 nt, Human
aaauuucaguuggaaugagcuc

SEQ ID NO: 1141602 - RNA, 22 nt, Human
acacauuugcauaauaccucau

SEQ ID NO: 1141603 - RNA, 19 nt, Human
cuccaagugccaaggacag

SEQ ID NO: 1141604 - RNA, 23 nt, Human
uccugcagauaagcugguugaca

SEQ ID NO: 1141605 - RNA, 22 nt, Human
augauugaaaaugacauugcca

SEQ ID NO: 1141606 - RNA, 22 nt, Human
acaugacuuuucucuuccagag

SEQ ID NO: 1141607 - RNA, 22 nt, Human
gauggccuggguccccuuccgg

SEQ ID NO: 1141608 - RNA, 22 nt, Human
ccugcagaggucaggccagaaa

SEQ ID NO: 1141609 - RNA, 22 nt, Human
guauuagguuggugcaaaauug

SEQ ID NO: 1141610 - RNA, 22 nt, Human
ugcuucugucucuuaugccuug

SEQ ID NO: 1141611 - RNA, 22 nt, Human
aaucuucauuuugacaagauuc

SEQ ID NO: 1141612 - RNA, 22 nt, Human
uauauauucuuaaguaguguag

SEQ ID NO: 1141613 - RNA, 22 nt, Human
ucuaggaguaaugagcuagcac

SEQ ID NO: 1141614 - RNA, 22 nt, Human
gcacccagccagcaucucagag

SEQ ID NO: 1141615 - RNA, 22 nt, Human
gaaacugaguaggcuagagcac

SEQ ID NO: 1141616 - RNA, 22 nt, Human
ugcaggcugcucaagacuuagu

SEQ ID NO: 1141617 - RNA, 22 nt, Human
augcuucagugcuaccuucaaa

SEQ ID NO: 1141618 - RNA, 22 nt, Human
ugguuccucaagcgcuggcggc

SEQ ID NO: 1141619 - RNA, 22 nt, Human
uccaggcagagcaacaaaauau

SEQ ID NO: 1141620 - RNA, 22 nt, Human
ccaaguacucucaccaaagcuu

SEQ ID NO: 1141621 - RNA, 21 nt, Human
ucuggcaguggucuuucaaau

SEQ ID NO: 1141622 - RNA, 22 nt, Human
uuucauaauauccagagauuuu

SEQ ID NO: 1141623 - RNA, 23 nt, Human
ccagcccuccaccagcucuaggc

SEQ ID NO: 1141624 - RNA, 20 nt, Human
ucaggcuccgcauuaacuua

SEQ ID NO: 1141625 - RNA, 22 nt, Human
uuuaauuuuccugguaggccug

SEQ ID NO: 1141626 - RNA, 22 nt, Human
guaugaaguuggacuguauaaa

SEQ ID NO: 1141627 - RNA, 22 nt, Human
cagugaggcucugcugagcggu

SEQ ID NO: 1141628 - RNA, 22 nt, Human
gaggagcugggacccugucauc

SEQ ID NO: 1141629 - RNA, 22 nt, Human
gaggugagaagggggucagaug

SEQ ID NO: 1141630 - RNA, 18 nt, Human
auccuugaugagaggucu

SEQ ID NO: 1141631 - RNA, 22 nt, Human
cuagggacagaaagaggguaga

SEQ ID NO: 1141632 - RNA, 22 nt, Human
gggcugacauauuuggugcucu

SEQ ID NO: 1141633 - RNA, 22 nt, Human
ucccacaugugaauccucaggu

SEQ ID NO: 1141634 - RNA, 22 nt, Human
aggaggcugcaacccugaggcc

SEQ ID NO: 1141635 - RNA, 22 nt, Human
acagauauuuggggaaagacgu

SEQ ID NO: 1141636 - RNA, 22 nt, Human
gcuucuggaagcugcuucugcc

SEQ ID NO: 1141637 - RNA, 22 nt, Human
uaaaauagcaugugcagugaaa

SEQ ID NO: 1141638 - RNA, 22 nt, Human
uccugcaggccagaggggugag

SEQ ID NO: 1141639 - RNA, 22 nt, Human
acacacaugcaugcuugccauu

SEQ ID NO: 1141640 - RNA, 22 nt, Human
aggugaguuacaggaggagguc

SEQ ID NO: 1141641 - RNA, 20 nt, Human
gcaggcuccgggcuugggag

SEQ ID NO: 1141642 - RNA, 22 nt, Human
cagcuuuccagagaccugcccc

SEQ ID NO: 1141643 - RNA, 22 nt, Human
aauuugcaugaugagaacaaua

SEQ ID NO: 1141644 - RNA, 22 nt, Human
gccaaaguaccuagcccucugc

SEQ ID NO: 1141645 - RNA, 22 nt, Human
gccaggcaggccacgcuguguu

SEQ ID NO: 1141646 - RNA, 22 nt, Human
aauugucaaacacaaauaagag

SEQ ID NO: 1141647 - RNA, 22 nt, Human
ggagaagaggagcuggaagccu

SEQ ID NO: 1141648 - RNA, 23 nt, Human
aaacuacauuuauaguuuuucuc

SEQ ID NO: 1141649 - RNA, 19 nt, Human
ccagcccacagugacuuuc

SEQ ID NO: 1141650 - RNA, 22 nt, Human
uacugacacaaagccaaucccu

SEQ ID NO: 1141651 - RNA, 22 nt, Human
auacaugacucacacauucugc

SEQ ID NO: 1141652 - RNA, 22 nt, Human
uuuaccaguguuaaacaccagc

SEQ ID NO: 1141653 - RNA, 22 nt, Human
ggacuccucuagaaguugaggc

SEQ ID NO: 1141654 - RNA, 22 nt, Human
ucaggcccuucucccaggacuc

SEQ ID NO: 1141655 - RNA, 20 nt, Human
ucagauuuuucuaacuuuga

SEQ ID NO: 1141656 - RNA, 22 nt, Human
cucugaaagaguuuaguauuau

SEQ ID NO: 1141657 - RNA, 22 nt, Human
gccuggcacaggaauuaggagg

SEQ ID NO: 1141658 - RNA, 22 nt, Human
uaggaaauggcucaguuacugc

SEQ ID NO: 1141659 - RNA, 22 nt, Human
cuguaugaaauuaaguaaacag

SEQ ID NO: 1141660 - RNA, 22 nt, Human
cuggcacgcccacguaggcacu

SEQ ID NO: 1141661 - RNA, 22 nt, Human
cauuuauuggcauguaguaggu

SEQ ID NO: 1141662 - RNA, 22 nt, Human
cauuuauucucagauccuuguc

SEQ ID NO: 1141663 - RNA, 22 nt, Human
ucuucaaagaauuuuaguaauu

SEQ ID NO: 1141664 - RNA, 18 nt, Human
uccugcagcuucuaugua

SEQ ID NO: 1141665 - RNA, 22 nt, Human
agaggcuuggccucaguucugu

SEQ ID NO: 1141666 - RNA, 22 nt, Human
aaauauguaagauuagcacuag

SEQ ID NO: 1141667 - RNA, 22 nt, Human
aaagaucaauagauaaagcuac

SEQ ID NO: 1141668 - RNA, 21 nt, Human
ucuggcagcaguuuguugagu

SEQ ID NO: 1141669 - RNA, 22 nt, Human
aagagcaucuauuucacagugg

SEQ ID NO: 1141670 - RNA, 22 nt, Human
gcucacagccggcuggcagggg

SEQ ID NO: 1141671 - RNA, 22 nt, Human
guuaugaaauaaauauagauca

SEQ ID NO: 1141672 - RNA, 22 nt, Human
ccagcuuuccugcgaguugauu

SEQ ID NO: 1141673 - RNA, 22 nt, Human
aaacaucaccauuuuaccuaau

SEQ ID NO: 1141674 - RNA, 22 nt, Human
uccaugagggacacuggaugcu

SEQ ID NO: 1141675 - RNA, 22 nt, Human
aaauauuugucugaggcgguug

SEQ ID NO: 1141676 - RNA, 22 nt, Human
gguuucaaugagaagugcuugu

SEQ ID NO: 1141677 - RNA, 22 nt, Human
ugguaagaacccaucagagaag

SEQ ID NO: 1141678 - RNA, 22 nt, Human
cagggcucaggaaaucagacgu

SEQ ID NO: 1141679 - RNA, 22 nt, Human
cacagagacagaagcacuuaug

SEQ ID NO: 1141680 - RNA, 22 nt, Human
uccacccugcuuuugucuuuga

SEQ ID NO: 1141681 - RNA, 23 nt, Human
aaacaugcagcacaugaaugcua

SEQ ID NO: 1141682 - RNA, 22 nt, Human
cccugcagagaccacugaccuu

SEQ ID NO: 1141683 - RNA, 22 nt, Human
ucagcuuugaucucaggcaauc

SEQ ID NO: 1141684 - RNA, 22 nt, Human
guuagguagaaguuuacuuuga

SEQ ID NO: 1141685 - RNA, 22 nt, Human
uuugauaagagcugcugaaacu

SEQ ID NO: 1141686 - RNA, 22 nt, Human
gcagggaccagggccagaucca

SEQ ID NO: 1141687 - RNA, 18 nt, Human
acaaaugugucacaggaa

SEQ ID NO: 1141688 - RNA, 22 nt, Human
cugcagccacgagucacagccc

SEQ ID NO: 1141689 - RNA, 22 nt, Human
cauguuuuguguacagaauauu

SEQ ID NO: 1141690 - RNA, 22 nt, Human
agggcugaagggaggugcucau

SEQ ID NO: 1141691 - RNA, 22 nt, Human
cacccacauggaaauucacagu

SEQ ID NO: 1141692 - RNA, 22 nt, Human
ugcagagaaaacuccuggguac

SEQ ID NO: 1141693 - RNA, 22 nt, Human
gaggcuguuaggagggacucug

SEQ ID NO: 1141694 - RNA, 20 nt, Human
uguucugucgucuuucuuca

SEQ ID NO: 1141695 - RNA, 18 nt, Human
cucagagaugcccuuauu

SEQ ID NO: 1141696 - RNA, 22 nt, Human
uaaaucuccuguuuuucaucua

SEQ ID NO: 1141697 - RNA, 22 nt, Human
auuucucaguuccuacuguuua

SEQ ID NO: 1141698 - RNA, 22 nt, Human
cgugagcaaaauggacacuccc

SEQ ID NO: 1141699 - RNA, 22 nt, Human
guacccaggcacgccuugcuga

SEQ ID NO: 1141700 - RNA, 22 nt, Human
ucauaaaucauacuccauuugc

SEQ ID NO: 1141701 - RNA, 22 nt, Human
aauuagggagccaucauaaggu

SEQ ID NO: 1141702 - RNA, 22 nt, Human
uuggaaaguuuuuacugaagac

SEQ ID NO: 1141703 - RNA, 22 nt, Human
cguaugaaauuuuugacauuug

SEQ ID NO: 1141704 - RNA, 22 nt, Human
uuuauucugugcuacaugaaga

SEQ ID NO: 1141705 - RNA, 22 nt, Human
ccucugugucuugguuucaaga

SEQ ID NO: 1141706 - RNA, 22 nt, Human
cgcaggcuccggggugcccugg

SEQ ID NO: 1141707 - RNA, 22 nt, Human
cagagcaucgcgcagagagccu

SEQ ID NO: 1141708 - RNA, 22 nt, Human
ccuggcagguggcgcccucggc

SEQ ID NO: 1141709 - RNA, 22 nt, Human
gucugucauacggcuuauguaa

SEQ ID NO: 1141710 - RNA, 19 nt, Human
aggcugugagggaggacuc

SEQ ID NO: 1141711 - RNA, 22 nt, Human
cccagcuugcaaauggguugcu

SEQ ID NO: 1141712 - RNA, 22 nt, Human
caguuuauuuccaagaugacaa

SEQ ID NO: 1141713 - RNA, 22 nt, Human
uauucccauuccacuuaucaag

SEQ ID NO: 1141714 - RNA, 22 nt, Human
ugugaagauuuggcaugcagaa

SEQ ID NO: 1141715 - RNA, 20 nt, Human
gcauccagacacccagcugc

SEQ ID NO: 1141716 - RNA, 22 nt, Human
ccaggcucugagccucacucuu

SEQ ID NO: 1141717 - RNA, 22 nt, Human
aacuuaaacccacucauguaga

SEQ ID NO: 1141718 - RNA, 22 nt, Human
ccugggcucugucagaauuggg

SEQ ID NO: 1141719 - RNA, 22 nt, Human
gagacacacauucuggagagaa

SEQ ID NO: 1141720 - RNA, 22 nt, Human
uuugacaaaggaaaaaugcaca

SEQ ID NO: 1141721 - RNA, 22 nt, Human
ugcuucugaacucagcaugugg

SEQ ID NO: 1141722 - RNA, 22 nt, Human
cagcuuuagagaaaacauauuu

SEQ ID NO: 1141723 - RNA, 22 nt, Human
uauauguaaauaagucuaaugu

SEQ ID NO: 1141724 - RNA, 22 nt, Human
uacauucagaagaauggacacg

SEQ ID NO: 1141725 - RNA, 22 nt, Human
ccacaggcugcugcaggucccg

SEQ ID NO: 1141726 - RNA, 22 nt, Human
uuuuucauugcagccucucucc

SEQ ID NO: 1141727 - RNA, 22 nt, Human
aggacaguccgggguccuccac

SEQ ID NO: 1141728 - RNA, 22 nt, Human
gcaguguuguuaaaagauuaga

SEQ ID NO: 1141729 - RNA, 22 nt, Human
ccagacccugcucuggggcucu

SEQ ID NO: 1141730 - RNA, 22 nt, Human
gccaagcuuggaaggaucaugg

SEQ ID NO: 1141731 - RNA, 22 nt, Human
uauguaaaguagauggcaggua

SEQ ID NO: 1141732 - RNA, 22 nt, Human
ggggaccuuuccauuucugaga

SEQ ID NO: 1141733 - RNA, 22 nt, Human
ccccacccucgcuccauuucgg

SEQ ID NO: 1141734 - RNA, 22 nt, Human
aguaugaacggaaggccuggga

SEQ ID NO: 1141735 - RNA, 22 nt, Human
acaucugaggagaccagccucu

SEQ ID NO: 1141736 - RNA, 22 nt, Human
acccaggcugcuucucaguggc

SEQ ID NO: 1141737 - RNA, 22 nt, Human
ugugugaaggaauauauacuca

SEQ ID NO: 1141738 - RNA, 22 nt, Human
uuccuggcgccacggagccggu

SEQ ID NO: 1141739 - RNA, 23 nt, Human
uuccaggcagagcagggauuaga

SEQ ID NO: 1141740 - RNA, 21 nt, Human
guuuucaugauagagucugua

SEQ ID NO: 1141741 - RNA, 22 nt, Human
uccuggcagagggcggccucga

SEQ ID NO: 1141742 - RNA, 22 nt, Human
augaaaaguucgaucuagaagg

SEQ ID NO: 1141743 - RNA, 22 nt, Human
cucaucaccacauauaacaaag

SEQ ID NO: 1141744 - RNA, 22 nt, Human
aaggaccuauauugucagagga

SEQ ID NO: 1141745 - RNA, 22 nt, Human
cugggcugcuguccacuagggu

SEQ ID NO: 1141746 - RNA, 21 nt, Human
acagugugcuucucucccucc

SEQ ID NO: 1141747 - RNA, 20 nt, Human
gauuacaaaaugaaaugcau

SEQ ID NO: 1141748 - RNA, 22 nt, Human
uucauacacgaaaaugcaugca

SEQ ID NO: 1141749 - RNA, 22 nt, Human
uuucauugucuacauaugacau

SEQ ID NO: 1141750 - RNA, 22 nt, Human
aguaugaauggaaacuaccuau

SEQ ID NO: 1141751 - RNA, 22 nt, Human
uggcaugggcaaaccagggaaa

SEQ ID NO: 1141752 - RNA, 22 nt, Human
uuucagauggagguuuaggaca

SEQ ID NO: 1141753 - RNA, 22 nt, Human
auccaggccccaagaccccgac

SEQ ID NO: 1141754 - RNA, 22 nt, Human
aucugcuuccugggcuccauga

SEQ ID NO: 1141755 - RNA, 21 nt, Human
ucuggggaagacaucuaggau

SEQ ID NO: 1141756 - RNA, 22 nt, Human
cagaagagaugaaauaguauua

SEQ ID NO: 1141757 - RNA, 22 nt, Human
augcuuuuccaggagaaauaua

SEQ ID NO: 1141758 - RNA, 22 nt, Human
aguucacauaucuguuuuauuu

SEQ ID NO: 1141759 - RNA, 22 nt, Human
caggcuccuucccagggauggu

SEQ ID NO: 1141760 - RNA, 22 nt, Human
acucacuuuccauucaagcacc

SEQ ID NO: 1141761 - RNA, 22 nt, Human
cagaaagaccugggcucaagag

SEQ ID NO: 1141762 - RNA, 22 nt, Human
cauguuaauaugcauugaguac

SEQ ID NO: 1141763 - RNA, 22 nt, Human
aguguugggucuuuagaauuua

SEQ ID NO: 1141764 - RNA, 22 nt, Human
uuccaaguugagcgauuuuccu

SEQ ID NO: 1141765 - RNA, 22 nt, Human
agggaagaagcugguaguaggu

SEQ ID NO: 1141766 - RNA, 21 nt, Human
ugcaggcuacuucugacucua

SEQ ID NO: 1141767 - RNA, 22 nt, Human
acugccaaugguaguuugaugg

SEQ ID NO: 1141768 - RNA, 22 nt, Human
cauaauauacuacauugaugaa

SEQ ID NO: 1141769 - RNA, 22 nt, Human
cagagggcucggcggccgcucc

SEQ ID NO: 1141770 - RNA, 22 nt, Human
agacaggcuuugcuguauauca

SEQ ID NO: 1141771 - RNA, 22 nt, Human
agcaggcuccaggcuggccauc

SEQ ID NO: 1141772 - RNA, 22 nt, Human
auuuucaucgcuagguuggccu

SEQ ID NO: 1141773 - RNA, 22 nt, Human
ggcuuuauguuuuucauguggu

SEQ ID NO: 1141774 - RNA, 22 nt, Human
ugcaggcuggauuugcuuuugu

SEQ ID NO: 1141775 - RNA, 22 nt, Human
aauaacuucaguucuuacauua

SEQ ID NO: 1141776 - RNA, 22 nt, Human
ccuggcaggcaagaggaaggga

SEQ ID NO: 1141777 - RNA, 22 nt, Human
ugaaugauacagaauuauguag

SEQ ID NO: 1141778 - RNA, 22 nt, Human
cugcaggggcuggaguuggcuu

SEQ ID NO: 1141779 - RNA, 22 nt, Human
acacacuguugcucauccaggc

SEQ ID NO: 1141780 - RNA, 22 nt, Human
cugcaggagcaaagccucugcu

SEQ ID NO: 1141781 - RNA, 22 nt, Human
cuguuuaucucuaaccuguuua

SEQ ID NO: 1141782 - RNA, 22 nt, Human
uaauuucuagggacuaaggugc

SEQ ID NO: 1141783 - RNA, 22 nt, Human
cagcccucaucucagcuucuuu

SEQ ID NO: 1141784 - RNA, 18 nt, Human
ggccucuggacuggcagc

SEQ ID NO: 1141785 - RNA, 22 nt, Human
aauaucuucuaaggauagaacu

SEQ ID NO: 1141786 - RNA, 22 nt, Human
gcugggcuggaaggccaaggca

SEQ ID NO: 1141787 - RNA, 22 nt, Human
acauauuuugaaagcuuucuaa

SEQ ID NO: 1141788 - RNA, 22 nt, Human
acagcuuuucugauagauccug

SEQ ID NO: 1141789 - RNA, 22 nt, Human
ccagcuuuagguugccugccag

SEQ ID NO: 1141790 - RNA, 22 nt, Human
ugcuuuauaaccauuucugugg

SEQ ID NO: 1141791 - RNA, 20 nt, Human
uggaccugucucuuuaggga

SEQ ID NO: 1141792 - RNA, 22 nt, Human
gagcucagccugaggccuggcu

SEQ ID NO: 1141793 - RNA, 18 nt, Human
ccuagccuccaagcucau

SEQ ID NO: 1141794 - RNA, 22 nt, Human
uucuuaaaacuuauggacaggu

SEQ ID NO: 1141795 - RNA, 22 nt, Human
ucccagccuuccagucugguuu

SEQ ID NO: 1141796 - RNA, 22 nt, Human
ugcagggccuucuagaccaugg

SEQ ID NO: 1141797 - RNA, 22 nt, Human
cuagguauucauguuucguggc

SEQ ID NO: 1141798 - RNA, 20 nt, Human
auacacauauucuugcaacu

SEQ ID NO: 1141799 - RNA, 22 nt, Human
auuagggaaacugacuugucuc

SEQ ID NO: 1141800 - RNA, 22 nt, Human
ccuggcaggacuguuguaagaa

SEQ ID NO: 1141801 - RNA, 20 nt, Human
ggccucaguguccuuguuug

SEQ ID NO: 1141802 - RNA, 22 nt, Human
gcuggcaggguucucacugaaa

SEQ ID NO: 1141803 - RNA, 22 nt, Human
uauuacagaaucaggcauaacu

SEQ ID NO: 1141804 - RNA, 22 nt, Human
ccagagaggccaaggucguggu

SEQ ID NO: 1141805 - RNA, 22 nt, Human
auguuauggcucaaacauuugg

SEQ ID NO: 1141806 - RNA, 22 nt, Human
ccugggcucgcgcacuucaccc

SEQ ID NO: 1141807 - RNA, 22 nt, Human
uuuaucuuuaggacuuugcaga

SEQ ID NO: 1141808 - RNA, 22 nt, Human
cagggccagagagggcuggcug

SEQ ID NO: 1141809 - RNA, 22 nt, Human
cugcuuuagacaacugcuggga

SEQ ID NO: 1141810 - RNA, 22 nt, Human
agauaugugcgucuuagauuga

SEQ ID NO: 1141811 - RNA, 22 nt, Human
gggagcuguaagggacagguag

SEQ ID NO: 1141812 - RNA, 22 nt, Human
ugcuuuauuuuaaauaugccau

SEQ ID NO: 1141813 - RNA, 22 nt, Human
uucucuuaucuggcauuauugg

SEQ ID NO: 1141814 - RNA, 22 nt, Human
aauuaugauuggucuaaaccag

SEQ ID NO: 1141815 - RNA, 22 nt, Human
uugggaagaauggaggugguua

SEQ ID NO: 1141816 - RNA, 22 nt, Human
guuacucuuccccggggucugg

SEQ ID NO: 1141817 - RNA, 22 nt, Human
ccagcccuuagauaaaccuggc

SEQ ID NO: 1141818 - RNA, 22 nt, Human
ucuggcagcucaguucaggucu

SEQ ID NO: 1141819 - RNA, 22 nt, Human
uuaggaaaaucaugagagauga

SEQ ID NO: 1141820 - RNA, 22 nt, Human
augaagcugaaaaaggcauaua

SEQ ID NO: 1141821 - RNA, 22 nt, Human
aaauaguucagccacggugacu

SEQ ID NO: 1141822 - RNA, 22 nt, Human
acaggcagguccugucccagcu

SEQ ID NO: 1141823 - RNA, 16 nt, Human
cagcuuuaugucagug

SEQ ID NO: 1141824 - RNA, 22 nt, Human
auuccacagcuacaucaaucua

SEQ ID NO: 1141825 - RNA, 22 nt, Human
agcuugauuucucugcagugug

SEQ ID NO: 1141826 - RNA, 22 nt, Human
cauaugaaauaugaguugaaca

SEQ ID NO: 1141827 - RNA, 22 nt, Human
agucucuuuaaucacagugucu

SEQ ID NO: 1141828 - RNA, 22 nt, Human
uggggacccggacuccuggguc

SEQ ID NO: 1141829 - RNA, 22 nt, Human
aagggcuccauccuuauaaaug

SEQ ID NO: 1141830 - RNA, 18 nt, Human
cuccuggcugauggugag

SEQ ID NO: 1141831 - RNA, 20 nt, Human
gauacacagcacagagggcc

SEQ ID NO: 1141832 - RNA, 22 nt, Human
uggaacacuggcuuuccacugu

SEQ ID NO: 1141833 - RNA, 22 nt, Human
augacugcucugggcucccaug

SEQ ID NO: 1141834 - RNA, 22 nt, Human
ggcuuucuaugaacucaaaggc

SEQ ID NO: 1141835 - RNA, 22 nt, Human
uauggaaagcucuuuuugauug

SEQ ID NO: 1141836 - RNA, 22 nt, Human
cuggccuggggggacacauccc

SEQ ID NO: 1141837 - RNA, 22 nt, Human
ccuggcagcauugguagagauu

SEQ ID NO: 1141838 - RNA, 22 nt, Human
gcagggaccucacuacccccag

SEQ ID NO: 1141839 - RNA, 22 nt, Human
uccugcagcugauaaauacagu

SEQ ID NO: 1141840 - RNA, 23 nt, Human
ugccaaaguuuaccuaacacugg

SEQ ID NO: 1141841 - RNA, 22 nt, Human
cccugcagaucuaggguccuuc

SEQ ID NO: 1141842 - RNA, 22 nt, Human
aauucugugcaggcagagcuau

SEQ ID NO: 1141843 - RNA, 22 nt, Human
gccaagcuuauaugaugcuuga

SEQ ID NO: 1141844 - RNA, 22 nt, Human
aaucuuagguuuggcuucaucu

SEQ ID NO: 1141845 - RNA, 22 nt, Human
acuagauaauuauaaaagguag

SEQ ID NO: 1141846 - RNA, 22 nt, Human
accugcaggggugcucucuggg

SEQ ID NO: 1141847 - RNA, 22 nt, Human
gagaaagaugaagaguggcguu

SEQ ID NO: 1141848 - RNA, 22 nt, Human
uugggaagaaacauguccauca

SEQ ID NO: 1141849 - RNA, 22 nt, Human
uuuuucuuaaauguggguuggc

SEQ ID NO: 1141850 - RNA, 22 nt, Human
uacauaauuaaucuuuaaguuc

SEQ ID NO: 1141851 - RNA, 22 nt, Human
uagggcucacugagaugaauau

SEQ ID NO: 1141852 - RNA, 22 nt, Human
uaacuuucacaucacacugacu

SEQ ID NO: 1141853 - RNA, 22 nt, Human
aaauaguuacuucugcugucuu

SEQ ID NO: 1141854 - RNA, 22 nt, Human
uaguuaggaauagcagcgacuc

SEQ ID NO: 1141855 - RNA, 22 nt, Human
aacaaucaaguuucuaaaugac

SEQ ID NO: 1141856 - RNA, 22 nt, Human
acacacuuuaaauuaaaccucu

SEQ ID NO: 1141857 - RNA, 22 nt, Human
acacacaugccuuuccuaagua

SEQ ID NO: 1141858 - RNA, 22 nt, Human
cccucucucaggcugacagccu

SEQ ID NO: 1141859 - RNA, 22 nt, Human
cacaucccuggaguuacccagu

SEQ ID NO: 1141860 - RNA, 22 nt, Human
gcuggggagggcgucaaggcca

SEQ ID NO: 1141861 - RNA, 22 nt, Human
uggaacacaucuaaggaagcag

SEQ ID NO: 1141862 - RNA, 22 nt, Human
uguaugaaguuacugagccucu

SEQ ID NO: 1141863 - RNA, 19 nt, Human
acauauguggauauacaug

SEQ ID NO: 1141864 - RNA, 22 nt, Human
ccuucaaaacacuaguuuuuga

SEQ ID NO: 1141865 - RNA, 22 nt, Human
ucaugaacauggaauaucuuuu

SEQ ID NO: 1141866 - RNA, 22 nt, Human
ugggaccucucuugagagagca

SEQ ID NO: 1141867 - RNA, 22 nt, Human
uggaccugggguggccuccucu

SEQ ID NO: 1141868 - RNA, 22 nt, Human
uuuguuuucaaugugucauuca

SEQ ID NO: 1141869 - RNA, 22 nt, Human
ugggcucucaaagugcggcuug

SEQ ID NO: 1141870 - RNA, 22 nt, Human
uuuaacaugugaauuuuggaag

SEQ ID NO: 1141871 - RNA, 22 nt, Human
gcacacugcggugaugugaguc

SEQ ID NO: 1141872 - RNA, 22 nt, Human
ccaggcagggcucaaggaaccu

SEQ ID NO: 1141873 - RNA, 22 nt, Human
cagcuuauucaguaagcacaua

SEQ ID NO: 1141874 - RNA, 22 nt, Human
uuccaagugcugaggacaguag

SEQ ID NO: 1141875 - RNA, 22 nt, Human
ggccagggggcuucagacucca

SEQ ID NO: 1141876 - RNA, 22 nt, Human
uuauuuucuccucagaaagugg

SEQ ID NO: 1141877 - RNA, 22 nt, Human
uacacagauaugugaucaauca

SEQ ID NO: 1141878 - RNA, 22 nt, Human
auguuggagucguaaggcaugg

SEQ ID NO: 1141879 - RNA, 22 nt, Human
uguuuucauuugauguaacaaa

SEQ ID NO: 1141880 - RNA, 22 nt, Human
ucaggagcucuucccuggugug

SEQ ID NO: 1141881 - RNA, 22 nt, Human
gcacccaggccggcgacugcag

SEQ ID NO: 1141882 - RNA, 22 nt, Human
ucucuuaauuguaaugguuccu

SEQ ID NO: 1141883 - RNA, 20 nt, Human
uccaugaguuagagacuaua

SEQ ID NO: 1141884 - RNA, 22 nt, Human
ucugucaaaaguuuucaauaaa

SEQ ID NO: 1141885 - RNA, 22 nt, Human
uguuugaacugaauaacauagu

SEQ ID NO: 1141886 - RNA, 22 nt, Human
cacacucauuagucauuucucu

SEQ ID NO: 1141887 - RNA, 22 nt, Human
ccaaggcaggggaucaaaguuu

SEQ ID NO: 1141888 - RNA, 22 nt, Human
gggcugacgaaggccaugugug

SEQ ID NO: 1141889 - RNA, 23 nt, Human
cagcuuucagggcuuuagggaag

SEQ ID NO: 1141890 - RNA, 21 nt, Human
ugucagagcuuguaggacauu

SEQ ID NO: 1141891 - RNA, 22 nt, Human
gacuacucaaacuuucucuaua

SEQ ID NO: 1141892 - RNA, 22 nt, Human
ucagcucuguuuugaguggaac

SEQ ID NO: 1141893 - RNA, 22 nt, Human
acagagagguaaaauauauagu

SEQ ID NO: 1141894 - RNA, 22 nt, Human
gcauaugaucacgugugucggu

SEQ ID NO: 1141895 - RNA, 22 nt, Human
cagagccuuccuagcagacucu

SEQ ID NO: 1141896 - RNA, 22 nt, Human
ccacuguaguuaugaugaaguu

SEQ ID NO: 1141897 - RNA, 22 nt, Human
uuccaagucuaaguuauaaauc

SEQ ID NO: 1141898 - RNA, 22 nt, Human
agcuuuaucacaauauuggcua

SEQ ID NO: 1141899 - RNA, 22 nt, Human
augugguugaagaauuacaucu

SEQ ID NO: 1141900 - RNA, 22 nt, Human
cuguaaaacacuguaguaucug

SEQ ID NO: 1141901 - RNA, 22 nt, Human
ccuggcagcgccgaagcuggcc

SEQ ID NO: 1141902 - RNA, 22 nt, Human
cccccaaaguuugcacggauaa

SEQ ID NO: 1141903 - RNA, 22 nt, Human
aagcuuuaagugucagucagcc

SEQ ID NO: 1141904 - RNA, 22 nt, Human
ucugaacagaaaagaugcacaa

SEQ ID NO: 1141905 - RNA, 22 nt, Human
uauucacaggcacgaaauauug

SEQ ID NO: 1141906 - RNA, 22 nt, Human
ccuggggaagucacuucucuuu

SEQ ID NO: 1141907 - RNA, 22 nt, Human
accaggcaugauguggagcaca

SEQ ID NO: 1141908 - RNA, 22 nt, Human
uagcuuuaagaugagaugugga

SEQ ID NO: 1141909 - RNA, 20 nt, Human
aacacagauaccaaagguug

SEQ ID NO: 1141910 - RNA, 22 nt, Human
agcucugacauugauucucagc

SEQ ID NO: 1141911 - RNA, 22 nt, Human
ggcauccaaauaccaagaugua

SEQ ID NO: 1141912 - RNA, 22 nt, Human
ccuggcagcuguuuggcuuggc

SEQ ID NO: 1141913 - RNA, 22 nt, Human
aacccaggagacagguugcagu

SEQ ID NO: 1141914 - RNA, 21 nt, Human
ucacacacguuuccaagggca

SEQ ID NO: 1141915 - RNA, 22 nt, Human
cuccucuggguccugguggcca

SEQ ID NO: 1141916 - RNA, 22 nt, Human
guaaacaugcuguguacucagc

SEQ ID NO: 1141917 - RNA, 22 nt, Human
ucuggcagagugauaggauaag

SEQ ID NO: 1141918 - RNA, 22 nt, Human
uggaacacagugauugauagcg

SEQ ID NO: 1141919 - RNA, 22 nt, Human
gaacacauuagucugaguuggc

SEQ ID NO: 1141920 - RNA, 19 nt, Human
agcaacaccguuuauuucc

SEQ ID NO: 1141921 - RNA, 22 nt, Human
cacauuccuggugcucagcagc

SEQ ID NO: 1141922 - RNA, 22 nt, Human
gcaggcuccaacuggaggaguu

SEQ ID NO: 1141923 - RNA, 22 nt, Human
cucucugggcccaguuggcacc

SEQ ID NO: 1141924 - RNA, 22 nt, Human
ucuggcaggccuugucaaucug

SEQ ID NO: 1141925 - RNA, 17 nt, Human
gagccacccugugcgag

SEQ ID NO: 1141926 - RNA, 22 nt, Human
cccaggcagagagcuggugagc

SEQ ID NO: 1141927 - RNA, 20 nt, Human
ccccacacuauugagcacuu

SEQ ID NO: 1141928 - RNA, 22 nt, Human
uccuggcacccuuggguuggag

SEQ ID NO: 1141929 - RNA, 19 nt, Human
aaaguuuuauucucauuug

SEQ ID NO: 1141930 - RNA, 22 nt, Human
uuaauuuuaaccuguuuguguc

SEQ ID NO: 1141931 - RNA, 22 nt, Human
cugugaucauucuugauuuaag

SEQ ID NO: 1141932 - RNA, 22 nt, Human
acagcuuuuuacuaauagauug

SEQ ID NO: 1141933 - RNA, 22 nt, Human
accaggcagagcugggccuuaa

SEQ ID NO: 1141934 - RNA, 22 nt, Human
cuuguuaaaaugcagauuccaa

SEQ ID NO: 1141935 - RNA, 22 nt, Human
auauuaggcaaggagauuauuu

SEQ ID NO: 1141936 - RNA, 22 nt, Human
gauaauauuagaagauacaaau

SEQ ID NO: 1141937 - RNA, 22 nt, Human
uucugucaaaugccaguagaga

SEQ ID NO: 1141938 - RNA, 20 nt, Human
auguccagugacuggaccau

SEQ ID NO: 1141939 - RNA, 22 nt, Human
auacuucuuugauguucacagg

SEQ ID NO: 1141940 - RNA, 22 nt, Human
auucucuggcuaaaaccugaag

SEQ ID NO: 1141941 - RNA, 22 nt, Human
uguuuauugagugccuacuaua

SEQ ID NO: 1141942 - RNA, 16 nt, Human
uguaugaacgucucca

SEQ ID NO: 1141943 - RNA, 22 nt, Human
uagggacaaagagcugaggccu

SEQ ID NO: 1141944 - RNA, 22 nt, Human
uucccacagagauuacauugaa

SEQ ID NO: 1141945 - RNA, 22 nt, Human
uccaggcaucuguauuuuuuaa

SEQ ID NO: 1141946 - RNA, 22 nt, Human
gcagcuuuaaaggaggcucuga

SEQ ID NO: 1141947 - RNA, 22 nt, Human
uuaaauuuuagaaacagacucu

SEQ ID NO: 1141948 - RNA, 22 nt, Human
guccuggcccacuggcaggcug

SEQ ID NO: 1141949 - RNA, 22 nt, Human
uucugucauccuuucuagaugu

SEQ ID NO: 1141950 - RNA, 22 nt, Human
caggacauugauccauuggcac

SEQ ID NO: 1141951 - RNA, 22 nt, Human
cauaauuucccaagagauugaa

SEQ ID NO: 1141952 - RNA, 22 nt, Human
ugcauaaacuucucugguguga

SEQ ID NO: 1141953 - RNA, 22 nt, Human
gguggccugaauuagcucaggg

SEQ ID NO: 1141954 - RNA, 22 nt, Human
aaauggaucuguggaauacauu

SEQ ID NO: 1141955 - RNA, 18 nt, Human
ugaccugcgcuucacggu

SEQ ID NO: 1141956 - RNA, 22 nt, Human
ucccugugagaaaugaagcagg

SEQ ID NO: 1141957 - RNA, 22 nt, Human
aaaguguugauaugugacaucc

SEQ ID NO: 1141958 - RNA, 22 nt, Human
cagccucuugcacuuugaaggc

SEQ ID NO: 1141959 - RNA, 22 nt, Human
aaagagucuggcacuguaccag

SEQ ID NO: 1141960 - RNA, 22 nt, Human
ugcuggcacguggaccaggaga

SEQ ID NO: 1141961 - RNA, 22 nt, Human
ccuggcaguuuugcccaggauu

SEQ ID NO: 1141962 - RNA, 22 nt, Human
cucaccccacuaccccuuggug

SEQ ID NO: 1141963 - RNA, 22 nt, Human
aguccaguguguucuggcagca

SEQ ID NO: 1141964 - RNA, 20 nt, Human
aguguuugcucacagucucc

SEQ ID NO: 1141965 - RNA, 22 nt, Human
cuggcaggagcauucacagagg

SEQ ID NO: 1141966 - RNA, 22 nt, Human
uauucacaguugauuuacaguu

SEQ ID NO: 1141967 - RNA, 22 nt, Human
aauguaugaagguuccaguuuc

SEQ ID NO: 1141968 - RNA, 21 nt, Human
aggucccagguuugggcagca

SEQ ID NO: 1141969 - RNA, 22 nt, Human
cacaugaagagagucuaguaau

SEQ ID NO: 1141970 - RNA, 22 nt, Human
aguauaaagugguuuucagcac

SEQ ID NO: 1141971 - RNA, 22 nt, Human
aggagcugcagauucugccuug

SEQ ID NO: 1141972 - RNA, 22 nt, Human
uccaggcaucccccaggacaga

SEQ ID NO: 1141973 - RNA, 22 nt, Human
caguguggcugagacagaggcu

SEQ ID NO: 1141974 - RNA, 23 nt, Human
ugcagggcaaguuagagacccca

SEQ ID NO: 1141975 - RNA, 22 nt, Human
ucuaugaaaagucuauucauuc

SEQ ID NO: 1141976 - RNA, 22 nt, Human
guuuucaugucuauugggcaua

SEQ ID NO: 1141977 - RNA, 22 nt, Human
uugugcucuguguuauuuaagg

SEQ ID NO: 1141978 - RNA, 22 nt, Human
uaugaacucuggagucugagug

SEQ ID NO: 1141979 - RNA, 22 nt, Human
acacauuucucuuuuuguaagu

SEQ ID NO: 1141980 - RNA, 22 nt, Human
auaugagaguaaaugccgaucu

SEQ ID NO: 1141981 - RNA, 22 nt, Human
cagggcucgcugccagcuucag

SEQ ID NO: 1141982 - RNA, 22 nt, Human
cuucugggcauucagcugcaca

SEQ ID NO: 1141983 - RNA, 20 nt, Human
cugaaccaaggcuuucucag

SEQ ID NO: 1141984 - RNA, 23 nt, Human
ccuggggagcuguauccagagug

SEQ ID NO: 1141985 - RNA, 22 nt, Human
gcaaggacucccugggucauuc

SEQ ID NO: 1141986 - RNA, 22 nt, Human
cagcuuuaguaacccacugcuc

SEQ ID NO: 1141987 - RNA, 22 nt, Human
guauuaggaaauaugaagaaag

SEQ ID NO: 1141988 - RNA, 22 nt, Human
gcaggggcuaaggacacagaga

SEQ ID NO: 1141989 - RNA, 22 nt, Human
cacccagcagcacuuaagacua

SEQ ID NO: 1141990 - RNA, 22 nt, Human
cucaaauauaagcuaaaugugg

SEQ ID NO: 1141991 - RNA, 23 nt, Human
ucuguacaauugagaagagaaca

SEQ ID NO: 1141992 - RNA, 22 nt, Human
uucauagagcagcucacugaau

SEQ ID NO: 1141993 - RNA, 22 nt, Human
uucacuuauagggauguuauug

SEQ ID NO: 1141994 - RNA, 22 nt, Human
ggagcugaaggggugggcucag

SEQ ID NO: 1141995 - RNA, 22 nt, Human
ucaagagauugaauaauaacug

SEQ ID NO: 1141996 - RNA, 22 nt, Human
uccaguggcaccuuggcccuca

SEQ ID NO: 1141997 - RNA, 22 nt, Human
uugaauuauaagugugucuacu

SEQ ID NO: 1141998 - RNA, 22 nt, Human
caaagagcuguucagugucgcu

SEQ ID NO: 1141999 - RNA, 22 nt, Human
acacaucaugccaaguuucacc

SEQ ID NO: 1142000 - RNA, 22 nt, Human
ccaggcucugacauagauggga

SEQ ID NO: 1142001 - RNA, 22 nt, Human
cuucauuaaccaaaaugcaaua

SEQ ID NO: 1142002 - RNA, 19 nt, Human
gccugcagaaaaggcaggg

SEQ ID NO: 1142003 - RNA, 22 nt, Human
cagggcucuucaucacacagua

SEQ ID NO: 1142004 - RNA, 22 nt, Human
uacaaguaaauuguagauacca

SEQ ID NO: 1142005 - RNA, 22 nt, Human
agucuacaaucuuaaaugaacu

SEQ ID NO: 1142006 - RNA, 22 nt, Human
guuaaccaaggcaccaagugua

SEQ ID NO: 1142007 - RNA, 22 nt, Human
gguuuauuaaugugaacuguau

SEQ ID NO: 1142008 - RNA, 22 nt, Human
uguaggaauguuuuuaaguugg

SEQ ID NO: 1142009 - RNA, 22 nt, Human
ugaguguauaucaggagagagc

SEQ ID NO: 1142010 - RNA, 22 nt, Human
gugaaacagaagcuccuggaau

SEQ ID NO: 1142011 - RNA, 22 nt, Human
uaauaguuucauaaugugcuuc

SEQ ID NO: 1142012 - RNA, 22 nt, Human
aauacugucuuucacagauauu

SEQ ID NO: 1142013 - RNA, 22 nt, Human
cagugaggugcccagccugccc

SEQ ID NO: 1142014 - RNA, 22 nt, Human
ugcuucuggggacaggcugccu

SEQ ID NO: 1142015 - RNA, 22 nt, Human
caugaaaucugaguauguuucc

SEQ ID NO: 1142016 - RNA, 22 nt, Human
cuuccucccccacacacucacu

SEQ ID NO: 1142017 - RNA, 22 nt, Human
auuucucagugaaaugacaggc

SEQ ID NO: 1142018 - RNA, 22 nt, Human
ggccucaggguugggcccauua

SEQ ID NO: 1142019 - RNA, 22 nt, Human
guggccaggccgacugccaggc

SEQ ID NO: 1142020 - RNA, 22 nt, Human
cagcacaggucaguuuuuuaag

SEQ ID NO: 1142021 - RNA, 22 nt, Human
uagggacccucccugcucuaac

SEQ ID NO: 1142022 - RNA, 22 nt, Human
ccccacaccugccgggcagcag

SEQ ID NO: 1142023 - RNA, 22 nt, Human
ucagagagguuggugauaagaa

SEQ ID NO: 1142024 - RNA, 22 nt, Human
uccugcagcauccgucgucugu

SEQ ID NO: 1142025 - RNA, 22 nt, Human
guccucuggagguuuuuaggug

SEQ ID NO: 1142026 - RNA, 22 nt, Human
cacaucagguagaccuacagag

SEQ ID NO: 1142027 - RNA, 15 nt, Human
ccaggcucugcacuc

SEQ ID NO: 1142028 - RNA, 22 nt, Human
ggggaccuucccagagcaguug

SEQ ID NO: 1142029 - RNA, 22 nt, Human
uccccacagcagaagaucugag

SEQ ID NO: 1142030 - RNA, 22 nt, Human
gcccagcuuuucacuuccacac

SEQ ID NO: 1142031 - RNA, 22 nt, Human
uuuaaauuauaguuaaugucug

SEQ ID NO: 1142032 - RNA, 19 nt, Human
acuggcagcuguagucugu

SEQ ID NO: 1142033 - RNA, 22 nt, Human
cuccagugagugagcaggcgac

SEQ ID NO: 1142034 - RNA, 22 nt, Human
cagccucugacaccacagucgu

SEQ ID NO: 1142035 - RNA, 22 nt, Human
cagcauuuaaugcagugcuucc

SEQ ID NO: 1142036 - RNA, 22 nt, Human
auuagggcuggaugcaaggaaa

SEQ ID NO: 1142037 - RNA, 22 nt, Human
accaggcagcacuuuccuugca

SEQ ID NO: 1142038 - RNA, 22 nt, Human
ccagagagaaaauggagggcca

SEQ ID NO: 1142039 - RNA, 21 nt, Human
cagcuucuucugugaccuggu

SEQ ID NO: 1142040 - RNA, 22 nt, Human
aacauaauguggccaaagucac

SEQ ID NO: 1142041 - RNA, 22 nt, Human
uuucuuucaauucuccuaaugc

SEQ ID NO: 1142042 - RNA, 22 nt, Human
auuuagacuucccagcacugug

SEQ ID NO: 1142043 - RNA, 22 nt, Human
gcccucucuucugcagccucca

SEQ ID NO: 1142044 - RNA, 22 nt, Human
caggucccugcgccccggccuc

SEQ ID NO: 1142045 - RNA, 22 nt, Human
agcaggggcuccuccacagcca

SEQ ID NO: 1142046 - RNA, 22 nt, Human
ugccaggcacgugagaguggcc

SEQ ID NO: 1142047 - RNA, 22 nt, Human
acuggcagaggauagcacuaau

SEQ ID NO: 1142048 - RNA, 22 nt, Human
acuccugggugcugaccagcgu

SEQ ID NO: 1142049 - RNA, 22 nt, Human
auuaaauuagcaaacugugaaa

SEQ ID NO: 1142050 - RNA, 22 nt, Human
ucucuuaauaaguaaauacuga

SEQ ID NO: 1142051 - RNA, 22 nt, Human
gaaaagaguccugugugaggag

SEQ ID NO: 1142052 - RNA, 22 nt, Human
cuccuggcuuucccagaccagg

SEQ ID NO: 1142053 - RNA, 22 nt, Human
gucugucaucugagauggagug

SEQ ID NO: 1142054 - RNA, 22 nt, Human
gagcuuuagcugagaccugcuu

SEQ ID NO: 1142055 - RNA, 22 nt, Human
aauauuucuguagcuauguucu

SEQ ID NO: 1142056 - RNA, 22 nt, Human
cagacagagucuucccaucagu

SEQ ID NO: 1142057 - RNA, 22 nt, Human
gccaaaucacagggccaaaagc

SEQ ID NO: 1142058 - RNA, 22 nt, Human
uuccaagugaaaguagcuuugu

SEQ ID NO: 1142059 - RNA, 22 nt, Human
auuacucugucugccucugacc

SEQ ID NO: 1142060 - RNA, 22 nt, Human
cagaggcugccagccaugugca

SEQ ID NO: 1142061 - RNA, 22 nt, Human
gggguggcccuacccucuggaa

SEQ ID NO: 1142062 - RNA, 22 nt, Human
uggcaguggcucagagugcaga

SEQ ID NO: 1142063 - RNA, 22 nt, Human
ucccaccccggucaagggcuga

SEQ ID NO: 1142064 - RNA, 22 nt, Human
guuuagaacacggaaauacuga

SEQ ID NO: 1142065 - RNA, 22 nt, Human
aauuaggggaggacguaucaua

SEQ ID NO: 1142066 - RNA, 23 nt, Human
uggccaggguacuacacccaccc

SEQ ID NO: 1142067 - RNA, 22 nt, Human
acuggcagagguuggacaccau

SEQ ID NO: 1142068 - RNA, 22 nt, Human
uacacaucacuguaucuuucag

SEQ ID NO: 1142069 - RNA, 22 nt, Human
uuucuauugaucuaauaaacau

SEQ ID NO: 1142070 - RNA, 22 nt, Human
acacacuguaaggacuaucacu

SEQ ID NO: 1142071 - RNA, 22 nt, Human
cgcuaggauuaggauuaauccu

SEQ ID NO: 1142072 - RNA, 22 nt, Human
cuacauggagaagaaaauucuu

SEQ ID NO: 1142073 - RNA, 22 nt, Human
uuuucauuguuacuaugagcua

SEQ ID NO: 1142074 - RNA, 22 nt, Human
ugcucuguauucuauggcaguu

SEQ ID NO: 1142075 - RNA, 21 nt, Human
aggcucccagaaaugggcauc

SEQ ID NO: 1142076 - RNA, 20 nt, Human
aggcucugccugcaggccca

SEQ ID NO: 1142077 - RNA, 22 nt, Human
agggcccaggacagcaucaggg

SEQ ID NO: 1142078 - RNA, 22 nt, Human
ccuggcuccugccucugcaggg

SEQ ID NO: 1142079 - RNA, 22 nt, Human
uggaaauacuugccauaaaacu

SEQ ID NO: 1142080 - RNA, 22 nt, Human
ggguuccuccaguuccuagagc

SEQ ID NO: 1142081 - RNA, 22 nt, Human
uacagcauauacagaaugaaca

SEQ ID NO: 1142082 - RNA, 22 nt, Human
uuuucauuuacauuagggaaga

SEQ ID NO: 1142083 - RNA, 23 nt, Human
agaccugcaucugauaggcccug

SEQ ID NO: 1142084 - RNA, 23 nt, Human
ucagggacaugaugugucauauc

SEQ ID NO: 1142085 - RNA, 22 nt, Human
acuggcagggggagccccgaga

SEQ ID NO: 1142086 - RNA, 22 nt, Human
auggcagacgaggcagcagggg

SEQ ID NO: 1142087 - RNA, 22 nt, Human
gauuuauugucccuguccugcu

SEQ ID NO: 1142088 - RNA, 22 nt, Human
cuucugggauuuuugaagacuc

SEQ ID NO: 1142089 - RNA, 22 nt, Human
ccagccacugggccacugccag

SEQ ID NO: 1142090 - RNA, 22 nt, Human
uggucucugcaggccaggcuca

SEQ ID NO: 1142091 - RNA, 22 nt, Human
gaggagggagcuggaagcucuu

SEQ ID NO: 1142092 - RNA, 22 nt, Human
gccaggcaauguguuagaagcg

SEQ ID NO: 1142093 - RNA, 22 nt, Human
uccaggcacgaggcccugugca

SEQ ID NO: 1142094 - RNA, 22 nt, Human
uguaaacauaccagagccaagu

SEQ ID NO: 1142095 - RNA, 22 nt, Human
ucuggggaugagugaugucgua

SEQ ID NO: 1142096 - RNA, 22 nt, Human
uuagggacagcucuguagguga

SEQ ID NO: 1142097 - RNA, 17 nt, Human
ugcaggcuccugucccu

SEQ ID NO: 1142098 - RNA, 20 nt, Human
acaaagacuggaaaagcaag

SEQ ID NO: 1142099 - RNA, 22 nt, Human
uuguaugaggauagcaagaagc

SEQ ID NO: 1142100 - RNA, 22 nt, Human
agagagcauggcacagaggggu

SEQ ID NO: 1142101 - RNA, 22 nt, Human
ccuggcagacagcacugaagcu

SEQ ID NO: 1142102 - RNA, 22 nt, Human
cacaggcugcccgcagcuggga

SEQ ID NO: 1142103 - RNA, 22 nt, Human
caguuuauagcucuagcagcuu

SEQ ID NO: 1142104 - RNA, 22 nt, Human
uaacacauaucuacaacaugug

SEQ ID NO: 1142105 - RNA, 22 nt, Human
cugggcuuaggaccuggugcgg

SEQ ID NO: 1142106 - RNA, 22 nt, Human
agcaggcugggcaauaugggca

SEQ ID NO: 1142107 - RNA, 22 nt, Human
agagucagcuuaugacacaguc

SEQ ID NO: 1142108 - RNA, 22 nt, Human
ucacacacauaaucuaagauua

SEQ ID NO: 1142109 - RNA, 22 nt, Human
gcuggcagagagcuggugagga

SEQ ID NO: 1142110 - RNA, 22 nt, Human
uccugcagcugcagaccugggg

SEQ ID NO: 1142111 - RNA, 22 nt, Human
acaucacaguaguuaagccaga

SEQ ID NO: 1142112 - RNA, 22 nt, Human
ucuggcagcagcaucaguggcu

SEQ ID NO: 1142113 - RNA, 22 nt, Human
ccugggcucuauccugacccag

SEQ ID NO: 1142114 - RNA, 20 nt, Human
cugaacacagaauaagcaca

SEQ ID NO: 1142115 - RNA, 22 nt, Human
ggcaggcuccguguuccauucc

SEQ ID NO: 1142116 - RNA, 22 nt, Human
ugcaggcuggggaggcagacuu

SEQ ID NO: 1142117 - RNA, 22 nt, Human
uauaaaguuucgaaagauguau

SEQ ID NO: 1142118 - RNA, 22 nt, Human
augaaacagugaauuagucaag

SEQ ID NO: 1142119 - RNA, 22 nt, Human
ugcuucugaugugagcagcccc

SEQ ID NO: 1142120 - RNA, 22 nt, Human
acagauuugacugguaccuggc

SEQ ID NO: 1142121 - RNA, 22 nt, Human
aagugugggaaguugcuaaaau

SEQ ID NO: 1142122 - RNA, 22 nt, Human
aagugauuucugccugcauguu

SEQ ID NO: 1142123 - RNA, 22 nt, Human
cacccaggcagguggcugagaa

SEQ ID NO: 1142124 - RNA, 22 nt, Human
uagcauuuauuccagauuugga

SEQ ID NO: 1142125 - RNA, 22 nt, Human
cuguggcucauucuugguggca

SEQ ID NO: 1142126 - RNA, 22 nt, Human
uacuuacacagcuguagaaggu

SEQ ID NO: 1142127 - RNA, 22 nt, Human
uuccuggccuaagguaggugac

SEQ ID NO: 1142128 - RNA, 22 nt, Human
gagauggagucuuuuucuguca

SEQ ID NO: 1142129 - RNA, 17 nt, Human
agcaggcugcagaggcc

SEQ ID NO: 1142130 - RNA, 22 nt, Human
uuaugggagcaauuggggaggu

SEQ ID NO: 1142131 - RNA, 22 nt, Human
gacauaauccuccucaccuacu

SEQ ID NO: 1142132 - RNA, 22 nt, Human
ugcaggcuggaggagggacuaa

SEQ ID NO: 1142133 - RNA, 22 nt, Human
auguagaaauuaggaugauagu

SEQ ID NO: 1142134 - RNA, 22 nt, Human
aggaccuguagggccugcaucc

SEQ ID NO: 1142135 - RNA, 22 nt, Human
ugggccaggcaugugaucagca

SEQ ID NO: 1142136 - RNA, 20 nt, Human
uuuuccuucugaguauguug

SEQ ID NO: 1142137 - RNA, 19 nt, Human
accugcaguaauaauuccu

SEQ ID NO: 1142138 - RNA, 22 nt, Human
uacagccacaggugacucucau

SEQ ID NO: 1142139 - RNA, 22 nt, Human
aauuugauucccugcaccuguu

SEQ ID NO: 1142140 - RNA, 22 nt, Human
cuggggacuugcagacacaauu

SEQ ID NO: 1142141 - RNA, 22 nt, Human
aggcuuuaaguggccuacagcu

SEQ ID NO: 1142142 - RNA, 22 nt, Human
cugcagggaacugaggcccaga

SEQ ID NO: 1142143 - RNA, 22 nt, Human
ugcuucugggucccagccuggc

SEQ ID NO: 1142144 - RNA, 22 nt, Human
acagauuuauugaagcugcugc

SEQ ID NO: 1142145 - RNA, 22 nt, Human
augggcuguccuaguccagccc

SEQ ID NO: 1142146 - RNA, 22 nt, Human
uuauuaggaaaaggucagaugu

SEQ ID NO: 1142147 - RNA, 18 nt, Human
gacccagcagaugggcuu

SEQ ID NO: 1142148 - RNA, 22 nt, Human
gccaggcaguucaaguacacca

SEQ ID NO: 1142149 - RNA, 21 nt, Human
ugcaggcugugcgcuccugcc

SEQ ID NO: 1142150 - RNA, 22 nt, Human
gugugaaagcuuguccucugua

SEQ ID NO: 1142151 - RNA, 20 nt, Human
agggcugagaagggacuagc

SEQ ID NO: 1142152 - RNA, 22 nt, Human
aaccugcauguuucuaaaagca

SEQ ID NO: 1142153 - RNA, 22 nt, Human
cuauuacauuucuggacauuca

SEQ ID NO: 1142154 - RNA, 22 nt, Human
uacauuccuguuagcaucuaag

SEQ ID NO: 1142155 - RNA, 22 nt, Human
aaauuucuaagcagccacuucc

SEQ ID NO: 1142156 - RNA, 22 nt, Human
ccacuguaaguuugaaaauaac

SEQ ID NO: 1142157 - RNA, 22 nt, Human
gggcugacagcacgccuucugu

SEQ ID NO: 1142158 - RNA, 22 nt, Human
cacauugcagcuucuuuuggcu

SEQ ID NO: 1142159 - RNA, 22 nt, Human
cacauacauucauguuacucua

SEQ ID NO: 1142160 - RNA, 22 nt, Human
cccagccucuguuugcuccucu

SEQ ID NO: 1142161 - RNA, 22 nt, Human
aagagcauggaauggagaucca

SEQ ID NO: 1142162 - RNA, 22 nt, Human
uucacaaaacacuauuuucugg

SEQ ID NO: 1142163 - RNA, 22 nt, Human
acagaccaaguuuccagcaggu

SEQ ID NO: 1142164 - RNA, 22 nt, Human
agggcugaaguuauggcugagc

SEQ ID NO: 1142165 - RNA, 22 nt, Human
aaguguuuacuuaaagucaugg

SEQ ID NO: 1142166 - RNA, 22 nt, Human
gaauauuuguaauuacuguuga

SEQ ID NO: 1142167 - RNA, 22 nt, Human
cuccaaguccgagggcucucaa

SEQ ID NO: 1142168 - RNA, 22 nt, Human
uggcaggcgggagccauagagg

SEQ ID NO: 1142169 - RNA, 22 nt, Human
cacaggcuuccaguccccagcu

SEQ ID NO: 1142170 - RNA, 22 nt, Human
acaauauuguacccagaaguuu

SEQ ID NO: 1142171 - RNA, 22 nt, Human
ucccaaggugcucggcaacagg

SEQ ID NO: 1142172 - RNA, 22 nt, Human
cagcauuuaucuuguagcagga

SEQ ID NO: 1142173 - RNA, 22 nt, Human
acuggggaguugaagcacuuuc

SEQ ID NO: 1142174 - RNA, 22 nt, Human
uuguaugagcuccaggaacuca

SEQ ID NO: 1142175 - RNA, 22 nt, Human
aacacagaucaaaauauuuccu

SEQ ID NO: 1142176 - RNA, 22 nt, Human
agguuuauguuuggugcaggag

SEQ ID NO: 1142177 - RNA, 22 nt, Human
auucucaguucacuaguuucuu

SEQ ID NO: 1142178 - RNA, 21 nt, Human
uccagcucuuauguucaugaa

SEQ ID NO: 1142179 - RNA, 22 nt, Human
cuugggcucagacuugaggaca

SEQ ID NO: 1142180 - RNA, 22 nt, Human
cuccaggguuccccgauccacu

SEQ ID NO: 1142181 - RNA, 22 nt, Human
cucuuaaaaacuugauauauuu

SEQ ID NO: 1142182 - RNA, 21 nt, Human
caauaaacugcacauugagac

SEQ ID NO: 1142183 - RNA, 22 nt, Human
gccuccuggguucaugccauuc

SEQ ID NO: 1142184 - RNA, 22 nt, Human
agggcuccuccccggccuccac

SEQ ID NO: 1142185 - RNA, 22 nt, Human
ucuggcagagucagugcacaca

SEQ ID NO: 1142186 - RNA, 22 nt, Human
aaccccgcucaggcugggugag

SEQ ID NO: 1142187 - RNA, 22 nt, Human
ucuggggaccauggcaucuaaa

SEQ ID NO: 1142188 - RNA, 22 nt, Human
cuaucauuuuacaugguuggug

SEQ ID NO: 1142189 - RNA, 22 nt, Human
acccaggccugagagacaggag

SEQ ID NO: 1142190 - RNA, 18 nt, Human
uguuuauuuuucucuuac

SEQ ID NO: 1142191 - RNA, 22 nt, Human
aguuuucuguucuacaauuuga

SEQ ID NO: 1142192 - RNA, 22 nt, Human
uucuugaaucacuuuagagaua

SEQ ID NO: 1142193 - RNA, 22 nt, Human
ugggcuccggcggccucaggcu

SEQ ID NO: 1142194 - RNA, 22 nt, Human
ucuccugucuucucagcacccc

SEQ ID NO: 1142195 - RNA, 23 nt, Human
cccugcagucagggugagauggu

SEQ ID NO: 1142196 - RNA, 22 nt, Human
uacccaggaggaaacugaggcu

SEQ ID NO: 1142197 - RNA, 22 nt, Human
aaugucauugguaaagauuagg

SEQ ID NO: 1142198 - RNA, 22 nt, Human
cuugggaggagaacaaagcucc

SEQ ID NO: 1142199 - RNA, 22 nt, Human
aagugccaucauagcauggcug

SEQ ID NO: 1142200 - RNA, 17 nt, Human
ccaggcuccaucacugu

SEQ ID NO: 1142201 - RNA, 22 nt, Human
uuggagagauuuaggucucagu

SEQ ID NO: 1142202 - RNA, 22 nt, Human
gagcuuuaccuuagguucuguu

SEQ ID NO: 1142203 - RNA, 22 nt, Human
uucaugaaacuuaacuguuggg

SEQ ID NO: 1142204 - RNA, 22 nt, Human
cagagcauugagggucugccaa

SEQ ID NO: 1142205 - RNA, 22 nt, Human
ccagagaguaucauggagagua

SEQ ID NO: 1142206 - RNA, 22 nt, Human
acauuuuaauaugcuuagugug

SEQ ID NO: 1142207 - RNA, 22 nt, Human
ccucugcaaagaauuugucucc

SEQ ID NO: 1142208 - RNA, 22 nt, Human
agggcuccuaugaugcucugcc

SEQ ID NO: 1142209 - RNA, 22 nt, Human
gacaaaaguguuuugaacaagg

SEQ ID NO: 1142210 - RNA, 22 nt, Human
ggcugccacgucgaggguccaa

SEQ ID NO: 1142211 - RNA, 22 nt, Human
cagcuucuucaguccuggagcu

SEQ ID NO: 1142212 - RNA, 22 nt, Human
gugauaaaauucaaauagcucu

SEQ ID NO: 1142213 - RNA, 22 nt, Human
ucuuaaaccacaaaauucagag

SEQ ID NO: 1142214 - RNA, 22 nt, Human
auccucuguggauuacaccuag

SEQ ID NO: 1142215 - RNA, 22 nt, Human
uaacacauuuuaagccauuuua

SEQ ID NO: 1142216 - RNA, 22 nt, Human
auugaaaauauaauucuaggag

SEQ ID NO: 1142217 - RNA, 22 nt, Human
ucagcuuuccuugcuuuagauu

SEQ ID NO: 1142218 - RNA, 22 nt, Human
acagugugugcuuucccuuacg

SEQ ID NO: 1142219 - RNA, 22 nt, Human
caucuuuucagaagccauucug

SEQ ID NO: 1142220 - RNA, 22 nt, Human
uccaggcuccccugcgugcucc

SEQ ID NO: 1142221 - RNA, 22 nt, Human
cugggagggguagccaauccua

SEQ ID NO: 1142222 - RNA, 22 nt, Human
ucacuguaaaguaauacuguca

SEQ ID NO: 1142223 - RNA, 23 nt, Human
uggccagguagaggagguaguga

SEQ ID NO: 1142224 - RNA, 22 nt, Human
cuguggcugcguaggucuggca

SEQ ID NO: 1142225 - RNA, 22 nt, Human
uaaguuuucuggaauaacuugg

SEQ ID NO: 1142226 - RNA, 22 nt, Human
gaagcacugcauuucaagauca

SEQ ID NO: 1142227 - RNA, 18 nt, Human
acaggcugugggaauggu

SEQ ID NO: 1142228 - RNA, 22 nt, Human
auuaaaauuccaagguaugcca

SEQ ID NO: 1142229 - RNA, 22 nt, Human
cccaggcagcggggucuccuug

SEQ ID NO: 1142230 - RNA, 22 nt, Human
ugcuuuauggagcccaucucau

SEQ ID NO: 1142231 - RNA, 22 nt, Human
auucauuuagguauucacuuac

SEQ ID NO: 1142232 - RNA, 22 nt, Human
gagggcuccacacgggcccagc

SEQ ID NO: 1142233 - RNA, 22 nt, Human
gggaccuggacaugugugugcu

SEQ ID NO: 1142234 - RNA, 22 nt, Human
auccaggcgaaugcagaaggcc

SEQ ID NO: 1142235 - RNA, 21 nt, Human
uggccaaacuggagcauuuga

SEQ ID NO: 1142236 - RNA, 22 nt, Human
ccaggcucugcgcuggacaugg

SEQ ID NO: 1142237 - RNA, 22 nt, Human
ugcauguuuuauaccaaagcuu

SEQ ID NO: 1142238 - RNA, 22 nt, Human
cugcauaucaaauuacuccugg

SEQ ID NO: 1142239 - RNA, 22 nt, Human
gccucugcaccaguacugugcc

SEQ ID NO: 1142240 - RNA, 22 nt, Human
gaauguuauugaacuacgagcu

SEQ ID NO: 1142241 - RNA, 22 nt, Human
auacaccaccuuggaucuuuca

SEQ ID NO: 1142242 - RNA, 23 nt, Human
ugaaagcaaugggucuauaguau

SEQ ID NO: 1142243 - RNA, 22 nt, Human
uugcaucagcaggcauaauugg

SEQ ID NO: 1142244 - RNA, 22 nt, Human
ugcaggccuggacugauguggu

SEQ ID NO: 1142245 - RNA, 22 nt, Human
uaucacauacuucucauccagg

SEQ ID NO: 1142246 - RNA, 22 nt, Human
auuauguagcuaaaaauugugu

SEQ ID NO: 1142247 - RNA, 22 nt, Human
gccuuugcugugacaaugcugg

SEQ ID NO: 1142248 - RNA, 20 nt, Human
uugcaaagugaauagcaauu

SEQ ID NO: 1142249 - RNA, 23 nt, Human
auaauaacgucugucuugucucu

SEQ ID NO: 1142250 - RNA, 22 nt, Human
agacugugagaagauggcugcg

SEQ ID NO: 1142251 - RNA, 22 nt, Human
gagugcucgggccucugccugc

SEQ ID NO: 1142252 - RNA, 22 nt, Human
aaaucaugguggaagaaacaga

SEQ ID NO: 1142253 - RNA, 22 nt, Human
ugcucuguucaguguaucuugu

SEQ ID NO: 1142254 - RNA, 22 nt, Human
ccaggaagaaacagucuuuaua

SEQ ID NO: 1142255 - RNA, 22 nt, Human
agugauguagguggauucuggc

SEQ ID NO: 1142256 - RNA, 22 nt, Human
uaucuguauucugacagucacu

SEQ ID NO: 1142257 - RNA, 22 nt, Human
caugucaagacugaagauccag

SEQ ID NO: 1142258 - RNA, 22 nt, Human
guuuauuggguauuguggagcc

SEQ ID NO: 1142259 - RNA, 22 nt, Human
agucagucugcuagccugugga

SEQ ID NO: 1142260 - RNA, 22 nt, Human
aagugucuucugauggggugug

SEQ ID NO: 1142261 - RNA, 22 nt, Human
augaucaagaauuuuguauucc

SEQ ID NO: 1142262 - RNA, 20 nt, Human
cuugaguucagagcugucau

SEQ ID NO: 1142263 - RNA, 22 nt, Human
gggaccuggacaugugugugcu

SEQ ID NO: 1142264 - RNA, 22 nt, Human
augcauaucuccuaucuccuca

SEQ ID NO: 1142265 - RNA, 22 nt, Human
ugccucugcugcauauucaccu

SEQ ID NO: 1142266 - RNA, 22 nt, Human
uguaucauauggggaagcuuca

SEQ ID NO: 1142267 - RNA, 23 nt, Human
acaaguguuuccaauauggcugg

SEQ ID NO: 1142268 - RNA, 22 nt, Human
aggcaguggcuuuuguuguguu

SEQ ID NO: 1142269 - RNA, 22 nt, Human
uccuggccaaguagauguggcg

SEQ ID NO: 1142270 - RNA, 22 nt, Human
caaugcagauaccuuccagaga

SEQ ID NO: 1142271 - RNA, 22 nt, Human
guaaaucagugucauuuuagaa

SEQ ID NO: 1142272 - RNA, 22 nt, Human
aauuagaagcuguuagcaaaau

SEQ ID NO: 1142273 - RNA, 22 nt, Human
gacucugguugcggguucugcu

SEQ ID NO: 1142274 - RNA, 22 nt, Human
auaacugagugagcagcgacuc

SEQ ID NO: 1142275 - RNA, 22 nt, Human
uagauuaucccugauuugucca

SEQ ID NO: 1142276 - RNA, 19 nt, Human
auagaguagaguaucuguu

SEQ ID NO: 1142277 - RNA, 22 nt, Human
aguaacagguguacagacuauc

SEQ ID NO: 1142278 - RNA, 22 nt, Human
ucacuguuaauaaauagcaaag

SEQ ID NO: 1142279 - RNA, 22 nt, Human
gaaguucugguguaugugauaa

SEQ ID NO: 1142280 - RNA, 22 nt, Human
gagguauaguucuauuagauga

SEQ ID NO: 1142281 - RNA, 22 nt, Human
aaggauuuuuggaaugagaugg

SEQ ID NO: 1142282 - RNA, 22 nt, Human
agucaguaugacuuauaguucu

SEQ ID NO: 1142283 - RNA, 22 nt, Human
uagcauuucacugaucuucacu

SEQ ID NO: 1142284 - RNA, 17 nt, Human
auucaugaacauguccu

SEQ ID NO: 1142285 - RNA, 22 nt, Human
guuugcaaauuguguuaaagcu

SEQ ID NO: 1142286 - RNA, 22 nt, Human
guguaucaacauguuuuuugug

SEQ ID NO: 1142287 - RNA, 22 nt, Human
auccauuuuuucagaaugcucu

SEQ ID NO: 1142288 - RNA, 22 nt, Human
uugcacagaugcacaugguugc

SEQ ID NO: 1142289 - RNA, 22 nt, Human
cauuguccucugaugccuuccc

SEQ ID NO: 1142290 - RNA, 22 nt, Human
gucaggaugagggaugaggagu

SEQ ID NO: 1142291 - RNA, 22 nt, Human
auccuucaaaaggaauagcagg

SEQ ID NO: 1142292 - RNA, 22 nt, Human
augugaaagagguguucagugg

SEQ ID NO: 1142293 - RNA, 22 nt, Human
auuuacugagguaaauaaacug

SEQ ID NO: 1142294 - RNA, 22 nt, Human
aauaguguauuuuucaaaauua

SEQ ID NO: 1142295 - RNA, 22 nt, Human
guguuuggucagacguccgggg

SEQ ID NO: 1142296 - RNA, 22 nt, Human
uuucaugauuaacuuagugaau

SEQ ID NO: 1142297 - RNA, 22 nt, Human
ccugugcaugccaggguacacc

SEQ ID NO: 1142298 - RNA, 22 nt, Human
ugugaagaauuaaugugaauca

SEQ ID NO: 1142299 - RNA, 22 nt, Human
cucuggucaagcaaagagguuu

SEQ ID NO: 1142300 - RNA, 22 nt, Human
uagcuucccugcuggaucauaa

SEQ ID NO: 1142301 - RNA, 22 nt, Human
aaguuacacauuuucauuguaa

SEQ ID NO: 1142302 - RNA, 22 nt, Human
ugaggcuggaugggaugccucc

SEQ ID NO: 1142303 - RNA, 22 nt, Human
agagcaauuagcuuagguaaaa

SEQ ID NO: 1142304 - RNA, 22 nt, Human
uugaggucuggcaguagcguug

SEQ ID NO: 1142305 - RNA, 22 nt, Human
agauaucuuacacuuugaaguu

SEQ ID NO: 1142306 - RNA, 22 nt, Human
gccucugcacuguggcacacca

SEQ ID NO: 1142307 - RNA, 18 nt, Human
auuugcaggcaugcaggc

SEQ ID NO: 1142308 - RNA, 22 nt, Human
augauuuguuaacagacuuaau

SEQ ID NO: 1142309 - RNA, 22 nt, Human
uggugcugccaccuccucugcu

SEQ ID NO: 1142310 - RNA, 22 nt, Human
aaauugcuugagauuagucucc

SEQ ID NO: 1142311 - RNA, 22 nt, Human
uuacaguuuacauaagaauugu

SEQ ID NO: 1142312 - RNA, 22 nt, Human
uuuggcaagcgaguacuuucug

SEQ ID NO: 1142313 - RNA, 22 nt, Human
ugggugugagcccgggagccgc

SEQ ID NO: 1142314 - RNA, 22 nt, Human
ucuuuuaucuguuguguaacaa

SEQ ID NO: 1142315 - RNA, 22 nt, Human
guugguccuuugagcaagaucc

SEQ ID NO: 1142316 - RNA, 22 nt, Human
uaaucuuagacauguauuuuuc

SEQ ID NO: 1142317 - RNA, 22 nt, Human
uaucuagagccuggaagucuug

SEQ ID NO: 1142318 - RNA, 20 nt, Human
uccaguuuuggagacauucu

SEQ ID NO: 1142319 - RNA, 22 nt, Human
caaguaugagaaagcuauuacc

SEQ ID NO: 1142320 - RNA, 22 nt, Human
cugagcaugcuacaugcagcac

SEQ ID NO: 1142321 - RNA, 22 nt, Human
gaauguuaaugcacuucuagcu

SEQ ID NO: 1142322 - RNA, 22 nt, Human
ucugcuggaaaaccagggaauu

SEQ ID NO: 1142323 - RNA, 22 nt, Human
aaagccauaucuauucuauucu

SEQ ID NO: 1142324 - RNA, 22 nt, Human
uuuuuggguccaggcuguaucu

SEQ ID NO: 1142325 - RNA, 22 nt, Human
agagaagagucuugucaaauua

SEQ ID NO: 1142326 - RNA, 22 nt, Human
ugucuguccaucugucugggac

SEQ ID NO: 1142327 - RNA, 22 nt, Human
aacuagaaagaacauauuucca

SEQ ID NO: 1142328 - RNA, 22 nt, Human
gaggcugaacagguucucauga

SEQ ID NO: 1142329 - RNA, 22 nt, Human
cuuauuagaaagaaaagacaug

SEQ ID NO: 1142330 - RNA, 22 nt, Human
aggcauuuaaagauguaagacu

SEQ ID NO: 1142331 - RNA, 22 nt, Human
uaaguauuggccuauagcuaga

SEQ ID NO: 1142332 - RNA, 21 nt, Human
ccuguggugccagaucgccag

SEQ ID NO: 1142333 - RNA, 22 nt, Human
acuugcaucuuagagacucacc

SEQ ID NO: 1142334 - RNA, 22 nt, Human
cuguauaugugcauacacacac

SEQ ID NO: 1142335 - RNA, 22 nt, Human
uuucuacauuuguaaccagauu

SEQ ID NO: 1142336 - RNA, 22 nt, Human
acuggauucucuuacacagaug

SEQ ID NO: 1142337 - RNA, 22 nt, Human
auguuguugaacucuuugcaug

SEQ ID NO: 1142338 - RNA, 20 nt, Human
agugauuuguuaguacauug

SEQ ID NO: 1142339 - RNA, 22 nt, Human
ucauuccuccagcgggagucca

SEQ ID NO: 1142340 - RNA, 22 nt, Human
cuucucuuggguguggugucuu

SEQ ID NO: 1142341 - RNA, 22 nt, Human
cucugcaaggcccuccaguagc

SEQ ID NO: 1142342 - RNA, 22 nt, Human
cugguuuuccaauguuuugacu

SEQ ID NO: 1142343 - RNA, 22 nt, Human
aaauugaauuugggaaacauug

SEQ ID NO: 1142344 - RNA, 22 nt, Human
aaugcugugauuuauuaaguau

SEQ ID NO: 1142345 - RNA, 22 nt, Human
cucaggaaaauauugaagaagu

SEQ ID NO: 1142346 - RNA, 22 nt, Human
guaugugucuuagaacuuggga

SEQ ID NO: 1142347 - RNA, 22 nt, Human
cuccaggacugaggacagagcu

SEQ ID NO: 1142348 - RNA, 22 nt, Human
uaaagacaauuucgagcuguag

SEQ ID NO: 1142349 - RNA, 22 nt, Human
uguacauauucaagcacuucua

SEQ ID NO: 1142350 - RNA, 22 nt, Human
auuacugaggcaaaguaguuuu

SEQ ID NO: 1142351 - RNA, 22 nt, Human
cagcacauggauggaguuagga

SEQ ID NO: 1142352 - RNA, 20 nt, Human
ugggguccuggaggggaucc

SEQ ID NO: 1142353 - RNA, 20 nt, Human
uugaggagauauugaauacu

SEQ ID NO: 1142354 - RNA, 18 nt, Human
ugugccucugcaggacgu

SEQ ID NO: 1142355 - RNA, 22 nt, Human
aaucuguugucaggaauccaca

SEQ ID NO: 1142356 - RNA, 22 nt, Human
uaucaguagaacaauggacauu

SEQ ID NO: 1142357 - RNA, 22 nt, Human
ccugguuugggugccagugagu

SEQ ID NO: 1142358 - RNA, 23 nt, Human
auagaccauugucucacacuuca

SEQ ID NO: 1142359 - RNA, 22 nt, Human
ggcuguggucauuaggagguug

SEQ ID NO: 1142360 - RNA, 22 nt, Human
gcugcuggcuuccugcuguuuu

SEQ ID NO: 1142361 - RNA, 22 nt, Human
uugagauagguggaaucucuuu

SEQ ID NO: 1142362 - RNA, 20 nt, Human
ugugguuuuugccaguugaa

SEQ ID NO: 1142363 - RNA, 22 nt, Human
augguuuuguccucuuugguuc

SEQ ID NO: 1142364 - RNA, 22 nt, Human
ggucagugccuaucaugugggc

SEQ ID NO: 1142365 - RNA, 22 nt, Human
aguaauggguugaaauuuaguu

SEQ ID NO: 1142366 - RNA, 22 nt, Human
auauuuguuuggcagaguucag

SEQ ID NO: 1142367 - RNA, 22 nt, Human
uaauucuagauugacauuuuga

SEQ ID NO: 1142368 - RNA, 22 nt, Human
caggaacagcaccaggagcuag

SEQ ID NO: 1142369 - RNA, 22 nt, Human
aaguuacaggagaaagagauca

SEQ ID NO: 1142370 - RNA, 22 nt, Human
aaucuucaggguccuggggcuc

SEQ ID NO: 1142371 - RNA, 22 nt, Human
ugggguccucucacuuggaggg

SEQ ID NO: 1142372 - RNA, 22 nt, Human
gacagucccccagcagcaaacc

SEQ ID NO: 1142373 - RNA, 22 nt, Human
uugcuauuuugagagucauagu

SEQ ID NO: 1142374 - RNA, 21 nt, Human
ucugugcuuuuuuggcuccua

SEQ ID NO: 1142375 - RNA, 22 nt, Human
guauuucuuuacauaugcucau

SEQ ID NO: 1142376 - RNA, 22 nt, Human
augaaacaacagacuuggucaa

SEQ ID NO: 1142377 - RNA, 22 nt, Human
cagccuuugggucagaagauuc

SEQ ID NO: 1142378 - RNA, 22 nt, Human
cauuuugugcuagacacuaugg

SEQ ID NO: 1142379 - RNA, 22 nt, Human
ucuuugcauggacauguguuuu

SEQ ID NO: 1142380 - RNA, 22 nt, Human
cuggcuuugaucagagugaccu

SEQ ID NO: 1142381 - RNA, 22 nt, Human
gggaaucuuccuuuuuuguaag

SEQ ID NO: 1142382 - RNA, 19 nt, Human
ugaggauugagguccagua

SEQ ID NO: 1142383 - RNA, 22 nt, Human
ucaauuuauguggcuauucauu

SEQ ID NO: 1142384 - RNA, 20 nt, Human
uguauuuaaugaaggcuuuu

SEQ ID NO: 1142385 - RNA, 17 nt, Human
gugcuggccuggggcuc

SEQ ID NO: 1142386 - RNA, 22 nt, Human
aaugguaauauuucauaguugu

SEQ ID NO: 1142387 - RNA, 22 nt, Human
cucucuguuaugcuuucaugaa

SEQ ID NO: 1142388 - RNA, 22 nt, Human
ugucauuggugaucugaugccu

SEQ ID NO: 1142389 - RNA, 22 nt, Human
auaucuaggcugaauguaaaau

SEQ ID NO: 1142390 - RNA, 22 nt, Human
agaaaagaggcuuucuaagcau

SEQ ID NO: 1142391 - RNA, 22 nt, Human
uguucauaucauuuugaaagcu

SEQ ID NO: 1142392 - RNA, 22 nt, Human
agaaucugcauuuuaacaagau

SEQ ID NO: 1142393 - RNA, 22 nt, Human
guaaagcaaaauguagagauug

SEQ ID NO: 1142394 - RNA, 22 nt, Human
auauaguuggguuucauucuac

SEQ ID NO: 1142395 - RNA, 22 nt, Human
aauuauguuugcuuuagaugga

SEQ ID NO: 1142396 - RNA, 22 nt, Human
ugucuuaugcugcauagacuau

SEQ ID NO: 1142397 - RNA, 22 nt, Human
cuggcuuuuuucccauuaugca

SEQ ID NO: 1142398 - RNA, 22 nt, Human
uuaaggcuguggggauuacugc

SEQ ID NO: 1142399 - RNA, 22 nt, Human
ucugcuguuuacugugugauau

SEQ ID NO: 1142400 - RNA, 22 nt, Human
agcuaguauuucauugaggauu

SEQ ID NO: 1142401 - RNA, 22 nt, Human
ugcaucauuaagguacaguugg

SEQ ID NO: 1142402 - RNA, 22 nt, Human
aguguauucugcaugggagacu

SEQ ID NO: 1142403 - RNA, 22 nt, Human
aaugucaacacaagagaaaugc

SEQ ID NO: 1142404 - RNA, 22 nt, Human
caagggcagcagccucaagcgg

SEQ ID NO: 1142405 - RNA, 22 nt, Human
uccagcugugcuccaggaggug

SEQ ID NO: 1142406 - RNA, 22 nt, Human
acuugguggcgaacgaggguca

SEQ ID NO: 1142407 - RNA, 22 nt, Human
cuuaagacaggcucaaagauua

SEQ ID NO: 1142408 - RNA, 22 nt, Human
gcacaguauuuaguagaaugag

SEQ ID NO: 1142409 - RNA, 22 nt, Human
uuuauacuccacucugcaagcg

SEQ ID NO: 1142410 - RNA, 22 nt, Human
aaaucugagaaauauuguccag

SEQ ID NO: 1142411 - RNA, 22 nt, Human
uuguauuaaaauguguuucugu

SEQ ID NO: 1142412 - RNA, 22 nt, Human
ucugguuucccaguuccuccgu

SEQ ID NO: 1142413 - RNA, 22 nt, Human
ugaaucaaugaauugcacuuca

SEQ ID NO: 1142414 - RNA, 22 nt, Human
cacauuuaaagguugaagcuga

SEQ ID NO: 1142415 - RNA, 22 nt, Human
guugugcaaacacuggggucug

SEQ ID NO: 1142416 - RNA, 22 nt, Human
caagauauguccuguuacuaag

SEQ ID NO: 1142417 - RNA, 14 nt, Human
accacgcccggcua

SEQ ID NO: 1142418 - RNA, 20 nt, Human
accacgcccggcuaauuuuu

SEQ ID NO: 1142419 - RNA, 22 nt, Human
accccaaaauuagccaguaauc

SEQ ID NO: 1142420 - RNA, 23 nt, Human
accccaaaauuagccaguaaucc

SEQ ID NO: 1142421 - RNA, 18 nt, Human
accccgaccaccugccca

SEQ ID NO: 1142422 - RNA, 22 nt, Human
accccuaaagagauacuuugau

SEQ ID NO: 1142423 - RNA, 21 nt, Human
acaaguaugaauaaagacacc

SEQ ID NO: 1142424 - RNA, 23 nt, Human
acaaguaugaauaaagacaccua

SEQ ID NO: 1142425 - RNA, 13 nt, Human
aauuuuaucugcc

SEQ ID NO: 1142426 - RNA, 18 nt, Human
acaacuaugauuuggaaa

SEQ ID NO: 1142427 - RNA, 17 nt, Human
acacgcuccuuccucug

SEQ ID NO: 1142428 - RNA, 19 nt, Human
acacgcuccuuccucugag

SEQ ID NO: 1142429 - RNA, 21 nt, Human
acaauuagauaaauguccauu

SEQ ID NO: 1142430 - RNA, 21 nt, Human
acagaacacauaauucaggaa

SEQ ID NO: 1142431 - RNA, 14 nt, Human
acagcaucucagcu

SEQ ID NO: 1142432 - RNA, 15 nt, Human
acagcaucucagcuc

SEQ ID NO: 1142433 - RNA, 21 nt, Human
acagcugcucaauaaaguaca

SEQ ID NO: 1142434 - RNA, 21 nt, Human
acaggguaacuaacuaaaaca

SEQ ID NO: 1142435 - RNA, 22 nt, Human
acaggguaacuaacuaaaacaa

SEQ ID NO: 1142436 - RNA, 21 nt, Human
acaggugugagccaccacgcc

SEQ ID NO: 1142437 - RNA, 22 nt, Human
acaggugugagccaccacgccc

SEQ ID NO: 1142438 - RNA, 14 nt, Human
acuagcuauggugu

SEQ ID NO: 1142439 - RNA, 15 nt, Human
acuaggguccugggg

SEQ ID NO: 1142440 - RNA, 16 nt, Human
acuaggguccugggga

SEQ ID NO: 1142441 - RNA, 14 nt, Human
acucaguggggagg

SEQ ID NO: 1142442 - RNA, 20 nt, Human
accugccccuccucucugcc

SEQ ID NO: 1142443 - RNA, 22 nt, Human
accugccccuccucucugcccu

SEQ ID NO: 1142444 - RNA, 12 nt, Human
accuuuauucug

SEQ ID NO: 1142445 - RNA, 13 nt, Human
accuuuauucugg

SEQ ID NO: 1142446 - RNA, 21 nt, Human
accugcccaaccugcucuccu

SEQ ID NO: 1142447 - RNA, 14 nt, Human
accugccccuccuc

SEQ ID NO: 1142448 - RNA, 18 nt, Human
accugccccuccucucug

SEQ ID NO: 1142449 - RNA, 17 nt, Human
acuaauacagcugagcu

SEQ ID NO: 1142450 - RNA, 22 nt, Human
acgugauuagugaaaggaagau

SEQ ID NO: 1142451 - RNA, 14 nt, Human
agaaaauaacaaua

SEQ ID NO: 1142452 - RNA, 21 nt, Human
acugguggcccgacagccugg

SEQ ID NO: 1142453 - RNA, 22 nt, Human
acugguggcccgacagccuggc

SEQ ID NO: 1142454 - RNA, 23 nt, Human
acugguggcccgacagccuggca

SEQ ID NO: 1142455 - RNA, 19 nt, Human
acugucucaagagggcacu

SEQ ID NO: 1142456 - RNA, 20 nt, Human
acugaaguaaaacaaacaau

SEQ ID NO: 1142457 - RNA, 19 nt, Human
acugcccccucugcccugc

SEQ ID NO: 1142458 - RNA, 20 nt, Human
acugcccccucugcccugcg

SEQ ID NO: 1142459 - RNA, 17 nt, Human
acuguuguuaucuguuu

SEQ ID NO: 1142460 - RNA, 13 nt, Human
acuguuuucuagu

SEQ ID NO: 1142461 - RNA, 17 nt, Human
acuguuuucuaguguau

SEQ ID NO: 1142462 - RNA, 18 nt, Human
acuguuuucuaguguauc

SEQ ID NO: 1142463 - RNA, 19 nt, Human
acuguuuucuaguguauca

SEQ ID NO: 1142464 - RNA, 20 nt, Human
acuguuuucuaguguaucaa

SEQ ID NO: 1142465 - RNA, 21 nt, Human
acuguuuucuaguguaucaaa

SEQ ID NO: 1142466 - RNA, 23 nt, Human
acuguuuucuaguguaucaaaau

SEQ ID NO: 1142467 - RNA, 24 nt, Human
acuguuuucuaguguaucaaaaug

SEQ ID NO: 1142468 - RNA, 20 nt, Human
acuuguaaaugugguaaaga

SEQ ID NO: 1142469 - RNA, 18 nt, Human
acuuguaaaugugguaaa

SEQ ID NO: 1142470 - RNA, 19 nt, Human
acuuguaaaggaauuuaaa

SEQ ID NO: 1142471 - RNA, 20 nt, Human
acuuguaaaggaauuuaaaa

SEQ ID NO: 1142472 - RNA, 18 nt, Human
aauccaggguggugguga

SEQ ID NO: 1142473 - RNA, 19 nt, Human
aaugaagacaaaacauaca

SEQ ID NO: 1142474 - RNA, 21 nt, Human
aaugaucugauugaccguguu

SEQ ID NO: 1142475 - RNA, 22 nt, Human
aauggucuuucuaaugugugaa

SEQ ID NO: 1142476 - RNA, 16 nt, Human
aaugucucacugagca

SEQ ID NO: 1142477 - RNA, 19 nt, Human
aaugucucacugagcacug

SEQ ID NO: 1142478 - RNA, 22 nt, Human
aaugucucacugagcacuguuu

SEQ ID NO: 1142479 - RNA, 21 nt, Human
aauaauccuaaacauaugaau

SEQ ID NO: 1142480 - RNA, 23 nt, Human
aauaaaauuaaagcugaaaacug

SEQ ID NO: 1142481 - RNA, 12 nt, Human
aagcugcucaac

SEQ ID NO: 1142482 - RNA, 23 nt, Human
aagcugcucaacuugcaaaauca

SEQ ID NO: 1142483 - RNA, 20 nt, Human
aagcugcucaacuugcaaaa

SEQ ID NO: 1142484 - RNA, 18 nt, Human
aaggacccggaggggccu

SEQ ID NO: 1142485 - RNA, 21 nt, Human
aaggacccggaggggccuggc

SEQ ID NO: 1142486 - RNA, 18 nt, Human
aaggacuaggguccuggg

SEQ ID NO: 1142487 - RNA, 20 nt, Human
aaggacuaggguccugggga

SEQ ID NO: 1142488 - RNA, 11 nt, Human
aaacugccccc

SEQ ID NO: 1142489 - RNA, 22 nt, Human
aaacagauguccaucagaugac

SEQ ID NO: 1142490 - RNA, 14 nt, Human
aaacagauguccau

SEQ ID NO: 1142491 - RNA, 22 nt, Human
aaauaaaauuaaagcugaaaac

SEQ ID NO: 1142492 - RNA, 12 nt, Human
aaauaacaauga

SEQ ID NO: 1142493 - RNA, 22 nt, Human
aaauacuguuuuuaacaacuau

SEQ ID NO: 1142494 - RNA, 14 nt, Human
aaauacuugucugu

SEQ ID NO: 1142495 - RNA, 16 nt, Human
aaauacuugucuguuu

SEQ ID NO: 1142496 - RNA, 19 nt, Human
aaauacuugucuguuuuaa

SEQ ID NO: 1142497 - RNA, 14 nt, Human
aaauagaauguaaa

SEQ ID NO: 1142498 - RNA, 17 nt, Human
aaauagaauguaaaugu

SEQ ID NO: 1142499 - RNA, 21 nt, Human
aaauagaauguaaaugucuca

SEQ ID NO: 1142500 - RNA, 19 nt, Human
aaauagaauguaaaugucu

SEQ ID NO: 1142501 - RNA, 13 nt, Human
aaauaguaaaaau

SEQ ID NO: 1142502 - RNA, 16 nt, Human
aaauaguaaaaauaaa

SEQ ID NO: 1142503 - RNA, 14 nt, Human
aaaucuuccaauuu

SEQ ID NO: 1142504 - RNA, 12 nt, Human
aaaucuuccaau

SEQ ID NO: 1142505 - RNA, 18 nt, Human
aaauugcauuuccugaca

SEQ ID NO: 1142506 - RNA, 12 nt, Human
aaauuggagaaa

SEQ ID NO: 1142507 - RNA, 16 nt, Human
aacaaagccacuuuca

SEQ ID NO: 1142508 - RNA, 13 nt, Human
aacagcucgacuu

SEQ ID NO: 1142509 - RNA, 12 nt, Human
aacaugcagaac

SEQ ID NO: 1142510 - RNA, 19 nt, Human
aacaugcagaacaaaugaa

SEQ ID NO: 1142511 - RNA, 20 nt, Human
aacaugcagaacaaaugaag

SEQ ID NO: 1142512 - RNA, 22 nt, Human
aaccacuggaaaguuuaugguu

SEQ ID NO: 1142513 - RNA, 16 nt, Human
aacugaacucugacaa

SEQ ID NO: 1142514 - RNA, 19 nt, Human
aacugaacucugacaacag

SEQ ID NO: 1142515 - RNA, 20 nt, Human
aacugaacucugacaacaga

SEQ ID NO: 1142516 - RNA, 23 nt, Human
aacugaacucugacaacagacuu

SEQ ID NO: 1142517 - RNA, 19 nt, Human
aacugacaagcuccauuua

SEQ ID NO: 1142518 - RNA, 20 nt, Human
aacugacaagcuccauuuaa

SEQ ID NO: 1142519 - RNA, 14 nt, Human
aacugaccagccuc

SEQ ID NO: 1142520 - RNA, 19 nt, Human
aacugaccagccuccaugc

SEQ ID NO: 1142521 - RNA, 21 nt, Human
aacuuagcauuuucugcaucu

SEQ ID NO: 1142522 - RNA, 23 nt, Human
aacuuagcauuuucugcaucucc

SEQ ID NO: 1142523 - RNA, 13 nt, Human
aagaaaucuauuu

SEQ ID NO: 1142524 - RNA, 19 nt, Human
auauacucaagagugguau

SEQ ID NO: 1142525 - RNA, 12 nt, Human
auaguauaaacc

SEQ ID NO: 1142526 - RNA, 19 nt, Human
auaccugaaugcucuguag

SEQ ID NO: 1142527 - RNA, 22 nt, Human
auacccccugcaaagcccagcu

SEQ ID NO: 1142528 - RNA, 18 nt, Human
agugauucucaugccuca

SEQ ID NO: 1142529 - RNA, 19 nt, Human
agugauucucaugccucag

SEQ ID NO: 1142530 - RNA, 18 nt, Human
agucaaggguaggguggg

SEQ ID NO: 1142531 - RNA, 15 nt, Human
auguacauagugcua

SEQ ID NO: 1142532 - RNA, 17 nt, Human
auguacauagugcuaac

SEQ ID NO: 1142533 - RNA, 18 nt, Human
auguacauagugcuaaca

SEQ ID NO: 1142534 - RNA, 15 nt, Human
augucaagauucagc

SEQ ID NO: 1142535 - RNA, 16 nt, Human
augucaagauucagcu

SEQ ID NO: 1142536 - RNA, 17 nt, Human
augucaagauucagcua

SEQ ID NO: 1142537 - RNA, 18 nt, Human
augucaagauucagcuag

SEQ ID NO: 1142538 - RNA, 14 nt, Human
augucaagggcagc

SEQ ID NO: 1142539 - RNA, 21 nt, Human
augucaagggcagcuuugcuc

SEQ ID NO: 1142540 - RNA, 23 nt, Human
augucaagggcagcuuugcucau

SEQ ID NO: 1142541 - RNA, 16 nt, Human
auguggugaaaagcag

SEQ ID NO: 1142542 - RNA, 20 nt, Human
auguggugaaaagcagguug

SEQ ID NO: 1142543 - RNA, 13 nt, Human
auguuugcauaua

SEQ ID NO: 1142544 - RNA, 15 nt, Human
auguuugcauauaag

SEQ ID NO: 1142545 - RNA, 14 nt, Human
auguuugcauauaa

SEQ ID NO: 1142546 - RNA, 11 nt, Human
augaugugcuu

SEQ ID NO: 1142547 - RNA, 13 nt, Human
augaugugcuuaa

SEQ ID NO: 1142548 - RNA, 16 nt, Human
augaugugugaaaacu

SEQ ID NO: 1142549 - RNA, 13 nt, Human
auggaaauguuua

SEQ ID NO: 1142550 - RNA, 16 nt, Human
auggaggaaaaccaag

SEQ ID NO: 1142551 - RNA, 14 nt, Human
aucccggcugcccu

SEQ ID NO: 1142552 - RNA, 15 nt, Human
aucccggcugcccuu

SEQ ID NO: 1142553 - RNA, 15 nt, Human
auccuuugugaaaaa

SEQ ID NO: 1142554 - RNA, 12 nt, Human
aucaccugcccu

SEQ ID NO: 1142555 - RNA, 13 nt, Human
aucaccugcccug

SEQ ID NO: 1142556 - RNA, 15 nt, Human
aucugggccagaauu

SEQ ID NO: 1142557 - RNA, 17 nt, Human
aucugggccagaauuuc

SEQ ID NO: 1142558 - RNA, 22 nt, Human
aucuuauaauuuaaaauaugcu

SEQ ID NO: 1142559 - RNA, 22 nt, Human
aucuuccaauuuaguuguugua

SEQ ID NO: 1142560 - RNA, 17 nt, Human
augacuccauagaccuu

SEQ ID NO: 1142561 - RNA, 16 nt, Human
agaugggacaauuaga

SEQ ID NO: 1142562 - RNA, 13 nt, Human
agccccacuuacc

SEQ ID NO: 1142563 - RNA, 17 nt, Human
agccccacuuaccgcgu

SEQ ID NO: 1142564 - RNA, 23 nt, Human
agccccauaauuuuuuuuuuccu

SEQ ID NO: 1142565 - RNA, 21 nt, Human
agauaggucagugcaaauacu

SEQ ID NO: 1142566 - RNA, 23 nt, Human
agauggcugugccucugccuguc

SEQ ID NO: 1142567 - RNA, 15 nt, Human
agagcccuucauuug

SEQ ID NO: 1142568 - RNA, 14 nt, Human
agagaguggcuccu

SEQ ID NO: 1142569 - RNA, 16 nt, Human
agagaguggcuccucc

SEQ ID NO: 1142570 - RNA, 17 nt, Human
agagaguggcuccuccc

SEQ ID NO: 1142571 - RNA, 16 nt, Human
agagagcuucuguugc

SEQ ID NO: 1142572 - RNA, 20 nt, Human
agagagcuucuguugcugcc

SEQ ID NO: 1142573 - RNA, 23 nt, Human
agagagcuucuguugcugccuca

SEQ ID NO: 1142574 - RNA, 17 nt, Human
agguaaucgaccugccu

SEQ ID NO: 1142575 - RNA, 18 nt, Human
agguaaucgaccugccuc

SEQ ID NO: 1142576 - RNA, 19 nt, Human
agguaaucgaccugccucg

SEQ ID NO: 1142577 - RNA, 20 nt, Human
aggcugaacuuguuuucugg

SEQ ID NO: 1142578 - RNA, 21 nt, Human
aggcugaacuuguuuucuggg

SEQ ID NO: 1142579 - RNA, 17 nt, Human
aggacccggaggggccu

SEQ ID NO: 1142580 - RNA, 14 nt, Human
aggcacugcugccc

SEQ ID NO: 1142581 - RNA, 16 nt, Human
aggcacugcugcccag

SEQ ID NO: 1142582 - RNA, 22 nt, Human
aggcacugcugcccagccucca

SEQ ID NO: 1142583 - RNA, 21 nt, Human
agcugacaaaauacuugucug

SEQ ID NO: 1142584 - RNA, 16 nt, Human
agcugacaaaauacuu

SEQ ID NO: 1142585 - RNA, 14 nt, Human
agcuggguuggaaa

SEQ ID NO: 1142586 - RNA, 21 nt, Human
agcuucuguugcugccucaug

SEQ ID NO: 1142587 - RNA, 22 nt, Human
agcuucuguugcugccucaugc

SEQ ID NO: 1142588 - RNA, 17 nt, Human
aggaaauccaggguggu

SEQ ID NO: 1142589 - RNA, 22 nt, Human
aggaacguaaucguguccccua

SEQ ID NO: 1142590 - RNA, 23 nt, Human
agcuucuguugcugccucaugcu

SEQ ID NO: 1142591 - RNA, 13 nt, Human
agcuuuucccuuc

SEQ ID NO: 1142592 - RNA, 16 nt, Human
agcuuuucccuucuuu

SEQ ID NO: 1142593 - RNA, 12 nt, Human
cagaacaaauga

SEQ ID NO: 1142594 - RNA, 14 nt, Human
cagaacaaaugaag

SEQ ID NO: 1142595 - RNA, 16 nt, Human
cagaacaaaugaagac

SEQ ID NO: 1142596 - RNA, 15 nt, Human
cagaacacauaauuc

SEQ ID NO: 1142597 - RNA, 15 nt, Human
cagaaguuucucagc

SEQ ID NO: 1142598 - RNA, 22 nt, Human
cagaauauuagugaccucagcu

SEQ ID NO: 1142599 - RNA, 21 nt, Human
cacuuucaaucuucaauccuu

SEQ ID NO: 1142600 - RNA, 13 nt, Human
cacugguggcccg

SEQ ID NO: 1142601 - RNA, 21 nt, Human
cacugguggcccgacagccug

SEQ ID NO: 1142602 - RNA, 22 nt, Human
cacugguggcccgacagccugg

SEQ ID NO: 1142603 - RNA, 21 nt, Human
cacuguuucacuacucagcau

SEQ ID NO: 1142604 - RNA, 22 nt, Human
cacuguuucacuacucagcaug

SEQ ID NO: 1142605 - RNA, 17 nt, Human
cacuuagaaauugcauu

SEQ ID NO: 1142606 - RNA, 19 nt, Human
cacuuagaaauugcauuuc

SEQ ID NO: 1142607 - RNA, 24 nt, Human
cacuuagaaauugcauuuccugac

SEQ ID NO: 1142608 - RNA, 20 nt, Human
cacuuagaaauugcauuucc

SEQ ID NO: 1142609 - RNA, 20 nt, Human
caccuaccaccacgcccggc

SEQ ID NO: 1142610 - RNA, 14 nt, Human
caccuuuauucugg

SEQ ID NO: 1142611 - RNA, 14 nt, Human
cacuacucagcaug

SEQ ID NO: 1142612 - RNA, 13 nt, Human
cacuacucagcau

SEQ ID NO: 1142613 - RNA, 16 nt, Human
caauaaaccaaugaac

SEQ ID NO: 1142614 - RNA, 19 nt, Human
caauaaaccaaugaacgaa

SEQ ID NO: 1142615 - RNA, 20 nt, Human
caauaaaccaaugaacgaag

SEQ ID NO: 1142616 - RNA, 13 nt, Human
caagauucagcua

SEQ ID NO: 1142617 - RNA, 17 nt, Human
caauucuccugccucag

SEQ ID NO: 1142618 - RNA, 19 nt, Human
caauucuccugccucagcc

SEQ ID NO: 1142619 - RNA, 13 nt, Human
auucaagauuccc

SEQ ID NO: 1142620 - RNA, 12 nt, Human
auucaagauucc

SEQ ID NO: 1142621 - RNA, 16 nt, Human
auucaauuugaugugg

SEQ ID NO: 1142622 - RNA, 21 nt, Human
auucaauuugauguggugaaa

SEQ ID NO: 1142623 - RNA, 14 nt, Human
auugaugauccauu

SEQ ID NO: 1142624 - RNA, 23 nt, Human
auuguaauaggcguaacuaauuu

SEQ ID NO: 1142625 - RNA, 23 nt, Human
auuuauaccucaauuuucacugu

SEQ ID NO: 1142626 - RNA, 16 nt, Human
auuucagcagcugcag

SEQ ID NO: 1142627 - RNA, 13 nt, Human
caaaugcagcuuu

SEQ ID NO: 1142628 - RNA, 14 nt, Human
caaccauuccccau

SEQ ID NO: 1142629 - RNA, 17 nt, Human
caacuaugauuuggaaa

SEQ ID NO: 1142630 - RNA, 18 nt, Human
caacuaugauuuggaaaa

SEQ ID NO: 1142631 - RNA, 19 nt, Human
caacuaugauuuggaaaau

SEQ ID NO: 1142632 - RNA, 22 nt, Human
caacuaugauuuggaaaauaaa

SEQ ID NO: 1142633 - RNA, 13 nt, Human
caagacacaguga

SEQ ID NO: 1142634 - RNA, 21 nt, Human
auuuuaucugccucucuugua

SEQ ID NO: 1142635 - RNA, 22 nt, Human
auuuuaucugccucucuuguaa

SEQ ID NO: 1142636 - RNA, 17 nt, Human
auuuuauagcuacuaau

SEQ ID NO: 1142637 - RNA, 19 nt, Human
cagauccccaagccuggca

SEQ ID NO: 1142638 - RNA, 15 nt, Human
cagagguccacaaca

SEQ ID NO: 1142639 - RNA, 20 nt, Human
cagagguccacaacacacag

SEQ ID NO: 1142640 - RNA, 15 nt, Human
caggccacuugauga

SEQ ID NO: 1142641 - RNA, 22 nt, Human
cagguugucugaagucacugca

SEQ ID NO: 1142642 - RNA, 23 nt, Human
cagguugucugaagucacugcac

SEQ ID NO: 1142643 - RNA, 12 nt, Human
cagugcaucuca

SEQ ID NO: 1142644 - RNA, 15 nt, Human
cagugcaucucagcc

SEQ ID NO: 1142645 - RNA, 16 nt, Human
cagugcaucucagccc

SEQ ID NO: 1142646 - RNA, 17 nt, Human
cagugcaucucagccca

SEQ ID NO: 1142647 - RNA, 18 nt, Human
cagugcaucucagcccac

SEQ ID NO: 1142648 - RNA, 20 nt, Human
caguggggaggggcuguggg

SEQ ID NO: 1142649 - RNA, 18 nt, Human
cauauggauccacuggcu

SEQ ID NO: 1142650 - RNA, 17 nt, Human
cauauggauccacuggc

SEQ ID NO: 1142651 - RNA, 13 nt, Human
cauauuaagaaug

SEQ ID NO: 1142652 - RNA, 19 nt, Human
cauauuaagaaugaucuga

SEQ ID NO: 1142653 - RNA, 15 nt, Human
cauauuaagaaugau

SEQ ID NO: 1142654 - RNA, 21 nt, Human
cauucuagagugcauauauuu

SEQ ID NO: 1142655 - RNA, 14 nt, Human
caugucaaacguga

SEQ ID NO: 1142656 - RNA, 19 nt, Human
caugucaaacgugaaaaug

SEQ ID NO: 1142657 - RNA, 16 nt, Human
caugucccuaccgagu

SEQ ID NO: 1142658 - RNA, 22 nt, Human
caugucccuaccgagucucuuc

SEQ ID NO: 1142659 - RNA, 23 nt, Human
caugucccuaccgagucucuucu

SEQ ID NO: 1142660 - RNA, 14 nt, Human
cauguuaguaauac

SEQ ID NO: 1142661 - RNA, 16 nt, Human
cauguuaguaauaccu

SEQ ID NO: 1142662 - RNA, 17 nt, Human
cauguuaguaauaccuc

SEQ ID NO: 1142663 - RNA, 18 nt, Human
cauguuaguaauaccucu

SEQ ID NO: 1142664 - RNA, 19 nt, Human
cauguuaguaauaccucua

SEQ ID NO: 1142665 - RNA, 20 nt, Human
cauguuaguaauaccucuaa

SEQ ID NO: 1142666 - RNA, 24 nt, Human
cauguuaguaauaccucuaauagu

SEQ ID NO: 1142667 - RNA, 20 nt, Human
cauguuggccaggcugcucu

SEQ ID NO: 1142668 - RNA, 13 nt, Human
caugauuucaugu

SEQ ID NO: 1142669 - RNA, 14 nt, Human
caugauuucaugua

SEQ ID NO: 1142670 - RNA, 16 nt, Human
caugauuucauguacu

SEQ ID NO: 1142671 - RNA, 17 nt, Human
caugauuucauguacug

SEQ ID NO: 1142672 - RNA, 19 nt, Human
caugauuucauguacugca

SEQ ID NO: 1142673 - RNA, 20 nt, Human
caugauuucauguacugcau

SEQ ID NO: 1142674 - RNA, 17 nt, Human
cauuuguggguuuuuau

SEQ ID NO: 1142675 - RNA, 23 nt, Human
cauuuguggguuuuuauuuccua

SEQ ID NO: 1142676 - RNA, 22 nt, Human
cauuuguggguuuuuauuuccu

SEQ ID NO: 1142677 - RNA, 13 nt, Human
ccacgcccggcua

SEQ ID NO: 1142678 - RNA, 14 nt, Human
ccacagcugcucaa

SEQ ID NO: 1142679 - RNA, 17 nt, Human
cuccacuuggcauuagc

SEQ ID NO: 1142680 - RNA, 13 nt, Human
cucagucucccuc

SEQ ID NO: 1142681 - RNA, 15 nt, Human
cucagucucccuccc

SEQ ID NO: 1142682 - RNA, 16 nt, Human
cucagucucccucccu

SEQ ID NO: 1142683 - RNA, 17 nt, Human
cucagucucccucccuu

SEQ ID NO: 1142684 - RNA, 12 nt, Human
cucaugccucag

SEQ ID NO: 1142685 - RNA, 16 nt, Human
cucaugccucagccuc

SEQ ID NO: 1142686 - RNA, 14 nt, Human
cuccaagcuccauc

SEQ ID NO: 1142687 - RNA, 18 nt, Human
cuccaagcuccaucucca

SEQ ID NO: 1142688 - RNA, 19 nt, Human
cuccaagcuccaucuccac

SEQ ID NO: 1142689 - RNA, 13 nt, Human
cucccccaucucu

SEQ ID NO: 1142690 - RNA, 13 nt, Human
cuccucucugccc

SEQ ID NO: 1142691 - RNA, 14 nt, Human
cuccucucugcccu

SEQ ID NO: 1142692 - RNA, 15 nt, Human
cuccucucugcccua

SEQ ID NO: 1142693 - RNA, 19 nt, Human
cuccucucugcccuaaugc

SEQ ID NO: 1142694 - RNA, 18 nt, Human
cuccucuucaacugacca

SEQ ID NO: 1142695 - RNA, 23 nt, Human
cuccucuucaacugaccagccuc

SEQ ID NO: 1142696 - RNA, 15 nt, Human
cuccuggacuccugc

SEQ ID NO: 1142697 - RNA, 18 nt, Human
cuccuggggguucuuucu

SEQ ID NO: 1142698 - RNA, 20 nt, Human
cuccuggggguucuuucuuc

SEQ ID NO: 1142699 - RNA, 22 nt, Human
cuccuggggguucuuucuuccu

SEQ ID NO: 1142700 - RNA, 23 nt, Human
cuccuggggguucuuucuuccuc

SEQ ID NO: 1142701 - RNA, 15 nt, Human
cucuaucaccaagga

SEQ ID NO: 1142702 - RNA, 12 nt, Human
cucuguccaggc

SEQ ID NO: 1142703 - RNA, 13 nt, Human
cucuuauuucauc

SEQ ID NO: 1142704 - RNA, 14 nt, Human
cucuuauuucauca

SEQ ID NO: 1142705 - RNA, 16 nt, Human
cucuucaacugaccag

SEQ ID NO: 1142706 - RNA, 17 nt, Human
cucuucaacugaccagc

SEQ ID NO: 1142707 - RNA, 20 nt, Human
cucuucaacugaccagccuc

SEQ ID NO: 1142708 - RNA, 16 nt, Human
cugacaaaauacuugu

SEQ ID NO: 1142709 - RNA, 15 nt, Human
cugacaacagacuuc

SEQ ID NO: 1142710 - RNA, 18 nt, Human
cugacaacagacuucuga

SEQ ID NO: 1142711 - RNA, 19 nt, Human
cugacaacagacuucugaa

SEQ ID NO: 1142712 - RNA, 18 nt, Human
cugacaagcuccauuuaa

SEQ ID NO: 1142713 - RNA, 13 nt, Human
cugacaagcucca

SEQ ID NO: 1142714 - RNA, 14 nt, Human
cugaggaccagcca

SEQ ID NO: 1142715 - RNA, 22 nt, Human
cugaggacuuaaaauauuccug

SEQ ID NO: 1142716 - RNA, 14 nt, Human
cugaguagcuggga

SEQ ID NO: 1142717 - RNA, 15 nt, Human
cugaguagcugggau

SEQ ID NO: 1142718 - RNA, 20 nt, Human
cugaguagcugggauuacag

SEQ ID NO: 1142719 - RNA, 23 nt, Human
cgguguuuaagacauuuuuggaa

SEQ ID NO: 1142720 - RNA, 16 nt, Human
cgagucucuucuccac

SEQ ID NO: 1142721 - RNA, 13 nt, Human
cgcaggcuggccc

SEQ ID NO: 1142722 - RNA, 15 nt, Human
ccuuucacaaccuuc

SEQ ID NO: 1142723 - RNA, 12 nt, Human
cgacagccuggc

SEQ ID NO: 1142724 - RNA, 13 nt, Human
cgacagccuggca

SEQ ID NO: 1142725 - RNA, 14 nt, Human
cgacagccuggcac

SEQ ID NO: 1142726 - RNA, 11 nt, Human
cuacucagcau

SEQ ID NO: 1142727 - RNA, 11 nt, Human
cgugugugugu

SEQ ID NO: 1142728 - RNA, 17 nt, Human
cuacguuaccaggcagg

SEQ ID NO: 1142729 - RNA, 15 nt, Human
cucaauuuucacugu

SEQ ID NO: 1142730 - RNA, 11 nt, Human
cucacaaaaga

SEQ ID NO: 1142731 - RNA, 17 nt, Human
cucaauuuucacugugu

SEQ ID NO: 1142732 - RNA, 20 nt, Human
cucaauaaaauuauagcucu

SEQ ID NO: 1142733 - RNA, 14 nt, Human
cucaauaaaguaca

SEQ ID NO: 1142734 - RNA, 17 nt, Human
ccugccccagggcuccc

SEQ ID NO: 1142735 - RNA, 18 nt, Human
ccugugacuucagcucug

SEQ ID NO: 1142736 - RNA, 16 nt, Human
ccugugaacugaacuc

SEQ ID NO: 1142737 - RNA, 17 nt, Human
ccugugaacugaacucu

SEQ ID NO: 1142738 - RNA, 13 nt, Human
ccugguuuccugc

SEQ ID NO: 1142739 - RNA, 14 nt, Human
ccugguuuccugcc

SEQ ID NO: 1142740 - RNA, 16 nt, Human
ccugguuuccugcccu

SEQ ID NO: 1142741 - RNA, 15 nt, Human
ccugguuuccugccc

SEQ ID NO: 1142742 - RNA, 17 nt, Human
ccuguccugccuaaggc

SEQ ID NO: 1142743 - RNA, 19 nt, Human
ccuguccugccuaaggcug

SEQ ID NO: 1142744 - RNA, 20 nt, Human
ccugggccccaguuguauuu

SEQ ID NO: 1142745 - RNA, 23 nt, Human
ccucauuuuugaauacaggcaua

SEQ ID NO: 1142746 - RNA, 13 nt, Human
cccucagagccac

SEQ ID NO: 1142747 - RNA, 12 nt, Human
cccggcugcccu

SEQ ID NO: 1142748 - RNA, 13 nt, Human
cccggcugcccuu

SEQ ID NO: 1142749 - RNA, 15 nt, Human
ccccugcaaagccca

SEQ ID NO: 1142750 - RNA, 16 nt, Human
ccccugcaaagcccag

SEQ ID NO: 1142751 - RNA, 17 nt, Human
ccccugcaaagcccagc

SEQ ID NO: 1142752 - RNA, 23 nt, Human
cccauaauuuuuuuuuuccuuuu

SEQ ID NO: 1142753 - RNA, 22 nt, Human
cccauaauuuuuuuuuuccuuu

SEQ ID NO: 1142754 - RNA, 14 nt, Human
ccagucccccugcc

SEQ ID NO: 1142755 - RNA, 22 nt, Human
ccaggauguacaaggacagccc

SEQ ID NO: 1142756 - RNA, 17 nt, Human
ccaggcaacuugggaac

SEQ ID NO: 1142757 - RNA, 18 nt, Human
ccagcuugaaaccuucac

SEQ ID NO: 1142758 - RNA, 20 nt, Human
ccagcuugaaaccuucacuu

SEQ ID NO: 1142759 - RNA, 20 nt, Human
ccauaauuuuuuuuuuccuu

SEQ ID NO: 1142760 - RNA, 12 nt, Human
cugcccuggugc

SEQ ID NO: 1142761 - RNA, 13 nt, Human
cugcccuggugcu

SEQ ID NO: 1142762 - RNA, 14 nt, Human
cugcccuggugcug

SEQ ID NO: 1142763 - RNA, 15 nt, Human
cugcccuggugcugc

SEQ ID NO: 1142764 - RNA, 16 nt, Human
cugcccuggugcugcc

SEQ ID NO: 1142765 - RNA, 17 nt, Human
cugcccugguuuccugc

SEQ ID NO: 1142766 - RNA, 18 nt, Human
cugcccugguuuccugcc

SEQ ID NO: 1142767 - RNA, 19 nt, Human
cugcccugguuuccugccc

SEQ ID NO: 1142768 - RNA, 21 nt, Human
cugcccugguuuccugcccug

SEQ ID NO: 1142769 - RNA, 20 nt, Human
cugcccugguuuccugcccu

SEQ ID NO: 1142770 - RNA, 15 nt, Human
cugccuguucccauu

SEQ ID NO: 1142771 - RNA, 19 nt, Human
cugccuguucccauucuug

SEQ ID NO: 1142772 - RNA, 16 nt, Human
cugcucaacuugcaaa

SEQ ID NO: 1142773 - RNA, 22 nt, Human
cuggacuccucuguccaggcac

SEQ ID NO: 1142774 - RNA, 23 nt, Human
cuggacuccucuguccaggcacu

SEQ ID NO: 1142775 - RNA, 14 nt, Human
cuggagaacuagag

SEQ ID NO: 1142776 - RNA, 15 nt, Human
cuggagaacuagaga

SEQ ID NO: 1142777 - RNA, 17 nt, Human
cuggauccaucaggcca

SEQ ID NO: 1142778 - RNA, 19 nt, Human
cuggauccaucaggccacu

SEQ ID NO: 1142779 - RNA, 20 nt, Human
cuggaucuccauucucucag

SEQ ID NO: 1142780 - RNA, 13 nt, Human
cuggcagccgugc

SEQ ID NO: 1142781 - RNA, 17 nt, Human
cuggcagccgugccuuc

SEQ ID NO: 1142782 - RNA, 18 nt, Human
cuggcagccgugccuuca

SEQ ID NO: 1142783 - RNA, 19 nt, Human
cuggcagccgugccuucag

SEQ ID NO: 1142784 - RNA, 19 nt, Human
cuggcucccacaggcccuu

SEQ ID NO: 1142785 - RNA, 22 nt, Human
cuggcucccacaggcccuuccu

SEQ ID NO: 1142786 - RNA, 22 nt, Human
cuguagccuaaacuccaaacau

SEQ ID NO: 1142787 - RNA, 17 nt, Human
cuguaggaagguacugu

SEQ ID NO: 1142788 - RNA, 18 nt, Human
cuguaggaagguacugua

SEQ ID NO: 1142789 - RNA, 19 nt, Human
cuguaggaagguacuguau

SEQ ID NO: 1142790 - RNA, 20 nt, Human
cuguaggaagguacuguaug

SEQ ID NO: 1142791 - RNA, 21 nt, Human
cuguaggaagguacuguauga

SEQ ID NO: 1142792 - RNA, 13 nt, Human
cugugaacugaac

SEQ ID NO: 1142793 - RNA, 15 nt, Human
cugugaacugaacuc

SEQ ID NO: 1142794 - RNA, 16 nt, Human
cugugaacugaacucu

SEQ ID NO: 1142795 - RNA, 13 nt, Human
cuguucacucuac

SEQ ID NO: 1142796 - RNA, 14 nt, Human
cuguugcugccuca

SEQ ID NO: 1142797 - RNA, 13 nt, Human
cuguuguuaucug

SEQ ID NO: 1142798 - RNA, 22 nt, Human
cuguuguuaucuguuugagaaa

SEQ ID NO: 1142799 - RNA, 14 nt, Human
cuguuguuaugaug

SEQ ID NO: 1142800 - RNA, 15 nt, Human
cuguuguuaugaugu

SEQ ID NO: 1142801 - RNA, 17 nt, Human
cuguuguuaugaugugc

SEQ ID NO: 1142802 - RNA, 19 nt, Human
cuguuguuaugaugugcuu

SEQ ID NO: 1142803 - RNA, 23 nt, Human
cuguuguuaugaugugcuuaaca

SEQ ID NO: 1142804 - RNA, 21 nt, Human
cuguuguuaugaugugcuuaa

SEQ ID NO: 1142805 - RNA, 18 nt, Human
cuuaaacaguugcacagc

SEQ ID NO: 1142806 - RNA, 19 nt, Human
cuuaaacaguugcacagca

SEQ ID NO: 1142807 - RNA, 20 nt, Human
cuuaaacaguugcacagcau

SEQ ID NO: 1142808 - RNA, 22 nt, Human
cuuaaacaguugcacagcaucu

SEQ ID NO: 1142809 - RNA, 23 nt, Human
cuuaaagaauucaaauuuuaucu

SEQ ID NO: 1142810 - RNA, 15 nt, Human
cuuaaagaauucaaa

SEQ ID NO: 1142811 - RNA, 17 nt, Human
cuuaaagaauucaaauu

SEQ ID NO: 1142812 - RNA, 18 nt, Human
cuuaaagaauucaaauuu

SEQ ID NO: 1142813 - RNA, 16 nt, Human
cuuaaauacagcuuuu

SEQ ID NO: 1142814 - RNA, 20 nt, Human
cuuacauuagcaguuugcuu

SEQ ID NO: 1142815 - RNA, 14 nt, Human
cuuccauauggauc

SEQ ID NO: 1142816 - RNA, 16 nt, Human
cuuccucuccacugcc

SEQ ID NO: 1142817 - RNA, 17 nt, Human
cuuccucuccacugccu

SEQ ID NO: 1142818 - RNA, 19 nt, Human
cuuccucuccacugccuuc

SEQ ID NO: 1142819 - RNA, 21 nt, Human
cuuccucuccacugccuucga

SEQ ID NO: 1142820 - RNA, 11 nt, Human
cuuccucugcu

SEQ ID NO: 1142821 - RNA, 12 nt, Human
cuuccucugcug

SEQ ID NO: 1142822 - RNA, 13 nt, Human
cuuccucugcuga

SEQ ID NO: 1142823 - RNA, 19 nt, Human
gaaaacugcaacuuguaaa

SEQ ID NO: 1142824 - RNA, 18 nt, Human
gaaaauuaggauuucaug

SEQ ID NO: 1142825 - RNA, 22 nt, Human
gaaaauuaggauuucaugauuu

SEQ ID NO: 1142826 - RNA, 18 nt, Human
gaaagaaguggggacaga

SEQ ID NO: 1142827 - RNA, 13 nt, Human
gaaugaucugauu

SEQ ID NO: 1142828 - RNA, 16 nt, Human
gaaugaucugauugac

SEQ ID NO: 1142829 - RNA, 19 nt, Human
gacauuguagagcuucugg

SEQ ID NO: 1142830 - RNA, 16 nt, Human
gaccccugagcuugca

SEQ ID NO: 1142831 - RNA, 17 nt, Human
gacccggaggggccugg

SEQ ID NO: 1142832 - RNA, 18 nt, Human
gacccggaggggccuggc

SEQ ID NO: 1142833 - RNA, 19 nt, Human
gacccggaggggccuggca

SEQ ID NO: 1142834 - RNA, 20 nt, Human
gacccggaggggccuggcag

SEQ ID NO: 1142835 - RNA, 22 nt, Human
gaccucagguaaucgaccugcc

SEQ ID NO: 1142836 - RNA, 23 nt, Human
gaccucagguaaucgaccugccu

SEQ ID NO: 1142837 - RNA, 18 nt, Human
gacuuuuauuuccaguga

SEQ ID NO: 1142838 - RNA, 20 nt, Human
gagaaaaagaaaaaauauau

SEQ ID NO: 1142839 - RNA, 22 nt, Human
gagagcuucuguugcugccuca

SEQ ID NO: 1142840 - RNA, 15 nt, Human
gagauuauguucuuu

SEQ ID NO: 1142841 - RNA, 12 nt, Human
gagggccugggc

SEQ ID NO: 1142842 - RNA, 18 nt, Human
gauacuuugauauuuuca

SEQ ID NO: 1142843 - RNA, 19 nt, Human
gauauuuucaacgcagccc

SEQ ID NO: 1142844 - RNA, 21 nt, Human
gauauuuucaacgcagcccug

SEQ ID NO: 1142845 - RNA, 22 nt, Human
gauauuuucaacgcagcccugc

SEQ ID NO: 1142846 - RNA, 23 nt, Human
gauauuuucaacgcagcccugcu

SEQ ID NO: 1142847 - RNA, 22 nt, Human
gaucaaaccccgaccaccugcc

SEQ ID NO: 1142848 - RNA, 14 nt, Human
gaucaaauguuuaa

SEQ ID NO: 1142849 - RNA, 16 nt, Human
gaucaaauguuuaauc

SEQ ID NO: 1142850 - RNA, 20 nt, Human
gaucaaauguuuaaucauau

SEQ ID NO: 1142851 - RNA, 18 nt, Human
gaucaaauguuuaaucau

SEQ ID NO: 1142852 - RNA, 19 nt, Human
gauccacuggcuggacaaa

SEQ ID NO: 1142853 - RNA, 13 nt, Human
gauccacuggcug

SEQ ID NO: 1142854 - RNA, 17 nt, Human
gaucugaugcaagcaag

SEQ ID NO: 1142855 - RNA, 16 nt, Human
gaucugauugaccgug

SEQ ID NO: 1142856 - RNA, 23 nt, Human
gaucugauugaccguguuggucu

SEQ ID NO: 1142857 - RNA, 13 nt, Human
gcaaaaucaguuu

SEQ ID NO: 1142858 - RNA, 15 nt, Human
gcaaaaucaguuuuc

SEQ ID NO: 1142859 - RNA, 20 nt, Human
gcaaccuucgccaccugggu

SEQ ID NO: 1142860 - RNA, 17 nt, Human
gcauccuccgccucccg

SEQ ID NO: 1142861 - RNA, 20 nt, Human
gcaucuagcaugucgucaaa

SEQ ID NO: 1142862 - RNA, 17 nt, Human
gccauugacuucuuccc

SEQ ID NO: 1142863 - RNA, 15 nt, Human
gcccccucugcccug

SEQ ID NO: 1142864 - RNA, 16 nt, Human
gcccccucugcccugc

SEQ ID NO: 1142865 - RNA, 17 nt, Human
gcccccucugcccugcg

SEQ ID NO: 1142866 - RNA, 20 nt, Human
gcccugcgggucacaggagg

SEQ ID NO: 1142867 - RNA, 12 nt, Human
gcccuuccaugu

SEQ ID NO: 1142868 - RNA, 21 nt, Human
gcccuuccaugucgccucugc

SEQ ID NO: 1142869 - RNA, 22 nt, Human
gcccuuccaugucgccucugca

SEQ ID NO: 1142870 - RNA, 12 nt, Human
gcccuuccucuc

SEQ ID NO: 1142871 - RNA, 14 nt, Human
gcccuuccucucca

SEQ ID NO: 1142872 - RNA, 15 nt, Human
gcccuuccucuccac

SEQ ID NO: 1142873 - RNA, 16 nt, Human
gcccuuccucuccacu

SEQ ID NO: 1142874 - RNA, 19 nt, Human
gccucaugcuaagacucag

SEQ ID NO: 1142875 - RNA, 19 nt, Human
gccuccugaguagcuggga

SEQ ID NO: 1142876 - RNA, 14 nt, Human
gcgcaggcuggccc

SEQ ID NO: 1142877 - RNA, 15 nt, Human
gcgcaggcuggcccu

SEQ ID NO: 1142878 - RNA, 16 nt, Human
gcgcaggcuggcccug

SEQ ID NO: 1142879 - RNA, 17 nt, Human
gcgcaggcuggcccugc

SEQ ID NO: 1142880 - RNA, 15 nt, Human
gcucaacuugcaaaa

SEQ ID NO: 1142881 - RNA, 13 nt, Human
gcugccucaugcu

SEQ ID NO: 1142882 - RNA, 23 nt, Human
gcugcucuugaacuccugaccuc

SEQ ID NO: 1142883 - RNA, 11 nt, Human
gcuggcugccu

SEQ ID NO: 1142884 - RNA, 14 nt, Human
gcuggcugccuuag

SEQ ID NO: 1142885 - RNA, 20 nt, Human
gcuggcugccuuagaaccuu

SEQ ID NO: 1142886 - RNA, 14 nt, Human
gcugugccucugcc

SEQ ID NO: 1142887 - RNA, 15 nt, Human
gcugugccucugccu

SEQ ID NO: 1142888 - RNA, 16 nt, Human
gcugugccucugccug

SEQ ID NO: 1142889 - RNA, 13 nt, Human
gcuguuguuauga

SEQ ID NO: 1142890 - RNA, 14 nt, Human
gcuguuguuaugau

SEQ ID NO: 1142891 - RNA, 15 nt, Human
gcuguuguuaugaug

SEQ ID NO: 1142892 - RNA, 19 nt, Human
gcuguuguuaugaugugcu

SEQ ID NO: 1142893 - RNA, 17 nt, Human
gcuguuguuaugaugug

SEQ ID NO: 1142894 - RNA, 18 nt, Human
gcuuuuggauuggacaaa

SEQ ID NO: 1142895 - RNA, 16 nt, Human
ggaaaaaauaacaaug

SEQ ID NO: 1142896 - RNA, 16 nt, Human
ggaaauccaggguggu

SEQ ID NO: 1142897 - RNA, 19 nt, Human
ggacaggcugcggccccuc

SEQ ID NO: 1142898 - RNA, 21 nt, Human
ggacaggcugcggccccuccc

SEQ ID NO: 1142899 - RNA, 22 nt, Human
ggacaggcugcggccccucccc

SEQ ID NO: 1142900 - RNA, 15 nt, Human
ggacagggcauggcc

SEQ ID NO: 1142901 - RNA, 22 nt, Human
ggacagggcauggccagguggc

SEQ ID NO: 1142902 - RNA, 21 nt, Human
ggaucucuucuuaauguacau

SEQ ID NO: 1142903 - RNA, 22 nt, Human
ggaucucuucuuaauguacaua

SEQ ID NO: 1142904 - RNA, 16 nt, Human
ggcagccucuucaaaa

SEQ ID NO: 1142905 - RNA, 10 nt, Human
ggcagggagg

SEQ ID NO: 1142906 - RNA, 17 nt, Human
ggcagggagggccuggg

SEQ ID NO: 1142907 - RNA, 18 nt, Human
ggcagggagggccugggc

SEQ ID NO: 1142908 - RNA, 19 nt, Human
ggcagggagggccugggcc

SEQ ID NO: 1142909 - RNA, 20 nt, Human
ggcagggagggccugggccc

SEQ ID NO: 1142910 - RNA, 20 nt, Human
ggcaucgcaauguaagacuc

SEQ ID NO: 1142911 - RNA, 22 nt, Human
ggccaagagaugcagugccagg

SEQ ID NO: 1142912 - RNA, 11 nt, Human
ggccugccugu

SEQ ID NO: 1142913 - RNA, 14 nt, Human
ggccuggcagccgu

SEQ ID NO: 1142914 - RNA, 15 nt, Human
ggccuggcagccgug

SEQ ID NO: 1142915 - RNA, 17 nt, Human
ggccuucagggagugag

SEQ ID NO: 1142916 - RNA, 14 nt, Human
ggcgugagaccugc

SEQ ID NO: 1142917 - RNA, 16 nt, Human
ggcgugagaccugccc

SEQ ID NO: 1142918 - RNA, 17 nt, Human
ggcgugagaccugcccc

SEQ ID NO: 1142919 - RNA, 18 nt, Human
ggcgugagaccugccccu

SEQ ID NO: 1142920 - RNA, 20 nt, Human
ggcuaagcuucacuguaaaa

SEQ ID NO: 1142921 - RNA, 18 nt, Human
ggcuaauuuuuguuuugu

SEQ ID NO: 1142922 - RNA, 22 nt, Human
ggcuacaccuuagccugcccuc

SEQ ID NO: 1142923 - RNA, 23 nt, Human
ggcuacaccuuagccugcccucc

SEQ ID NO: 1142924 - RNA, 12 nt, Human
ggcugcccuggu

SEQ ID NO: 1142925 - RNA, 10 nt, Human
ggcugcccuu

SEQ ID NO: 1142926 - RNA, 11 nt, Human
ggcugcccuuu

SEQ ID NO: 1142927 - RNA, 14 nt, Human
ggcugcccuuucug

SEQ ID NO: 1142928 - RNA, 18 nt, Human
ggcugcccuuucugggca

SEQ ID NO: 1142929 - RNA, 20 nt, Human
aaaauacuugucuguuuuaa

SEQ ID NO: 1142930 - RNA, 22 nt, Human
aaaauaugaccacacuccagcu

SEQ ID NO: 1142931 - RNA, 15 nt, Human
aaaauauuccugcau

SEQ ID NO: 1142932 - RNA, 23 nt, Human
aaaaugcuguauuagucacagag

SEQ ID NO: 1142933 - RNA, 18 nt, Human
gggcgugagaccugcccc

SEQ ID NO: 1142934 - RNA, 19 nt, Human
gggcgugagaccugccccu

SEQ ID NO: 1142935 - RNA, 20 nt, Human
gggcuaggaaauccagggug

SEQ ID NO: 1142936 - RNA, 17 nt, Human
aaaccuucacuuaggaa

SEQ ID NO: 1142937 - RNA, 13 nt, Human
aaacgcaucuagu

SEQ ID NO: 1142938 - RNA, 15 nt, Human
gggugguggugauag

SEQ ID NO: 1142939 - RNA, 23 nt, Human
ggguuuuuauuuccuaugaugua

SEQ ID NO: 1142940 - RNA, 11 nt, Human
gguaggguggg

SEQ ID NO: 1142941 - RNA, 23 nt, Human
gguagggugggccuucagggagu

SEQ ID NO: 1142942 - RNA, 21 nt, Human
gguauaucuagguuuaugaca

SEQ ID NO: 1142943 - RNA, 19 nt, Human
gguauaucuagguuuauga

SEQ ID NO: 1142944 - RNA, 14 nt, Human
ggucagugcaaaua

SEQ ID NO: 1142945 - RNA, 17 nt, Human
aaacuucguuuaaugaa

SEQ ID NO: 1142946 - RNA, 14 nt, Human
aaacuucguuuaau

SEQ ID NO: 1142947 - RNA, 21 nt, Human
aaagcagguugauaaaucauu

SEQ ID NO: 1142948 - RNA, 12 nt, Human
gguuuccugccc

SEQ ID NO: 1142949 - RNA, 13 nt, Human
gguuuccugcccu

SEQ ID NO: 1142950 - RNA, 15 nt, Human
gguuuccugcccugg

SEQ ID NO: 1142951 - RNA, 16 nt, Human
gguuuccugcccuggg

SEQ ID NO: 1142952 - RNA, 19 nt, Human
gguuuccugcccugggagg

SEQ ID NO: 1142953 - RNA, 16 nt, Human
guaacuaacuaaaaca

SEQ ID NO: 1142954 - RNA, 17 nt, Human
guaacuaacuaaaacaa

SEQ ID NO: 1142955 - RNA, 21 nt, Human
guaauaccucuaauaguauaa

SEQ ID NO: 1142956 - RNA, 22 nt, Human
guaauaccucuaauaguauaaa

SEQ ID NO: 1142957 - RNA, 12 nt, Human
guaauccuguag

SEQ ID NO: 1142958 - RNA, 15 nt, Human
guaaucgaccugccu

SEQ ID NO: 1142959 - RNA, 17 nt, Human
guaaucgaccugccucg

SEQ ID NO: 1142960 - RNA, 21 nt, Human
guacaaaaaaaucuuccaauu

SEQ ID NO: 1142961 - RNA, 22 nt, Human
guacaaccuguucugcuuuccu

SEQ ID NO: 1142962 - RNA, 14 nt, Human
aaauauauacucaa

SEQ ID NO: 1142963 - RNA, 18 nt, Human
aaauauaugcuaagucuu

SEQ ID NO: 1142964 - RNA, 20 nt, Human
aaauauuccugcauuuguga

SEQ ID NO: 1142965 - RNA, 11 nt, Human
guauugacaaa

SEQ ID NO: 1142966 - RNA, 13 nt, Human
guauugacaaaau

SEQ ID NO: 1142967 - RNA, 15 nt, Human
guauugacaaaaugu

SEQ ID NO: 1142968 - RNA, 16 nt, Human
guauugacaaaauguu

SEQ ID NO: 1142969 - RNA, 17 nt, Human
guauugacaaaauguua

SEQ ID NO: 1142970 - RNA, 19 nt, Human
guauugacaaaauguuauu

SEQ ID NO: 1142971 - RNA, 18 nt, Human
guauugacaaaauguuau

SEQ ID NO: 1142972 - RNA, 11 nt, Human
guauuuauuca

SEQ ID NO: 1142973 - RNA, 16 nt, Human
aaaugucucacugagc

SEQ ID NO: 1142974 - RNA, 17 nt, Human
aaaugucucacugagca

SEQ ID NO: 1142975 - RNA, 14 nt, Human
aaaugucuuccugg

SEQ ID NO: 1142976 - RNA, 15 nt, Human
aaauguggcuccugg

SEQ ID NO: 1142977 - RNA, 14 nt, Human
aaauuaaucugggc

SEQ ID NO: 1142978 - RNA, 20 nt, Human
aaauuagccaguaauccugu

SEQ ID NO: 1142979 - RNA, 21 nt, Human
aaauuagccaguaauccugua

SEQ ID NO: 1142980 - RNA, 22 nt, Human
aaauuagccaguaauccuguag

SEQ ID NO: 1142981 - RNA, 18 nt, Human
aaauuaggauuucaugau

SEQ ID NO: 1142982 - RNA, 19 nt, Human
aaauuaggauuucaugauu

SEQ ID NO: 1142983 - RNA, 17 nt, Human
aaauuccaagugauuga

SEQ ID NO: 1142984 - RNA, 17 nt, Human
aaauuguauuacaaauc

SEQ ID NO: 1142985 - RNA, 18 nt, Human
aaauugucagaugcugug

SEQ ID NO: 1142986 - RNA, 17 nt, Human
gucacaggacucugccu

SEQ ID NO: 1142987 - RNA, 18 nt, Human
gucacaggacucugccuc

SEQ ID NO: 1142988 - RNA, 19 nt, Human
gucacaggacucugccucc

SEQ ID NO: 1142989 - RNA, 16 nt, Human
gucacaggagggaggg

SEQ ID NO: 1142990 - RNA, 20 nt, Human
gucacugcacagugcaucuc

SEQ ID NO: 1142991 - RNA, 23 nt, Human
gucacugcacagugcaucucagc

SEQ ID NO: 1142992 - RNA, 17 nt, Human
gucacuuuguuuuacug

SEQ ID NO: 1142993 - RNA, 18 nt, Human
guccuggagguuccccag

SEQ ID NO: 1142994 - RNA, 12 nt, Human
gucgccucugca

SEQ ID NO: 1142995 - RNA, 22 nt, Human
gucuuguuuuuuuuuuccacuu

SEQ ID NO: 1142996 - RNA, 23 nt, Human
aaccuggucacaggacucugccu

SEQ ID NO: 1142997 - RNA, 21 nt, Human
aaccuucgccaccuggguucc

SEQ ID NO: 1142998 - RNA, 12 nt, Human
aacgugaaaaug

SEQ ID NO: 1142999 - RNA, 13 nt, Human
aacuaaaacaaag

SEQ ID NO: 1143000 - RNA, 17 nt, Human
aacuaaaacaaagccac

SEQ ID NO: 1143001 - RNA, 20 nt, Human
aacuaaaacaaagccacuuu

SEQ ID NO: 1143002 - RNA, 15 nt, Human
aacuauguugauaaa

SEQ ID NO: 1143003 - RNA, 12 nt, Human
aacuccugaccu

SEQ ID NO: 1143004 - RNA, 14 nt, Human
aacuccugaccuca

SEQ ID NO: 1143005 - RNA, 22 nt, Human
gugacauguguuggcagccucu

SEQ ID NO: 1143006 - RNA, 16 nt, Human
gugacuucagcucugu

SEQ ID NO: 1143007 - RNA, 13 nt, Human
gugagaccugccc

SEQ ID NO: 1143008 - RNA, 14 nt, Human
gugagaccugcccc

SEQ ID NO: 1143009 - RNA, 15 nt, Human
gugagaccugccccu

SEQ ID NO: 1143010 - RNA, 16 nt, Human
gugagaccugccccuc

SEQ ID NO: 1143011 - RNA, 23 nt, Human
gugagaccugccccuccucucug

SEQ ID NO: 1143012 - RNA, 16 nt, Human
aacucugacaacagac

SEQ ID NO: 1143013 - RNA, 16 nt, Human
aacugcccccucugcc

SEQ ID NO: 1143014 - RNA, 17 nt, Human
aacugcccccucugccc

SEQ ID NO: 1143015 - RNA, 18 nt, Human
aacugcccccucugcccu

SEQ ID NO: 1143016 - RNA, 19 nt, Human
aacugcccccucugcccug

SEQ ID NO: 1143017 - RNA, 20 nt, Human
aacugcccccucugcccugc

SEQ ID NO: 1143018 - RNA, 21 nt, Human
aacugcccccucugcccugcg

SEQ ID NO: 1143019 - RNA, 23 nt, Human
gugaugguuccccuguucacucu

SEQ ID NO: 1143020 - RNA, 13 nt, Human
gugauuagugaaa

SEQ ID NO: 1143021 - RNA, 20 nt, Human
gugauucacagugugaaucu

SEQ ID NO: 1143022 - RNA, 16 nt, Human
aagauggcugugccuc

SEQ ID NO: 1143023 - RNA, 18 nt, Human
aagauggcugugccucug

SEQ ID NO: 1143024 - RNA, 16 nt, Human
aagcacuaaacaaaga

SEQ ID NO: 1143025 - RNA, 13 nt, Human
aagcccagcuuga

SEQ ID NO: 1143026 - RNA, 19 nt, Human
guuaauauuuauaggucac

SEQ ID NO: 1143027 - RNA, 23 nt, Human
guuacucuucaguuaagccuuug

SEQ ID NO: 1143028 - RNA, 19 nt, Human
guuauuauauuuacaaaug

SEQ ID NO: 1143029 - RNA, 20 nt, Human
guuauuauauuuacaaaugg

SEQ ID NO: 1143030 - RNA, 13 nt, Human
aagccguggcuuc

SEQ ID NO: 1143031 - RNA, 14 nt, Human
aagccguggcuucc

SEQ ID NO: 1143032 - RNA, 15 nt, Human
aagccguggcuuccc

SEQ ID NO: 1143033 - RNA, 19 nt, Human
guucuucgacuguuguuau

SEQ ID NO: 1143034 - RNA, 15 nt, Human
guuuaugacaguaau

SEQ ID NO: 1143035 - RNA, 17 nt, Human
guuuaugacaguaauug

SEQ ID NO: 1143036 - RNA, 13 nt, Human
guuuauucauaug

SEQ ID NO: 1143037 - RNA, 14 nt, Human
guuuauucauaugc

SEQ ID NO: 1143038 - RNA, 16 nt, Human
guuuauucauaugcau

SEQ ID NO: 1143039 - RNA, 17 nt, Human
guuuauucauaugcaua

SEQ ID NO: 1143040 - RNA, 19 nt, Human
guuuauucauaugcauauu

SEQ ID NO: 1143041 - RNA, 18 nt, Human
guuuauucauaugcauau

SEQ ID NO: 1143042 - RNA, 23 nt, Human
aagguauaucuagguuuaugaca

SEQ ID NO: 1143043 - RNA, 22 nt, Human
aagguauaucuagguuuaugac

SEQ ID NO: 1143044 - RNA, 23 nt, Human
aagguuucagaaagaagugggga

SEQ ID NO: 1143045 - RNA, 20 nt, Human
guuugcuuuguaugcacuuu

SEQ ID NO: 1143046 - RNA, 13 nt, Human
guuuggagacaga

SEQ ID NO: 1143047 - RNA, 22 nt, Human
aagucacugcacagugcaucuc

SEQ ID NO: 1143048 - RNA, 16 nt, Human
aagucaggaaucauca

SEQ ID NO: 1143049 - RNA, 22 nt, Human
uaaaaagcuccaaaugcagcuu

SEQ ID NO: 1143050 - RNA, 13 nt, Human
aagugauucucau

SEQ ID NO: 1143051 - RNA, 16 nt, Human
aagugauucucaugcc

SEQ ID NO: 1143052 - RNA, 19 nt, Human
aagugauucucaugccuca

SEQ ID NO: 1143053 - RNA, 17 nt, Human
aagugauucucaugccu

SEQ ID NO: 1143054 - RNA, 11 nt, Human
aaguuaagaau

SEQ ID NO: 1143055 - RNA, 23 nt, Human
aaguuaagaauguucuuauguug

SEQ ID NO: 1143056 - RNA, 14 nt, Human
aaguucccuacuuc

SEQ ID NO: 1143057 - RNA, 17 nt, Human
aaguucccuacuuccug

SEQ ID NO: 1143058 - RNA, 20 nt, Human
aaguucccuacuuccuguga

SEQ ID NO: 1143059 - RNA, 14 nt, Human
aauaguuguugauu

SEQ ID NO: 1143060 - RNA, 15 nt, Human
uaacaugaagaccuu

SEQ ID NO: 1143061 - RNA, 20 nt, Human
uaacgauaaaagacagugaa

SEQ ID NO: 1143062 - RNA, 15 nt, Human
aauauuccugcauuu

SEQ ID NO: 1143063 - RNA, 14 nt, Human
uaagauuccagaga

SEQ ID NO: 1143064 - RNA, 21 nt, Human
uaagauuccagagaguggcuc

SEQ ID NO: 1143065 - RNA, 12 nt, Human
aaucauauaaau

SEQ ID NO: 1143066 - RNA, 17 nt, Human
aaucauauaaauagaau

SEQ ID NO: 1143067 - RNA, 18 nt, Human
aaucauauaaauagaaug

SEQ ID NO: 1143068 - RNA, 20 nt, Human
aaucauauaaauagaaugua

SEQ ID NO: 1143069 - RNA, 21 nt, Human
aaucauauaaauagaauguaa

SEQ ID NO: 1143070 - RNA, 22 nt, Human
aaucauauaaauagaauguaaa

SEQ ID NO: 1143071 - RNA, 18 nt, Human
aauccuguaggaagguac

SEQ ID NO: 1143072 - RNA, 20 nt, Human
aauccuguaggaagguacug

SEQ ID NO: 1143073 - RNA, 23 nt, Human
aauccuguaggaagguacuguau

SEQ ID NO: 1143074 - RNA, 22 nt, Human
aauccuguaggaagguacugua

SEQ ID NO: 1143075 - RNA, 13 nt, Human
aauccuuugugaa

SEQ ID NO: 1143076 - RNA, 15 nt, Human
aaucgaccugccucg

SEQ ID NO: 1143077 - RNA, 16 nt, Human
aaucugggccagaauu

SEQ ID NO: 1143078 - RNA, 17 nt, Human
aaucugggccagaauuu

SEQ ID NO: 1143079 - RNA, 18 nt, Human
aaucugggccagaauuuc

SEQ ID NO: 1143080 - RNA, 19 nt, Human
aaucuuauaauuuaaaaua

SEQ ID NO: 1143081 - RNA, 12 nt, Human
uaaugaauaccu

SEQ ID NO: 1143082 - RNA, 13 nt, Human
uaaugaauaccuu

SEQ ID NO: 1143083 - RNA, 18 nt, Human
uaaugaauaccuuagugc

SEQ ID NO: 1143084 - RNA, 20 nt, Human
uaaugaauaccuuagugcag

SEQ ID NO: 1143085 - RNA, 15 nt, Human
uaaugaaugcauaaa

SEQ ID NO: 1143086 - RNA, 23 nt, Human
uaaugaaugcuuaaagaauucaa

SEQ ID NO: 1143087 - RNA, 13 nt, Human
uaaugaaugcuua

SEQ ID NO: 1143088 - RNA, 18 nt, Human
uaaugaaugcuuaaagaa

SEQ ID NO: 1143089 - RNA, 20 nt, Human
uaaugaaugcuuaaagaauu

SEQ ID NO: 1143090 - RNA, 13 nt, Human
uaauguacauagu

SEQ ID NO: 1143091 - RNA, 19 nt, Human
uaauguacauagugcuaac

SEQ ID NO: 1143092 - RNA, 17 nt, Human
aaugaaugcauaaaaug

SEQ ID NO: 1143093 - RNA, 14 nt, Human
aaugaaugcuuaaa

SEQ ID NO: 1143094 - RNA, 22 nt, Human
aaugcuguauuagucacagaga

SEQ ID NO: 1143095 - RNA, 19 nt, Human
aaugcuuaaagaauucaaa

SEQ ID NO: 1143096 - RNA, 21 nt, Human
aaugcuuaaagaauucaaauu

SEQ ID NO: 1143097 - RNA, 22 nt, Human
aaugcuuaaagaauucaaauuu

SEQ ID NO: 1143098 - RNA, 23 nt, Human
aauggcacaaucucggcucacug

SEQ ID NO: 1143099 - RNA, 12 nt, Human
aauguaaauguc

SEQ ID NO: 1143100 - RNA, 13 nt, Human
aauguaaaugucu

SEQ ID NO: 1143101 - RNA, 14 nt, Human
aauguaaaugucuc

SEQ ID NO: 1143102 - RNA, 15 nt, Human
aauguaaaugucuca

SEQ ID NO: 1143103 - RNA, 16 nt, Human
aauguaaaugucucac

SEQ ID NO: 1143104 - RNA, 18 nt, Human
aauguaaaugucucacug

SEQ ID NO: 1143105 - RNA, 24 nt, Human
aauguaaaugucucacugagcacu

SEQ ID NO: 1143106 - RNA, 20 nt, Human
uacagauccccaagccuggc

SEQ ID NO: 1143107 - RNA, 11 nt, Human
aaugugugugu

SEQ ID NO: 1143108 - RNA, 22 nt, Human
aauuaaucugggccagaauuuc

SEQ ID NO: 1143109 - RNA, 16 nt, Human
uacauucuucaagauc

SEQ ID NO: 1143110 - RNA, 17 nt, Human
uacauucuucaagaucc

SEQ ID NO: 1143111 - RNA, 21 nt, Human
uacauucuucaagaucccauu

SEQ ID NO: 1143112 - RNA, 20 nt, Human
uacauucuucaagaucccau

SEQ ID NO: 1143113 - RNA, 14 nt, Human
uaccaccugacauu

SEQ ID NO: 1143114 - RNA, 12 nt, Human
aauuagccagua

SEQ ID NO: 1143115 - RNA, 14 nt, Human
aauuagccaguaau

SEQ ID NO: 1143116 - RNA, 20 nt, Human
aauuagccaguaauccugua

SEQ ID NO: 1143117 - RNA, 17 nt, Human
aauuagccaguaauccu

SEQ ID NO: 1143118 - RNA, 18 nt, Human
aauuagccaguaauccug

SEQ ID NO: 1143119 - RNA, 19 nt, Human
aauuagccaguaauccugu

SEQ ID NO: 1143120 - RNA, 22 nt, Human
aauuagcuuauguuaacugaca

SEQ ID NO: 1143121 - RNA, 16 nt, Human
aauuagcuuauguuaa

SEQ ID NO: 1143122 - RNA, 22 nt, Human
aauucaaauuuuaucugccucu

SEQ ID NO: 1143123 - RNA, 18 nt, Human
aauuccaagugauugaaa

SEQ ID NO: 1143124 - RNA, 24 nt, Human
uacgcuccaucgcugucaucucag

SEQ ID NO: 1143125 - RNA, 20 nt, Human
uacuaucaugucaaacguga

SEQ ID NO: 1143126 - RNA, 18 nt, Human
acaaaaggauaaugaaua

SEQ ID NO: 1143127 - RNA, 23 nt, Human
uagaugcugacuguacuccuccc

SEQ ID NO: 1143128 - RNA, 18 nt, Human
uagcaugucgucaaagcu

SEQ ID NO: 1143129 - RNA, 17 nt, Human
uagcauuuucugcaucu

SEQ ID NO: 1143130 - RNA, 19 nt, Human
uagcauuuucugcaucucc

SEQ ID NO: 1143131 - RNA, 22 nt, Human
acaaggacagccccuccuccau

SEQ ID NO: 1143132 - RNA, 18 nt, Human
acaaggacuaggguccug

SEQ ID NO: 1143133 - RNA, 19 nt, Human
acaaggacuaggguccugg

SEQ ID NO: 1143134 - RNA, 10 nt, Human
acaauaccug

SEQ ID NO: 1143135 - RNA, 16 nt, Human
uaggaaauccagggug

SEQ ID NO: 1143136 - RNA, 21 nt, Human
uagugaaaggaagauaaacgu

SEQ ID NO: 1143137 - RNA, 15 nt, Human
uaguuccccuguuua

SEQ ID NO: 1143138 - RNA, 16 nt, Human
uaguuccccuguuuau

SEQ ID NO: 1143139 - RNA, 14 nt, Human
acaccgggccugga

SEQ ID NO: 1143140 - RNA, 16 nt, Human
acaccgggccuggaga

SEQ ID NO: 1143141 - RNA, 21 nt, Human
acaccuuagccugcccuccuu

SEQ ID NO: 1143142 - RNA, 17 nt, Human
uauauuguucacuucuu

SEQ ID NO: 1143143 - RNA, 17 nt, Human
acagauccccaagccug

SEQ ID NO: 1143144 - RNA, 18 nt, Human
acagauccccaagccugg

SEQ ID NO: 1143145 - RNA, 22 nt, Human
acagaucucugcuuuggaaauc

SEQ ID NO: 1143146 - RNA, 14 nt, Human
acagauuugagcuc

SEQ ID NO: 1143147 - RNA, 15 nt, Human
acagauuugagcuca

SEQ ID NO: 1143148 - RNA, 18 nt, Human
acagccguuuguucccca

SEQ ID NO: 1143149 - RNA, 12 nt, Human
acagccuggcac

SEQ ID NO: 1143150 - RNA, 11 nt, Human
acagccuggca

SEQ ID NO: 1143151 - RNA, 14 nt, Human
acaggacucugccu

SEQ ID NO: 1143152 - RNA, 15 nt, Human
acaggacucugccuc

SEQ ID NO: 1143153 - RNA, 19 nt, Human
uauuagugaccucagcuuu

SEQ ID NO: 1143154 - RNA, 21 nt, Human
uauuagugaccucagcuuuga

SEQ ID NO: 1143155 - RNA, 22 nt, Human
acaggcgugagccaccgugccu

SEQ ID NO: 1143156 - RNA, 12 nt, Human
acaggcuccugc

SEQ ID NO: 1143157 - RNA, 13 nt, Human
acaggcuccugcc

SEQ ID NO: 1143158 - RNA, 15 nt, Human
acaggcuccugccac

SEQ ID NO: 1143159 - RNA, 21 nt, Human
acaggcuccugccaccacgcc

SEQ ID NO: 1143160 - RNA, 22 nt, Human
acaggcuccugccaccacgccc

SEQ ID NO: 1143161 - RNA, 16 nt, Human
acaggcugcggccccu

SEQ ID NO: 1143162 - RNA, 18 nt, Human
acaggcugcggccccucc

SEQ ID NO: 1143163 - RNA, 19 nt, Human
acaggcugcggccccuccc

SEQ ID NO: 1143164 - RNA, 21 nt, Human
acaggcugcggccccuccccc

SEQ ID NO: 1143165 - RNA, 24 nt, Human
acaggcugcggccccucccccguc

SEQ ID NO: 1143166 - RNA, 21 nt, Human
acagggaacgugauuagugaa

SEQ ID NO: 1143167 - RNA, 22 nt, Human
acagggaacgugauuagugaaa

SEQ ID NO: 1143168 - RNA, 15 nt, Human
acaguaauuguguuu

SEQ ID NO: 1143169 - RNA, 17 nt, Human
acaguaauuguguuuac

SEQ ID NO: 1143170 - RNA, 18 nt, Human
acaguaauuguguuuaca

SEQ ID NO: 1143171 - RNA, 21 nt, Human
acaguaauuguguuuacauuu

SEQ ID NO: 1143172 - RNA, 21 nt, Human
acauuccuugcugaaacgcau

SEQ ID NO: 1143173 - RNA, 14 nt, Human
acauuccuugcuga

SEQ ID NO: 1143174 - RNA, 14 nt, Human
ucaaauuuuaucug

SEQ ID NO: 1143175 - RNA, 22 nt, Human
ucaaauuuuaucugccucucuu

SEQ ID NO: 1143176 - RNA, 15 nt, Human
ucaaccauuccccau

SEQ ID NO: 1143177 - RNA, 18 nt, Human
ucaaccauuccccauggg

SEQ ID NO: 1143178 - RNA, 13 nt, Human
ucaacuugcaaaa

SEQ ID NO: 1143179 - RNA, 14 nt, Human
ucaacuugcaaaau

SEQ ID NO: 1143180 - RNA, 16 nt, Human
ucaacuugcaaaauca

SEQ ID NO: 1143181 - RNA, 20 nt, Human
ucaacuugcaaaaucaguuu

SEQ ID NO: 1143182 - RNA, 19 nt, Human
ucaacuugcaaaaucaguu

SEQ ID NO: 1143183 - RNA, 15 nt, Human
ucaagucuaccaacc

SEQ ID NO: 1143184 - RNA, 22 nt, Human
ucaagucuaccaaccuguucaa

SEQ ID NO: 1143185 - RNA, 18 nt, Human
ucaagucuaccaauuaua

SEQ ID NO: 1143186 - RNA, 17 nt, Human
ucaaucuucaauccuug

SEQ ID NO: 1143187 - RNA, 21 nt, Human
acauucuucaagaucccauuu

SEQ ID NO: 1143188 - RNA, 16 nt, Human
ucaauucuugccaaau

SEQ ID NO: 1143189 - RNA, 16 nt, Human
ucaauuugauguggug

SEQ ID NO: 1143190 - RNA, 14 nt, Human
ucacaaccuucugu

SEQ ID NO: 1143191 - RNA, 21 nt, Human
ucacagaugugugauucacag

SEQ ID NO: 1143192 - RNA, 23 nt, Human
ucacagaugugugauucacagug

SEQ ID NO: 1143193 - RNA, 22 nt, Human
ucaccauguuggccaggcuggu

SEQ ID NO: 1143194 - RNA, 16 nt, Human
ucacuaggcuucuggu

SEQ ID NO: 1143195 - RNA, 19 nt, Human
ucacuaucccggcugcccu

SEQ ID NO: 1143196 - RNA, 20 nt, Human
ucacuaucccggcugcccuu

SEQ ID NO: 1143197 - RNA, 13 nt, Human
ucacugcauccuc

SEQ ID NO: 1143198 - RNA, 16 nt, Human
ucacugugcuguuguu

SEQ ID NO: 1143199 - RNA, 19 nt, Human
ucacugugcuguuguuaug

SEQ ID NO: 1143200 - RNA, 20 nt, Human
ucacugugcuguuguuauga

SEQ ID NO: 1143201 - RNA, 23 nt, Human
ucacugugcuguuguuaugaugu

SEQ ID NO: 1143202 - RNA, 15 nt, Human
ucacuguguccaggu

SEQ ID NO: 1143203 - RNA, 14 nt, Human
ucacuguuucacua

SEQ ID NO: 1143204 - RNA, 21 nt, Human
ucacuguuucacuacucagca

SEQ ID NO: 1143205 - RNA, 15 nt, Human
ucacuguuucacuac

SEQ ID NO: 1143206 - RNA, 13 nt, Human
accauacuaauua

SEQ ID NO: 1143207 - RNA, 13 nt, Human
ucagcccucccug

SEQ ID NO: 1143208 - RNA, 14 nt, Human
ucagcccucccugc

SEQ ID NO: 1143209 - RNA, 15 nt, Human
ucagcccucccugcc

SEQ ID NO: 1143210 - RNA, 16 nt, Human
ucagcccucccugccc

SEQ ID NO: 1143211 - RNA, 17 nt, Human
ucagcccucccugcccc

SEQ ID NO: 1143212 - RNA, 15 nt, Human
accccugagcuugca

SEQ ID NO: 1143213 - RNA, 18 nt, Human
accccuggcuuuucacug

SEQ ID NO: 1143214 - RNA, 19 nt, Human
accccuggcuuuucacugc

SEQ ID NO: 1143215 - RNA, 20 nt, Human
accccuggcuuuucacugcu

SEQ ID NO: 1143216 - RNA, 21 nt, Human
accccuggcuuuucacugcug

SEQ ID NO: 1143217 - RNA, 18 nt, Human
acccggaggggccuggca

SEQ ID NO: 1143218 - RNA, 21 nt, Human
acccggaggggccuggcagcc

SEQ ID NO: 1143219 - RNA, 20 nt, Human
ucagugcccuccaggauaga

SEQ ID NO: 1143220 - RNA, 16 nt, Human
ucaguggggaggggcu

SEQ ID NO: 1143221 - RNA, 20 nt, Human
ucaguggggcccauggaugu

SEQ ID NO: 1143222 - RNA, 15 nt, Human
ucaguuuuugugaaa

SEQ ID NO: 1143223 - RNA, 17 nt, Human
ucaguuuuugugaaaag

SEQ ID NO: 1143224 - RNA, 20 nt, Human
ucaguuuuccucucaauaaa

SEQ ID NO: 1143225 - RNA, 13 nt, Human
ucauauaaauaga

SEQ ID NO: 1143226 - RNA, 14 nt, Human
ucauauaaauagaa

SEQ ID NO: 1143227 - RNA, 16 nt, Human
ucauauaaauagaaug

SEQ ID NO: 1143228 - RNA, 18 nt, Human
ucauauaaauagaaugua

SEQ ID NO: 1143229 - RNA, 21 nt, Human
ucauauaaauagaauguaaau

SEQ ID NO: 1143230 - RNA, 22 nt, Human
ucauauaaauagaauguaaaug

SEQ ID NO: 1143231 - RNA, 13 nt, Human
ucauaugcauauu

SEQ ID NO: 1143232 - RNA, 13 nt, Human
ucauauuucccau

SEQ ID NO: 1143233 - RNA, 19 nt, Human
ucauauuucccaugauuuc

SEQ ID NO: 1143234 - RNA, 21 nt, Human
ucauauuucccaugauuucau

SEQ ID NO: 1143235 - RNA, 22 nt, Human
ucauauuucccaugauuucaug

SEQ ID NO: 1143236 - RNA, 16 nt, Human
accgagucucuucucc

SEQ ID NO: 1143237 - RNA, 17 nt, Human
accgagucucuucucca

SEQ ID NO: 1143238 - RNA, 18 nt, Human
accgagucucuucuccac

SEQ ID NO: 1143239 - RNA, 13 nt, Human
ucauccauccagg

SEQ ID NO: 1143240 - RNA, 11 nt, Human
ucaugauuuuu

SEQ ID NO: 1143241 - RNA, 18 nt, Human
uccagaauggucuuucua

SEQ ID NO: 1143242 - RNA, 13 nt, Human
uccagaccccugg

SEQ ID NO: 1143243 - RNA, 14 nt, Human
acgcuccuuccucu

SEQ ID NO: 1143244 - RNA, 15 nt, Human
acgcuccuuccucug

SEQ ID NO: 1143245 - RNA, 15 nt, Human
acguuaccaggcagg

SEQ ID NO: 1143246 - RNA, 15 nt, Human
acuaauuuuaaaaug

SEQ ID NO: 1143247 - RNA, 19 nt, Human
acuagacucccaagcugga

SEQ ID NO: 1143248 - RNA, 15 nt, Human
acuccagaccccugg

SEQ ID NO: 1143249 - RNA, 18 nt, Human
acuccagaccccuggcuu

SEQ ID NO: 1143250 - RNA, 19 nt, Human
acuccagaccccuggcuuu

SEQ ID NO: 1143251 - RNA, 21 nt, Human
acuccagaccccuggcuuuuc

SEQ ID NO: 1143252 - RNA, 19 nt, Human
acuccauagaccuuuucau

SEQ ID NO: 1143253 - RNA, 12 nt, Human
acuccucccagg

SEQ ID NO: 1143254 - RNA, 18 nt, Human
uccgguguuuaagacauu

SEQ ID NO: 1143255 - RNA, 12 nt, Human
acucugccuccu

SEQ ID NO: 1143256 - RNA, 16 nt, Human
acucugccuccucuuc

SEQ ID NO: 1143257 - RNA, 13 nt, Human
uccucccaggcgc

SEQ ID NO: 1143258 - RNA, 19 nt, Human
uccucccaggcgccccuuc

SEQ ID NO: 1143259 - RNA, 21 nt, Human
uccucccaggcgccccuuccc

SEQ ID NO: 1143260 - RNA, 21 nt, Human
uccugaauuuuauuuuuuggg

SEQ ID NO: 1143261 - RNA, 20 nt, Human
acugaacucugacaacagac

SEQ ID NO: 1143262 - RNA, 13 nt, Human
acugagcacuguu

SEQ ID NO: 1143263 - RNA, 15 nt, Human
acugagcacuguuuu

SEQ ID NO: 1143264 - RNA, 16 nt, Human
acugagcacuguuuuc

SEQ ID NO: 1143265 - RNA, 23 nt, Human
acugagcacuguuuucuagugua

SEQ ID NO: 1143266 - RNA, 17 nt, Human
acugagcacuguuuucu

SEQ ID NO: 1143267 - RNA, 20 nt, Human
acugcaacuuguaaaugugg

SEQ ID NO: 1143268 - RNA, 23 nt, Human
acugcacagugcaucucagccca

SEQ ID NO: 1143269 - RNA, 19 nt, Human
acugcaccaguugcugcuu

SEQ ID NO: 1143270 - RNA, 14 nt, Human
uccugcacacgcuc

SEQ ID NO: 1143271 - RNA, 21 nt, Human
uccugcacacgcuccuuccuc

SEQ ID NO: 1143272 - RNA, 22 nt, Human
uccugcacacgcuccuuccucu

SEQ ID NO: 1143273 - RNA, 20 nt, Human
ucuacagcuaaucagcauuc

SEQ ID NO: 1143274 - RNA, 23 nt, Human
ucuacagcuaaucagcauucuca

SEQ ID NO: 1143275 - RNA, 17 nt, Human
acuuacagcaaauccuu

SEQ ID NO: 1143276 - RNA, 14 nt, Human
acuuagcugggaga

SEQ ID NO: 1143277 - RNA, 16 nt, Human
acuuaguauugcaaag

SEQ ID NO: 1143278 - RNA, 13 nt, Human
acuuccccuuccu

SEQ ID NO: 1143279 - RNA, 19 nt, Human
acuuccccuuccuaauucc

SEQ ID NO: 1143280 - RNA, 13 nt, Human
acuugcaaaauca

SEQ ID NO: 1143281 - RNA, 16 nt, Human
acuugcaaaaucaguu

SEQ ID NO: 1143282 - RNA, 17 nt, Human
acuugcaaaaucaguuu

SEQ ID NO: 1143283 - RNA, 18 nt, Human
acuugcaaaaucaguuuu

SEQ ID NO: 1143284 - RNA, 21 nt, Human
ucucaugccucagccuccuga

SEQ ID NO: 1143285 - RNA, 19 nt, Human
ucucauuugccaauaauaa

SEQ ID NO: 1143286 - RNA, 16 nt, Human
ucuccuuucacaaccu

SEQ ID NO: 1143287 - RNA, 16 nt, Human
ucugaugcaagcaaga

SEQ ID NO: 1143288 - RNA, 21 nt, Human
ucugaugcaagcaagaaacac

SEQ ID NO: 1143289 - RNA, 23 nt, Human
ucugaugcaagcaagaaacacug

SEQ ID NO: 1143290 - RNA, 17 nt, Human
agaaauugcauuuccug

SEQ ID NO: 1143291 - RNA, 20 nt, Human
agaaauugcauuuccugaca

SEQ ID NO: 1143292 - RNA, 10 nt, Human
ucugcccugc

SEQ ID NO: 1143293 - RNA, 11 nt, Human
ucugcccugcg

SEQ ID NO: 1143294 - RNA, 12 nt, Human
ucugcccugcgg

SEQ ID NO: 1143295 - RNA, 22 nt, Human
ucugcccugcgggucacaggag

SEQ ID NO: 1143296 - RNA, 12 nt, Human
ucugcuuuccuc

SEQ ID NO: 1143297 - RNA, 13 nt, Human
ucugcuuuccucu

SEQ ID NO: 1143298 - RNA, 18 nt, Human
ucugcuuuccucuuccug

SEQ ID NO: 1143299 - RNA, 20 nt, Human
agaaguggggacagagcaga

SEQ ID NO: 1143300 - RNA, 16 nt, Human
agaauagaugcugacu

SEQ ID NO: 1143301 - RNA, 20 nt, Human
agaauccagcaccggcccca

SEQ ID NO: 1143302 - RNA, 13 nt, Human
agaauguaaaugu

SEQ ID NO: 1143303 - RNA, 14 nt, Human
agaauguaaauguc

SEQ ID NO: 1143304 - RNA, 17 nt, Human
agaauguaaaugucuca

SEQ ID NO: 1143305 - RNA, 19 nt, Human
agaauguaaaugucucacu

SEQ ID NO: 1143306 - RNA, 22 nt, Human
agaauguaaaugucucacugag

SEQ ID NO: 1143307 - RNA, 17 nt, Human
agaauucaaauuuuauc

SEQ ID NO: 1143308 - RNA, 12 nt, Human
agaauucaaauu

SEQ ID NO: 1143309 - RNA, 14 nt, Human
ucugggccagaauu

SEQ ID NO: 1143310 - RNA, 15 nt, Human
ucugggccagaauuu

SEQ ID NO: 1143311 - RNA, 15 nt, Human
ucuguugcugccuca

SEQ ID NO: 1143312 - RNA, 21 nt, Human
agacuccagcuggguuggaaa

SEQ ID NO: 1143313 - RNA, 16 nt, Human
agacucccaagcugga

SEQ ID NO: 1143314 - RNA, 14 nt, Human
ucuuuuuuugugau

SEQ ID NO: 1143315 - RNA, 16 nt, Human
ucuuuuuuugugaugu

SEQ ID NO: 1143316 - RNA, 13 nt, Human
ugaaagaaaauaa

SEQ ID NO: 1143317 - RNA, 23 nt, Human
ugaaauagacccacaagaggcag

SEQ ID NO: 1143318 - RNA, 15 nt, Human
ugaacuccugaccuc

SEQ ID NO: 1143319 - RNA, 23 nt, Human
ugaaguaaaacaaacaauaccug

SEQ ID NO: 1143320 - RNA, 13 nt, Human
ugaaguaaaacaa

SEQ ID NO: 1143321 - RNA, 22 nt, Human
ugaaguaaaacaaacaauaccu

SEQ ID NO: 1143322 - RNA, 13 nt, Human
ugaaguaagcaaa

SEQ ID NO: 1143323 - RNA, 14 nt, Human
ugaaguaagcaaag

SEQ ID NO: 1143324 - RNA, 15 nt, Human
ugaaguaagcaaaga

SEQ ID NO: 1143325 - RNA, 17 nt, Human
ugaaugcuuaaagaauu

SEQ ID NO: 1143326 - RNA, 22 nt, Human
ugaaugcuuaaagaauucaaau

SEQ ID NO: 1143327 - RNA, 21 nt, Human
ugaaugcuuaaagaauucaaa

SEQ ID NO: 1143328 - RNA, 15 nt, Human
ugacauuccuugcug

SEQ ID NO: 1143329 - RNA, 18 nt, Human
agauccccaagccuggca

SEQ ID NO: 1143330 - RNA, 21 nt, Human
ugacucguauaugucucaggu

SEQ ID NO: 1143331 - RNA, 13 nt, Human
agauucagcuagu

SEQ ID NO: 1143332 - RNA, 21 nt, Human
agauuccagagaguggcuccu

SEQ ID NO: 1143333 - RNA, 22 nt, Human
agauuccagagaguggcuccuc

SEQ ID NO: 1143334 - RNA, 13 nt, Human
ugagaagcugcuc

SEQ ID NO: 1143335 - RNA, 14 nt, Human
ugagaagcugcuca

SEQ ID NO: 1143336 - RNA, 16 nt, Human
ugagaagcugcucaac

SEQ ID NO: 1143337 - RNA, 17 nt, Human
ugagaagcugcucaacu

SEQ ID NO: 1143338 - RNA, 21 nt, Human
ugagaagcugcucaacuugca

SEQ ID NO: 1143339 - RNA, 20 nt, Human
ugagacagaaucucgcucug

SEQ ID NO: 1143340 - RNA, 15 nt, Human
ugagcaaauguggcu

SEQ ID NO: 1143341 - RNA, 14 nt, Human
ugagcauuagauuu

SEQ ID NO: 1143342 - RNA, 16 nt, Human
ugagcauuagauuucu

SEQ ID NO: 1143343 - RNA, 17 nt, Human
agcaccuagccucgcuc

SEQ ID NO: 1143344 - RNA, 15 nt, Human
ugauggugaugaaau

SEQ ID NO: 1143345 - RNA, 16 nt, Human
ugauggugaugaaaug

SEQ ID NO: 1143346 - RNA, 17 nt, Human
ugauggugaugaaaugu

SEQ ID NO: 1143347 - RNA, 17 nt, Human
ugauuaauggaaauguu

SEQ ID NO: 1143348 - RNA, 23 nt, Human
agcccagcuugaaaccuucacuu

SEQ ID NO: 1143349 - RNA, 13 nt, Human
ugauucucaugcc

SEQ ID NO: 1143350 - RNA, 14 nt, Human
ugauucucaugccu

SEQ ID NO: 1143351 - RNA, 15 nt, Human
ugauucucaugccuc

SEQ ID NO: 1143352 - RNA, 16 nt, Human
ugauucucaugccuca

SEQ ID NO: 1143353 - RNA, 17 nt, Human
ugauuucagcucacugc

SEQ ID NO: 1143354 - RNA, 13 nt, Human
ugauuucauguac

SEQ ID NO: 1143355 - RNA, 15 nt, Human
ugauuucauguacug

SEQ ID NO: 1143356 - RNA, 16 nt, Human
ugauuucauguacugc

SEQ ID NO: 1143357 - RNA, 17 nt, Human
ugauuucauguacugca

SEQ ID NO: 1143358 - RNA, 18 nt, Human
ugauuucauguacugcau

SEQ ID NO: 1143359 - RNA, 16 nt, Human
ugcaauacaaguuuca

SEQ ID NO: 1143360 - RNA, 17 nt, Human
ugcaauacaaguuucau

SEQ ID NO: 1143361 - RNA, 18 nt, Human
ugcaauacaaguuucauc

SEQ ID NO: 1143362 - RNA, 23 nt, Human
ugcaauacaaguuucauccagaa

SEQ ID NO: 1143363 - RNA, 17 nt, Human
agcccugcuuugggcug

SEQ ID NO: 1143364 - RNA, 19 nt, Human
agcccugcuuugggcugcc

SEQ ID NO: 1143365 - RNA, 20 nt, Human
agcccugcuuugggcugccc

SEQ ID NO: 1143366 - RNA, 13 nt, Human
agccucagucucc

SEQ ID NO: 1143367 - RNA, 16 nt, Human
agccucagucucccuc

SEQ ID NO: 1143368 - RNA, 19 nt, Human
agccucagucucccucccu

SEQ ID NO: 1143369 - RNA, 20 nt, Human
agccucagucucccucccuu

SEQ ID NO: 1143370 - RNA, 22 nt, Human
agccucagucucccucccuugg

SEQ ID NO: 1143371 - RNA, 21 nt, Human
agccuccaagcuccaucucca

SEQ ID NO: 1143372 - RNA, 17 nt, Human
agccuccaugcugccuc

SEQ ID NO: 1143373 - RNA, 14 nt, Human
agcgcacucuucau

SEQ ID NO: 1143374 - RNA, 15 nt, Human
ugcauuauuugagaa

SEQ ID NO: 1143375 - RNA, 16 nt, Human
ugcauuauuugagaag

SEQ ID NO: 1143376 - RNA, 23 nt, Human
ugcauuauuugagaagcugcuca

SEQ ID NO: 1143377 - RNA, 13 nt, Human
ugcauuuccugac

SEQ ID NO: 1143378 - RNA, 13 nt, Human
ugccacugccucu

SEQ ID NO: 1143379 - RNA, 17 nt, Human
ugccacugccucuuccu

SEQ ID NO: 1143380 - RNA, 18 nt, Human
ugccacugccucuuccuc

SEQ ID NO: 1143381 - RNA, 19 nt, Human
ugccacugccucuuccucc

SEQ ID NO: 1143382 - RNA, 20 nt, Human
ugccacugccucuuccuccc

SEQ ID NO: 1143383 - RNA, 23 nt, Human
ugccacugccucuuccucccuca

SEQ ID NO: 1143384 - RNA, 19 nt, Human
ugccaggaacccuuaaaca

SEQ ID NO: 1143385 - RNA, 14 nt, Human
ugcccccucugccc

SEQ ID NO: 1143386 - RNA, 15 nt, Human
ugcccccucugcccu

SEQ ID NO: 1143387 - RNA, 16 nt, Human
ugcccccucugcccug

SEQ ID NO: 1143388 - RNA, 17 nt, Human
ugcccccucugcccugc

SEQ ID NO: 1143389 - RNA, 18 nt, Human
ugcccccucugcccugcg

SEQ ID NO: 1143390 - RNA, 20 nt, Human
ugcccuaaugcgcaggcugg

SEQ ID NO: 1143391 - RNA, 23 nt, Human
ugcccuaaugcgcaggcuggccc

SEQ ID NO: 1143392 - RNA, 14 nt, Human
agcuccauuuaaac

SEQ ID NO: 1143393 - RNA, 15 nt, Human
agcuccauuuaaaca

SEQ ID NO: 1143394 - RNA, 18 nt, Human
agcuccauuuaaacagau

SEQ ID NO: 1143395 - RNA, 21 nt, Human
agcuccauuuaaacagauguc

SEQ ID NO: 1143396 - RNA, 14 nt, Human
agcucuaauguuug

SEQ ID NO: 1143397 - RNA, 17 nt, Human
agcucuaauguuugcau

SEQ ID NO: 1143398 - RNA, 18 nt, Human
agcucuaauguuugcaua

SEQ ID NO: 1143399 - RNA, 20 nt, Human
agcucuaauguuugcauaua

SEQ ID NO: 1143400 - RNA, 22 nt, Human
agcucuaauguuugcauauaag

SEQ ID NO: 1143401 - RNA, 21 nt, Human
agcucuaauguuugcauauaa

SEQ ID NO: 1143402 - RNA, 17 nt, Human
agcucuaucaccaagga

SEQ ID NO: 1143403 - RNA, 21 nt, Human
agcucugcagagcaggaaaca

SEQ ID NO: 1143404 - RNA, 15 nt, Human
ugccucagccucccg

SEQ ID NO: 1143405 - RNA, 15 nt, Human
ugccucagccuccug

SEQ ID NO: 1143406 - RNA, 11 nt, Human
ugccucugccu

SEQ ID NO: 1143407 - RNA, 22 nt, Human
agcuggaucuccauucucucag

SEQ ID NO: 1143408 - RNA, 14 nt, Human
ugcugacuguacuc

SEQ ID NO: 1143409 - RNA, 11 nt, Human
aggaauuuaaa

SEQ ID NO: 1143410 - RNA, 15 nt, Human
ugcuggcugccuuag

SEQ ID NO: 1143411 - RNA, 21 nt, Human
ugcuggcugccuuagaaccuu

SEQ ID NO: 1143412 - RNA, 21 nt, Human
ugcuguacugaaguaaaacaa

SEQ ID NO: 1143413 - RNA, 16 nt, Human
ugcuuauauuguucac

SEQ ID NO: 1143414 - RNA, 12 nt, Human
aggacaggcugc

SEQ ID NO: 1143415 - RNA, 16 nt, Human
aggacaggcugcggcc

SEQ ID NO: 1143416 - RNA, 20 nt, Human
aggacaggcugcggccccuc

SEQ ID NO: 1143417 - RNA, 21 nt, Human
aggacaggcugcggccccucc

SEQ ID NO: 1143418 - RNA, 18 nt, Human
ugcuuugggcugcccugg

SEQ ID NO: 1143419 - RNA, 19 nt, Human
ugcuuugggcugcccuggu

SEQ ID NO: 1143420 - RNA, 20 nt, Human
ugcuuugggcugcccuggug

SEQ ID NO: 1143421 - RNA, 21 nt, Human
ugcuuugggcugcccuggugc

SEQ ID NO: 1143422 - RNA, 21 nt, Human
aggagggagcaucagugcccu

SEQ ID NO: 1143423 - RNA, 14 nt, Human
aggagggaggggga

SEQ ID NO: 1143424 - RNA, 17 nt, Human
aggaugccccguccccc

SEQ ID NO: 1143425 - RNA, 18 nt, Human
uggacgagaaaacaauaa

SEQ ID NO: 1143426 - RNA, 19 nt, Human
uggagucagacagaugugg

SEQ ID NO: 1143427 - RNA, 16 nt, Human
uggcagccgugccuuc

SEQ ID NO: 1143428 - RNA, 23 nt, Human
uggcagccgugccuucagcucua

SEQ ID NO: 1143429 - RNA, 15 nt, Human
uggcagccucuucaa

SEQ ID NO: 1143430 - RNA, 16 nt, Human
uggcagccucuucaaa

SEQ ID NO: 1143431 - RNA, 13 nt, Human
aggccugccuguu

SEQ ID NO: 1143432 - RNA, 20 nt, Human
uggccaggcuggucucgaac

SEQ ID NO: 1143433 - RNA, 11 nt, Human
uggccaggugg

SEQ ID NO: 1143434 - RNA, 14 nt, Human
uggcccgacagccu

SEQ ID NO: 1143435 - RNA, 15 nt, Human
uggcccgacagccug

SEQ ID NO: 1143436 - RNA, 16 nt, Human
uggcccgacagccugg

SEQ ID NO: 1143437 - RNA, 17 nt, Human
uggcccgacagccuggc

SEQ ID NO: 1143438 - RNA, 18 nt, Human
uggcccgacagccuggca

SEQ ID NO: 1143439 - RNA, 19 nt, Human
uggcccgacagccuggcac

SEQ ID NO: 1143440 - RNA, 15 nt, Human
uggccgggagccuga

SEQ ID NO: 1143441 - RNA, 14 nt, Human
aggcuccugccacc

SEQ ID NO: 1143442 - RNA, 20 nt, Human
aggcuccugccaccacgccc

SEQ ID NO: 1143443 - RNA, 16 nt, Human
aggcugcggccccucc

SEQ ID NO: 1143444 - RNA, 17 nt, Human
aggcugcggccccuccc

SEQ ID NO: 1143445 - RNA, 18 nt, Human
aggcugcggccccucccc

SEQ ID NO: 1143446 - RNA, 19 nt, Human
aggcugcggccccuccccc

SEQ ID NO: 1143447 - RNA, 23 nt, Human
aggcugcucuugaacuccugacc

SEQ ID NO: 1143448 - RNA, 22 nt, Human
aggcugcuguacugaaguaaaa

SEQ ID NO: 1143449 - RNA, 12 nt, Human
aggcuggcccug

SEQ ID NO: 1143450 - RNA, 14 nt, Human
aggcuggcccugcc

SEQ ID NO: 1143451 - RNA, 15 nt, Human
aggcuggcccugccc

SEQ ID NO: 1143452 - RNA, 16 nt, Human
aggcuggcccugcccu

SEQ ID NO: 1143453 - RNA, 17 nt, Human
aggcuggcccugcccug

SEQ ID NO: 1143454 - RNA, 18 nt, Human
aggcuggcccugcccugg

SEQ ID NO: 1143455 - RNA, 19 nt, Human
aggcuggcccugcccuggu

SEQ ID NO: 1143456 - RNA, 23 nt, Human
uggcuagauuaaccuucucuguc

SEQ ID NO: 1143457 - RNA, 15 nt, Human
uggcuucccgcucag

SEQ ID NO: 1143458 - RNA, 16 nt, Human
uggcuucccgcucagc

SEQ ID NO: 1143459 - RNA, 18 nt, Human
uggcuucccgcucagccc

SEQ ID NO: 1143460 - RNA, 17 nt, Human
uggcuucccgcucagcc

SEQ ID NO: 1143461 - RNA, 13 nt, Human
ugggaacuagacu

SEQ ID NO: 1143462 - RNA, 15 nt, Human
agggggaaggcaggg

SEQ ID NO: 1143463 - RNA, 12 nt, Human
aggguagggugg

SEQ ID NO: 1143464 - RNA, 22 nt, Human
ugggucuuguuuuuuuuuucca

SEQ ID NO: 1143465 - RNA, 22 nt, Human
uggguuuuuauuuccuaugaug

SEQ ID NO: 1143466 - RNA, 22 nt, Human
ugguaauuuaagauuccagaga

SEQ ID NO: 1143467 - RNA, 22 nt, Human
ugguccaugggccauaugaaaa

SEQ ID NO: 1143468 - RNA, 19 nt, Human
uggucucgaacuccugacc

SEQ ID NO: 1143469 - RNA, 20 nt, Human
uggucucgaacuccugaccu

SEQ ID NO: 1143470 - RNA, 21 nt, Human
uggucucgaacuccugaccuu

SEQ ID NO: 1143471 - RNA, 22 nt, Human
uggugaaaagcagguugauaaa

SEQ ID NO: 1143472 - RNA, 23 nt, Human
uggugaaaagcagguugauaaau

SEQ ID NO: 1143473 - RNA, 19 nt, Human
agguauaucuagguuuaug

SEQ ID NO: 1143474 - RNA, 22 nt, Human
agguauaucuagguuuaugaca

SEQ ID NO: 1143475 - RNA, 15 nt, Human
aggucagugcaaaua

SEQ ID NO: 1143476 - RNA, 17 nt, Human
agguccacaacacacag

SEQ ID NO: 1143477 - RNA, 19 nt, Human
agguccacaacacacagau

SEQ ID NO: 1143478 - RNA, 15 nt, Human
ugguguguguaugcg

SEQ ID NO: 1143479 - RNA, 16 nt, Human
uguaaaggaauuuaaa

SEQ ID NO: 1143480 - RNA, 21 nt, Human
uguaaauacuguuuuuaacaa

SEQ ID NO: 1143481 - RNA, 22 nt, Human
aggugauccacucgccuucauc

SEQ ID NO: 1143482 - RNA, 20 nt, Human
aggugugagccaccacgccc

SEQ ID NO: 1143483 - RNA, 16 nt, Human
agguugucugaaguca

SEQ ID NO: 1143484 - RNA, 20 nt, Human
agguugucugaagucacugc

SEQ ID NO: 1143485 - RNA, 17 nt, Human
uguagagaaaacaugca

SEQ ID NO: 1143486 - RNA, 19 nt, Human
uguagagaaaacaugcaga

SEQ ID NO: 1143487 - RNA, 15 nt, Human
uguauuagucacaga

SEQ ID NO: 1143488 - RNA, 22 nt, Human
aguauugacaaaauguuauuuc

SEQ ID NO: 1143489 - RNA, 16 nt, Human
aguauugcaaagucag

SEQ ID NO: 1143490 - RNA, 12 nt, Human
aguauugcaaag

SEQ ID NO: 1143491 - RNA, 22 nt, Human
agucacagagauaauucuagcu

SEQ ID NO: 1143492 - RNA, 19 nt, Human
uguccaggcacugcugccc

SEQ ID NO: 1143493 - RNA, 20 nt, Human
uguccaggcacugcugccca

SEQ ID NO: 1143494 - RNA, 21 nt, Human
uguccaggcacugcugcccag

SEQ ID NO: 1143495 - RNA, 20 nt, Human
ugucccuaccgagucucuuc

SEQ ID NO: 1143496 - RNA, 21 nt, Human
ugucccuaccgagucucuucu

SEQ ID NO: 1143497 - RNA, 22 nt, Human
ugucccuaccgagucucuucuc

SEQ ID NO: 1143498 - RNA, 17 nt, Human
agucagauucuugcauc

SEQ ID NO: 1143499 - RNA, 16 nt, Human
agucagauucuugcau

SEQ ID NO: 1143500 - RNA, 14 nt, Human
ugugaacugaacuc

SEQ ID NO: 1143501 - RNA, 23 nt, Human
ugugaacugaacucugacaacag

SEQ ID NO: 1143502 - RNA, 14 nt, Human
agucucccucccuu

SEQ ID NO: 1143503 - RNA, 18 nt, Human
agucucccucccuugggg

SEQ ID NO: 1143504 - RNA, 17 nt, Human
agugagcaguguuagcu

SEQ ID NO: 1143505 - RNA, 14 nt, Human
aguguaaugaauac

SEQ ID NO: 1143506 - RNA, 16 nt, Human
aguguaaugaauaccu

SEQ ID NO: 1143507 - RNA, 22 nt, Human
aguguaaugaauaccuuagugc

SEQ ID NO: 1143508 - RNA, 12 nt, Human
uguuaugaugug

SEQ ID NO: 1143509 - RNA, 14 nt, Human
uguuaugaugugcu

SEQ ID NO: 1143510 - RNA, 16 nt, Human
uguuaugaugugcuua

SEQ ID NO: 1143511 - RNA, 17 nt, Human
uguuaugaugugcuuaa

SEQ ID NO: 1143512 - RNA, 19 nt, Human
uguuaugaugugcuuaaca

SEQ ID NO: 1143513 - RNA, 22 nt, Human
uguuaugaugugcuuaacaggg

SEQ ID NO: 1143514 - RNA, 16 nt, Human
uguucccauucuugca

SEQ ID NO: 1143515 - RNA, 20 nt, Human
aguuauuauauuuacaaaug

SEQ ID NO: 1143516 - RNA, 17 nt, Human
aguucccuacuuccugu

SEQ ID NO: 1143517 - RNA, 14 nt, Human
aguuccugugcaca

SEQ ID NO: 1143518 - RNA, 16 nt, Human
aguuccugugcacagc

SEQ ID NO: 1143519 - RNA, 17 nt, Human
aguuccugugcacagcc

SEQ ID NO: 1143520 - RNA, 14 nt, Human
uguuguagagaaaa

SEQ ID NO: 1143521 - RNA, 17 nt, Human
uguuguagagaaaacau

SEQ ID NO: 1143522 - RNA, 23 nt, Human
uguuguagagaaaacaugcagaa

SEQ ID NO: 1143523 - RNA, 13 nt, Human
uguuugcauauaa

SEQ ID NO: 1143524 - RNA, 14 nt, Human
uguuugcauauaag

SEQ ID NO: 1143525 - RNA, 13 nt, Human
uguuuucuagugu

SEQ ID NO: 1143526 - RNA, 14 nt, Human
uguuuucuagugua

SEQ ID NO: 1143527 - RNA, 15 nt, Human
uguuuucuaguguau

SEQ ID NO: 1143528 - RNA, 16 nt, Human
uguuuucuaguguauc

SEQ ID NO: 1143529 - RNA, 18 nt, Human
uguuuucuaguguaucaa

SEQ ID NO: 1143530 - RNA, 19 nt, Human
uguuuucuaguguaucaaa

SEQ ID NO: 1143531 - RNA, 20 nt, Human
uguuuucuaguguaucaaaa

SEQ ID NO: 1143532 - RNA, 21 nt, Human
uguuuucuaguguaucaaaau

SEQ ID NO: 1143533 - RNA, 11 nt, Human
aguugcacagc

SEQ ID NO: 1143534 - RNA, 12 nt, Human
aguugcacagca

SEQ ID NO: 1143535 - RNA, 13 nt, Human
aguugcacagcau

SEQ ID NO: 1143536 - RNA, 14 nt, Human
aguugcacagcauc

SEQ ID NO: 1143537 - RNA, 15 nt, Human
aguugcacagcaucu

SEQ ID NO: 1143538 - RNA, 16 nt, Human
aguugcacagcaucuc

SEQ ID NO: 1143539 - RNA, 17 nt, Human
aguugcacagcaucuca

SEQ ID NO: 1143540 - RNA, 20 nt, Human
aguugcacagcaucucagcu

SEQ ID NO: 1143541 - RNA, 16 nt, Human
uuaaaauauuccugca

SEQ ID NO: 1143542 - RNA, 19 nt, Human
uuaaaauauuccugcauuu

SEQ ID NO: 1143543 - RNA, 16 nt, Human
aguuucucagcuccca

SEQ ID NO: 1143544 - RNA, 17 nt, Human
auaaaccaaugaacgaa

SEQ ID NO: 1143545 - RNA, 22 nt, Human
auaaaccccaccccaaaauuag

SEQ ID NO: 1143546 - RNA, 23 nt, Human
auaaaccccaccccaaaauuagc

SEQ ID NO: 1143547 - RNA, 18 nt, Human
auaaacguggauguuacu

SEQ ID NO: 1143548 - RNA, 17 nt, Human
auaaacguggauguuac

SEQ ID NO: 1143549 - RNA, 21 nt, Human
uuaccgcguaaugcgccaaua

SEQ ID NO: 1143550 - RNA, 22 nt, Human
uuaccgcguaaugcgccaauaa

SEQ ID NO: 1143551 - RNA, 14 nt, Human
auaaugaauacuuu

SEQ ID NO: 1143552 - RNA, 16 nt, Human
uuagcaguuugcuuug

SEQ ID NO: 1143553 - RNA, 14 nt, Human
uuagccccauaauu

SEQ ID NO: 1143554 - RNA, 21 nt, Human
uuagccaguaauccuguagga

SEQ ID NO: 1143555 - RNA, 18 nt, Human
uuauacccccugcaaagc

SEQ ID NO: 1143556 - RNA, 14 nt, Human
uuauaccucaauuu

SEQ ID NO: 1143557 - RNA, 22 nt, Human
uuauaccucaauuuucacugug

SEQ ID NO: 1143558 - RNA, 21 nt, Human
uuauaccucaauuuucacugu

SEQ ID NO: 1143559 - RNA, 12 nt, Human
uuauagcucuaa

SEQ ID NO: 1143560 - RNA, 15 nt, Human
uuauagcucuaaugu

SEQ ID NO: 1143561 - RNA, 16 nt, Human
uuauagcucuaauguu

SEQ ID NO: 1143562 - RNA, 17 nt, Human
uuauagcucuaauguuu

SEQ ID NO: 1143563 - RNA, 18 nt, Human
uuauagcucuaauguuug

SEQ ID NO: 1143564 - RNA, 20 nt, Human
uuauagcucuaauguuugca

SEQ ID NO: 1143565 - RNA, 16 nt, Human
auacagcuuuuggauu

SEQ ID NO: 1143566 - RNA, 20 nt, Human
auacauucuucaagauccca

SEQ ID NO: 1143567 - RNA, 16 nt, Human
auacauuuuguaccaa

SEQ ID NO: 1143568 - RNA, 23 nt, Human
auacucaagagugguaucuugca

SEQ ID NO: 1143569 - RNA, 11 nt, Human
uuaucauguua

SEQ ID NO: 1143570 - RNA, 17 nt, Human
uuaucauguuaguaaua

SEQ ID NO: 1143571 - RNA, 18 nt, Human
uuaucauguuaguaauac

SEQ ID NO: 1143572 - RNA, 22 nt, Human
uuaucauguuaguaauaccucu

SEQ ID NO: 1143573 - RNA, 23 nt, Human
uuaucauguuaguaauaccucua

SEQ ID NO: 1143574 - RNA, 16 nt, Human
uucacuucacugugcu

SEQ ID NO: 1143575 - RNA, 14 nt, Human
uucagcucacugca

SEQ ID NO: 1143576 - RNA, 12 nt, Human
uucauaugcaua

SEQ ID NO: 1143577 - RNA, 13 nt, Human
auauaugcuaagu

SEQ ID NO: 1143578 - RNA, 20 nt, Human
auaugcaaacaggguaacua

SEQ ID NO: 1143579 - RNA, 17 nt, Human
uuccaauuuaguuguug

SEQ ID NO: 1143580 - RNA, 15 nt, Human
uuccaccuucccaug

SEQ ID NO: 1143581 - RNA, 22 nt, Human
uuccagugaaaucaguuacucu

SEQ ID NO: 1143582 - RNA, 13 nt, Human
auauuuacaaaug

SEQ ID NO: 1143583 - RNA, 12 nt, Human
uucccgcucagc

SEQ ID NO: 1143584 - RNA, 14 nt, Human
uucccgcucagccc

SEQ ID NO: 1143585 - RNA, 15 nt, Human
uucccgcucagcccu

SEQ ID NO: 1143586 - RNA, 14 nt, Human
uucccuacauuaaa

SEQ ID NO: 1143587 - RNA, 19 nt, Human
uucccuacauuaaacauga

SEQ ID NO: 1143588 - RNA, 13 nt, Human
uucccuacuuccu

SEQ ID NO: 1143589 - RNA, 18 nt, Human
uuccucuccacugccuuc

SEQ ID NO: 1143590 - RNA, 19 nt, Human
uuccucuccacugccuucg

SEQ ID NO: 1143591 - RNA, 13 nt, Human
uuccucugagccu

SEQ ID NO: 1143592 - RNA, 13 nt, Human
aucagugcccucc

SEQ ID NO: 1143593 - RNA, 15 nt, Human
aucagugcccuccag

SEQ ID NO: 1143594 - RNA, 17 nt, Human
aucagugcccuccagga

SEQ ID NO: 1143595 - RNA, 21 nt, Human
aucaguuacacaugaucauaa

SEQ ID NO: 1143596 - RNA, 14 nt, Human
aucauauaaauaga

SEQ ID NO: 1143597 - RNA, 18 nt, Human
aucauauaaauagaaugu

SEQ ID NO: 1143598 - RNA, 19 nt, Human
aucauauaaauagaaugua

SEQ ID NO: 1143599 - RNA, 21 nt, Human
aucauauaaauagaauguaaa

SEQ ID NO: 1143600 - RNA, 22 nt, Human
aucauauaaauagaauguaaau

SEQ ID NO: 1143601 - RNA, 23 nt, Human
aucauauaaauagaauguaaaug

SEQ ID NO: 1143602 - RNA, 24 nt, Human
aucauauaaauagaauguaaaugu

SEQ ID NO: 1143603 - RNA, 18 nt, Human
uucuccuuucacaaccuu

SEQ ID NO: 1143604 - RNA, 22 nt, Human
uucuccuuucacaaccuucugu

SEQ ID NO: 1143605 - RNA, 22 nt, Human
auccaauuagcuuauguuaacu

SEQ ID NO: 1143606 - RNA, 20 nt, Human
auccaauuagcuuauguuaa

SEQ ID NO: 1143607 - RNA, 22 nt, Human
auccucuuccauauggauccac

SEQ ID NO: 1143608 - RNA, 19 nt, Human
auccuguaggaagguacug

SEQ ID NO: 1143609 - RNA, 20 nt, Human
auccuguaggaagguacugu

SEQ ID NO: 1143610 - RNA, 22 nt, Human
auccuguaggaagguacuguau

SEQ ID NO: 1143611 - RNA, 21 nt, Human
auccuguaggaagguacugua

SEQ ID NO: 1143612 - RNA, 15 nt, Human
aucuaaacugccccc

SEQ ID NO: 1143613 - RNA, 13 nt, Human
uugagaagcugcu

SEQ ID NO: 1143614 - RNA, 15 nt, Human
uugagaagcugcuca

SEQ ID NO: 1143615 - RNA, 16 nt, Human
uugagaagcugcucaa

SEQ ID NO: 1143616 - RNA, 15 nt, Human
uugauaaaucauuuu

SEQ ID NO: 1143617 - RNA, 21 nt, Human
uugauaaaucauuuuauguca

SEQ ID NO: 1143618 - RNA, 18 nt, Human
uugauaaaucauuuuaug

SEQ ID NO: 1143619 - RNA, 15 nt, Human
uugcugaaugcaaga

SEQ ID NO: 1143620 - RNA, 19 nt, Human
augaaagauggcugugccu

SEQ ID NO: 1143621 - RNA, 20 nt, Human
augaaagauggcugugccuc

SEQ ID NO: 1143622 - RNA, 23 nt, Human
augaaagauggcugugccucugc

SEQ ID NO: 1143623 - RNA, 22 nt, Human
uuguaaaaauuaaaaguuaugg

SEQ ID NO: 1143624 - RNA, 21 nt, Human
augacaagaaaggcugcugua

SEQ ID NO: 1143625 - RNA, 12 nt, Human
augacaguaauu

SEQ ID NO: 1143626 - RNA, 20 nt, Human
augacaguaauuguguuuac

SEQ ID NO: 1143627 - RNA, 22 nt, Human
augacaguaauuguguuuacau

SEQ ID NO: 1143628 - RNA, 21 nt, Human
augacaguaauuguguuuaca

SEQ ID NO: 1143629 - RNA, 12 nt, Human
augaucaaaugu

SEQ ID NO: 1143630 - RNA, 13 nt, Human
augaucaaauguu

SEQ ID NO: 1143631 - RNA, 14 nt, Human
augaucaaauguuu

SEQ ID NO: 1143632 - RNA, 15 nt, Human
augaucaaauguuua

SEQ ID NO: 1143633 - RNA, 16 nt, Human
augaucaaauguuuaa

SEQ ID NO: 1143634 - RNA, 17 nt, Human
augaucaaauguuuaau

SEQ ID NO: 1143635 - RNA, 19 nt, Human
augaucaaauguuuaauca

SEQ ID NO: 1143636 - RNA, 20 nt, Human
augaucaaauguuuaaucau

SEQ ID NO: 1143637 - RNA, 15 nt, Human
augauccuaaugaau

SEQ ID NO: 1143638 - RNA, 13 nt, Human
augaucugauuga

SEQ ID NO: 1143639 - RNA, 18 nt, Human
uuguuuuuuuuuuccacu

SEQ ID NO: 1143640 - RNA, 19 nt, Human
uuguuuuuuuuuuccacuu

SEQ ID NO: 1143641 - RNA, 17 nt, Human
uuuaaaaaauuaaucug

SEQ ID NO: 1143642 - RNA, 21 nt, Human
uuuaaaaaauuaaucugggcc

SEQ ID NO: 1143643 - RNA, 15 nt, Human
augcgccaauaaacc

SEQ ID NO: 1143644 - RNA, 16 nt, Human
augcgccaauaaacca

SEQ ID NO: 1143645 - RNA, 18 nt, Human
augcgccaauaaaccaau

SEQ ID NO: 1143646 - RNA, 18 nt, Human
augcuacaggauuugaaa

SEQ ID NO: 1143647 - RNA, 15 nt, Human
uuuagcugacaaaau

SEQ ID NO: 1143648 - RNA, 14 nt, Human
augcuguauauguu

SEQ ID NO: 1143649 - RNA, 20 nt, Human
augcuuauauuguucacuuc

SEQ ID NO: 1143650 - RNA, 13 nt, Human
uuuauuuuuuggg

SEQ ID NO: 1143651 - RNA, 16 nt, Human
uuuauuuuuugggaaa

SEQ ID NO: 1143652 - RNA, 14 nt, Human
uuucccaugauuuc

SEQ ID NO: 1143653 - RNA, 15 nt, Human
augggacuggccucu

SEQ ID NO: 1143654 - RNA, 21 nt, Human
uuuccuuuuaaaacacuucca

SEQ ID NO: 1143655 - RNA, 16 nt, Human
uuucuaguguaucaaa

SEQ ID NO: 1143656 - RNA, 19 nt, Human
uuucuaguguaucaaaaug

SEQ ID NO: 1143657 - RNA, 20 nt, Human
uuucuaguguaucaaaaugc

SEQ ID NO: 1143658 - RNA, 21 nt, Human
uuucuaguguaucaaaaugcu

SEQ ID NO: 1143659 - RNA, 22 nt, Human
uuucucauuugccaauaauaau

SEQ ID NO: 1143660 - RNA, 13 nt, Human
uuucugcaucucc

SEQ ID NO: 1143661 - RNA, 16 nt, Human
uuucugcaucuccacu

SEQ ID NO: 1143662 - RNA, 15 nt, Human
uuucugcaucuccac

SEQ ID NO: 1143663 - RNA, 12 nt, Human
augugugugugc

SEQ ID NO: 1143664 - RNA, 11 nt, Human
uuuuauuuccu

SEQ ID NO: 1143665 - RNA, 18 nt, Human
uuuuauuuccuaugaugu

SEQ ID NO: 1143666 - RNA, 16 nt, Human
uuuuauuuccuaugau

SEQ ID NO: 1143667 - RNA, 23 nt, Human
auuaaacaugacuccauagaccu

SEQ ID NO: 1143668 - RNA, 21 nt, Human
uuuugugaugucccaacuugu

SEQ ID NO: 1143669 - RNA, 20 nt, Human
uuuuuacccauuuguucaua

SEQ ID NO: 1143670 - RNA, 19 nt, Human
uuuuugugaaaagcuccau

SEQ ID NO: 1143671 - RNA, 15 nt, Human
auuacuuaguauugc

SEQ ID NO: 1143672 - RNA, 18 nt, Human
auuacuuaguauugcaaa

SEQ ID NO: 1143673 - RNA, 22 nt, Human
auuacuuaguauugcaaaguca

SEQ ID NO: 1143674 - RNA, 12 nt, Human
auucccucccca

SEQ ID NO: 1143675 - RNA, 14 nt, Human
auucucaugccuca

SEQ ID NO: 1143676 - RNA, 15 nt, Human
auucucaugccucag

SEQ ID NO: 1143677 - RNA, 21 nt, Human
auucucaugccucagccuccu

SEQ ID NO: 1143678 - RNA, 12 nt, Human
auucuccugccu

SEQ ID NO: 1143679 - RNA, 13 nt, Human
auucuccugccuc

SEQ ID NO: 1143680 - RNA, 14 nt, Human
auucuccugccuca

SEQ ID NO: 1143681 - RNA, 18 nt, Human
auucuucaagaucccauu

SEQ ID NO: 1143682 - RNA, 21 nt, Human
auucuucaagaucccauuuga

SEQ ID NO: 1143683 - RNA, 15 nt, Human
auugugcauucuaga

SEQ ID NO: 1143684 - RNA, 16 nt, Human
auuucaaacggccuca

SEQ ID NO: 1143685 - RNA, 22 nt, Human
auuucauuugugccagaaugcu

SEQ ID NO: 1143686 - RNA, 20 nt, Human
auuuccagugaaaucaguua

SEQ ID NO: 1143687 - RNA, 18 nt, Human
auuucccaugauuucaug

SEQ ID NO: 1143688 - RNA, 18 nt, Human
auuuucaacgcagcccug

SEQ ID NO: 1143689 - RNA, 20 nt, Human
auuuucaacgcagcccugcu

SEQ ID NO: 1143690 - RNA, 14 nt, Human
auuuucacuguguc

SEQ ID NO: 1143691 - RNA, 13 nt, Human
auuuucacugugu

SEQ ID NO: 1143692 - RNA, 22 nt, Human
auuuucaguuauuauauuuaca

SEQ ID NO: 1143693 - RNA, 21 nt, Human
caaaacuucguuuaaugaaug

SEQ ID NO: 1143694 - RNA, 22 nt, Human
caaaaugcucuuauuucaucau

SEQ ID NO: 1143695 - RNA, 16 nt, Human
caaaauguuauuuccc

SEQ ID NO: 1143696 - RNA, 17 nt, Human
caaaauguuauuucccu

SEQ ID NO: 1143697 - RNA, 18 nt, Human
caaaauguuauuucccua

SEQ ID NO: 1143698 - RNA, 13 nt, Human
caaaauuagccag

SEQ ID NO: 1143699 - RNA, 20 nt, Human
caaaauuagccaguaauccu

SEQ ID NO: 1143700 - RNA, 21 nt, Human
caaaauuagccaguaauccug

SEQ ID NO: 1143701 - RNA, 22 nt, Human
caaaauuagccaguaauccugu

SEQ ID NO: 1143702 - RNA, 23 nt, Human
caaaauuagccaguaauccugua

SEQ ID NO: 1143703 - RNA, 19 nt, Human
caaagugcugggauuacag

SEQ ID NO: 1143704 - RNA, 15 nt, Human
caaaugucuuccugg

SEQ ID NO: 1143705 - RNA, 13 nt, Human
caacccucagagc

SEQ ID NO: 1143706 - RNA, 18 nt, Human
caacccucagagccaccc

SEQ ID NO: 1143707 - RNA, 17 nt, Human
caacccuggcacccagg

SEQ ID NO: 1143708 - RNA, 20 nt, Human
caaccuguucugcuuuccuc

SEQ ID NO: 1143709 - RNA, 19 nt, Human
caaccuucgccaccugggu

SEQ ID NO: 1143710 - RNA, 16 nt, Human
caaccuucuguggcuc

SEQ ID NO: 1143711 - RNA, 15 nt, Human
caacugaccagccuc

SEQ ID NO: 1143712 - RNA, 17 nt, Human
caacugaccagccucca

SEQ ID NO: 1143713 - RNA, 19 nt, Human
caacugaccagccuccaug

SEQ ID NO: 1143714 - RNA, 13 nt, Human
caagagggcacug

SEQ ID NO: 1143715 - RNA, 14 nt, Human
caagagggcacugg

SEQ ID NO: 1143716 - RNA, 15 nt, Human
caagagggcacuggu

SEQ ID NO: 1143717 - RNA, 17 nt, Human
caagagggcacuggugg

SEQ ID NO: 1143718 - RNA, 18 nt, Human
caagccguggcuucccgc

SEQ ID NO: 1143719 - RNA, 14 nt, Human
caagccuggcaagg

SEQ ID NO: 1143720 - RNA, 18 nt, Human
caaggacagccccuccuc

SEQ ID NO: 1143721 - RNA, 15 nt, Human
caaggacugcaggga

SEQ ID NO: 1143722 - RNA, 22 nt, Human
caaggacugcagggacugccag

SEQ ID NO: 1143723 - RNA, 18 nt, Human
caaggguagggugggccu

SEQ ID NO: 1143724 - RNA, 19 nt, Human
caaggguagggugggccuu

SEQ ID NO: 1143725 - RNA, 17 nt, Human
caagugauucucaugcc

SEQ ID NO: 1143726 - RNA, 18 nt, Human
caagugauucucaugccu

SEQ ID NO: 1143727 - RNA, 20 nt, Human
caagugauucucaugccuca

SEQ ID NO: 1143728 - RNA, 21 nt, Human
caagugauucucaugccucag

SEQ ID NO: 1143729 - RNA, 19 nt, Human
caaguggcucccacacccu

SEQ ID NO: 1143730 - RNA, 12 nt, Human
caaguguaauga

SEQ ID NO: 1143731 - RNA, 15 nt, Human
caaguguaaugaaua

SEQ ID NO: 1143732 - RNA, 19 nt, Human
caaguguaaugaauaccuu

SEQ ID NO: 1143733 - RNA, 18 nt, Human
caaguguaaugaauaccu

SEQ ID NO: 1143734 - RNA, 16 nt, Human
caauacaaguuucauc

SEQ ID NO: 1143735 - RNA, 21 nt, Human
caauacaaguuucauccagaa

SEQ ID NO: 1143736 - RNA, 13 nt, Human
caauucuccugcc

SEQ ID NO: 1143737 - RNA, 14 nt, Human
caauucuccugccu

SEQ ID NO: 1143738 - RNA, 15 nt, Human
caauucuccugccuc

SEQ ID NO: 1143739 - RNA, 16 nt, Human
caauucuccugccuca

SEQ ID NO: 1143740 - RNA, 13 nt, Human
caauuugaugugg

SEQ ID NO: 1143741 - RNA, 14 nt, Human
cacaggagggaggg

SEQ ID NO: 1143742 - RNA, 19 nt, Human
cacaggagggagggggaag

SEQ ID NO: 1143743 - RNA, 21 nt, Human
cacaggagggagggggaaggc

SEQ ID NO: 1143744 - RNA, 14 nt, Human
cacagugcaucuca

SEQ ID NO: 1143745 - RNA, 17 nt, Human
cacagugcaucucagcc

SEQ ID NO: 1143746 - RNA, 21 nt, Human
cacauagugaugguuccccug

SEQ ID NO: 1143747 - RNA, 22 nt, Human
caccggccccauuuacccaacu

SEQ ID NO: 1143748 - RNA, 13 nt, Human
caccgggccugga

SEQ ID NO: 1143749 - RNA, 15 nt, Human
caccggggccucgga

SEQ ID NO: 1143750 - RNA, 15 nt, Human
caccgugccuggcca

SEQ ID NO: 1143751 - RNA, 20 nt, Human
caccgugccuggccacgccc

SEQ ID NO: 1143752 - RNA, 14 nt, Human
caccucccccaucu

SEQ ID NO: 1143753 - RNA, 21 nt, Human
caccucccccaucucuucugg

SEQ ID NO: 1143754 - RNA, 22 nt, Human
caccuuagccugcccuccuuuc

SEQ ID NO: 1143755 - RNA, 13 nt, Human
caccuucccaugc

SEQ ID NO: 1143756 - RNA, 14 nt, Human
caccuucccaugcc

SEQ ID NO: 1143757 - RNA, 14 nt, Human
cacgcuccuuccuc

SEQ ID NO: 1143758 - RNA, 15 nt, Human
cacgggggccaagga

SEQ ID NO: 1143759 - RNA, 13 nt, Human
cacgugacagccg

SEQ ID NO: 1143760 - RNA, 13 nt, Human
cacuaaacaaaga

SEQ ID NO: 1143761 - RNA, 18 nt, Human
cacuaucccggcugcccu

SEQ ID NO: 1143762 - RNA, 19 nt, Human
cacuaucccggcugcccuu

SEQ ID NO: 1143763 - RNA, 13 nt, Human
cacuccuaccugg

SEQ ID NO: 1143764 - RNA, 14 nt, Human
cacuccuaccuggu

SEQ ID NO: 1143765 - RNA, 19 nt, Human
cacucgaggucgggcagca

SEQ ID NO: 1143766 - RNA, 14 nt, Human
cacucuacuuagca

SEQ ID NO: 1143767 - RNA, 13 nt, Human
cacugagcacugu

SEQ ID NO: 1143768 - RNA, 15 nt, Human
cacugagcacuguuu

SEQ ID NO: 1143769 - RNA, 16 nt, Human
cacugagcacuguuuu

SEQ ID NO: 1143770 - RNA, 17 nt, Human
cacugagcacuguuuuc

SEQ ID NO: 1143771 - RNA, 18 nt, Human
cacugagcacuguuuucu

SEQ ID NO: 1143772 - RNA, 22 nt, Human
cacugagcacuguuuucuagug

SEQ ID NO: 1143773 - RNA, 19 nt, Human
cacugagcacuguuuucua

SEQ ID NO: 1143774 - RNA, 14 nt, Human
cacugcaaccuucg

SEQ ID NO: 1143775 - RNA, 22 nt, Human
cacugcaaccuucgccaccugg

SEQ ID NO: 1143776 - RNA, 23 nt, Human
cacugcaaccuucgccaccuggg

SEQ ID NO: 1143777 - RNA, 18 nt, Human
cacugcacagugcaucuc

SEQ ID NO: 1143778 - RNA, 19 nt, Human
cacugcacagugcaucuca

SEQ ID NO: 1143779 - RNA, 21 nt, Human
cacugcacagugcaucucagc

SEQ ID NO: 1143780 - RNA, 22 nt, Human
cacugcacagugcaucucagcc

SEQ ID NO: 1143781 - RNA, 23 nt, Human
cacugcacagugcaucucagccc

SEQ ID NO: 1143782 - RNA, 16 nt, Human
cacugccucuuccucc

SEQ ID NO: 1143783 - RNA, 20 nt, Human
cacugccuucgauacaccgg

SEQ ID NO: 1143784 - RNA, 22 nt, Human
cacugccuucgauacaccgggc

SEQ ID NO: 1143785 - RNA, 20 nt, Human
cacugcucugaugaagagga

SEQ ID NO: 1143786 - RNA, 15 nt, Human
cacugcugcccagcc

SEQ ID NO: 1143787 - RNA, 17 nt, Human
cacugcugcccagccuc

SEQ ID NO: 1143788 - RNA, 12 nt, Human
cacugcuggcug

SEQ ID NO: 1143789 - RNA, 13 nt, Human
cacugcuggcugc

SEQ ID NO: 1143790 - RNA, 14 nt, Human
cacugcuggcugcc

SEQ ID NO: 1143791 - RNA, 15 nt, Human
cacugcuggcugccu

SEQ ID NO: 1143792 - RNA, 16 nt, Human
cacugcuggcugccuu

SEQ ID NO: 1143793 - RNA, 21 nt, Human
cacugcuggcugccuuagaac

SEQ ID NO: 1143794 - RNA, 15 nt, Human
cacuggacucaccuc

SEQ ID NO: 1143795 - RNA, 18 nt, Human
cacuggacucaccucccc

SEQ ID NO: 1143796 - RNA, 14 nt, Human
cacugugcuguugu

SEQ ID NO: 1143797 - RNA, 15 nt, Human
cacugugcuguuguu

SEQ ID NO: 1143798 - RNA, 17 nt, Human
cacugugcuguuguuau

SEQ ID NO: 1143799 - RNA, 19 nt, Human
cacugugcuguuguuauga

SEQ ID NO: 1143800 - RNA, 20 nt, Human
cacugugcuguuguuaugau

SEQ ID NO: 1143801 - RNA, 23 nt, Human
cacugugcuguuguuaugaugug

SEQ ID NO: 1143802 - RNA, 21 nt, Human
cacugugcuguuguuaugaug

SEQ ID NO: 1143803 - RNA, 12 nt, Human
cacuucacugug

SEQ ID NO: 1143804 - RNA, 13 nt, Human
cacuucacugugc

SEQ ID NO: 1143805 - RNA, 15 nt, Human
cacuucacugugcug

SEQ ID NO: 1143806 - RNA, 14 nt, Human
cacuucaggcucuu

SEQ ID NO: 1143807 - RNA, 15 nt, Human
cacuucaggcucuuc

SEQ ID NO: 1143808 - RNA, 16 nt, Human
cacuucaggcucuucu

SEQ ID NO: 1143809 - RNA, 20 nt, Human
cacuucaggcucuucuccuu

SEQ ID NO: 1143810 - RNA, 23 nt, Human
cacuucaggcucuucuccuuuca

SEQ ID NO: 1143811 - RNA, 20 nt, Human
cacuuccauaaucuggacuc

SEQ ID NO: 1143812 - RNA, 19 nt, Human
cacuugaugacccccaacc

SEQ ID NO: 1143813 - RNA, 18 nt, Human
cacuuuuauuuagcacca

SEQ ID NO: 1143814 - RNA, 24 nt, Human
cagaaagaaguggggacagagcag

SEQ ID NO: 1143815 - RNA, 22 nt, Human
cagaacccuuggagccaaugga

SEQ ID NO: 1143816 - RNA, 19 nt, Human
cagaacuaccaccugacau

SEQ ID NO: 1143817 - RNA, 15 nt, Human
cagaaucucgcucug

SEQ ID NO: 1143818 - RNA, 14 nt, Human
cagacauugugcua

SEQ ID NO: 1143819 - RNA, 13 nt, Human
cagaccccuggcu

SEQ ID NO: 1143820 - RNA, 14 nt, Human
cagaccccuggcuu

SEQ ID NO: 1143821 - RNA, 15 nt, Human
cagaccccuggcuuu

SEQ ID NO: 1143822 - RNA, 16 nt, Human
cagaccccuggcuuuu

SEQ ID NO: 1143823 - RNA, 18 nt, Human
cagaccccuggcuuuuca

SEQ ID NO: 1143824 - RNA, 21 nt, Human
cagaccccuggcuuuucacug

SEQ ID NO: 1143825 - RNA, 22 nt, Human
cagaccccuggcuuuucacugc

SEQ ID NO: 1143826 - RNA, 23 nt, Human
cagaccccuggcuuuucacugcu

SEQ ID NO: 1143827 - RNA, 20 nt, Human
cagacuuuuuuuaaauagua

SEQ ID NO: 1143828 - RNA, 13 nt, Human
cagagaguggcuc

SEQ ID NO: 1143829 - RNA, 14 nt, Human
cagagaguggcucc

SEQ ID NO: 1143830 - RNA, 15 nt, Human
cagagaguggcuccu

SEQ ID NO: 1143831 - RNA, 18 nt, Human
cagagaguggcuccuccc

SEQ ID NO: 1143832 - RNA, 18 nt, Human
cagagcacagcagccccu

SEQ ID NO: 1143833 - RNA, 22 nt, Human
cagagccaccccuaaagagaua

SEQ ID NO: 1143834 - RNA, 23 nt, Human
cagaugacaagaaaggcugcugu

SEQ ID NO: 1143835 - RNA, 15 nt, Human
cagaugcugugcaaa

SEQ ID NO: 1143836 - RNA, 16 nt, Human
cagauguccaucagau

SEQ ID NO: 1143837 - RNA, 19 nt, Human
cagauguccaucagaugac

SEQ ID NO: 1143838 - RNA, 21 nt, Human
cagauguccaucagaugacaa

SEQ ID NO: 1143839 - RNA, 15 nt, Human
cagaugucuauauug

SEQ ID NO: 1143840 - RNA, 15 nt, Human
cagauucuugcaucc

SEQ ID NO: 1143841 - RNA, 19 nt, Human
cagauuuuuuacagcugcc

SEQ ID NO: 1143842 - RNA, 22 nt, Human
cagauuuuuuacagcugccugc

SEQ ID NO: 1143843 - RNA, 16 nt, Human
cagcaaauccuuugug

SEQ ID NO: 1143844 - RNA, 18 nt, Human
cagcaaauccuuugugaa

SEQ ID NO: 1143845 - RNA, 15 nt, Human
cagcaauucuccugc

SEQ ID NO: 1143846 - RNA, 16 nt, Human
cagcaauucuccugcc

SEQ ID NO: 1143847 - RNA, 17 nt, Human
cagcaauucuccugccu

SEQ ID NO: 1143848 - RNA, 18 nt, Human
cagcaauucuccugccuc

SEQ ID NO: 1143849 - RNA, 19 nt, Human
cagcaauucuccugccuca

SEQ ID NO: 1143850 - RNA, 20 nt, Human
cagcaauucuccugccucag

SEQ ID NO: 1143851 - RNA, 13 nt, Human
cagcagccccugc

SEQ ID NO: 1143852 - RNA, 16 nt, Human
cagcagccccugcaca

SEQ ID NO: 1143853 - RNA, 23 nt, Human
cagcagccccugcacaaagcccu

SEQ ID NO: 1143854 - RNA, 13 nt, Human
cagcaucucagcu

SEQ ID NO: 1143855 - RNA, 14 nt, Human
cagcaucucagcuc

SEQ ID NO: 1143856 - RNA, 14 nt, Human
cagcauucucacuc

SEQ ID NO: 1143857 - RNA, 15 nt, Human
cagcauucucacucc

SEQ ID NO: 1143858 - RNA, 19 nt, Human
cagcccacauagugauggu

SEQ ID NO: 1143859 - RNA, 18 nt, Human
cagccuccaugcugccuc

SEQ ID NO: 1143860 - RNA, 22 nt, Human
cagcccuccaucuaaacugccc

SEQ ID NO: 1143861 - RNA, 23 nt, Human
cagcccuccaucuaaacugcccc

SEQ ID NO: 1143862 - RNA, 13 nt, Human
cagcccucccugc

SEQ ID NO: 1143863 - RNA, 15 nt, Human
cagcccucccugccc

SEQ ID NO: 1143864 - RNA, 16 nt, Human
cagcccucccugcccc

SEQ ID NO: 1143865 - RNA, 17 nt, Human
cagcccucccugccccu

SEQ ID NO: 1143866 - RNA, 18 nt, Human
cagcccucccugccccuc

SEQ ID NO: 1143867 - RNA, 22 nt, Human
cagcccucccugccccucccuu

SEQ ID NO: 1143868 - RNA, 11 nt, Human
cagcccugcuu

SEQ ID NO: 1143869 - RNA, 13 nt, Human
cagcccugcuuug

SEQ ID NO: 1143870 - RNA, 19 nt, Human
cagcccugcuuugggcugc

SEQ ID NO: 1143871 - RNA, 20 nt, Human
cagcccugcuuugggcugcc

SEQ ID NO: 1143872 - RNA, 21 nt, Human
cagcccugcuuugggcugccc

SEQ ID NO: 1143873 - RNA, 22 nt, Human
cagcccugcuuugggcugcccu

SEQ ID NO: 1143874 - RNA, 23 nt, Human
cagcccugcuuugggcugcccug

SEQ ID NO: 1143875 - RNA, 9 nt, Human
cagccgugc

SEQ ID NO: 1143876 - RNA, 14 nt, Human
cagccgugccuuca

SEQ ID NO: 1143877 - RNA, 16 nt, Human
cagccgugccuucagc

SEQ ID NO: 1143878 - RNA, 18 nt, Human
cagccgugccuucagcuc

SEQ ID NO: 1143879 - RNA, 20 nt, Human
cagccgugccuucagcucua

SEQ ID NO: 1143880 - RNA, 14 nt, Human
cagccuccaagcuc

SEQ ID NO: 1143881 - RNA, 20 nt, Human
cagccuccaagcuccaucuc

SEQ ID NO: 1143882 - RNA, 14 nt, Human
cagccuccaugcug

SEQ ID NO: 1143883 - RNA, 15 nt, Human
cagccuccaugcugc

SEQ ID NO: 1143884 - RNA, 17 nt, Human
cagccuccaugcugccu

SEQ ID NO: 1143885 - RNA, 20 nt, Human
cagccuccaugcugccucca

SEQ ID NO: 1143886 - RNA, 15 nt, Human
cagccuccugaguag

SEQ ID NO: 1143887 - RNA, 10 nt, Human
cagccuggca

SEQ ID NO: 1143888 - RNA, 13 nt, Human
cagccuggcacag

SEQ ID NO: 1143889 - RNA, 20 nt, Human
cagccuggcacagggcagug

SEQ ID NO: 1143890 - RNA, 21 nt, Human
cagccuggcacagggcagugg

SEQ ID NO: 1143891 - RNA, 19 nt, Human
cagcuaaucagcauucuca

SEQ ID NO: 1143892 - RNA, 12 nt, Human
cagcucacugca

SEQ ID NO: 1143893 - RNA, 14 nt, Human
cagcucacugcaac

SEQ ID NO: 1143894 - RNA, 15 nt, Human
cagcucacugcaacc

SEQ ID NO: 1143895 - RNA, 21 nt, Human
cagcucacugcaaccuucgcc

SEQ ID NO: 1143896 - RNA, 21 nt, Human
cagcugcucaauaaaguacaa

SEQ ID NO: 1143897 - RNA, 19 nt, Human
cagcuggccgggagccuga

SEQ ID NO: 1143898 - RNA, 23 nt, Human
cagcugggaucacauguggacuu

SEQ ID NO: 1143899 - RNA, 16 nt, Human
cagcuggguuggaaaa

SEQ ID NO: 1143900 - RNA, 17 nt, Human
cagcuggguuggaaaac

SEQ ID NO: 1143901 - RNA, 22 nt, Human
cagcuuuaaaaaauuaaucugg

SEQ ID NO: 1143902 - RNA, 23 nt, Human
cagcuuuccccaugucucgacuc

SEQ ID NO: 1143903 - RNA, 14 nt, Human
cagcuuugauauuu

SEQ ID NO: 1143904 - RNA, 16 nt, Human
cagcuuugcucauauu

SEQ ID NO: 1143905 - RNA, 21 nt, Human
cagcuuugcucauauuuccca

SEQ ID NO: 1143906 - RNA, 20 nt, Human
cagcuuugcucauauuuccc

SEQ ID NO: 1143907 - RNA, 23 nt, Human
cagcuuuuggauuggacaaaaug

SEQ ID NO: 1143908 - RNA, 15 nt, Human
caggaacguuuagcu

SEQ ID NO: 1143909 - RNA, 14 nt, Human
caggaagcagcuuu

SEQ ID NO: 1143910 - RNA, 19 nt, Human
caggaaggcugagaggaga

SEQ ID NO: 1143911 - RNA, 12 nt, Human
caggacucugcc

SEQ ID NO: 1143912 - RNA, 13 nt, Human
caggacucugccu

SEQ ID NO: 1143913 - RNA, 15 nt, Human
caggacucugccucc

SEQ ID NO: 1143914 - RNA, 16 nt, Human
caggacucugccuccu

SEQ ID NO: 1143915 - RNA, 16 nt, Human
caggaguuggaagugu

SEQ ID NO: 1143916 - RNA, 13 nt, Human
caggauagacuuu

SEQ ID NO: 1143917 - RNA, 19 nt, Human
caggauguacaaggacagc

SEQ ID NO: 1143918 - RNA, 20 nt, Human
caggcaggaaggcugagagg

SEQ ID NO: 1143919 - RNA, 18 nt, Human
caggccauuccccgucuc

SEQ ID NO: 1143920 - RNA, 21 nt, Human
caggccauuccccgucucugg

SEQ ID NO: 1143921 - RNA, 15 nt, Human
caggcccuuccucuc

SEQ ID NO: 1143922 - RNA, 16 nt, Human
caggcccuuccucucc

SEQ ID NO: 1143923 - RNA, 17 nt, Human
caggcccuuccucucca

SEQ ID NO: 1143924 - RNA, 19 nt, Human
caggcccuuccucuccacu

SEQ ID NO: 1143925 - RNA, 20 nt, Human
caggcccuuccucuccacug

SEQ ID NO: 1143926 - RNA, 21 nt, Human
caggcccuuccucuccacugc

SEQ ID NO: 1143927 - RNA, 23 nt, Human
caggcccuuccucuccacugccu

SEQ ID NO: 1143928 - RNA, 13 nt, Human
caggcuccugcca

SEQ ID NO: 1143929 - RNA, 14 nt, Human
caggcuccugccac

SEQ ID NO: 1143930 - RNA, 15 nt, Human
caggcuccugccacc

SEQ ID NO: 1143931 - RNA, 16 nt, Human
caggcuccugccacca

SEQ ID NO: 1143932 - RNA, 18 nt, Human
caggcuccugccaccacg

SEQ ID NO: 1143933 - RNA, 12 nt, Human
caggcucuucuc

SEQ ID NO: 1143934 - RNA, 14 nt, Human
caggcucuucuccu

SEQ ID NO: 1143935 - RNA, 15 nt, Human
caggcucuucuccuu

SEQ ID NO: 1143936 - RNA, 18 nt, Human
caggcucuucuccuuuca

SEQ ID NO: 1143937 - RNA, 22 nt, Human
caggcucuucuccuuucacaac

SEQ ID NO: 1143938 - RNA, 12 nt, Human
caggcugagccu

SEQ ID NO: 1143939 - RNA, 13 nt, Human
caggcugagccuc

SEQ ID NO: 1143940 - RNA, 14 nt, Human
caggcugagccuca

SEQ ID NO: 1143941 - RNA, 15 nt, Human
caggcugagccucag

SEQ ID NO: 1143942 - RNA, 16 nt, Human
caggcugagccucagu

SEQ ID NO: 1143943 - RNA, 17 nt, Human
caggcugagccucaguc

SEQ ID NO: 1143944 - RNA, 21 nt, Human
caggcugagccucagucuccc

SEQ ID NO: 1143945 - RNA, 15 nt, Human
caggcugcggccccu

SEQ ID NO: 1143946 - RNA, 16 nt, Human
caggcugcggccccuc

SEQ ID NO: 1143947 - RNA, 18 nt, Human
caggcugcggccccuccc

SEQ ID NO: 1143948 - RNA, 19 nt, Human
caggcugcggccccucccc

SEQ ID NO: 1143949 - RNA, 20 nt, Human
caggcugcggccccuccccc

SEQ ID NO: 1143950 - RNA, 12 nt, Human
caggcugcucuu

SEQ ID NO: 1143951 - RNA, 20 nt, Human
caggcugcucuugaacuccu

SEQ ID NO: 1143952 - RNA, 23 nt, Human
caggcugcucuugaacuccugac

SEQ ID NO: 1143953 - RNA, 12 nt, Human
caggcuggcccu

SEQ ID NO: 1143954 - RNA, 14 nt, Human
caggcuggcccugc

SEQ ID NO: 1143955 - RNA, 15 nt, Human
caggcuggcccugcc

SEQ ID NO: 1143956 - RNA, 16 nt, Human
caggcuggcccugccc

SEQ ID NO: 1143957 - RNA, 17 nt, Human
caggcuggcccugcccu

SEQ ID NO: 1143958 - RNA, 20 nt, Human
caggcuggucucgaacuccu

SEQ ID NO: 1143959 - RNA, 22 nt, Human
caggcuggucucgaacuccuga

SEQ ID NO: 1143960 - RNA, 23 nt, Human
caggcuggucucgaacuccugac

SEQ ID NO: 1143961 - RNA, 14 nt, Human
caggcugugaguuu

SEQ ID NO: 1143962 - RNA, 19 nt, Human
cagggaacgugauuaguga

SEQ ID NO: 1143963 - RNA, 18 nt, Human
cagggaacgugauuagug

SEQ ID NO: 1143964 - RNA, 15 nt, Human
cagggaaggggacaa

SEQ ID NO: 1143965 - RNA, 17 nt, Human
cagggaaggggacaagg

SEQ ID NO: 1143966 - RNA, 20 nt, Human
cagggcauggccagguggcc

SEQ ID NO: 1143967 - RNA, 12 nt, Human
caggguaacuaa

SEQ ID NO: 1143968 - RNA, 19 nt, Human
caggguaacuaacuaaaac

SEQ ID NO: 1143969 - RNA, 22 nt, Human
caggguaacuaacuaaaacaaa

SEQ ID NO: 1143970 - RNA, 21 nt, Human
caggguaacuaacuaaaacaa

SEQ ID NO: 1143971 - RNA, 17 nt, Human
cagguaaucgaccugcc

SEQ ID NO: 1143972 - RNA, 18 nt, Human
cagguaaucgaccugccu

SEQ ID NO: 1143973 - RNA, 19 nt, Human
cagguaaucgaccugccuc

SEQ ID NO: 1143974 - RNA, 20 nt, Human
cagguaaucgaccugccucg

SEQ ID NO: 1143975 - RNA, 15 nt, Human
cagguggccacucca

SEQ ID NO: 1143976 - RNA, 16 nt, Human
cagguggccacuccag

SEQ ID NO: 1143977 - RNA, 19 nt, Human
cagguggccacuccagacc

SEQ ID NO: 1143978 - RNA, 21 nt, Human
cagguggccacuccagacccc

SEQ ID NO: 1143979 - RNA, 18 nt, Human
caggugugagccaccacg

SEQ ID NO: 1143980 - RNA, 21 nt, Human
caggugugagccaccacgccc

SEQ ID NO: 1143981 - RNA, 12 nt, Human
caguaauccugu

SEQ ID NO: 1143982 - RNA, 13 nt, Human
caguaauccugua

SEQ ID NO: 1143983 - RNA, 16 nt, Human
caguaauccuguagga

SEQ ID NO: 1143984 - RNA, 17 nt, Human
caguaauccuguaggaa

SEQ ID NO: 1143985 - RNA, 21 nt, Human
caguaauccuguaggaaggua

SEQ ID NO: 1143986 - RNA, 23 nt, Human
caguaauccuguaggaagguacu

SEQ ID NO: 1143987 - RNA, 17 nt, Human
caguaauuguguuuaca

SEQ ID NO: 1143988 - RNA, 18 nt, Human
caguaauuguguuuacau

SEQ ID NO: 1143989 - RNA, 20 nt, Human
caguaauuguguuuacauuu

SEQ ID NO: 1143990 - RNA, 14 nt, Human
caguaucggcacug

SEQ ID NO: 1143991 - RNA, 15 nt, Human
caguaucggcacugu

SEQ ID NO: 1143992 - RNA, 16 nt, Human
caguaucggcacugua

SEQ ID NO: 1143993 - RNA, 20 nt, Human
caguaucggcacuguacaaa

SEQ ID NO: 1143994 - RNA, 19 nt, Human
caguaucggcacuguacaa

SEQ ID NO: 1143995 - RNA, 23 nt, Human
caguccccgugaaggagagcccu

SEQ ID NO: 1143996 - RNA, 16 nt, Human
cagucccccugcccca

SEQ ID NO: 1143997 - RNA, 17 nt, Human
cagucccccugccccag

SEQ ID NO: 1143998 - RNA, 16 nt, Human
cagugaaagaaaauaa

SEQ ID NO: 1143999 - RNA, 20 nt, Human
cagugaaagaaaauaacaau

SEQ ID NO: 1144000 - RNA, 15 nt, Human
cagugcccuccagga

SEQ ID NO: 1144001 - RNA, 18 nt, Human
cauagugaugguuccccu

SEQ ID NO: 1144002 - RNA, 19 nt, Human
cauagugaugguuccccug

SEQ ID NO: 1144003 - RNA, 22 nt, Human
cauagugaugguuccccuguuc

SEQ ID NO: 1144004 - RNA, 20 nt, Human
cauauaaauagaauguaaau

SEQ ID NO: 1144005 - RNA, 21 nt, Human
cauauaaauagaauguaaaug

SEQ ID NO: 1144006 - RNA, 22 nt, Human
cauauaaauagaauguaaaugu

SEQ ID NO: 1144007 - RNA, 19 nt, Human
cauauaagggaaguaguua

SEQ ID NO: 1144008 - RNA, 23 nt, Human
cauauaagggaaguaguuaucau

SEQ ID NO: 1144009 - RNA, 16 nt, Human
caucauucacuucacu

SEQ ID NO: 1144010 - RNA, 17 nt, Human
caucauucacuucacug

SEQ ID NO: 1144011 - RNA, 18 nt, Human
caucauucacuucacugu

SEQ ID NO: 1144012 - RNA, 20 nt, Human
caucauucacuucacugugc

SEQ ID NO: 1144013 - RNA, 19 nt, Human
caucauucacuucacugug

SEQ ID NO: 1144014 - RNA, 12 nt, Human
cauccauccagg

SEQ ID NO: 1144015 - RNA, 18 nt, Human
cauccuacaagacacagu

SEQ ID NO: 1144016 - RNA, 19 nt, Human
cauccuacaagacacagug

SEQ ID NO: 1144017 - RNA, 15 nt, Human
caugaagaccuuuuu

SEQ ID NO: 1144018 - RNA, 22 nt, Human
caugaagaccuuuuucugcacu

SEQ ID NO: 1144019 - RNA, 17 nt, Human
caugaagaccuuuuucu

SEQ ID NO: 1144020 - RNA, 19 nt, Human
caugaagaccuuuuucugc

SEQ ID NO: 1144021 - RNA, 20 nt, Human
caugaagaccuuuuucugca

SEQ ID NO: 1144022 - RNA, 20 nt, Human
caugacucguauaugucuca

SEQ ID NO: 1144023 - RNA, 23 nt, Human
caugacucguauaugucucaggu

SEQ ID NO: 1144024 - RNA, 20 nt, Human
caugcagaacaaaugaagac

SEQ ID NO: 1144025 - RNA, 19 nt, Human
caugcagaacaaaugaaga

SEQ ID NO: 1144026 - RNA, 14 nt, Human
caugcagcaucuaa

SEQ ID NO: 1144027 - RNA, 23 nt, Human
cauggaaacaagaugaaauucca

SEQ ID NO: 1144028 - RNA, 15 nt, Human
cauguacugcauuau

SEQ ID NO: 1144029 - RNA, 16 nt, Human
cauguacugcauuauu

SEQ ID NO: 1144030 - RNA, 17 nt, Human
cauguacugcauuauuu

SEQ ID NO: 1144031 - RNA, 22 nt, Human
cauguacugcauuauuugagaa

SEQ ID NO: 1144032 - RNA, 23 nt, Human
cauguacugcauuauuugagaag

SEQ ID NO: 1144033 - RNA, 14 nt, Human
caugucucgacuca

SEQ ID NO: 1144034 - RNA, 18 nt, Human
cauguguuggcagccucu

SEQ ID NO: 1144035 - RNA, 15 nt, Human
cauuaaacaugacuc

SEQ ID NO: 1144036 - RNA, 14 nt, Human
cauucaagauuccc

SEQ ID NO: 1144037 - RNA, 14 nt, Human
cauucacuucacug

SEQ ID NO: 1144038 - RNA, 17 nt, Human
cauucacuucacugugc

SEQ ID NO: 1144039 - RNA, 18 nt, Human
cauucacuucacugugcu

SEQ ID NO: 1144040 - RNA, 19 nt, Human
cauucacuucacugugcug

SEQ ID NO: 1144041 - RNA, 20 nt, Human
cauucacuucacugugcugu

SEQ ID NO: 1144042 - RNA, 17 nt, Human
cauuccaccuucccaug

SEQ ID NO: 1144043 - RNA, 22 nt, Human
cauuccaccuucccaugcccug

SEQ ID NO: 1144044 - RNA, 13 nt, Human
cauuccccauggg

SEQ ID NO: 1144045 - RNA, 17 nt, Human
cauuccccgucucuggu

SEQ ID NO: 1144046 - RNA, 18 nt, Human
cauuccucccauucaaga

SEQ ID NO: 1144047 - RNA, 19 nt, Human
cauuccucccauucaagau

SEQ ID NO: 1144048 - RNA, 13 nt, Human
cauucuggaauaa

SEQ ID NO: 1144049 - RNA, 12 nt, Human
cauucuucaaga

SEQ ID NO: 1144050 - RNA, 13 nt, Human
cauucuucaagau

SEQ ID NO: 1144051 - RNA, 17 nt, Human
cauucuucaagauccca

SEQ ID NO: 1144052 - RNA, 14 nt, Human
cauuuucugcaucu

SEQ ID NO: 1144053 - RNA, 16 nt, Human
cauuuucugcaucucc

SEQ ID NO: 1144054 - RNA, 17 nt, Human
cauuuucugcaucucca

SEQ ID NO: 1144055 - RNA, 23 nt, Human
ccaaaauuagccaguaauccugu

SEQ ID NO: 1144056 - RNA, 14 nt, Human
ccacacuccagcug

SEQ ID NO: 1144057 - RNA, 17 nt, Human
ccacacuccagcuggga

SEQ ID NO: 1144058 - RNA, 19 nt, Human
ccacauagugaugguuccc

SEQ ID NO: 1144059 - RNA, 21 nt, Human
ccacauagugaugguuccccu

SEQ ID NO: 1144060 - RNA, 22 nt, Human
ccacauagugaugguuccccug

SEQ ID NO: 1144061 - RNA, 23 nt, Human
ccacauagugaugguuccccugu

SEQ ID NO: 1144062 - RNA, 20 nt, Human
ccaccugacauuccuugcug

SEQ ID NO: 1144063 - RNA, 14 nt, Human
ccaccugcccaacc

SEQ ID NO: 1144064 - RNA, 17 nt, Human
ccacuccagaccccugg

SEQ ID NO: 1144065 - RNA, 19 nt, Human
ccacuccagaccccuggcu

SEQ ID NO: 1144066 - RNA, 20 nt, Human
ccacuccagaccccuggcuu

SEQ ID NO: 1144067 - RNA, 11 nt, Human
ccacugccucu

SEQ ID NO: 1144068 - RNA, 23 nt, Human
ccacuggcuggacaaacugcacc

SEQ ID NO: 1144069 - RNA, 16 nt, Human
ccacuggcuggacaaa

SEQ ID NO: 1144070 - RNA, 16 nt, Human
ccagcaauucuccugc

SEQ ID NO: 1144071 - RNA, 18 nt, Human
ccagcaauucuccugccu

SEQ ID NO: 1144072 - RNA, 19 nt, Human
ccagcaauucuccugccuc

SEQ ID NO: 1144073 - RNA, 20 nt, Human
ccagcaauucuccugccuca

SEQ ID NO: 1144074 - RNA, 21 nt, Human
ccagcaauucuccugccucag

SEQ ID NO: 1144075 - RNA, 21 nt, Human
ccagcccuccuuaucaaagga

SEQ ID NO: 1144076 - RNA, 21 nt, Human
ccagccuccaagcuccaucuc

SEQ ID NO: 1144077 - RNA, 15 nt, Human
ccagccuccaugcug

SEQ ID NO: 1144078 - RNA, 16 nt, Human
ccagccuccaugcugc

SEQ ID NO: 1144079 - RNA, 18 nt, Human
ccaggcgccccuuccccc

SEQ ID NO: 1144080 - RNA, 19 nt, Human
ccaggcgccccuucccccu

SEQ ID NO: 1144081 - RNA, 21 nt, Human
ccagggcuggaaugauuucag

SEQ ID NO: 1144082 - RNA, 12 nt, Human
ccauaggucacc

SEQ ID NO: 1144083 - RNA, 21 nt, Human
ccauaguaugggacuggccuc

SEQ ID NO: 1144084 - RNA, 14 nt, Human
ccaucuaaacugcc

SEQ ID NO: 1144085 - RNA, 15 nt, Human
ccaucuaaacugccc

SEQ ID NO: 1144086 - RNA, 16 nt, Human
ccaucuaaacugcccc

SEQ ID NO: 1144087 - RNA, 21 nt, Human
ccaugggaaaugucaacaagu

SEQ ID NO: 1144088 - RNA, 18 nt, Human
ccauguuggccaggcugc

SEQ ID NO: 1144089 - RNA, 21 nt, Human
ccauguuggccaggcugcucu

SEQ ID NO: 1144090 - RNA, 18 nt, Human
ccauguuggccaggcugg

SEQ ID NO: 1144091 - RNA, 13 nt, Human
ccauuuguucaua

SEQ ID NO: 1144092 - RNA, 15 nt, Human
cccaacccuggcacc

SEQ ID NO: 1144093 - RNA, 13 nt, Human
cccaaccugcucu

SEQ ID NO: 1144094 - RNA, 17 nt, Human
cccaaggcucugagcaa

SEQ ID NO: 1144095 - RNA, 23 nt, Human
cccaccgggcugggagcucugca

SEQ ID NO: 1144096 - RNA, 18 nt, Human
cccggugcccaagaauag

SEQ ID NO: 1144097 - RNA, 22 nt, Human
cccgucucugguuccuccccuc

SEQ ID NO: 1144098 - RNA, 17 nt, Human
cccuaaugcgcaggcug

SEQ ID NO: 1144099 - RNA, 21 nt, Human
cccuaaugcgcaggcuggccc

SEQ ID NO: 1144100 - RNA, 22 nt, Human
cccuaaugcgcaggcuggcccu

SEQ ID NO: 1144101 - RNA, 23 nt, Human
cccuaaugcgcaggcuggcccug

SEQ ID NO: 1144102 - RNA, 18 nt, Human
cccuaccgagucucuucu

SEQ ID NO: 1144103 - RNA, 21 nt, Human
cccuaccgagucucuucucca

SEQ ID NO: 1144104 - RNA, 22 nt, Human
cccuauccuacuuccccuuccu

SEQ ID NO: 1144105 - RNA, 13 nt, Human
cccucccccgucc

SEQ ID NO: 1144106 - RNA, 15 nt, Human
cccugcaaagcccag

SEQ ID NO: 1144107 - RNA, 16 nt, Human
cccugcaaagcccagc

SEQ ID NO: 1144108 - RNA, 17 nt, Human
cccugcaaagcccagcu

SEQ ID NO: 1144109 - RNA, 19 nt, Human
cccugcaaagcccagcuug

SEQ ID NO: 1144110 - RNA, 20 nt, Human
cccugcaaagcccagcuuga

SEQ ID NO: 1144111 - RNA, 17 nt, Human
cccugcuuugggcugcc

SEQ ID NO: 1144112 - RNA, 18 nt, Human
cccugcuuugggcugccc

SEQ ID NO: 1144113 - RNA, 19 nt, Human
cccugcuuugggcugcccu

SEQ ID NO: 1144114 - RNA, 20 nt, Human
cccugcuuugggcugcccug

SEQ ID NO: 1144115 - RNA, 22 nt, Human
cccugcuuugggcugcccuggu

SEQ ID NO: 1144116 - RNA, 18 nt, Human
cccuggcuuuucacugcu

SEQ ID NO: 1144117 - RNA, 19 nt, Human
cccuggcuuuucacugcug

SEQ ID NO: 1144118 - RNA, 22 nt, Human
cccuggcuuuucacugcuggcu

SEQ ID NO: 1144119 - RNA, 18 nt, Human
cccugggaggcagugaug

SEQ ID NO: 1144120 - RNA, 16 nt, Human
cccugguuuccugccc

SEQ ID NO: 1144121 - RNA, 17 nt, Human
cccugguuuccugcccu

SEQ ID NO: 1144122 - RNA, 18 nt, Human
cccugguuuccugcccug

SEQ ID NO: 1144123 - RNA, 19 nt, Human
cccugguuuccugcccugg

SEQ ID NO: 1144124 - RNA, 11 nt, Human
ccgcucagccc

SEQ ID NO: 1144125 - RNA, 12 nt, Human
ccgcucagcccu

SEQ ID NO: 1144126 - RNA, 13 nt, Human
ccgcucagcccuc

SEQ ID NO: 1144127 - RNA, 15 nt, Human
ccgcucagcccuccc

SEQ ID NO: 1144128 - RNA, 19 nt, Human
ccgcucagcccucccugcc

SEQ ID NO: 1144129 - RNA, 21 nt, Human
ccgcucagcccucccugcccc

SEQ ID NO: 1144130 - RNA, 22 nt, Human
ccgcucagcccucccugccccu

SEQ ID NO: 1144131 - RNA, 13 nt, Human
ccgggacccccag

SEQ ID NO: 1144132 - RNA, 15 nt, Human
ccgggacccccagga

SEQ ID NO: 1144133 - RNA, 17 nt, Human
ccgggacccccaggaca

SEQ ID NO: 1144134 - RNA, 13 nt, Human
ccgggcugggagc

SEQ ID NO: 1144135 - RNA, 18 nt, Human
ccgggcugggagcucugc

SEQ ID NO: 1144136 - RNA, 19 nt, Human
ccgggcugggagcucugca

SEQ ID NO: 1144137 - RNA, 15 nt, Human
ccuacaagacacagu

SEQ ID NO: 1144138 - RNA, 22 nt, Human
ccuaccgagucucuucuccacu

SEQ ID NO: 1144139 - RNA, 23 nt, Human
ccuaccgagucucuucuccacug

SEQ ID NO: 1144140 - RNA, 13 nt, Human
ccuacuuccugug

SEQ ID NO: 1144141 - RNA, 15 nt, Human
ccuacuuccugugac

SEQ ID NO: 1144142 - RNA, 22 nt, Human
ccuaugauguauacugccacua

SEQ ID NO: 1144143 - RNA, 19 nt, Human
ccuaugcagagguccacaa

SEQ ID NO: 1144144 - RNA, 17 nt, Human
ccucauagcccucaccc

SEQ ID NO: 1144145 - RNA, 18 nt, Human
ccucauagcccucacccu

SEQ ID NO: 1144146 - RNA, 21 nt, Human
ccucauagcccucacccuggg

SEQ ID NO: 1144147 - RNA, 22 nt, Human
ccucauagcccucacccugggg

SEQ ID NO: 1144148 - RNA, 23 nt, Human
ccuccaaucccaccaacccucag

SEQ ID NO: 1144149 - RNA, 18 nt, Human
ccuccaucuaaacugccc

SEQ ID NO: 1144150 - RNA, 14 nt, Human
ccuccaugcugccu

SEQ ID NO: 1144151 - RNA, 15 nt, Human
ccuccaugcugccuc

SEQ ID NO: 1144152 - RNA, 16 nt, Human
ccuccaugcugccucc

SEQ ID NO: 1144153 - RNA, 18 nt, Human
ccucccugccccucccuu

SEQ ID NO: 1144154 - RNA, 21 nt, Human
ccucccugccccucccuucaa

SEQ ID NO: 1144155 - RNA, 22 nt, Human
ccucccugccccucccuucaac

SEQ ID NO: 1144156 - RNA, 24 nt, Human
ccucccugccccucccuucaacca

SEQ ID NO: 1144157 - RNA, 16 nt, Human
ccugacagaaggacuc

SEQ ID NO: 1144158 - RNA, 17 nt, Human
ccugacauuccuugcug

SEQ ID NO: 1144159 - RNA, 18 nt, Human
ccugacauuccuugcuga

SEQ ID NO: 1144160 - RNA, 20 nt, Human
ccugcacaaagcccuuccau

SEQ ID NO: 1144161 - RNA, 15 nt, Human
ccugcagggccaagc

SEQ ID NO: 1144162 - RNA, 18 nt, Human
ccugcaguacuuuaccuc

SEQ ID NO: 1144163 - RNA, 20 nt, Human
ccugcaguacuuuaccuccu

SEQ ID NO: 1144164 - RNA, 14 nt, Human
ccugccccccagcc

SEQ ID NO: 1144165 - RNA, 14 nt, Human
ccugccccucccuu

SEQ ID NO: 1144166 - RNA, 20 nt, Human
ccugccuuuuaguuccugug

SEQ ID NO: 1144167 - RNA, 22 nt, Human
ccugccuuuuaguuccugugca

SEQ ID NO: 1144168 - RNA, 18 nt, Human
ccugcgggucacaggagg

SEQ ID NO: 1144169 - RNA, 22 nt, Human
ccugcgggucacaggagggagg

SEQ ID NO: 1144170 - RNA, 16 nt, Human
ccugcucuccucuugc

SEQ ID NO: 1144171 - RNA, 18 nt, Human
ccugcucuccucuugcca

SEQ ID NO: 1144172 - RNA, 19 nt, Human
ccugcucuccucuugccac

SEQ ID NO: 1144173 - RNA, 21 nt, Human
ccugcucuccucuugccacug

SEQ ID NO: 1144174 - RNA, 22 nt, Human
ccugcucuccucuugccacugc

SEQ ID NO: 1144175 - RNA, 15 nt, Human
ccugcugagucccag

SEQ ID NO: 1144176 - RNA, 20 nt, Human
ccugcuuugggcugcccugg

SEQ ID NO: 1144177 - RNA, 21 nt, Human
ccugcuuugggcugcccuggu

SEQ ID NO: 1144178 - RNA, 22 nt, Human
ccugcuuugggcugcccuggug

SEQ ID NO: 1144179 - RNA, 23 nt, Human
ccugcuuugggcugcccuggugc

SEQ ID NO: 1144180 - RNA, 22 nt, Human
ccuggcagccgugccuucagcu

SEQ ID NO: 1144181 - RNA, 17 nt, Human
ccuggcucccacaggcc

SEQ ID NO: 1144182 - RNA, 23 nt, Human
ccuggcucccacaggcccuuccu

SEQ ID NO: 1144183 - RNA, 20 nt, Human
ccuggcuuuucacugcuggc

SEQ ID NO: 1144184 - RNA, 21 nt, Human
ccuggcuuuucacugcuggcu

SEQ ID NO: 1144185 - RNA, 22 nt, Human
ccuggcuuuucacugcuggcug

SEQ ID NO: 1144186 - RNA, 23 nt, Human
ccuggcuuuucacugcuggcugc

SEQ ID NO: 1144187 - RNA, 24 nt, Human
ccuggcuuuucacugcuggcugcc

SEQ ID NO: 1144188 - RNA, 18 nt, Human
ccuggggguucuuucuuc

SEQ ID NO: 1144189 - RNA, 21 nt, Human
ccuggggguucuuucuuccuc

SEQ ID NO: 1144190 - RNA, 22 nt, Human
ccuggggguucuuucuuccucu

SEQ ID NO: 1144191 - RNA, 23 nt, Human
ccuggggguucuuucuuccucug

SEQ ID NO: 1144192 - RNA, 21 nt, Human
ccuggucacaggacucugccu

SEQ ID NO: 1144193 - RNA, 22 nt, Human
ccuggucacaggacucugccuc

SEQ ID NO: 1144194 - RNA, 23 nt, Human
ccuggucacaggacucugccucc

SEQ ID NO: 1144195 - RNA, 21 nt, Human
ccuguuuauucauaugcauau

SEQ ID NO: 1144196 - RNA, 19 nt, Human
ccuuaaacaguugcacagc

SEQ ID NO: 1144197 - RNA, 20 nt, Human
ccuuaaacaguugcacagca

SEQ ID NO: 1144198 - RNA, 17 nt, Human
ccuuaccacugcucuga

SEQ ID NO: 1144199 - RNA, 20 nt, Human
ccuuaccacugcucugauga

SEQ ID NO: 1144200 - RNA, 14 nt, Human
ccuucacuuaggaa

SEQ ID NO: 1144201 - RNA, 15 nt, Human
ccuuccucugagccu

SEQ ID NO: 1144202 - RNA, 16 nt, Human
ccuuccucugagccuu

SEQ ID NO: 1144203 - RNA, 20 nt, Human
ccuuccucugagccuuggga

SEQ ID NO: 1144204 - RNA, 13 nt, Human
ccuuccucugagg

SEQ ID NO: 1144205 - RNA, 14 nt, Human
ccuuccucugaggc

SEQ ID NO: 1144206 - RNA, 15 nt, Human
ccuucgauacaccgg

SEQ ID NO: 1144207 - RNA, 14 nt, Human
ccuucuguggcuca

SEQ ID NO: 1144208 - RNA, 21 nt, Human
ccuucuguggcucacagaacc

SEQ ID NO: 1144209 - RNA, 14 nt, Human
ccuugaagguauau

SEQ ID NO: 1144210 - RNA, 12 nt, Human
ccuugggacccc

SEQ ID NO: 1144211 - RNA, 14 nt, Human
ccuuguccccauga

SEQ ID NO: 1144212 - RNA, 22 nt, Human
ccuuuuaguuccugugcacagc

SEQ ID NO: 1144213 - RNA, 16 nt, Human
ccuuuuaguuccugug

SEQ ID NO: 1144214 - RNA, 14 nt, Human
cgaacuccugaccu

SEQ ID NO: 1144215 - RNA, 19 nt, Human
cgacuguuguuaucuguuu

SEQ ID NO: 1144216 - RNA, 11 nt, Human
cgacuguuguu

SEQ ID NO: 1144217 - RNA, 10 nt, Human
cgcagcccug

SEQ ID NO: 1144218 - RNA, 12 nt, Human
cuagguuuauga

SEQ ID NO: 1144219 - RNA, 16 nt, Human
cuagguuuaugacagu

SEQ ID NO: 1144220 - RNA, 20 nt, Human
cuauauugcugaaugcaaga

SEQ ID NO: 1144221 - RNA, 20 nt, Human
cuaugcagagguccacaaca

SEQ ID NO: 1144222 - RNA, 19 nt, Human
cuauugucaccagggcugg

SEQ ID NO: 1144223 - RNA, 22 nt, Human
cuauuuaugugauccuuuugga

SEQ ID NO: 1144224 - RNA, 13 nt, Human
cucacuccuaccu

SEQ ID NO: 1144225 - RNA, 15 nt, Human
cucacuccuaccugg

SEQ ID NO: 1144226 - RNA, 16 nt, Human
cucacuccuaccuggu

SEQ ID NO: 1144227 - RNA, 17 nt, Human
cucacuccuaccuggua

SEQ ID NO: 1144228 - RNA, 19 nt, Human
cucacuccuaccugguaau

SEQ ID NO: 1144229 - RNA, 15 nt, Human
cucacugagcacugu

SEQ ID NO: 1144230 - RNA, 16 nt, Human
cucacugagcacuguu

SEQ ID NO: 1144231 - RNA, 18 nt, Human
cucacugagcacuguuuu

SEQ ID NO: 1144232 - RNA, 17 nt, Human
cucacugagcacuguuu

SEQ ID NO: 1144233 - RNA, 19 nt, Human
cucagcccacauagugaug

SEQ ID NO: 1144234 - RNA, 21 nt, Human
cucagcccacauagugauggu

SEQ ID NO: 1144235 - RNA, 13 nt, Human
cucauagcccuca

SEQ ID NO: 1144236 - RNA, 17 nt, Human
cucauagcccucacccu

SEQ ID NO: 1144237 - RNA, 20 nt, Human
cucauagcccucacccuggg

SEQ ID NO: 1144238 - RNA, 21 nt, Human
cucauagcccucacccugggg

SEQ ID NO: 1144239 - RNA, 19 nt, Human
cuccaaaacuucguuuaau

SEQ ID NO: 1144240 - RNA, 22 nt, Human
cuccaaucccaccaacccucag

SEQ ID NO: 1144241 - RNA, 12 nt, Human
cuccccuccucc

SEQ ID NO: 1144242 - RNA, 20 nt, Human
cuccccuccuccuggacucc

SEQ ID NO: 1144243 - RNA, 15 nt, Human
cucccggugcccaag

SEQ ID NO: 1144244 - RNA, 21 nt, Human
cucccggugcccaagaauaga

SEQ ID NO: 1144245 - RNA, 17 nt, Human
cucccugccccccagcc

SEQ ID NO: 1144246 - RNA, 23 nt, Human
cucccugccccccagcccuccuu

SEQ ID NO: 1144247 - RNA, 13 nt, Human
cucccugccccuc

SEQ ID NO: 1144248 - RNA, 14 nt, Human
cucccugccccucc

SEQ ID NO: 1144249 - RNA, 17 nt, Human
cucccugccccucccuu

SEQ ID NO: 1144250 - RNA, 18 nt, Human
cucccugccccucccuuc

SEQ ID NO: 1144251 - RNA, 20 nt, Human
cucccugccccucccuucaa

SEQ ID NO: 1144252 - RNA, 21 nt, Human
cucccugccccucccuucaac

SEQ ID NO: 1144253 - RNA, 19 nt, Human
cucccuuggggccuaugca

SEQ ID NO: 1144254 - RNA, 17 nt, Human
cuccucccaggcgcccc

SEQ ID NO: 1144255 - RNA, 22 nt, Human
cuccucccaggcgccccuuccc

SEQ ID NO: 1144256 - RNA, 23 nt, Human
cuccucccaggcgccccuucccc

SEQ ID NO: 1144257 - RNA, 14 nt, Human
cuccuccuggacuc

SEQ ID NO: 1144258 - RNA, 15 nt, Human
cuccuccuggacucc

SEQ ID NO: 1144259 - RNA, 19 nt, Human
cuccuccuggacuccugca

SEQ ID NO: 1144260 - RNA, 11 nt, Human
cuccugccuca

SEQ ID NO: 1144261 - RNA, 12 nt, Human
cuccugccucag

SEQ ID NO: 1144262 - RNA, 13 nt, Human
cuccugccucagc

SEQ ID NO: 1144263 - RNA, 19 nt, Human
cuccugccucagccucccg

SEQ ID NO: 1144264 - RNA, 11 nt, Human
cuccuggacuc

SEQ ID NO: 1144265 - RNA, 12 nt, Human
cuccuggacucc

SEQ ID NO: 1144266 - RNA, 17 nt, Human
cuccuuaucaaaggaca

SEQ ID NO: 1144267 - RNA, 22 nt, Human
cuccuuaucaaaggacaccauu

SEQ ID NO: 1144268 - RNA, 17 nt, Human
cucgaggucgggcagca

SEQ ID NO: 1144269 - RNA, 15 nt, Human
cucgccuucaucucc

SEQ ID NO: 1144270 - RNA, 23 nt, Human
cucgcucugucgcccaggcugga

SEQ ID NO: 1144271 - RNA, 16 nt, Human
cucugacaacagacuu

SEQ ID NO: 1144272 - RNA, 21 nt, Human
cucugacaacagacuucugaa

SEQ ID NO: 1144273 - RNA, 22 nt, Human
cucugacaacagacuucugaaa

SEQ ID NO: 1144274 - RNA, 20 nt, Human
cucugcccuaaugcgcaggc

SEQ ID NO: 1144275 - RNA, 22 nt, Human
cucugcccuaaugcgcaggcug

SEQ ID NO: 1144276 - RNA, 15 nt, Human
cucugucgcccaggc

SEQ ID NO: 1144277 - RNA, 18 nt, Human
cucugucgcccaggcugg

SEQ ID NO: 1144278 - RNA, 22 nt, Human
cucugucgcccaggcuggagug

SEQ ID NO: 1144279 - RNA, 12 nt, Human
cucuucuccacu

SEQ ID NO: 1144280 - RNA, 13 nt, Human
cucuucuccacug

SEQ ID NO: 1144281 - RNA, 13 nt, Human
cugaagucacugc

SEQ ID NO: 1144282 - RNA, 14 nt, Human
cugaagucacugca

SEQ ID NO: 1144283 - RNA, 15 nt, Human
cugaagucacugcac

SEQ ID NO: 1144284 - RNA, 16 nt, Human
cugaagucacugcaca

SEQ ID NO: 1144285 - RNA, 14 nt, Human
cugaaugcucugua

SEQ ID NO: 1144286 - RNA, 17 nt, Human
cugaccagccuccaugc

SEQ ID NO: 1144287 - RNA, 21 nt, Human
cugaccagccuccaugcugcc

SEQ ID NO: 1144288 - RNA, 23 nt, Human
cugaccagccuccaugcugccuc

SEQ ID NO: 1144289 - RNA, 17 nt, Human
cugacuguacuccuccc

SEQ ID NO: 1144290 - RNA, 23 nt, Human
cugagauuauaggcaccuaccac

SEQ ID NO: 1144291 - RNA, 15 nt, Human
cugagcaaauguggc

SEQ ID NO: 1144292 - RNA, 17 nt, Human
cugagcaaauguggcuc

SEQ ID NO: 1144293 - RNA, 20 nt, Human
cugagcaaauguggcuccug

SEQ ID NO: 1144294 - RNA, 21 nt, Human
cugagcaaauguggcuccugg

SEQ ID NO: 1144295 - RNA, 12 nt, Human
cugagcacuguu

SEQ ID NO: 1144296 - RNA, 13 nt, Human
cugagcacuguuu

SEQ ID NO: 1144297 - RNA, 14 nt, Human
cugagcacuguuuu

SEQ ID NO: 1144298 - RNA, 15 nt, Human
cugagcacuguuuuc

SEQ ID NO: 1144299 - RNA, 23 nt, Human
cugagcacuguuuucuaguguau

SEQ ID NO: 1144300 - RNA, 21 nt, Human
cugagcacuguuuucuagugu

SEQ ID NO: 1144301 - RNA, 20 nt, Human
cugagucccaggcugagccu

SEQ ID NO: 1144302 - RNA, 15 nt, Human
cugaucaccugcccu

SEQ ID NO: 1144303 - RNA, 13 nt, Human
cugcaaagcccag

SEQ ID NO: 1144304 - RNA, 15 nt, Human
cugcaaagcccagcu

SEQ ID NO: 1144305 - RNA, 17 nt, Human
cugcaaagcccagcuug

SEQ ID NO: 1144306 - RNA, 18 nt, Human
cugcaauacaaguuucau

SEQ ID NO: 1144307 - RNA, 13 nt, Human
cugcacacagcac

SEQ ID NO: 1144308 - RNA, 14 nt, Human
cugcacacagcacg

SEQ ID NO: 1144309 - RNA, 20 nt, Human
cugcacacgcuccuuccucu

SEQ ID NO: 1144310 - RNA, 22 nt, Human
cugcacacgcuccuuccucuga

SEQ ID NO: 1144311 - RNA, 19 nt, Human
cugcauccuccgccucccg

SEQ ID NO: 1144312 - RNA, 20 nt, Human
cugcauccuccgccucccgg

SEQ ID NO: 1144313 - RNA, 17 nt, Human
cugcccagccuccaagc

SEQ ID NO: 1144314 - RNA, 21 nt, Human
cugccccuccucucugcccua

SEQ ID NO: 1144315 - RNA, 17 nt, Human
cugccucagccucccga

SEQ ID NO: 1144316 - RNA, 14 nt, Human
cugccuccagaaug

SEQ ID NO: 1144317 - RNA, 22 nt, Human
cugccuccagaauggucuuucu

SEQ ID NO: 1144318 - RNA, 17 nt, Human
cugccuuuuaguuccug

SEQ ID NO: 1144319 - RNA, 19 nt, Human
cugccuuuuaguuccugug

SEQ ID NO: 1144320 - RNA, 20 nt, Human
cugccuuuuaguuccugugc

SEQ ID NO: 1144321 - RNA, 23 nt, Human
cugccuuuuaguuccugugcaca

SEQ ID NO: 1144322 - RNA, 21 nt, Human
cugccuuuuaguuccugugca

SEQ ID NO: 1144323 - RNA, 16 nt, Human
cugcggccccuccccc

SEQ ID NO: 1144324 - RNA, 18 nt, Human
cugggauuacaggcguga

SEQ ID NO: 1144325 - RNA, 20 nt, Human
cuggggguucuuucuuccuc

SEQ ID NO: 1144326 - RNA, 23 nt, Human
cuggggguucuuucuuccucugc

SEQ ID NO: 1144327 - RNA, 14 nt, Human
cuguacuccuccca

SEQ ID NO: 1144328 - RNA, 15 nt, Human
cuguacuccucccag

SEQ ID NO: 1144329 - RNA, 16 nt, Human
cuguacuccucccagg

SEQ ID NO: 1144330 - RNA, 19 nt, Human
cuguacuccucccaggcgc

SEQ ID NO: 1144331 - RNA, 21 nt, Human
cuguacuccucccaggcgccc

SEQ ID NO: 1144332 - RNA, 17 nt, Human
cuguauuagucacagag

SEQ ID NO: 1144333 - RNA, 19 nt, Human
cuguauuagucacagagau

SEQ ID NO: 1144334 - RNA, 12 nt, Human
cugugccucugc

SEQ ID NO: 1144335 - RNA, 13 nt, Human
cugugccucugcc

SEQ ID NO: 1144336 - RNA, 14 nt, Human
cugugccucugccu

SEQ ID NO: 1144337 - RNA, 15 nt, Human
cugugccucugccug

SEQ ID NO: 1144338 - RNA, 16 nt, Human
cugugccucugccugu

SEQ ID NO: 1144339 - RNA, 17 nt, Human
cugugccucugccuguc

SEQ ID NO: 1144340 - RNA, 12 nt, Human
cuguuugagaaa

SEQ ID NO: 1144341 - RNA, 13 nt, Human
cuguuugagaaag

SEQ ID NO: 1144342 - RNA, 22 nt, Human
cuguuuuacaaaaaagaaaaga

SEQ ID NO: 1144343 - RNA, 15 nt, Human
cuguuuucuagugua

SEQ ID NO: 1144344 - RNA, 17 nt, Human
cuguuuucuaguguauc

SEQ ID NO: 1144345 - RNA, 18 nt, Human
cuguuuucuaguguauca

SEQ ID NO: 1144346 - RNA, 20 nt, Human
cuguuuucuaguguaucaaa

SEQ ID NO: 1144347 - RNA, 22 nt, Human
cuguuuucuaguguaucaaaau

SEQ ID NO: 1144348 - RNA, 19 nt, Human
cuuaacagggaacgugauu

SEQ ID NO: 1144349 - RNA, 18 nt, Human
cuuaagaauuuugagcag

SEQ ID NO: 1144350 - RNA, 16 nt, Human
cuuagaaauugcauuu

SEQ ID NO: 1144351 - RNA, 18 nt, Human
cuuagaaguuuguuguga

SEQ ID NO: 1144352 - RNA, 13 nt, Human
cuuaguauugcaa

SEQ ID NO: 1144353 - RNA, 17 nt, Human
cuucaacugaccagccu

SEQ ID NO: 1144354 - RNA, 20 nt, Human
cuucaacugaccagccucca

SEQ ID NO: 1144355 - RNA, 23 nt, Human
cuucaacugaccagccuccaugc

SEQ ID NO: 1144356 - RNA, 18 nt, Human
cuucaagaucccauuuga

SEQ ID NO: 1144357 - RNA, 21 nt, Human
cuucaauuuauaccucaauuu

SEQ ID NO: 1144358 - RNA, 14 nt, Human
cuuccaaaaauuac

SEQ ID NO: 1144359 - RNA, 12 nt, Human
cuucccccucca

SEQ ID NO: 1144360 - RNA, 15 nt, Human
cuucccccuccaauc

SEQ ID NO: 1144361 - RNA, 13 nt, Human
cuuccugugacuu

SEQ ID NO: 1144362 - RNA, 16 nt, Human
cuuccugugacuucag

SEQ ID NO: 1144363 - RNA, 21 nt, Human
cuucgauacaccgggccugga

SEQ ID NO: 1144364 - RNA, 14 nt, Human
cuucgccaccuggg

SEQ ID NO: 1144365 - RNA, 15 nt, Human
cuucgccaccugggu

SEQ ID NO: 1144366 - RNA, 14 nt, Human
cuugccacugccuc

SEQ ID NO: 1144367 - RNA, 15 nt, Human
cuugccacugccucu

SEQ ID NO: 1144368 - RNA, 19 nt, Human
cuuguaaaggaauuuaaaa

SEQ ID NO: 1144369 - RNA, 14 nt, Human
cuuguuuucuggga

SEQ ID NO: 1144370 - RNA, 19 nt, Human
cuuguuuuuuuuuuccacu

SEQ ID NO: 1144371 - RNA, 20 nt, Human
cuuguuuuuuuuuuccacuu

SEQ ID NO: 1144372 - RNA, 21 nt, Human
cuuguuuuuuuuuuccacuua

SEQ ID NO: 1144373 - RNA, 20 nt, Human
cuuuauucuggcagaggagg

SEQ ID NO: 1144374 - RNA, 21 nt, Human
cuuuauuuucuauaauuuaaa

SEQ ID NO: 1144375 - RNA, 17 nt, Human
cuuuucacugcuggcug

SEQ ID NO: 1144376 - RNA, 18 nt, Human
cuuuucacugcuggcugc

SEQ ID NO: 1144377 - RNA, 20 nt, Human
cuuuucacugcuggcugccu

SEQ ID NO: 1144378 - RNA, 14 nt, Human
cuuuucccuucuuu

SEQ ID NO: 1144379 - RNA, 22 nt, Human
gaaaacaauaacgauaaaagac

SEQ ID NO: 1144380 - RNA, 14 nt, Human
gaaaacaugcagaa

SEQ ID NO: 1144381 - RNA, 18 nt, Human
gaaaaccaagccguggcu

SEQ ID NO: 1144382 - RNA, 19 nt, Human
gaaaaccaagccguggcuu

SEQ ID NO: 1144383 - RNA, 21 nt, Human
gaaaaccaagccguggcuucc

SEQ ID NO: 1144384 - RNA, 19 nt, Human
gaaaauaacgauaaaagac

SEQ ID NO: 1144385 - RNA, 19 nt, Human
gaaaaucuuauaauuuaaa

SEQ ID NO: 1144386 - RNA, 20 nt, Human
gaaaaucuuauaauuuaaaa

SEQ ID NO: 1144387 - RNA, 22 nt, Human
gaaacacugggcuucuagaacc

SEQ ID NO: 1144388 - RNA, 15 nt, Human
gaaacagcucgacuu

SEQ ID NO: 1144389 - RNA, 20 nt, Human
gaaacagcucgacuuuaaaa

SEQ ID NO: 1144390 - RNA, 20 nt, Human
gaaacaugacucguauaugu

SEQ ID NO: 1144391 - RNA, 19 nt, Human
gaaauugcauuuccugaca

SEQ ID NO: 1144392 - RNA, 11 nt, Human
gaaccugaccc

SEQ ID NO: 1144393 - RNA, 12 nt, Human
gaaccugacccc

SEQ ID NO: 1144394 - RNA, 22 nt, Human
gaacgugauuagugaaaggaag

SEQ ID NO: 1144395 - RNA, 23 nt, Human
gaacguuuagcugacaaaauacu

SEQ ID NO: 1144396 - RNA, 20 nt, Human
gaacguuuagcugacaaaau

SEQ ID NO: 1144397 - RNA, 21 nt, Human
gaacuuguaaaggaauuuaaa

SEQ ID NO: 1144398 - RNA, 22 nt, Human
gaacuuguaaaggaauuuaaaa

SEQ ID NO: 1144399 - RNA, 10 nt, Human
gaagccuuug

SEQ ID NO: 1144400 - RNA, 11 nt, Human
gaagccuuugu

SEQ ID NO: 1144401 - RNA, 13 nt, Human
gaaggcagggagg

SEQ ID NO: 1144402 - RNA, 14 nt, Human
gaaggcagggaggg

SEQ ID NO: 1144403 - RNA, 18 nt, Human
gaaggcagggagggccug

SEQ ID NO: 1144404 - RNA, 13 nt, Human
gaagguacuguau

SEQ ID NO: 1144405 - RNA, 14 nt, Human
gaauaaagacaccu

SEQ ID NO: 1144406 - RNA, 15 nt, Human
gaauaaauugcuccu

SEQ ID NO: 1144407 - RNA, 14 nt, Human
gaauacuuuauaaa

SEQ ID NO: 1144408 - RNA, 15 nt, Human
gaauagaugcugacu

SEQ ID NO: 1144409 - RNA, 15 nt, Human
gaaugcuguauaugu

SEQ ID NO: 1144410 - RNA, 22 nt, Human
gagcacuguuuucuaguguauc

SEQ ID NO: 1144411 - RNA, 14 nt, Human
gagcacuguuuucu

SEQ ID NO: 1144412 - RNA, 14 nt, Human
gagccaccgugccu

SEQ ID NO: 1144413 - RNA, 20 nt, Human
gagccaccgugccuggccac

SEQ ID NO: 1144414 - RNA, 18 nt, Human
gagccucagucucccucc

SEQ ID NO: 1144415 - RNA, 12 nt, Human
gagcuacaaaug

SEQ ID NO: 1144416 - RNA, 13 nt, Human
gagcuacaaaugc

SEQ ID NO: 1144417 - RNA, 14 nt, Human
gagcuacaaaugca

SEQ ID NO: 1144418 - RNA, 16 nt, Human
gagcucugcagagcag

SEQ ID NO: 1144419 - RNA, 15 nt, Human
gagcuuaacagugug

SEQ ID NO: 1144420 - RNA, 14 nt, Human
gagcuucuggcacu

SEQ ID NO: 1144421 - RNA, 18 nt, Human
gagcuucuguugcugccu

SEQ ID NO: 1144422 - RNA, 21 nt, Human
gagcuucuguugcugccucau

SEQ ID NO: 1144423 - RNA, 13 nt, Human
gaggcccggccuc

SEQ ID NO: 1144424 - RNA, 12 nt, Human
gagggcacuggu

SEQ ID NO: 1144425 - RNA, 16 nt, Human
gagggcacugguggcc

SEQ ID NO: 1144426 - RNA, 18 nt, Human
gagggcacugguggcccg

SEQ ID NO: 1144427 - RNA, 13 nt, Human
gaggggccuggca

SEQ ID NO: 1144428 - RNA, 14 nt, Human
gaggggccuggcag

SEQ ID NO: 1144429 - RNA, 18 nt, Human
gaggggccuggcagccgu

SEQ ID NO: 1144430 - RNA, 20 nt, Human
gaggggccuggcagccgugc

SEQ ID NO: 1144431 - RNA, 18 nt, Human
gagguccacaacacacag

SEQ ID NO: 1144432 - RNA, 18 nt, Human
gagucccaggcugagccu

SEQ ID NO: 1144433 - RNA, 19 nt, Human
gagucccaggcugagccuc

SEQ ID NO: 1144434 - RNA, 23 nt, Human
gagucucgcuauugucaccaggg

SEQ ID NO: 1144435 - RNA, 12 nt, Human
gagucucuucuc

SEQ ID NO: 1144436 - RNA, 14 nt, Human
gagucucuucucca

SEQ ID NO: 1144437 - RNA, 15 nt, Human
gagucucuucuccac

SEQ ID NO: 1144438 - RNA, 16 nt, Human
gagucucuucuccacu

SEQ ID NO: 1144439 - RNA, 17 nt, Human
gagucucuucuccacug

SEQ ID NO: 1144440 - RNA, 18 nt, Human
gagucucuucuccacugg

SEQ ID NO: 1144441 - RNA, 13 nt, Human
gaguggcuccucc

SEQ ID NO: 1144442 - RNA, 15 nt, Human
gaguggcuccucccg

SEQ ID NO: 1144443 - RNA, 21 nt, Human
gaguugaaaaucuuauaauuu

SEQ ID NO: 1144444 - RNA, 23 nt, Human
gauagauaggucagugcaaauac

SEQ ID NO: 1144445 - RNA, 15 nt, Human
gauccuuuuggaguc

SEQ ID NO: 1144446 - RNA, 17 nt, Human
gauccuuuuggagucag

SEQ ID NO: 1144447 - RNA, 22 nt, Human
gaugggacaauuagauaaaugu

SEQ ID NO: 1144448 - RNA, 19 nt, Human
gaugugcuuguuaacugag

SEQ ID NO: 1144449 - RNA, 20 nt, Human
gaugugcuuguuaacugagu

SEQ ID NO: 1144450 - RNA, 13 nt, Human
gaugugcuuaaca

SEQ ID NO: 1144451 - RNA, 14 nt, Human
gaugugcuuaacag

SEQ ID NO: 1144452 - RNA, 24 nt, Human
gauugaccguguuggucuguacug

SEQ ID NO: 1144453 - RNA, 14 nt, Human
gauuggacaaaaug

SEQ ID NO: 1144454 - RNA, 15 nt, Human
gauuggacaaaauga

SEQ ID NO: 1144455 - RNA, 13 nt, Human
gcacagcaucuca

SEQ ID NO: 1144456 - RNA, 18 nt, Human
gcacagcaucucagcuca

SEQ ID NO: 1144457 - RNA, 16 nt, Human
gcacagggcaguggga

SEQ ID NO: 1144458 - RNA, 19 nt, Human
gcacuguuuucuaguguau

SEQ ID NO: 1144459 - RNA, 20 nt, Human
gcacuguuuucuaguguauc

SEQ ID NO: 1144460 - RNA, 21 nt, Human
gcacuguuuucuaguguauca

SEQ ID NO: 1144461 - RNA, 22 nt, Human
gcacuguuuucuaguguaucaa

SEQ ID NO: 1144462 - RNA, 23 nt, Human
gcacuguuuucuaguguaucaaa

SEQ ID NO: 1144463 - RNA, 21 nt, Human
gcagagguccacaacacacag

SEQ ID NO: 1144464 - RNA, 18 nt, Human
gcagauguccuugaugcu

SEQ ID NO: 1144465 - RNA, 24 nt, Human
gcagcccugcuuugggcugcccug

SEQ ID NO: 1144466 - RNA, 14 nt, Human
gcagccgugccuuc

SEQ ID NO: 1144467 - RNA, 21 nt, Human
gcagugggacagggcauggcc

SEQ ID NO: 1144468 - RNA, 15 nt, Human
gcaucagugcccucc

SEQ ID NO: 1144469 - RNA, 23 nt, Human
gcaucagugcccuccaggauaga

SEQ ID NO: 1144470 - RNA, 22 nt, Human
gcaucuaguuccccuguuuauu

SEQ ID NO: 1144471 - RNA, 20 nt, Human
gcaucuaguuccccuguuua

SEQ ID NO: 1144472 - RNA, 12 nt, Human
gcaucucagccc

SEQ ID NO: 1144473 - RNA, 13 nt, Human
gcaucucagccca

SEQ ID NO: 1144474 - RNA, 14 nt, Human
gcaucucagcccac

SEQ ID NO: 1144475 - RNA, 15 nt, Human
gcaucucagcccaca

SEQ ID NO: 1144476 - RNA, 14 nt, Human
gcaucucagcucau

SEQ ID NO: 1144477 - RNA, 22 nt, Human
gcaucucagcucaucuucacug

SEQ ID NO: 1144478 - RNA, 12 nt, Human
gcauuugugaaa

SEQ ID NO: 1144479 - RNA, 16 nt, Human
gccaauaaaccaauga

SEQ ID NO: 1144480 - RNA, 19 nt, Human
gccaauaaaccaaugaacg

SEQ ID NO: 1144481 - RNA, 22 nt, Human
gccaauaaaccaaugaacgaag

SEQ ID NO: 1144482 - RNA, 20 nt, Human
gccaauaauaauaccucccu

SEQ ID NO: 1144483 - RNA, 16 nt, Human
gccaauggagacuguc

SEQ ID NO: 1144484 - RNA, 19 nt, Human
gccaauggagacugucuca

SEQ ID NO: 1144485 - RNA, 21 nt, Human
gccaauggagacugucucaag

SEQ ID NO: 1144486 - RNA, 17 nt, Human
gccacacgagaaccuga

SEQ ID NO: 1144487 - RNA, 20 nt, Human
gccacacuucaggcucuucu

SEQ ID NO: 1144488 - RNA, 22 nt, Human
gccacacuucaggcucuucucc

SEQ ID NO: 1144489 - RNA, 23 nt, Human
gccacacuucaggcucuucuccu

SEQ ID NO: 1144490 - RNA, 17 nt, Human
gccaccgugccuggcca

SEQ ID NO: 1144491 - RNA, 22 nt, Human
gccaccgugccuggccacgccc

SEQ ID NO: 1144492 - RNA, 11 nt, Human
gccaccugggu

SEQ ID NO: 1144493 - RNA, 20 nt, Human
gccacgcccaacuaauuuuu

SEQ ID NO: 1144494 - RNA, 13 nt, Human
gccaggcugcucu

SEQ ID NO: 1144495 - RNA, 14 nt, Human
gccaggcugcucuu

SEQ ID NO: 1144496 - RNA, 22 nt, Human
gccaggcugcucuugaacuccu

SEQ ID NO: 1144497 - RNA, 22 nt, Human
gccaggcuggucucgaacuccu

SEQ ID NO: 1144498 - RNA, 14 nt, Human
gcccaaccugcucu

SEQ ID NO: 1144499 - RNA, 21 nt, Human
gcccagcuugaaaccuucacu

SEQ ID NO: 1144500 - RNA, 13 nt, Human
gccuggcacaggg

SEQ ID NO: 1144501 - RNA, 14 nt, Human
gccuggcacagggc

SEQ ID NO: 1144502 - RNA, 18 nt, Human
gccuggcacagggcagug

SEQ ID NO: 1144503 - RNA, 19 nt, Human
gccuggcacagggcagugg

SEQ ID NO: 1144504 - RNA, 12 nt, Human
gccuggcagccg

SEQ ID NO: 1144505 - RNA, 20 nt, Human
gccuggcagccgugccuuca

SEQ ID NO: 1144506 - RNA, 21 nt, Human
gccuggcagccgugccuucag

SEQ ID NO: 1144507 - RNA, 22 nt, Human
gccuggcagccgugccuucagc

SEQ ID NO: 1144508 - RNA, 18 nt, Human
gcgcaggcuggcccugcc

SEQ ID NO: 1144509 - RNA, 19 nt, Human
gcgcaggcuggcccugccc

SEQ ID NO: 1144510 - RNA, 20 nt, Human
gcgcaggcuggcccugcccu

SEQ ID NO: 1144511 - RNA, 21 nt, Human
gcgcaggcuggcccugcccug

SEQ ID NO: 1144512 - RNA, 22 nt, Human
gcgcaggcuggcccugcccugg

SEQ ID NO: 1144513 - RNA, 13 nt, Human
gcgccaauaaacc

SEQ ID NO: 1144514 - RNA, 13 nt, Human
gcgccccuucccc

SEQ ID NO: 1144515 - RNA, 20 nt, Human
gcuauaacuauguugauaaa

SEQ ID NO: 1144516 - RNA, 22 nt, Human
gcucacagaacccuuggagcca

SEQ ID NO: 1144517 - RNA, 12 nt, Human
gcucagcccucc

SEQ ID NO: 1144518 - RNA, 15 nt, Human
gcucagcccucccug

SEQ ID NO: 1144519 - RNA, 16 nt, Human
gcucagcccucccugc

SEQ ID NO: 1144520 - RNA, 17 nt, Human
gcucagcccucccugcc

SEQ ID NO: 1144521 - RNA, 18 nt, Human
gcucagcccucccugccc

SEQ ID NO: 1144522 - RNA, 19 nt, Human
gcucagcccucccugcccc

SEQ ID NO: 1144523 - RNA, 21 nt, Human
gcucagcccucccugccccuc

SEQ ID NO: 1144524 - RNA, 15 nt, Human
gcucauauuucccau

SEQ ID NO: 1144525 - RNA, 15 nt, Human
gcucccacaggcccu

SEQ ID NO: 1144526 - RNA, 14 nt, Human
gcuccucccggugc

SEQ ID NO: 1144527 - RNA, 16 nt, Human
gcuccucccggugccc

SEQ ID NO: 1144528 - RNA, 18 nt, Human
gcuccuuccucugaggcu

SEQ ID NO: 1144529 - RNA, 20 nt, Human
gcuccuuccucugaggcuga

SEQ ID NO: 1144530 - RNA, 22 nt, Human
gcuccuuccucugaggcugaaa

SEQ ID NO: 1144531 - RNA, 14 nt, Human
gcucuugaacuccu

SEQ ID NO: 1144532 - RNA, 16 nt, Human
gcucuugaacuccuga

SEQ ID NO: 1144533 - RNA, 19 nt, Human
gcucuugaacuccugaccu

SEQ ID NO: 1144534 - RNA, 21 nt, Human
gcucuugaacuccugaccuca

SEQ ID NO: 1144535 - RNA, 19 nt, Human
gcucuuggcagguacucag

SEQ ID NO: 1144536 - RNA, 16 nt, Human
gcugagaggagagaga

SEQ ID NO: 1144537 - RNA, 15 nt, Human
gcugccacacuucag

SEQ ID NO: 1144538 - RNA, 17 nt, Human
gcugccacacuucaggc

SEQ ID NO: 1144539 - RNA, 18 nt, Human
gcugccacacuucaggcu

SEQ ID NO: 1144540 - RNA, 21 nt, Human
gcugccacacuucaggcucuu

SEQ ID NO: 1144541 - RNA, 22 nt, Human
gcugccacacuucaggcucuuc

SEQ ID NO: 1144542 - RNA, 23 nt, Human
gcugccacacuucaggcucuucu

SEQ ID NO: 1144543 - RNA, 12 nt, Human
gcugcccuggug

SEQ ID NO: 1144544 - RNA, 13 nt, Human
gcugcccuggugc

SEQ ID NO: 1144545 - RNA, 14 nt, Human
gcugcccuggugcu

SEQ ID NO: 1144546 - RNA, 15 nt, Human
gcugcccuggugcug

SEQ ID NO: 1144547 - RNA, 18 nt, Human
gcugcccuggugcugcca

SEQ ID NO: 1144548 - RNA, 17 nt, Human
gcugcccuggugcugcc

SEQ ID NO: 1144549 - RNA, 15 nt, Human
gcugccuuagaaccu

SEQ ID NO: 1144550 - RNA, 20 nt, Human
gcugccuuagaaccuuucuu

SEQ ID NO: 1144551 - RNA, 15 nt, Human
gcugcggccccuccc

SEQ ID NO: 1144552 - RNA, 17 nt, Human
gcugcggccccuccccc

SEQ ID NO: 1144553 - RNA, 23 nt, Human
gcuggaaugauuucagcucacug

SEQ ID NO: 1144554 - RNA, 19 nt, Human
gcuggacaaacugcaccag

SEQ ID NO: 1144555 - RNA, 14 nt, Human
gcuggacaaacugc

SEQ ID NO: 1144556 - RNA, 14 nt, Human
gcuggcccugcccu

SEQ ID NO: 1144557 - RNA, 15 nt, Human
gcuggcccugcccug

SEQ ID NO: 1144558 - RNA, 16 nt, Human
gcuggcccugcccugg

SEQ ID NO: 1144559 - RNA, 19 nt, Human
gcuggcccuggcucccaca

SEQ ID NO: 1144560 - RNA, 19 nt, Human
gcuggucucgaacuccuga

SEQ ID NO: 1144561 - RNA, 22 nt, Human
gcuggucucgaacuccugaccu

SEQ ID NO: 1144562 - RNA, 23 nt, Human
gcuggucucgaacuccugaccuu

SEQ ID NO: 1144563 - RNA, 13 nt, Human
gcugucaucucag

SEQ ID NO: 1144564 - RNA, 15 nt, Human
gcuuauauuguucac

SEQ ID NO: 1144565 - RNA, 17 nt, Human
gcuucuguugcugccuc

SEQ ID NO: 1144566 - RNA, 18 nt, Human
gcuucuguugcugccuca

SEQ ID NO: 1144567 - RNA, 19 nt, Human
gcuucuguugcugccucau

SEQ ID NO: 1144568 - RNA, 19 nt, Human
gcuuugggcugcccuggug

SEQ ID NO: 1144569 - RNA, 12 nt, Human
gcuuuucacugc

SEQ ID NO: 1144570 - RNA, 15 nt, Human
ggacagccccuccuc

SEQ ID NO: 1144571 - RNA, 16 nt, Human
ggacagccccuccucc

SEQ ID NO: 1144572 - RNA, 13 nt, Human
ggagggccugggc

SEQ ID NO: 1144573 - RNA, 13 nt, Human
ggaggggccuggc

SEQ ID NO: 1144574 - RNA, 14 nt, Human
ggaggggccuggca

SEQ ID NO: 1144575 - RNA, 18 nt, Human
ggaggggccuggcagccg

SEQ ID NO: 1144576 - RNA, 21 nt, Human
ggaggggccuggcagccgugc

SEQ ID NO: 1144577 - RNA, 17 nt, Human
ggaugccccgucccccu

SEQ ID NO: 1144578 - RNA, 21 nt, Human
ggcagugggacagggcauggc

SEQ ID NO: 1144579 - RNA, 15 nt, Human
ggccgggagccugau

SEQ ID NO: 1144580 - RNA, 17 nt, Human
ggccucggacuuagcug

SEQ ID NO: 1144581 - RNA, 11 nt, Human
ggccugggccc

SEQ ID NO: 1144582 - RNA, 13 nt, Human
ggcugugccucug

SEQ ID NO: 1144583 - RNA, 16 nt, Human
ggcugugccucugccu

SEQ ID NO: 1144584 - RNA, 11 nt, Human
ggcuugcugcc

SEQ ID NO: 1144585 - RNA, 13 nt, Human
ggcuuuucacugc

SEQ ID NO: 1144586 - RNA, 11 nt, Human
gggacccccag

SEQ ID NO: 1144587 - RNA, 13 nt, Human
gggacccccagga

SEQ ID NO: 1144588 - RNA, 23 nt, Human
gggacugccagucccccugcccc

SEQ ID NO: 1144589 - RNA, 21 nt, Human
gggagccugaucaccugcccu

SEQ ID NO: 1144590 - RNA, 12 nt, Human
gggagcucugca

SEQ ID NO: 1144591 - RNA, 23 nt, Human
uauggauccacuggcuggacaaa

SEQ ID NO: 1144592 - RNA, 22 nt, Human
uauggugccuaguauugacaaa

SEQ ID NO: 1144593 - RNA, 16 nt, Human
uaugucaagggcagcu

SEQ ID NO: 1144594 - RNA, 23 nt, Human
uaugucaagggcagcuuugcuca

SEQ ID NO: 1144595 - RNA, 14 nt, Human
uauguugauaaaag

SEQ ID NO: 1144596 - RNA, 12 nt, Human
uauuaagaauga

SEQ ID NO: 1144597 - RNA, 17 nt, Human
uauuccugcauuuguga

SEQ ID NO: 1144598 - RNA, 19 nt, Human
uauuccugcauuugugaaa

SEQ ID NO: 1144599 - RNA, 20 nt, Human
uauuccugcauuugugaaau

SEQ ID NO: 1144600 - RNA, 21 nt, Human
uauuccugcauuugugaaaug

SEQ ID NO: 1144601 - RNA, 23 nt, Human
uauucuaacuuuuauuuuuauca

SEQ ID NO: 1144602 - RNA, 17 nt, Human
uauugcugaaugcaaga

SEQ ID NO: 1144603 - RNA, 19 nt, Human
uauuuucaacgcagcccug

SEQ ID NO: 1144604 - RNA, 14 nt, Human
ucaacgcagcccug

SEQ ID NO: 1144605 - RNA, 15 nt, Human
ucaacgcagcccugc

SEQ ID NO: 1144606 - RNA, 18 nt, Human
ucaacgcagcccugcuuu

SEQ ID NO: 1144607 - RNA, 14 nt, Human
ucaauaaaauuaua

SEQ ID NO: 1144608 - RNA, 15 nt, Human
ucaauaaaauuauag

SEQ ID NO: 1144609 - RNA, 17 nt, Human
ucaauaaaauuauagcu

SEQ ID NO: 1144610 - RNA, 19 nt, Human
ucaauaaaauuauagcucu

SEQ ID NO: 1144611 - RNA, 18 nt, Human
ucacugcauccuccgccu

SEQ ID NO: 1144612 - RNA, 19 nt, Human
ucacugcauccuccgccuc

SEQ ID NO: 1144613 - RNA, 12 nt, Human
ucacugcuggcu

SEQ ID NO: 1144614 - RNA, 13 nt, Human
ucacugcuggcug

SEQ ID NO: 1144615 - RNA, 14 nt, Human
ucacugcuggcugc

SEQ ID NO: 1144616 - RNA, 15 nt, Human
ucacugcuggcugcc

SEQ ID NO: 1144617 - RNA, 16 nt, Human
ucacugcuggcugccu

SEQ ID NO: 1144618 - RNA, 17 nt, Human
ucacugcuggcugccuu

SEQ ID NO: 1144619 - RNA, 18 nt, Human
ucacugcuggcugccuua

SEQ ID NO: 1144620 - RNA, 22 nt, Human
ucacugcuggcugccuuagaac

SEQ ID NO: 1144621 - RNA, 17 nt, Human
ucagcauucucacuccu

SEQ ID NO: 1144622 - RNA, 20 nt, Human
ucagcauucucacuccuacc

SEQ ID NO: 1144623 - RNA, 23 nt, Human
ucagcauucucacuccuaccugg

SEQ ID NO: 1144624 - RNA, 20 nt, Human
ucagccuccugaguagcugg

SEQ ID NO: 1144625 - RNA, 22 nt, Human
ucagccuccugaguagcuggga

SEQ ID NO: 1144626 - RNA, 15 nt, Human
ucaggcucuucuccu

SEQ ID NO: 1144627 - RNA, 21 nt, Human
ucauagcccucacccuggggc

SEQ ID NO: 1144628 - RNA, 15 nt, Human
ucaucaggaacguuu

SEQ ID NO: 1144629 - RNA, 13 nt, Human
ucaucuucacugc

SEQ ID NO: 1144630 - RNA, 23 nt, Human
ucauuccaccuucccaugcccug

SEQ ID NO: 1144631 - RNA, 18 nt, Human
uccaauuuaguuguugua

SEQ ID NO: 1144632 - RNA, 15 nt, Human
uccaccuucccaugc

SEQ ID NO: 1144633 - RNA, 11 nt, Human
uccaggguggu

SEQ ID NO: 1144634 - RNA, 16 nt, Human
ucccuacauuaaacau

SEQ ID NO: 1144635 - RNA, 13 nt, Human
ucccuacauuaaa

SEQ ID NO: 1144636 - RNA, 20 nt, Human
ucccugccccucccuucaac

SEQ ID NO: 1144637 - RNA, 22 nt, Human
uccuaaugaaugcauaaaaugu

SEQ ID NO: 1144638 - RNA, 15 nt, Human
uccuaauuccacagc

SEQ ID NO: 1144639 - RNA, 16 nt, Human
uccuaauuccacagcu

SEQ ID NO: 1144640 - RNA, 17 nt, Human
uccuaauuccacagcug

SEQ ID NO: 1144641 - RNA, 18 nt, Human
uccuaauuccacagcugc

SEQ ID NO: 1144642 - RNA, 15 nt, Human
uccuacaagacacag

SEQ ID NO: 1144643 - RNA, 21 nt, Human
uccucuuccugaauuuuauuu

SEQ ID NO: 1144644 - RNA, 14 nt, Human
uccugccucagccu

SEQ ID NO: 1144645 - RNA, 13 nt, Human
uccuugaagguau

SEQ ID NO: 1144646 - RNA, 17 nt, Human
uccuugaagguauaucu

SEQ ID NO: 1144647 - RNA, 19 nt, Human
uccuuuuaaaacacuucca

SEQ ID NO: 1144648 - RNA, 15 nt, Human
ucgaacuccugaccu

SEQ ID NO: 1144649 - RNA, 22 nt, Human
ucggccucccaaagugcuggga

SEQ ID NO: 1144650 - RNA, 12 nt, Human
ucuaauaguaua

SEQ ID NO: 1144651 - RNA, 17 nt, Human
ucuaauaguauaaaccc

SEQ ID NO: 1144652 - RNA, 14 nt, Human
ucuaauaguauaaa

SEQ ID NO: 1144653 - RNA, 14 nt, Human
ucuaaugugugaau

SEQ ID NO: 1144654 - RNA, 13 nt, Human
ucuaauguuugca

SEQ ID NO: 1144655 - RNA, 14 nt, Human
ucuaauguuugcau

SEQ ID NO: 1144656 - RNA, 15 nt, Human
ucuaauguuugcaua

SEQ ID NO: 1144657 - RNA, 16 nt, Human
ucuaauguuugcauau

SEQ ID NO: 1144658 - RNA, 17 nt, Human
ucuaauguuugcauaua

SEQ ID NO: 1144659 - RNA, 19 nt, Human
ucuaauguuugcauauaag

SEQ ID NO: 1144660 - RNA, 18 nt, Human
ucuaauguuugcauauaa

SEQ ID NO: 1144661 - RNA, 17 nt, Human
ucucaagagggcacugg

SEQ ID NO: 1144662 - RNA, 18 nt, Human
ucucaagagggcacuggu

SEQ ID NO: 1144663 - RNA, 19 nt, Human
ucucaagagggcacuggug

SEQ ID NO: 1144664 - RNA, 21 nt, Human
ucucaauaaaauuauagcucu

SEQ ID NO: 1144665 - RNA, 23 nt, Human
ucucaauaaaauuauagcucuaa

SEQ ID NO: 1144666 - RNA, 22 nt, Human
ucucaauaaaauuauagcucua

SEQ ID NO: 1144667 - RNA, 17 nt, Human
ucuccugccucagccuc

SEQ ID NO: 1144668 - RNA, 19 nt, Human
ucuccugccucagccuccc

SEQ ID NO: 1144669 - RNA, 15 nt, Human
ucucuguccgagugu

SEQ ID NO: 1144670 - RNA, 11 nt, Human
ucugaggcuga

SEQ ID NO: 1144671 - RNA, 23 nt, Human
ucugaggcugaaauucagaauau

SEQ ID NO: 1144672 - RNA, 13 nt, Human
ucugcaucuccac

SEQ ID NO: 1144673 - RNA, 11 nt, Human
ucugcaucucc

SEQ ID NO: 1144674 - RNA, 17 nt, Human
ucugcauucaggaucaa

SEQ ID NO: 1144675 - RNA, 22 nt, Human
ucugcugauccucccaggcuuc

SEQ ID NO: 1144676 - RNA, 15 nt, Human
ucuggcuccagcugg

SEQ ID NO: 1144677 - RNA, 13 nt, Human
ucugguuccuccc

SEQ ID NO: 1144678 - RNA, 20 nt, Human
ucugguuccuccccuccucc

SEQ ID NO: 1144679 - RNA, 21 nt, Human
ucugguuccuccccuccuccu

SEQ ID NO: 1144680 - RNA, 17 nt, Human
ucuuccuggauuauuca

SEQ ID NO: 1144681 - RNA, 12 nt, Human
ucuucuccacug

SEQ ID NO: 1144682 - RNA, 13 nt, Human
ucuucuccuuuca

SEQ ID NO: 1144683 - RNA, 14 nt, Human
ucuucuccuuucac

SEQ ID NO: 1144684 - RNA, 16 nt, Human
ucuucuuuuuuuguga

SEQ ID NO: 1144685 - RNA, 17 nt, Human
ucuucuuuuuuugugau

SEQ ID NO: 1144686 - RNA, 18 nt, Human
ucuucuuuuuuugugaug

SEQ ID NO: 1144687 - RNA, 17 nt, Human
ucuugaacuccugaccu

SEQ ID NO: 1144688 - RNA, 19 nt, Human
ucuugaacuccugaccuca

SEQ ID NO: 1144689 - RNA, 19 nt, Human
ugaccguguuggucuguac

SEQ ID NO: 1144690 - RNA, 20 nt, Human
ugaccguguuggucuguacu

SEQ ID NO: 1144691 - RNA, 21 nt, Human
ugaccguguuggucuguacug

SEQ ID NO: 1144692 - RNA, 16 nt, Human
ugaccucagcuuugau

SEQ ID NO: 1144693 - RNA, 16 nt, Human
ugacuguacuccuccc

SEQ ID NO: 1144694 - RNA, 17 nt, Human
ugacuguacuccuccca

SEQ ID NO: 1144695 - RNA, 18 nt, Human
ugacuguacuccucccag

SEQ ID NO: 1144696 - RNA, 22 nt, Human
ugacuguacuccucccaggcgc

SEQ ID NO: 1144697 - RNA, 23 nt, Human
ugaggacuuaaaauauuccugca

SEQ ID NO: 1144698 - RNA, 14 nt, Human
ugauaaaucauuuu

SEQ ID NO: 1144699 - RNA, 15 nt, Human
ugauaaaucauuuua

SEQ ID NO: 1144700 - RNA, 20 nt, Human
ugauaaaucauuuuauguca

SEQ ID NO: 1144701 - RNA, 18 nt, Human
ugauagguauaaguggug

SEQ ID NO: 1144702 - RNA, 14 nt, Human
ugauccacucgccu

SEQ ID NO: 1144703 - RNA, 20 nt, Human
ugaucugaugcaagcaagaa

SEQ ID NO: 1144704 - RNA, 21 nt, Human
ugaucugaugcaagcaagaaa

SEQ ID NO: 1144705 - RNA, 13 nt, Human
ugaugugcuuaac

SEQ ID NO: 1144706 - RNA, 17 nt, Human
ugaugugcuuaacaggg

SEQ ID NO: 1144707 - RNA, 16 nt, Human
ugauuuuuuuuuuuca

SEQ ID NO: 1144708 - RNA, 22 nt, Human
ugauuuuuuuuuuuuuccuguc

SEQ ID NO: 1144709 - RNA, 14 nt, Human
ugcaaaaucaguuu

SEQ ID NO: 1144710 - RNA, 15 nt, Human
ugcaaaaucaguuuu

SEQ ID NO: 1144711 - RNA, 20 nt, Human
ugcaaaaucaguuuuccucu

SEQ ID NO: 1144712 - RNA, 18 nt, Human
ugcaaccuucgccaccug

SEQ ID NO: 1144713 - RNA, 21 nt, Human
ugcaaccuucgccaccugggu

SEQ ID NO: 1144714 - RNA, 16 nt, Human
ugcaacuuguaaaugu

SEQ ID NO: 1144715 - RNA, 18 nt, Human
ugcaacuuguaaaugugg

SEQ ID NO: 1144716 - RNA, 22 nt, Human
ugcaagaaguggggcagcagca

SEQ ID NO: 1144717 - RNA, 15 nt, Human
ugcacaaagcccuuc

SEQ ID NO: 1144718 - RNA, 17 nt, Human
ugcacaaagcccuucca

SEQ ID NO: 1144719 - RNA, 15 nt, Human
ugcacagugcaucuc

SEQ ID NO: 1144720 - RNA, 16 nt, Human
ugcacagugcaucuca

SEQ ID NO: 1144721 - RNA, 17 nt, Human
ugcacagugcaucucag

SEQ ID NO: 1144722 - RNA, 18 nt, Human
ugcacagugcaucucagc

SEQ ID NO: 1144723 - RNA, 19 nt, Human
ugcagagguccacaacaca

SEQ ID NO: 1144724 - RNA, 14 nt, Human
ugcaucccuggcug

SEQ ID NO: 1144725 - RNA, 14 nt, Human
ugcauccuccgccu

SEQ ID NO: 1144726 - RNA, 15 nt, Human
ugcauccuccgccuc

SEQ ID NO: 1144727 - RNA, 15 nt, Human
ugccaccacgcccgg

SEQ ID NO: 1144728 - RNA, 19 nt, Human
ugcccugcgggucacagga

SEQ ID NO: 1144729 - RNA, 18 nt, Human
ugcccugcugagucccag

SEQ ID NO: 1144730 - RNA, 22 nt, Human
ugcccugcugagucccaggcug

SEQ ID NO: 1144731 - RNA, 23 nt, Human
ugcccugcugagucccaggcuga

SEQ ID NO: 1144732 - RNA, 18 nt, Human
ugcccuggauccaucagg

SEQ ID NO: 1144733 - RNA, 20 nt, Human
ugcccuggugcugccacacu

SEQ ID NO: 1144734 - RNA, 21 nt, Human
ugcccuggugcugccacacuu

SEQ ID NO: 1144735 - RNA, 15 nt, Human
ugcccugguuuccug

SEQ ID NO: 1144736 - RNA, 13 nt, Human
ugccucugccugu

SEQ ID NO: 1144737 - RNA, 14 nt, Human
ugccucugccuguc

SEQ ID NO: 1144738 - RNA, 18 nt, Human
ugccucugccugucuccc

SEQ ID NO: 1144739 - RNA, 13 nt, Human
ugccucuuccucc

SEQ ID NO: 1144740 - RNA, 18 nt, Human
ugcuuaaagaauucaaau

SEQ ID NO: 1144741 - RNA, 19 nt, Human
ugcuuaaagaauucaaauu

SEQ ID NO: 1144742 - RNA, 20 nt, Human
ugcuuaaagaauucaaauuu

SEQ ID NO: 1144743 - RNA, 22 nt, Human
ugcuuaacagggaacgugauua

SEQ ID NO: 1144744 - RNA, 14 nt, Human
ugcuuguuaacuga

SEQ ID NO: 1144745 - RNA, 16 nt, Human
ugcuuguuaacugagu

SEQ ID NO: 1144746 - RNA, 17 nt, Human
ugcuuucgguuccaguu

SEQ ID NO: 1144747 - RNA, 13 nt, Human
ugcuuuggaaauc

SEQ ID NO: 1144748 - RNA, 17 nt, Human
uggcuccagcuggccgg

SEQ ID NO: 1144749 - RNA, 19 nt, Human
uggcuucccgcucagcccu

SEQ ID NO: 1144750 - RNA, 20 nt, Human
uggcuucccgcucagcccuc

SEQ ID NO: 1144751 - RNA, 21 nt, Human
uggcuucccgcucagcccucc

SEQ ID NO: 1144752 - RNA, 22 nt, Human
uggcuucccgcucagcccuccc

SEQ ID NO: 1144753 - RNA, 16 nt, Human
uggcuuuucacugcug

SEQ ID NO: 1144754 - RNA, 18 nt, Human
uggcuuuucacugcuggc

SEQ ID NO: 1144755 - RNA, 19 nt, Human
uggcuuuucacugcuggcu

SEQ ID NO: 1144756 - RNA, 21 nt, Human
uggcuuuucacugcuggcugc

SEQ ID NO: 1144757 - RNA, 22 nt, Human
uggcuuuucacugcuggcugcc

SEQ ID NO: 1144758 - RNA, 19 nt, Human
ugggaucacauguggacuu

SEQ ID NO: 1144759 - RNA, 19 nt, Human
ugguggcccgacagccugg

SEQ ID NO: 1144760 - RNA, 21 nt, Human
ugguggcccgacagccuggca

SEQ ID NO: 1144761 - RNA, 11 nt, Human
ugguuccccug

SEQ ID NO: 1144762 - RNA, 18 nt, Human
ugguuccccuguucacuc

SEQ ID NO: 1144763 - RNA, 19 nt, Human
ugguuccccuguucacucu

SEQ ID NO: 1144764 - RNA, 20 nt, Human
ugguuccccuguucacucua

SEQ ID NO: 1144765 - RNA, 23 nt, Human
ugguuccccuguucacucuacuu

SEQ ID NO: 1144766 - RNA, 12 nt, Human
ugguuccucccc

SEQ ID NO: 1144767 - RNA, 18 nt, Human
ugguuccuccccuccucc

SEQ ID NO: 1144768 - RNA, 23 nt, Human
ugguuccuccccuccuccuggac

SEQ ID NO: 1144769 - RNA, 13 nt, Human
ugguugcauccua

SEQ ID NO: 1144770 - RNA, 16 nt, Human
uguaggaagguacugu

SEQ ID NO: 1144771 - RNA, 18 nt, Human
uguaggaagguacuguau

SEQ ID NO: 1144772 - RNA, 19 nt, Human
uguaggaagguacuguaug

SEQ ID NO: 1144773 - RNA, 20 nt, Human
uguaggaagguacuguauga

SEQ ID NO: 1144774 - RNA, 22 nt, Human
uguaggaagguacuguaugauc

SEQ ID NO: 1144775 - RNA, 22 nt, Human
uguaugaaagauggcugugccu

SEQ ID NO: 1144776 - RNA, 12 nt, Human
uguaugaucaaa

SEQ ID NO: 1144777 - RNA, 13 nt, Human
uguaugcgugugu

SEQ ID NO: 1144778 - RNA, 13 nt, Human
ugucaucucagcu

SEQ ID NO: 1144779 - RNA, 13 nt, Human
uguccccuauccu

SEQ ID NO: 1144780 - RNA, 22 nt, Human
uguccugccuaaggcugaacuu

SEQ ID NO: 1144781 - RNA, 17 nt, Human
ugucucaagagggcacu

SEQ ID NO: 1144782 - RNA, 18 nt, Human
ugucucaagagggcacug

SEQ ID NO: 1144783 - RNA, 19 nt, Human
ugucucaagagggcacugg

SEQ ID NO: 1144784 - RNA, 14 nt, Human
ugucucacugagca

SEQ ID NO: 1144785 - RNA, 20 nt, Human
ugucucacugagcacuguuu

SEQ ID NO: 1144786 - RNA, 16 nt, Human
ugucucaggucccugc

SEQ ID NO: 1144787 - RNA, 16 nt, Human
ugucuguuuuaaaaac

SEQ ID NO: 1144788 - RNA, 19 nt, Human
uuagugaccucagcuuuga

SEQ ID NO: 1144789 - RNA, 15 nt, Human
uuagugacuaaacca

SEQ ID NO: 1144790 - RNA, 23 nt, Human
uuagugacuaaaccauugugcau

SEQ ID NO: 1144791 - RNA, 17 nt, Human
uuagugacuaaaccauu

SEQ ID NO: 1144792 - RNA, 22 nt, Human
uuauaagggcaaauuggagaaa

SEQ ID NO: 1144793 - RNA, 18 nt, Human
uuauaagggcaaauugga

SEQ ID NO: 1144794 - RNA, 12 nt, Human
uuauaauuuaaa

SEQ ID NO: 1144795 - RNA, 15 nt, Human
uuauauuguucacuu

SEQ ID NO: 1144796 - RNA, 17 nt, Human
uuauauuguucacuucu

SEQ ID NO: 1144797 - RNA, 16 nt, Human
uuauauuuacaaaugg

SEQ ID NO: 1144798 - RNA, 16 nt, Human
uuaucuguuugagaaa

SEQ ID NO: 1144799 - RNA, 20 nt, Human
uuaucuguuugagaaaguca

SEQ ID NO: 1144800 - RNA, 14 nt, Human
uuaugauuagcuuu

SEQ ID NO: 1144801 - RNA, 12 nt, Human
uuauuugagaag

SEQ ID NO: 1144802 - RNA, 18 nt, Human
uuauuugagaagcugcuc

SEQ ID NO: 1144803 - RNA, 20 nt, Human
uuauuugagaagcugcucaa

SEQ ID NO: 1144804 - RNA, 15 nt, Human
uucaaccauucccca

SEQ ID NO: 1144805 - RNA, 21 nt, Human
uucacaaccuucuguggcuca

SEQ ID NO: 1144806 - RNA, 23 nt, Human
uucaguuauuauauuuacaaaug

SEQ ID NO: 1144807 - RNA, 22 nt, Human
uuccaaaaauuacuuaguauug

SEQ ID NO: 1144808 - RNA, 18 nt, Human
uuccauauggauccacug

SEQ ID NO: 1144809 - RNA, 19 nt, Human
uuccauauggauccacugg

SEQ ID NO: 1144810 - RNA, 21 nt, Human
uuccauauggauccacuggcu

SEQ ID NO: 1144811 - RNA, 22 nt, Human
uuccauauggauccacuggcug

SEQ ID NO: 1144812 - RNA, 15 nt, Human
uuccaugucaagauu

SEQ ID NO: 1144813 - RNA, 21 nt, Human
uuccaugucaagauucagcua

SEQ ID NO: 1144814 - RNA, 16 nt, Human
uuccaugucgccucug

SEQ ID NO: 1144815 - RNA, 17 nt, Human
uuccaugucaagauuca

SEQ ID NO: 1144816 - RNA, 15 nt, Human
uuccugcauuuguga

SEQ ID NO: 1144817 - RNA, 18 nt, Human
uucggugagcuacaaaug

SEQ ID NO: 1144818 - RNA, 23 nt, Human
uucuaaugugugaaucagagcac

SEQ ID NO: 1144819 - RNA, 13 nt, Human
uucuacuauuuau

SEQ ID NO: 1144820 - RNA, 20 nt, Human
uucucauuugccaauaauaa

SEQ ID NO: 1144821 - RNA, 12 nt, Human
uucuccacugga

SEQ ID NO: 1144822 - RNA, 18 nt, Human
uucugcuuuccucuuccu

SEQ ID NO: 1144823 - RNA, 15 nt, Human
uucuggcagaggagg

SEQ ID NO: 1144824 - RNA, 17 nt, Human
uugaacuccugaccuca

SEQ ID NO: 1144825 - RNA, 14 nt, Human
uugacaaaauguua

SEQ ID NO: 1144826 - RNA, 19 nt, Human
uugacaaaauguuauuucc

SEQ ID NO: 1144827 - RNA, 20 nt, Human
uugacaaaauguuauuuccc

SEQ ID NO: 1144828 - RNA, 21 nt, Human
uugacaaaauguuauuucccu

SEQ ID NO: 1144829 - RNA, 17 nt, Human
uugaugacccccaacca

SEQ ID NO: 1144830 - RNA, 21 nt, Human
uuguaaaugugguaaagaguu

SEQ ID NO: 1144831 - RNA, 13 nt, Human
uuguaaauuguca

SEQ ID NO: 1144832 - RNA, 14 nt, Human
uuguauuacaaauc

SEQ ID NO: 1144833 - RNA, 21 nt, Human
uugucugaagucacugcacag

SEQ ID NO: 1144834 - RNA, 14 nt, Human
uugugaaaugaugg

SEQ ID NO: 1144835 - RNA, 16 nt, Human
uugugccagaaugcuu

SEQ ID NO: 1144836 - RNA, 21 nt, Human
uugugccagaaugcuuuagga

SEQ ID NO: 1144837 - RNA, 21 nt, Human
uuguggaaaaugaaaauuagg

SEQ ID NO: 1144838 - RNA, 12 nt, Human
uuguguuuacau

SEQ ID NO: 1144839 - RNA, 13 nt, Human
uuguguuuacauu

SEQ ID NO: 1144840 - RNA, 18 nt, Human
uuguguuuacauuuuaug

SEQ ID NO: 1144841 - RNA, 22 nt, Human
uuguguuuacauuuuauggugc

SEQ ID NO: 1144842 - RNA, 13 nt, Human
uuguuaucuguuu

SEQ ID NO: 1144843 - RNA, 13 nt, Human
uuguuaugaugug

SEQ ID NO: 1144844 - RNA, 15 nt, Human
uuguuaugaugugcu

SEQ ID NO: 1144845 - RNA, 17 nt, Human
uuguuaugaugugcuua

SEQ ID NO: 1144846 - RNA, 18 nt, Human
uuguuaugaugugcuuaa

SEQ ID NO: 1144847 - RNA, 18 nt, Human
uuguuuggagacagaguc

SEQ ID NO: 1144848 - RNA, 23 nt, Human
uuuaacaacuaugauuuggaaaa

SEQ ID NO: 1144849 - RNA, 19 nt, Human
uuuaacucuauaauguguu

SEQ ID NO: 1144850 - RNA, 19 nt, Human
uuuaagacauuuuuggaag

SEQ ID NO: 1144851 - RNA, 15 nt, Human
uuuacagcugccugc

SEQ ID NO: 1144852 - RNA, 16 nt, Human
uuuacagcugccugca

SEQ ID NO: 1144853 - RNA, 13 nt, Human
uuuacauuuuaug

SEQ ID NO: 1144854 - RNA, 17 nt, Human
uuuacauuuuauggugc

SEQ ID NO: 1144855 - RNA, 22 nt, Human
uuuacauuuuauggugccuagu

SEQ ID NO: 1144856 - RNA, 23 nt, Human
uuuacauuuuauggugccuagua

SEQ ID NO: 1144857 - RNA, 20 nt, Human
uuuauggcagacauugugcu

SEQ ID NO: 1144858 - RNA, 21 nt, Human
uuuauggcagacauugugcua

SEQ ID NO: 1144859 - RNA, 15 nt, Human
uuucaacgcagcccu

SEQ ID NO: 1144860 - RNA, 16 nt, Human
uuucaacgcagcccug

SEQ ID NO: 1144861 - RNA, 20 nt, Human
uuucaacgcagcccugcuuu

SEQ ID NO: 1144862 - RNA, 21 nt, Human
uuucaacgcagcccugcuuug

SEQ ID NO: 1144863 - RNA, 16 nt, Human
uuucacaaccuucugu

SEQ ID NO: 1144864 - RNA, 22 nt, Human
uuucacaaccuucuguggcuca

SEQ ID NO: 1144865 - RNA, 15 nt, Human
uuucagcagcugcag

SEQ ID NO: 1144866 - RNA, 14 nt, Human
uuuguauuuuuagu

SEQ ID NO: 1144867 - RNA, 20 nt, Human
uuuuaaacccuauugguaaa

SEQ ID NO: 1144868 - RNA, 21 nt, Human
uuuuaaaguaacccuacaaaa

SEQ ID NO: 1144869 - RNA, 19 nt, Human
uuuuacaaaaaagaaaaga

SEQ ID NO: 1144870 - RNA, 17 nt, Human
uuuuacaauaaaaucuu

SEQ ID NO: 1144871 - RNA, 16 nt, Human
uuuuacagcugccugc

SEQ ID NO: 1144872 - RNA, 13 nt, Human
uuuuuuccacuua

SEQ ID NO: 1144873 - RNA, 15 nt, Human
uuuuuuccugucaua

SEQ ID NO: 1144874 - RNA, 13 nt, Human
uuuuuuuuccugu

SEQ ID NO: 1144875 - RNA, 23 nt, Human
aaauagcuuggguagcgcacucu

SEQ ID NO: 1144876 - RNA, 19 nt, Human
aaaucaaugcuauaacuau

SEQ ID NO: 1144877 - RNA, 22 nt, Human
aaagcccuuccaugucgccucu

SEQ ID NO: 1144878 - RNA, 23 nt, Human
aaagcccuuccaugucgccucug

SEQ ID NO: 1144879 - RNA, 19 nt, Human
aaaauaaaauuaaagcuga

SEQ ID NO: 1144880 - RNA, 16 nt, Human
aaacccuauugguaaa

SEQ ID NO: 1144881 - RNA, 20 nt, Human
aaagaagguuucagaaagaa

SEQ ID NO: 1144882 - RNA, 15 nt, Human
aacccuauugguaaa

SEQ ID NO: 1144883 - RNA, 12 nt, Human
aacccucagagc

SEQ ID NO: 1144884 - RNA, 21 nt, Human
aacccuuggagccaauggaga

SEQ ID NO: 1144885 - RNA, 11 nt, Human
aaauguuuaau

SEQ ID NO: 1144886 - RNA, 13 nt, Human
aaauguuuaauca

SEQ ID NO: 1144887 - RNA, 14 nt, Human
aaauguuuaaucau

SEQ ID NO: 1144888 - RNA, 15 nt, Human
aaauguuuaaucaua

SEQ ID NO: 1144889 - RNA, 17 nt, Human
aaauguuuaaucauaua

SEQ ID NO: 1144890 - RNA, 19 nt, Human
aaauguuuaaucauauaaa

SEQ ID NO: 1144891 - RNA, 18 nt, Human
aaauguuuaaucauauaa

SEQ ID NO: 1144892 - RNA, 17 nt, Human
aaaucuuauaauuuaaa

SEQ ID NO: 1144893 - RNA, 13 nt, Human
aaauuaaagcuga

SEQ ID NO: 1144894 - RNA, 17 nt, Human
aaauuaaagcugaaaac

SEQ ID NO: 1144895 - RNA, 13 nt, Human
aaauugcuccuug

SEQ ID NO: 1144896 - RNA, 14 nt, Human
aaauugcuccuuga

SEQ ID NO: 1144897 - RNA, 16 nt, Human
aacugagugccuuuug

SEQ ID NO: 1144898 - RNA, 11 nt, Human
aacgcagcccu

SEQ ID NO: 1144899 - RNA, 12 nt, Human
aacgcagcccug

SEQ ID NO: 1144900 - RNA, 14 nt, Human
aaugcgcaggcugg

SEQ ID NO: 1144901 - RNA, 22 nt, Human
aaugcgcaggcuggcccugccc

SEQ ID NO: 1144902 - RNA, 15 nt, Human
aaugcgccaauaaac

SEQ ID NO: 1144903 - RNA, 23 nt, Human
aaugcuauaacuauguugauaaa

SEQ ID NO: 1144904 - RNA, 18 nt, Human
aauguccauucuuuauca

SEQ ID NO: 1144905 - RNA, 13 nt, Human
aauguuuaaucau

SEQ ID NO: 1144906 - RNA, 14 nt, Human
aauguuuaaucaua

SEQ ID NO: 1144907 - RNA, 16 nt, Human
aauguuuaaucauaua

SEQ ID NO: 1144908 - RNA, 17 nt, Human
aauguuuaaucauauaa

SEQ ID NO: 1144909 - RNA, 18 nt, Human
aauguuuaaucauauaaa

SEQ ID NO: 1144910 - RNA, 20 nt, Human
aauguuuaaucauauaaaua

SEQ ID NO: 1144911 - RNA, 23 nt, Human
aauguuuaaucauauaaauagaa

SEQ ID NO: 1144912 - RNA, 22 nt, Human
aauguuuacagauccccaagcc

SEQ ID NO: 1144913 - RNA, 13 nt, Human
aauguuugcauau

SEQ ID NO: 1144914 - RNA, 14 nt, Human
aauguuugcauaua

SEQ ID NO: 1144915 - RNA, 15 nt, Human
aauccaaugaaauga

SEQ ID NO: 1144916 - RNA, 15 nt, Human
aauacuugucuguuu

SEQ ID NO: 1144917 - RNA, 23 nt, Human
aaucaaguuggcuucuaaucaaa

SEQ ID NO: 1144918 - RNA, 19 nt, Human
aaucacauucgaguguuuc

SEQ ID NO: 1144919 - RNA, 21 nt, Human
aauauuagugaccucagcuuu

SEQ ID NO: 1144920 - RNA, 14 nt, Human
aauagaauguaaau

SEQ ID NO: 1144921 - RNA, 16 nt, Human
aauagaauguaaaugu

SEQ ID NO: 1144922 - RNA, 14 nt, Human
aaguguaaugaaua

SEQ ID NO: 1144923 - RNA, 22 nt, Human
aagggaaguaguuaucauguua

SEQ ID NO: 1144924 - RNA, 20 nt, Human
aagggaaguaguuaucaugu

SEQ ID NO: 1144925 - RNA, 20 nt, Human
aagucuaccaaccuguucaa

SEQ ID NO: 1144926 - RNA, 21 nt, Human
aagauaaacguggauguuacu

SEQ ID NO: 1144927 - RNA, 12 nt, Human
aaggcagggagg

SEQ ID NO: 1144928 - RNA, 13 nt, Human
aaggacagccccu

SEQ ID NO: 1144929 - RNA, 19 nt, Human
aaggacagccccuccucca

SEQ ID NO: 1144930 - RNA, 22 nt, Human
acuuuauuuucuauaauuuaaa

SEQ ID NO: 1144931 - RNA, 23 nt, Human
acuuuuauuuccagugaaaucag

SEQ ID NO: 1144932 - RNA, 15 nt, Human
agaaaggcugcugua

SEQ ID NO: 1144933 - RNA, 16 nt, Human
agaaagugagcagugu

SEQ ID NO: 1144934 - RNA, 14 nt, Human
agaaagugagcagu

SEQ ID NO: 1144935 - RNA, 14 nt, Human
acugcccccucugc

SEQ ID NO: 1144936 - RNA, 15 nt, Human
acugcccccucugcc

SEQ ID NO: 1144937 - RNA, 16 nt, Human
acugcccccucugccc

SEQ ID NO: 1144938 - RNA, 17 nt, Human
acugcccccucugcccu

SEQ ID NO: 1144939 - RNA, 18 nt, Human
acugcccccucugcccug

SEQ ID NO: 1144940 - RNA, 20 nt, Human
acugucucaagagggcacug

SEQ ID NO: 1144941 - RNA, 21 nt, Human
acugucucaagagggcacugg

SEQ ID NO: 1144942 - RNA, 23 nt, Human
acugucucaagagggcacuggug

SEQ ID NO: 1144943 - RNA, 13 nt, Human
acuucacugugcu

SEQ ID NO: 1144944 - RNA, 14 nt, Human
acuucacugugcug

SEQ ID NO: 1144945 - RNA, 17 nt, Human
acuucacugugcuguug

SEQ ID NO: 1144946 - RNA, 19 nt, Human
acuucacugugcuguuguu

SEQ ID NO: 1144947 - RNA, 20 nt, Human
acuucacugugcuguuguua

SEQ ID NO: 1144948 - RNA, 21 nt, Human
acuucacugugcuguuguuau

SEQ ID NO: 1144949 - RNA, 24 nt, Human
acuucacugugcuguuguuaugau

SEQ ID NO: 1144950 - RNA, 22 nt, Human
acuucacugugcuguuguuaug

SEQ ID NO: 1144951 - RNA, 18 nt, Human
acuuguaaaggaauuuaa

SEQ ID NO: 1144952 - RNA, 22 nt, Human
acgcaucuaguuccccuguuua

SEQ ID NO: 1144953 - RNA, 20 nt, Human
accugcccugcugaguccca

SEQ ID NO: 1144954 - RNA, 11 nt, Human
acucagcaugg

SEQ ID NO: 1144955 - RNA, 16 nt, Human
acacgcuccuuccucu

SEQ ID NO: 1144956 - RNA, 14 nt, Human
acacgcuccuuccu

SEQ ID NO: 1144957 - RNA, 17 nt, Human
acacagauuugagcuca

SEQ ID NO: 1144958 - RNA, 17 nt, Human
acaaaauguuauuuccc

SEQ ID NO: 1144959 - RNA, 11 nt, Human
acaaaauguua

SEQ ID NO: 1144960 - RNA, 12 nt, Human
acaaaauguuau

SEQ ID NO: 1144961 - RNA, 21 nt, Human
acaagaaaggcugcuguacug

SEQ ID NO: 1144962 - RNA, 22 nt, Human
acaagaaaggcugcuguacuga

SEQ ID NO: 1144963 - RNA, 17 nt, Human
accccucauagcccuca

SEQ ID NO: 1144964 - RNA, 15 nt, Human
acccauuuguucaua

SEQ ID NO: 1144965 - RNA, 14 nt, Human
acccccugcaaagc

SEQ ID NO: 1144966 - RNA, 17 nt, Human
acccccugcaaagccca

SEQ ID NO: 1144967 - RNA, 18 nt, Human
acccccugcaaagcccag

SEQ ID NO: 1144968 - RNA, 20 nt, Human
acccccugcaaagcccagcu

SEQ ID NO: 1144969 - RNA, 22 nt, Human
acccccugcaaagcccagcuug

SEQ ID NO: 1144970 - RNA, 14 nt, Human
acccauuuguucau

SEQ ID NO: 1144971 - RNA, 21 nt, Human
aggguccuggggaaccugacc

SEQ ID NO: 1144972 - RNA, 23 nt, Human
aggguccuggggaaccugacccc

SEQ ID NO: 1144973 - RNA, 12 nt, Human
aggguccugggg

SEQ ID NO: 1144974 - RNA, 15 nt, Human
aggguccuggggaac

SEQ ID NO: 1144975 - RNA, 20 nt, Human
agguaaaagcaucacaugaa

SEQ ID NO: 1144976 - RNA, 21 nt, Human
agguaaucgaccugccucggc

SEQ ID NO: 1144977 - RNA, 17 nt, Human
agguacaaccuguucug

SEQ ID NO: 1144978 - RNA, 18 nt, Human
agguuauuaugauuagcu

SEQ ID NO: 1144979 - RNA, 21 nt, Human
aggcgugagccaccgugccug

SEQ ID NO: 1144980 - RNA, 19 nt, Human
aggcccuuccucuccacug

SEQ ID NO: 1144981 - RNA, 13 nt, Human
aggcccuuccucu

SEQ ID NO: 1144982 - RNA, 15 nt, Human
aggcccuuccucucc

SEQ ID NO: 1144983 - RNA, 17 nt, Human
aggcccuuccucuccac

SEQ ID NO: 1144984 - RNA, 18 nt, Human
aggcccuuccucuccacu

SEQ ID NO: 1144985 - RNA, 23 nt, Human
agcugagauuauaggcaccuacc

SEQ ID NO: 1144986 - RNA, 20 nt, Human
agcugcucaacuugcaaaau

SEQ ID NO: 1144987 - RNA, 16 nt, Human
agcugcucaacuugca

SEQ ID NO: 1144988 - RNA, 19 nt, Human
agcuucuguugcugccuca

SEQ ID NO: 1144989 - RNA, 14 nt, Human
aggauuaaauaaug

SEQ ID NO: 1144990 - RNA, 20 nt, Human
aggauuaaauaauguaaaua

SEQ ID NO: 1144991 - RNA, 22 nt, Human
aggauguacaaggacagccccu

SEQ ID NO: 1144992 - RNA, 20 nt, Human
agcuucuguugcugccucau

SEQ ID NO: 1144993 - RNA, 15 nt, Human
agaugaaauuccauu

SEQ ID NO: 1144994 - RNA, 14 nt, Human
agauggcugugccu

SEQ ID NO: 1144995 - RNA, 17 nt, Human
agauggcugugccucug

SEQ ID NO: 1144996 - RNA, 19 nt, Human
agaguggcuccucccggug

SEQ ID NO: 1144997 - RNA, 23 nt, Human
agaguggcuccucccggugccca

SEQ ID NO: 1144998 - RNA, 16 nt, Human
agagaaaacaugcaga

SEQ ID NO: 1144999 - RNA, 17 nt, Human
agagaaaacaugcagaa

SEQ ID NO: 1145000 - RNA, 23 nt, Human
agagaaaacaugcagaacaaaug

SEQ ID NO: 1145001 - RNA, 15 nt, Human
agcacuguuuucuag

SEQ ID NO: 1145002 - RNA, 18 nt, Human
agcacuguuuucuagugu

SEQ ID NO: 1145003 - RNA, 13 nt, Human
agcaguguuagcu

SEQ ID NO: 1145004 - RNA, 17 nt, Human
agcaguguuagcuuagu

SEQ ID NO: 1145005 - RNA, 17 nt, Human
agcccucacccuggggc

SEQ ID NO: 1145006 - RNA, 21 nt, Human
agcccuccaucuaaacugccc

SEQ ID NO: 1145007 - RNA, 15 nt, Human
agccgugccuucagc

SEQ ID NO: 1145008 - RNA, 16 nt, Human
agccgugccuucagcu

SEQ ID NO: 1145009 - RNA, 17 nt, Human
agccgugccuucagcuc

SEQ ID NO: 1145010 - RNA, 13 nt, Human
agccguggcuucc

SEQ ID NO: 1145011 - RNA, 13 nt, Human
augucuuccugga

SEQ ID NO: 1145012 - RNA, 19 nt, Human
auggcugugccucugccug

SEQ ID NO: 1145013 - RNA, 20 nt, Human
auggcugugccucugccugu

SEQ ID NO: 1145014 - RNA, 22 nt, Human
auggaaacaagaugaaauucca

SEQ ID NO: 1145015 - RNA, 22 nt, Human
auggaggaaaaccaagccgugg

SEQ ID NO: 1145016 - RNA, 12 nt, Human
auccucccaggc

SEQ ID NO: 1145017 - RNA, 13 nt, Human
auccccaagccug

SEQ ID NO: 1145018 - RNA, 16 nt, Human
auccccaagccuggca

SEQ ID NO: 1145019 - RNA, 15 nt, Human
aucacauguggacuu

SEQ ID NO: 1145020 - RNA, 21 nt, Human
aucauguuaguaauaccucua

SEQ ID NO: 1145021 - RNA, 22 nt, Human
aucauguuaguaauaccucuaa

SEQ ID NO: 1145022 - RNA, 14 nt, Human
aucauguuaguaau

SEQ ID NO: 1145023 - RNA, 19 nt, Human
aucauguuaguaauaccuc

SEQ ID NO: 1145024 - RNA, 14 nt, Human
aucucggcucacug

SEQ ID NO: 1145025 - RNA, 15 nt, Human
aucucggcucacugc

SEQ ID NO: 1145026 - RNA, 16 nt, Human
aucucggcucacugca

SEQ ID NO: 1145027 - RNA, 15 nt, Human
aucuggacuccucug

SEQ ID NO: 1145028 - RNA, 16 nt, Human
aucuggacuccucugu

SEQ ID NO: 1145029 - RNA, 17 nt, Human
aucuggacuccucuguc

SEQ ID NO: 1145030 - RNA, 18 nt, Human
aucuggacuccucugucc

SEQ ID NO: 1145031 - RNA, 19 nt, Human
aucuggacuccucugucca

SEQ ID NO: 1145032 - RNA, 22 nt, Human
aucuggacuccucuguccaggc

SEQ ID NO: 1145033 - RNA, 18 nt, Human
agugaccauacuaauuau

SEQ ID NO: 1145034 - RNA, 12 nt, Human
aguccuguaaug

SEQ ID NO: 1145035 - RNA, 17 nt, Human
aguaugggacuggccuc

SEQ ID NO: 1145036 - RNA, 20 nt, Human
aguaugggacuggccucugc

SEQ ID NO: 1145037 - RNA, 16 nt, Human
aguaugaauaaagaca

SEQ ID NO: 1145038 - RNA, 13 nt, Human
aguggcuccuccc

SEQ ID NO: 1145039 - RNA, 17 nt, Human
aguggcuccucccggug

SEQ ID NO: 1145040 - RNA, 21 nt, Human
aguggcuccucccggugccca

SEQ ID NO: 1145041 - RNA, 13 nt, Human
aguguaucaaaau

SEQ ID NO: 1145042 - RNA, 14 nt, Human
aguguaucaaaaug

SEQ ID NO: 1145043 - RNA, 15 nt, Human
aguguaucaaaaugc

SEQ ID NO: 1145044 - RNA, 16 nt, Human
aguguaucaaaaugcu

SEQ ID NO: 1145045 - RNA, 17 nt, Human
aguguaucaaaaugcuc

SEQ ID NO: 1145046 - RNA, 18 nt, Human
aguguaucaaaaugcucu

SEQ ID NO: 1145047 - RNA, 14 nt, Human
aguuaagccuuugg

SEQ ID NO: 1145048 - RNA, 13 nt, Human
aguuaagccuuug

SEQ ID NO: 1145049 - RNA, 22 nt, Human
aguugaaaaucuuauaauuuaa

SEQ ID NO: 1145050 - RNA, 14 nt, Human
aguuguuguagaga

SEQ ID NO: 1145051 - RNA, 23 nt, Human
aguugaaaaucuuauaauuuaaa

SEQ ID NO: 1145052 - RNA, 18 nt, Human
auaaaggauuaaugucaa

SEQ ID NO: 1145053 - RNA, 15 nt, Human
auaaaagacagugaa

SEQ ID NO: 1145054 - RNA, 12 nt, Human
auaaagacaccu

SEQ ID NO: 1145055 - RNA, 18 nt, Human
auaccuuagugcaguuau

SEQ ID NO: 1145056 - RNA, 20 nt, Human
auaccucaauuuucacugug

SEQ ID NO: 1145057 - RNA, 14 nt, Human
auaccucuaauagu

SEQ ID NO: 1145058 - RNA, 18 nt, Human
auaccucuaauaguauaa

SEQ ID NO: 1145059 - RNA, 19 nt, Human
auaccucuaauaguauaaa

SEQ ID NO: 1145060 - RNA, 20 nt, Human
auaccucuaauaguauaaac

SEQ ID NO: 1145061 - RNA, 21 nt, Human
auagguauaaguggugugugu

SEQ ID NO: 1145062 - RNA, 15 nt, Human
auagguuuaauaauu

SEQ ID NO: 1145063 - RNA, 14 nt, Human
cuccgggaccccca

SEQ ID NO: 1145064 - RNA, 15 nt, Human
cuccgggacccccag

SEQ ID NO: 1145065 - RNA, 16 nt, Human
cuccgggacccccagg

SEQ ID NO: 1145066 - RNA, 17 nt, Human
cuccgggacccccagga

SEQ ID NO: 1145067 - RNA, 19 nt, Human
cuccauagaccuuuucauu

SEQ ID NO: 1145068 - RNA, 13 nt, Human
cucgaacuccuga

SEQ ID NO: 1145069 - RNA, 16 nt, Human
cucgaacuccugaccu

SEQ ID NO: 1145070 - RNA, 17 nt, Human
cucgaacuccugaccuu

SEQ ID NO: 1145071 - RNA, 18 nt, Human
cucgguauaguuuuguca

SEQ ID NO: 1145072 - RNA, 18 nt, Human
cucguauaugucucaggu

SEQ ID NO: 1145073 - RNA, 20 nt, Human
cucguauaugucucaggucc

SEQ ID NO: 1145074 - RNA, 14 nt, Human
cugacagaaggacu

SEQ ID NO: 1145075 - RNA, 17 nt, Human
cugaccccucauagccc

SEQ ID NO: 1145076 - RNA, 20 nt, Human
cugaccccucauagcccuca

SEQ ID NO: 1145077 - RNA, 21 nt, Human
cugaccccucauagcccucac

SEQ ID NO: 1145078 - RNA, 22 nt, Human
cugagcuugcagagaugaggcc

SEQ ID NO: 1145079 - RNA, 21 nt, Human
cuagacccacuggacucaccu

SEQ ID NO: 1145080 - RNA, 13 nt, Human
cuaggguccuggg

SEQ ID NO: 1145081 - RNA, 14 nt, Human
cuaggguccugggg

SEQ ID NO: 1145082 - RNA, 15 nt, Human
cuaggguccugggga

SEQ ID NO: 1145083 - RNA, 21 nt, Human
cuaguuccccuguuuauucau

SEQ ID NO: 1145084 - RNA, 18 nt, Human
cuaccuuccaguuccuca

SEQ ID NO: 1145085 - RNA, 14 nt, Human
cucacccuggggcu

SEQ ID NO: 1145086 - RNA, 16 nt, Human
cucaccucccccaucu

SEQ ID NO: 1145087 - RNA, 22 nt, Human
cgcaucuaguuccccuguuuau

SEQ ID NO: 1145088 - RNA, 22 nt, Human
cgaggucgggcagcacaagugu

SEQ ID NO: 1145089 - RNA, 19 nt, Human
cgaguagcugagauuauag

SEQ ID NO: 1145090 - RNA, 18 nt, Human
cgauacaccgggccugga

SEQ ID NO: 1145091 - RNA, 20 nt, Human
cgauacaccgggccuggaga

SEQ ID NO: 1145092 - RNA, 21 nt, Human
cgauacaccgggccuggagaa

SEQ ID NO: 1145093 - RNA, 17 nt, Human
cguaaugcgccaauaaa

SEQ ID NO: 1145094 - RNA, 22 nt, Human
cguguccccuauccuacuuccc

SEQ ID NO: 1145095 - RNA, 14 nt, Human
cguuaccaggcagg

SEQ ID NO: 1145096 - RNA, 21 nt, Human
cuaaagaagguuucagaaaga

SEQ ID NO: 1145097 - RNA, 16 nt, Human
cccacuggacucaccu

SEQ ID NO: 1145098 - RNA, 16 nt, Human
cccaggcugagccuca

SEQ ID NO: 1145099 - RNA, 17 nt, Human
cccaggcugagccucag

SEQ ID NO: 1145100 - RNA, 18 nt, Human
cccaggcugagccucagu

SEQ ID NO: 1145101 - RNA, 13 nt, Human
cccaggcuggagu

SEQ ID NO: 1145102 - RNA, 17 nt, Human
ccccagaggcuggguga

SEQ ID NO: 1145103 - RNA, 16 nt, Human
cccuccucucugcccu

SEQ ID NO: 1145104 - RNA, 16 nt, Human
cccucacccuggggcu

SEQ ID NO: 1145105 - RNA, 20 nt, Human
cccggcuaauuuuuguauuu

SEQ ID NO: 1145106 - RNA, 23 nt, Human
ccccucugcccugcgggucacag

SEQ ID NO: 1145107 - RNA, 15 nt, Human
ccccucugcccugcg

SEQ ID NO: 1145108 - RNA, 20 nt, Human
ccccucugcccugcggguca

SEQ ID NO: 1145109 - RNA, 16 nt, Human
ccccucuggcuccagc

SEQ ID NO: 1145110 - RNA, 18 nt, Human
ccccucuggcuccagcug

SEQ ID NO: 1145111 - RNA, 18 nt, Human
ccccugcaaagcccagcu

SEQ ID NO: 1145112 - RNA, 20 nt, Human
ccccugcaaagcccagcuug

SEQ ID NO: 1145113 - RNA, 21 nt, Human
ccccugcaaagcccagcuuga

SEQ ID NO: 1145114 - RNA, 12 nt, Human
ccaugucgccuc

SEQ ID NO: 1145115 - RNA, 15 nt, Human
ccaugucgccucugc

SEQ ID NO: 1145116 - RNA, 16 nt, Human
ccaugucgccucugca

SEQ ID NO: 1145117 - RNA, 17 nt, Human
ccaugucgccucugcau

SEQ ID NO: 1145118 - RNA, 19 nt, Human
ccaugucgccucugcauuc

SEQ ID NO: 1145119 - RNA, 19 nt, Human
ccaguucuucgacuguugu

SEQ ID NO: 1145120 - RNA, 21 nt, Human
ccaguugcugcuucaauuuau

SEQ ID NO: 1145121 - RNA, 14 nt, Human
ccauaaucuggacu

SEQ ID NO: 1145122 - RNA, 21 nt, Human
ccauaaucuggacuccucugu

SEQ ID NO: 1145123 - RNA, 21 nt, Human
ccauuucauuugugccagaau

SEQ ID NO: 1145124 - RNA, 22 nt, Human
ccauuucauuugugccagaaug

SEQ ID NO: 1145125 - RNA, 21 nt, Human
ccaggcugcucuugaacuccu

SEQ ID NO: 1145126 - RNA, 18 nt, Human
ccagucccccugccccag

SEQ ID NO: 1145127 - RNA, 17 nt, Human
ccugccucagccucccg

SEQ ID NO: 1145128 - RNA, 18 nt, Human
ccugcugagucccaggcu

SEQ ID NO: 1145129 - RNA, 19 nt, Human
ccugcugagucccaggcug

SEQ ID NO: 1145130 - RNA, 20 nt, Human
ccugcugagucccaggcuga

SEQ ID NO: 1145131 - RNA, 18 nt, Human
ccugaccccucauagccc

SEQ ID NO: 1145132 - RNA, 23 nt, Human
ccucuugccacugccucuuccuc

SEQ ID NO: 1145133 - RNA, 22 nt, Human
ccucuugccacugccucuuccu

SEQ ID NO: 1145134 - RNA, 14 nt, Human
ccuggauuugcaua

SEQ ID NO: 1145135 - RNA, 18 nt, Human
ccuggggaaccugacccc

SEQ ID NO: 1145136 - RNA, 18 nt, Human
ccugguuuccugcccugg

SEQ ID NO: 1145137 - RNA, 19 nt, Human
ccugguuuccugcccuggg

SEQ ID NO: 1145138 - RNA, 20 nt, Human
ccugguuuccugcccuggga

SEQ ID NO: 1145139 - RNA, 21 nt, Human
ccugguuuccugcccugggag

SEQ ID NO: 1145140 - RNA, 22 nt, Human
ccugguuuccugcccugggagg

SEQ ID NO: 1145141 - RNA, 21 nt, Human
ccucauuccaccuucccaugc

SEQ ID NO: 1145142 - RNA, 20 nt, Human
ccucccuuggggccuaugca

SEQ ID NO: 1145143 - RNA, 19 nt, Human
ccuccuaucagaaguuucu

SEQ ID NO: 1145144 - RNA, 19 nt, Human
ccucggacuuagcugggag

SEQ ID NO: 1145145 - RNA, 20 nt, Human
ccucggacuuagcugggaga

SEQ ID NO: 1145146 - RNA, 12 nt, Human
ccgacagccugg

SEQ ID NO: 1145147 - RNA, 13 nt, Human
ccgacagccuggc

SEQ ID NO: 1145148 - RNA, 14 nt, Human
ccgacagccuggca

SEQ ID NO: 1145149 - RNA, 15 nt, Human
ccgacagccuggcac

SEQ ID NO: 1145150 - RNA, 22 nt, Human
ccgacagccuggcacagggcag

SEQ ID NO: 1145151 - RNA, 14 nt, Human
ccgucccccucugg

SEQ ID NO: 1145152 - RNA, 21 nt, Human
ccuaaugcgcaggcuggcccu

SEQ ID NO: 1145153 - RNA, 13 nt, Human
ccuaauuccacag

SEQ ID NO: 1145154 - RNA, 19 nt, Human
ccaccgggcugggagcucu

SEQ ID NO: 1145155 - RNA, 22 nt, Human
ccaccgggcugggagcucugca

SEQ ID NO: 1145156 - RNA, 16 nt, Human
ccacacuucaggcucu

SEQ ID NO: 1145157 - RNA, 20 nt, Human
ccacacuucaggcucuucuc

SEQ ID NO: 1145158 - RNA, 21 nt, Human
ccacacuucaggcucuucucc

SEQ ID NO: 1145159 - RNA, 22 nt, Human
ccacacuucaggcucuucuccu

SEQ ID NO: 1145160 - RNA, 15 nt, Human
ccaccacgcccggcu

SEQ ID NO: 1145161 - RNA, 14 nt, Human
cauuugugaaauga

SEQ ID NO: 1145162 - RNA, 16 nt, Human
cauuugugaaaugaug

SEQ ID NO: 1145163 - RNA, 13 nt, Human
ccaaaugcagcuu

SEQ ID NO: 1145164 - RNA, 15 nt, Human
ccaaaugcagcuuua

SEQ ID NO: 1145165 - RNA, 18 nt, Human
ccaaaugcagcuuuaaaa

SEQ ID NO: 1145166 - RNA, 18 nt, Human
ccaaggaugccccguccc

SEQ ID NO: 1145167 - RNA, 14 nt, Human
caugucaagauuca

SEQ ID NO: 1145168 - RNA, 17 nt, Human
caugucaagauucagcu

SEQ ID NO: 1145169 - RNA, 19 nt, Human
caugucaagauucagcuag

SEQ ID NO: 1145170 - RNA, 14 nt, Human
cauucucacuccua

SEQ ID NO: 1145171 - RNA, 15 nt, Human
cauuccuugcugaaa

SEQ ID NO: 1145172 - RNA, 18 nt, Human
cauucuagguuugcaaga

SEQ ID NO: 1145173 - RNA, 13 nt, Human
cauucucacuccu

SEQ ID NO: 1145174 - RNA, 14 nt, Human
cauggccagguggc

SEQ ID NO: 1145175 - RNA, 13 nt, Human
cauggccaggugg

SEQ ID NO: 1145176 - RNA, 14 nt, Human
cagggagggccugg

SEQ ID NO: 1145177 - RNA, 16 nt, Human
cagggagggccugggc

SEQ ID NO: 1145178 - RNA, 17 nt, Human
cagggagggccugggcc

SEQ ID NO: 1145179 - RNA, 20 nt, Human
caggccugccuguucccauu

SEQ ID NO: 1145180 - RNA, 15 nt, Human
caggcgccccuuccc

SEQ ID NO: 1145181 - RNA, 17 nt, Human
caggcgccccuuccccc

SEQ ID NO: 1145182 - RNA, 18 nt, Human
caggcuggcccugcccug

SEQ ID NO: 1145183 - RNA, 19 nt, Human
caggcuggcccugcccugg

SEQ ID NO: 1145184 - RNA, 20 nt, Human
caggcuggcccugcccuggu

SEQ ID NO: 1145185 - RNA, 12 nt, Human
cagggagggccu

SEQ ID NO: 1145186 - RNA, 13 nt, Human
cagggagggccug

SEQ ID NO: 1145187 - RNA, 15 nt, Human
caggagggaggggga

SEQ ID NO: 1145188 - RNA, 23 nt, Human
caggagggagggggaaggcaggg

SEQ ID NO: 1145189 - RNA, 14 nt, Human
cagucucccucccu

SEQ ID NO: 1145190 - RNA, 18 nt, Human
cagugccaggaacccuua

SEQ ID NO: 1145191 - RNA, 19 nt, Human
cagugggacagggcauggc

SEQ ID NO: 1145192 - RNA, 21 nt, Human
cagcucccaaggcucugagca

SEQ ID NO: 1145193 - RNA, 12 nt, Human
cagcugccugca

SEQ ID NO: 1145194 - RNA, 13 nt, Human
caccagggaaggg

SEQ ID NO: 1145195 - RNA, 18 nt, Human
caccagggaaggggacaa

SEQ ID NO: 1145196 - RNA, 21 nt, Human
caccagggaaggggacaagga

SEQ ID NO: 1145197 - RNA, 13 nt, Human
caccaacccucag

SEQ ID NO: 1145198 - RNA, 13 nt, Human
cacagaacccuug

SEQ ID NO: 1145199 - RNA, 16 nt, Human
caaucccaccaacccu

SEQ ID NO: 1145200 - RNA, 17 nt, Human
caaucccaccaacccuc

SEQ ID NO: 1145201 - RNA, 22 nt, Human
caaucccaccaacccucagagc

SEQ ID NO: 1145202 - RNA, 23 nt, Human
caaucccaccaacccucagagcc

SEQ ID NO: 1145203 - RNA, 23 nt, Human
caauaaaauuauagcucuaaugu

SEQ ID NO: 1145204 - RNA, 13 nt, Human
caauaaaauuaua

SEQ ID NO: 1145205 - RNA, 20 nt, Human
caauaaaauuauagcucuaa

SEQ ID NO: 1145206 - RNA, 20 nt, Human
caauaaaaucuugaaaaugc

SEQ ID NO: 1145207 - RNA, 15 nt, Human
caaggcucugagcaa

SEQ ID NO: 1145208 - RNA, 13 nt, Human
caaguuucaucca

SEQ ID NO: 1145209 - RNA, 20 nt, Human
caaguuucauccagaacuac

SEQ ID NO: 1145210 - RNA, 16 nt, Human
caaguuucauccagaa

SEQ ID NO: 1145211 - RNA, 14 nt, Human
cacucuucauggug

SEQ ID NO: 1145212 - RNA, 12 nt, Human
caccuacugagu

SEQ ID NO: 1145213 - RNA, 13 nt, Human
caccugcccaacc

SEQ ID NO: 1145214 - RNA, 18 nt, Human
caccugcccaaccugcuc

SEQ ID NO: 1145215 - RNA, 19 nt, Human
caccugcccaaccugcucu

SEQ ID NO: 1145216 - RNA, 23 nt, Human
caccuuuauucuggcagaggagg

SEQ ID NO: 1145217 - RNA, 19 nt, Human
cagaaguuucucagcuccc

SEQ ID NO: 1145218 - RNA, 13 nt, Human
cacugggcuucua

SEQ ID NO: 1145219 - RNA, 14 nt, Human
cacuguuuucuagu

SEQ ID NO: 1145220 - RNA, 16 nt, Human
cacuguuuucuagugu

SEQ ID NO: 1145221 - RNA, 17 nt, Human
cacuguuuucuagugua

SEQ ID NO: 1145222 - RNA, 21 nt, Human
cacuguuuucuaguguaucaa

SEQ ID NO: 1145223 - RNA, 23 nt, Human
cacuguuuucuaguguaucaaaa

SEQ ID NO: 1145224 - RNA, 19 nt, Human
cacuuguugauuaauggaa

SEQ ID NO: 1145225 - RNA, 12 nt, Human
auuguguuuaca

SEQ ID NO: 1145226 - RNA, 14 nt, Human
auuguguuuacauu

SEQ ID NO: 1145227 - RNA, 15 nt, Human
auuguguuuacauuu

SEQ ID NO: 1145228 - RNA, 18 nt, Human
auuguguuuacauuuuau

SEQ ID NO: 1145229 - RNA, 19 nt, Human
auuguguuuacauuuuaug

SEQ ID NO: 1145230 - RNA, 23 nt, Human
auuguguuuacauuuuauggugc

SEQ ID NO: 1145231 - RNA, 22 nt, Human
auuguguuuacauuuuauggug

SEQ ID NO: 1145232 - RNA, 17 nt, Human
auucuugccaaauauaa

SEQ ID NO: 1145233 - RNA, 15 nt, Human
auuccugcauuugug

SEQ ID NO: 1145234 - RNA, 18 nt, Human
auuccugcauuugugaaa

SEQ ID NO: 1145235 - RNA, 13 nt, Human
auucaaauuuuau

SEQ ID NO: 1145236 - RNA, 14 nt, Human
auuaggauuucaug

SEQ ID NO: 1145237 - RNA, 16 nt, Human
auuaggauuucaugau

SEQ ID NO: 1145238 - RNA, 14 nt, Human
caaccauccaauua

SEQ ID NO: 1145239 - RNA, 18 nt, Human
caacuaauuuuuguauuu

SEQ ID NO: 1145240 - RNA, 21 nt, Human
caacacacagauuugagcuca

SEQ ID NO: 1145241 - RNA, 22 nt, Human
caacacacagauuugagcucag

SEQ ID NO: 1145242 - RNA, 18 nt, Human
caaagucaggaaucauca

SEQ ID NO: 1145243 - RNA, 22 nt, Human
caaagucaggaaucaucaggaa

SEQ ID NO: 1145244 - RNA, 19 nt, Human
caaaugaagacaaaacaua

SEQ ID NO: 1145245 - RNA, 22 nt, Human
auuuuauggugccuaguauuga

SEQ ID NO: 1145246 - RNA, 21 nt, Human
caaaaggauaaugaauacuuu

SEQ ID NO: 1145247 - RNA, 18 nt, Human
caaaccccgaccaccugc

SEQ ID NO: 1145248 - RNA, 21 nt, Human
caaaccccgaccaccugccca

SEQ ID NO: 1145249 - RNA, 20 nt, Human
cugaucugaugcaagcaaga

SEQ ID NO: 1145250 - RNA, 13 nt, Human
cugccuccucuuc

SEQ ID NO: 1145251 - RNA, 14 nt, Human
cugccuccucuuca

SEQ ID NO: 1145252 - RNA, 15 nt, Human
cugccuccucuucaa

SEQ ID NO: 1145253 - RNA, 24 nt, Human
cugccuccucuucaacugaccagc

SEQ ID NO: 1145254 - RNA, 14 nt, Human
cuggcagaggaggg

SEQ ID NO: 1145255 - RNA, 20 nt, Human
cuggcagccgugccuucagc

SEQ ID NO: 1145256 - RNA, 21 nt, Human
cuggcagccgugccuucagcu

SEQ ID NO: 1145257 - RNA, 22 nt, Human
cuggcagccgugccuucagcuc

SEQ ID NO: 1145258 - RNA, 11 nt, Human
cuggcccugcc

SEQ ID NO: 1145259 - RNA, 13 nt, Human
cuggcccugcccu

SEQ ID NO: 1145260 - RNA, 14 nt, Human
cuggcccugcccug

SEQ ID NO: 1145261 - RNA, 15 nt, Human
cuggcccugcccugg

SEQ ID NO: 1145262 - RNA, 16 nt, Human
cuggccgggagccuga

SEQ ID NO: 1145263 - RNA, 12 nt, Human
cugggccagaau

SEQ ID NO: 1145264 - RNA, 14 nt, Human
cugggccagaauuu

SEQ ID NO: 1145265 - RNA, 22 nt, Human
cuggguuccagcaauucuccug

SEQ ID NO: 1145266 - RNA, 13 nt, Human
cugguuuccugcc

SEQ ID NO: 1145267 - RNA, 14 nt, Human
cugguuuccugccc

SEQ ID NO: 1145268 - RNA, 16 nt, Human
cugguuuccugcccug

SEQ ID NO: 1145269 - RNA, 20 nt, Human
cuguacugaaguaaaacaaa

SEQ ID NO: 1145270 - RNA, 19 nt, Human
cuguacugaaguaaaacaa

SEQ ID NO: 1145271 - RNA, 13 nt, Human
cuguacugauuca

SEQ ID NO: 1145272 - RNA, 14 nt, Human
cuguacugauucaa

SEQ ID NO: 1145273 - RNA, 17 nt, Human
cuguacugauucaauuu

SEQ ID NO: 1145274 - RNA, 21 nt, Human
cuguacugauucaauuugaug

SEQ ID NO: 1145275 - RNA, 21 nt, Human
cuuacauuagcaguuugcuuu

SEQ ID NO: 1145276 - RNA, 22 nt, Human
cuuacauuagcaguuugcuuug

SEQ ID NO: 1145277 - RNA, 21 nt, Human
cuuagcauuuucugcaucucc

SEQ ID NO: 1145278 - RNA, 19 nt, Human
cuuagcauuuucugcaucu

SEQ ID NO: 1145279 - RNA, 13 nt, Human
cuuagcugggaga

SEQ ID NO: 1145280 - RNA, 13 nt, Human
cuuccucuccacu

SEQ ID NO: 1145281 - RNA, 14 nt, Human
cuuccucuccacug

SEQ ID NO: 1145282 - RNA, 15 nt, Human
cuuccucuccacugc

SEQ ID NO: 1145283 - RNA, 14 nt, Human
cuuccucugagccu

SEQ ID NO: 1145284 - RNA, 15 nt, Human
cuuccucugagccuu

SEQ ID NO: 1145285 - RNA, 16 nt, Human
cuuccucugaggcuga

SEQ ID NO: 1145286 - RNA, 22 nt, Human
cuuccucugaggcugaaauuca

SEQ ID NO: 1145287 - RNA, 13 nt, Human
cuucucacauuua

SEQ ID NO: 1145288 - RNA, 20 nt, Human
cuucucacauuuauauuuuu

SEQ ID NO: 1145289 - RNA, 15 nt, Human
cuucuuaauguacau

SEQ ID NO: 1145290 - RNA, 16 nt, Human
cuucuuaauguacaua

SEQ ID NO: 1145291 - RNA, 20 nt, Human
cuucuuaauguacauagugc

SEQ ID NO: 1145292 - RNA, 18 nt, Human
cuucuuaauguacauagu

SEQ ID NO: 1145293 - RNA, 23 nt, Human
cuugaagguauaucuagguuuau

SEQ ID NO: 1145294 - RNA, 15 nt, Human
cuugcaaaaucaguu

SEQ ID NO: 1145295 - RNA, 16 nt, Human
cuugcaaaaucaguuu

SEQ ID NO: 1145296 - RNA, 17 nt, Human
cuugcaaaaucaguuuu

SEQ ID NO: 1145297 - RNA, 22 nt, Human
cuugcaaaaucaguuuuccucu

SEQ ID NO: 1145298 - RNA, 16 nt, Human
cuuggguagcgcacuc

SEQ ID NO: 1145299 - RNA, 12 nt, Human
cuuuguaugcac

SEQ ID NO: 1145300 - RNA, 12 nt, Human
gaaaaugugugu

SEQ ID NO: 1145301 - RNA, 15 nt, Human
gaaaaugugugugug

SEQ ID NO: 1145302 - RNA, 13 nt, Human
gaacaaaugaaga

SEQ ID NO: 1145303 - RNA, 17 nt, Human
gaacacauaauucagga

SEQ ID NO: 1145304 - RNA, 20 nt, Human
gaacacauaauucaggaagc

SEQ ID NO: 1145305 - RNA, 14 nt, Human
gaagaccuuuuucu

SEQ ID NO: 1145306 - RNA, 17 nt, Human
gaagaccuuuuucugca

SEQ ID NO: 1145307 - RNA, 21 nt, Human
gaagaccuuuuucugcacuau

SEQ ID NO: 1145308 - RNA, 21 nt, Human
gacacucgaggucgggcagca

SEQ ID NO: 1145309 - RNA, 11 nt, Human
gacagccuggc

SEQ ID NO: 1145310 - RNA, 12 nt, Human
gacagccuggca

SEQ ID NO: 1145311 - RNA, 13 nt, Human
gacagccuggcac

SEQ ID NO: 1145312 - RNA, 17 nt, Human
gacaggguuucaccaug

SEQ ID NO: 1145313 - RNA, 15 nt, Human
gacaguaauuguguu

SEQ ID NO: 1145314 - RNA, 18 nt, Human
gacaguaauuguguuuac

SEQ ID NO: 1145315 - RNA, 19 nt, Human
gacaguaauuguguuuaca

SEQ ID NO: 1145316 - RNA, 22 nt, Human
gacaguaauuguguuuacauuu

SEQ ID NO: 1145317 - RNA, 20 nt, Human
gacaguaauuguguuuacau

SEQ ID NO: 1145318 - RNA, 13 nt, Human
gaccccuggcuuu

SEQ ID NO: 1145319 - RNA, 21 nt, Human
gaccccuggcuuuucacugcu

SEQ ID NO: 1145320 - RNA, 22 nt, Human
gaccccuggcuuuucacugcug

SEQ ID NO: 1145321 - RNA, 16 nt, Human
gacuguacuccuccca

SEQ ID NO: 1145322 - RNA, 17 nt, Human
gacuguacuccucccag

SEQ ID NO: 1145323 - RNA, 18 nt, Human
gacuguacuccucccagg

SEQ ID NO: 1145324 - RNA, 21 nt, Human
gacugucucaagagggcacug

SEQ ID NO: 1145325 - RNA, 22 nt, Human
gacugucucaagagggcacugg

SEQ ID NO: 1145326 - RNA, 23 nt, Human
gacugucucaagagggcacuggu

SEQ ID NO: 1145327 - RNA, 13 nt, Human
gagaagcugcuca

SEQ ID NO: 1145328 - RNA, 22 nt, Human
gagaagcugcucaacuugcaaa

SEQ ID NO: 1145329 - RNA, 23 nt, Human
gauggaggaaaaccaagccgugg

SEQ ID NO: 1145330 - RNA, 17 nt, Human
gaugucccaacuuguaa

SEQ ID NO: 1145331 - RNA, 18 nt, Human
gaugucccaacuuguaaa

SEQ ID NO: 1145332 - RNA, 15 nt, Human
gauuucagcucacug

SEQ ID NO: 1145333 - RNA, 17 nt, Human
gauuucagcucacugca

SEQ ID NO: 1145334 - RNA, 20 nt, Human
gauuucagcucacugcaacc

SEQ ID NO: 1145335 - RNA, 21 nt, Human
gauuuuuuuuuuuuuccuguc

SEQ ID NO: 1145336 - RNA, 17 nt, Human
gcaauacaaguuucauc

SEQ ID NO: 1145337 - RNA, 11 nt, Human
gcacacagcac

SEQ ID NO: 1145338 - RNA, 23 nt, Human
gcacacagcacgggggccaagga

SEQ ID NO: 1145339 - RNA, 18 nt, Human
gcacacagaggggaguca

SEQ ID NO: 1145340 - RNA, 17 nt, Human
gcaccuaccaccacgcc

SEQ ID NO: 1145341 - RNA, 18 nt, Human
gcaccuaccaccacgccc

SEQ ID NO: 1145342 - RNA, 14 nt, Human
gcacuauaugcaaa

SEQ ID NO: 1145343 - RNA, 15 nt, Human
gcacuauaugcaaac

SEQ ID NO: 1145344 - RNA, 18 nt, Human
gcacuauaugcaaacagg

SEQ ID NO: 1145345 - RNA, 13 nt, Human
gcacucuucaugg

SEQ ID NO: 1145346 - RNA, 15 nt, Human
gcacucuucauggug

SEQ ID NO: 1145347 - RNA, 13 nt, Human
gcaggcuggcccu

SEQ ID NO: 1145348 - RNA, 14 nt, Human
gcaggcuggcccug

SEQ ID NO: 1145349 - RNA, 13 nt, Human
gcaucgcaaugua

SEQ ID NO: 1145350 - RNA, 13 nt, Human
gcauggccaggug

SEQ ID NO: 1145351 - RNA, 14 nt, Human
gcauggccaggugg

SEQ ID NO: 1145352 - RNA, 17 nt, Human
gcauggccagguggcca

SEQ ID NO: 1145353 - RNA, 23 nt, Human
gcaugucccuaccgagucucuuc

SEQ ID NO: 1145354 - RNA, 22 nt, Human
gccaagcaccuagccucgcucu

SEQ ID NO: 1145355 - RNA, 16 nt, Human
gcccuaaugcgcaggc

SEQ ID NO: 1145356 - RNA, 17 nt, Human
gcccuaaugcgcaggcu

SEQ ID NO: 1145357 - RNA, 19 nt, Human
gcccuaaugcgcaggcugg

SEQ ID NO: 1145358 - RNA, 20 nt, Human
gcccuaaugcgcaggcuggc

SEQ ID NO: 1145359 - RNA, 23 nt, Human
gcccuaaugcgcaggcuggcccu

SEQ ID NO: 1145360 - RNA, 15 nt, Human
gcccucacccugggg

SEQ ID NO: 1145361 - RNA, 11 nt, Human
gcccugcccug

SEQ ID NO: 1145362 - RNA, 12 nt, Human
gcccugcccugg

SEQ ID NO: 1145363 - RNA, 16 nt, Human
gcccugcccugguuuc

SEQ ID NO: 1145364 - RNA, 18 nt, Human
gcccugcccugguuuccu

SEQ ID NO: 1145365 - RNA, 22 nt, Human
gcccuguccugccuaaggcuga

SEQ ID NO: 1145366 - RNA, 16 nt, Human
gccuaguauugacaaa

SEQ ID NO: 1145367 - RNA, 14 nt, Human
gccuaguauugaca

SEQ ID NO: 1145368 - RNA, 12 nt, Human
gccucuuccucc

SEQ ID NO: 1145369 - RNA, 23 nt, Human
gccuguucccauucuugcauggc

SEQ ID NO: 1145370 - RNA, 14 nt, Human
gcuaaucagcauuc

SEQ ID NO: 1145371 - RNA, 16 nt, Human
gcuaaucagcauucuc

SEQ ID NO: 1145372 - RNA, 17 nt, Human
gcuaaucagcauucuca

SEQ ID NO: 1145373 - RNA, 22 nt, Human
gcuaaucagcauucucacuccu

SEQ ID NO: 1145374 - RNA, 16 nt, Human
gcucacugcauccucc

SEQ ID NO: 1145375 - RNA, 20 nt, Human
gcucacugcauccuccgccu

SEQ ID NO: 1145376 - RNA, 16 nt, Human
gcucccacaggcccuu

SEQ ID NO: 1145377 - RNA, 17 nt, Human
gcucccacaggcccuuc

SEQ ID NO: 1145378 - RNA, 20 nt, Human
gcucccacaggcccuuccuc

SEQ ID NO: 1145379 - RNA, 21 nt, Human
gcucccacaggcccuuccucu

SEQ ID NO: 1145380 - RNA, 22 nt, Human
gcucccacaggcccuuccucuc

SEQ ID NO: 1145381 - RNA, 12 nt, Human
gcuccugccacc

SEQ ID NO: 1145382 - RNA, 18 nt, Human
gcuccugccaccacgccc

SEQ ID NO: 1145383 - RNA, 21 nt, Human
gcuccugccaccacgcccggc

SEQ ID NO: 1145384 - RNA, 23 nt, Human
gcuccuggggguucuuucuuccu

SEQ ID NO: 1145385 - RNA, 12 nt, Human
gcuuauguuaac

SEQ ID NO: 1145386 - RNA, 19 nt, Human
ggacaaggacuaggguccu

SEQ ID NO: 1145387 - RNA, 12 nt, Human
ggacuccucugu

SEQ ID NO: 1145388 - RNA, 22 nt, Human
ggagacugcugagucaacccaa

SEQ ID NO: 1145389 - RNA, 15 nt, Human
ggcacugguggcccg

SEQ ID NO: 1145390 - RNA, 13 nt, Human
ggcacuguacaaa

SEQ ID NO: 1145391 - RNA, 20 nt, Human
ggcagacauugugcuagugc

SEQ ID NO: 1145392 - RNA, 18 nt, Human
ggcagccgugccuucagc

SEQ ID NO: 1145393 - RNA, 19 nt, Human
ggccucacuaggcuucugg

SEQ ID NO: 1145394 - RNA, 12 nt, Human
ggcucuucuccu

SEQ ID NO: 1145395 - RNA, 13 nt, Human
ggcucuucuccuu

SEQ ID NO: 1145396 - RNA, 14 nt, Human
ggcucuucuccuuu

SEQ ID NO: 1145397 - RNA, 15 nt, Human
ggcucuucuccuuuc

SEQ ID NO: 1145398 - RNA, 23 nt, Human
ggcucuucuccuuucacaaccuu

SEQ ID NO: 1145399 - RNA, 16 nt, Human
ggcucuucuccuuuca

SEQ ID NO: 1145400 - RNA, 22 nt, Human
ggcugacagacagcccuccauc

SEQ ID NO: 1145401 - RNA, 13 nt, Human
ggcugcccuggug

SEQ ID NO: 1145402 - RNA, 14 nt, Human
ggcugcccuggugc

SEQ ID NO: 1145403 - RNA, 15 nt, Human
ggcugcccuggugcu

SEQ ID NO: 1145404 - RNA, 16 nt, Human
ggcugcccuggugcug

SEQ ID NO: 1145405 - RNA, 19 nt, Human
ggcugcccuggugcugcca

SEQ ID NO: 1145406 - RNA, 22 nt, Human
ggcugcccuggugcugccacac

SEQ ID NO: 1145407 - RNA, 16 nt, Human
ggcugccuuagaaccu

SEQ ID NO: 1145408 - RNA, 12 nt, Human
ggcugcggcccc

SEQ ID NO: 1145409 - RNA, 18 nt, Human
ggcugcggccccuccccc

SEQ ID NO: 1145410 - RNA, 14 nt, Human
aaaaauaacaauga

SEQ ID NO: 1145411 - RNA, 15 nt, Human
ggcuucccgcucagc

SEQ ID NO: 1145412 - RNA, 16 nt, Human
ggcuucccgcucagcc

SEQ ID NO: 1145413 - RNA, 17 nt, Human
ggcuucccgcucagccc

SEQ ID NO: 1145414 - RNA, 18 nt, Human
ggcuucccgcucagcccu

SEQ ID NO: 1145415 - RNA, 19 nt, Human
ggcuucccgcucagcccuc

SEQ ID NO: 1145416 - RNA, 21 nt, Human
ggcuucccgcucagcccuccc

SEQ ID NO: 1145417 - RNA, 22 nt, Human
ggcuucccgcucagcccucccu

SEQ ID NO: 1145418 - RNA, 13 nt, Human
gggaaccugaccc

SEQ ID NO: 1145419 - RNA, 13 nt, Human
gggacagagcaga

SEQ ID NO: 1145420 - RNA, 21 nt, Human
aaaacaugcagaacaaaugaa

SEQ ID NO: 1145421 - RNA, 23 nt, Human
aaaacaugcagaacaaaugaaga

SEQ ID NO: 1145422 - RNA, 23 nt, Human
aaaaccuguucaagucuaccaac

SEQ ID NO: 1145423 - RNA, 22 nt, Human
aaaaccuuccaugucaagauuc

SEQ ID NO: 1145424 - RNA, 11 nt, Human
aaaaccuguuc

SEQ ID NO: 1145425 - RNA, 20 nt, Human
aaaacuucguuuaaugaaug

SEQ ID NO: 1145426 - RNA, 15 nt, Human
aaaauguuauuuccc

SEQ ID NO: 1145427 - RNA, 16 nt, Human
aaaauguuauuucccu

SEQ ID NO: 1145428 - RNA, 12 nt, Human
aaacaauaccug

SEQ ID NO: 1145429 - RNA, 20 nt, Human
aaacaggguaacuaacuaaa

SEQ ID NO: 1145430 - RNA, 13 nt, Human
ggggaaggcaggg

SEQ ID NO: 1145431 - RNA, 15 nt, Human
aaacauuaugaugug

SEQ ID NO: 1145432 - RNA, 22 nt, Human
aaacugcccccucugcccugcg

SEQ ID NO: 1145433 - RNA, 13 nt, Human
aaagacagugaaa

SEQ ID NO: 1145434 - RNA, 21 nt, Human
aaagauggcugugccucugcc

SEQ ID NO: 1145435 - RNA, 22 nt, Human
aaagauggcugugccucugccu

SEQ ID NO: 1145436 - RNA, 23 nt, Human
aaagauggcugugccucugccug

SEQ ID NO: 1145437 - RNA, 15 nt, Human
aaagcugaaaacugc

SEQ ID NO: 1145438 - RNA, 12 nt, Human
aaagcugaaaac

SEQ ID NO: 1145439 - RNA, 20 nt, Human
guaauaggcguaacuaauuu

SEQ ID NO: 1145440 - RNA, 13 nt, Human
guaauuguguuua

SEQ ID NO: 1145441 - RNA, 15 nt, Human
guaauuguguuuaca

SEQ ID NO: 1145442 - RNA, 17 nt, Human
guaauuguguuuacauu

SEQ ID NO: 1145443 - RNA, 18 nt, Human
guaauuguguuuacauuu

SEQ ID NO: 1145444 - RNA, 20 nt, Human
guaauuguguuuacauuuua

SEQ ID NO: 1145445 - RNA, 18 nt, Human
guaauuuggaucucuucu

SEQ ID NO: 1145446 - RNA, 15 nt, Human
aaauauuccugcauu

SEQ ID NO: 1145447 - RNA, 14 nt, Human
aaaucauuuuaugu

SEQ ID NO: 1145448 - RNA, 15 nt, Human
aaaucauuuuauguc

SEQ ID NO: 1145449 - RNA, 17 nt, Human
aaaucauuuuaugucaa

SEQ ID NO: 1145450 - RNA, 17 nt, Human
guaccaaccauccaauu

SEQ ID NO: 1145451 - RNA, 14 nt, Human
guacuccucccagg

SEQ ID NO: 1145452 - RNA, 16 nt, Human
guacugauucaauuug

SEQ ID NO: 1145453 - RNA, 15 nt, Human
guacugauucaauuu

SEQ ID NO: 1145454 - RNA, 15 nt, Human
guacugcauuauuug

SEQ ID NO: 1145455 - RNA, 13 nt, Human
guacugcauuauu

SEQ ID NO: 1145456 - RNA, 14 nt, Human
guacuguaugauca

SEQ ID NO: 1145457 - RNA, 17 nt, Human
guacuguaugaucaaau

SEQ ID NO: 1145458 - RNA, 18 nt, Human
guacuguaugaucaaaug

SEQ ID NO: 1145459 - RNA, 20 nt, Human
guacuguaugaucaaauguu

SEQ ID NO: 1145460 - RNA, 21 nt, Human
guacuguaugaucaaauguuu

SEQ ID NO: 1145461 - RNA, 22 nt, Human
guacuguaugaucaaauguuua

SEQ ID NO: 1145462 - RNA, 23 nt, Human
guacuguaugaucaaauguuuaa

SEQ ID NO: 1145463 - RNA, 11 nt, Human
guagagacagg

SEQ ID NO: 1145464 - RNA, 12 nt, Human
gucccccucugg

SEQ ID NO: 1145465 - RNA, 14 nt, Human
gucccccucuggcu

SEQ ID NO: 1145466 - RNA, 20 nt, Human
aacagauguccaucagauga

SEQ ID NO: 1145467 - RNA, 19 nt, Human
aacagauguccaucagaug

SEQ ID NO: 1145468 - RNA, 14 nt, Human
gucgcccaggcugg

SEQ ID NO: 1145469 - RNA, 15 nt, Human
gucgcccaggcugga

SEQ ID NO: 1145470 - RNA, 20 nt, Human
gucgcccaggcuggagugca

SEQ ID NO: 1145471 - RNA, 15 nt, Human
gucucaagagggcac

SEQ ID NO: 1145472 - RNA, 17 nt, Human
gucucaagagggcacug

SEQ ID NO: 1145473 - RNA, 20 nt, Human
gucucaagagggcacuggug

SEQ ID NO: 1145474 - RNA, 22 nt, Human
gucucaagagggcacugguggc

SEQ ID NO: 1145475 - RNA, 15 nt, Human
gucucaggucccugc

SEQ ID NO: 1145476 - RNA, 16 nt, Human
gucucaggucccugca

SEQ ID NO: 1145477 - RNA, 16 nt, Human
aaccaagccguggcuu

SEQ ID NO: 1145478 - RNA, 16 nt, Human
gucugaagucacugca

SEQ ID NO: 1145479 - RNA, 17 nt, Human
gucugaagucacugcac

SEQ ID NO: 1145480 - RNA, 19 nt, Human
gucugaagucacugcacag

SEQ ID NO: 1145481 - RNA, 13 nt, Human
aaccuguucugcu

SEQ ID NO: 1145482 - RNA, 17 nt, Human
aaccuguucugcuuucc

SEQ ID NO: 1145483 - RNA, 18 nt, Human
aacguuuagcugacaaaa

SEQ ID NO: 1145484 - RNA, 13 nt, Human
aacuaacuaaaac

SEQ ID NO: 1145485 - RNA, 20 nt, Human
aacuagacucccaagcugga

SEQ ID NO: 1145486 - RNA, 15 nt, Human
gugagcaggcuguga

SEQ ID NO: 1145487 - RNA, 17 nt, Human
gugagcaggcugugagu

SEQ ID NO: 1145488 - RNA, 14 nt, Human
aacugaacucugac

SEQ ID NO: 1145489 - RNA, 16 nt, Human
gugccuggccacgccc

SEQ ID NO: 1145490 - RNA, 15 nt, Human
aacuuguaaaugugg

SEQ ID NO: 1145491 - RNA, 13 nt, Human
aacuuguuuucug

SEQ ID NO: 1145492 - RNA, 15 nt, Human
aagaaaggcugcugu

SEQ ID NO: 1145493 - RNA, 22 nt, Human
aagaaagugagcaguguuagcu

SEQ ID NO: 1145494 - RNA, 20 nt, Human
aagaaaggcugcuguacuga

SEQ ID NO: 1145495 - RNA, 23 nt, Human
aagaagguuucagaaagaagugg

SEQ ID NO: 1145496 - RNA, 12 nt, Human
aagaauucaaau

SEQ ID NO: 1145497 - RNA, 13 nt, Human
aagaauucaaauu

SEQ ID NO: 1145498 - RNA, 17 nt, Human
aagaauucaaauuuuau

SEQ ID NO: 1145499 - RNA, 18 nt, Human
aagaauucaaauuuuauc

SEQ ID NO: 1145500 - RNA, 21 nt, Human
aagaauucaaauuuuaucugc

SEQ ID NO: 1145501 - RNA, 12 nt, Human
aagaccagucca

SEQ ID NO: 1145502 - RNA, 23 nt, Human
aagaccccuuaccacugcucuga

SEQ ID NO: 1145503 - RNA, 16 nt, Human
guggcccgacagccug

SEQ ID NO: 1145504 - RNA, 17 nt, Human
guggcccgacagccugg

SEQ ID NO: 1145505 - RNA, 21 nt, Human
guggcuucccgcucagcccuc

SEQ ID NO: 1145506 - RNA, 14 nt, Human
aagaucccauuuga

SEQ ID NO: 1145507 - RNA, 12 nt, Human
aagcaaaugucu

SEQ ID NO: 1145508 - RNA, 19 nt, Human
guguguguaugcgugugug

SEQ ID NO: 1145509 - RNA, 13 nt, Human
guguuuaagacau

SEQ ID NO: 1145510 - RNA, 14 nt, Human
guguuuaagacauu

SEQ ID NO: 1145511 - RNA, 22 nt, Human
guguuuaagacauuuuuggaag

SEQ ID NO: 1145512 - RNA, 14 nt, Human
guguuuacauuuua

SEQ ID NO: 1145513 - RNA, 16 nt, Human
aaggaaaaaauaacaa

SEQ ID NO: 1145514 - RNA, 19 nt, Human
aaggaaaaaauaacaauga

SEQ ID NO: 1145515 - RNA, 15 nt, Human
guuccccuguucacu

SEQ ID NO: 1145516 - RNA, 17 nt, Human
guuccccuguucacucu

SEQ ID NO: 1145517 - RNA, 18 nt, Human
guuccccuguucacucua

SEQ ID NO: 1145518 - RNA, 17 nt, Human
guuccccuguuuauuca

SEQ ID NO: 1145519 - RNA, 18 nt, Human
guuccccuguuuauucau

SEQ ID NO: 1145520 - RNA, 19 nt, Human
guuccccuguuuauucaua

SEQ ID NO: 1145521 - RNA, 13 nt, Human
aaggauaaugaau

SEQ ID NO: 1145522 - RNA, 12 nt, Human
guugcugccuca

SEQ ID NO: 1145523 - RNA, 19 nt, Human
aaggcugagaggagagaga

SEQ ID NO: 1145524 - RNA, 16 nt, Human
aaggcugcuguacuga

SEQ ID NO: 1145525 - RNA, 17 nt, Human
aaguaaaacaaacaaua

SEQ ID NO: 1145526 - RNA, 20 nt, Human
aaguaaaacaaacaauaccu

SEQ ID NO: 1145527 - RNA, 14 nt, Human
guuucucagcuccc

SEQ ID NO: 1145528 - RNA, 23 nt, Human
guuugcauauaagggaaguaguu

SEQ ID NO: 1145529 - RNA, 15 nt, Human
aagucaacuuagcau

SEQ ID NO: 1145530 - RNA, 19 nt, Human
aagucaaggguaggguggg

SEQ ID NO: 1145531 - RNA, 12 nt, Human
aagucacugcac

SEQ ID NO: 1145532 - RNA, 14 nt, Human
aagucacugcacag

SEQ ID NO: 1145533 - RNA, 22 nt, Human
aagucuuauauauuguagauaa

SEQ ID NO: 1145534 - RNA, 16 nt, Human
uaaaauuaaagcugaa

SEQ ID NO: 1145535 - RNA, 18 nt, Human
uaaaauuaaagcugaaaa

SEQ ID NO: 1145536 - RNA, 19 nt, Human
uaaaauuaaagcugaaaac

SEQ ID NO: 1145537 - RNA, 15 nt, Human
uaaaauuauagcucu

SEQ ID NO: 1145538 - RNA, 16 nt, Human
uaaaauuauagcucua

SEQ ID NO: 1145539 - RNA, 18 nt, Human
uaaaauuauagcucuaau

SEQ ID NO: 1145540 - RNA, 21 nt, Human
uaaaauuauagcucuaauguu

SEQ ID NO: 1145541 - RNA, 20 nt, Human
uaaaauuauagcucuaaugu

SEQ ID NO: 1145542 - RNA, 17 nt, Human
uaaaccaaugaacgaag

SEQ ID NO: 1145543 - RNA, 14 nt, Human
uaaaccauugugca

SEQ ID NO: 1145544 - RNA, 22 nt, Human
uaaaccccaccccaaaauuagc

SEQ ID NO: 1145545 - RNA, 18 nt, Human
uaaacguggauguuacuc

SEQ ID NO: 1145546 - RNA, 14 nt, Human
uaaacguggauguu

SEQ ID NO: 1145547 - RNA, 12 nt, Human
uaaacugccccc

SEQ ID NO: 1145548 - RNA, 14 nt, Human
uaaagaagguuuca

SEQ ID NO: 1145549 - RNA, 14 nt, Human
uaaagaauucaaau

SEQ ID NO: 1145550 - RNA, 15 nt, Human
uaaagaauucaaauu

SEQ ID NO: 1145551 - RNA, 15 nt, Human
uaaagacaccuacug

SEQ ID NO: 1145552 - RNA, 18 nt, Human
uaaagaguuaguuugagu

SEQ ID NO: 1145553 - RNA, 12 nt, Human
aauaaaaauaau

SEQ ID NO: 1145554 - RNA, 16 nt, Human
aauaaaaucuugaaaa

SEQ ID NO: 1145555 - RNA, 16 nt, Human
aauaaaguacaagagc

SEQ ID NO: 1145556 - RNA, 15 nt, Human
aauaacaauaaaaga

SEQ ID NO: 1145557 - RNA, 17 nt, Human
aauacaaguuucaucca

SEQ ID NO: 1145558 - RNA, 19 nt, Human
uaaauaguaaaaauaaaau

SEQ ID NO: 1145559 - RNA, 20 nt, Human
uaaauaguaaaaauaaaauu

SEQ ID NO: 1145560 - RNA, 16 nt, Human
uaacaacuaugauuug

SEQ ID NO: 1145561 - RNA, 21 nt, Human
uaacaacuaugauuuggaaaa

SEQ ID NO: 1145562 - RNA, 22 nt, Human
uaacaacuaugauuuggaaaau

SEQ ID NO: 1145563 - RNA, 15 nt, Human
uaauacagcugagcu

SEQ ID NO: 1145564 - RNA, 13 nt, Human
uaauaccucccuu

SEQ ID NO: 1145565 - RNA, 21 nt, Human
uaauaccucuaauaguauaaa

SEQ ID NO: 1145566 - RNA, 23 nt, Human
uaauaccucuaauaguauaaacc

SEQ ID NO: 1145567 - RNA, 13 nt, Human
aaucuugaaaaug

SEQ ID NO: 1145568 - RNA, 20 nt, Human
uaauuauacccccugcaaag

SEQ ID NO: 1145569 - RNA, 14 nt, Human
uacaaguuucaucc

SEQ ID NO: 1145570 - RNA, 18 nt, Human
uacaaguuucauccagaa

SEQ ID NO: 1145571 - RNA, 20 nt, Human
uacaauaaaaucuugaaaau

SEQ ID NO: 1145572 - RNA, 15 nt, Human
uacaaguuucaucca

SEQ ID NO: 1145573 - RNA, 21 nt, Human
aauguacauagugcuaacaug

SEQ ID NO: 1145574 - RNA, 20 nt, Human
uacagcaaauccuuugugaa

SEQ ID NO: 1145575 - RNA, 14 nt, Human
uacagcaaauccuu

SEQ ID NO: 1145576 - RNA, 12 nt, Human
uacauuaaacau

SEQ ID NO: 1145577 - RNA, 20 nt, Human
uacauuaaacaugacuccau

SEQ ID NO: 1145578 - RNA, 14 nt, Human
uacauuaaacauga

SEQ ID NO: 1145579 - RNA, 19 nt, Human
uacauuagcaguuugcuuu

SEQ ID NO: 1145580 - RNA, 20 nt, Human
uacauuagcaguuugcuuug

SEQ ID NO: 1145581 - RNA, 21 nt, Human
aauucuugccaaauauaaaua

SEQ ID NO: 1145582 - RNA, 14 nt, Human
uacguuaccaggca

SEQ ID NO: 1145583 - RNA, 23 nt, Human
uacucaagagugguaucuugcag

SEQ ID NO: 1145584 - RNA, 22 nt, Human
uacucaagagugguaucuugca

SEQ ID NO: 1145585 - RNA, 18 nt, Human
uacucuuauagacaacau

SEQ ID NO: 1145586 - RNA, 22 nt, Human
uacucuucaguuaagccuuugg

SEQ ID NO: 1145587 - RNA, 16 nt, Human
uacugaaguaaaacaa

SEQ ID NO: 1145588 - RNA, 17 nt, Human
uacugaaguaaaacaaa

SEQ ID NO: 1145589 - RNA, 12 nt, Human
aauugcuccuug

SEQ ID NO: 1145590 - RNA, 14 nt, Human
aauuguguuuacau

SEQ ID NO: 1145591 - RNA, 19 nt, Human
aauuguguuuacauuuuau

SEQ ID NO: 1145592 - RNA, 20 nt, Human
aauuguguuuacauuuuaug

SEQ ID NO: 1145593 - RNA, 21 nt, Human
aauuguguuuacauuuuaugg

SEQ ID NO: 1145594 - RNA, 22 nt, Human
aauuguguuuacauuuuauggu

SEQ ID NO: 1145595 - RNA, 12 nt, Human
aauuugaugugg

SEQ ID NO: 1145596 - RNA, 22 nt, Human
aauuugauguggugaaaagcag

SEQ ID NO: 1145597 - RNA, 14 nt, Human
aauuuuuguauuuu

SEQ ID NO: 1145598 - RNA, 19 nt, Human
acaaaaaaaucuuccaauu

SEQ ID NO: 1145599 - RNA, 14 nt, Human
acaaaaaaaucuuc

SEQ ID NO: 1145600 - RNA, 15 nt, Human
uagagcuucuggcac

SEQ ID NO: 1145601 - RNA, 13 nt, Human
uagcaccagggaa

SEQ ID NO: 1145602 - RNA, 14 nt, Human
uagcaccagggaag

SEQ ID NO: 1145603 - RNA, 21 nt, Human
uagcaugucgucaaagcugaa

SEQ ID NO: 1145604 - RNA, 16 nt, Human
uagcaccagggaaggg

SEQ ID NO: 1145605 - RNA, 15 nt, Human
acaacaaccugguca

SEQ ID NO: 1145606 - RNA, 13 nt, Human
acaagacacagug

SEQ ID NO: 1145607 - RNA, 18 nt, Human
acaagcacuaaacaaaga

SEQ ID NO: 1145608 - RNA, 21 nt, Human
acaaggacagccccuccucca

SEQ ID NO: 1145609 - RNA, 22 nt, Human
uagugacuaaaccauugugcau

SEQ ID NO: 1145610 - RNA, 23 nt, Human
uagugacuaaaccauugugcauu

SEQ ID NO: 1145611 - RNA, 13 nt, Human
uagugaugguucc

SEQ ID NO: 1145612 - RNA, 23 nt, Human
uaguuccccuguuuauucauaug

SEQ ID NO: 1145613 - RNA, 19 nt, Human
uaguuccccuguuuauuca

SEQ ID NO: 1145614 - RNA, 17 nt, Human
uaguuccugugcacagc

SEQ ID NO: 1145615 - RNA, 14 nt, Human
uauagcucuaaugu

SEQ ID NO: 1145616 - RNA, 16 nt, Human
uauagcucuaauguuu

SEQ ID NO: 1145617 - RNA, 20 nt, Human
uauagcucuaauguuugcau

SEQ ID NO: 1145618 - RNA, 18 nt, Human
uauagcucuaauguuugc

SEQ ID NO: 1145619 - RNA, 13 nt, Human
acagacagcccuc

SEQ ID NO: 1145620 - RNA, 15 nt, Human
acagacagcccucca

SEQ ID NO: 1145621 - RNA, 15 nt, Human
uauauuuacaaaugg

SEQ ID NO: 1145622 - RNA, 15 nt, Human
uaucuagguuuauga

SEQ ID NO: 1145623 - RNA, 21 nt, Human
uaucuagguuuaugacaguaa

SEQ ID NO: 1145624 - RNA, 17 nt, Human
uaucuagguuuaugaca

SEQ ID NO: 1145625 - RNA, 13 nt, Human
acagacuucugaa

SEQ ID NO: 1145626 - RNA, 14 nt, Human
acagacuucugaaa

SEQ ID NO: 1145627 - RNA, 18 nt, Human
acagcagccccugcacaa

SEQ ID NO: 1145628 - RNA, 23 nt, Human
uaucuugcaguaucggcacugua

SEQ ID NO: 1145629 - RNA, 22 nt, Human
uaucuugcaguaucggcacugu

SEQ ID NO: 1145630 - RNA, 19 nt, Human
uaugauguauacugccacu

SEQ ID NO: 1145631 - RNA, 21 nt, Human
uaugauguauacugccacuaa

SEQ ID NO: 1145632 - RNA, 14 nt, Human
uaugaugugcuuaa

SEQ ID NO: 1145633 - RNA, 17 nt, Human
uaugaugugcuuaacag

SEQ ID NO: 1145634 - RNA, 21 nt, Human
uaugaugugcuuaacagggaa

SEQ ID NO: 1145635 - RNA, 14 nt, Human
acagccuggcacag

SEQ ID NO: 1145636 - RNA, 15 nt, Human
acagccuggcacagg

SEQ ID NO: 1145637 - RNA, 20 nt, Human
acagcuaaucagcauucuca

SEQ ID NO: 1145638 - RNA, 22 nt, Human
acagcuaaucagcauucucacu

SEQ ID NO: 1145639 - RNA, 13 nt, Human
uauucauaugcau

SEQ ID NO: 1145640 - RNA, 14 nt, Human
uauucauaugcaua

SEQ ID NO: 1145641 - RNA, 15 nt, Human
uauucauaugcauau

SEQ ID NO: 1145642 - RNA, 16 nt, Human
uauucauaugcauauu

SEQ ID NO: 1145643 - RNA, 17 nt, Human
uauucauaugcauauuu

SEQ ID NO: 1145644 - RNA, 20 nt, Human
acagugaaagaaaauaacaa

SEQ ID NO: 1145645 - RNA, 19 nt, Human
acaguucggugagcuacaa

SEQ ID NO: 1145646 - RNA, 22 nt, Human
acaguucggugagcuacaaaug

SEQ ID NO: 1145647 - RNA, 23 nt, Human
acaguucggugagcuacaaaugc

SEQ ID NO: 1145648 - RNA, 12 nt, Human
uauugacaaaau

SEQ ID NO: 1145649 - RNA, 13 nt, Human
uauugacaaaaug

SEQ ID NO: 1145650 - RNA, 16 nt, Human
uauugacaaaauguua

SEQ ID NO: 1145651 - RNA, 22 nt, Human
uauugacaaaauguuauuuccc

SEQ ID NO: 1145652 - RNA, 21 nt, Human
uauugacaaaauguuauuucc

SEQ ID NO: 1145653 - RNA, 20 nt, Human
uauuuagcaccagggaaggg

SEQ ID NO: 1145654 - RNA, 14 nt, Human
uauuuauuuaguau

SEQ ID NO: 1145655 - RNA, 19 nt, Human
uauuucaucauucacuuca

SEQ ID NO: 1145656 - RNA, 15 nt, Human
accacugcucugaug

SEQ ID NO: 1145657 - RNA, 19 nt, Human
accaggcaacuugggaacu

SEQ ID NO: 1145658 - RNA, 13 nt, Human
ucaccucccccau

SEQ ID NO: 1145659 - RNA, 15 nt, Human
ucaccucccccaucu

SEQ ID NO: 1145660 - RNA, 20 nt, Human
ucacugcacagugcaucuca

SEQ ID NO: 1145661 - RNA, 22 nt, Human
ucacugcacagugcaucucagc

SEQ ID NO: 1145662 - RNA, 24 nt, Human
ucacugcacagugcaucucagccc

SEQ ID NO: 1145663 - RNA, 14 nt, Human
accaguugcugcuu

SEQ ID NO: 1145664 - RNA, 15 nt, Human
accauuccccauggg

SEQ ID NO: 1145665 - RNA, 13 nt, Human
accauugugcauu

SEQ ID NO: 1145666 - RNA, 18 nt, Human
ucagcccucccugccccu

SEQ ID NO: 1145667 - RNA, 19 nt, Human
ucagcccucccugccccuc

SEQ ID NO: 1145668 - RNA, 12 nt, Human
acccccaggaca

SEQ ID NO: 1145669 - RNA, 12 nt, Human
accccuggcuuu

SEQ ID NO: 1145670 - RNA, 15 nt, Human
accccuggcuuuuca

SEQ ID NO: 1145671 - RNA, 17 nt, Human
accccuggcuuuucacu

SEQ ID NO: 1145672 - RNA, 18 nt, Human
ucaggaacguuuagcuga

SEQ ID NO: 1145673 - RNA, 23 nt, Human
ucaggaacguuuagcugacaaaa

SEQ ID NO: 1145674 - RNA, 22 nt, Human
ucaggaacguuuagcugacaaa

SEQ ID NO: 1145675 - RNA, 14 nt, Human
ucauauuaagaaug

SEQ ID NO: 1145676 - RNA, 15 nt, Human
ucauauuaagaauga

SEQ ID NO: 1145677 - RNA, 17 nt, Human
ucauauuaagaaugauc

SEQ ID NO: 1145678 - RNA, 18 nt, Human
ucauauuaagaaugaucu

SEQ ID NO: 1145679 - RNA, 22 nt, Human
ucauauuaagaaugaucugauu

SEQ ID NO: 1145680 - RNA, 20 nt, Human
accgagucucuucuccacug

SEQ ID NO: 1145681 - RNA, 21 nt, Human
accgagucucuucuccacugg

SEQ ID NO: 1145682 - RNA, 24 nt, Human
accgagucucuucuccacuggaug

SEQ ID NO: 1145683 - RNA, 22 nt, Human
accguguuggucuguacugauu

SEQ ID NO: 1145684 - RNA, 16 nt, Human
accguguuggucugua

SEQ ID NO: 1145685 - RNA, 20 nt, Human
accucaauuuucacuguguc

SEQ ID NO: 1145686 - RNA, 18 nt, Human
accucaauuuucacugug

SEQ ID NO: 1145687 - RNA, 14 nt, Human
ucauguuaguaaua

SEQ ID NO: 1145688 - RNA, 17 nt, Human
ucauguuaguaauaccu

SEQ ID NO: 1145689 - RNA, 18 nt, Human
ucauguuaguaauaccuc

SEQ ID NO: 1145690 - RNA, 19 nt, Human
ucauguuaguaauaccucu

SEQ ID NO: 1145691 - RNA, 21 nt, Human
ucauguuaguaauaccucuaa

SEQ ID NO: 1145692 - RNA, 12 nt, Human
accucuaauagu

SEQ ID NO: 1145693 - RNA, 16 nt, Human
accucuaauaguauaa

SEQ ID NO: 1145694 - RNA, 17 nt, Human
accucuaauaguauaaa

SEQ ID NO: 1145695 - RNA, 20 nt, Human
accucuaauaguauaaaccc

SEQ ID NO: 1145696 - RNA, 19 nt, Human
accucuaauaguauaaacc

SEQ ID NO: 1145697 - RNA, 16 nt, Human
accugaaugcucugua

SEQ ID NO: 1145698 - RNA, 18 nt, Human
accugcucuccucuugcc

SEQ ID NO: 1145699 - RNA, 19 nt, Human
accugcucuccucuugcca

SEQ ID NO: 1145700 - RNA, 18 nt, Human
ucauuugugccagaaugc

SEQ ID NO: 1145701 - RNA, 18 nt, Human
ucauuuguggguuuuuau

SEQ ID NO: 1145702 - RNA, 23 nt, Human
ucauuuguggguuuuuauuuccu

SEQ ID NO: 1145703 - RNA, 22 nt, Human
ucauuuguggguuuuuauuucc

SEQ ID NO: 1145704 - RNA, 14 nt, Human
ucauuuuaugucaa

SEQ ID NO: 1145705 - RNA, 14 nt, Human
uccaaaugcagcuu

SEQ ID NO: 1145706 - RNA, 15 nt, Human
uccaaaugcagcuuu

SEQ ID NO: 1145707 - RNA, 18 nt, Human
uccaagcuccaucuccac

SEQ ID NO: 1145708 - RNA, 23 nt, Human
accuggucacaggacucugccuc

SEQ ID NO: 1145709 - RNA, 14 nt, Human
accuuagccugccc

SEQ ID NO: 1145710 - RNA, 21 nt, Human
accuuagugcaguuauuugcu

SEQ ID NO: 1145711 - RNA, 17 nt, Human
accuuagugcaguuauu

SEQ ID NO: 1145712 - RNA, 20 nt, Human
accuuccaugucaagauuca

SEQ ID NO: 1145713 - RNA, 12 nt, Human
accuucuguggc

SEQ ID NO: 1145714 - RNA, 13 nt, Human
accuucuguggcu

SEQ ID NO: 1145715 - RNA, 15 nt, Human
accuucuguggcuca

SEQ ID NO: 1145716 - RNA, 16 nt, Human
accuucuguggcucac

SEQ ID NO: 1145717 - RNA, 15 nt, Human
uccagaccccuggcu

SEQ ID NO: 1145718 - RNA, 16 nt, Human
uccagaccccuggcuu

SEQ ID NO: 1145719 - RNA, 17 nt, Human
uccagaccccuggcuuu

SEQ ID NO: 1145720 - RNA, 18 nt, Human
uccagaccccuggcuuuu

SEQ ID NO: 1145721 - RNA, 23 nt, Human
uccagaccccuggcuuuucacug

SEQ ID NO: 1145722 - RNA, 22 nt, Human
acguuuagcugacaaaauacuu

SEQ ID NO: 1145723 - RNA, 17 nt, Human
acguuuagcugacaaaa

SEQ ID NO: 1145724 - RNA, 19 nt, Human
acuaaaacaaagccacuuu

SEQ ID NO: 1145725 - RNA, 16 nt, Human
acuaaaacaaagccac

SEQ ID NO: 1145726 - RNA, 15 nt, Human
uccccaagccuggca

SEQ ID NO: 1145727 - RNA, 13 nt, Human
acuauaugcaaac

SEQ ID NO: 1145728 - RNA, 14 nt, Human
acuauaugcaaaca

SEQ ID NO: 1145729 - RNA, 18 nt, Human
acuauaugcaaacagggu

SEQ ID NO: 1145730 - RNA, 22 nt, Human
acuaucaugucaaacgugaaaa

SEQ ID NO: 1145731 - RNA, 16 nt, Human
acuaucccggcugccc

SEQ ID NO: 1145732 - RNA, 17 nt, Human
acuaucccggcugcccu

SEQ ID NO: 1145733 - RNA, 18 nt, Human
acuaucccggcugcccuu

SEQ ID NO: 1145734 - RNA, 13 nt, Human
ucccgcucagccc

SEQ ID NO: 1145735 - RNA, 14 nt, Human
ucccgcucagcccu

SEQ ID NO: 1145736 - RNA, 15 nt, Human
ucccgcucagcccuc

SEQ ID NO: 1145737 - RNA, 16 nt, Human
ucccgcucagcccucc

SEQ ID NO: 1145738 - RNA, 20 nt, Human
ucccgcucagcccucccugc

SEQ ID NO: 1145739 - RNA, 23 nt, Human
ucccucauuccaccuucccaugc

SEQ ID NO: 1145740 - RNA, 20 nt, Human
acuccagcuggguuggaaaa

SEQ ID NO: 1145741 - RNA, 14 nt, Human
acuccuaccuggua

SEQ ID NO: 1145742 - RNA, 23 nt, Human
acuccugcacacgcuccuuccuc

SEQ ID NO: 1145743 - RNA, 11 nt, Human
ucccuucaacc

SEQ ID NO: 1145744 - RNA, 21 nt, Human
ucccuucaaccauuccccaug

SEQ ID NO: 1145745 - RNA, 22 nt, Human
ucccuucaaccauuccccaugg

SEQ ID NO: 1145746 - RNA, 13 nt, Human
acucugacaacag

SEQ ID NO: 1145747 - RNA, 16 nt, Human
uccuccccuccuccug

SEQ ID NO: 1145748 - RNA, 18 nt, Human
uccuccccuccuccugga

SEQ ID NO: 1145749 - RNA, 20 nt, Human
uccuccccuccuccuggacu

SEQ ID NO: 1145750 - RNA, 22 nt, Human
uccuccccuccuccuggacucc

SEQ ID NO: 1145751 - RNA, 12 nt, Human
uccucuccacug

SEQ ID NO: 1145752 - RNA, 13 nt, Human
uccucuccacugc

SEQ ID NO: 1145753 - RNA, 14 nt, Human
uccucuccacugcc

SEQ ID NO: 1145754 - RNA, 15 nt, Human
uccucuccacugccu

SEQ ID NO: 1145755 - RNA, 16 nt, Human
uccucuccacugccuu

SEQ ID NO: 1145756 - RNA, 15 nt, Human
acugaggaccagcca

SEQ ID NO: 1145757 - RNA, 16 nt, Human
acugagugccuuuugg

SEQ ID NO: 1145758 - RNA, 20 nt, Human
acugcaaccuucgccaccug

SEQ ID NO: 1145759 - RNA, 23 nt, Human
acugcaaccuucgccaccugggu

SEQ ID NO: 1145760 - RNA, 16 nt, Human
acugcacagugcaucu

SEQ ID NO: 1145761 - RNA, 18 nt, Human
acugcacagugcaucuca

SEQ ID NO: 1145762 - RNA, 22 nt, Human
acugcacagugcaucucagccc

SEQ ID NO: 1145763 - RNA, 20 nt, Human
uccugaguagcugggauuac

SEQ ID NO: 1145764 - RNA, 16 nt, Human
uccugcauuugugaaa

SEQ ID NO: 1145765 - RNA, 18 nt, Human
uccuggggaaccugaccc

SEQ ID NO: 1145766 - RNA, 19 nt, Human
uccuggggaaccugacccc

SEQ ID NO: 1145767 - RNA, 21 nt, Human
uccuggggguucuuucuuccu

SEQ ID NO: 1145768 - RNA, 22 nt, Human
uccuggggguucuuucuuccuc

SEQ ID NO: 1145769 - RNA, 23 nt, Human
uccuggggguucuuucuuccucu

SEQ ID NO: 1145770 - RNA, 18 nt, Human
uccugugacuucagcucu

SEQ ID NO: 1145771 - RNA, 13 nt, Human
uccugugcacagc

SEQ ID NO: 1145772 - RNA, 14 nt, Human
uccugugcacagcc

SEQ ID NO: 1145773 - RNA, 16 nt, Human
acugcagggacugcca

SEQ ID NO: 1145774 - RNA, 17 nt, Human
acugcagggacugccag

SEQ ID NO: 1145775 - RNA, 18 nt, Human
acugcagggacugccagu

SEQ ID NO: 1145776 - RNA, 12 nt, Human
acugcucugaug

SEQ ID NO: 1145777 - RNA, 16 nt, Human
acugcugcccagccuc

SEQ ID NO: 1145778 - RNA, 18 nt, Human
acugcugcccagccucca

SEQ ID NO: 1145779 - RNA, 21 nt, Human
acugcugcccagccuccaagc

SEQ ID NO: 1145780 - RNA, 12 nt, Human
acugcuggcugc

SEQ ID NO: 1145781 - RNA, 13 nt, Human
acugcuggcugcc

SEQ ID NO: 1145782 - RNA, 14 nt, Human
acugcuggcugccu

SEQ ID NO: 1145783 - RNA, 23 nt, Human
acuggccucugcugauccuccca

SEQ ID NO: 1145784 - RNA, 16 nt, Human
uccuuccucugagccu

SEQ ID NO: 1145785 - RNA, 17 nt, Human
uccuuccucugagccuu

SEQ ID NO: 1145786 - RNA, 16 nt, Human
uccuuccucugaggcu

SEQ ID NO: 1145787 - RNA, 16 nt, Human
uccuuucacaaccuuc

SEQ ID NO: 1145788 - RNA, 18 nt, Human
uccuuucacaaccuucug

SEQ ID NO: 1145789 - RNA, 19 nt, Human
uccuuucacaaccuucugu

SEQ ID NO: 1145790 - RNA, 20 nt, Human
uccuuucacaaccuucugug

SEQ ID NO: 1145791 - RNA, 13 nt, Human
ucgaccugccucg

SEQ ID NO: 1145792 - RNA, 17 nt, Human
acuguacaaaaaaaucu

SEQ ID NO: 1145793 - RNA, 19 nt, Human
acuguacaaaaaaaucuuc

SEQ ID NO: 1145794 - RNA, 22 nt, Human
acuguacaaaaaaaucuuccaa

SEQ ID NO: 1145795 - RNA, 13 nt, Human
acuguacuccucc

SEQ ID NO: 1145796 - RNA, 14 nt, Human
acuguacuccuccc

SEQ ID NO: 1145797 - RNA, 15 nt, Human
acuguacuccuccca

SEQ ID NO: 1145798 - RNA, 18 nt, Human
ucucccaaagugcuggga

SEQ ID NO: 1145799 - RNA, 19 nt, Human
acuuguugauuaauggaaa

SEQ ID NO: 1145800 - RNA, 21 nt, Human
acuuguugauuaauggaaaug

SEQ ID NO: 1145801 - RNA, 11 nt, Human
ucucugcccua

SEQ ID NO: 1145802 - RNA, 22 nt, Human
ucucugcccuaaugcgcaggcu

SEQ ID NO: 1145803 - RNA, 18 nt, Human
ucucuucuggguuccuuc

SEQ ID NO: 1145804 - RNA, 19 nt, Human
ucucuucuggguuccuucc

SEQ ID NO: 1145805 - RNA, 20 nt, Human
ucucuucuggguuccuuccu

SEQ ID NO: 1145806 - RNA, 21 nt, Human
ucucuucuggguuccuuccuc

SEQ ID NO: 1145807 - RNA, 18 nt, Human
ucucuucuuaauguacau

SEQ ID NO: 1145808 - RNA, 14 nt, Human
ucucuucuuaaugu

SEQ ID NO: 1145809 - RNA, 19 nt, Human
agaaaaauaugaccacacu

SEQ ID NO: 1145810 - RNA, 20 nt, Human
agaaaacaugcagaacaaau

SEQ ID NO: 1145811 - RNA, 12 nt, Human
ucugcagagcag

SEQ ID NO: 1145812 - RNA, 18 nt, Human
agaacuaccaccugacau

SEQ ID NO: 1145813 - RNA, 13 nt, Human
agaagcugcucaa

SEQ ID NO: 1145814 - RNA, 23 nt, Human
agaagcugcucaacuugcaaaau

SEQ ID NO: 1145815 - RNA, 16 nt, Human
ucuggguuccuuccuc

SEQ ID NO: 1145816 - RNA, 24 nt, Human
ucuguccaggcacugcugcccagc

SEQ ID NO: 1145817 - RNA, 12 nt, Human
ucuguuccacau

SEQ ID NO: 1145818 - RNA, 16 nt, Human
ucuguuuuaaaaaccu

SEQ ID NO: 1145819 - RNA, 18 nt, Human
agacagaaucucgcucug

SEQ ID NO: 1145820 - RNA, 22 nt, Human
agacagaaucucgcucugucgc

SEQ ID NO: 1145821 - RNA, 17 nt, Human
ucuucaaaaugagcccu

SEQ ID NO: 1145822 - RNA, 22 nt, Human
ucuuccauauggauccacuggc

SEQ ID NO: 1145823 - RNA, 13 nt, Human
agaccugccccuc

SEQ ID NO: 1145824 - RNA, 12 nt, Human
agaccugccccu

SEQ ID NO: 1145825 - RNA, 15 nt, Human
agagcuucuggcacu

SEQ ID NO: 1145826 - RNA, 19 nt, Human
agagcuucuguugcugccu

SEQ ID NO: 1145827 - RNA, 20 nt, Human
agagcuucuguugcugccuc

SEQ ID NO: 1145828 - RNA, 21 nt, Human
agagcuucuguugcugccuca

SEQ ID NO: 1145829 - RNA, 22 nt, Human
agagcuucuguugcugccucau

SEQ ID NO: 1145830 - RNA, 15 nt, Human
ugaaugcauaaaaug

SEQ ID NO: 1145831 - RNA, 16 nt, Human
ugaaugcauaaaaugu

SEQ ID NO: 1145832 - RNA, 20 nt, Human
agauaaacguggauguuacu

SEQ ID NO: 1145833 - RNA, 18 nt, Human
agauaauucuagcuuuga

SEQ ID NO: 1145834 - RNA, 14 nt, Human
ugacaguaauugug

SEQ ID NO: 1145835 - RNA, 15 nt, Human
ugacaguaauugugu

SEQ ID NO: 1145836 - RNA, 20 nt, Human
ugacaguaauuguguuuaca

SEQ ID NO: 1145837 - RNA, 21 nt, Human
ugacaguaauuguguuuacau

SEQ ID NO: 1145838 - RNA, 22 nt, Human
ugacaguaauuguguuuacauu

SEQ ID NO: 1145839 - RNA, 18 nt, Human
ugacauuguagagcuucu

SEQ ID NO: 1145840 - RNA, 22 nt, Human
ugacauuguagagcuucuggca

SEQ ID NO: 1145841 - RNA, 12 nt, Human
ugaccacacucc

SEQ ID NO: 1145842 - RNA, 17 nt, Human
ugaccacacuccagcug

SEQ ID NO: 1145843 - RNA, 19 nt, Human
ugaccacacuccagcuggg

SEQ ID NO: 1145844 - RNA, 20 nt, Human
ugaccacacuccagcuggga

SEQ ID NO: 1145845 - RNA, 21 nt, Human
agauguccaucagaugacaag

SEQ ID NO: 1145846 - RNA, 23 nt, Human
agauguccaucagaugacaagaa

SEQ ID NO: 1145847 - RNA, 14 nt, Human
agaugucuauauug

SEQ ID NO: 1145848 - RNA, 22 nt, Human
ugacccccaaccaaguggcucc

SEQ ID NO: 1145849 - RNA, 17 nt, Human
ugaccccucauagcccu

SEQ ID NO: 1145850 - RNA, 19 nt, Human
ugaccccucauagcccuca

SEQ ID NO: 1145851 - RNA, 20 nt, Human
ugaccccucauagcccucac

SEQ ID NO: 1145852 - RNA, 23 nt, Human
ugaccccucauagcccucacccu

SEQ ID NO: 1145853 - RNA, 22 nt, Human
ugacuugaagacuuacagcaaa

SEQ ID NO: 1145854 - RNA, 20 nt, Human
agauuauaggcaccuaccac

SEQ ID NO: 1145855 - RNA, 16 nt, Human
agauucaaucccagga

SEQ ID NO: 1145856 - RNA, 16 nt, Human
ugagcaaauguggcuc

SEQ ID NO: 1145857 - RNA, 18 nt, Human
ugagcaaauguggcuccu

SEQ ID NO: 1145858 - RNA, 19 nt, Human
ugagcaaauguggcuccug

SEQ ID NO: 1145859 - RNA, 13 nt, Human
ugagcacuguuuu

SEQ ID NO: 1145860 - RNA, 22 nt, Human
ugagcacuguuuucuaguguau

SEQ ID NO: 1145861 - RNA, 14 nt, Human
ugagcacuguuuuc

SEQ ID NO: 1145862 - RNA, 15 nt, Human
ugagcacuguuuucu

SEQ ID NO: 1145863 - RNA, 21 nt, Human
ugagcacuguuuucuagugua

SEQ ID NO: 1145864 - RNA, 15 nt, Human
ugagccaccacgccc

SEQ ID NO: 1145865 - RNA, 14 nt, Human
ugagccaccgugcc

SEQ ID NO: 1145866 - RNA, 18 nt, Human
ugagccaccgugccuggc

SEQ ID NO: 1145867 - RNA, 19 nt, Human
ugagccaccgugccuggcc

SEQ ID NO: 1145868 - RNA, 20 nt, Human
ugagccaccgugccuggcca

SEQ ID NO: 1145869 - RNA, 21 nt, Human
ugagccaccgugccuggccac

SEQ ID NO: 1145870 - RNA, 21 nt, Human
agcacagcagccccugcacaa

SEQ ID NO: 1145871 - RNA, 10 nt, Human
agcaccaggg

SEQ ID NO: 1145872 - RNA, 12 nt, Human
agcaccagggaa

SEQ ID NO: 1145873 - RNA, 13 nt, Human
agcaccagggaag

SEQ ID NO: 1145874 - RNA, 13 nt, Human
ugagcuacaaaug

SEQ ID NO: 1145875 - RNA, 14 nt, Human
ugagcuacaaaugc

SEQ ID NO: 1145876 - RNA, 16 nt, Human
ugagcuacaaaugcau

SEQ ID NO: 1145877 - RNA, 18 nt, Human
ugaggaacggaucagaug

SEQ ID NO: 1145878 - RNA, 15 nt, Human
ugagggauuaucuuu

SEQ ID NO: 1145879 - RNA, 19 nt, Human
ugagguacaaccuguucug

SEQ ID NO: 1145880 - RNA, 14 nt, Human
ugcagaacaaauga

SEQ ID NO: 1145881 - RNA, 15 nt, Human
ugcagaacaaaugaa

SEQ ID NO: 1145882 - RNA, 18 nt, Human
ugcagaacaaaugaagac

SEQ ID NO: 1145883 - RNA, 13 nt, Human
agcccuucauuug

SEQ ID NO: 1145884 - RNA, 14 nt, Human
agcccuucauuugg

SEQ ID NO: 1145885 - RNA, 19 nt, Human
agcccuuccaugucgccuc

SEQ ID NO: 1145886 - RNA, 22 nt, Human
agcccuuccaugucgccucugc

SEQ ID NO: 1145887 - RNA, 23 nt, Human
agcccuuccaugucgccucugca

SEQ ID NO: 1145888 - RNA, 23 nt, Human
agccguuuguuccccaagacauu

SEQ ID NO: 1145889 - RNA, 11 nt, Human
ugcauaaaaug

SEQ ID NO: 1145890 - RNA, 23 nt, Human
ugcaucuccacuuggcauuagcu

SEQ ID NO: 1145891 - RNA, 18 nt, Human
agccugaucaccugcccu

SEQ ID NO: 1145892 - RNA, 19 nt, Human
agccugaucaccugcccug

SEQ ID NO: 1145893 - RNA, 12 nt, Human
agccugcccucc

SEQ ID NO: 1145894 - RNA, 20 nt, Human
agcgcccacuagacccacug

SEQ ID NO: 1145895 - RNA, 14 nt, Human
ugcauuuccugaca

SEQ ID NO: 1145896 - RNA, 19 nt, Human
ugccacacgagaaccugaa

SEQ ID NO: 1145897 - RNA, 12 nt, Human
ugccacacuuca

SEQ ID NO: 1145898 - RNA, 17 nt, Human
ugccagucccccugccc

SEQ ID NO: 1145899 - RNA, 19 nt, Human
ugccagucccccugcccca

SEQ ID NO: 1145900 - RNA, 20 nt, Human
ugccagucccccugccccag

SEQ ID NO: 1145901 - RNA, 19 nt, Human
agcuauggugucauaggcu

SEQ ID NO: 1145902 - RNA, 18 nt, Human
ugcccaaccugcucuccu

SEQ ID NO: 1145903 - RNA, 22 nt, Human
ugcccaaccugcucuccucuug

SEQ ID NO: 1145904 - RNA, 23 nt, Human
ugcccaaccugcucuccucuugc

SEQ ID NO: 1145905 - RNA, 24 nt, Human
ugcccaaccugcucuccucuugcc

SEQ ID NO: 1145906 - RNA, 15 nt, Human
ugcccaggccugccu

SEQ ID NO: 1145907 - RNA, 17 nt, Human
ugcccaggccugccugu

SEQ ID NO: 1145908 - RNA, 12 nt, Human
ugccccccagcc

SEQ ID NO: 1145909 - RNA, 16 nt, Human
ugccccgucccccucu

SEQ ID NO: 1145910 - RNA, 18 nt, Human
ugccccgucccccucugg

SEQ ID NO: 1145911 - RNA, 22 nt, Human
agcucuaucaccaaggagccaa

SEQ ID NO: 1145912 - RNA, 15 nt, Human
ugcccuuucugggca

SEQ ID NO: 1145913 - RNA, 22 nt, Human
agcugggaucacauguggacuu

SEQ ID NO: 1145914 - RNA, 18 nt, Human
agcugggauuacaggcuc

SEQ ID NO: 1145915 - RNA, 21 nt, Human
agcugggauuacaggcuccug

SEQ ID NO: 1145916 - RNA, 22 nt, Human
agcugggauuacaggcuccugc

SEQ ID NO: 1145917 - RNA, 23 nt, Human
agcugggauuacaggcuccugcc

SEQ ID NO: 1145918 - RNA, 14 nt, Human
ugccuuagaaccuu

SEQ ID NO: 1145919 - RNA, 17 nt, Human
ugccuuagaaccuuucu

SEQ ID NO: 1145920 - RNA, 21 nt, Human
ugccuuagaaccuuucuuaca

SEQ ID NO: 1145921 - RNA, 20 nt, Human
agcuuauguuaacugacaag

SEQ ID NO: 1145922 - RNA, 21 nt, Human
ugcuauaacuauguugauaaa

SEQ ID NO: 1145923 - RNA, 18 nt, Human
ugcucugaugaagaggag

SEQ ID NO: 1145924 - RNA, 19 nt, Human
ugcucugaugaagaggagu

SEQ ID NO: 1145925 - RNA, 14 nt, Human
ugcucuguagccua

SEQ ID NO: 1145926 - RNA, 15 nt, Human
ugcugagucccaggc

SEQ ID NO: 1145927 - RNA, 18 nt, Human
ugcugagucccaggcuga

SEQ ID NO: 1145928 - RNA, 22 nt, Human
ugcugagucccaggcugagccu

SEQ ID NO: 1145929 - RNA, 15 nt, Human
ugcugccacacuuca

SEQ ID NO: 1145930 - RNA, 16 nt, Human
ugcugccacacuucag

SEQ ID NO: 1145931 - RNA, 19 nt, Human
ugcugccacacuucaggcu

SEQ ID NO: 1145932 - RNA, 22 nt, Human
ugcugccacacuucaggcucuu

SEQ ID NO: 1145933 - RNA, 14 nt, Human
ugcugcccagccuc

SEQ ID NO: 1145934 - RNA, 16 nt, Human
ugcugcccagccucca

SEQ ID NO: 1145935 - RNA, 16 nt, Human
aggcaacuugggaacu

SEQ ID NO: 1145936 - RNA, 14 nt, Human
uggacaaaaugacu

SEQ ID NO: 1145937 - RNA, 21 nt, Human
uggaggaaaaccaagccgugg

SEQ ID NO: 1145938 - RNA, 23 nt, Human
uggaggaaaaccaagccguggcu

SEQ ID NO: 1145939 - RNA, 16 nt, Human
aggcagggagggccug

SEQ ID NO: 1145940 - RNA, 17 nt, Human
aggcaucgcaauguaag

SEQ ID NO: 1145941 - RNA, 15 nt, Human
uggcacagggcagug

SEQ ID NO: 1145942 - RNA, 16 nt, Human
uggcacagggcagugg

SEQ ID NO: 1145943 - RNA, 17 nt, Human
uggcagccgugccuuca

SEQ ID NO: 1145944 - RNA, 18 nt, Human
uggcagccgugccuucag

SEQ ID NO: 1145945 - RNA, 19 nt, Human
uggcagccgugccuucagc

SEQ ID NO: 1145946 - RNA, 20 nt, Human
uggcagccgugccuucagcu

SEQ ID NO: 1145947 - RNA, 21 nt, Human
uggcagccgugccuucagcuc

SEQ ID NO: 1145948 - RNA, 22 nt, Human
uggcagccgugccuucagcucu

SEQ ID NO: 1145949 - RNA, 20 nt, Human
aggccauuccccgucucugg

SEQ ID NO: 1145950 - RNA, 12 nt, Human
uggcccugcccu

SEQ ID NO: 1145951 - RNA, 13 nt, Human
uggcccugcccug

SEQ ID NO: 1145952 - RNA, 21 nt, Human
uggccucugcugauccuccca

SEQ ID NO: 1145953 - RNA, 14 nt, Human
aggcgccccuuccc

SEQ ID NO: 1145954 - RNA, 13 nt, Human
aggcuccugccac

SEQ ID NO: 1145955 - RNA, 14 nt, Human
uggcugugccucug

SEQ ID NO: 1145956 - RNA, 15 nt, Human
uggcugugccucugc

SEQ ID NO: 1145957 - RNA, 16 nt, Human
uggcugugccucugcc

SEQ ID NO: 1145958 - RNA, 17 nt, Human
uggcugugccucugccu

SEQ ID NO: 1145959 - RNA, 18 nt, Human
uggcugugccucugccug

SEQ ID NO: 1145960 - RNA, 19 nt, Human
uggcugugccucugccugu

SEQ ID NO: 1145961 - RNA, 22 nt, Human
uggcugugccucugccugucuc

SEQ ID NO: 1145962 - RNA, 18 nt, Human
ugggaaacaaaaggauaa

SEQ ID NO: 1145963 - RNA, 20 nt, Human
ugggaacaccauaggucacc

SEQ ID NO: 1145964 - RNA, 23 nt, Human
aggcuucugguugaugccuguga

SEQ ID NO: 1145965 - RNA, 13 nt, Human
agggaaauuucag

SEQ ID NO: 1145966 - RNA, 18 nt, Human
agggagcaucagugcccu

SEQ ID NO: 1145967 - RNA, 14 nt, Human
ugggacuggccucu

SEQ ID NO: 1145968 - RNA, 16 nt, Human
ugggacuggccucugc

SEQ ID NO: 1145969 - RNA, 13 nt, Human
agggagggccugg

SEQ ID NO: 1145970 - RNA, 15 nt, Human
agggagggccugggc

SEQ ID NO: 1145971 - RNA, 13 nt, Human
ugggcugcccugg

SEQ ID NO: 1145972 - RNA, 14 nt, Human
ugggcugcccuggu

SEQ ID NO: 1145973 - RNA, 15 nt, Human
ugggcugcccuggug

SEQ ID NO: 1145974 - RNA, 16 nt, Human
ugggcugcccuggugc

SEQ ID NO: 1145975 - RNA, 22 nt, Human
agguuuaugacaguaauugugu

SEQ ID NO: 1145976 - RNA, 17 nt, Human
uguacaaaaaaaucuuc

SEQ ID NO: 1145977 - RNA, 21 nt, Human
uguacaaaaaaaucuuccaau

SEQ ID NO: 1145978 - RNA, 22 nt, Human
uguacaaaaaaaucuuccaauu

SEQ ID NO: 1145979 - RNA, 14 nt, Human
uguacauagugcua

SEQ ID NO: 1145980 - RNA, 17 nt, Human
uguacauagugcuaaca

SEQ ID NO: 1145981 - RNA, 19 nt, Human
uguacauagugcuaacaug

SEQ ID NO: 1145982 - RNA, 21 nt, Human
uguacauagugcuaacaugaa

SEQ ID NO: 1145983 - RNA, 20 nt, Human
uguacauagugcuaacauga

SEQ ID NO: 1145984 - RNA, 20 nt, Human
aguaauaccucuaauaguau

SEQ ID NO: 1145985 - RNA, 21 nt, Human
aguaauaccucuaauaguaua

SEQ ID NO: 1145986 - RNA, 22 nt, Human
aguaauaccucuaauaguauaa

SEQ ID NO: 1145987 - RNA, 23 nt, Human
aguaauaccucuaauaguauaaa

SEQ ID NO: 1145988 - RNA, 12 nt, Human
aguaauccugua

SEQ ID NO: 1145989 - RNA, 16 nt, Human
aguaauuguguuuaca

SEQ ID NO: 1145990 - RNA, 18 nt, Human
aguaauuguguuuacauu

SEQ ID NO: 1145991 - RNA, 21 nt, Human
aguaauuguguuuacauuuua

SEQ ID NO: 1145992 - RNA, 22 nt, Human
aguaauuguguuuacauuuuau

SEQ ID NO: 1145993 - RNA, 23 nt, Human
aguaauuguguuuacauuuuaug

SEQ ID NO: 1145994 - RNA, 14 nt, Human
ugucgccucugcau

SEQ ID NO: 1145995 - RNA, 17 nt, Human
agucccaggcugagccu

SEQ ID NO: 1145996 - RNA, 18 nt, Human
agucccaggcugagccuc

SEQ ID NO: 1145997 - RNA, 19 nt, Human
agucccaggcugagccuca

SEQ ID NO: 1145998 - RNA, 20 nt, Human
agucccaggcugagccucag

SEQ ID NO: 1145999 - RNA, 16 nt, Human
agucccccugccccag

SEQ ID NO: 1146000 - RNA, 21 nt, Human
agucuaccaaccuguucaagu

SEQ ID NO: 1146001 - RNA, 11 nt, Human
agucuaccaau

SEQ ID NO: 1146002 - RNA, 18 nt, Human
ugugacuucagcucuguu

SEQ ID NO: 1146003 - RNA, 19 nt, Human
ugugacuucagcucuguuu

SEQ ID NO: 1146004 - RNA, 19 nt, Human
agucucuucuccacuggau

SEQ ID NO: 1146005 - RNA, 21 nt, Human
agucucuucuccacuggaugg

SEQ ID NO: 1146006 - RNA, 16 nt, Human
agucuuucacauuuaa

SEQ ID NO: 1146007 - RNA, 18 nt, Human
agucuuucacauuuaaau

SEQ ID NO: 1146008 - RNA, 15 nt, Human
agugcaguuauuugc

SEQ ID NO: 1146009 - RNA, 17 nt, Human
agugcaguuauuugcuu

SEQ ID NO: 1146010 - RNA, 14 nt, Human
agugcaucucagcc

SEQ ID NO: 1146011 - RNA, 16 nt, Human
agugcccuccaggaua

SEQ ID NO: 1146012 - RNA, 20 nt, Human
uguggguuuuuauuuccuau

SEQ ID NO: 1146013 - RNA, 16 nt, Human
uguuaacugagugccu

SEQ ID NO: 1146014 - RNA, 22 nt, Human
uguuaacugagugccuuuuggu

SEQ ID NO: 1146015 - RNA, 22 nt, Human
uguuaaguugauggugaugaaa

SEQ ID NO: 1146016 - RNA, 17 nt, Human
aguggauggaaggggcu

SEQ ID NO: 1146017 - RNA, 15 nt, Human
aguggggacagagca

SEQ ID NO: 1146018 - RNA, 14 nt, Human
aguggggaggggcu

SEQ ID NO: 1146019 - RNA, 15 nt, Human
agugguaucuugcag

SEQ ID NO: 1146020 - RNA, 23 nt, Human
aguuacuaucaugucaaacguga

SEQ ID NO: 1146021 - RNA, 20 nt, Human
aguuuaaauuguaauaggcg

SEQ ID NO: 1146022 - RNA, 13 nt, Human
aguuucucagcuc

SEQ ID NO: 1146023 - RNA, 15 nt, Human
aguuucucagcuccc

SEQ ID NO: 1146024 - RNA, 19 nt, Human
uuaagaaugaucugauuga

SEQ ID NO: 1146025 - RNA, 15 nt, Human
uuaagaaugaucuga

SEQ ID NO: 1146026 - RNA, 18 nt, Human
uuaagacauuuuuggaag

SEQ ID NO: 1146027 - RNA, 23 nt, Human
uuaagacauuuuuggaaggggac

SEQ ID NO: 1146028 - RNA, 13 nt, Human
uuaaucauauaaa

SEQ ID NO: 1146029 - RNA, 15 nt, Human
uuaaucauauaaaua

SEQ ID NO: 1146030 - RNA, 16 nt, Human
uuaaucauauaaauag

SEQ ID NO: 1146031 - RNA, 17 nt, Human
uuaaucauauaaauaga

SEQ ID NO: 1146032 - RNA, 19 nt, Human
uuaaucauauaaauagaau

SEQ ID NO: 1146033 - RNA, 13 nt, Human
auaaauugcuccu

SEQ ID NO: 1146034 - RNA, 16 nt, Human
auaaauugcuccuuga

SEQ ID NO: 1146035 - RNA, 18 nt, Human
auaaauugcuccuugaca

SEQ ID NO: 1146036 - RNA, 15 nt, Human
auaacuauguugaua

SEQ ID NO: 1146037 - RNA, 24 nt, Human
uuacuccaaaacuucguuuaauga

SEQ ID NO: 1146038 - RNA, 20 nt, Human
auaauucaggaagcagcuuu

SEQ ID NO: 1146039 - RNA, 14 nt, Human
uuaguaauaccucu

SEQ ID NO: 1146040 - RNA, 16 nt, Human
uuaguaauaccucuaa

SEQ ID NO: 1146041 - RNA, 17 nt, Human
uuaguaauaccucuaau

SEQ ID NO: 1146042 - RNA, 17 nt, Human
uuaguagagacaggguu

SEQ ID NO: 1146043 - RNA, 13 nt, Human
auacaaguuucau

SEQ ID NO: 1146044 - RNA, 14 nt, Human
auacaaguuucauc

SEQ ID NO: 1146045 - RNA, 21 nt, Human
auacaguucggugagcuacaa

SEQ ID NO: 1146046 - RNA, 13 nt, Human
uuaugacaguaau

SEQ ID NO: 1146047 - RNA, 15 nt, Human
uuaugacaguaauug

SEQ ID NO: 1146048 - RNA, 16 nt, Human
uuaugacaguaauugu

SEQ ID NO: 1146049 - RNA, 24 nt, Human
uuaugacaguaauuguguuuacau

SEQ ID NO: 1146050 - RNA, 11 nt, Human
uuaugaugugc

SEQ ID NO: 1146051 - RNA, 13 nt, Human
uuaugaugugcuu

SEQ ID NO: 1146052 - RNA, 14 nt, Human
uuaugaugugcuua

SEQ ID NO: 1146053 - RNA, 16 nt, Human
uuaugaugugcuuaac

SEQ ID NO: 1146054 - RNA, 17 nt, Human
uuaugaugugcuuaaca

SEQ ID NO: 1146055 - RNA, 18 nt, Human
uuaugaugugcuuaacag

SEQ ID NO: 1146056 - RNA, 14 nt, Human
uuauuauauuuaca

SEQ ID NO: 1146057 - RNA, 15 nt, Human
uuauuauauuuacaa

SEQ ID NO: 1146058 - RNA, 20 nt, Human
uuauucacuuuuauuuagca

SEQ ID NO: 1146059 - RNA, 14 nt, Human
uuauucauaugcau

SEQ ID NO: 1146060 - RNA, 16 nt, Human
uuauucauaugcauau

SEQ ID NO: 1146061 - RNA, 15 nt, Human
uuauucauaugcaua

SEQ ID NO: 1146062 - RNA, 18 nt, Human
auacucuuauagacaaca

SEQ ID NO: 1146063 - RNA, 17 nt, Human
auacugccacuaaccuu

SEQ ID NO: 1146064 - RNA, 13 nt, Human
auagaaguaaaaa

SEQ ID NO: 1146065 - RNA, 14 nt, Human
auagaauguaaaug

SEQ ID NO: 1146066 - RNA, 15 nt, Human
auagaauguaaaugu

SEQ ID NO: 1146067 - RNA, 17 nt, Human
auagaauguaaaugucu

SEQ ID NO: 1146068 - RNA, 19 nt, Human
auagaauguaaaugucuca

SEQ ID NO: 1146069 - RNA, 20 nt, Human
auagaauguaaaugucucac

SEQ ID NO: 1146070 - RNA, 18 nt, Human
auagacccacaagaggca

SEQ ID NO: 1146071 - RNA, 17 nt, Human
auagaccuuuucauuug

SEQ ID NO: 1146072 - RNA, 18 nt, Human
auagauaggucagugcaa

SEQ ID NO: 1146073 - RNA, 16 nt, Human
uucccgcucagcccuc

SEQ ID NO: 1146074 - RNA, 18 nt, Human
uucccgcucagcccuccc

SEQ ID NO: 1146075 - RNA, 21 nt, Human
uucccgcucagcccucccugc

SEQ ID NO: 1146076 - RNA, 22 nt, Human
uucccgcucagcccucccugcc

SEQ ID NO: 1146077 - RNA, 19 nt, Human
uuccguagguuauuuucag

SEQ ID NO: 1146078 - RNA, 16 nt, Human
uuccuaauuccacagc

SEQ ID NO: 1146079 - RNA, 17 nt, Human
uuccuaauuccacagcu

SEQ ID NO: 1146080 - RNA, 18 nt, Human
uuccuaauuccacagcug

SEQ ID NO: 1146081 - RNA, 14 nt, Human
uuccucugagccuu

SEQ ID NO: 1146082 - RNA, 17 nt, Human
uuccucugagccuuggg

SEQ ID NO: 1146083 - RNA, 21 nt, Human
uuccucugaggcugaaauuca

SEQ ID NO: 1146084 - RNA, 14 nt, Human
uuccugugcacagc

SEQ ID NO: 1146085 - RNA, 15 nt, Human
uuccugugcacagcc

SEQ ID NO: 1146086 - RNA, 22 nt, Human
aucaaauguuuaaucauauaaa

SEQ ID NO: 1146087 - RNA, 16 nt, Human
uucucacuccuaccug

SEQ ID NO: 1146088 - RNA, 18 nt, Human
uucucacuccuaccuggu

SEQ ID NO: 1146089 - RNA, 18 nt, Human
aucagaaguuucucagcu

SEQ ID NO: 1146090 - RNA, 17 nt, Human
uucuccuuucacaaccu

SEQ ID NO: 1146091 - RNA, 14 nt, Human
aucauuuuauguca

SEQ ID NO: 1146092 - RNA, 23 nt, Human
aucauuuuaugucaagggcagcu

SEQ ID NO: 1146093 - RNA, 13 nt, Human
auccaucaggcca

SEQ ID NO: 1146094 - RNA, 14 nt, Human
uucuuuuuuuguga

SEQ ID NO: 1146095 - RNA, 17 nt, Human
uugaaauuguauuacaa

SEQ ID NO: 1146096 - RNA, 18 nt, Human
auccuacaagacacagug

SEQ ID NO: 1146097 - RNA, 19 nt, Human
auccuacaagacacaguga

SEQ ID NO: 1146098 - RNA, 13 nt, Human
uugaagccuuugu

SEQ ID NO: 1146099 - RNA, 17 nt, Human
uugaagggaaauuucag

SEQ ID NO: 1146100 - RNA, 13 nt, Human
uugaaucacagua

SEQ ID NO: 1146101 - RNA, 15 nt, Human
aucuccacuccagau

SEQ ID NO: 1146102 - RNA, 21 nt, Human
aucucuucuggguuccuuccu

SEQ ID NO: 1146103 - RNA, 13 nt, Human
aucucuucuuaau

SEQ ID NO: 1146104 - RNA, 17 nt, Human
aucucuucuuaauguac

SEQ ID NO: 1146105 - RNA, 18 nt, Human
aucucuucuuaauguaca

SEQ ID NO: 1146106 - RNA, 19 nt, Human
aucucuucuuaauguacau

SEQ ID NO: 1146107 - RNA, 22 nt, Human
aucucuucuuaauguacauagu

SEQ ID NO: 1146108 - RNA, 20 nt, Human
aucucuucuuaauguacaua

SEQ ID NO: 1146109 - RNA, 23 nt, Human
uugcauauaagggaaguaguuau

SEQ ID NO: 1146110 - RNA, 15 nt, Human
aucugccucucuugu

SEQ ID NO: 1146111 - RNA, 18 nt, Human
aucugccucucuuguaau

SEQ ID NO: 1146112 - RNA, 13 nt, Human
aucuguuugagaa

SEQ ID NO: 1146113 - RNA, 14 nt, Human
aucuguuugagaaa

SEQ ID NO: 1146114 - RNA, 19 nt, Human
aucuguuugagaaagucag

SEQ ID NO: 1146115 - RNA, 15 nt, Human
aucuguuugagaaag

SEQ ID NO: 1146116 - RNA, 14 nt, Human
aucuuauaauuuaa

SEQ ID NO: 1146117 - RNA, 21 nt, Human
aucuugcaguaucggcacugu

SEQ ID NO: 1146118 - RNA, 22 nt, Human
aucuugcaguaucggcacugua

SEQ ID NO: 1146119 - RNA, 24 nt, Human
aucuugcaguaucggcacuguaca

SEQ ID NO: 1146120 - RNA, 16 nt, Human
uugcucauauuuccca

SEQ ID NO: 1146121 - RNA, 12 nt, Human
uugcuccuugac

SEQ ID NO: 1146122 - RNA, 11 nt, Human
uuggagacaga

SEQ ID NO: 1146123 - RNA, 13 nt, Human
augaaauuccauu

SEQ ID NO: 1146124 - RNA, 18 nt, Human
augaacuuguaaaggaau

SEQ ID NO: 1146125 - RNA, 19 nt, Human
augaagaccuuuuucugca

SEQ ID NO: 1146126 - RNA, 24 nt, Human
augaagaccuuuuucugcacuaua

SEQ ID NO: 1146127 - RNA, 21 nt, Human
augaagaccuuuuucugcacu

SEQ ID NO: 1146128 - RNA, 22 nt, Human
augaagaccuuuuucugcacua

SEQ ID NO: 1146129 - RNA, 11 nt, Human
augaagaggag

SEQ ID NO: 1146130 - RNA, 21 nt, Human
augaaugcuuaaagaauucaa

SEQ ID NO: 1146131 - RNA, 20 nt, Human
augaaugcuuaaagaauuca

SEQ ID NO: 1146132 - RNA, 17 nt, Human
uuguucauauuaagaau

SEQ ID NO: 1146133 - RNA, 19 nt, Human
uuguucauauuaagaauga

SEQ ID NO: 1146134 - RNA, 18 nt, Human
uuuaaauauaugcuaagu

SEQ ID NO: 1146135 - RNA, 17 nt, Human
augcagcaucuaaguaa

SEQ ID NO: 1146136 - RNA, 14 nt, Human
augcccuggaucca

SEQ ID NO: 1146137 - RNA, 16 nt, Human
augccucagccuccug

SEQ ID NO: 1146138 - RNA, 16 nt, Human
augcuaagacucagug

SEQ ID NO: 1146139 - RNA, 18 nt, Human
auggagacugucucaaga

SEQ ID NO: 1146140 - RNA, 14 nt, Human
uuucugcacuauau

SEQ ID NO: 1146141 - RNA, 17 nt, Human
uuucugcacuauaugca

SEQ ID NO: 1146142 - RNA, 23 nt, Human
uuucugggcaccggggccucgga

SEQ ID NO: 1146143 - RNA, 23 nt, Human
uuucuuuuuacccauuuguucau

SEQ ID NO: 1146144 - RNA, 17 nt, Human
augggggcacugaggac

SEQ ID NO: 1146145 - RNA, 14 nt, Human
auggugaugaaaug

SEQ ID NO: 1146146 - RNA, 16 nt, Human
auggugaugaaaugua

SEQ ID NO: 1146147 - RNA, 17 nt, Human
auggugaugaaauguaa

SEQ ID NO: 1146148 - RNA, 16 nt, Human
auggugccuaguauug

SEQ ID NO: 1146149 - RNA, 19 nt, Human
auggugccuaguauugaca

SEQ ID NO: 1146150 - RNA, 21 nt, Human
auggugccuaguauugacaaa

SEQ ID NO: 1146151 - RNA, 20 nt, Human
auggugccuaguauugacaa

SEQ ID NO: 1146152 - RNA, 19 nt, Human
augguuccccuguucacuc

SEQ ID NO: 1146153 - RNA, 20 nt, Human
augguuccccuguucacucu

SEQ ID NO: 1146154 - RNA, 18 nt, Human
auguaaaugucucacuga

SEQ ID NO: 1146155 - RNA, 19 nt, Human
auguaaaugucucacugag

SEQ ID NO: 1146156 - RNA, 23 nt, Human
auguaaaugucucacugagcacu

SEQ ID NO: 1146157 - RNA, 21 nt, Human
auguaaaugucucacugagca

SEQ ID NO: 1146158 - RNA, 13 nt, Human
auguacugcauua

SEQ ID NO: 1146159 - RNA, 20 nt, Human
auguacugcauuauuugaga

SEQ ID NO: 1146160 - RNA, 15 nt, Human
auguacugcauuauu

SEQ ID NO: 1146161 - RNA, 18 nt, Human
auguaugagguacaaccu

SEQ ID NO: 1146162 - RNA, 13 nt, Human
augucgccucugc

SEQ ID NO: 1146163 - RNA, 14 nt, Human
augucgccucugca

SEQ ID NO: 1146164 - RNA, 15 nt, Human
augucgccucugcau

SEQ ID NO: 1146165 - RNA, 14 nt, Human
augucucacugagc

SEQ ID NO: 1146166 - RNA, 15 nt, Human
augucucacugagca

SEQ ID NO: 1146167 - RNA, 18 nt, Human
augucucacugagcacug

SEQ ID NO: 1146168 - RNA, 17 nt, Human
augucucaggucccugc

SEQ ID NO: 1146169 - RNA, 22 nt, Human
augucucaggucccugcagggc

SEQ ID NO: 1146170 - RNA, 19 nt, Human
augucucacugagcacugu

SEQ ID NO: 1146171 - RNA, 20 nt, Human
augucucacugagcacuguu

SEQ ID NO: 1146172 - RNA, 22 nt, Human
augucucacugagcacuguuuu

SEQ ID NO: 1146173 - RNA, 17 nt, Human
augucucugagcauuag

SEQ ID NO: 1146174 - RNA, 22 nt, Human
uuugugaaaugauggugaaagu

SEQ ID NO: 1146175 - RNA, 11 nt, Human
uuuguggaaaa

SEQ ID NO: 1146176 - RNA, 19 nt, Human
auuauacccccugcaaagc

SEQ ID NO: 1146177 - RNA, 15 nt, Human
auuauauuuacaaau

SEQ ID NO: 1146178 - RNA, 13 nt, Human
auuauuugagaag

SEQ ID NO: 1146179 - RNA, 21 nt, Human
auuauuugagaagcugcucaa

SEQ ID NO: 1146180 - RNA, 22 nt, Human
auucaggaagcagcuuucccca

SEQ ID NO: 1146181 - RNA, 21 nt, Human
auuccagagaguggcuccucc

SEQ ID NO: 1146182 - RNA, 23 nt, Human
auuccccgucucugguuccuccc

SEQ ID NO: 1146183 - RNA, 15 nt, Human
auucuagcuuugagc

SEQ ID NO: 1146184 - RNA, 22 nt, Human
auucucaugccucagccuccug

SEQ ID NO: 1146185 - RNA, 11 nt, Human
auugacuucuu

SEQ ID NO: 1146186 - RNA, 19 nt, Human
auuggacaguaaaauccac

SEQ ID NO: 1146187 - RNA, 18 nt, Human
auugguaaagaauggaag

SEQ ID NO: 1146188 - RNA, 15 nt, Human
auuucccuacauuaa

SEQ ID NO: 1146189 - RNA, 17 nt, Human
auuucccuacauuaaac

SEQ ID NO: 1146190 - RNA, 20 nt, Human
auuucccuacauuaaacaug

SEQ ID NO: 1146191 - RNA, 20 nt, Human
auuucuugagguaaaagcau

SEQ ID NO: 1146192 - RNA, 23 nt, Human
auuugugaaaugauggugaaagu

SEQ ID NO: 1146193 - RNA, 14 nt, Human
auuuucuauaauuu

SEQ ID NO: 1146194 - RNA, 15 nt, Human
auuuucuauaauuua

SEQ ID NO: 1146195 - RNA, 18 nt, Human
auuuugccagugggaacu

SEQ ID NO: 1146196 - RNA, 22 nt, Human
auuuuugugauuuugugauuga

SEQ ID NO: 1146197 - RNA, 18 nt, Human
auuuuuuaaauugaauuc

SEQ ID NO: 1146198 - RNA, 19 nt, Human
auuuuuuacagcugccugc

SEQ ID NO: 1146199 - RNA, 16 nt, Human
auuuuuuagugacuaa

SEQ ID NO: 1146200 - RNA, 18 nt, Human
caaaaaaaucuuccaauu

SEQ ID NO: 1146201 - RNA, 18 nt, Human
caaaugucuuccuggauu

SEQ ID NO: 1146202 - RNA, 14 nt, Human
caaauguggcuccu

SEQ ID NO: 1146203 - RNA, 13 nt, Human
caaauguuuaauc

SEQ ID NO: 1146204 - RNA, 15 nt, Human
caaauguuuaaucau

SEQ ID NO: 1146205 - RNA, 16 nt, Human
caaauguuuaaucaua

SEQ ID NO: 1146206 - RNA, 21 nt, Human
caacccucagagccaccccua

SEQ ID NO: 1146207 - RNA, 12 nt, Human
caacgcagcccu

SEQ ID NO: 1146208 - RNA, 13 nt, Human
caacgcagcccug

SEQ ID NO: 1146209 - RNA, 15 nt, Human
caacgcagcccugcu

SEQ ID NO: 1146210 - RNA, 18 nt, Human
caacgcagcccugcuuug

SEQ ID NO: 1146211 - RNA, 20 nt, Human
caagaaaggcugcuguacug

SEQ ID NO: 1146212 - RNA, 17 nt, Human
caagcacuaaacaaaga

SEQ ID NO: 1146213 - RNA, 14 nt, Human
caagccguggcuuc

SEQ ID NO: 1146214 - RNA, 15 nt, Human
caagccguggcuucc

SEQ ID NO: 1146215 - RNA, 16 nt, Human
caagccguggcuuccc

SEQ ID NO: 1146216 - RNA, 17 nt, Human
caagccguggcuucccg

SEQ ID NO: 1146217 - RNA, 14 nt, Human
caaggacuaggguc

SEQ ID NO: 1146218 - RNA, 19 nt, Human
caaggaugccccguccccc

SEQ ID NO: 1146219 - RNA, 14 nt, Human
caagucuaccaauu

SEQ ID NO: 1146220 - RNA, 22 nt, Human
caagugauucucaugccucagc

SEQ ID NO: 1146221 - RNA, 14 nt, Human
caauuuucacugug

SEQ ID NO: 1146222 - RNA, 20 nt, Human
caauuuucacuguguccagg

SEQ ID NO: 1146223 - RNA, 15 nt, Human
caauuuucacugugu

SEQ ID NO: 1146224 - RNA, 18 nt, Human
cacaaagcccuuccaugu

SEQ ID NO: 1146225 - RNA, 22 nt, Human
cacaacacacagauuugagcuc

SEQ ID NO: 1146226 - RNA, 17 nt, Human
cacaaccuucuguggcu

SEQ ID NO: 1146227 - RNA, 18 nt, Human
cacaaccuucuguggcuc

SEQ ID NO: 1146228 - RNA, 19 nt, Human
cacaaccuucuguggcuca

SEQ ID NO: 1146229 - RNA, 23 nt, Human
cacaaccuucuguggcucacaga

SEQ ID NO: 1146230 - RNA, 14 nt, Human
cacacccuguuuua

SEQ ID NO: 1146231 - RNA, 17 nt, Human
cacacgagaaccugaag

SEQ ID NO: 1146232 - RNA, 14 nt, Human
cacacuucaggcuc

SEQ ID NO: 1146233 - RNA, 17 nt, Human
cacacuucaggcucuuc

SEQ ID NO: 1146234 - RNA, 18 nt, Human
cacacuucaggcucuucu

SEQ ID NO: 1146235 - RNA, 20 nt, Human
cacacuucaggcucuucucc

SEQ ID NO: 1146236 - RNA, 21 nt, Human
cacacuucaggcucuucuccu

SEQ ID NO: 1146237 - RNA, 22 nt, Human
cacacuucaggcucuucuccuu

SEQ ID NO: 1146238 - RNA, 20 nt, Human
cacagcacgggggccaagga

SEQ ID NO: 1146239 - RNA, 16 nt, Human
cacagcagccccugca

SEQ ID NO: 1146240 - RNA, 12 nt, Human
cacagcaucuca

SEQ ID NO: 1146241 - RNA, 13 nt, Human
cacagcaucucag

SEQ ID NO: 1146242 - RNA, 14 nt, Human
cacagcaucucagc

SEQ ID NO: 1146243 - RNA, 15 nt, Human
cacagcaucucagcu

SEQ ID NO: 1146244 - RNA, 16 nt, Human
cacagcaucucagcuc

SEQ ID NO: 1146245 - RNA, 19 nt, Human
cacagcaucucagcucauc

SEQ ID NO: 1146246 - RNA, 15 nt, Human
cacaggcccuuccuc

SEQ ID NO: 1146247 - RNA, 22 nt, Human
cacauaauucaggaagcagcuu

SEQ ID NO: 1146248 - RNA, 13 nt, Human
cacauguggacuu

SEQ ID NO: 1146249 - RNA, 15 nt, Human
caccccuaaagagau

SEQ ID NO: 1146250 - RNA, 14 nt, Human
caccccuaaagaga

SEQ ID NO: 1146251 - RNA, 14 nt, Human
ccaccuucccaugc

SEQ ID NO: 1146252 - RNA, 13 nt, Human
ccacugccucuuc

SEQ ID NO: 1146253 - RNA, 16 nt, Human
ccacugccucuuccuc

SEQ ID NO: 1146254 - RNA, 21 nt, Human
ccacugccuucgauacaccgg

SEQ ID NO: 1146255 - RNA, 24 nt, Human
ccagaccccuggcuuuucacugcu

SEQ ID NO: 1146256 - RNA, 14 nt, Human
ccagagaguggcuc

SEQ ID NO: 1146257 - RNA, 15 nt, Human
ccagagaguggcucc

SEQ ID NO: 1146258 - RNA, 16 nt, Human
ccagagaguggcuccu

SEQ ID NO: 1146259 - RNA, 18 nt, Human
ccagagaguggcuccucc

SEQ ID NO: 1146260 - RNA, 22 nt, Human
ccagagaguggcuccucccggu

SEQ ID NO: 1146261 - RNA, 24 nt, Human
ccagauuuuuuacagcugccugca

SEQ ID NO: 1146262 - RNA, 22 nt, Human
ccagcaccggccccauuuaccc

SEQ ID NO: 1146263 - RNA, 16 nt, Human
ccagguggccacucca

SEQ ID NO: 1146264 - RNA, 21 nt, Human
ccagguggccacuccagaccc

SEQ ID NO: 1146265 - RNA, 16 nt, Human
ccauauggauccacug

SEQ ID NO: 1146266 - RNA, 20 nt, Human
ccauuaaguaaacaauaaaa

SEQ ID NO: 1146267 - RNA, 22 nt, Human
ccauuugaauuuuuuagugacu

SEQ ID NO: 1146268 - RNA, 15 nt, Human
ccauuuguucauauu

SEQ ID NO: 1146269 - RNA, 20 nt, Human
ccauuuguucauauuaagaa

SEQ ID NO: 1146270 - RNA, 16 nt, Human
ccauuuguucauauua

SEQ ID NO: 1146271 - RNA, 16 nt, Human
cccacaggcccuuccu

SEQ ID NO: 1146272 - RNA, 18 nt, Human
cccacaggcccuuccucu

SEQ ID NO: 1146273 - RNA, 19 nt, Human
cccacauagugaugguucc

SEQ ID NO: 1146274 - RNA, 13 nt, Human
cccaguuguauuu

SEQ ID NO: 1146275 - RNA, 14 nt, Human
cccaucucuucugg

SEQ ID NO: 1146276 - RNA, 16 nt, Human
cccaugauuucaugua

SEQ ID NO: 1146277 - RNA, 17 nt, Human
cccaugauuucauguac

SEQ ID NO: 1146278 - RNA, 19 nt, Human
cccaugauuucauguacug

SEQ ID NO: 1146279 - RNA, 15 nt, Human
cccauucaagauucc

SEQ ID NO: 1146280 - RNA, 17 nt, Human
ccccaccccaaaauuag

SEQ ID NO: 1146281 - RNA, 18 nt, Human
ccccacuuaccgcguaau

SEQ ID NO: 1146282 - RNA, 22 nt, Human
ccccauaauuuuuuuuuuccuu

SEQ ID NO: 1146283 - RNA, 12 nt, Human
cccccucuggcu

SEQ ID NO: 1146284 - RNA, 19 nt, Human
cccccucuggcuccagcug

SEQ ID NO: 1146285 - RNA, 21 nt, Human
cccccucuggcuccagcuggc

SEQ ID NO: 1146286 - RNA, 18 nt, Human
cccccugcaaagcccagc

SEQ ID NO: 1146287 - RNA, 19 nt, Human
cccccugcaaagcccagcu

SEQ ID NO: 1146288 - RNA, 21 nt, Human
cccccugcaaagcccagcuug

SEQ ID NO: 1146289 - RNA, 20 nt, Human
ccccucauagcccucacccu

SEQ ID NO: 1146290 - RNA, 23 nt, Human
ccccuccaaucccaccaacccuc

SEQ ID NO: 1146291 - RNA, 15 nt, Human
ccccucccuucaacc

SEQ ID NO: 1146292 - RNA, 18 nt, Human
ccccuccuccuggacucc

SEQ ID NO: 1146293 - RNA, 22 nt, Human
ccccuccuccuggacuccugca

SEQ ID NO: 1146294 - RNA, 15 nt, Human
ccccuccucucugcc

SEQ ID NO: 1146295 - RNA, 17 nt, Human
ccccuccucucugcccu

SEQ ID NO: 1146296 - RNA, 12 nt, Human
ccccucugcccu

SEQ ID NO: 1146297 - RNA, 13 nt, Human
ccccucugcccug

SEQ ID NO: 1146298 - RNA, 14 nt, Human
ccccucugcccugc

SEQ ID NO: 1146299 - RNA, 18 nt, Human
ccccuggcuuuucacugc

SEQ ID NO: 1146300 - RNA, 20 nt, Human
ccccuggcuuuucacugcug

SEQ ID NO: 1146301 - RNA, 22 nt, Human
ccccuggcuuuucacugcuggc

SEQ ID NO: 1146302 - RNA, 15 nt, Human
ccccuguucacucua

SEQ ID NO: 1146303 - RNA, 14 nt, Human
cccgacagccuggc

SEQ ID NO: 1146304 - RNA, 15 nt, Human
cccgacagccuggca

SEQ ID NO: 1146305 - RNA, 18 nt, Human
cccgacagccuggcacag

SEQ ID NO: 1146306 - RNA, 15 nt, Human
cccgcucagcccucc

SEQ ID NO: 1146307 - RNA, 12 nt, Human
cccgcucagccc

SEQ ID NO: 1146308 - RNA, 13 nt, Human
cccgcucagcccu

SEQ ID NO: 1146309 - RNA, 14 nt, Human
cccgcucagcccuc

SEQ ID NO: 1146310 - RNA, 14 nt, Human
cccucccugccccu

SEQ ID NO: 1146311 - RNA, 12 nt, Human
cccucugcccug

SEQ ID NO: 1146312 - RNA, 13 nt, Human
cccucugcccugc

SEQ ID NO: 1146313 - RNA, 14 nt, Human
cccucugcccugcg

SEQ ID NO: 1146314 - RNA, 12 nt, Human
cccucuggcucc

SEQ ID NO: 1146315 - RNA, 16 nt, Human
cccucuggcuccagcu

SEQ ID NO: 1146316 - RNA, 17 nt, Human
cccucuggcuccagcug

SEQ ID NO: 1146317 - RNA, 22 nt, Human
cccucuggcuccagcuggccgg

SEQ ID NO: 1146318 - RNA, 20 nt, Human
cccucuguucugcacacagc

SEQ ID NO: 1146319 - RNA, 21 nt, Human
cccucuguucugcacacagca

SEQ ID NO: 1146320 - RNA, 19 nt, Human
cccugcgggucacaggagg

SEQ ID NO: 1146321 - RNA, 21 nt, Human
cccugcgggucacaggaggga

SEQ ID NO: 1146322 - RNA, 21 nt, Human
cccugcugagucccaggcuga

SEQ ID NO: 1146323 - RNA, 23 nt, Human
cccugcugagucccaggcugagc

SEQ ID NO: 1146324 - RNA, 16 nt, Human
cccuggugcugccaca

SEQ ID NO: 1146325 - RNA, 13 nt, Human
cccuggugcugcc

SEQ ID NO: 1146326 - RNA, 14 nt, Human
cccuggugcugcca

SEQ ID NO: 1146327 - RNA, 15 nt, Human
cccuggugcugccac

SEQ ID NO: 1146328 - RNA, 20 nt, Human
cccuuaaacaguugcacagc

SEQ ID NO: 1146329 - RNA, 21 nt, Human
cccuuaaacaguugcacagca

SEQ ID NO: 1146330 - RNA, 22 nt, Human
cccuuaaacaguugcacagcau

SEQ ID NO: 1146331 - RNA, 20 nt, Human
cccuuagaaguuuguuguga

SEQ ID NO: 1146332 - RNA, 14 nt, Human
cccuucaaccauuc

SEQ ID NO: 1146333 - RNA, 18 nt, Human
cccuucaaccauucccca

SEQ ID NO: 1146334 - RNA, 20 nt, Human
cccuuccaugucgccucugc

SEQ ID NO: 1146335 - RNA, 20 nt, Human
ccgaguagcugagauuauag

SEQ ID NO: 1146336 - RNA, 14 nt, Human
ccgagucucuucuc

SEQ ID NO: 1146337 - RNA, 16 nt, Human
ccgagucucuucucca

SEQ ID NO: 1146338 - RNA, 18 nt, Human
ccgagucucuucuccacu

SEQ ID NO: 1146339 - RNA, 19 nt, Human
ccgagucucuucuccacug

SEQ ID NO: 1146340 - RNA, 20 nt, Human
ccgagucucuucuccacugg

SEQ ID NO: 1146341 - RNA, 21 nt, Human
ccgagucucuucuccacugga

SEQ ID NO: 1146342 - RNA, 17 nt, Human
ccgccuccgggaccccc

SEQ ID NO: 1146343 - RNA, 18 nt, Human
ccgccuccgggaccccca

SEQ ID NO: 1146344 - RNA, 21 nt, Human
ccgccuccgggacccccagga

SEQ ID NO: 1146345 - RNA, 22 nt, Human
ccgccuccgggacccccaggac

SEQ ID NO: 1146346 - RNA, 23 nt, Human
ccgccuccgggacccccaggaca

SEQ ID NO: 1146347 - RNA, 14 nt, Human
ccggaggggccugg

SEQ ID NO: 1146348 - RNA, 15 nt, Human
ccggaggggccuggc

SEQ ID NO: 1146349 - RNA, 16 nt, Human
ccggaggggccuggca

SEQ ID NO: 1146350 - RNA, 17 nt, Human
ccggaggggccuggcag

SEQ ID NO: 1146351 - RNA, 14 nt, Human
ccguggcuucccgc

SEQ ID NO: 1146352 - RNA, 11 nt, Human
ccguggcuucc

SEQ ID NO: 1146353 - RNA, 16 nt, Human
ccuaccgagucucuuc

SEQ ID NO: 1146354 - RNA, 17 nt, Human
ccuaccgagucucuucu

SEQ ID NO: 1146355 - RNA, 19 nt, Human
ccuaccgagucucuucucc

SEQ ID NO: 1146356 - RNA, 20 nt, Human
ccuaccgagucucuucucca

SEQ ID NO: 1146357 - RNA, 21 nt, Human
ccuaccgagucucuucuccac

SEQ ID NO: 1146358 - RNA, 11 nt, Human
ccuaugaugua

SEQ ID NO: 1146359 - RNA, 14 nt, Human
ccuaugauguauac

SEQ ID NO: 1146360 - RNA, 15 nt, Human
ccuaugauguauacu

SEQ ID NO: 1146361 - RNA, 18 nt, Human
ccuaugauguauacugcc

SEQ ID NO: 1146362 - RNA, 11 nt, Human
ccucuuccuga

SEQ ID NO: 1146363 - RNA, 19 nt, Human
ccugaaguaagcaaagacu

SEQ ID NO: 1146364 - RNA, 14 nt, Human
ccugcaaagcccag

SEQ ID NO: 1146365 - RNA, 15 nt, Human
ccugcaaagcccagc

SEQ ID NO: 1146366 - RNA, 16 nt, Human
ccugcaaagcccagcu

SEQ ID NO: 1146367 - RNA, 17 nt, Human
ccugcaaagcccagcuu

SEQ ID NO: 1146368 - RNA, 18 nt, Human
ccugcaaagcccagcuug

SEQ ID NO: 1146369 - RNA, 22 nt, Human
ccugcacaaagcccuuccaugu

SEQ ID NO: 1146370 - RNA, 23 nt, Human
ccugcacaaagcccuuccauguc

SEQ ID NO: 1146371 - RNA, 19 nt, Human
ccugcaaagcccagcuuga

SEQ ID NO: 1146372 - RNA, 21 nt, Human
ccugcacacgcuccuuccucu

SEQ ID NO: 1146373 - RNA, 23 nt, Human
ccugcauuugugaaaugauggug

SEQ ID NO: 1146374 - RNA, 15 nt, Human
ccugccaccacgccc

SEQ ID NO: 1146375 - RNA, 19 nt, Human
ccugccaccacgcccggcu

SEQ ID NO: 1146376 - RNA, 15 nt, Human
ccugccccucccuuc

SEQ ID NO: 1146377 - RNA, 16 nt, Human
ccugccccucccuuca

SEQ ID NO: 1146378 - RNA, 18 nt, Human
ccugccccucccuucaac

SEQ ID NO: 1146379 - RNA, 18 nt, Human
ccugccccuccucucugc

SEQ ID NO: 1146380 - RNA, 19 nt, Human
ccugccccuccucucugcc

SEQ ID NO: 1146381 - RNA, 20 nt, Human
ccugccccuccucucugccc

SEQ ID NO: 1146382 - RNA, 21 nt, Human
ccugccccuccucucugcccu

SEQ ID NO: 1146383 - RNA, 22 nt, Human
ccugccccuccucucugcccua

SEQ ID NO: 1146384 - RNA, 10 nt, Human
ccugcccugg

SEQ ID NO: 1146385 - RNA, 12 nt, Human
ccugcccuggga

SEQ ID NO: 1146386 - RNA, 14 nt, Human
ccugcccugggagg

SEQ ID NO: 1146387 - RNA, 15 nt, Human
ccugcccugggaggc

SEQ ID NO: 1146388 - RNA, 20 nt, Human
ccugcccugggaggcaguga

SEQ ID NO: 1146389 - RNA, 22 nt, Human
ccugcccugggaggcagugaug

SEQ ID NO: 1146390 - RNA, 14 nt, Human
ccugcccugguuuc

SEQ ID NO: 1146391 - RNA, 19 nt, Human
ccugcccugguuuccugcc

SEQ ID NO: 1146392 - RNA, 20 nt, Human
ccugcccugguuuccugccc

SEQ ID NO: 1146393 - RNA, 21 nt, Human
ccugcccugguuuccugcccu

SEQ ID NO: 1146394 - RNA, 22 nt, Human
ccugcccugguuuccugcccug

SEQ ID NO: 1146395 - RNA, 23 nt, Human
ccugcccugguuuccugcccugg

SEQ ID NO: 1146396 - RNA, 12 nt, Human
ccugccucagcc

SEQ ID NO: 1146397 - RNA, 22 nt, Human
ccugccuguucccauucuugca

SEQ ID NO: 1146398 - RNA, 12 nt, Human
ccuggagaacua

SEQ ID NO: 1146399 - RNA, 13 nt, Human
ccuggagaacuag

SEQ ID NO: 1146400 - RNA, 16 nt, Human
ccuggagaacuagaga

SEQ ID NO: 1146401 - RNA, 13 nt, Human
ccuggccacgccc

SEQ ID NO: 1146402 - RNA, 16 nt, Human
ccuggcuuuucacugc

SEQ ID NO: 1146403 - RNA, 17 nt, Human
ccuggcuuuucacugcu

SEQ ID NO: 1146404 - RNA, 18 nt, Human
ccuggcuuuucacugcug

SEQ ID NO: 1146405 - RNA, 13 nt, Human
ccugggaggcagu

SEQ ID NO: 1146406 - RNA, 19 nt, Human
ccuguaggaagguacugua

SEQ ID NO: 1146407 - RNA, 20 nt, Human
ccuguaggaagguacuguau

SEQ ID NO: 1146408 - RNA, 17 nt, Human
ccugucauacuuuguua

SEQ ID NO: 1146409 - RNA, 18 nt, Human
ccuuccaugucgccucug

SEQ ID NO: 1146410 - RNA, 19 nt, Human
ccuuccaugucgccucugc

SEQ ID NO: 1146411 - RNA, 23 nt, Human
ccuugacauuguagagcuucugg

SEQ ID NO: 1146412 - RNA, 21 nt, Human
ccuuuguaaauugucagaugc

SEQ ID NO: 1146413 - RNA, 23 nt, Human
ccuuuguaaauugucagaugcug

SEQ ID NO: 1146414 - RNA, 13 nt, Human
ccuuugugaaaaa

SEQ ID NO: 1146415 - RNA, 13 nt, Human
cgcagcccugcuu

SEQ ID NO: 1146416 - RNA, 15 nt, Human
cgcagcccugcuuug

SEQ ID NO: 1146417 - RNA, 24 nt, Human
cgcagcccugcuuugggcugcccu

SEQ ID NO: 1146418 - RNA, 18 nt, Human
cgcccaacuaauuuuugu

SEQ ID NO: 1146419 - RNA, 18 nt, Human
cgcccggcuaauuuuugu

SEQ ID NO: 1146420 - RNA, 16 nt, Human
cggacuuagcugggag

SEQ ID NO: 1146421 - RNA, 17 nt, Human
cggacuuagcugggaga

SEQ ID NO: 1146422 - RNA, 20 nt, Human
cguuuguuccccaagacauu

SEQ ID NO: 1146423 - RNA, 20 nt, Human
cuaaacuccaaacauccucu

SEQ ID NO: 1146424 - RNA, 19 nt, Human
cuaaacuccaaacauccuc

SEQ ID NO: 1146425 - RNA, 12 nt, Human
cuaaacugcccc

SEQ ID NO: 1146426 - RNA, 13 nt, Human
cuaaacugccccc

SEQ ID NO: 1146427 - RNA, 21 nt, Human
cuaaacugcccccucugcccu

SEQ ID NO: 1146428 - RNA, 15 nt, Human
cuaacaugaagaccu

SEQ ID NO: 1146429 - RNA, 21 nt, Human
cuaagcuucacuguaaaauaa

SEQ ID NO: 1146430 - RNA, 17 nt, Human
cuaauacagcugagcua

SEQ ID NO: 1146431 - RNA, 14 nt, Human
cuaauaguauaaac

SEQ ID NO: 1146432 - RNA, 21 nt, Human
cuaaucagcauucucacuccu

SEQ ID NO: 1146433 - RNA, 15 nt, Human
cuaaugcgcaggcug

SEQ ID NO: 1146434 - RNA, 16 nt, Human
cuaaugcgcaggcugg

SEQ ID NO: 1146435 - RNA, 19 nt, Human
cuaaugcgcaggcuggccc

SEQ ID NO: 1146436 - RNA, 20 nt, Human
cuaaugcgcaggcuggcccu

SEQ ID NO: 1146437 - RNA, 22 nt, Human
cuaaugcgcaggcuggcccugc

SEQ ID NO: 1146438 - RNA, 23 nt, Human
cuaaugcgcaggcuggcccugcc

SEQ ID NO: 1146439 - RNA, 22 nt, Human
cuaauuauacccccugcaaagc

SEQ ID NO: 1146440 - RNA, 14 nt, Human
cuaauuccacagcu

SEQ ID NO: 1146441 - RNA, 15 nt, Human
cuaauuccacagcug

SEQ ID NO: 1146442 - RNA, 16 nt, Human
cuaauuccacagcugc

SEQ ID NO: 1146443 - RNA, 23 nt, Human
cuacacgagauacagaauuuuau

SEQ ID NO: 1146444 - RNA, 18 nt, Human
cuacagcuaaucagcauu

SEQ ID NO: 1146445 - RNA, 19 nt, Human
cuacagcuaaucagcauuc

SEQ ID NO: 1146446 - RNA, 21 nt, Human
cuacagcuaaucagcauucuc

SEQ ID NO: 1146447 - RNA, 22 nt, Human
cuacagcuaaucagcauucuca

SEQ ID NO: 1146448 - RNA, 18 nt, Human
cuacauuaaacaugacuc

SEQ ID NO: 1146449 - RNA, 16 nt, Human
cuaccaaccuguucaa

SEQ ID NO: 1146450 - RNA, 17 nt, Human
cuaccgagucucuucuc

SEQ ID NO: 1146451 - RNA, 19 nt, Human
cuaccgagucucuucucca

SEQ ID NO: 1146452 - RNA, 21 nt, Human
cuaccgagucucuucuccacu

SEQ ID NO: 1146453 - RNA, 22 nt, Human
cuaccgagucucuucuccacug

SEQ ID NO: 1146454 - RNA, 23 nt, Human
cuaccgagucucuucuccacugg

SEQ ID NO: 1146455 - RNA, 17 nt, Human
cuacuuagcaugucccu

SEQ ID NO: 1146456 - RNA, 22 nt, Human
cuacuuagcaugucccuaccga

SEQ ID NO: 1146457 - RNA, 12 nt, Human
cuauaauuuaaa

SEQ ID NO: 1146458 - RNA, 13 nt, Human
cuauaauuuaaau

SEQ ID NO: 1146459 - RNA, 13 nt, Human
cuaugauguauac

SEQ ID NO: 1146460 - RNA, 14 nt, Human
cuaugauguauacu

SEQ ID NO: 1146461 - RNA, 20 nt, Human
cuaugauguauacugccacu

SEQ ID NO: 1146462 - RNA, 16 nt, Human
cuaugauguauacugc

SEQ ID NO: 1146463 - RNA, 15 nt, Human
cuaugauuuggaaaa

SEQ ID NO: 1146464 - RNA, 19 nt, Human
cuaugauuuggaaaauaaa

SEQ ID NO: 1146465 - RNA, 19 nt, Human
cuaugggggcacugaggac

SEQ ID NO: 1146466 - RNA, 11 nt, Human
cuauugguaaa

SEQ ID NO: 1146467 - RNA, 17 nt, Human
cucacagaacccuugga

SEQ ID NO: 1146468 - RNA, 20 nt, Human
cucacugcauccuccgccuc

SEQ ID NO: 1146469 - RNA, 15 nt, Human
cucagagccaccccu

SEQ ID NO: 1146470 - RNA, 14 nt, Human
cucagcccucccug

SEQ ID NO: 1146471 - RNA, 19 nt, Human
cucagcccucccugccccu

SEQ ID NO: 1146472 - RNA, 20 nt, Human
cucagcccucccugccccuc

SEQ ID NO: 1146473 - RNA, 21 nt, Human
cucagcccucccugccccucc

SEQ ID NO: 1146474 - RNA, 21 nt, Human
cucagcucaucuucacugcac

SEQ ID NO: 1146475 - RNA, 15 nt, Human
cucagcucccaaggc

SEQ ID NO: 1146476 - RNA, 19 nt, Human
cucagcucccaaggcucug

SEQ ID NO: 1146477 - RNA, 20 nt, Human
cucagguaaucgaccugccu

SEQ ID NO: 1146478 - RNA, 22 nt, Human
cucagguaaucgaccugccucg

SEQ ID NO: 1146479 - RNA, 24 nt, Human
cucagguaaucgaccugccucggc

SEQ ID NO: 1146480 - RNA, 14 nt, Human
cuccacugccuucg

SEQ ID NO: 1146481 - RNA, 15 nt, Human
cuccacugccuucga

SEQ ID NO: 1146482 - RNA, 16 nt, Human
cuccacugccuucgau

SEQ ID NO: 1146483 - RNA, 13 nt, Human
cuccacuggaugg

SEQ ID NO: 1146484 - RNA, 14 nt, Human
cuccacuggaugga

SEQ ID NO: 1146485 - RNA, 16 nt, Human
cuccacuggauggagg

SEQ ID NO: 1146486 - RNA, 22 nt, Human
cuccagcuggccgggagccuga

SEQ ID NO: 1146487 - RNA, 23 nt, Human
cuccagcuggccgggagccugau

SEQ ID NO: 1146488 - RNA, 19 nt, Human
cuccagcuggguuggaaaa

SEQ ID NO: 1146489 - RNA, 14 nt, Human
cuccaugcugccuc

SEQ ID NO: 1146490 - RNA, 15 nt, Human
cuccaugcugccucc

SEQ ID NO: 1146491 - RNA, 16 nt, Human
cuccaugcugccucca

SEQ ID NO: 1146492 - RNA, 17 nt, Human
cuccaugcugccuccag

SEQ ID NO: 1146493 - RNA, 18 nt, Human
cuccauuuaaacagaugu

SEQ ID NO: 1146494 - RNA, 16 nt, Human
cucccaaagugcuggg

SEQ ID NO: 1146495 - RNA, 14 nt, Human
cucccacaggcccu

SEQ ID NO: 1146496 - RNA, 19 nt, Human
cucccaggcgccccuuccc

SEQ ID NO: 1146497 - RNA, 20 nt, Human
cucccaggcgccccuucccc

SEQ ID NO: 1146498 - RNA, 22 nt, Human
cucccaggcgccccuucccccu

SEQ ID NO: 1146499 - RNA, 15 nt, Human
cucccauucaagauu

SEQ ID NO: 1146500 - RNA, 21 nt, Human
cucccuucaaccauuccccau

SEQ ID NO: 1146501 - RNA, 22 nt, Human
cucccuucaaccauuccccaug

SEQ ID NO: 1146502 - RNA, 23 nt, Human
cucccuucaaccauuccccaugg

SEQ ID NO: 1146503 - RNA, 20 nt, Human
cugcccugcgggucacagga

SEQ ID NO: 1146504 - RNA, 22 nt, Human
cugcccugcugagucccaggcu

SEQ ID NO: 1146505 - RNA, 21 nt, Human
cugcccuuucugggcaccggg

SEQ ID NO: 1146506 - RNA, 16 nt, Human
cugccucucuuguaau

SEQ ID NO: 1146507 - RNA, 14 nt, Human
cugcucuccucuug

SEQ ID NO: 1146508 - RNA, 20 nt, Human
cugcucuccucuugccacug

SEQ ID NO: 1146509 - RNA, 21 nt, Human
cugcucuccucuugccacugc

SEQ ID NO: 1146510 - RNA, 17 nt, Human
cugcugaaggaauaaau

SEQ ID NO: 1146511 - RNA, 18 nt, Human
cugcugaaggaauaaauu

SEQ ID NO: 1146512 - RNA, 12 nt, Human
cugcugcccagc

SEQ ID NO: 1146513 - RNA, 15 nt, Human
cugcugcccagccuc

SEQ ID NO: 1146514 - RNA, 22 nt, Human
cugcugcccagccuccaagcuc

SEQ ID NO: 1146515 - RNA, 12 nt, Human
cugcuggcugcc

SEQ ID NO: 1146516 - RNA, 14 nt, Human
cuggacuccucugu

SEQ ID NO: 1146517 - RNA, 17 nt, Human
cuggacuccucugucca

SEQ ID NO: 1146518 - RNA, 18 nt, Human
cuggacuccucuguccag

SEQ ID NO: 1146519 - RNA, 19 nt, Human
cuggacuccucuguccagg

SEQ ID NO: 1146520 - RNA, 20 nt, Human
cuggacuccucuguccaggc

SEQ ID NO: 1146521 - RNA, 14 nt, Human
cuggcacuuggaga

SEQ ID NO: 1146522 - RNA, 21 nt, Human
cuggcacuuggagacuuguau

SEQ ID NO: 1146523 - RNA, 18 nt, Human
cuggucacaggacucugc

SEQ ID NO: 1146524 - RNA, 19 nt, Human
cuggucacaggacucugcc

SEQ ID NO: 1146525 - RNA, 12 nt, Human
cuggugcugcca

SEQ ID NO: 1146526 - RNA, 13 nt, Human
cuggugcugccac

SEQ ID NO: 1146527 - RNA, 20 nt, Human
cuggugcugccacacuucag

SEQ ID NO: 1146528 - RNA, 22 nt, Human
cuggugcugccacacuucaggc

SEQ ID NO: 1146529 - RNA, 21 nt, Human
cugguggcccgacagccuggc

SEQ ID NO: 1146530 - RNA, 22 nt, Human
cugguggcccgacagccuggca

SEQ ID NO: 1146531 - RNA, 23 nt, Human
cugguggcccgacagccuggcac

SEQ ID NO: 1146532 - RNA, 12 nt, Human
cugguuccuccc

SEQ ID NO: 1146533 - RNA, 13 nt, Human
cugguuccucccc

SEQ ID NO: 1146534 - RNA, 23 nt, Human
cuguacaaaaaaaucuuccaauu

SEQ ID NO: 1146535 - RNA, 13 nt, Human
cuguaugaucaaa

SEQ ID NO: 1146536 - RNA, 14 nt, Human
cuguaugaucaaau

SEQ ID NO: 1146537 - RNA, 15 nt, Human
cuguaugaucaaaug

SEQ ID NO: 1146538 - RNA, 16 nt, Human
cuguaugaucaaaugu

SEQ ID NO: 1146539 - RNA, 17 nt, Human
cuguaugaucaaauguu

SEQ ID NO: 1146540 - RNA, 18 nt, Human
cuguaugaucaaauguuu

SEQ ID NO: 1146541 - RNA, 23 nt, Human
cuguaugaucaaauguuuaauca

SEQ ID NO: 1146542 - RNA, 19 nt, Human
cuguaugaucaaauguuua

SEQ ID NO: 1146543 - RNA, 21 nt, Human
cuguaugaucaaauguuuaau

SEQ ID NO: 1146544 - RNA, 17 nt, Human
cuguccaggcacugcug

SEQ ID NO: 1146545 - RNA, 18 nt, Human
cuguccgagugugccaca

SEQ ID NO: 1146546 - RNA, 22 nt, Human
cugucucaagagggcacuggug

SEQ ID NO: 1146547 - RNA, 23 nt, Human
cugucucaagagggcacuggugg

SEQ ID NO: 1146548 - RNA, 11 nt, Human
cugugcacagc

SEQ ID NO: 1146549 - RNA, 12 nt, Human
cugugcacagcc

SEQ ID NO: 1146550 - RNA, 13 nt, Human
cugugcacagccc

SEQ ID NO: 1146551 - RNA, 11 nt, Human
cugugccucug

SEQ ID NO: 1146552 - RNA, 13 nt, Human
cugugcuguuguu

SEQ ID NO: 1146553 - RNA, 17 nt, Human
cugugcuguuguuauga

SEQ ID NO: 1146554 - RNA, 19 nt, Human
cugugcuguuguuaugaug

SEQ ID NO: 1146555 - RNA, 21 nt, Human
cugugcuguuguuaugaugug

SEQ ID NO: 1146556 - RNA, 21 nt, Human
cugugggcgugagaccugccc

SEQ ID NO: 1146557 - RNA, 22 nt, Human
cugugggcgugagaccugcccc

SEQ ID NO: 1146558 - RNA, 23 nt, Human
cugugggcgugagaccugccccu

SEQ ID NO: 1146559 - RNA, 18 nt, Human
cuguucccauucuugcau

SEQ ID NO: 1146560 - RNA, 16 nt, Human
cuguucugcacacagc

SEQ ID NO: 1146561 - RNA, 19 nt, Human
cuuagugcaguuauuugcu

SEQ ID NO: 1146562 - RNA, 14 nt, Human
cuuauagacaacau

SEQ ID NO: 1146563 - RNA, 15 nt, Human
cuuauuucaucauuc

SEQ ID NO: 1146564 - RNA, 18 nt, Human
cuuauuucaucauucacu

SEQ ID NO: 1146565 - RNA, 17 nt, Human
cuucaaagcaaaugucu

SEQ ID NO: 1146566 - RNA, 16 nt, Human
cuucaaccauucccca

SEQ ID NO: 1146567 - RNA, 20 nt, Human
cuucaaccauuccccauggg

SEQ ID NO: 1146568 - RNA, 16 nt, Human
cuucaacucccugccc

SEQ ID NO: 1146569 - RNA, 17 nt, Human
cuucaauccuugaaggu

SEQ ID NO: 1146570 - RNA, 15 nt, Human
cuucaauuuauaccu

SEQ ID NO: 1146571 - RNA, 19 nt, Human
cuucaggcucuucuccuuu

SEQ ID NO: 1146572 - RNA, 22 nt, Human
cuucaggcucuucuccuuucac

SEQ ID NO: 1146573 - RNA, 15 nt, Human
cuucagggagugagg

SEQ ID NO: 1146574 - RNA, 19 nt, Human
cuucccgcucagcccuccc

SEQ ID NO: 1146575 - RNA, 23 nt, Human
cuucccgcucagcccucccugcc

SEQ ID NO: 1146576 - RNA, 13 nt, Human
cuuccuaauucca

SEQ ID NO: 1146577 - RNA, 17 nt, Human
cuuccuaauuccacagc

SEQ ID NO: 1146578 - RNA, 18 nt, Human
cuuccuaauuccacagcu

SEQ ID NO: 1146579 - RNA, 19 nt, Human
cuuccuaauuccacagcug

SEQ ID NO: 1146580 - RNA, 13 nt, Human
cuuccucccucau

SEQ ID NO: 1146581 - RNA, 15 nt, Human
cuuccucccucauuc

SEQ ID NO: 1146582 - RNA, 13 nt, Human
cuucuccacugga

SEQ ID NO: 1146583 - RNA, 14 nt, Human
cuucuccacuggau

SEQ ID NO: 1146584 - RNA, 15 nt, Human
cuucuccacuggaug

SEQ ID NO: 1146585 - RNA, 17 nt, Human
cuucuccacuggaugga

SEQ ID NO: 1146586 - RNA, 16 nt, Human
cuucuggguuccuucc

SEQ ID NO: 1146587 - RNA, 17 nt, Human
cuucuggguuccuuccu

SEQ ID NO: 1146588 - RNA, 23 nt, Human
cuucuggguuccuuccucugagc

SEQ ID NO: 1146589 - RNA, 14 nt, Human
cuucugguugaugc

SEQ ID NO: 1146590 - RNA, 13 nt, Human
cuucuguggcuca

SEQ ID NO: 1146591 - RNA, 15 nt, Human
cuucuguggcucaca

SEQ ID NO: 1146592 - RNA, 22 nt, Human
cuucuguggcucacagaacccu

SEQ ID NO: 1146593 - RNA, 15 nt, Human
cuucuguugcugccu

SEQ ID NO: 1146594 - RNA, 13 nt, Human
cuugaacuccuga

SEQ ID NO: 1146595 - RNA, 16 nt, Human
cuugaacuccugaccu

SEQ ID NO: 1146596 - RNA, 18 nt, Human
cuugaacuccugaccuca

SEQ ID NO: 1146597 - RNA, 19 nt, Human
cuugaguuuaaauuguaau

SEQ ID NO: 1146598 - RNA, 17 nt, Human
cuuguacuuuauuuucu

SEQ ID NO: 1146599 - RNA, 23 nt, Human
cuuuauggcagacauugugcuag

SEQ ID NO: 1146600 - RNA, 20 nt, Human
cuuucugggcaccggggccu

SEQ ID NO: 1146601 - RNA, 11 nt, Human
cuuucuuccuc

SEQ ID NO: 1146602 - RNA, 12 nt, Human
cuuucuuccucu

SEQ ID NO: 1146603 - RNA, 13 nt, Human
cuuucuuccucug

SEQ ID NO: 1146604 - RNA, 14 nt, Human
cuuucuuccucugc

SEQ ID NO: 1146605 - RNA, 15 nt, Human
cuuucuuccucugcu

SEQ ID NO: 1146606 - RNA, 17 nt, Human
cuuugcucauauuuccc

SEQ ID NO: 1146607 - RNA, 16 nt, Human
cuuugucacuguuuca

SEQ ID NO: 1146608 - RNA, 13 nt, Human
cuuuuucugcacu

SEQ ID NO: 1146609 - RNA, 14 nt, Human
cuuuuucugcacua

SEQ ID NO: 1146610 - RNA, 16 nt, Human
cuuuuucugcacuaua

SEQ ID NO: 1146611 - RNA, 20 nt, Human
cuuuuucugcacuauaugca

SEQ ID NO: 1146612 - RNA, 22 nt, Human
cuuuuucugcacuauaugcaaa

SEQ ID NO: 1146613 - RNA, 18 nt, Human
gaaaaucuuauaauuuaa

SEQ ID NO: 1146614 - RNA, 23 nt, Human
gaaugcuuaaagaauucaaauuu

SEQ ID NO: 1146615 - RNA, 21 nt, Human
gaaugcuuaaagaauucaaau

SEQ ID NO: 1146616 - RNA, 21 nt, Human
gaauuucuucaacucccugcc

SEQ ID NO: 1146617 - RNA, 16 nt, Human
gacaacagacuucuga

SEQ ID NO: 1146618 - RNA, 16 nt, Human
gacaaggaaaaaauaa

SEQ ID NO: 1146619 - RNA, 22 nt, Human
gacaagaaaggcugcuguacug

SEQ ID NO: 1146620 - RNA, 22 nt, Human
gacaauuagauaaauguccauu

SEQ ID NO: 1146621 - RNA, 13 nt, Human
gaccaccugccca

SEQ ID NO: 1146622 - RNA, 14 nt, Human
gaccaccugcccaa

SEQ ID NO: 1146623 - RNA, 20 nt, Human
gaccagccuccaugcugccu

SEQ ID NO: 1146624 - RNA, 21 nt, Human
gaccagccuccaugcugccuc

SEQ ID NO: 1146625 - RNA, 22 nt, Human
gaccagccuccaugcugccucc

SEQ ID NO: 1146626 - RNA, 12 nt, Human
gacccccaacca

SEQ ID NO: 1146627 - RNA, 21 nt, Human
gacccccaaccaaguggcucc

SEQ ID NO: 1146628 - RNA, 11 nt, Human
gacuccucugu

SEQ ID NO: 1146629 - RNA, 14 nt, Human
gacuccucugucca

SEQ ID NO: 1146630 - RNA, 23 nt, Human
gacuccugcacacgcuccuuccu

SEQ ID NO: 1146631 - RNA, 19 nt, Human
gacuuaaaauauuccugca

SEQ ID NO: 1146632 - RNA, 16 nt, Human
gacuugaagacuuaca

SEQ ID NO: 1146633 - RNA, 22 nt, Human
gagacugucucaagagggcacu

SEQ ID NO: 1146634 - RNA, 19 nt, Human
gagagagcuucuguugcug

SEQ ID NO: 1146635 - RNA, 22 nt, Human
gagagagcuucuguugcugccu

SEQ ID NO: 1146636 - RNA, 16 nt, Human
gagagcccuucauuug

SEQ ID NO: 1146637 - RNA, 16 nt, Human
gagaguggcuccuccc

SEQ ID NO: 1146638 - RNA, 21 nt, Human
gagaguggcuccucccggugc

SEQ ID NO: 1146639 - RNA, 17 nt, Human
gagaugaggccgccaug

SEQ ID NO: 1146640 - RNA, 15 nt, Human
gagcauuagauuucu

SEQ ID NO: 1146641 - RNA, 21 nt, Human
gagcauuagauuucucauuug

SEQ ID NO: 1146642 - RNA, 22 nt, Human
gagcccuguccugccuaaggcu

SEQ ID NO: 1146643 - RNA, 20 nt, Human
gagggagggggaaggcaggg

SEQ ID NO: 1146644 - RNA, 17 nt, Human
gaggggcugugggcgug

SEQ ID NO: 1146645 - RNA, 13 nt, Human
gauaaaucauuuu

SEQ ID NO: 1146646 - RNA, 14 nt, Human
gauaaaucauuuua

SEQ ID NO: 1146647 - RNA, 20 nt, Human
gauaaaucauuuuaugucaa

SEQ ID NO: 1146648 - RNA, 16 nt, Human
gaugccccgucccccu

SEQ ID NO: 1146649 - RNA, 21 nt, Human
gaugccccgucccccucuggc

SEQ ID NO: 1146650 - RNA, 17 nt, Human
gaugcugacuguacucc

SEQ ID NO: 1146651 - RNA, 20 nt, Human
gaugcugacuguacuccucc

SEQ ID NO: 1146652 - RNA, 13 nt, Human
gaugguuccccug

SEQ ID NO: 1146653 - RNA, 18 nt, Human
gaugguuccccuguucac

SEQ ID NO: 1146654 - RNA, 21 nt, Human
gaugguuccccuguucacucu

SEQ ID NO: 1146655 - RNA, 14 nt, Human
gauguggugaaaag

SEQ ID NO: 1146656 - RNA, 17 nt, Human
gauguuacuccaaaacu

SEQ ID NO: 1146657 - RNA, 20 nt, Human
gauuacaggcgugagccacc

SEQ ID NO: 1146658 - RNA, 17 nt, Human
gauuacaggcuccugcc

SEQ ID NO: 1146659 - RNA, 18 nt, Human
gauuacaggcuccugcca

SEQ ID NO: 1146660 - RNA, 21 nt, Human
gauuacaggcuccugccacca

SEQ ID NO: 1146661 - RNA, 16 nt, Human
gauucaauuugaugug

SEQ ID NO: 1146662 - RNA, 16 nt, Human
gauucucaugccucag

SEQ ID NO: 1146663 - RNA, 16 nt, Human
gauuugagcucagccc

SEQ ID NO: 1146664 - RNA, 15 nt, Human
gcaaauguggcuccu

SEQ ID NO: 1146665 - RNA, 14 nt, Human
gcaaauuggagaaa

SEQ ID NO: 1146666 - RNA, 15 nt, Human
gcaaauuggagaaaa

SEQ ID NO: 1146667 - RNA, 14 nt, Human
gcaauucuccugcc

SEQ ID NO: 1146668 - RNA, 15 nt, Human
gcaauucuccugccu

SEQ ID NO: 1146669 - RNA, 16 nt, Human
gcaauucuccugccuc

SEQ ID NO: 1146670 - RNA, 17 nt, Human
gcaauucuccugccuca

SEQ ID NO: 1146671 - RNA, 18 nt, Human
gcaauucuccugccucag

SEQ ID NO: 1146672 - RNA, 19 nt, Human
gcaauucuccugccucagc

SEQ ID NO: 1146673 - RNA, 20 nt, Human
gcaauucuccugccucagcc

SEQ ID NO: 1146674 - RNA, 13 nt, Human
gcacagugcaucu

SEQ ID NO: 1146675 - RNA, 15 nt, Human
gcacagugcaucuca

SEQ ID NO: 1146676 - RNA, 18 nt, Human
gcacagugcaucucagcc

SEQ ID NO: 1146677 - RNA, 19 nt, Human
gcacagugcaucucagccc

SEQ ID NO: 1146678 - RNA, 22 nt, Human
gcaccaguugcugcuucaauuu

SEQ ID NO: 1146679 - RNA, 14 nt, Human
gcacugcugcccag

SEQ ID NO: 1146680 - RNA, 15 nt, Human
gcacugcugcccagc

SEQ ID NO: 1146681 - RNA, 18 nt, Human
gcacugcugcccagccuc

SEQ ID NO: 1146682 - RNA, 20 nt, Human
gcacugcugcccagccucca

SEQ ID NO: 1146683 - RNA, 14 nt, Human
gcacugguggcccg

SEQ ID NO: 1146684 - RNA, 19 nt, Human
gcacugguggcccgacagc

SEQ ID NO: 1146685 - RNA, 12 nt, Human
gccccucccuuc

SEQ ID NO: 1146686 - RNA, 14 nt, Human
gccccucccuucaa

SEQ ID NO: 1146687 - RNA, 15 nt, Human
gccccucccuucaac

SEQ ID NO: 1146688 - RNA, 18 nt, Human
gccccuccucucugcccu

SEQ ID NO: 1146689 - RNA, 19 nt, Human
gccccuccucucugcccua

SEQ ID NO: 1146690 - RNA, 12 nt, Human
gccccuuccccc

SEQ ID NO: 1146691 - RNA, 17 nt, Human
gccccuucccccuccaa

SEQ ID NO: 1146692 - RNA, 17 nt, Human
gcccgacagccuggcac

SEQ ID NO: 1146693 - RNA, 19 nt, Human
gcccgacagccuggcacag

SEQ ID NO: 1146694 - RNA, 20 nt, Human
gcccugcuuugggcugcccu

SEQ ID NO: 1146695 - RNA, 21 nt, Human
gcccugcuuugggcugcccug

SEQ ID NO: 1146696 - RNA, 22 nt, Human
gcccugcuuugggcugcccugg

SEQ ID NO: 1146697 - RNA, 23 nt, Human
gcccugcuuugggcugcccuggu

SEQ ID NO: 1146698 - RNA, 15 nt, Human
gcccuggcucccaca

SEQ ID NO: 1146699 - RNA, 19 nt, Human
gcccuggcucccacaggcc

SEQ ID NO: 1146700 - RNA, 20 nt, Human
gcccuggcucccacaggccc

SEQ ID NO: 1146701 - RNA, 11 nt, Human
gcccugggagg

SEQ ID NO: 1146702 - RNA, 14 nt, Human
gcccugggaggcag

SEQ ID NO: 1146703 - RNA, 16 nt, Human
gcccugggaggcagug

SEQ ID NO: 1146704 - RNA, 15 nt, Human
gcccuggugcugcca

SEQ ID NO: 1146705 - RNA, 16 nt, Human
gcccuggugcugccac

SEQ ID NO: 1146706 - RNA, 17 nt, Human
gcccuggugcugccaca

SEQ ID NO: 1146707 - RNA, 21 nt, Human
gcccuggugcugccacacuuc

SEQ ID NO: 1146708 - RNA, 14 nt, Human
gcccugguuuccug

SEQ ID NO: 1146709 - RNA, 15 nt, Human
gcccugguuuccugc

SEQ ID NO: 1146710 - RNA, 17 nt, Human
gcccugguuuccugccc

SEQ ID NO: 1146711 - RNA, 18 nt, Human
gcccugguuuccugcccu

SEQ ID NO: 1146712 - RNA, 19 nt, Human
gcccugguuuccugcccug

SEQ ID NO: 1146713 - RNA, 20 nt, Human
gcccugguuuccugcccugg

SEQ ID NO: 1146714 - RNA, 21 nt, Human
gcccugguuuccugcccuggg

SEQ ID NO: 1146715 - RNA, 23 nt, Human
gcccugguuuccugcccugggag

SEQ ID NO: 1146716 - RNA, 17 nt, Human
gcccuuccucuccacug

SEQ ID NO: 1146717 - RNA, 18 nt, Human
gcccuuccucuccacugc

SEQ ID NO: 1146718 - RNA, 19 nt, Human
gcccuuccucuccacugcc

SEQ ID NO: 1146719 - RNA, 21 nt, Human
gcccuuccucuccacugccuu

SEQ ID NO: 1146720 - RNA, 20 nt, Human
gcccuuccucuccacugccu

SEQ ID NO: 1146721 - RNA, 16 nt, Human
gccuaaggcugaacuu

SEQ ID NO: 1146722 - RNA, 14 nt, Human
gccucagccucccg

SEQ ID NO: 1146723 - RNA, 15 nt, Human
gccucagucucccuc

SEQ ID NO: 1146724 - RNA, 18 nt, Human
gccucagucucccucccu

SEQ ID NO: 1146725 - RNA, 21 nt, Human
gccucggacuuagcugggaga

SEQ ID NO: 1146726 - RNA, 12 nt, Human
gccucugccugu

SEQ ID NO: 1146727 - RNA, 13 nt, Human
gccucugccuguc

SEQ ID NO: 1146728 - RNA, 18 nt, Human
gccucugcugauccuccc

SEQ ID NO: 1146729 - RNA, 19 nt, Human
gccucugcugauccuccca

SEQ ID NO: 1146730 - RNA, 13 nt, Human
gccuggccacgcc

SEQ ID NO: 1146731 - RNA, 17 nt, Human
gccugugaacugaacuc

SEQ ID NO: 1146732 - RNA, 15 nt, Human
gcgugagaccugccc

SEQ ID NO: 1146733 - RNA, 13 nt, Human
gcuaacaugaaga

SEQ ID NO: 1146734 - RNA, 22 nt, Human
gcuaacaugaagaccuuuuucu

SEQ ID NO: 1146735 - RNA, 16 nt, Human
gcuccaaaugcagcuu

SEQ ID NO: 1146736 - RNA, 17 nt, Human
gcuccagcuggccggga

SEQ ID NO: 1146737 - RNA, 23 nt, Human
gcuccagcuggccgggagccuga

SEQ ID NO: 1146738 - RNA, 14 nt, Human
gcuccaucuccacu

SEQ ID NO: 1146739 - RNA, 16 nt, Human
gcuccauuuaaacaga

SEQ ID NO: 1146740 - RNA, 23 nt, Human
gcuccauuuaaacagauguccau

SEQ ID NO: 1146741 - RNA, 20 nt, Human
gcuccauuuuuagugaaaua

SEQ ID NO: 1146742 - RNA, 19 nt, Human
gcuccauuuaaacagaugu

SEQ ID NO: 1146743 - RNA, 15 nt, Human
gcucuccucuugcca

SEQ ID NO: 1146744 - RNA, 19 nt, Human
gcucuccucuugccacugc

SEQ ID NO: 1146745 - RNA, 22 nt, Human
gcucuccucuugccacugccuc

SEQ ID NO: 1146746 - RNA, 13 nt, Human
gcucuucuccuuu

SEQ ID NO: 1146747 - RNA, 17 nt, Human
gcucuucuccuuucaca

SEQ ID NO: 1146748 - RNA, 21 nt, Human
gcucuucuccuuucacaaccu

SEQ ID NO: 1146749 - RNA, 23 nt, Human
gcucuucuccuuucacaaccuuc

SEQ ID NO: 1146750 - RNA, 17 nt, Human
gcugacagacagcccuc

SEQ ID NO: 1146751 - RNA, 18 nt, Human
gcugacuguacuccuccc

SEQ ID NO: 1146752 - RNA, 19 nt, Human
gcugacuguacuccuccca

SEQ ID NO: 1146753 - RNA, 21 nt, Human
gcugacuguacuccucccagg

SEQ ID NO: 1146754 - RNA, 21 nt, Human
gcugagucccaggcugagccu

SEQ ID NO: 1146755 - RNA, 22 nt, Human
gcugagucccaggcugagccuc

SEQ ID NO: 1146756 - RNA, 20 nt, Human
gcugugggcgugagaccugc

SEQ ID NO: 1146757 - RNA, 21 nt, Human
gcugugggcgugagaccugcc

SEQ ID NO: 1146758 - RNA, 22 nt, Human
gcugugggcgugagaccugccc

SEQ ID NO: 1146759 - RNA, 15 nt, Human
gcuuuguaugcacuu

SEQ ID NO: 1146760 - RNA, 13 nt, Human
gcuuuucacugcu

SEQ ID NO: 1146761 - RNA, 14 nt, Human
gcuuuucacugcug

SEQ ID NO: 1146762 - RNA, 18 nt, Human
gcuuuucacugcuggcug

SEQ ID NO: 1146763 - RNA, 22 nt, Human
gcuuuucacugcuggcugccuu

SEQ ID NO: 1146764 - RNA, 23 nt, Human
gcuuuucacugcuggcugccuua

SEQ ID NO: 1146765 - RNA, 21 nt, Human
ggaaaaccaagccguggcuuc

SEQ ID NO: 1146766 - RNA, 13 nt, Human
ggaaccugacccc

SEQ ID NO: 1146767 - RNA, 14 nt, Human
ggaaggcagggagg

SEQ ID NO: 1146768 - RNA, 17 nt, Human
ggaaggcugagaggaga

SEQ ID NO: 1146769 - RNA, 19 nt, Human
ggaagguacuguaugauca

SEQ ID NO: 1146770 - RNA, 13 nt, Human
ggaaguaguuauc

SEQ ID NO: 1146771 - RNA, 16 nt, Human
ggaaguaguuaucaug

SEQ ID NO: 1146772 - RNA, 19 nt, Human
ggaaguaguuaucauguua

SEQ ID NO: 1146773 - RNA, 11 nt, Human
ggacaaaauga

SEQ ID NO: 1146774 - RNA, 11 nt, Human
ggacaaacugc

SEQ ID NO: 1146775 - RNA, 18 nt, Human
ggacuggccucugcugau

SEQ ID NO: 1146776 - RNA, 22 nt, Human
ggaucaaaccccgaccaccugc

SEQ ID NO: 1146777 - RNA, 19 nt, Human
ggauuacaggcuccugcca

SEQ ID NO: 1146778 - RNA, 18 nt, Human
ggcaccggggccucggac

SEQ ID NO: 1146779 - RNA, 17 nt, Human
ggcauggccagguggcc

SEQ ID NO: 1146780 - RNA, 18 nt, Human
ggcauggccagguggcca

SEQ ID NO: 1146781 - RNA, 17 nt, Human
ggccacuccagaccccu

SEQ ID NO: 1146782 - RNA, 11 nt, Human
ggccaggcugc

SEQ ID NO: 1146783 - RNA, 14 nt, Human
ggccaggcugcucu

SEQ ID NO: 1146784 - RNA, 15 nt, Human
ggccaggcugcucuu

SEQ ID NO: 1146785 - RNA, 16 nt, Human
ggccaggcugcucuug

SEQ ID NO: 1146786 - RNA, 11 nt, Human
ggcccugcccu

SEQ ID NO: 1146787 - RNA, 12 nt, Human
ggcccugcccug

SEQ ID NO: 1146788 - RNA, 13 nt, Human
ggcccugcccugg

SEQ ID NO: 1146789 - RNA, 20 nt, Human
ggcccugcccugguuuccug

SEQ ID NO: 1146790 - RNA, 22 nt, Human
ggcccugcccugguuuccugcc

SEQ ID NO: 1146791 - RNA, 13 nt, Human
ggcccuggcuccc

SEQ ID NO: 1146792 - RNA, 22 nt, Human
ggcccuggcucccacaggcccu

SEQ ID NO: 1146793 - RNA, 20 nt, Human
ggccucggacuuagcuggga

SEQ ID NO: 1146794 - RNA, 22 nt, Human
ggccucggacuuagcugggaga

SEQ ID NO: 1146795 - RNA, 19 nt, Human
ggcuaugggggcacugagg

SEQ ID NO: 1146796 - RNA, 12 nt, Human
ggcuccagcugg

SEQ ID NO: 1146797 - RNA, 17 nt, Human
ggcucccacaggcccuu

SEQ ID NO: 1146798 - RNA, 18 nt, Human
ggcucccacaggcccuuc

SEQ ID NO: 1146799 - RNA, 19 nt, Human
ggcucccacaggcccuucc

SEQ ID NO: 1146800 - RNA, 20 nt, Human
ggcucccacaggcccuuccu

SEQ ID NO: 1146801 - RNA, 21 nt, Human
ggcucccacaggcccuuccuc

SEQ ID NO: 1146802 - RNA, 10 nt, Human
gggccuggca

SEQ ID NO: 1146803 - RNA, 22 nt, Human
gggccuggcagccgugccuuca

SEQ ID NO: 1146804 - RNA, 16 nt, Human
ggggcagcagcagugg

SEQ ID NO: 1146805 - RNA, 20 nt, Human
gggguucuuucuuccucugc

SEQ ID NO: 1146806 - RNA, 22 nt, Human
gggguucuuucuuccucugcug

SEQ ID NO: 1146807 - RNA, 22 nt, Human
ggguuccagcaauucuccugcc

SEQ ID NO: 1146808 - RNA, 16 nt, Human
ggguucuuucuuccuc

SEQ ID NO: 1146809 - RNA, 14 nt, Human
ggguucuuucuucc

SEQ ID NO: 1146810 - RNA, 20 nt, Human
ggguuucaccauguuggcca

SEQ ID NO: 1146811 - RNA, 17 nt, Human
gguacuguaugaucaaa

SEQ ID NO: 1146812 - RNA, 18 nt, Human
gguacuguaugaucaaau

SEQ ID NO: 1146813 - RNA, 20 nt, Human
gguacuguaugaucaaaugu

SEQ ID NO: 1146814 - RNA, 21 nt, Human
gguacuguaugaucaaauguu

SEQ ID NO: 1146815 - RNA, 19 nt, Human
ggucucgaacuccugaccu

SEQ ID NO: 1146816 - RNA, 20 nt, Human
ggucucgaacuccugaccuu

SEQ ID NO: 1146817 - RNA, 22 nt, Human
ggugauagguauaaguggugug

SEQ ID NO: 1146818 - RNA, 17 nt, Human
ggugccuaguauugaca

SEQ ID NO: 1146819 - RNA, 19 nt, Human
ggugccuaguauugacaaa

SEQ ID NO: 1146820 - RNA, 16 nt, Human
gguggcccgacagccu

SEQ ID NO: 1146821 - RNA, 17 nt, Human
gguggcccgacagccug

SEQ ID NO: 1146822 - RNA, 18 nt, Human
gguggcccgacagccugg

SEQ ID NO: 1146823 - RNA, 19 nt, Human
gguggcccgacagccuggc

SEQ ID NO: 1146824 - RNA, 20 nt, Human
gguggcccgacagccuggca

SEQ ID NO: 1146825 - RNA, 18 nt, Human
gguucuuucuuccucugc

SEQ ID NO: 1146826 - RNA, 14 nt, Human
gguuuuuauuuccu

SEQ ID NO: 1146827 - RNA, 13 nt, Human
guaaaaauaaaau

SEQ ID NO: 1146828 - RNA, 14 nt, Human
guaaaaauaaaauu

SEQ ID NO: 1146829 - RNA, 19 nt, Human
guaaaacaaacaauaccug

SEQ ID NO: 1146830 - RNA, 19 nt, Human
guaaaugucucacugagca

SEQ ID NO: 1146831 - RNA, 17 nt, Human
guaaaugucucacugag

SEQ ID NO: 1146832 - RNA, 15 nt, Human
guaaucguguccccu

SEQ ID NO: 1146833 - RNA, 14 nt, Human
guaaugaauaccuu

SEQ ID NO: 1146834 - RNA, 18 nt, Human
guaaugaugucguuugaa

SEQ ID NO: 1146835 - RNA, 16 nt, Human
guaaugcgccaauaaa

SEQ ID NO: 1146836 - RNA, 17 nt, Human
guaaugcgccaauaaac

SEQ ID NO: 1146837 - RNA, 22 nt, Human
guacauagugcuaacaugaaga

SEQ ID NO: 1146838 - RNA, 23 nt, Human
guacuuuauuuucuauaauuuaa

SEQ ID NO: 1146839 - RNA, 19 nt, Human
guauuuauuuaguauuuau

SEQ ID NO: 1146840 - RNA, 15 nt, Human
gucaagauucagcua

SEQ ID NO: 1146841 - RNA, 16 nt, Human
gucaagauucagcuag

SEQ ID NO: 1146842 - RNA, 19 nt, Human
gucaagauucagcuagugg

SEQ ID NO: 1146843 - RNA, 16 nt, Human
gucaucucagcuggau

SEQ ID NO: 1146844 - RNA, 19 nt, Human
guccuggggaaccugaccc

SEQ ID NO: 1146845 - RNA, 20 nt, Human
guccuggggaaccugacccc

SEQ ID NO: 1146846 - RNA, 22 nt, Human
gucuacauaacuaauacagcug

SEQ ID NO: 1146847 - RNA, 15 nt, Human
gucuaccaauuauaa

SEQ ID NO: 1146848 - RNA, 14 nt, Human
gucucuucuccacu

SEQ ID NO: 1146849 - RNA, 15 nt, Human
gucucuucuccacug

SEQ ID NO: 1146850 - RNA, 16 nt, Human
gucucuucuccacugg

SEQ ID NO: 1146851 - RNA, 17 nt, Human
gucucuucuccacugga

SEQ ID NO: 1146852 - RNA, 16 nt, Human
gugaaaaugugugugu

SEQ ID NO: 1146853 - RNA, 19 nt, Human
gugaaagaaaauaacaaua

SEQ ID NO: 1146854 - RNA, 14 nt, Human
gugaaucagagcac

SEQ ID NO: 1146855 - RNA, 16 nt, Human
gugaccucagcuuuga

SEQ ID NO: 1146856 - RNA, 15 nt, Human
gugagccaccacgcc

SEQ ID NO: 1146857 - RNA, 16 nt, Human
gugagccaccacgccc

SEQ ID NO: 1146858 - RNA, 15 nt, Human
gugagccaccgugcc

SEQ ID NO: 1146859 - RNA, 17 nt, Human
gugagccaccgugccug

SEQ ID NO: 1146860 - RNA, 21 nt, Human
gugagccaccgugccuggcca

SEQ ID NO: 1146861 - RNA, 22 nt, Human
gugagccaccgugccuggccac

SEQ ID NO: 1146862 - RNA, 23 nt, Human
gugaggauuaaauaauguaaaua

SEQ ID NO: 1146863 - RNA, 20 nt, Human
gugauucucaugccucagcc

SEQ ID NO: 1146864 - RNA, 22 nt, Human
gugcaaaguucccuacuuccug

SEQ ID NO: 1146865 - RNA, 15 nt, Human
gugcaucucagccca

SEQ ID NO: 1146866 - RNA, 18 nt, Human
gugcaucucagcccacau

SEQ ID NO: 1146867 - RNA, 18 nt, Human
gugcaugcagcaucuaag

SEQ ID NO: 1146868 - RNA, 12 nt, Human
gugcugccacac

SEQ ID NO: 1146869 - RNA, 21 nt, Human
gugcugccacacuucaggcuc

SEQ ID NO: 1146870 - RNA, 14 nt, Human
gugcuguuguuaug

SEQ ID NO: 1146871 - RNA, 15 nt, Human
gugcuguuguuauga

SEQ ID NO: 1146872 - RNA, 17 nt, Human
gugcuguuguuaugaug

SEQ ID NO: 1146873 - RNA, 19 nt, Human
gugcuguuguuaugaugug

SEQ ID NO: 1146874 - RNA, 20 nt, Human
gugcuguuguuaugaugugc

SEQ ID NO: 1146875 - RNA, 22 nt, Human
gugcuguuguuaugaugugcuu

SEQ ID NO: 1146876 - RNA, 18 nt, Human
gugcuuauguaugaggua

SEQ ID NO: 1146877 - RNA, 13 nt, Human
guggacuuuuauu

SEQ ID NO: 1146878 - RNA, 18 nt, Human
guggagaggcccggccuc

SEQ ID NO: 1146879 - RNA, 21 nt, Human
guggccacuccagaccccugg

SEQ ID NO: 1146880 - RNA, 17 nt, Human
uaggccguuccuucaaa

SEQ ID NO: 1146881 - RNA, 20 nt, Human
uagguauaaguggugugugu

SEQ ID NO: 1146882 - RNA, 16 nt, Human
uaggucagugcaaaua

SEQ ID NO: 1146883 - RNA, 21 nt, Human
uaggugauccacucgccuuca

SEQ ID NO: 1146884 - RNA, 16 nt, Human
uagugcaguuauuugc

SEQ ID NO: 1146885 - RNA, 15 nt, Human
uagugcuaacaugaa

SEQ ID NO: 1146886 - RNA, 16 nt, Human
uaucugccucucuugu

SEQ ID NO: 1146887 - RNA, 20 nt, Human
uaucugccucucuuguaauu

SEQ ID NO: 1146888 - RNA, 21 nt, Human
uaucugccucucuuguaauuu

SEQ ID NO: 1146889 - RNA, 19 nt, Human
uaucuguuugagaaaguca

SEQ ID NO: 1146890 - RNA, 15 nt, Human
uaucuguuugagaaa

SEQ ID NO: 1146891 - RNA, 16 nt, Human
uaucuguuugagaaag

SEQ ID NO: 1146892 - RNA, 18 nt, Human
uaugaauaaagacaccua

SEQ ID NO: 1146893 - RNA, 15 nt, Human
uaugacaguaauugu

SEQ ID NO: 1146894 - RNA, 17 nt, Human
uaugacaguaauugugu

SEQ ID NO: 1146895 - RNA, 18 nt, Human
uaugacaguaauuguguu

SEQ ID NO: 1146896 - RNA, 22 nt, Human
uaugacaguaauuguguuuaca

SEQ ID NO: 1146897 - RNA, 23 nt, Human
uaugacaguaauuguguuuacau

SEQ ID NO: 1146898 - RNA, 14 nt, Human
uaugaccacacucc

SEQ ID NO: 1146899 - RNA, 19 nt, Human
uaugaccacacuccagcug

SEQ ID NO: 1146900 - RNA, 21 nt, Human
uaugauuagcuuugucacugu

SEQ ID NO: 1146901 - RNA, 15 nt, Human
uaugauuuggaaaau

SEQ ID NO: 1146902 - RNA, 17 nt, Human
uaugauuuggaaaauaa

SEQ ID NO: 1146903 - RNA, 18 nt, Human
uaugauuuggaaaauaaa

SEQ ID NO: 1146904 - RNA, 16 nt, Human
uaugcaaacaggguaa

SEQ ID NO: 1146905 - RNA, 18 nt, Human
uaugcagagguccacaac

SEQ ID NO: 1146906 - RNA, 20 nt, Human
uaugcuuauauuguucacuu

SEQ ID NO: 1146907 - RNA, 17 nt, Human
uauguugaagccuuugu

SEQ ID NO: 1146908 - RNA, 17 nt, Human
uauuauauuuacaaaug

SEQ ID NO: 1146909 - RNA, 14 nt, Human
uauuaugauuagcu

SEQ ID NO: 1146910 - RNA, 20 nt, Human
uauugcaaagucaggaauca

SEQ ID NO: 1146911 - RNA, 14 nt, Human
uauugcaaagucag

SEQ ID NO: 1146912 - RNA, 19 nt, Human
uauuugagaagcugcucaa

SEQ ID NO: 1146913 - RNA, 19 nt, Human
ucaaaccccgaccaccugc

SEQ ID NO: 1146914 - RNA, 20 nt, Human
ucaaaccccgaccaccugcc

SEQ ID NO: 1146915 - RNA, 23 nt, Human
ucaaaccccgaccaccugcccaa

SEQ ID NO: 1146916 - RNA, 12 nt, Human
ucaaauguuuaa

SEQ ID NO: 1146917 - RNA, 14 nt, Human
ucaaauguuuaauc

SEQ ID NO: 1146918 - RNA, 15 nt, Human
ucaaauguuuaauca

SEQ ID NO: 1146919 - RNA, 17 nt, Human
ucaaauguuuaaucaua

SEQ ID NO: 1146920 - RNA, 18 nt, Human
ucaaauguuuaaucauau

SEQ ID NO: 1146921 - RNA, 20 nt, Human
ucaaauguuuaaucauauaa

SEQ ID NO: 1146922 - RNA, 21 nt, Human
ucaaauguuuaaucauauaaa

SEQ ID NO: 1146923 - RNA, 14 nt, Human
ucaacucccugccc

SEQ ID NO: 1146924 - RNA, 15 nt, Human
ucaacucccugcccc

SEQ ID NO: 1146925 - RNA, 21 nt, Human
ucaacucccugccccccagcc

SEQ ID NO: 1146926 - RNA, 22 nt, Human
ucaacucccugccccccagccc

SEQ ID NO: 1146927 - RNA, 19 nt, Human
ucaacucuugaguuuuuca

SEQ ID NO: 1146928 - RNA, 18 nt, Human
ucaacugaccagccucca

SEQ ID NO: 1146929 - RNA, 24 nt, Human
ucaacugaccagccuccaugcugc

SEQ ID NO: 1146930 - RNA, 17 nt, Human
ucacaggacucugccuc

SEQ ID NO: 1146931 - RNA, 18 nt, Human
ucacaggacucugccucc

SEQ ID NO: 1146932 - RNA, 19 nt, Human
ucacaggacucugccuccu

SEQ ID NO: 1146933 - RNA, 23 nt, Human
ucacaggacucugccuccucuuc

SEQ ID NO: 1146934 - RNA, 19 nt, Human
ucacaggagggagggggaa

SEQ ID NO: 1146935 - RNA, 12 nt, Human
ucacauuuaaau

SEQ ID NO: 1146936 - RNA, 20 nt, Human
ucacccuggggcuaggaaau

SEQ ID NO: 1146937 - RNA, 22 nt, Human
ucaggaaucaucaggaacguuu

SEQ ID NO: 1146938 - RNA, 20 nt, Human
ucaggaucaaaccccgacca

SEQ ID NO: 1146939 - RNA, 16 nt, Human
ucaggcucuucuccuu

SEQ ID NO: 1146940 - RNA, 21 nt, Human
ucaggcucuucuccuuucaca

SEQ ID NO: 1146941 - RNA, 12 nt, Human
ucaggucccugc

SEQ ID NO: 1146942 - RNA, 16 nt, Human
ucagucucccucccuu

SEQ ID NO: 1146943 - RNA, 17 nt, Human
ucaucauucacuucacu

SEQ ID NO: 1146944 - RNA, 19 nt, Human
ucaucauucacuucacugu

SEQ ID NO: 1146945 - RNA, 21 nt, Human
ucaucauucacuucacugugc

SEQ ID NO: 1146946 - RNA, 22 nt, Human
ucaucauucacuucacugugcu

SEQ ID NO: 1146947 - RNA, 23 nt, Human
ucaucauucacuucacugugcug

SEQ ID NO: 1146948 - RNA, 14 nt, Human
uccaaacauccucu

SEQ ID NO: 1146949 - RNA, 19 nt, Human
uccaaacuaccuuccaguu

SEQ ID NO: 1146950 - RNA, 22 nt, Human
uccagcaauucuccugccucag

SEQ ID NO: 1146951 - RNA, 19 nt, Human
uccaguucuucgacuguug

SEQ ID NO: 1146952 - RNA, 23 nt, Human
uccaguucuucgacuguuguuau

SEQ ID NO: 1146953 - RNA, 21 nt, Human
uccaguucuucgacuguuguu

SEQ ID NO: 1146954 - RNA, 22 nt, Human
uccauaaucuggacuccucugu

SEQ ID NO: 1146955 - RNA, 21 nt, Human
uccauaaucuggacuccucug

SEQ ID NO: 1146956 - RNA, 17 nt, Human
uccauagaccuuuucau

SEQ ID NO: 1146957 - RNA, 16 nt, Human
uccaucagaugacaag

SEQ ID NO: 1146958 - RNA, 14 nt, Human
uccaucaggccacu

SEQ ID NO: 1146959 - RNA, 14 nt, Human
uccaugcugccucc

SEQ ID NO: 1146960 - RNA, 15 nt, Human
uccaugcugccucca

SEQ ID NO: 1146961 - RNA, 20 nt, Human
uccaugggccauaugaaaag

SEQ ID NO: 1146962 - RNA, 18 nt, Human
ucccaggcgccccuuccc

SEQ ID NO: 1146963 - RNA, 16 nt, Human
ucccaggcgccccuuc

SEQ ID NO: 1146964 - RNA, 17 nt, Human
uccuaucagaaguuucu

SEQ ID NO: 1146965 - RNA, 11 nt, Human
uccugccacca

SEQ ID NO: 1146966 - RNA, 16 nt, Human
uccugccaccacgccc

SEQ ID NO: 1146967 - RNA, 10 nt, Human
uccugcccug

SEQ ID NO: 1146968 - RNA, 11 nt, Human
uccugcccugg

SEQ ID NO: 1146969 - RNA, 12 nt, Human
uccugcccuggg

SEQ ID NO: 1146970 - RNA, 14 nt, Human
uccugcccugggag

SEQ ID NO: 1146971 - RNA, 15 nt, Human
uccugcccugggagg

SEQ ID NO: 1146972 - RNA, 21 nt, Human
uccugcccugggaggcaguga

SEQ ID NO: 1146973 - RNA, 16 nt, Human
uccugccuaaggcuga

SEQ ID NO: 1146974 - RNA, 19 nt, Human
uccugccuaaggcugaacu

SEQ ID NO: 1146975 - RNA, 17 nt, Human
uccuggagguuccccag

SEQ ID NO: 1146976 - RNA, 19 nt, Human
uccuggagguuccccagcc

SEQ ID NO: 1146977 - RNA, 22 nt, Human
uccuggagguuccccagcccca

SEQ ID NO: 1146978 - RNA, 15 nt, Human
ucggcacuguacaaa

SEQ ID NO: 1146979 - RNA, 16 nt, Human
ucguguccccuauccu

SEQ ID NO: 1146980 - RNA, 14 nt, Human
ucuaucaccaagga

SEQ ID NO: 1146981 - RNA, 13 nt, Human
ucucaugccucag

SEQ ID NO: 1146982 - RNA, 16 nt, Human
ucucaugccucagccu

SEQ ID NO: 1146983 - RNA, 19 nt, Human
ucucaugccucagccuccu

SEQ ID NO: 1146984 - RNA, 20 nt, Human
ucucaugccucagccuccug

SEQ ID NO: 1146985 - RNA, 13 nt, Human
ucuccacuccaga

SEQ ID NO: 1146986 - RNA, 14 nt, Human
ucuccacugccuuc

SEQ ID NO: 1146987 - RNA, 14 nt, Human
ucucccucccuugg

SEQ ID NO: 1146988 - RNA, 13 nt, Human
ucuccucuugcca

SEQ ID NO: 1146989 - RNA, 16 nt, Human
ucuccucuugccacug

SEQ ID NO: 1146990 - RNA, 22 nt, Human
ucuccucuugccacugccucuu

SEQ ID NO: 1146991 - RNA, 17 nt, Human
ucuccucuugccacugc

SEQ ID NO: 1146992 - RNA, 20 nt, Human
ucuugcaguaucggcacugu

SEQ ID NO: 1146993 - RNA, 21 nt, Human
ucuugcaguaucggcacugua

SEQ ID NO: 1146994 - RNA, 12 nt, Human
ucuuugccaagu

SEQ ID NO: 1146995 - RNA, 22 nt, Human
ugaaaagcagguugauaaauca

SEQ ID NO: 1146996 - RNA, 18 nt, Human
ugaaaagcagguugauaa

SEQ ID NO: 1146997 - RNA, 19 nt, Human
ugaaaagcagguugauaaa

SEQ ID NO: 1146998 - RNA, 20 nt, Human
ugaaaagcuccauuuuuagu

SEQ ID NO: 1146999 - RNA, 19 nt, Human
ugaaagauggcugugccuc

SEQ ID NO: 1147000 - RNA, 18 nt, Human
ugaaagauggcugugccu

SEQ ID NO: 1147001 - RNA, 16 nt, Human
ugaaaucaguuacucu

SEQ ID NO: 1147002 - RNA, 17 nt, Human
ugaaaucaguuacucuu

SEQ ID NO: 1147003 - RNA, 15 nt, Human
ugaaauuccauuugu

SEQ ID NO: 1147004 - RNA, 16 nt, Human
ugaaauuccauuugua

SEQ ID NO: 1147005 - RNA, 16 nt, Human
ugaacucugacaacag

SEQ ID NO: 1147006 - RNA, 20 nt, Human
ugaaggaauaaauugcuccu

SEQ ID NO: 1147007 - RNA, 16 nt, Human
ugaaggagagcccuuc

SEQ ID NO: 1147008 - RNA, 20 nt, Human
ugaaggagagcccuucauuu

SEQ ID NO: 1147009 - RNA, 14 nt, Human
ugaauaaagacacc

SEQ ID NO: 1147010 - RNA, 15 nt, Human
ugaauaaagacaccu

SEQ ID NO: 1147011 - RNA, 22 nt, Human
ugacaagaaaggcugcuguacu

SEQ ID NO: 1147012 - RNA, 23 nt, Human
ugacaagaaaggcugcuguacug

SEQ ID NO: 1147013 - RNA, 21 nt, Human
ugacaagcuccauuuaaacag

SEQ ID NO: 1147014 - RNA, 18 nt, Human
ugacaagcuccauuuaaa

SEQ ID NO: 1147015 - RNA, 16 nt, Human
ugacagacagcccucc

SEQ ID NO: 1147016 - RNA, 22 nt, Human
ugaccucagcuuugauauuuca

SEQ ID NO: 1147017 - RNA, 16 nt, Human
ugagcaguguuagcuu

SEQ ID NO: 1147018 - RNA, 18 nt, Human
ugagcccuguccugccua

SEQ ID NO: 1147019 - RNA, 14 nt, Human
ugagccucagucuc

SEQ ID NO: 1147020 - RNA, 23 nt, Human
ugaggcaucgcaauguaagacuc

SEQ ID NO: 1147021 - RNA, 15 nt, Human
ugagucccaggcuga

SEQ ID NO: 1147022 - RNA, 19 nt, Human
ugagucccaggcugagccu

SEQ ID NO: 1147023 - RNA, 22 nt, Human
ugaguuugggccccagaggcug

SEQ ID NO: 1147024 - RNA, 23 nt, Human
ugaguuugggccccagaggcugg

SEQ ID NO: 1147025 - RNA, 15 nt, Human
ugaucugugggcaca

SEQ ID NO: 1147026 - RNA, 15 nt, Human
ugaugccugugaacu

SEQ ID NO: 1147027 - RNA, 20 nt, Human
ugaugccugugaacugaacu

SEQ ID NO: 1147028 - RNA, 20 nt, Human
ugaugcuacaggauuugaaa

SEQ ID NO: 1147029 - RNA, 23 nt, Human
ugaugcuacaggauuugaaauug

SEQ ID NO: 1147030 - RNA, 21 nt, Human
ugaugccugugaacugaacuc

SEQ ID NO: 1147031 - RNA, 14 nt, Human
ugaugguuccccug

SEQ ID NO: 1147032 - RNA, 19 nt, Human
ugaugucccaacuuguaaa

SEQ ID NO: 1147033 - RNA, 16 nt, Human
ugauguggugaaaagc

SEQ ID NO: 1147034 - RNA, 19 nt, Human
ugauuagcuuugucacugu

SEQ ID NO: 1147035 - RNA, 22 nt, Human
ugauuagugaaaggaagauaaa

SEQ ID NO: 1147036 - RNA, 13 nt, Human
ugauuauauguca

SEQ ID NO: 1147037 - RNA, 14 nt, Human
ugauucaauuugau

SEQ ID NO: 1147038 - RNA, 16 nt, Human
ugauucaauuugaugu

SEQ ID NO: 1147039 - RNA, 19 nt, Human
ugauucaauuugauguggu

SEQ ID NO: 1147040 - RNA, 12 nt, Human
ugauucacagug

SEQ ID NO: 1147041 - RNA, 21 nt, Human
ugauugaccguguuggucugu

SEQ ID NO: 1147042 - RNA, 20 nt, Human
ugauuggcaggaguuggaag

SEQ ID NO: 1147043 - RNA, 14 nt, Human
ugcaguuauuugcu

SEQ ID NO: 1147044 - RNA, 15 nt, Human
ugccccucccuucaa

SEQ ID NO: 1147045 - RNA, 16 nt, Human
ugccccucccuucaac

SEQ ID NO: 1147046 - RNA, 17 nt, Human
ugccccuccucucugcc

SEQ ID NO: 1147047 - RNA, 18 nt, Human
ugccccuccucucugccc

SEQ ID NO: 1147048 - RNA, 19 nt, Human
ugccccuccucucugcccu

SEQ ID NO: 1147049 - RNA, 20 nt, Human
ugccccuccucucugcccua

SEQ ID NO: 1147050 - RNA, 13 nt, Human
ugcccugggaggc

SEQ ID NO: 1147051 - RNA, 15 nt, Human
ugcccugggaggcag

SEQ ID NO: 1147052 - RNA, 17 nt, Human
ugcccugggaggcagug

SEQ ID NO: 1147053 - RNA, 18 nt, Human
ugcccugggaggcaguga

SEQ ID NO: 1147054 - RNA, 12 nt, Human
ugcccuggugcu

SEQ ID NO: 1147055 - RNA, 14 nt, Human
ugcccuggugcugc

SEQ ID NO: 1147056 - RNA, 16 nt, Human
ugcccuggugcugcca

SEQ ID NO: 1147057 - RNA, 17 nt, Human
ugcccuggugcugccac

SEQ ID NO: 1147058 - RNA, 18 nt, Human
ugcccuggugcugccaca

SEQ ID NO: 1147059 - RNA, 17 nt, Human
ugcccugguuuccugcc

SEQ ID NO: 1147060 - RNA, 18 nt, Human
ugcccugguuuccugccc

SEQ ID NO: 1147061 - RNA, 19 nt, Human
ugcccugguuuccugcccu

SEQ ID NO: 1147062 - RNA, 20 nt, Human
ugcccugguuuccugcccug

SEQ ID NO: 1147063 - RNA, 23 nt, Human
ugcccugguuuccugcccuggga

SEQ ID NO: 1147064 - RNA, 17 nt, Human
ugccuaguauugacaaa

SEQ ID NO: 1147065 - RNA, 18 nt, Human
ugccuaguauugacaaaa

SEQ ID NO: 1147066 - RNA, 22 nt, Human
ugccuaguauugacaaaauguu

SEQ ID NO: 1147067 - RNA, 21 nt, Human
ugccuaguauugacaaaaugu

SEQ ID NO: 1147068 - RNA, 14 nt, Human
ugccuccucuucaa

SEQ ID NO: 1147069 - RNA, 16 nt, Human
ugccuccucuucaacu

SEQ ID NO: 1147070 - RNA, 21 nt, Human
ugcgcaggcuggcccugcccu

SEQ ID NO: 1147071 - RNA, 22 nt, Human
ugcgcaggcuggcccugcccug

SEQ ID NO: 1147072 - RNA, 23 nt, Human
ugcgcaggcuggcccugcccugg

SEQ ID NO: 1147073 - RNA, 19 nt, Human
ugcuaacaugaagaccuuu

SEQ ID NO: 1147074 - RNA, 22 nt, Human
ugcuaagacucaguggggaggg

SEQ ID NO: 1147075 - RNA, 14 nt, Human
ugcucauauuuccc

SEQ ID NO: 1147076 - RNA, 15 nt, Human
ugcucauauuuccca

SEQ ID NO: 1147077 - RNA, 22 nt, Human
ugcucauauuucccaugauuuc

SEQ ID NO: 1147078 - RNA, 24 nt, Human
ugcucauauuucccaugauuucau

SEQ ID NO: 1147079 - RNA, 12 nt, Human
ugcucuccucuu

SEQ ID NO: 1147080 - RNA, 14 nt, Human
ugcucuccucuugc

SEQ ID NO: 1147081 - RNA, 13 nt, Human
ugcugcuucaauu

SEQ ID NO: 1147082 - RNA, 14 nt, Human
ugcugcuucaauuu

SEQ ID NO: 1147083 - RNA, 15 nt, Human
ugcuguuguuaugau

SEQ ID NO: 1147084 - RNA, 16 nt, Human
ugcuguuguuaugaug

SEQ ID NO: 1147085 - RNA, 17 nt, Human
ugcuguuguuaugaugu

SEQ ID NO: 1147086 - RNA, 18 nt, Human
ugcuguuguuaugaugug

SEQ ID NO: 1147087 - RNA, 19 nt, Human
ugcuguuguuaugaugugc

SEQ ID NO: 1147088 - RNA, 20 nt, Human
ugcuguuguuaugaugugcu

SEQ ID NO: 1147089 - RNA, 22 nt, Human
ugcuguuguuaugaugugcuua

SEQ ID NO: 1147090 - RNA, 23 nt, Human
ugcuguuguuaugaugugcuuaa

SEQ ID NO: 1147091 - RNA, 13 nt, Human
uggacuccucugu

SEQ ID NO: 1147092 - RNA, 14 nt, Human
uggacuccucuguc

SEQ ID NO: 1147093 - RNA, 14 nt, Human
uggagacugucuca

SEQ ID NO: 1147094 - RNA, 17 nt, Human
uggagacugucucaaga

SEQ ID NO: 1147095 - RNA, 19 nt, Human
uggaucucuucuuaaugua

SEQ ID NO: 1147096 - RNA, 20 nt, Human
uggaucucuucuuaauguac

SEQ ID NO: 1147097 - RNA, 21 nt, Human
uggaucucuucuuaauguaca

SEQ ID NO: 1147098 - RNA, 23 nt, Human
uggaucucuucuuaauguacaua

SEQ ID NO: 1147099 - RNA, 22 nt, Human
uggaucucuucuuaauguacau

SEQ ID NO: 1147100 - RNA, 12 nt, Human
uggcagaggagg

SEQ ID NO: 1147101 - RNA, 16 nt, Human
uggccaggcugcucuu

SEQ ID NO: 1147102 - RNA, 17 nt, Human
uggccaggcugcucuug

SEQ ID NO: 1147103 - RNA, 20 nt, Human
uggccaggcugcucuugaac

SEQ ID NO: 1147104 - RNA, 14 nt, Human
uggcucccacaggc

SEQ ID NO: 1147105 - RNA, 17 nt, Human
uggcucccacaggcccu

SEQ ID NO: 1147106 - RNA, 20 nt, Human
uggcucccacaggcccuucc

SEQ ID NO: 1147107 - RNA, 14 nt, Human
uggcuccucccggu

SEQ ID NO: 1147108 - RNA, 16 nt, Human
uggcuccucccggugc

SEQ ID NO: 1147109 - RNA, 18 nt, Human
uggcuccucccggugccc

SEQ ID NO: 1147110 - RNA, 19 nt, Human
uggcuccucccggugccca

SEQ ID NO: 1147111 - RNA, 17 nt, Human
ugggauuacaggcguga

SEQ ID NO: 1147112 - RNA, 18 nt, Human
ugggauuacaggcuccug

SEQ ID NO: 1147113 - RNA, 11 nt, Human
ugggccuucag

SEQ ID NO: 1147114 - RNA, 15 nt, Human
ugggccuucagggag

SEQ ID NO: 1147115 - RNA, 12 nt, Human
ugggccuucagg

SEQ ID NO: 1147116 - RNA, 15 nt, Human
uggggguucuuucuu

SEQ ID NO: 1147117 - RNA, 19 nt, Human
uggggguucuuucuuccuc

SEQ ID NO: 1147118 - RNA, 20 nt, Human
uggggguucuuucuuccucu

SEQ ID NO: 1147119 - RNA, 22 nt, Human
uggggguucuuucuuccucugc

SEQ ID NO: 1147120 - RNA, 18 nt, Human
uggucacaggacucugcc

SEQ ID NO: 1147121 - RNA, 20 nt, Human
uggucacaggacucugccuc

SEQ ID NO: 1147122 - RNA, 19 nt, Human
uggucacaggacucugccu

SEQ ID NO: 1147123 - RNA, 17 nt, Human
uguuucacuacucagca

SEQ ID NO: 1147124 - RNA, 17 nt, Human
uguuuuguuuggagaca

SEQ ID NO: 1147125 - RNA, 18 nt, Human
uguuuuuuuuuuccacuu

SEQ ID NO: 1147126 - RNA, 19 nt, Human
uguuuuuuuuuuccacuua

SEQ ID NO: 1147127 - RNA, 14 nt, Human
uuaaagaauucaaa

SEQ ID NO: 1147128 - RNA, 20 nt, Human
uuaaagaauucaaauuuuau

SEQ ID NO: 1147129 - RNA, 15 nt, Human
uuaaagaauucaaau

SEQ ID NO: 1147130 - RNA, 17 nt, Human
uuaaagaauucaaauuu

SEQ ID NO: 1147131 - RNA, 19 nt, Human
uuaaagaauucaaauuuua

SEQ ID NO: 1147132 - RNA, 20 nt, Human
uuaacugacaagcuccauuu

SEQ ID NO: 1147133 - RNA, 15 nt, Human
uuaagccuuuggaaa

SEQ ID NO: 1147134 - RNA, 16 nt, Human
uuaagccuuuggaaac

SEQ ID NO: 1147135 - RNA, 17 nt, Human
uuaauguacauagugcu

SEQ ID NO: 1147136 - RNA, 18 nt, Human
uuaauguacauagugcua

SEQ ID NO: 1147137 - RNA, 22 nt, Human
uuaaugucaauucuugccaaau

SEQ ID NO: 1147138 - RNA, 19 nt, Human
uuacuaucaugucaaacgu

SEQ ID NO: 1147139 - RNA, 21 nt, Human
uuacuaucaugucaaacguga

SEQ ID NO: 1147140 - RNA, 13 nt, Human
uuacuuaguauug

SEQ ID NO: 1147141 - RNA, 15 nt, Human
uuacuuaguauugca

SEQ ID NO: 1147142 - RNA, 19 nt, Human
uuacuuaguauugcaaagu

SEQ ID NO: 1147143 - RNA, 12 nt, Human
uuagcugacaaa

SEQ ID NO: 1147144 - RNA, 18 nt, Human
uuagcugacaaaauacuu

SEQ ID NO: 1147145 - RNA, 15 nt, Human
uuagcugacaaaaua

SEQ ID NO: 1147146 - RNA, 12 nt, Human
uuagcugggaga

SEQ ID NO: 1147147 - RNA, 17 nt, Human
uuagcuuauguuaacug

SEQ ID NO: 1147148 - RNA, 16 nt, Human
uuagcuuugucacugu

SEQ ID NO: 1147149 - RNA, 12 nt, Human
uuagcuuuguca

SEQ ID NO: 1147150 - RNA, 11 nt, Human
uuaguauugca

SEQ ID NO: 1147151 - RNA, 13 nt, Human
uuaguauugcaaa

SEQ ID NO: 1147152 - RNA, 17 nt, Human
uuaguauugcaaaguca

SEQ ID NO: 1147153 - RNA, 12 nt, Human
uuaguuccugug

SEQ ID NO: 1147154 - RNA, 15 nt, Human
uuaguuccugugcac

SEQ ID NO: 1147155 - RNA, 18 nt, Human
uuaguuccugugcacagc

SEQ ID NO: 1147156 - RNA, 21 nt, Human
uuaucugccucucuuguaauu

SEQ ID NO: 1147157 - RNA, 18 nt, Human
uuaucugccucucuugua

SEQ ID NO: 1147158 - RNA, 16 nt, Human
uucaacgcagcccugc

SEQ ID NO: 1147159 - RNA, 19 nt, Human
uucaacgcagcccugcuuu

SEQ ID NO: 1147160 - RNA, 20 nt, Human
uucaacgcagcccugcuuug

SEQ ID NO: 1147161 - RNA, 17 nt, Human
uucaacugaccagccuc

SEQ ID NO: 1147162 - RNA, 16 nt, Human
uucaauuuauaccuca

SEQ ID NO: 1147163 - RNA, 15 nt, Human
uucaauuuauaccuc

SEQ ID NO: 1147164 - RNA, 15 nt, Human
uucaauuugaugugg

SEQ ID NO: 1147165 - RNA, 22 nt, Human
uucaauuugauguggugaaaag

SEQ ID NO: 1147166 - RNA, 16 nt, Human
uucaauuugauguggu

SEQ ID NO: 1147167 - RNA, 14 nt, Human
uucacuacucagca

SEQ ID NO: 1147168 - RNA, 15 nt, Human
uucacuacucagcau

SEQ ID NO: 1147169 - RNA, 17 nt, Human
uuccagagaguggcucc

SEQ ID NO: 1147170 - RNA, 18 nt, Human
uuccagagaguggcuccu

SEQ ID NO: 1147171 - RNA, 19 nt, Human
uuccagagaguggcuccuc

SEQ ID NO: 1147172 - RNA, 20 nt, Human
uuccagagaguggcuccucc

SEQ ID NO: 1147173 - RNA, 21 nt, Human
uuccagagaguggcuccuccc

SEQ ID NO: 1147174 - RNA, 20 nt, Human
uuccagcaauucuccugccu

SEQ ID NO: 1147175 - RNA, 21 nt, Human
uuccagcaauucuccugccuc

SEQ ID NO: 1147176 - RNA, 22 nt, Human
uuccagcaauucuccugccuca

SEQ ID NO: 1147177 - RNA, 23 nt, Human
uuccagcaauucuccugccucag

SEQ ID NO: 1147178 - RNA, 13 nt, Human
uucccaugauuuc

SEQ ID NO: 1147179 - RNA, 18 nt, Human
uucccaugauuucaugua

SEQ ID NO: 1147180 - RNA, 20 nt, Human
uucccaugauuucauguacu

SEQ ID NO: 1147181 - RNA, 21 nt, Human
uucccaugauuucauguacug

SEQ ID NO: 1147182 - RNA, 22 nt, Human
uucccaugauuucauguacugc

SEQ ID NO: 1147183 - RNA, 14 nt, Human
uucccauucuugca

SEQ ID NO: 1147184 - RNA, 14 nt, Human
uuccccagccccac

SEQ ID NO: 1147185 - RNA, 15 nt, Human
uuccccagccccacu

SEQ ID NO: 1147186 - RNA, 11 nt, Human
uuccccauggg

SEQ ID NO: 1147187 - RNA, 19 nt, Human
uuccccaugucucgacuca

SEQ ID NO: 1147188 - RNA, 19 nt, Human
uucccccuccaaucccacc

SEQ ID NO: 1147189 - RNA, 14 nt, Human
uuccuaugauguau

SEQ ID NO: 1147190 - RNA, 21 nt, Human
uuccuaugauguauacugcca

SEQ ID NO: 1147191 - RNA, 18 nt, Human
uuccuaugauguauacug

SEQ ID NO: 1147192 - RNA, 18 nt, Human
uuccucccauucaagauu

SEQ ID NO: 1147193 - RNA, 16 nt, Human
uuccugcauuugugaa

SEQ ID NO: 1147194 - RNA, 18 nt, Human
uuccugcauuugugaaau

SEQ ID NO: 1147195 - RNA, 16 nt, Human
uucguuuaaugaaugc

SEQ ID NO: 1147196 - RNA, 17 nt, Human
uucuuauguugcccagu

SEQ ID NO: 1147197 - RNA, 21 nt, Human
uugaaaaucuuauaauuuaaa

SEQ ID NO: 1147198 - RNA, 13 nt, Human
uugagcucagccc

SEQ ID NO: 1147199 - RNA, 22 nt, Human
uugauauuuucaacgcagcccu

SEQ ID NO: 1147200 - RNA, 13 nt, Human
uuggacaaaauga

SEQ ID NO: 1147201 - RNA, 14 nt, Human
uuggucuguacuga

SEQ ID NO: 1147202 - RNA, 16 nt, Human
uuggucuguacugauu

SEQ ID NO: 1147203 - RNA, 20 nt, Human
uuggucuguacugauucaau

SEQ ID NO: 1147204 - RNA, 22 nt, Human
uuguaugaaagauggcugugcc

SEQ ID NO: 1147205 - RNA, 20 nt, Human
uuguaugauccuaaugaaug

SEQ ID NO: 1147206 - RNA, 17 nt, Human
uugucugaagucacugc

SEQ ID NO: 1147207 - RNA, 20 nt, Human
uugucugaagucacugcaca

SEQ ID NO: 1147208 - RNA, 18 nt, Human
uugucugaagucacugca

SEQ ID NO: 1147209 - RNA, 15 nt, Human
uuguuuuacugucuu

SEQ ID NO: 1147210 - RNA, 12 nt, Human
uuuaaaaugucu

SEQ ID NO: 1147211 - RNA, 23 nt, Human
uuuaaacagauguccaucagaug

SEQ ID NO: 1147212 - RNA, 14 nt, Human
uuuaaacagauguc

SEQ ID NO: 1147213 - RNA, 12 nt, Human
uuuaaucauaua

SEQ ID NO: 1147214 - RNA, 13 nt, Human
uuuaaucauauaa

SEQ ID NO: 1147215 - RNA, 13 nt, Human
uuuacagcugccu

SEQ ID NO: 1147216 - RNA, 12 nt, Human
uuuaguuccugu

SEQ ID NO: 1147217 - RNA, 19 nt, Human
uuuaguuccugugcacagc

SEQ ID NO: 1147218 - RNA, 13 nt, Human
uuuaguuccugug

SEQ ID NO: 1147219 - RNA, 22 nt, Human
uuuauaccucaauuuucacugu

SEQ ID NO: 1147220 - RNA, 14 nt, Human
uuuaucugccucuc

SEQ ID NO: 1147221 - RNA, 19 nt, Human
uuuaucugccucucuugua

SEQ ID NO: 1147222 - RNA, 21 nt, Human
uuuaucugccucucuuguaau

SEQ ID NO: 1147223 - RNA, 20 nt, Human
uuuaucugccucucuuguaa

SEQ ID NO: 1147224 - RNA, 14 nt, Human
uuuaugacaguaau

SEQ ID NO: 1147225 - RNA, 15 nt, Human
uuuaugacaguaauu

SEQ ID NO: 1147226 - RNA, 16 nt, Human
uuuaugacaguaauug

SEQ ID NO: 1147227 - RNA, 19 nt, Human
uuuaugacaguaauugugu

SEQ ID NO: 1147228 - RNA, 15 nt, Human
uuuccacuucuucau

SEQ ID NO: 1147229 - RNA, 16 nt, Human
uuuccacuucuucauu

SEQ ID NO: 1147230 - RNA, 22 nt, Human
uuuccucuuagucgagccaagu

SEQ ID NO: 1147231 - RNA, 23 nt, Human
uuucugaucugaugcaagcaaga

SEQ ID NO: 1147232 - RNA, 21 nt, Human
uuugaaauuguauuacaaauc

SEQ ID NO: 1147233 - RNA, 19 nt, Human
uuugcuuucgguuccaguu

SEQ ID NO: 1147234 - RNA, 20 nt, Human
uuuguggguuuuuauuuccu

SEQ ID NO: 1147235 - RNA, 23 nt, Human
accucagguaaucgaccugccuc

SEQ ID NO: 1147236 - RNA, 22 nt, Human
accucagguaaucgaccugccu

SEQ ID NO: 1147237 - RNA, 21 nt, Human
acccuuaaacaguugcacagc

SEQ ID NO: 1147238 - RNA, 23 nt, Human
acccuuaaacaguugcacagcau

SEQ ID NO: 1147239 - RNA, 23 nt, Human
accugccccuccucucugcccua

SEQ ID NO: 1147240 - RNA, 13 nt, Human
accugcccaaccu

SEQ ID NO: 1147241 - RNA, 22 nt, Human
acuaaccuuccaaaaauuacuu

SEQ ID NO: 1147242 - RNA, 14 nt, Human
acuaacuaaaacaa

SEQ ID NO: 1147243 - RNA, 15 nt, Human
acuaacuaaaacaaa

SEQ ID NO: 1147244 - RNA, 22 nt, Human
acuaacuaaaacaaagccacuu

SEQ ID NO: 1147245 - RNA, 18 nt, Human
acugccagucccccugcc

SEQ ID NO: 1147246 - RNA, 19 nt, Human
acugccagucccccugccc

SEQ ID NO: 1147247 - RNA, 20 nt, Human
acucuacuuagcaugucccu

SEQ ID NO: 1147248 - RNA, 21 nt, Human
acucuacuuagcaugucccua

SEQ ID NO: 1147249 - RNA, 14 nt, Human
acugauucaauuug

SEQ ID NO: 1147250 - RNA, 13 nt, Human
acugaccagccuc

SEQ ID NO: 1147251 - RNA, 15 nt, Human
acugaccagccucca

SEQ ID NO: 1147252 - RNA, 20 nt, Human
acugaccagccuccaugcug

SEQ ID NO: 1147253 - RNA, 23 nt, Human
acugaccagccuccaugcugccu

SEQ ID NO: 1147254 - RNA, 11 nt, Human
acuuucaaucu

SEQ ID NO: 1147255 - RNA, 20 nt, Human
acuuucaaucuucaauccuu

SEQ ID NO: 1147256 - RNA, 22 nt, Human
acuuucaggccacauggcuaaa

SEQ ID NO: 1147257 - RNA, 22 nt, Human
acuuaaaauauuccugcauuug

SEQ ID NO: 1147258 - RNA, 13 nt, Human
acuucagcucugu

SEQ ID NO: 1147259 - RNA, 13 nt, Human
acagugcaucuca

SEQ ID NO: 1147260 - RNA, 12 nt, Human
acagcugccugc

SEQ ID NO: 1147261 - RNA, 16 nt, Human
acagcugccugcagua

SEQ ID NO: 1147262 - RNA, 20 nt, Human
acauaauucaggaagcagcu

SEQ ID NO: 1147263 - RNA, 15 nt, Human
acauccuacaagaca

SEQ ID NO: 1147264 - RNA, 16 nt, Human
acauccucuuccauau

SEQ ID NO: 1147265 - RNA, 16 nt, Human
accauacuaauuauac

SEQ ID NO: 1147266 - RNA, 21 nt, Human
accauacuaauuauacccccu

SEQ ID NO: 1147267 - RNA, 17 nt, Human
accauaggucaccuuua

SEQ ID NO: 1147268 - RNA, 12 nt, Human
accaccugccca

SEQ ID NO: 1147269 - RNA, 14 nt, Human
aauuuucacugugu

SEQ ID NO: 1147270 - RNA, 18 nt, Human
acaaccuucuguggcuca

SEQ ID NO: 1147271 - RNA, 15 nt, Human
aaugcgcaggcuggc

SEQ ID NO: 1147272 - RNA, 17 nt, Human
aaugcgcaggcuggccc

SEQ ID NO: 1147273 - RNA, 18 nt, Human
aaugcgcaggcuggcccu

SEQ ID NO: 1147274 - RNA, 19 nt, Human
aaugcgcaggcuggcccug

SEQ ID NO: 1147275 - RNA, 20 nt, Human
aaugcgcaggcuggcccugc

SEQ ID NO: 1147276 - RNA, 21 nt, Human
aaugcgcaggcuggcccugcc

SEQ ID NO: 1147277 - RNA, 14 nt, Human
aaugcucuuauuuc

SEQ ID NO: 1147278 - RNA, 16 nt, Human
aaugcucuuauuucau

SEQ ID NO: 1147279 - RNA, 13 nt, Human
aaucauuuuaugu

SEQ ID NO: 1147280 - RNA, 23 nt, Human
aaugauguauguugaagccuuug

SEQ ID NO: 1147281 - RNA, 23 nt, Human
aaucucgcucugucgcccaggcu

SEQ ID NO: 1147282 - RNA, 18 nt, Human
aaucucggcucacugcau

SEQ ID NO: 1147283 - RNA, 15 nt, Human
aaucuggacuccucu

SEQ ID NO: 1147284 - RNA, 16 nt, Human
aaucuggacuccucug

SEQ ID NO: 1147285 - RNA, 17 nt, Human
aaucuggacuccucugu

SEQ ID NO: 1147286 - RNA, 18 nt, Human
aaucuggacuccucuguc

SEQ ID NO: 1147287 - RNA, 20 nt, Human
aaucuggacuccucugucca

SEQ ID NO: 1147288 - RNA, 19 nt, Human
aauaccuuagugcaguuau

SEQ ID NO: 1147289 - RNA, 21 nt, Human
aauaugcuuauauuguucacu

SEQ ID NO: 1147290 - RNA, 13 nt, Human
aaguaguuaucau

SEQ ID NO: 1147291 - RNA, 15 nt, Human
aaguaguuaucaugu

SEQ ID NO: 1147292 - RNA, 17 nt, Human
aaguaguuaucauguua

SEQ ID NO: 1147293 - RNA, 19 nt, Human
aaguaguuaucauguuagu

SEQ ID NO: 1147294 - RNA, 18 nt, Human
aaguaguuaucauguuag

SEQ ID NO: 1147295 - RNA, 15 nt, Human
aaguggggacagagc

SEQ ID NO: 1147296 - RNA, 20 nt, Human
aaguggggcagcagcagugg

SEQ ID NO: 1147297 - RNA, 18 nt, Human
aaguugauggugaugaaa

SEQ ID NO: 1147298 - RNA, 18 nt, Human
aagggcaaauuggagaaa

SEQ ID NO: 1147299 - RNA, 19 nt, Human
aagggcagcuuugcucaua

SEQ ID NO: 1147300 - RNA, 20 nt, Human
aagggcagcuuugcucauau

SEQ ID NO: 1147301 - RNA, 22 nt, Human
aaggacccggaggggccuggca

SEQ ID NO: 1147302 - RNA, 13 nt, Human
aaggacuaggguc

SEQ ID NO: 1147303 - RNA, 15 nt, Human
aaggacuaggguccu

SEQ ID NO: 1147304 - RNA, 17 nt, Human
aagauucaaucccagga

SEQ ID NO: 1147305 - RNA, 13 nt, Human
aagauucagcuag

SEQ ID NO: 1147306 - RNA, 14 nt, Human
aagauucagcuagu

SEQ ID NO: 1147307 - RNA, 15 nt, Human
aagauucagcuagug

SEQ ID NO: 1147308 - RNA, 23 nt, Human
aagacagugaaagaaaauaacaa

SEQ ID NO: 1147309 - RNA, 20 nt, Human
aaaccccaccccaaaauuag

SEQ ID NO: 1147310 - RNA, 15 nt, Human
aaagucaggaaucau

SEQ ID NO: 1147311 - RNA, 18 nt, Human
aaagucagauucuugcau

SEQ ID NO: 1147312 - RNA, 23 nt, Human
aaaauuaaucugggccagaauuu

SEQ ID NO: 1147313 - RNA, 21 nt, Human
aaaauuacuuaguauugcaaa

SEQ ID NO: 1147314 - RNA, 23 nt, Human
aaaauuacuuaguauugcaaagu

SEQ ID NO: 1147315 - RNA, 22 nt, Human
aaaauuacuuaguauugcaaag

SEQ ID NO: 1147316 - RNA, 21 nt, Human
aaaauuagccaguaauccugu

SEQ ID NO: 1147317 - RNA, 19 nt, Human
aaaauuaggauuucaugau

SEQ ID NO: 1147318 - RNA, 17 nt, Human
aaaauuagccaguaauc

SEQ ID NO: 1147319 - RNA, 19 nt, Human
aaaauuagccaguaauccu

SEQ ID NO: 1147320 - RNA, 15 nt, Human
aaaauuauagcucua

SEQ ID NO: 1147321 - RNA, 19 nt, Human
aaaauuauagcucuaaugu

SEQ ID NO: 1147322 - RNA, 24 nt, Human
aaaauuauagcucuaauguuugca

SEQ ID NO: 1147323 - RNA, 22 nt, Human
aacccuuaaacaguugcacagc

SEQ ID NO: 1147324 - RNA, 18 nt, Human
aacccuuaaacaguugca

SEQ ID NO: 1147325 - RNA, 23 nt, Human
aacccuuaaacaguugcacagca

SEQ ID NO: 1147326 - RNA, 15 nt, Human
aacauccuacaagac

SEQ ID NO: 1147327 - RNA, 22 nt, Human
aacauccuacaagacacaguga

SEQ ID NO: 1147328 - RNA, 15 nt, Human
aacaaacaauaccug

SEQ ID NO: 1147329 - RNA, 12 nt, Human
aacaaaugaaga

SEQ ID NO: 1147330 - RNA, 14 nt, Human
aacaaaugaagaca

SEQ ID NO: 1147331 - RNA, 19 nt, Human
aaaugcucuuauuucauca

SEQ ID NO: 1147332 - RNA, 23 nt, Human
aaaugcucuuauuucaucauuca

SEQ ID NO: 1147333 - RNA, 19 nt, Human
agugggacagggcauggcc

SEQ ID NO: 1147334 - RNA, 21 nt, Human
agugggacagggcauggccag

SEQ ID NO: 1147335 - RNA, 20 nt, Human
agugauggguuaguggaugg

SEQ ID NO: 1147336 - RNA, 21 nt, Human
agugauucucaugccucagcc

SEQ ID NO: 1147337 - RNA, 22 nt, Human
agugacuaaaccauugugcauu

SEQ ID NO: 1147338 - RNA, 16 nt, Human
agugacuaaaccauug

SEQ ID NO: 1147339 - RNA, 17 nt, Human
agugacuaaaccauugu

SEQ ID NO: 1147340 - RNA, 18 nt, Human
agugaccucagcuuugau

SEQ ID NO: 1147341 - RNA, 17 nt, Human
agugaccucagcuuuga

SEQ ID NO: 1147342 - RNA, 19 nt, Human
agucaugcguuuaaucaca

SEQ ID NO: 1147343 - RNA, 15 nt, Human
aguaucggcacugua

SEQ ID NO: 1147344 - RNA, 16 nt, Human
aguaucggcacuguac

SEQ ID NO: 1147345 - RNA, 19 nt, Human
aguaucggcacuguacaaa

SEQ ID NO: 1147346 - RNA, 13 nt, Human
auaguaaaaauaa

SEQ ID NO: 1147347 - RNA, 14 nt, Human
auaguaaaaauaaa

SEQ ID NO: 1147348 - RNA, 13 nt, Human
auacuugucuguu

SEQ ID NO: 1147349 - RNA, 16 nt, Human
auacuugucuguuuua

SEQ ID NO: 1147350 - RNA, 18 nt, Human
auauuucccaugauuuca

SEQ ID NO: 1147351 - RNA, 22 nt, Human
auauuucccaugauuucaugua

SEQ ID NO: 1147352 - RNA, 12 nt, Human
auaagggaagua

SEQ ID NO: 1147353 - RNA, 22 nt, Human
auaagggaaguaguuaucaugu

SEQ ID NO: 1147354 - RNA, 23 nt, Human
auaagggaaguaguuaucauguu

SEQ ID NO: 1147355 - RNA, 19 nt, Human
auaagggcaaauuggagaa

SEQ ID NO: 1147356 - RNA, 15 nt, Human
auaauguaaauaaag

SEQ ID NO: 1147357 - RNA, 20 nt, Human
auacccccugcaaagcccag

SEQ ID NO: 1147358 - RNA, 21 nt, Human
auacccccugcaaagcccagc

SEQ ID NO: 1147359 - RNA, 17 nt, Human
auacccccugcaaagcc

SEQ ID NO: 1147360 - RNA, 19 nt, Human
auacccccugcaaagccca

SEQ ID NO: 1147361 - RNA, 14 nt, Human
auaacaaugaaagu

SEQ ID NO: 1147362 - RNA, 23 nt, Human
augauguauguugaagccuuugu

SEQ ID NO: 1147363 - RNA, 18 nt, Human
augauguauacugccacu

SEQ ID NO: 1147364 - RNA, 19 nt, Human
augcugacuguacuccucc

SEQ ID NO: 1147365 - RNA, 20 nt, Human
augcugacuguacuccuccc

SEQ ID NO: 1147366 - RNA, 21 nt, Human
augcugacuguacuccuccca

SEQ ID NO: 1147367 - RNA, 12 nt, Human
augcugccucca

SEQ ID NO: 1147368 - RNA, 15 nt, Human
augcugccuccagaa

SEQ ID NO: 1147369 - RNA, 18 nt, Human
augcuuuaggauguacag

SEQ ID NO: 1147370 - RNA, 21 nt, Human
augcuuuaggauguacaguua

SEQ ID NO: 1147371 - RNA, 22 nt, Human
auggauccacuggcuggacaaa

SEQ ID NO: 1147372 - RNA, 15 nt, Human
auggcugugccucug

SEQ ID NO: 1147373 - RNA, 16 nt, Human
auggcugugccucugc

SEQ ID NO: 1147374 - RNA, 17 nt, Human
auggcugugccucugcc

SEQ ID NO: 1147375 - RNA, 18 nt, Human
auggcugugccucugccu

SEQ ID NO: 1147376 - RNA, 15 nt, Human
aucaaaaugcucuua

SEQ ID NO: 1147377 - RNA, 19 nt, Human
aucaaaaugcucuuauuuc

SEQ ID NO: 1147378 - RNA, 19 nt, Human
auauuucccaugauuucau

SEQ ID NO: 1147379 - RNA, 21 nt, Human
auauuucccaugauuucaugu

SEQ ID NO: 1147380 - RNA, 20 nt, Human
aucaaaaugcucuuauuuca

SEQ ID NO: 1147381 - RNA, 21 nt, Human
aucaaaaugcucuuauuucau

SEQ ID NO: 1147382 - RNA, 23 nt, Human
aucaaaaugcucuuauuucauca

SEQ ID NO: 1147383 - RNA, 13 nt, Human
aucaggaacguuu

SEQ ID NO: 1147384 - RNA, 23 nt, Human
aucaggaacguuuagcugacaaa

SEQ ID NO: 1147385 - RNA, 13 nt, Human
auccacucgccuu

SEQ ID NO: 1147386 - RNA, 18 nt, Human
auccccaagccuggcaag

SEQ ID NO: 1147387 - RNA, 19 nt, Human
auccucaguuuuugugaaa

SEQ ID NO: 1147388 - RNA, 16 nt, Human
auccuugaagguauau

SEQ ID NO: 1147389 - RNA, 23 nt, Human
auccuugaagguauaucuagguu

SEQ ID NO: 1147390 - RNA, 16 nt, Human
aucucugcuuuggaaa

SEQ ID NO: 1147391 - RNA, 17 nt, Human
aucucugcuuuggaaau

SEQ ID NO: 1147392 - RNA, 14 nt, Human
aucuucaauccuug

SEQ ID NO: 1147393 - RNA, 14 nt, Human
aucuagguuuauga

SEQ ID NO: 1147394 - RNA, 15 nt, Human
aucuagguuuaugac

SEQ ID NO: 1147395 - RNA, 18 nt, Human
aucuagguuuaugacagu

SEQ ID NO: 1147396 - RNA, 21 nt, Human
aucuagguuuaugacaguaau

SEQ ID NO: 1147397 - RNA, 22 nt, Human
aucuagguuuaugacaguaauu

SEQ ID NO: 1147398 - RNA, 23 nt, Human
aucuagguuuaugacaguaauug

SEQ ID NO: 1147399 - RNA, 17 nt, Human
aucuaguuccccuguuu

SEQ ID NO: 1147400 - RNA, 23 nt, Human
aucuaguuccccuguuuauucau

SEQ ID NO: 1147401 - RNA, 19 nt, Human
aucuaguuccccuguuuau

SEQ ID NO: 1147402 - RNA, 20 nt, Human
aucuaguuccccuguuuauu

SEQ ID NO: 1147403 - RNA, 22 nt, Human
aucuaguuccccuguuuauuca

SEQ ID NO: 1147404 - RNA, 18 nt, Human
augaccacacuccagcug

SEQ ID NO: 1147405 - RNA, 15 nt, Human
agcccucccugcccc

SEQ ID NO: 1147406 - RNA, 16 nt, Human
agcccucccugccccu

SEQ ID NO: 1147407 - RNA, 17 nt, Human
agcccucccugccccuc

SEQ ID NO: 1147408 - RNA, 19 nt, Human
agcccucccugccccuccc

SEQ ID NO: 1147409 - RNA, 22 nt, Human
agcccucccugccccucccuuc

SEQ ID NO: 1147410 - RNA, 23 nt, Human
agcccucccugccccucccuuca

SEQ ID NO: 1147411 - RNA, 16 nt, Human
agcuaaucagcauucu

SEQ ID NO: 1147412 - RNA, 21 nt, Human
agcuaaucagcauucucacuc

SEQ ID NO: 1147413 - RNA, 12 nt, Human
agcuacaaaugc

SEQ ID NO: 1147414 - RNA, 18 nt, Human
agcuucacuguaaaauaa

SEQ ID NO: 1147415 - RNA, 16 nt, Human
agcuuuuaaacccuau

SEQ ID NO: 1147416 - RNA, 22 nt, Human
aggaaggcugagaggagagaga

SEQ ID NO: 1147417 - RNA, 19 nt, Human
aggaauaaauugcuccuug

SEQ ID NO: 1147418 - RNA, 20 nt, Human
aggaauaaauugcuccuuga

SEQ ID NO: 1147419 - RNA, 21 nt, Human
aggacccggaggggccuggca

SEQ ID NO: 1147420 - RNA, 22 nt, Human
aggacccggaggggccuggcag

SEQ ID NO: 1147421 - RNA, 18 nt, Human
aggacccggaggggccug

SEQ ID NO: 1147422 - RNA, 20 nt, Human
aggacccggaggggccuggc

SEQ ID NO: 1147423 - RNA, 20 nt, Human
aggaaucaucaggaacguuu

SEQ ID NO: 1147424 - RNA, 22 nt, Human
aggcccuuccucuccacugccu

SEQ ID NO: 1147425 - RNA, 11 nt, Human
aggcugagccu

SEQ ID NO: 1147426 - RNA, 23 nt, Human
aggcuggucucgaacuccugacc

SEQ ID NO: 1147427 - RNA, 23 nt, Human
agggacugccagucccccugccc

SEQ ID NO: 1147428 - RNA, 11 nt, Human
agguacuguau

SEQ ID NO: 1147429 - RNA, 17 nt, Human
agggcaaauuggagaaa

SEQ ID NO: 1147430 - RNA, 12 nt, Human
aggggccuggca

SEQ ID NO: 1147431 - RNA, 13 nt, Human
aggggccuggcag

SEQ ID NO: 1147432 - RNA, 15 nt, Human
aggggccuggcagcc

SEQ ID NO: 1147433 - RNA, 23 nt, Human
agaggagggagcaucagugcccu

SEQ ID NO: 1147434 - RNA, 21 nt, Human
acuuuccucuuagucgagcca

SEQ ID NO: 1147435 - RNA, 18 nt, Human
agaagguuucagaaagaa

SEQ ID NO: 1147436 - RNA, 23 nt, Human
agcccuccaucuaaacugccccc

SEQ ID NO: 1147437 - RNA, 12 nt, Human
agcccucccugc

SEQ ID NO: 1147438 - RNA, 13 nt, Human
agcccucccugcc

SEQ ID NO: 1147439 - RNA, 17 nt, Human
agaugaaauuccauuug

SEQ ID NO: 1147440 - RNA, 18 nt, Human
agaugaaauuccauuugu

SEQ ID NO: 1147441 - RNA, 12 nt, Human
agauucuugcau

SEQ ID NO: 1147442 - RNA, 17 nt, Human
agcaaaugucuuccugg

SEQ ID NO: 1147443 - RNA, 20 nt, Human
agcaaaugucuuccuggauu

SEQ ID NO: 1147444 - RNA, 16 nt, Human
agcaaauguggcuccu

SEQ ID NO: 1147445 - RNA, 21 nt, Human
agcacaaguguaaugaauacc

SEQ ID NO: 1147446 - RNA, 22 nt, Human
agcacuguuuucuaguguauca

SEQ ID NO: 1147447 - RNA, 20 nt, Human
agcacuguuuucuaguguau

SEQ ID NO: 1147448 - RNA, 12 nt, Human
cauagcccucac

SEQ ID NO: 1147449 - RNA, 15 nt, Human
cauagcccucacccu

SEQ ID NO: 1147450 - RNA, 19 nt, Human
cauagcccucacccugggg

SEQ ID NO: 1147451 - RNA, 12 nt, Human
caguuugcuuug

SEQ ID NO: 1147452 - RNA, 14 nt, Human
caguuugcuuugua

SEQ ID NO: 1147453 - RNA, 21 nt, Human
caguuugcuuuguaugcacuu

SEQ ID NO: 1147454 - RNA, 20 nt, Human
cauaaucuggacuccucugu

SEQ ID NO: 1147455 - RNA, 21 nt, Human
cauaaucuggacuccucuguc

SEQ ID NO: 1147456 - RNA, 22 nt, Human
cauaaucuggacuccucugucc

SEQ ID NO: 1147457 - RNA, 23 nt, Human
cauaaucuggacuccucugucca

SEQ ID NO: 1147458 - RNA, 12 nt, Human
caugcugccucc

SEQ ID NO: 1147459 - RNA, 14 nt, Human
caugcugccuccag

SEQ ID NO: 1147460 - RNA, 12 nt, Human
caucgcaaugua

SEQ ID NO: 1147461 - RNA, 18 nt, Human
cauuucauuugugccaga

SEQ ID NO: 1147462 - RNA, 18 nt, Human
cauuuuugaauacaggca

SEQ ID NO: 1147463 - RNA, 20 nt, Human
cauuuuugaauacaggcaua

SEQ ID NO: 1147464 - RNA, 22 nt, Human
ccaaaaauuacuuaguauugca

SEQ ID NO: 1147465 - RNA, 13 nt, Human
cauuaugaugugu

SEQ ID NO: 1147466 - RNA, 16 nt, Human
cauucucacuccuacc

SEQ ID NO: 1147467 - RNA, 17 nt, Human
cauucucacuccuaccu

SEQ ID NO: 1147468 - RNA, 19 nt, Human
ccaaagugcugggauuaca

SEQ ID NO: 1147469 - RNA, 22 nt, Human
ccaaagugcugggauuacaggc

SEQ ID NO: 1147470 - RNA, 22 nt, Human
ccaaagugcugggauuacaggu

SEQ ID NO: 1147471 - RNA, 12 nt, Human
ccaaaugcagcu

SEQ ID NO: 1147472 - RNA, 11 nt, Human
ccaacuuguaa

SEQ ID NO: 1147473 - RNA, 23 nt, Human
ccaccgggcugggagcucugcag

SEQ ID NO: 1147474 - RNA, 13 nt, Human
cagguugauaaau

SEQ ID NO: 1147475 - RNA, 18 nt, Human
cagguugauaaaucauuu

SEQ ID NO: 1147476 - RNA, 15 nt, Human
cagguugauaaauca

SEQ ID NO: 1147477 - RNA, 18 nt, Human
cagggagggccugggccc

SEQ ID NO: 1147478 - RNA, 18 nt, Human
caggacaggcugcggccc

SEQ ID NO: 1147479 - RNA, 22 nt, Human
caggacaggcugcggccccucc

SEQ ID NO: 1147480 - RNA, 23 nt, Human
caggacaggcugcggccccuccc

SEQ ID NO: 1147481 - RNA, 16 nt, Human
caggcacugcugccca

SEQ ID NO: 1147482 - RNA, 17 nt, Human
caggcacugcugcccag

SEQ ID NO: 1147483 - RNA, 23 nt, Human
caggcacugcugcccagccucca

SEQ ID NO: 1147484 - RNA, 13 nt, Human
cagccccugcaca

SEQ ID NO: 1147485 - RNA, 13 nt, Human
cagauuugagcuc

SEQ ID NO: 1147486 - RNA, 14 nt, Human
cagauuugagcuca

SEQ ID NO: 1147487 - RNA, 16 nt, Human
cagauuugagcucagc

SEQ ID NO: 1147488 - RNA, 19 nt, Human
caagcucuaucaccaagga

SEQ ID NO: 1147489 - RNA, 16 nt, Human
caaguaugaauaaaga

SEQ ID NO: 1147490 - RNA, 19 nt, Human
caaguaugaauaaagacac

SEQ ID NO: 1147491 - RNA, 21 nt, Human
caaguaugaauaaagacaccu

SEQ ID NO: 1147492 - RNA, 20 nt, Human
caauggagacugucucaaga

SEQ ID NO: 1147493 - RNA, 15 nt, Human
caauucuugccaaau

SEQ ID NO: 1147494 - RNA, 17 nt, Human
caauuuaguuguuguag

SEQ ID NO: 1147495 - RNA, 20 nt, Human
caauuuaguuguuguagaga

SEQ ID NO: 1147496 - RNA, 13 nt, Human
caauuuauaccuc

SEQ ID NO: 1147497 - RNA, 14 nt, Human
caauuuauaccuca

SEQ ID NO: 1147498 - RNA, 22 nt, Human
caauuuauaccucaauuuucac

SEQ ID NO: 1147499 - RNA, 23 nt, Human
cacaggcccuuccucuccacugc

SEQ ID NO: 1147500 - RNA, 14 nt, Human
cacugcauccuccg

SEQ ID NO: 1147501 - RNA, 16 nt, Human
cacugcauccuccgcc

SEQ ID NO: 1147502 - RNA, 18 nt, Human
cacugcauccuccgccuc

SEQ ID NO: 1147503 - RNA, 23 nt, Human
cacugguggcccgacagccuggc

SEQ ID NO: 1147504 - RNA, 23 nt, Human
cacuuaggaacguaaucgugucc

SEQ ID NO: 1147505 - RNA, 14 nt, Human
cacuaggcuucugg

SEQ ID NO: 1147506 - RNA, 11 nt, Human
cacuccagcug

SEQ ID NO: 1147507 - RNA, 12 nt, Human
cacuccagcugg

SEQ ID NO: 1147508 - RNA, 15 nt, Human
cacuccagcugggau

SEQ ID NO: 1147509 - RNA, 20 nt, Human
auuuuuuuuuuuuuccuguc

SEQ ID NO: 1147510 - RNA, 13 nt, Human
auuuggaaaauaa

SEQ ID NO: 1147511 - RNA, 12 nt, Human
auuuggaaaaua

SEQ ID NO: 1147512 - RNA, 14 nt, Human
auuugugccagaau

SEQ ID NO: 1147513 - RNA, 22 nt, Human
auuuguggguuuuuauuuccua

SEQ ID NO: 1147514 - RNA, 21 nt, Human
auuuguggguuuuuauuuccu

SEQ ID NO: 1147515 - RNA, 19 nt, Human
auuuuauagcuacuaauuu

SEQ ID NO: 1147516 - RNA, 17 nt, Human
auuugcauacauucuuc

SEQ ID NO: 1147517 - RNA, 15 nt, Human
auuugccaauaauaa

SEQ ID NO: 1147518 - RNA, 16 nt, Human
auuugccaauaauaau

SEQ ID NO: 1147519 - RNA, 13 nt, Human
auuagcuuauguu

SEQ ID NO: 1147520 - RNA, 21 nt, Human
auuagcuuauguuaacugaca

SEQ ID NO: 1147521 - RNA, 22 nt, Human
auuagcuuauguuaacugacaa

SEQ ID NO: 1147522 - RNA, 15 nt, Human
auuaugauuagcuuu

SEQ ID NO: 1147523 - RNA, 23 nt, Human
auguuugggagacugcugaguca

SEQ ID NO: 1147524 - RNA, 23 nt, Human
auuagauuucucauuugccaaua

SEQ ID NO: 1147525 - RNA, 17 nt, Human
auuagcaguuugcuuug

SEQ ID NO: 1147526 - RNA, 12 nt, Human
auuagccaguaa

SEQ ID NO: 1147527 - RNA, 14 nt, Human
auuagccaguaauc

SEQ ID NO: 1147528 - RNA, 16 nt, Human
auuagccaguaauccu

SEQ ID NO: 1147529 - RNA, 17 nt, Human
auuagccaguaauccug

SEQ ID NO: 1147530 - RNA, 18 nt, Human
auuagccaguaauccugu

SEQ ID NO: 1147531 - RNA, 19 nt, Human
auuagccaguaauccugua

SEQ ID NO: 1147532 - RNA, 23 nt, Human
auuagccaguaauccuguaggaa

SEQ ID NO: 1147533 - RNA, 12 nt, Human
auugcuccuuga

SEQ ID NO: 1147534 - RNA, 16 nt, Human
ccuggcacagggcagu

SEQ ID NO: 1147535 - RNA, 17 nt, Human
ccuggcacagggcagug

SEQ ID NO: 1147536 - RNA, 18 nt, Human
ccuggcacagggcagugg

SEQ ID NO: 1147537 - RNA, 16 nt, Human
ccuggagguuccccag

SEQ ID NO: 1147538 - RNA, 17 nt, Human
ccuggagguuccccagc

SEQ ID NO: 1147539 - RNA, 21 nt, Human
ccuggauccaucaggccacuu

SEQ ID NO: 1147540 - RNA, 21 nt, Human
ccugaguagcugggauuacag

SEQ ID NO: 1147541 - RNA, 14 nt, Human
ccucuugccacugc

SEQ ID NO: 1147542 - RNA, 12 nt, Human
ccucucugcccu

SEQ ID NO: 1147543 - RNA, 12 nt, Human
ccucugccuguc

SEQ ID NO: 1147544 - RNA, 15 nt, Human
ccucugcugauccuc

SEQ ID NO: 1147545 - RNA, 18 nt, Human
ccucugcugauccuccca

SEQ ID NO: 1147546 - RNA, 14 nt, Human
ccucccaggcgccc

SEQ ID NO: 1147547 - RNA, 20 nt, Human
ccucccaggcgccccuuccc

SEQ ID NO: 1147548 - RNA, 13 nt, Human
ccucagccuccug

SEQ ID NO: 1147549 - RNA, 21 nt, Human
ccuccaagcuccaucuccacu

SEQ ID NO: 1147550 - RNA, 22 nt, Human
ccuccaagcuccaucuccacuc

SEQ ID NO: 1147551 - RNA, 22 nt, Human
ccuccaaucccaccaacccuca

SEQ ID NO: 1147552 - RNA, 19 nt, Human
ccggcuaauuuuuguauuu

SEQ ID NO: 1147553 - RNA, 17 nt, Human
ccggcuaugggggcacu

SEQ ID NO: 1147554 - RNA, 22 nt, Human
ccggcuaugggggcacugagga

SEQ ID NO: 1147555 - RNA, 23 nt, Human
ccggcuaugggggcacugaggac

SEQ ID NO: 1147556 - RNA, 16 nt, Human
ccguagguuauuuuca

SEQ ID NO: 1147557 - RNA, 18 nt, Human
ccgucucugguuccuccc

SEQ ID NO: 1147558 - RNA, 17 nt, Human
cccuggcuuuucacugc

SEQ ID NO: 1147559 - RNA, 13 nt, Human
cccuggcuuuuca

SEQ ID NO: 1147560 - RNA, 17 nt, Human
cccuggcucccacaggc

SEQ ID NO: 1147561 - RNA, 19 nt, Human
cccuggcucccacaggccc

SEQ ID NO: 1147562 - RNA, 15 nt, Human
cccucacccuggggc

SEQ ID NO: 1147563 - RNA, 19 nt, Human
ccccucuggcuccagcugg

SEQ ID NO: 1147564 - RNA, 17 nt, Human
cccuauugguaaagaau

SEQ ID NO: 1147565 - RNA, 13 nt, Human
ccccaaaauuagc

SEQ ID NO: 1147566 - RNA, 13 nt, Human
ccccagaggcugg

SEQ ID NO: 1147567 - RNA, 18 nt, Human
cccacuagacccacugga

SEQ ID NO: 1147568 - RNA, 15 nt, Human
cccagcuugaaaccu

SEQ ID NO: 1147569 - RNA, 15 nt, Human
ccaugucaagauuca

SEQ ID NO: 1147570 - RNA, 19 nt, Human
ccaugucaagauucagcua

SEQ ID NO: 1147571 - RNA, 17 nt, Human
ccaugucaagauucagc

SEQ ID NO: 1147572 - RNA, 16 nt, Human
ccaggcacugcugccc

SEQ ID NO: 1147573 - RNA, 18 nt, Human
ccaggcacugcugcccag

SEQ ID NO: 1147574 - RNA, 14 nt, Human
ccuuuuucugcacu

SEQ ID NO: 1147575 - RNA, 15 nt, Human
ccuuuuucugcacua

SEQ ID NO: 1147576 - RNA, 17 nt, Human
ccuuuuucugcacuaua

SEQ ID NO: 1147577 - RNA, 21 nt, Human
ccuuuuucugcacuauaugca

SEQ ID NO: 1147578 - RNA, 18 nt, Human
ccuuuuucugcacuauau

SEQ ID NO: 1147579 - RNA, 12 nt, Human
cgaccaccugcc

SEQ ID NO: 1147580 - RNA, 14 nt, Human
cgaccaccugccca

SEQ ID NO: 1147581 - RNA, 18 nt, Human
cggaggggccuggcagcc

SEQ ID NO: 1147582 - RNA, 17 nt, Human
cggcucacugcauccuc

SEQ ID NO: 1147583 - RNA, 21 nt, Human
cggcucacugcauccuccgcc

SEQ ID NO: 1147584 - RNA, 13 nt, Human
cgccucugcauuc

SEQ ID NO: 1147585 - RNA, 17 nt, Human
cgccuccgggaccccca

SEQ ID NO: 1147586 - RNA, 19 nt, Human
cgccuccgggacccccagg

SEQ ID NO: 1147587 - RNA, 20 nt, Human
cgccuccgggacccccagga

SEQ ID NO: 1147588 - RNA, 22 nt, Human
cgccuccgggacccccaggaca

SEQ ID NO: 1147589 - RNA, 16 nt, Human
cgaccugccucggccu

SEQ ID NO: 1147590 - RNA, 14 nt, Human
cgcaggcuggcccu

SEQ ID NO: 1147591 - RNA, 15 nt, Human
cgcaggcuggcccug

SEQ ID NO: 1147592 - RNA, 17 nt, Human
cgcaggcuggcccugcc

SEQ ID NO: 1147593 - RNA, 18 nt, Human
cgcaggcuggcccugccc

SEQ ID NO: 1147594 - RNA, 19 nt, Human
cgcaggcuggcccugcccu

SEQ ID NO: 1147595 - RNA, 20 nt, Human
cgcaggcuggcccugcccug

SEQ ID NO: 1147596 - RNA, 21 nt, Human
cgcaggcuggcccugcccugg

SEQ ID NO: 1147597 - RNA, 21 nt, Human
cgccgccuccgggacccccag

SEQ ID NO: 1147598 - RNA, 16 nt, Human
cuaguuccccuguuua

SEQ ID NO: 1147599 - RNA, 18 nt, Human
cuaguuccccuguuuauu

SEQ ID NO: 1147600 - RNA, 20 nt, Human
cuaguuccccuguuuauuca

SEQ ID NO: 1147601 - RNA, 15 nt, Human
cuacaagacacagug

SEQ ID NO: 1147602 - RNA, 19 nt, Human
cuacauaacuaauacagcu

SEQ ID NO: 1147603 - RNA, 13 nt, Human
cgugagaccugcc

SEQ ID NO: 1147604 - RNA, 14 nt, Human
cgugagaccugccc

SEQ ID NO: 1147605 - RNA, 16 nt, Human
cgugagaccugccccu

SEQ ID NO: 1147606 - RNA, 23 nt, Human
cgugagccaccgugccuggccac

SEQ ID NO: 1147607 - RNA, 22 nt, Human
cuaaacugcccccucugcccug

SEQ ID NO: 1147608 - RNA, 23 nt, Human
cuaaacugcccccucugcccugc

SEQ ID NO: 1147609 - RNA, 14 nt, Human
cuccagaccccugg

SEQ ID NO: 1147610 - RNA, 18 nt, Human
cucaugccucagccuccu

SEQ ID NO: 1147611 - RNA, 20 nt, Human
cucaugccucagccuccuga

SEQ ID NO: 1147612 - RNA, 15 nt, Human
cuaucccggcugccc

SEQ ID NO: 1147613 - RNA, 16 nt, Human
cuaucccggcugcccu

SEQ ID NO: 1147614 - RNA, 17 nt, Human
cuaucccggcugcccuu

SEQ ID NO: 1147615 - RNA, 12 nt, Human
cucagccuccug

SEQ ID NO: 1147616 - RNA, 13 nt, Human
cucagccuccuga

SEQ ID NO: 1147617 - RNA, 14 nt, Human
cucagcgaaugaau

SEQ ID NO: 1147618 - RNA, 20 nt, Human
cucgggauuaguacacacuu

SEQ ID NO: 1147619 - RNA, 17 nt, Human
cucucaauaaaauuaua

SEQ ID NO: 1147620 - RNA, 14 nt, Human
cucugguuccuccc

SEQ ID NO: 1147621 - RNA, 13 nt, Human
cucuguagccuaa

SEQ ID NO: 1147622 - RNA, 16 nt, Human
cucuugccacugccuc

SEQ ID NO: 1147623 - RNA, 17 nt, Human
cucuugccacugccucu

SEQ ID NO: 1147624 - RNA, 18 nt, Human
cucuugccacugccucuu

SEQ ID NO: 1147625 - RNA, 19 nt, Human
cucuugccacugccucuuc

SEQ ID NO: 1147626 - RNA, 20 nt, Human
cucuugccacugccucuucc

SEQ ID NO: 1147627 - RNA, 22 nt, Human
cucuugccacugccucuuccuc

SEQ ID NO: 1147628 - RNA, 22 nt, Human
cugaaggaauaaauugcuccuu

SEQ ID NO: 1147629 - RNA, 22 nt, Human
cugaaggggaaggaaauagcuu

SEQ ID NO: 1147630 - RNA, 17 nt, Human
cugcauuauuugagaag

SEQ ID NO: 1147631 - RNA, 24 nt, Human
cugcauuauuugagaagcugcuca

SEQ ID NO: 1147632 - RNA, 20 nt, Human
cugcauucaggaucaaaccc

SEQ ID NO: 1147633 - RNA, 13 nt, Human
cugcauuugugaa

SEQ ID NO: 1147634 - RNA, 14 nt, Human
cugcauuugugaaa

SEQ ID NO: 1147635 - RNA, 15 nt, Human
cugcauuugugaaau

SEQ ID NO: 1147636 - RNA, 17 nt, Human
cugcauuugugaaauga

SEQ ID NO: 1147637 - RNA, 22 nt, Human
cugcauuugugaaaugauggug

SEQ ID NO: 1147638 - RNA, 19 nt, Human
cugccccagggcucccggc

SEQ ID NO: 1147639 - RNA, 14 nt, Human
cugcccccucugcc

SEQ ID NO: 1147640 - RNA, 15 nt, Human
cugcccccucugccc

SEQ ID NO: 1147641 - RNA, 16 nt, Human
cugcccccucugcccu

SEQ ID NO: 1147642 - RNA, 17 nt, Human
cugcccccucugcccug

SEQ ID NO: 1147643 - RNA, 18 nt, Human
cugcccccucugcccugc

SEQ ID NO: 1147644 - RNA, 19 nt, Human
cugcccccucugcccugcg

SEQ ID NO: 1147645 - RNA, 13 nt, Human
cugccccucccuu

SEQ ID NO: 1147646 - RNA, 17 nt, Human
cugcccuggugcugcca

SEQ ID NO: 1147647 - RNA, 18 nt, Human
cugcccuggugcugccac

SEQ ID NO: 1147648 - RNA, 19 nt, Human
cugcccuggugcugccaca

SEQ ID NO: 1147649 - RNA, 20 nt, Human
cugcccuggugcugccacac

SEQ ID NO: 1147650 - RNA, 21 nt, Human
cugcccuggugcugccacacu

SEQ ID NO: 1147651 - RNA, 22 nt, Human
cugcccugguuuccugcccugg

SEQ ID NO: 1147652 - RNA, 23 nt, Human
cugcccugguuuccugcccuggg

SEQ ID NO: 1147653 - RNA, 23 nt, Human
cugcccuggugcugccacacuuc

SEQ ID NO: 1147654 - RNA, 13 nt, Human
cuggcuccagcug

SEQ ID NO: 1147655 - RNA, 14 nt, Human
cuggcuccagcugg

SEQ ID NO: 1147656 - RNA, 18 nt, Human
cuggcuccagcuggccgg

SEQ ID NO: 1147657 - RNA, 20 nt, Human
cuggcuccagcuggccggga

SEQ ID NO: 1147658 - RNA, 15 nt, Human
cuggcucccacaggc

SEQ ID NO: 1147659 - RNA, 18 nt, Human
cuggcucccacaggcccu

SEQ ID NO: 1147660 - RNA, 15 nt, Human
cuggggaaccugacc

SEQ ID NO: 1147661 - RNA, 16 nt, Human
cuggggaaccugaccc

SEQ ID NO: 1147662 - RNA, 17 nt, Human
cuggggaaccugacccc

SEQ ID NO: 1147663 - RNA, 18 nt, Human
cuggguuccuuccucuga

SEQ ID NO: 1147664 - RNA, 22 nt, Human
cuggguuccuuccucugagccu

SEQ ID NO: 1147665 - RNA, 23 nt, Human
cuggguuccuuccucugagccuu

SEQ ID NO: 1147666 - RNA, 18 nt, Human
cugguuuccugcccuggg

SEQ ID NO: 1147667 - RNA, 21 nt, Human
cugguuuccugcccugggagg

SEQ ID NO: 1147668 - RNA, 22 nt, Human
cugguuuccugcccugggaggc

SEQ ID NO: 1147669 - RNA, 12 nt, Human
cuguccugccua

SEQ ID NO: 1147670 - RNA, 16 nt, Human
cugucgcccaggcugg

SEQ ID NO: 1147671 - RNA, 15 nt, Human
cuucacuguaaaaua

SEQ ID NO: 1147672 - RNA, 11 nt, Human
cuuccauaauc

SEQ ID NO: 1147673 - RNA, 21 nt, Human
cuuccauaaucuggacuccuc

SEQ ID NO: 1147674 - RNA, 13 nt, Human
cuucuagaaccag

SEQ ID NO: 1147675 - RNA, 17 nt, Human
cuucuagaaccaggcaa

SEQ ID NO: 1147676 - RNA, 17 nt, Human
cuucuguugcugccuca

SEQ ID NO: 1147677 - RNA, 18 nt, Human
cuucuguugcugccucau

SEQ ID NO: 1147678 - RNA, 19 nt, Human
cuucuguugcugccucaug

SEQ ID NO: 1147679 - RNA, 20 nt, Human
cuucuguugcugccucaugc

SEQ ID NO: 1147680 - RNA, 21 nt, Human
cuucuguugcugccucaugcu

SEQ ID NO: 1147681 - RNA, 14 nt, Human
cuuucacaaccuuc

SEQ ID NO: 1147682 - RNA, 16 nt, Human
cuuucacaaccuucug

SEQ ID NO: 1147683 - RNA, 22 nt, Human
cuuugauauuuucaacgcagcc

SEQ ID NO: 1147684 - RNA, 14 nt, Human
cuuugggcugcccu

SEQ ID NO: 1147685 - RNA, 15 nt, Human
cuuugggcugcccug

SEQ ID NO: 1147686 - RNA, 19 nt, Human
cuuugggcugcccuggugc

SEQ ID NO: 1147687 - RNA, 20 nt, Human
cuuugggcugcccuggugcu

SEQ ID NO: 1147688 - RNA, 21 nt, Human
cuuugggcugcccuggugcug

SEQ ID NO: 1147689 - RNA, 15 nt, Human
cuuuguaaauuguca

SEQ ID NO: 1147690 - RNA, 15 nt, Human
cuuuuaguuccugug

SEQ ID NO: 1147691 - RNA, 22 nt, Human
cuuuuaguuccugugcacagcc

SEQ ID NO: 1147692 - RNA, 21 nt, Human
cuuuuaguuccugugcacagc

SEQ ID NO: 1147693 - RNA, 13 nt, Human
cuuuugccauuga

SEQ ID NO: 1147694 - RNA, 13 nt, Human
cuuuuggagucag

SEQ ID NO: 1147695 - RNA, 18 nt, Human
cuuuuggauuggacaaaa

SEQ ID NO: 1147696 - RNA, 19 nt, Human
cuuuuggauuggacaaaau

SEQ ID NO: 1147697 - RNA, 21 nt, Human
cuuuuggauuggacaaaauga

SEQ ID NO: 1147698 - RNA, 23 nt, Human
cuuuuggauuggacaaaaugacu

SEQ ID NO: 1147699 - RNA, 20 nt, Human
cuuuuuuuuuuuugagacag

SEQ ID NO: 1147700 - RNA, 21 nt, Human
cuuuuuuuuuuuugagacaga

SEQ ID NO: 1147701 - RNA, 23 nt, Human
gaaaaugcuguauuagucacaga

SEQ ID NO: 1147702 - RNA, 18 nt, Human
gaaaggcugcuguacuga

SEQ ID NO: 1147703 - RNA, 19 nt, Human
gaaaggcugcuguacugaa

SEQ ID NO: 1147704 - RNA, 20 nt, Human
gaaaggcugcuguacugaag

SEQ ID NO: 1147705 - RNA, 23 nt, Human
gaaaggcugcuguacugaaguaa

SEQ ID NO: 1147706 - RNA, 13 nt, Human
gaaauccagggug

SEQ ID NO: 1147707 - RNA, 18 nt, Human
gaaauccagggugguggu

SEQ ID NO: 1147708 - RNA, 14 nt, Human
gaagcugcucaacu

SEQ ID NO: 1147709 - RNA, 20 nt, Human
gaagcugcucaacuugcaaa

SEQ ID NO: 1147710 - RNA, 15 nt, Human
gaaguggggacagag

SEQ ID NO: 1147711 - RNA, 21 nt, Human
gaauuuuauuuuuugggaaaa

SEQ ID NO: 1147712 - RNA, 22 nt, Human
gacaaaauacuugucuguuuua

SEQ ID NO: 1147713 - RNA, 12 nt, Human
gacaaaauguua

SEQ ID NO: 1147714 - RNA, 16 nt, Human
gacaaaauguuauuuc

SEQ ID NO: 1147715 - RNA, 13 nt, Human
gacaaaauguuau

SEQ ID NO: 1147716 - RNA, 13 nt, Human
gacagcccuccau

SEQ ID NO: 1147717 - RNA, 19 nt, Human
gacagccuggcacagggca

SEQ ID NO: 1147718 - RNA, 14 nt, Human
gacagugaaagaaa

SEQ ID NO: 1147719 - RNA, 15 nt, Human
gacuaggguccuggg

SEQ ID NO: 1147720 - RNA, 16 nt, Human
gacuaggguccugggg

SEQ ID NO: 1147721 - RNA, 18 nt, Human
gacuaggguccuggggaa

SEQ ID NO: 1147722 - RNA, 11 nt, Human
gacuuuccucu

SEQ ID NO: 1147723 - RNA, 20 nt, Human
gagaaggacccggaggggcc

SEQ ID NO: 1147724 - RNA, 22 nt, Human
gagaaggacccggaggggccug

SEQ ID NO: 1147725 - RNA, 23 nt, Human
gagaaggacccggaggggccugg

SEQ ID NO: 1147726 - RNA, 11 nt, Human
gagaccugccc

SEQ ID NO: 1147727 - RNA, 12 nt, Human
gagaccugcccc

SEQ ID NO: 1147728 - RNA, 13 nt, Human
gagaccugccccu

SEQ ID NO: 1147729 - RNA, 16 nt, Human
gagaugcagugccagg

SEQ ID NO: 1147730 - RNA, 19 nt, Human
gaucucuucuuaauguaca

SEQ ID NO: 1147731 - RNA, 21 nt, Human
gaucucuucuuaauguacaua

SEQ ID NO: 1147732 - RNA, 20 nt, Human
gauuacaggugugagccacc

SEQ ID NO: 1147733 - RNA, 19 nt, Human
gauuagcuuugucacuguu

SEQ ID NO: 1147734 - RNA, 21 nt, Human
gcacaaucucggcucacugca

SEQ ID NO: 1147735 - RNA, 22 nt, Human
gcacaaucucggcucacugcau

SEQ ID NO: 1147736 - RNA, 14 nt, Human
gcagaacaaaugaa

SEQ ID NO: 1147737 - RNA, 15 nt, Human
gcagaacaaaugaag

SEQ ID NO: 1147738 - RNA, 15 nt, Human
gcaggcuggcccugc

SEQ ID NO: 1147739 - RNA, 16 nt, Human
gcaggcuggcccugcc

SEQ ID NO: 1147740 - RNA, 17 nt, Human
gcaggcuggcccugccc

SEQ ID NO: 1147741 - RNA, 18 nt, Human
gcaggcuggcccugcccu

SEQ ID NO: 1147742 - RNA, 19 nt, Human
gcaggcuggcccugcccug

SEQ ID NO: 1147743 - RNA, 20 nt, Human
gcaggcuggcccugcccugg

SEQ ID NO: 1147744 - RNA, 21 nt, Human
gcaggcuggcccugcccuggu

SEQ ID NO: 1147745 - RNA, 10 nt, Human
gcagggaggg

SEQ ID NO: 1147746 - RNA, 13 nt, Human
gcagggagggccu

SEQ ID NO: 1147747 - RNA, 16 nt, Human
gcagguugauaaauca

SEQ ID NO: 1147748 - RNA, 17 nt, Human
gcagguugauaaaucau

SEQ ID NO: 1147749 - RNA, 19 nt, Human
gcagguugauaaaucauuu

SEQ ID NO: 1147750 - RNA, 20 nt, Human
gcaguaucggcacuguacaa

SEQ ID NO: 1147751 - RNA, 22 nt, Human
gcaguaucggcacuguacaaaa

SEQ ID NO: 1147752 - RNA, 16 nt, Human
gccauaugaaaaggcu

SEQ ID NO: 1147753 - RNA, 16 nt, Human
gcccucacccuggggc

SEQ ID NO: 1147754 - RNA, 17 nt, Human
gcccucacccuggggcu

SEQ ID NO: 1147755 - RNA, 17 nt, Human
gccuccaagcuccaucu

SEQ ID NO: 1147756 - RNA, 11 nt, Human
gccuccaugcu

SEQ ID NO: 1147757 - RNA, 13 nt, Human
gccucggacuuag

SEQ ID NO: 1147758 - RNA, 20 nt, Human
gccucggacuuagcugggag

SEQ ID NO: 1147759 - RNA, 14 nt, Human
gcggccccuccccc

SEQ ID NO: 1147760 - RNA, 17 nt, Human
gcggccccucccccguc

SEQ ID NO: 1147761 - RNA, 19 nt, Human
gcuccucccggugcccaag

SEQ ID NO: 1147762 - RNA, 18 nt, Human
gcugaaacgcaucuaguu

SEQ ID NO: 1147763 - RNA, 20 nt, Human
gcugaacuuguuuucuggga

SEQ ID NO: 1147764 - RNA, 12 nt, Human
gcugagccucag

SEQ ID NO: 1147765 - RNA, 16 nt, Human
gcugagccucagucuc

SEQ ID NO: 1147766 - RNA, 17 nt, Human
gcugagucccaggcuga

SEQ ID NO: 1147767 - RNA, 16 nt, Human
gcugcuguacugaagu

SEQ ID NO: 1147768 - RNA, 20 nt, Human
gcuguacugaaguaaaacaa

SEQ ID NO: 1147769 - RNA, 19 nt, Human
gcuguacugaaguaaaaca

SEQ ID NO: 1147770 - RNA, 12 nt, Human
gcugugccucug

SEQ ID NO: 1147771 - RNA, 21 nt, Human
gcuuuccccaugucucgacuc

SEQ ID NO: 1147772 - RNA, 22 nt, Human
gcuuuccccaugucucgacuca

SEQ ID NO: 1147773 - RNA, 16 nt, Human
gcuuuccucuuccuga

SEQ ID NO: 1147774 - RNA, 17 nt, Human
ggaaaugucaacaagua

SEQ ID NO: 1147775 - RNA, 17 nt, Human
ggaacaccauaggucac

SEQ ID NO: 1147776 - RNA, 16 nt, Human
ggagcaucagugcccu

SEQ ID NO: 1147777 - RNA, 16 nt, Human
ggagccaauggagacu

SEQ ID NO: 1147778 - RNA, 21 nt, Human
ggaguuggaagugugugaucu

SEQ ID NO: 1147779 - RNA, 21 nt, Human
ggauguacaaggacagccccu

SEQ ID NO: 1147780 - RNA, 22 nt, Human
ggcacaaucucggcucacugca

SEQ ID NO: 1147781 - RNA, 16 nt, Human
ggcacagggcaguggg

SEQ ID NO: 1147782 - RNA, 15 nt, Human
ggcccgacagccugg

SEQ ID NO: 1147783 - RNA, 13 nt, Human
ggcccuuccucuc

SEQ ID NO: 1147784 - RNA, 15 nt, Human
ggcccuuccucucca

SEQ ID NO: 1147785 - RNA, 18 nt, Human
ggcccuuccucuccacug

SEQ ID NO: 1147786 - RNA, 17 nt, Human
ggcccuuccucuccacu

SEQ ID NO: 1147787 - RNA, 16 nt, Human
ggcucacugcauccuc

SEQ ID NO: 1147788 - RNA, 19 nt, Human
ggcucacugcauccuccgc

SEQ ID NO: 1147789 - RNA, 21 nt, Human
aaaaauaugaccacacuccag

SEQ ID NO: 1147790 - RNA, 23 nt, Human
aaaaauaugaccacacuccagcu

SEQ ID NO: 1147791 - RNA, 18 nt, Human
aaaagcagguugauaaau

SEQ ID NO: 1147792 - RNA, 22 nt, Human
aaaagcagguugauaaaucauu

SEQ ID NO: 1147793 - RNA, 14 nt, Human
gggauuacaggcgu

SEQ ID NO: 1147794 - RNA, 13 nt, Human
gggauuacaggcu

SEQ ID NO: 1147795 - RNA, 16 nt, Human
gggauuacaggcuccu

SEQ ID NO: 1147796 - RNA, 21 nt, Human
gggauuacaggcuccugccac

SEQ ID NO: 1147797 - RNA, 12 nt, Human
gggauuacaggu

SEQ ID NO: 1147798 - RNA, 16 nt, Human
gggcaaauuggagaaa

SEQ ID NO: 1147799 - RNA, 17 nt, Human
aaaaugcucuuauuuca

SEQ ID NO: 1147800 - RNA, 20 nt, Human
aaaaugcucuuauuucauca

SEQ ID NO: 1147801 - RNA, 18 nt, Human
aaaaugcucuuauuucau

SEQ ID NO: 1147802 - RNA, 21 nt, Human
aaaaugcuguauuagucacag

SEQ ID NO: 1147803 - RNA, 22 nt, Human
gggccucggacuuagcugggag

SEQ ID NO: 1147804 - RNA, 23 nt, Human
gggcuacaccuuagccugcccuc

SEQ ID NO: 1147805 - RNA, 13 nt, Human
gggcugcccuggu

SEQ ID NO: 1147806 - RNA, 14 nt, Human
gggcugcccuggug

SEQ ID NO: 1147807 - RNA, 15 nt, Human
gggcugcccuggugc

SEQ ID NO: 1147808 - RNA, 21 nt, Human
gggcugcccuggugcugccac

SEQ ID NO: 1147809 - RNA, 16 nt, Human
gggcugggagcucugc

SEQ ID NO: 1147810 - RNA, 18 nt, Human
gggcugggagcucugcag

SEQ ID NO: 1147811 - RNA, 12 nt, Human
aaaaugugugug

SEQ ID NO: 1147812 - RNA, 20 nt, Human
aaacaagcacuaaacaaaga

SEQ ID NO: 1147813 - RNA, 15 nt, Human
aaacaguugcacagc

SEQ ID NO: 1147814 - RNA, 16 nt, Human
aaacaguugcacagca

SEQ ID NO: 1147815 - RNA, 17 nt, Human
aaacaguugcacagcau

SEQ ID NO: 1147816 - RNA, 18 nt, Human
aaacaguugcacagcauc

SEQ ID NO: 1147817 - RNA, 19 nt, Human
aaacaguugcacagcaucu

SEQ ID NO: 1147818 - RNA, 21 nt, Human
aaacaguugcacagcaucuca

SEQ ID NO: 1147819 - RNA, 18 nt, Human
aaacauccuacaagacac

SEQ ID NO: 1147820 - RNA, 22 nt, Human
aaacauccuacaagacacagug

SEQ ID NO: 1147821 - RNA, 17 nt, Human
aaacauccucuuccaua

SEQ ID NO: 1147822 - RNA, 16 nt, Human
aaacaugcagaacaaa

SEQ ID NO: 1147823 - RNA, 20 nt, Human
aaacaugcagaacaaaugaa

SEQ ID NO: 1147824 - RNA, 11 nt, Human
ggggccuggca

SEQ ID NO: 1147825 - RNA, 12 nt, Human
ggggccuggcag

SEQ ID NO: 1147826 - RNA, 14 nt, Human
gguaaucgaccugc

SEQ ID NO: 1147827 - RNA, 17 nt, Human
gguaaucgaccugccuc

SEQ ID NO: 1147828 - RNA, 18 nt, Human
gguaaucgaccugccucg

SEQ ID NO: 1147829 - RNA, 23 nt, Human
gguacaaccuguucugcuuuccu

SEQ ID NO: 1147830 - RNA, 24 nt, Human
gguacaaccuguucugcuuuccuc

SEQ ID NO: 1147831 - RNA, 14 nt, Human
gguagcuuuucccu

SEQ ID NO: 1147832 - RNA, 16 nt, Human
gguccacaacacacag

SEQ ID NO: 1147833 - RNA, 18 nt, Human
aaagaaguggggacagag

SEQ ID NO: 1147834 - RNA, 13 nt, Human
aaagacaccuacu

SEQ ID NO: 1147835 - RNA, 19 nt, Human
aaagacaccuacugagugg

SEQ ID NO: 1147836 - RNA, 13 nt, Human
aaagcaaaugucu

SEQ ID NO: 1147837 - RNA, 22 nt, Human
ggucgggcagcacaaguguaau

SEQ ID NO: 1147838 - RNA, 23 nt, Human
gguuccagcaauucuccugccuc

SEQ ID NO: 1147839 - RNA, 24 nt, Human
gguuccagcaauucuccugccuca

SEQ ID NO: 1147840 - RNA, 15 nt, Human
gguuccccuguucac

SEQ ID NO: 1147841 - RNA, 16 nt, Human
gguuccuccccuccuc

SEQ ID NO: 1147842 - RNA, 19 nt, Human
gguuccuuccucugagccu

SEQ ID NO: 1147843 - RNA, 20 nt, Human
gguuccuuccucugagccuu

SEQ ID NO: 1147844 - RNA, 21 nt, Human
gguuuaugacaguaauugugu

SEQ ID NO: 1147845 - RNA, 21 nt, Human
aaaguucccuacuuccuguga

SEQ ID NO: 1147846 - RNA, 23 nt, Human
aaaguucccuacuuccugugacu

SEQ ID NO: 1147847 - RNA, 19 nt, Human
aaauaaaaaaaaaaaagag

SEQ ID NO: 1147848 - RNA, 15 nt, Human
guauaaguggugugu

SEQ ID NO: 1147849 - RNA, 13 nt, Human
guaucaaaaugcu

SEQ ID NO: 1147850 - RNA, 14 nt, Human
guaucaaaaugcuc

SEQ ID NO: 1147851 - RNA, 22 nt, Human
guaucaaaaugcucuuauuuca

SEQ ID NO: 1147852 - RNA, 15 nt, Human
guaugcgugugugug

SEQ ID NO: 1147853 - RNA, 12 nt, Human
aaaugugugugu

SEQ ID NO: 1147854 - RNA, 14 nt, Human
gucaaacgugaaaa

SEQ ID NO: 1147855 - RNA, 15 nt, Human
gucaaacgugaaaau

SEQ ID NO: 1147856 - RNA, 17 nt, Human
gucaaacgugaaaaugc

SEQ ID NO: 1147857 - RNA, 21 nt, Human
gucaacaaguaugaauaaaga

SEQ ID NO: 1147858 - RNA, 23 nt, Human
aaauuuuaucugccucucuugua

SEQ ID NO: 1147859 - RNA, 17 nt, Human
aacaagaugaaauucca

SEQ ID NO: 1147860 - RNA, 21 nt, Human
aacaagccuccuuuuaaagua

SEQ ID NO: 1147861 - RNA, 12 nt, Human
aacaauaaaaga

SEQ ID NO: 1147862 - RNA, 19 nt, Human
aacaauaaaaguguccauu

SEQ ID NO: 1147863 - RNA, 14 nt, Human
aacaguugcacagc

SEQ ID NO: 1147864 - RNA, 15 nt, Human
aacaguugcacagca

SEQ ID NO: 1147865 - RNA, 17 nt, Human
aacaguugcacagcauc

SEQ ID NO: 1147866 - RNA, 18 nt, Human
aacaguugcacagcaucu

SEQ ID NO: 1147867 - RNA, 20 nt, Human
aacaguugcacagcaucuca

SEQ ID NO: 1147868 - RNA, 22 nt, Human
aacaguugcacagcaucucagc

SEQ ID NO: 1147869 - RNA, 13 nt, Human
gucucgaacuccu

SEQ ID NO: 1147870 - RNA, 18 nt, Human
gucucgaacuccugaccu

SEQ ID NO: 1147871 - RNA, 19 nt, Human
gucucgaacuccugaccuu

SEQ ID NO: 1147872 - RNA, 18 nt, Human
aaccaagccguggcuucc

SEQ ID NO: 1147873 - RNA, 16 nt, Human
aaccauugugcauucu

SEQ ID NO: 1147874 - RNA, 13 nt, Human
aaccauugugcau

SEQ ID NO: 1147875 - RNA, 13 nt, Human
aacccaauaguug

SEQ ID NO: 1147876 - RNA, 11 nt, Human
aaccugacccc

SEQ ID NO: 1147877 - RNA, 16 nt, Human
gucuguacugauucaa

SEQ ID NO: 1147878 - RNA, 16 nt, Human
gucuuucacauuuaaa

SEQ ID NO: 1147879 - RNA, 17 nt, Human
aacuaccaccugacauu

SEQ ID NO: 1147880 - RNA, 23 nt, Human
aacuagacucccaagcuggacua

SEQ ID NO: 1147881 - RNA, 16 nt, Human
aacuaugauuuggaaa

SEQ ID NO: 1147882 - RNA, 21 nt, Human
aacuaugauuuggaaaauaaa

SEQ ID NO: 1147883 - RNA, 20 nt, Human
aacucugacaacagacuucu

SEQ ID NO: 1147884 - RNA, 22 nt, Human
aacucugacaacagacuucuga

SEQ ID NO: 1147885 - RNA, 23 nt, Human
aacucugacaacagacuucugaa

SEQ ID NO: 1147886 - RNA, 20 nt, Human
aacugcaauacaaguuucau

SEQ ID NO: 1147887 - RNA, 20 nt, Human
aacugcaccaguugcugcuu

SEQ ID NO: 1147888 - RNA, 14 nt, Human
gugaugguuccccu

SEQ ID NO: 1147889 - RNA, 16 nt, Human
gugaugguuccccugu

SEQ ID NO: 1147890 - RNA, 22 nt, Human
gugaugguuccccuguucacuc

SEQ ID NO: 1147891 - RNA, 11 nt, Human
gugcacagccc

SEQ ID NO: 1147892 - RNA, 14 nt, Human
gugcacagccccua

SEQ ID NO: 1147893 - RNA, 12 nt, Human
gugccucugccu

SEQ ID NO: 1147894 - RNA, 14 nt, Human
aacuugcaaaauca

SEQ ID NO: 1147895 - RNA, 17 nt, Human
aacuugcaaaaucaguu

SEQ ID NO: 1147896 - RNA, 18 nt, Human
aacuugcaaaaucaguuu

SEQ ID NO: 1147897 - RNA, 19 nt, Human
aacuugcaaaaucaguuuu

SEQ ID NO: 1147898 - RNA, 15 nt, Human
aagaccuuuuucugc

SEQ ID NO: 1147899 - RNA, 16 nt, Human
aagaccuuuuucugca

SEQ ID NO: 1147900 - RNA, 20 nt, Human
aagaccuuuuucugcacuau

SEQ ID NO: 1147901 - RNA, 18 nt, Human
aagaccuuuuucugcacu

SEQ ID NO: 1147902 - RNA, 17 nt, Human
gugggaagggcuacacc

SEQ ID NO: 1147903 - RNA, 20 nt, Human
aagauggcugugccucugcc

SEQ ID NO: 1147904 - RNA, 21 nt, Human
aagauggcugugccucugccu

SEQ ID NO: 1147905 - RNA, 23 nt, Human
aagauggcugugccucugccugu

SEQ ID NO: 1147906 - RNA, 20 nt, Human
gugugugaaaaugugugugu

SEQ ID NO: 1147907 - RNA, 14 nt, Human
aagcagguugauaa

SEQ ID NO: 1147908 - RNA, 15 nt, Human
aagcagguugauaaa

SEQ ID NO: 1147909 - RNA, 19 nt, Human
aagcagguugauaaaucau

SEQ ID NO: 1147910 - RNA, 15 nt, Human
aagcccuuccauguc

SEQ ID NO: 1147911 - RNA, 20 nt, Human
aagcccuuccaugucgccuc

SEQ ID NO: 1147912 - RNA, 23 nt, Human
aagcccuuccaugucgccucugc

SEQ ID NO: 1147913 - RNA, 18 nt, Human
guuauuaugauuagcuuu

SEQ ID NO: 1147914 - RNA, 14 nt, Human
aagcuccaucucca

SEQ ID NO: 1147915 - RNA, 20 nt, Human
aagcuccaucuccacuccag

SEQ ID NO: 1147916 - RNA, 21 nt, Human
aaggaauaaauugcuccuuga

SEQ ID NO: 1147917 - RNA, 17 nt, Human
guuuaaucauauaaaua

SEQ ID NO: 1147918 - RNA, 19 nt, Human
guuuaaucauauaaauaga

SEQ ID NO: 1147919 - RNA, 18 nt, Human
guuuaaugaaugcuuaaa

SEQ ID NO: 1147920 - RNA, 15 nt, Human
guuuaaugaaugcuu

SEQ ID NO: 1147921 - RNA, 23 nt, Human
aaggcucugagcaaauguggcuc

SEQ ID NO: 1147922 - RNA, 23 nt, Human
aaggcucuguuccacauauauuu

SEQ ID NO: 1147923 - RNA, 13 nt, Human
aaguaagcaaaga

SEQ ID NO: 1147924 - RNA, 21 nt, Human
aagucaugcguuuaaucacau

SEQ ID NO: 1147925 - RNA, 16 nt, Human
aagucuuucacauuua

SEQ ID NO: 1147926 - RNA, 22 nt, Human
uaaaaccuuccaugucaagauu

SEQ ID NO: 1147927 - RNA, 20 nt, Human
uaaaagacagugaaagaaaa

SEQ ID NO: 1147928 - RNA, 18 nt, Human
uaaaaguguccauugaaa

SEQ ID NO: 1147929 - RNA, 16 nt, Human
uaaaaguguccauuga

SEQ ID NO: 1147930 - RNA, 13 nt, Human
uaaaauauuccug

SEQ ID NO: 1147931 - RNA, 22 nt, Human
uaaaauauuccugcauuuguga

SEQ ID NO: 1147932 - RNA, 20 nt, Human
aagugauucucaugccucag

SEQ ID NO: 1147933 - RNA, 21 nt, Human
aagugauucucaugccucagc

SEQ ID NO: 1147934 - RNA, 13 nt, Human
uaaaugugguaaa

SEQ ID NO: 1147935 - RNA, 15 nt, Human
aauaccucuaauagu

SEQ ID NO: 1147936 - RNA, 17 nt, Human
aauaccugaaugcucug

SEQ ID NO: 1147937 - RNA, 18 nt, Human
aauaccugaaugcucugu

SEQ ID NO: 1147938 - RNA, 17 nt, Human
uaacuaaaacaaagcca

SEQ ID NO: 1147939 - RNA, 20 nt, Human
uaacuaaaacaaagccacuu

SEQ ID NO: 1147940 - RNA, 16 nt, Human
uaacuauguugauaaa

SEQ ID NO: 1147941 - RNA, 15 nt, Human
aauauuuauagguca

SEQ ID NO: 1147942 - RNA, 18 nt, Human
aaucagcauucucacucc

SEQ ID NO: 1147943 - RNA, 19 nt, Human
aaucagcauucucacuccu

SEQ ID NO: 1147944 - RNA, 14 nt, Human
aaucaguuuuccuc

SEQ ID NO: 1147945 - RNA, 12 nt, Human
aaucccaggaug

SEQ ID NO: 1147946 - RNA, 24 nt, Human
aaugauuucagcucacugcaaccu

SEQ ID NO: 1147947 - RNA, 22 nt, Human
uaauuccguagguuauuuucag

SEQ ID NO: 1147948 - RNA, 15 nt, Human
uaauuuuuguauuuu

SEQ ID NO: 1147949 - RNA, 21 nt, Human
uaauuuuuguauuuuuaguag

SEQ ID NO: 1147950 - RNA, 22 nt, Human
uaauuuuuuuuuuccuuuuaaa

SEQ ID NO: 1147951 - RNA, 12 nt, Human
aauguaaauaaa

SEQ ID NO: 1147952 - RNA, 15 nt, Human
uacaccgggccugga

SEQ ID NO: 1147953 - RNA, 17 nt, Human
uacaccgggccuggaga

SEQ ID NO: 1147954 - RNA, 14 nt, Human
aauguuauuucccu

SEQ ID NO: 1147955 - RNA, 15 nt, Human
uacccccugcaaagc

SEQ ID NO: 1147956 - RNA, 19 nt, Human
uacccccugcaaagcccag

SEQ ID NO: 1147957 - RNA, 23 nt, Human
uacccccugcaaagcccagcuug

SEQ ID NO: 1147958 - RNA, 14 nt, Human
uaccugaaugcucu

SEQ ID NO: 1147959 - RNA, 16 nt, Human
uaccugaaugcucugu

SEQ ID NO: 1147960 - RNA, 17 nt, Human
aauuacuuaguauugca

SEQ ID NO: 1147961 - RNA, 13 nt, Human
aauuacuuaguau

SEQ ID NO: 1147962 - RNA, 12 nt, Human
aauuccacagcu

SEQ ID NO: 1147963 - RNA, 13 nt, Human
aauuccacagcug

SEQ ID NO: 1147964 - RNA, 14 nt, Human
aauuccacagcugc

SEQ ID NO: 1147965 - RNA, 22 nt, Human
aauuuggaucucuucuuaaugu

SEQ ID NO: 1147966 - RNA, 23 nt, Human
aauuuggaucucuucuuaaugua

SEQ ID NO: 1147967 - RNA, 16 nt, Human
uagcgcacucuucaug

SEQ ID NO: 1147968 - RNA, 13 nt, Human
uagcuuuucccuu

SEQ ID NO: 1147969 - RNA, 19 nt, Human
uagggauggggcugugggg

SEQ ID NO: 1147970 - RNA, 13 nt, Human
uaggguccugggg

SEQ ID NO: 1147971 - RNA, 15 nt, Human
uagggugggccuuca

SEQ ID NO: 1147972 - RNA, 23 nt, Human
acacacagauuugagcucagccc

SEQ ID NO: 1147973 - RNA, 13 nt, Human
uaguaaaaauaaa

SEQ ID NO: 1147974 - RNA, 16 nt, Human
uaguaaaaauaaaauu

SEQ ID NO: 1147975 - RNA, 13 nt, Human
uaguagagacggg

SEQ ID NO: 1147976 - RNA, 23 nt, Human
uauagcucuaauguuugcauaua

SEQ ID NO: 1147977 - RNA, 15 nt, Human
uauaggcaccuacca

SEQ ID NO: 1147978 - RNA, 22 nt, Human
uauaucuagguuuaugacagua

SEQ ID NO: 1147979 - RNA, 18 nt, Human
uauaucuagguuuaugac

SEQ ID NO: 1147980 - RNA, 15 nt, Human
acacuucaggcucuu

SEQ ID NO: 1147981 - RNA, 19 nt, Human
acacuucaggcucuucucc

SEQ ID NO: 1147982 - RNA, 22 nt, Human
acacuucaggcucuucuccuuu

SEQ ID NO: 1147983 - RNA, 14 nt, Human
acacuuccauaauc

SEQ ID NO: 1147984 - RNA, 15 nt, Human
uaucccggcugcccu

SEQ ID NO: 1147985 - RNA, 22 nt, Human
acagauuugagcucagcccugg

SEQ ID NO: 1147986 - RNA, 19 nt, Human
acagcacgggggccaagga

SEQ ID NO: 1147987 - RNA, 17 nt, Human
acagcagccccugcaca

SEQ ID NO: 1147988 - RNA, 14 nt, Human
acagccccuccucc

SEQ ID NO: 1147989 - RNA, 16 nt, Human
acagccccuccuccau

SEQ ID NO: 1147990 - RNA, 12 nt, Human
uaugaucaaaug

SEQ ID NO: 1147991 - RNA, 13 nt, Human
uaugaucaaaugu

SEQ ID NO: 1147992 - RNA, 14 nt, Human
uaugaucaaauguu

SEQ ID NO: 1147993 - RNA, 15 nt, Human
uaugaucaaauguuu

SEQ ID NO: 1147994 - RNA, 16 nt, Human
uaugaucaaauguuua

SEQ ID NO: 1147995 - RNA, 18 nt, Human
uaugaucaaauguuuaau

SEQ ID NO: 1147996 - RNA, 20 nt, Human
uaugaucaaauguuuaauca

SEQ ID NO: 1147997 - RNA, 22 nt, Human
uaugaucaaauguuuaaucaua

SEQ ID NO: 1147998 - RNA, 17 nt, Human
uauggugccuaguauug

SEQ ID NO: 1147999 - RNA, 19 nt, Human
uauggugccuaguauugac

SEQ ID NO: 1148000 - RNA, 18 nt, Human
uauggugccuaguauuga

SEQ ID NO: 1148001 - RNA, 16 nt, Human
acaggacucugccucc

SEQ ID NO: 1148002 - RNA, 13 nt, Human
acaggcccuuccu

SEQ ID NO: 1148003 - RNA, 15 nt, Human
acaggcccuuccucu

SEQ ID NO: 1148004 - RNA, 22 nt, Human
acaggcccuuccucuccacugc

SEQ ID NO: 1148005 - RNA, 15 nt, Human
ucaaagcaaaugucu

SEQ ID NO: 1148006 - RNA, 23 nt, Human
ucaaagcaaaugucuuccuggau

SEQ ID NO: 1148007 - RNA, 20 nt, Human
acaugacuccauagaccuuu

SEQ ID NO: 1148008 - RNA, 18 nt, Human
acaugacuccauagaccu

SEQ ID NO: 1148009 - RNA, 20 nt, Human
ucaagagggcacugguggcc

SEQ ID NO: 1148010 - RNA, 21 nt, Human
ucaagagggcacugguggccc

SEQ ID NO: 1148011 - RNA, 18 nt, Human
ucaagagugguaucuugc

SEQ ID NO: 1148012 - RNA, 21 nt, Human
ucaagugauucucaugccuca

SEQ ID NO: 1148013 - RNA, 22 nt, Human
ucaagugauucucaugccucag

SEQ ID NO: 1148014 - RNA, 20 nt, Human
acauuuuauggugccuagua

SEQ ID NO: 1148015 - RNA, 15 nt, Human
accaacccucagagc

SEQ ID NO: 1148016 - RNA, 21 nt, Human
ucacagaacccuuggagccaa

SEQ ID NO: 1148017 - RNA, 19 nt, Human
ucaauuuauaccucaauuu

SEQ ID NO: 1148018 - RNA, 14 nt, Human
ucacugagcacugu

SEQ ID NO: 1148019 - RNA, 15 nt, Human
ucacugagcacuguu

SEQ ID NO: 1148020 - RNA, 16 nt, Human
ucacugagcacuguuu

SEQ ID NO: 1148021 - RNA, 18 nt, Human
ucacugagcacuguuuuc

SEQ ID NO: 1148022 - RNA, 22 nt, Human
ucacugagcacuguuuucuagu

SEQ ID NO: 1148023 - RNA, 19 nt, Human
ucacugagcacuguuuucu

SEQ ID NO: 1148024 - RNA, 21 nt, Human
ucacugcaaccuucgccaccu

SEQ ID NO: 1148025 - RNA, 15 nt, Human
ucacugcacagugca

SEQ ID NO: 1148026 - RNA, 12 nt, Human
ucacuucacugu

SEQ ID NO: 1148027 - RNA, 14 nt, Human
ucacuucacugugc

SEQ ID NO: 1148028 - RNA, 15 nt, Human
ucacuucacugugcu

SEQ ID NO: 1148029 - RNA, 21 nt, Human
ucacuucacugugcuguuguu

SEQ ID NO: 1148030 - RNA, 18 nt, Human
accauguuggccaggcug

SEQ ID NO: 1148031 - RNA, 14 nt, Human
acccacuggacuca

SEQ ID NO: 1148032 - RNA, 17 nt, Human
acccacuggacucaccu

SEQ ID NO: 1148033 - RNA, 21 nt, Human
acccacuggacucaccucccc

SEQ ID NO: 1148034 - RNA, 21 nt, Human
ucagagccaccccuaaagaga

SEQ ID NO: 1148035 - RNA, 21 nt, Human
ucagaugcugugcaaauguua

SEQ ID NO: 1148036 - RNA, 13 nt, Human
ucagauucuugca

SEQ ID NO: 1148037 - RNA, 14 nt, Human
ucagauucuugcau

SEQ ID NO: 1148038 - RNA, 13 nt, Human
ucaggccacuuga

SEQ ID NO: 1148039 - RNA, 18 nt, Human
ucagguaaucgaccugcc

SEQ ID NO: 1148040 - RNA, 19 nt, Human
ucagguaaucgaccugccu

SEQ ID NO: 1148041 - RNA, 20 nt, Human
ucagguaaucgaccugccuc

SEQ ID NO: 1148042 - RNA, 21 nt, Human
ucagguaaucgaccugccucg

SEQ ID NO: 1148043 - RNA, 15 nt, Human
acccggaggggccug

SEQ ID NO: 1148044 - RNA, 22 nt, Human
ucagguugucugaagucacugc

SEQ ID NO: 1148045 - RNA, 15 nt, Human
ucagugcuucgcaga

SEQ ID NO: 1148046 - RNA, 16 nt, Human
ucauaauaaguugcau

SEQ ID NO: 1148047 - RNA, 17 nt, Human
accugaccccugacccc

SEQ ID NO: 1148048 - RNA, 17 nt, Human
accugccucggccuccc

SEQ ID NO: 1148049 - RNA, 12 nt, Human
accugcucuccu

SEQ ID NO: 1148050 - RNA, 17 nt, Human
accugcucuccucuugc

SEQ ID NO: 1148051 - RNA, 14 nt, Human
ucauuuuugaauac

SEQ ID NO: 1148052 - RNA, 19 nt, Human
uccaaaugcagcuuuaaaa

SEQ ID NO: 1148053 - RNA, 17 nt, Human
uccaauuagcuuauguu

SEQ ID NO: 1148054 - RNA, 20 nt, Human
uccaauuagcuuauguuaac

SEQ ID NO: 1148055 - RNA, 17 nt, Human
accuucccaugcccugg

SEQ ID NO: 1148056 - RNA, 15 nt, Human
accuucgccaccugg

SEQ ID NO: 1148057 - RNA, 17 nt, Human
accuucgccaccugggu

SEQ ID NO: 1148058 - RNA, 14 nt, Human
acgagaaaacaaua

SEQ ID NO: 1148059 - RNA, 13 nt, Human
uccauuuaaacag

SEQ ID NO: 1148060 - RNA, 14 nt, Human
uccauuuaaacaga

SEQ ID NO: 1148061 - RNA, 15 nt, Human
uccauuuaaacagau

SEQ ID NO: 1148062 - RNA, 18 nt, Human
uccauuuaaacagauguc

SEQ ID NO: 1148063 - RNA, 21 nt, Human
uccauuuaaacagauguccau

SEQ ID NO: 1148064 - RNA, 20 nt, Human
ucccaaagugcugggauuac

SEQ ID NO: 1148065 - RNA, 15 nt, Human
ucccacaggcccuuc

SEQ ID NO: 1148066 - RNA, 17 nt, Human
ucccacaggcccuuccu

SEQ ID NO: 1148067 - RNA, 21 nt, Human
ucccacaggcccuuccucucc

SEQ ID NO: 1148068 - RNA, 22 nt, Human
ucccacaggcccuuccucucca

SEQ ID NO: 1148069 - RNA, 19 nt, Human
ucccaccaacccucagagc

SEQ ID NO: 1148070 - RNA, 15 nt, Human
acuaugauuuggaaa

SEQ ID NO: 1148071 - RNA, 16 nt, Human
acuaugauuuggaaaa

SEQ ID NO: 1148072 - RNA, 13 nt, Human
acuauguugauaa

SEQ ID NO: 1148073 - RNA, 19 nt, Human
acucaccucccccaucucu

SEQ ID NO: 1148074 - RNA, 20 nt, Human
acucaccucccccaucucuu

SEQ ID NO: 1148075 - RNA, 14 nt, Human
acucguauaugucu

SEQ ID NO: 1148076 - RNA, 17 nt, Human
acucugacaacagacuu

SEQ ID NO: 1148077 - RNA, 18 nt, Human
acucugacaacagacuuc

SEQ ID NO: 1148078 - RNA, 20 nt, Human
acucugacaacagacuucug

SEQ ID NO: 1148079 - RNA, 22 nt, Human
acucugacaacagacuucugaa

SEQ ID NO: 1148080 - RNA, 23 nt, Human
acucugacaacagacuucugaaa

SEQ ID NO: 1148081 - RNA, 20 nt, Human
acucuucaguuaagccuuug

SEQ ID NO: 1148082 - RNA, 21 nt, Human
acucuucaguuaagccuuugg

SEQ ID NO: 1148083 - RNA, 17 nt, Human
uccucuccacugccuuc

SEQ ID NO: 1148084 - RNA, 18 nt, Human
uccucuccacugccuucg

SEQ ID NO: 1148085 - RNA, 12 nt, Human
uccucucugccc

SEQ ID NO: 1148086 - RNA, 13 nt, Human
uccucucugcccu

SEQ ID NO: 1148087 - RNA, 14 nt, Human
uccucucugcccua

SEQ ID NO: 1148088 - RNA, 15 nt, Human
uccucucugcccuaa

SEQ ID NO: 1148089 - RNA, 12 nt, Human
uccucugagccu

SEQ ID NO: 1148090 - RNA, 13 nt, Human
uccucugagccuu

SEQ ID NO: 1148091 - RNA, 17 nt, Human
uccucugagccuuggga

SEQ ID NO: 1148092 - RNA, 14 nt, Human
uccucugaggcuga

SEQ ID NO: 1148093 - RNA, 19 nt, Human
uccucuugccacugccucu

SEQ ID NO: 1148094 - RNA, 20 nt, Human
acuguacuccucccaggcgc

SEQ ID NO: 1148095 - RNA, 13 nt, Human
acuguaugaucaa

SEQ ID NO: 1148096 - RNA, 14 nt, Human
acuguaugaucaaa

SEQ ID NO: 1148097 - RNA, 15 nt, Human
acuguaugaucaaau

SEQ ID NO: 1148098 - RNA, 16 nt, Human
acuguaugaucaaaug

SEQ ID NO: 1148099 - RNA, 17 nt, Human
acuguaugaucaaaugu

SEQ ID NO: 1148100 - RNA, 18 nt, Human
acuguaugaucaaauguu

SEQ ID NO: 1148101 - RNA, 19 nt, Human
acuguaugaucaaauguuu

SEQ ID NO: 1148102 - RNA, 20 nt, Human
acuguaugaucaaauguuua

SEQ ID NO: 1148103 - RNA, 21 nt, Human
acuguaugaucaaauguuuaa

SEQ ID NO: 1148104 - RNA, 24 nt, Human
acuguaugaucaaauguuuaauca

SEQ ID NO: 1148105 - RNA, 22 nt, Human
acuguaugaucaaauguuuaau

SEQ ID NO: 1148106 - RNA, 19 nt, Human
ucggggagaggcugaggac

SEQ ID NO: 1148107 - RNA, 14 nt, Human
ucguuuaaugaaug

SEQ ID NO: 1148108 - RNA, 18 nt, Human
ucguuuaaugaaugcuua

SEQ ID NO: 1148109 - RNA, 20 nt, Human
ucguuuaaugaaugcuuaaa

SEQ ID NO: 1148110 - RNA, 13 nt, Human
ucuaaacugcccc

SEQ ID NO: 1148111 - RNA, 16 nt, Human
ucuaaacugcccccuc

SEQ ID NO: 1148112 - RNA, 22 nt, Human
ucuaaacugcccccucugcccu

SEQ ID NO: 1148113 - RNA, 23 nt, Human
ucuaaacugcccccucugcccug

SEQ ID NO: 1148114 - RNA, 20 nt, Human
acuuagcauuuucugcaucu

SEQ ID NO: 1148115 - RNA, 22 nt, Human
acuuagcauuuucugcaucucc

SEQ ID NO: 1148116 - RNA, 21 nt, Human
acuuagcauuuucugcaucuc

SEQ ID NO: 1148117 - RNA, 17 nt, Human
acuucaggcucuucucc

SEQ ID NO: 1148118 - RNA, 18 nt, Human
acuucaggcucuucuccu

SEQ ID NO: 1148119 - RNA, 20 nt, Human
acuucaggcucuucuccuuu

SEQ ID NO: 1148120 - RNA, 17 nt, Human
acuuccauaaucuggac

SEQ ID NO: 1148121 - RNA, 12 nt, Human
ucuaguguauca

SEQ ID NO: 1148122 - RNA, 13 nt, Human
ucuaguguaucaa

SEQ ID NO: 1148123 - RNA, 14 nt, Human
ucuaguguaucaaa

SEQ ID NO: 1148124 - RNA, 16 nt, Human
ucuaguguaucaaaau

SEQ ID NO: 1148125 - RNA, 22 nt, Human
ucuaguguaucaaaaugcucuu

SEQ ID NO: 1148126 - RNA, 19 nt, Human
ucuaguguaucaaaaugcu

SEQ ID NO: 1148127 - RNA, 21 nt, Human
ucuaguuccccuguuuauuca

SEQ ID NO: 1148128 - RNA, 17 nt, Human
ucuaguuccccuguuua

SEQ ID NO: 1148129 - RNA, 13 nt, Human
ucuauaauuuaaa

SEQ ID NO: 1148130 - RNA, 13 nt, Human
ucucacuccuacc

SEQ ID NO: 1148131 - RNA, 16 nt, Human
ucucacuccuaccugg

SEQ ID NO: 1148132 - RNA, 17 nt, Human
ucucacuccuaccuggu

SEQ ID NO: 1148133 - RNA, 18 nt, Human
ucucacuccuaccuggua

SEQ ID NO: 1148134 - RNA, 14 nt, Human
acuuguaugaaaga

SEQ ID NO: 1148135 - RNA, 13 nt, Human
acuugucuguuuu

SEQ ID NO: 1148136 - RNA, 12 nt, Human
acuugucuguuu

SEQ ID NO: 1148137 - RNA, 16 nt, Human
acuuguuuucugggaa

SEQ ID NO: 1148138 - RNA, 17 nt, Human
ucucgaacuccugaccu

SEQ ID NO: 1148139 - RNA, 20 nt, Human
ucucgcuauugucaccaggg

SEQ ID NO: 1148140 - RNA, 15 nt, Human
ucucggcucacugca

SEQ ID NO: 1148141 - RNA, 18 nt, Human
ucucuuguaauuuggauc

SEQ ID NO: 1148142 - RNA, 13 nt, Human
agaaaucuauuuc

SEQ ID NO: 1148143 - RNA, 12 nt, Human
ucugccugucuc

SEQ ID NO: 1148144 - RNA, 14 nt, Human
ucugccugucuccc

SEQ ID NO: 1148145 - RNA, 23 nt, Human
agaagcucccugaaguaagcaaa

SEQ ID NO: 1148146 - RNA, 15 nt, Human
ucuucaacucccugc

SEQ ID NO: 1148147 - RNA, 16 nt, Human
ucuucaacugaccagc

SEQ ID NO: 1148148 - RNA, 19 nt, Human
ucuucaacugaccagccuc

SEQ ID NO: 1148149 - RNA, 16 nt, Human
ucuucaagaucccauu

SEQ ID NO: 1148150 - RNA, 11 nt, Human
ucuuccucugc

SEQ ID NO: 1148151 - RNA, 12 nt, Human
ucuuccucugcu

SEQ ID NO: 1148152 - RNA, 14 nt, Human
ucuuccucugcuga

SEQ ID NO: 1148153 - RNA, 18 nt, Human
ucuucuggguuccuuccu

SEQ ID NO: 1148154 - RNA, 14 nt, Human
agaccccuggcuuu

SEQ ID NO: 1148155 - RNA, 18 nt, Human
ucuuucuaaugugugaau

SEQ ID NO: 1148156 - RNA, 19 nt, Human
ucuuucuaaugugugaauc

SEQ ID NO: 1148157 - RNA, 20 nt, Human
ugaaaaucuuauaauuuaaa

SEQ ID NO: 1148158 - RNA, 15 nt, Human
ugaaacgcaucuagu

SEQ ID NO: 1148159 - RNA, 16 nt, Human
agagacuccagcuggg

SEQ ID NO: 1148160 - RNA, 12 nt, Human
ugaagccuuugu

SEQ ID NO: 1148161 - RNA, 15 nt, Human
ugaagguauaucuag

SEQ ID NO: 1148162 - RNA, 14 nt, Human
ugaagucacugcac

SEQ ID NO: 1148163 - RNA, 15 nt, Human
ugaagucacugcaca

SEQ ID NO: 1148164 - RNA, 16 nt, Human
ugaagucacugcacag

SEQ ID NO: 1148165 - RNA, 21 nt, Human
ugaagucacugcacagugcau

SEQ ID NO: 1148166 - RNA, 16 nt, Human
ugaauaaagacaccua

SEQ ID NO: 1148167 - RNA, 16 nt, Human
ugaauaccuuagugca

SEQ ID NO: 1148168 - RNA, 21 nt, Human
ugaauaccuuagugcaguuau

SEQ ID NO: 1148169 - RNA, 22 nt, Human
ugaauaccuuagugcaguuauu

SEQ ID NO: 1148170 - RNA, 15 nt, Human
ugaauacuuuauaaa

SEQ ID NO: 1148171 - RNA, 22 nt, Human
ugacaaaauacuugucuguuuu

SEQ ID NO: 1148172 - RNA, 12 nt, Human
ugacaaaauguu

SEQ ID NO: 1148173 - RNA, 13 nt, Human
ugacaaaauguua

SEQ ID NO: 1148174 - RNA, 14 nt, Human
ugacaaaauguuau

SEQ ID NO: 1148175 - RNA, 15 nt, Human
ugacaaaauguuauu

SEQ ID NO: 1148176 - RNA, 20 nt, Human
ugacaaaauguuauuucccu

SEQ ID NO: 1148177 - RNA, 15 nt, Human
agaugcagugccagg

SEQ ID NO: 1148178 - RNA, 20 nt, Human
agaugcugacuguacuccuc

SEQ ID NO: 1148179 - RNA, 23 nt, Human
agaugcugacuguacuccuccca

SEQ ID NO: 1148180 - RNA, 20 nt, Human
agauuaaccuucucuguccg

SEQ ID NO: 1148181 - RNA, 21 nt, Human
ugacuccauagaccuuuucau

SEQ ID NO: 1148182 - RNA, 17 nt, Human
ugacuccauagaccuuu

SEQ ID NO: 1148183 - RNA, 18 nt, Human
agauuccagagaguggcu

SEQ ID NO: 1148184 - RNA, 19 nt, Human
agauuccagagaguggcuc

SEQ ID NO: 1148185 - RNA, 20 nt, Human
agauuucucauuugccaaua

SEQ ID NO: 1148186 - RNA, 22 nt, Human
ugaguaacugauuuguaacaag

SEQ ID NO: 1148187 - RNA, 13 nt, Human
ugaguagcuggga

SEQ ID NO: 1148188 - RNA, 19 nt, Human
ugauauuuucaacgcagcc

SEQ ID NO: 1148189 - RNA, 21 nt, Human
ugauauuuucaacgcagcccu

SEQ ID NO: 1148190 - RNA, 22 nt, Human
ugauauuuucaacgcagcccug

SEQ ID NO: 1148191 - RNA, 23 nt, Human
ugauauuuucaacgcagcccugc

SEQ ID NO: 1148192 - RNA, 13 nt, Human
ugaucaaauguuu

SEQ ID NO: 1148193 - RNA, 14 nt, Human
ugaucaaauguuua

SEQ ID NO: 1148194 - RNA, 15 nt, Human
ugaucaaauguuuaa

SEQ ID NO: 1148195 - RNA, 16 nt, Human
ugaucaaauguuuaau

SEQ ID NO: 1148196 - RNA, 17 nt, Human
ugaucaaauguuuaauc

SEQ ID NO: 1148197 - RNA, 18 nt, Human
ugaucaaauguuuaauca

SEQ ID NO: 1148198 - RNA, 22 nt, Human
ugaucaaauguuuaaucauaua

SEQ ID NO: 1148199 - RNA, 19 nt, Human
ugaucaaauguuuaaucau

SEQ ID NO: 1148200 - RNA, 20 nt, Human
agcaucacaugaacuuguaa

SEQ ID NO: 1148201 - RNA, 17 nt, Human
agcaugucgucaaagcu

SEQ ID NO: 1148202 - RNA, 20 nt, Human
agcaugucgucaaagcugaa

SEQ ID NO: 1148203 - RNA, 18 nt, Human
agccaccgugccuggcca

SEQ ID NO: 1148204 - RNA, 18 nt, Human
ugauccuuuuggagucag

SEQ ID NO: 1148205 - RNA, 13 nt, Human
ugaugaagaggag

SEQ ID NO: 1148206 - RNA, 14 nt, Human
ugaugaagaggagu

SEQ ID NO: 1148207 - RNA, 13 nt, Human
ugaugauccauua

SEQ ID NO: 1148208 - RNA, 23 nt, Human
agccacuuucaaucuucaauccu

SEQ ID NO: 1148209 - RNA, 20 nt, Human
agccacuuucaaucuucaau

SEQ ID NO: 1148210 - RNA, 13 nt, Human
agccaguaauccu

SEQ ID NO: 1148211 - RNA, 14 nt, Human
agccaguaauccug

SEQ ID NO: 1148212 - RNA, 15 nt, Human
agccaguaauccugu

SEQ ID NO: 1148213 - RNA, 22 nt, Human
agccccuaagucaacuuagcau

SEQ ID NO: 1148214 - RNA, 21 nt, Human
agcccugcuuugggcugcccu

SEQ ID NO: 1148215 - RNA, 22 nt, Human
agcccugcuuugggcugcccug

SEQ ID NO: 1148216 - RNA, 23 nt, Human
agcccugcuuugggcugcccugg

SEQ ID NO: 1148217 - RNA, 12 nt, Human
ugcacacagcac

SEQ ID NO: 1148218 - RNA, 24 nt, Human
ugcacacagcacgggggccaagga

SEQ ID NO: 1148219 - RNA, 12 nt, Human
ugcacuauaugc

SEQ ID NO: 1148220 - RNA, 14 nt, Human
ugcacuauaugcaa

SEQ ID NO: 1148221 - RNA, 15 nt, Human
ugcacuauaugcaaa

SEQ ID NO: 1148222 - RNA, 16 nt, Human
ugcacuauaugcaaac

SEQ ID NO: 1148223 - RNA, 17 nt, Human
ugcacuauaugcaaaca

SEQ ID NO: 1148224 - RNA, 18 nt, Human
ugcacuauaugcaaacag

SEQ ID NO: 1148225 - RNA, 20 nt, Human
ugcacuauaugcaaacaggg

SEQ ID NO: 1148226 - RNA, 14 nt, Human
agccguggcuuccc

SEQ ID NO: 1148227 - RNA, 21 nt, Human
agccguggcuucccgcucagc

SEQ ID NO: 1148228 - RNA, 22 nt, Human
agccguggcuucccgcucagcc

SEQ ID NO: 1148229 - RNA, 23 nt, Human
agccguggcuucccgcucagccc

SEQ ID NO: 1148230 - RNA, 19 nt, Human
agccguuuguuccccaaga

SEQ ID NO: 1148231 - RNA, 18 nt, Human
agccuccaugcugccucc

SEQ ID NO: 1148232 - RNA, 20 nt, Human
agccuccaugcugccuccag

SEQ ID NO: 1148233 - RNA, 18 nt, Human
ugcaguacuuuaccuccu

SEQ ID NO: 1148234 - RNA, 20 nt, Human
ugcauacauucuucaagauc

SEQ ID NO: 1148235 - RNA, 21 nt, Human
ugccaauaauaauaccucccu

SEQ ID NO: 1148236 - RNA, 22 nt, Human
ugccaauaauaauaccucccuu

SEQ ID NO: 1148237 - RNA, 13 nt, Human
ugccacacuucag

SEQ ID NO: 1148238 - RNA, 14 nt, Human
ugccacacuucagg

SEQ ID NO: 1148239 - RNA, 15 nt, Human
ugccacacuucaggc

SEQ ID NO: 1148240 - RNA, 16 nt, Human
ugccacacuucaggcu

SEQ ID NO: 1148241 - RNA, 22 nt, Human
ugccacacuucaggcucuucuc

SEQ ID NO: 1148242 - RNA, 23 nt, Human
ugccacacuucaggcucuucucc

SEQ ID NO: 1148243 - RNA, 19 nt, Human
agcuacuaauuuuaaaaug

SEQ ID NO: 1148244 - RNA, 16 nt, Human
agcucaucuucacugc

SEQ ID NO: 1148245 - RNA, 17 nt, Human
agcucaucuucacugca

SEQ ID NO: 1148246 - RNA, 21 nt, Human
ugcccaagaauagaugcugac

SEQ ID NO: 1148247 - RNA, 22 nt, Human
ugcccaagaauagaugcugacu

SEQ ID NO: 1148248 - RNA, 23 nt, Human
ugcccaagaauagaugcugacug

SEQ ID NO: 1148249 - RNA, 16 nt, Human
ugccuuuuaguuccug

SEQ ID NO: 1148250 - RNA, 18 nt, Human
ugccuuuuaguuccugug

SEQ ID NO: 1148251 - RNA, 13 nt, Human
ugcggccccuccc

SEQ ID NO: 1148252 - RNA, 15 nt, Human
ugcggccccuccccc

SEQ ID NO: 1148253 - RNA, 16 nt, Human
ugcggccccucccccg

SEQ ID NO: 1148254 - RNA, 18 nt, Human
ugcggccccucccccguc

SEQ ID NO: 1148255 - RNA, 14 nt, Human
ugcgggucacagga

SEQ ID NO: 1148256 - RNA, 16 nt, Human
ugcgggucacaggagg

SEQ ID NO: 1148257 - RNA, 17 nt, Human
ugcgggucacaggaggg

SEQ ID NO: 1148258 - RNA, 16 nt, Human
ugcugacuguacuccu

SEQ ID NO: 1148259 - RNA, 19 nt, Human
ugcugacuguacuccuccc

SEQ ID NO: 1148260 - RNA, 21 nt, Human
ugcugacuguacuccucccag

SEQ ID NO: 1148261 - RNA, 22 nt, Human
ugcugacuguacuccucccagg

SEQ ID NO: 1148262 - RNA, 14 nt, Human
aggaaauccagggu

SEQ ID NO: 1148263 - RNA, 15 nt, Human
aggaaauccagggug

SEQ ID NO: 1148264 - RNA, 13 nt, Human
ugcuggcugccuu

SEQ ID NO: 1148265 - RNA, 14 nt, Human
ugcuggcugccuua

SEQ ID NO: 1148266 - RNA, 20 nt, Human
ugcugggauuacagguguga

SEQ ID NO: 1148267 - RNA, 13 nt, Human
ugcugugcaaaug

SEQ ID NO: 1148268 - RNA, 17 nt, Human
aggacagccccuccucc

SEQ ID NO: 1148269 - RNA, 23 nt, Human
uggaaggggacacgugacagccg

SEQ ID NO: 1148270 - RNA, 14 nt, Human
uggagaacuagaga

SEQ ID NO: 1148271 - RNA, 21 nt, Human
uggagaagcucccugaaguaa

SEQ ID NO: 1148272 - RNA, 20 nt, Human
aggcaccuaccaccacgccc

SEQ ID NO: 1148273 - RNA, 15 nt, Human
uggauggaaggggcu

SEQ ID NO: 1148274 - RNA, 18 nt, Human
uggcacagggcaguggga

SEQ ID NO: 1148275 - RNA, 15 nt, Human
uggccagguggccac

SEQ ID NO: 1148276 - RNA, 16 nt, Human
uggccagguggccacu

SEQ ID NO: 1148277 - RNA, 17 nt, Human
uggccagguggccacuc

SEQ ID NO: 1148278 - RNA, 19 nt, Human
uggccagguggccacucca

SEQ ID NO: 1148279 - RNA, 14 nt, Human
uggcccugcccugg

SEQ ID NO: 1148280 - RNA, 14 nt, Human
ugggaguacaaaag

SEQ ID NO: 1148281 - RNA, 17 nt, Human
ugggccagaauuucaaa

SEQ ID NO: 1148282 - RNA, 18 nt, Human
ugggccagaauuucaaac

SEQ ID NO: 1148283 - RNA, 17 nt, Human
ugggcugcccuggugcu

SEQ ID NO: 1148284 - RNA, 19 nt, Human
ugggcugcccuggugcugc

SEQ ID NO: 1148285 - RNA, 20 nt, Human
ugggcugcccuggugcugcc

SEQ ID NO: 1148286 - RNA, 21 nt, Human
ugggcugcccuggugcugcca

SEQ ID NO: 1148287 - RNA, 17 nt, Human
uggggacagagcagaac

SEQ ID NO: 1148288 - RNA, 23 nt, Human
uggggcuaggaaauccagggugg

SEQ ID NO: 1148289 - RNA, 18 nt, Human
aggggccuggcagccgug

SEQ ID NO: 1148290 - RNA, 23 nt, Human
aggggccuggcagccgugccuuc

SEQ ID NO: 1148291 - RNA, 20 nt, Human
ugguagcuuuucccuucuuu

SEQ ID NO: 1148292 - RNA, 21 nt, Human
ugguagcuuuucccuucuuuu

SEQ ID NO: 1148293 - RNA, 22 nt, Human
uggucacaggacucugccuccu

SEQ ID NO: 1148294 - RNA, 23 nt, Human
uggucacaggacucugccuccuc

SEQ ID NO: 1148295 - RNA, 19 nt, Human
uggucuaucuuugagcgcc

SEQ ID NO: 1148296 - RNA, 15 nt, Human
uggucucgaacuccu

SEQ ID NO: 1148297 - RNA, 15 nt, Human
agguacuguaugauc

SEQ ID NO: 1148298 - RNA, 19 nt, Human
agguacuguaugaucaaau

SEQ ID NO: 1148299 - RNA, 21 nt, Human
agguacuguaugaucaaaugu

SEQ ID NO: 1148300 - RNA, 23 nt, Human
agguacuguaugaucaaauguuu

SEQ ID NO: 1148301 - RNA, 22 nt, Human
agguacuguaugaucaaauguu

SEQ ID NO: 1148302 - RNA, 19 nt, Human
agguauaaguggugugugu

SEQ ID NO: 1148303 - RNA, 20 nt, Human
agguauaaguggugugugua

SEQ ID NO: 1148304 - RNA, 18 nt, Human
aggucaccuuuauucugg

SEQ ID NO: 1148305 - RNA, 19 nt, Human
aggucaccuuuauucuggc

SEQ ID NO: 1148306 - RNA, 14 nt, Human
agguggccacucca

SEQ ID NO: 1148307 - RNA, 17 nt, Human
agguggccacuccagac

SEQ ID NO: 1148308 - RNA, 12 nt, Human
agguugauaaau

SEQ ID NO: 1148309 - RNA, 22 nt, Human
agguugauaaaucauuuuaugu

SEQ ID NO: 1148310 - RNA, 20 nt, Human
agguugauaaaucauuuuau

SEQ ID NO: 1148311 - RNA, 18 nt, Human
uguaccaaccauccaauu

SEQ ID NO: 1148312 - RNA, 12 nt, Human
aguaaaaauaaa

SEQ ID NO: 1148313 - RNA, 15 nt, Human
aguaaaaauaaaauu

SEQ ID NO: 1148314 - RNA, 16 nt, Human
aguaaaacaaacaaua

SEQ ID NO: 1148315 - RNA, 20 nt, Human
aguaaaacaaacaauaccug

SEQ ID NO: 1148316 - RNA, 19 nt, Human
aguaaaacaaacaauaccu

SEQ ID NO: 1148317 - RNA, 22 nt, Human
uguagguuauuaugauuagcuu

SEQ ID NO: 1148318 - RNA, 15 nt, Human
ugucaagauucagcu

SEQ ID NO: 1148319 - RNA, 16 nt, Human
ugucaagauucagcua

SEQ ID NO: 1148320 - RNA, 12 nt, Human
aguaguuaucau

SEQ ID NO: 1148321 - RNA, 13 nt, Human
aguaguuaucaug

SEQ ID NO: 1148322 - RNA, 14 nt, Human
aguaguuaucaugu

SEQ ID NO: 1148323 - RNA, 15 nt, Human
aguaguuaucauguu

SEQ ID NO: 1148324 - RNA, 16 nt, Human
aguaguuaucauguua

SEQ ID NO: 1148325 - RNA, 17 nt, Human
aguaguuaucauguuag

SEQ ID NO: 1148326 - RNA, 23 nt, Human
aguaguuaucauguuaguaauac

SEQ ID NO: 1148327 - RNA, 13 nt, Human
agucacugcacag

SEQ ID NO: 1148328 - RNA, 15 nt, Human
ugucgcccaggcugg

SEQ ID NO: 1148329 - RNA, 16 nt, Human
ugucgcccaggcugga

SEQ ID NO: 1148330 - RNA, 13 nt, Human
ugucgccucugca

SEQ ID NO: 1148331 - RNA, 16 nt, Human
agucagacagaugugg

SEQ ID NO: 1148332 - RNA, 12 nt, Human
ugugccucugcc

SEQ ID NO: 1148333 - RNA, 13 nt, Human
ugugccucugccu

SEQ ID NO: 1148334 - RNA, 15 nt, Human
agugcaucucagccc

SEQ ID NO: 1148335 - RNA, 16 nt, Human
agugcaucucagccca

SEQ ID NO: 1148336 - RNA, 17 nt, Human
agugcaucucagcccac

SEQ ID NO: 1148337 - RNA, 20 nt, Human
agugcugggauuacaggcgu

SEQ ID NO: 1148338 - RNA, 20 nt, Human
agugcugggauuacaggugu

SEQ ID NO: 1148339 - RNA, 17 nt, Human
uguggugaaaagcaggu

SEQ ID NO: 1148340 - RNA, 14 nt, Human
uguuaucuguuuga

SEQ ID NO: 1148341 - RNA, 17 nt, Human
uguuaucuguuugagaa

SEQ ID NO: 1148342 - RNA, 19 nt, Human
uguuaucuguuugagaaag

SEQ ID NO: 1148343 - RNA, 18 nt, Human
uguuaucuguuugagaaa

SEQ ID NO: 1148344 - RNA, 20 nt, Human
uguuauuucccuacauuaaa

SEQ ID NO: 1148345 - RNA, 21 nt, Human
uguuauuucccuacauuaaac

SEQ ID NO: 1148346 - RNA, 23 nt, Human
uguuauuucccuacauuaaacau

SEQ ID NO: 1148347 - RNA, 21 nt, Human
aguuacucuucaguuaagccu

SEQ ID NO: 1148348 - RNA, 12 nt, Human
aguuaucauguu

SEQ ID NO: 1148349 - RNA, 13 nt, Human
aguuaucauguua

SEQ ID NO: 1148350 - RNA, 14 nt, Human
aguuaucauguuag

SEQ ID NO: 1148351 - RNA, 15 nt, Human
aguuaucauguuagu

SEQ ID NO: 1148352 - RNA, 17 nt, Human
aguuaucauguuaguaa

SEQ ID NO: 1148353 - RNA, 18 nt, Human
aguuaucauguuaguaau

SEQ ID NO: 1148354 - RNA, 22 nt, Human
aguuaucauguuaguaauaccu

SEQ ID NO: 1148355 - RNA, 19 nt, Human
aguuaucauguuaguaaua

SEQ ID NO: 1148356 - RNA, 15 nt, Human
aguucccuacuuccu

SEQ ID NO: 1148357 - RNA, 18 nt, Human
aguuccccuguuuauuca

SEQ ID NO: 1148358 - RNA, 19 nt, Human
aguuccccuguuuauucau

SEQ ID NO: 1148359 - RNA, 20 nt, Human
aguuccccuguuuauucaua

SEQ ID NO: 1148360 - RNA, 19 nt, Human
aguucggugagcuacaaau

SEQ ID NO: 1148361 - RNA, 20 nt, Human
aguucggugagcuacaaaug

SEQ ID NO: 1148362 - RNA, 14 nt, Human
uguuggucuguacu

SEQ ID NO: 1148363 - RNA, 15 nt, Human
uguuggucuguacug

SEQ ID NO: 1148364 - RNA, 16 nt, Human
uguuggucuguacuga

SEQ ID NO: 1148365 - RNA, 21 nt, Human
uguuguuaucuguuugagaaa

SEQ ID NO: 1148366 - RNA, 14 nt, Human
uguuguuaugaugu

SEQ ID NO: 1148367 - RNA, 15 nt, Human
uguuguuaugaugug

SEQ ID NO: 1148368 - RNA, 19 nt, Human
uguuguuaugaugugcuua

SEQ ID NO: 1148369 - RNA, 17 nt, Human
uguuguuaugaugugcu

SEQ ID NO: 1148370 - RNA, 13 nt, Human
uguuuauucauau

SEQ ID NO: 1148371 - RNA, 16 nt, Human
uguuuauucauaugca

SEQ ID NO: 1148372 - RNA, 17 nt, Human
uguuuauucauaugcau

SEQ ID NO: 1148373 - RNA, 18 nt, Human
uguuuauucauaugcaua

SEQ ID NO: 1148374 - RNA, 19 nt, Human
uguuuauucauaugcauau

SEQ ID NO: 1148375 - RNA, 14 nt, Human
aguuuaaauuguaa

SEQ ID NO: 1148376 - RNA, 17 nt, Human
aguuuaaauuguaauag

SEQ ID NO: 1148377 - RNA, 16 nt, Human
uuaaacagauguccau

SEQ ID NO: 1148378 - RNA, 13 nt, Human
uuaaacaguugca

SEQ ID NO: 1148379 - RNA, 17 nt, Human
uuaaacaguugcacagc

SEQ ID NO: 1148380 - RNA, 18 nt, Human
uuaaacaguugcacagca

SEQ ID NO: 1148381 - RNA, 19 nt, Human
uuaaacaguugcacagcau

SEQ ID NO: 1148382 - RNA, 23 nt, Human
uuaaacaguugcacagcaucuca

SEQ ID NO: 1148383 - RNA, 21 nt, Human
uuaaacaguugcacagcaucu

SEQ ID NO: 1148384 - RNA, 22 nt, Human
uuaauauuuauaggucacuuug

SEQ ID NO: 1148385 - RNA, 21 nt, Human
uuaaucugggccagaauuuca

SEQ ID NO: 1148386 - RNA, 13 nt, Human
auaaauaaaaaua

SEQ ID NO: 1148387 - RNA, 14 nt, Human
auaaauaaaaauaa

SEQ ID NO: 1148388 - RNA, 14 nt, Human
auaaaucauuuuau

SEQ ID NO: 1148389 - RNA, 15 nt, Human
auaaaucauuuuaug

SEQ ID NO: 1148390 - RNA, 16 nt, Human
auaaaucauuuuaugu

SEQ ID NO: 1148391 - RNA, 18 nt, Human
auaaaucauuuuauguca

SEQ ID NO: 1148392 - RNA, 19 nt, Human
auaaaucauuuuaugucaa

SEQ ID NO: 1148393 - RNA, 22 nt, Human
auaacgauaaaagacagugaaa

SEQ ID NO: 1148394 - RNA, 24 nt, Human
uuacaggcgugagccaccgugccu

SEQ ID NO: 1148395 - RNA, 16 nt, Human
uuacaggcuccugcca

SEQ ID NO: 1148396 - RNA, 18 nt, Human
uuacaggcuccugccacc

SEQ ID NO: 1148397 - RNA, 19 nt, Human
uuacccauuuguucauauu

SEQ ID NO: 1148398 - RNA, 17 nt, Human
uuacccauuuguucaua

SEQ ID NO: 1148399 - RNA, 23 nt, Human
uuacucuucaguuaagccuuugg

SEQ ID NO: 1148400 - RNA, 17 nt, Human
uuagaaauugcauuucc

SEQ ID NO: 1148401 - RNA, 18 nt, Human
auaauccuaaacauauga

SEQ ID NO: 1148402 - RNA, 18 nt, Human
auaaucuggacuccucug

SEQ ID NO: 1148403 - RNA, 19 nt, Human
auaaucuggacuccucugu

SEQ ID NO: 1148404 - RNA, 20 nt, Human
auaaucuggacuccucuguc

SEQ ID NO: 1148405 - RNA, 22 nt, Human
auaaucuggacuccucugucca

SEQ ID NO: 1148406 - RNA, 12 nt, Human
uuagcaccaggg

SEQ ID NO: 1148407 - RNA, 20 nt, Human
uuagcauuuucugcaucucc

SEQ ID NO: 1148408 - RNA, 15 nt, Human
uuagccaguaauccu

SEQ ID NO: 1148409 - RNA, 23 nt, Human
uuauuuuuuaaagaaaucuauuu

SEQ ID NO: 1148410 - RNA, 17 nt, Human
uucaagaucccauuuga

SEQ ID NO: 1148411 - RNA, 11 nt, Human
uucaagauucc

SEQ ID NO: 1148412 - RNA, 20 nt, Human
uucaagucuaccaauuauaa

SEQ ID NO: 1148413 - RNA, 17 nt, Human
uucaagugauucucaug

SEQ ID NO: 1148414 - RNA, 17 nt, Human
auaggcguaacuaauuu

SEQ ID NO: 1148415 - RNA, 21 nt, Human
auagugaggcaucgcaaugua

SEQ ID NO: 1148416 - RNA, 14 nt, Human
auagugcuaacaug

SEQ ID NO: 1148417 - RNA, 19 nt, Human
auagugcuaacaugaagac

SEQ ID NO: 1148418 - RNA, 22 nt, Human
auagugcuaacaugaagaccuu

SEQ ID NO: 1148419 - RNA, 21 nt, Human
auagugcuaacaugaagaccu

SEQ ID NO: 1148420 - RNA, 15 nt, Human
auauaaauagaaugu

SEQ ID NO: 1148421 - RNA, 19 nt, Human
auauaaauagaauguaaau

SEQ ID NO: 1148422 - RNA, 21 nt, Human
auauaaauagaauguaaaugu

SEQ ID NO: 1148423 - RNA, 22 nt, Human
auauaaauagaauguaaauguc

SEQ ID NO: 1148424 - RNA, 12 nt, Human
uucacugugcug

SEQ ID NO: 1148425 - RNA, 18 nt, Human
uucacugugcuguuguua

SEQ ID NO: 1148426 - RNA, 15 nt, Human
uucacuuacagcacc

SEQ ID NO: 1148427 - RNA, 13 nt, Human
uucacugugcugu

SEQ ID NO: 1148428 - RNA, 12 nt, Human
uucacuucacug

SEQ ID NO: 1148429 - RNA, 14 nt, Human
uucacuucacugug

SEQ ID NO: 1148430 - RNA, 15 nt, Human
uucacuucacugugc

SEQ ID NO: 1148431 - RNA, 16 nt, Human
uucauauuaagaauga

SEQ ID NO: 1148432 - RNA, 22 nt, Human
uucauauuaagaaugaucugau

SEQ ID NO: 1148433 - RNA, 17 nt, Human
auaucuagguuuaugac

SEQ ID NO: 1148434 - RNA, 18 nt, Human
auaucuagguuuaugaca

SEQ ID NO: 1148435 - RNA, 19 nt, Human
auaucuagguuuaugacag

SEQ ID NO: 1148436 - RNA, 21 nt, Human
auaucuagguuuaugacagua

SEQ ID NO: 1148437 - RNA, 23 nt, Human
auaucuagguuuaugacaguaau

SEQ ID NO: 1148438 - RNA, 22 nt, Human
auaucuagguuuaugacaguaa

SEQ ID NO: 1148439 - RNA, 17 nt, Human
uuccaguucuucgacug

SEQ ID NO: 1148440 - RNA, 19 nt, Human
uuccauaaucuggacuccu

SEQ ID NO: 1148441 - RNA, 22 nt, Human
uuccauaaucuggacuccucug

SEQ ID NO: 1148442 - RNA, 23 nt, Human
uuccauaaucuggacuccucugu

SEQ ID NO: 1148443 - RNA, 14 nt, Human
uuccccuguucacu

SEQ ID NO: 1148444 - RNA, 17 nt, Human
uuccccuguucacucua

SEQ ID NO: 1148445 - RNA, 18 nt, Human
uuccccuguuuauucaua

SEQ ID NO: 1148446 - RNA, 19 nt, Human
uuccccuguuuauucauau

SEQ ID NO: 1148447 - RNA, 22 nt, Human
uuccccuuccuaauuccacagc

SEQ ID NO: 1148448 - RNA, 14 nt, Human
uucccuacuuccug

SEQ ID NO: 1148449 - RNA, 16 nt, Human
uucccuacuuccugug

SEQ ID NO: 1148450 - RNA, 17 nt, Human
uucccuacuuccuguga

SEQ ID NO: 1148451 - RNA, 12 nt, Human
uuccucuccacu

SEQ ID NO: 1148452 - RNA, 13 nt, Human
uuccucuccacug

SEQ ID NO: 1148453 - RNA, 14 nt, Human
uuccucuccacugc

SEQ ID NO: 1148454 - RNA, 15 nt, Human
uuccucuccacugcc

SEQ ID NO: 1148455 - RNA, 16 nt, Human
uuccucuccacugccu

SEQ ID NO: 1148456 - RNA, 20 nt, Human
uuccuucaaagcaaaugucu

SEQ ID NO: 1148457 - RNA, 12 nt, Human
aucaaauguuua

SEQ ID NO: 1148458 - RNA, 13 nt, Human
aucaaauguuuaa

SEQ ID NO: 1148459 - RNA, 14 nt, Human
aucaaauguuuaau

SEQ ID NO: 1148460 - RNA, 15 nt, Human
aucaaauguuuaauc

SEQ ID NO: 1148461 - RNA, 16 nt, Human
aucaaauguuuaauca

SEQ ID NO: 1148462 - RNA, 17 nt, Human
aucaaauguuuaaucau

SEQ ID NO: 1148463 - RNA, 21 nt, Human
aucaaauguuuaaucauauaa

SEQ ID NO: 1148464 - RNA, 18 nt, Human
aucaaauguuuaaucaua

SEQ ID NO: 1148465 - RNA, 22 nt, Human
aucaaguuggcuucuaaucaaa

SEQ ID NO: 1148466 - RNA, 23 nt, Human
aucaaguuggcuucuaaucaaag

SEQ ID NO: 1148467 - RNA, 16 nt, Human
uucgacuguuguuauc

SEQ ID NO: 1148468 - RNA, 21 nt, Human
uucgacuguuguuaucuguuu

SEQ ID NO: 1148469 - RNA, 20 nt, Human
uucgauacaccgggccugga

SEQ ID NO: 1148470 - RNA, 13 nt, Human
uucuauaauuuaa

SEQ ID NO: 1148471 - RNA, 14 nt, Human
uucuauaauuuaaa

SEQ ID NO: 1148472 - RNA, 13 nt, Human
uucucagcuccca

SEQ ID NO: 1148473 - RNA, 12 nt, Human
uucuccugccuc

SEQ ID NO: 1148474 - RNA, 13 nt, Human
uucuccugccuca

SEQ ID NO: 1148475 - RNA, 14 nt, Human
uucuccugccucag

SEQ ID NO: 1148476 - RNA, 15 nt, Human
uucugcacacagcac

SEQ ID NO: 1148477 - RNA, 16 nt, Human
uucugcacuauaugca

SEQ ID NO: 1148478 - RNA, 22 nt, Human
uucugguugaugccugugaacu

SEQ ID NO: 1148479 - RNA, 15 nt, Human
aucccaccaacccuc

SEQ ID NO: 1148480 - RNA, 15 nt, Human
uucuguugcugccuc

SEQ ID NO: 1148481 - RNA, 16 nt, Human
uucuguugcugccuca

SEQ ID NO: 1148482 - RNA, 17 nt, Human
uucuguugcugccucau

SEQ ID NO: 1148483 - RNA, 21 nt, Human
uucuuaauguacauagugcua

SEQ ID NO: 1148484 - RNA, 14 nt, Human
uucuuaauguacau

SEQ ID NO: 1148485 - RNA, 15 nt, Human
uucuuaauguacaua

SEQ ID NO: 1148486 - RNA, 11 nt, Human
uucuuccucug

SEQ ID NO: 1148487 - RNA, 12 nt, Human
uucuuccucugc

SEQ ID NO: 1148488 - RNA, 13 nt, Human
uucuuccucugcu

SEQ ID NO: 1148489 - RNA, 16 nt, Human
uucuucgacuguuguu

SEQ ID NO: 1148490 - RNA, 19 nt, Human
uucuucgacuguuguuauc

SEQ ID NO: 1148491 - RNA, 13 nt, Human
uucuuucuuccuc

SEQ ID NO: 1148492 - RNA, 15 nt, Human
uucuuucuuccucug

SEQ ID NO: 1148493 - RNA, 22 nt, Human
uucuuuuuacccauuuguucau

SEQ ID NO: 1148494 - RNA, 16 nt, Human
uugaaaguuuacagga

SEQ ID NO: 1148495 - RNA, 12 nt, Human
auccuaaugaau

SEQ ID NO: 1148496 - RNA, 13 nt, Human
auccuaaugaaug

SEQ ID NO: 1148497 - RNA, 19 nt, Human
auccuaaugaaugcauaaa

SEQ ID NO: 1148498 - RNA, 14 nt, Human
auccuacaagacac

SEQ ID NO: 1148499 - RNA, 11 nt, Human
aucucagccca

SEQ ID NO: 1148500 - RNA, 16 nt, Human
aucucagcucaucuuc

SEQ ID NO: 1148501 - RNA, 12 nt, Human
aucucagcucau

SEQ ID NO: 1148502 - RNA, 19 nt, Human
aucucuucuggguuccuuc

SEQ ID NO: 1148503 - RNA, 23 nt, Human
uugauggugaugaaauguaaaua

SEQ ID NO: 1148504 - RNA, 21 nt, Human
uugauguggugaaaagcaggu

SEQ ID NO: 1148505 - RNA, 15 nt, Human
uugcacagcaucuca

SEQ ID NO: 1148506 - RNA, 18 nt, Human
uugcacagcaucucagcu

SEQ ID NO: 1148507 - RNA, 19 nt, Human
uugcacagcaucucagcuc

SEQ ID NO: 1148508 - RNA, 18 nt, Human
aucugaugcaagcaagaa

SEQ ID NO: 1148509 - RNA, 23 nt, Human
uuggaucucuucuuaauguacau

SEQ ID NO: 1148510 - RNA, 12 nt, Human
augaaugcuuaa

SEQ ID NO: 1148511 - RNA, 15 nt, Human
augaaugcuuaaaga

SEQ ID NO: 1148512 - RNA, 18 nt, Human
uugggccccagaggcugg

SEQ ID NO: 1148513 - RNA, 15 nt, Human
augaccacacuccag

SEQ ID NO: 1148514 - RNA, 18 nt, Human
uuguggguuuuuauuucc

SEQ ID NO: 1148515 - RNA, 20 nt, Human
uuguggguuuuuauuuccua

SEQ ID NO: 1148516 - RNA, 18 nt, Human
uuguuguagagaaaacau

SEQ ID NO: 1148517 - RNA, 17 nt, Human
augauuucagcucacug

SEQ ID NO: 1148518 - RNA, 19 nt, Human
augauuucagcucacugca

SEQ ID NO: 1148519 - RNA, 13 nt, Human
augauuucaugua

SEQ ID NO: 1148520 - RNA, 16 nt, Human
augauuucauguacug

SEQ ID NO: 1148521 - RNA, 14 nt, Human
augauuucauguac

SEQ ID NO: 1148522 - RNA, 16 nt, Human
uuuaaugaaugcuuaa

SEQ ID NO: 1148523 - RNA, 22 nt, Human
uuuaaugaaugcuuaaagaauu

SEQ ID NO: 1148524 - RNA, 13 nt, Human
augcagugccagg

SEQ ID NO: 1148525 - RNA, 18 nt, Human
augccccgucccccucug

SEQ ID NO: 1148526 - RNA, 24 nt, Human
uuuauggugccuaguauugacaaa

SEQ ID NO: 1148527 - RNA, 19 nt, Human
uuuauggugccuaguauug

SEQ ID NO: 1148528 - RNA, 14 nt, Human
uuucacugcuggcu

SEQ ID NO: 1148529 - RNA, 17 nt, Human
uuucacugcuggcugcc

SEQ ID NO: 1148530 - RNA, 18 nt, Human
uuucacugcuggcugccu

SEQ ID NO: 1148531 - RNA, 20 nt, Human
uuucacugcuggcugccuua

SEQ ID NO: 1148532 - RNA, 22 nt, Human
uuucacugcuggcugccuuaga

SEQ ID NO: 1148533 - RNA, 24 nt, Human
uuucacugcuggcugccuuagaac

SEQ ID NO: 1148534 - RNA, 20 nt, Human
uuucaucauucacuucacug

SEQ ID NO: 1148535 - RNA, 21 nt, Human
uuucaucauucacuucacugu

SEQ ID NO: 1148536 - RNA, 22 nt, Human
uuucaucauucacuucacugug

SEQ ID NO: 1148537 - RNA, 24 nt, Human
uuucaucauucacuucacugugcu

SEQ ID NO: 1148538 - RNA, 16 nt, Human
uuucauguacugcauu

SEQ ID NO: 1148539 - RNA, 20 nt, Human
uuucauguacugcauuauuu

SEQ ID NO: 1148540 - RNA, 22 nt, Human
uuucauguacugcauuauuuga

SEQ ID NO: 1148541 - RNA, 15 nt, Human
uuucccaugauuuca

SEQ ID NO: 1148542 - RNA, 18 nt, Human
uuucccaugauuucaugu

SEQ ID NO: 1148543 - RNA, 21 nt, Human
uuucccaugauuucauguacu

SEQ ID NO: 1148544 - RNA, 19 nt, Human
auggcaaggacugcaggga

SEQ ID NO: 1148545 - RNA, 22 nt, Human
auggcacaaucucggcucacug

SEQ ID NO: 1148546 - RNA, 16 nt, Human
auggccagguggccac

SEQ ID NO: 1148547 - RNA, 22 nt, Human
auggccagguggccacuccaga

SEQ ID NO: 1148548 - RNA, 13 nt, Human
uuugcucauauuu

SEQ ID NO: 1148549 - RNA, 16 nt, Human
uuugcucauauuuccc

SEQ ID NO: 1148550 - RNA, 17 nt, Human
uuugcucauauuuccca

SEQ ID NO: 1148551 - RNA, 20 nt, Human
auguaguaugcuaugauuaa

SEQ ID NO: 1148552 - RNA, 20 nt, Human
augucccaacuuguaaaaau

SEQ ID NO: 1148553 - RNA, 18 nt, Human
auguccaucagaugacaa

SEQ ID NO: 1148554 - RNA, 24 nt, Human
augucccuaccgagucucuucucc

SEQ ID NO: 1148555 - RNA, 13 nt, Human
uuuguaaauuguc

SEQ ID NO: 1148556 - RNA, 16 nt, Human
uuugugagcaggcugu

SEQ ID NO: 1148557 - RNA, 16 nt, Human
uuuuaaaacacuucca

SEQ ID NO: 1148558 - RNA, 22 nt, Human
uuuuaaaacacuuccauaaucu

SEQ ID NO: 1148559 - RNA, 20 nt, Human
uuuuaaggguuuguggaaaa

SEQ ID NO: 1148560 - RNA, 23 nt, Human
uuuuaaggguuuguggaaaauga

SEQ ID NO: 1148561 - RNA, 15 nt, Human
auguuaguaauaccu

SEQ ID NO: 1148562 - RNA, 16 nt, Human
auguuaguaauaccuc

SEQ ID NO: 1148563 - RNA, 21 nt, Human
auguuaguaauaccucuaaua

SEQ ID NO: 1148564 - RNA, 20 nt, Human
auguuaguaauaccucuaau

SEQ ID NO: 1148565 - RNA, 16 nt, Human
auguugaagccuuugu

SEQ ID NO: 1148566 - RNA, 16 nt, Human
auguuggccaggcugc

SEQ ID NO: 1148567 - RNA, 16 nt, Human
auguuggccaggcugg

SEQ ID NO: 1148568 - RNA, 18 nt, Human
uuuuauggugccuaguau

SEQ ID NO: 1148569 - RNA, 23 nt, Human
uuuuauggugccuaguauugaca

SEQ ID NO: 1148570 - RNA, 23 nt, Human
auuaagaaugaucugauugaccg

SEQ ID NO: 1148571 - RNA, 14 nt, Human
auuaagaaugaucu

SEQ ID NO: 1148572 - RNA, 15 nt, Human
auuaagaaugaucug

SEQ ID NO: 1148573 - RNA, 16 nt, Human
auuaagaaugaucuga

SEQ ID NO: 1148574 - RNA, 23 nt, Human
auuauaagggcaaauuggagaaa

SEQ ID NO: 1148575 - RNA, 18 nt, Human
auuauaagggcaaauugg

SEQ ID NO: 1148576 - RNA, 12 nt, Human
auuauagcucua

SEQ ID NO: 1148577 - RNA, 13 nt, Human
auuauagcucuaa

SEQ ID NO: 1148578 - RNA, 15 nt, Human
auuauagcucuaaug

SEQ ID NO: 1148579 - RNA, 16 nt, Human
auuauagcucuaaugu

SEQ ID NO: 1148580 - RNA, 17 nt, Human
auuauagcucuaauguu

SEQ ID NO: 1148581 - RNA, 18 nt, Human
auuauagcucuaauguuu

SEQ ID NO: 1148582 - RNA, 19 nt, Human
auuauagcucuaauguuug

SEQ ID NO: 1148583 - RNA, 21 nt, Human
auuauagcucuaauguuugca

SEQ ID NO: 1148584 - RNA, 22 nt, Human
auuauagcucuaauguuugcau

SEQ ID NO: 1148585 - RNA, 23 nt, Human
auuauagcucuaauguuugcaua

SEQ ID NO: 1148586 - RNA, 16 nt, Human
auuauauuuacaaaug

SEQ ID NO: 1148587 - RNA, 17 nt, Human
auuauauuuacaaaugg

SEQ ID NO: 1148588 - RNA, 16 nt, Human
auucaaaaugauguau

SEQ ID NO: 1148589 - RNA, 21 nt, Human
auugaccguguuggucuguac

SEQ ID NO: 1148590 - RNA, 17 nt, Human
auugcauuuccugacag

SEQ ID NO: 1148591 - RNA, 14 nt, Human
auuguauuacaaau

SEQ ID NO: 1148592 - RNA, 15 nt, Human
auuguauuacaaauc

SEQ ID NO: 1148593 - RNA, 13 nt, Human
auugugcuagugc

SEQ ID NO: 1148594 - RNA, 11 nt, Human
auuuaaacaga

SEQ ID NO: 1148595 - RNA, 12 nt, Human
auuuaaacagau

SEQ ID NO: 1148596 - RNA, 18 nt, Human
auuuaaacagauguccau

SEQ ID NO: 1148597 - RNA, 16 nt, Human
auuuacaaaugggaaa

SEQ ID NO: 1148598 - RNA, 19 nt, Human
auuuacccaacucuguaca

SEQ ID NO: 1148599 - RNA, 21 nt, Human
caaaauacuugucuguuuuaa

SEQ ID NO: 1148600 - RNA, 20 nt, Human
caaaauacuugucuguuuua

SEQ ID NO: 1148601 - RNA, 16 nt, Human
caaaaucaguuuuccu

SEQ ID NO: 1148602 - RNA, 12 nt, Human
caaaaucaguuu

SEQ ID NO: 1148603 - RNA, 21 nt, Human
caaaaugagcccuguccugcc

SEQ ID NO: 1148604 - RNA, 13 nt, Human
caaacaauaccug

SEQ ID NO: 1148605 - RNA, 15 nt, Human
caaacaauaccugaa

SEQ ID NO: 1148606 - RNA, 22 nt, Human
caaacaauaccugaaugcucug

SEQ ID NO: 1148607 - RNA, 18 nt, Human
caaagugcugggauuaca

SEQ ID NO: 1148608 - RNA, 20 nt, Human
caaaguucccuacuuccugu

SEQ ID NO: 1148609 - RNA, 21 nt, Human
caaaguucccuacuuccugug

SEQ ID NO: 1148610 - RNA, 15 nt, Human
caaauuuuaucugcc

SEQ ID NO: 1148611 - RNA, 18 nt, Human
caaccugcucuccucuug

SEQ ID NO: 1148612 - RNA, 21 nt, Human
caaccugcucuccucuugcca

SEQ ID NO: 1148613 - RNA, 23 nt, Human
caaccugcucuccucuugccacu

SEQ ID NO: 1148614 - RNA, 16 nt, Human
caaccuggucacagga

SEQ ID NO: 1148615 - RNA, 17 nt, Human
caaccuucuguggcuca

SEQ ID NO: 1148616 - RNA, 19 nt, Human
caaccuucuguggcucaca

SEQ ID NO: 1148617 - RNA, 20 nt, Human
caaccuucuguggcucacag

SEQ ID NO: 1148618 - RNA, 12 nt, Human
caacuugggaac

SEQ ID NO: 1148619 - RNA, 16 nt, Human
caacuuguaaaugugg

SEQ ID NO: 1148620 - RNA, 17 nt, Human
caagagcuuaacagugu

SEQ ID NO: 1148621 - RNA, 23 nt, Human
caagggaauuucuucaacucccu

SEQ ID NO: 1148622 - RNA, 18 nt, Human
caaggaaaaaauaacaau

SEQ ID NO: 1148623 - RNA, 20 nt, Human
caaggaaaaaauaacaauga

SEQ ID NO: 1148624 - RNA, 14 nt, Human
caaggagccaaaca

SEQ ID NO: 1148625 - RNA, 18 nt, Human
caauaauaauaccucccu

SEQ ID NO: 1148626 - RNA, 19 nt, Human
caauaccugaaugcucugu

SEQ ID NO: 1148627 - RNA, 17 nt, Human
caauaccugaaugcucu

SEQ ID NO: 1148628 - RNA, 16 nt, Human
caauuagcuuauguua

SEQ ID NO: 1148629 - RNA, 15 nt, Human
cacaaguguaaugaa

SEQ ID NO: 1148630 - RNA, 17 nt, Human
cacaaguguaaugaaua

SEQ ID NO: 1148631 - RNA, 14 nt, Human
cacacuccagcugg

SEQ ID NO: 1148632 - RNA, 16 nt, Human
cacagauuugagcuca

SEQ ID NO: 1148633 - RNA, 17 nt, Human
cacagauuugagcucag

SEQ ID NO: 1148634 - RNA, 18 nt, Human
cacagauuugagcucagc

SEQ ID NO: 1148635 - RNA, 22 nt, Human
cacagauuugagcucagcccug

SEQ ID NO: 1148636 - RNA, 12 nt, Human
cacagcugcuca

SEQ ID NO: 1148637 - RNA, 22 nt, Human
cacagcugcucaauaaaguaca

SEQ ID NO: 1148638 - RNA, 16 nt, Human
cacaggcccuuccucu

SEQ ID NO: 1148639 - RNA, 17 nt, Human
cacaggcccuuccucuc

SEQ ID NO: 1148640 - RNA, 18 nt, Human
cacaggcccuuccucucc

SEQ ID NO: 1148641 - RNA, 19 nt, Human
cacaggcccuuccucucca

SEQ ID NO: 1148642 - RNA, 21 nt, Human
cacaggcccuuccucuccacu

SEQ ID NO: 1148643 - RNA, 22 nt, Human
cacaggcccuuccucuccacug

SEQ ID NO: 1148644 - RNA, 18 nt, Human
cacagugcaucucagccc

SEQ ID NO: 1148645 - RNA, 19 nt, Human
cacagugcaucucagccca

SEQ ID NO: 1148646 - RNA, 11 nt, Human
cagugggaacu

SEQ ID NO: 1148647 - RNA, 16 nt, Human
cagugggacagggcau

SEQ ID NO: 1148648 - RNA, 14 nt, Human
caguguuagcuuag

SEQ ID NO: 1148649 - RNA, 13 nt, Human
caguguuagcuua

SEQ ID NO: 1148650 - RNA, 14 nt, Human
caguuaagccuuug

SEQ ID NO: 1148651 - RNA, 15 nt, Human
caguuaagccuuugg

SEQ ID NO: 1148652 - RNA, 17 nt, Human
caguuaagccuuuggaa

SEQ ID NO: 1148653 - RNA, 20 nt, Human
caguuaagccuuuggaaaca

SEQ ID NO: 1148654 - RNA, 12 nt, Human
caguuacacaug

SEQ ID NO: 1148655 - RNA, 22 nt, Human
caguucggugagcuacaaaugc

SEQ ID NO: 1148656 - RNA, 18 nt, Human
caguucuucgacuguugu

SEQ ID NO: 1148657 - RNA, 19 nt, Human
caguucuucgacuguuguu

SEQ ID NO: 1148658 - RNA, 12 nt, Human
caguugcacagc

SEQ ID NO: 1148659 - RNA, 13 nt, Human
caguugcacagca

SEQ ID NO: 1148660 - RNA, 15 nt, Human
caguugcacagcauc

SEQ ID NO: 1148661 - RNA, 16 nt, Human
caguugcacagcaucu

SEQ ID NO: 1148662 - RNA, 17 nt, Human
caguugcacagcaucuc

SEQ ID NO: 1148663 - RNA, 18 nt, Human
caguugcacagcaucuca

SEQ ID NO: 1148664 - RNA, 21 nt, Human
caguugcacagcaucucagcu

SEQ ID NO: 1148665 - RNA, 22 nt, Human
caguugcacagcaucucagcuc

SEQ ID NO: 1148666 - RNA, 19 nt, Human
caguugcugcuucaauuua

SEQ ID NO: 1148667 - RNA, 18 nt, Human
caguugcugcuucaauuu

SEQ ID NO: 1148668 - RNA, 17 nt, Human
cauaacuaauacagcug

SEQ ID NO: 1148669 - RNA, 22 nt, Human
cauaacuaauacagcugagcua

SEQ ID NO: 1148670 - RNA, 19 nt, Human
cauaaucuggacuccucug

SEQ ID NO: 1148671 - RNA, 18 nt, Human
cauacauucuucaagauc

SEQ ID NO: 1148672 - RNA, 21 nt, Human
cauacauucuucaagauccca

SEQ ID NO: 1148673 - RNA, 17 nt, Human
cauacauuuuguaccaa

SEQ ID NO: 1148674 - RNA, 18 nt, Human
cauaccauggaggaaggc

SEQ ID NO: 1148675 - RNA, 20 nt, Human
cauacuaauuauacccccug

SEQ ID NO: 1148676 - RNA, 19 nt, Human
cauacuuuguuaggaaggg

SEQ ID NO: 1148677 - RNA, 17 nt, Human
cauagaccuuuucauuu

SEQ ID NO: 1148678 - RNA, 18 nt, Human
cauagugcuaacaugaag

SEQ ID NO: 1148679 - RNA, 19 nt, Human
cauagugcuaacaugaaga

SEQ ID NO: 1148680 - RNA, 20 nt, Human
cauagugcuaacaugaagac

SEQ ID NO: 1148681 - RNA, 13 nt, Human
cauauaaauagaa

SEQ ID NO: 1148682 - RNA, 15 nt, Human
cauauaaauagaaug

SEQ ID NO: 1148683 - RNA, 16 nt, Human
cauauaaauagaaugu

SEQ ID NO: 1148684 - RNA, 17 nt, Human
cauauaaauagaaugua

SEQ ID NO: 1148685 - RNA, 20 nt, Human
cauaugcauauuuuuuuucu

SEQ ID NO: 1148686 - RNA, 22 nt, Human
cauauuucccaugauuucaugu

SEQ ID NO: 1148687 - RNA, 22 nt, Human
caucaagucuuucacauuuaaa

SEQ ID NO: 1148688 - RNA, 16 nt, Human
cauccaauuagcuuau

SEQ ID NO: 1148689 - RNA, 17 nt, Human
cauccuacaagacacag

SEQ ID NO: 1148690 - RNA, 14 nt, Human
cauccuaacuccau

SEQ ID NO: 1148691 - RNA, 21 nt, Human
cauccuaacuccaugucucug

SEQ ID NO: 1148692 - RNA, 16 nt, Human
cauccuacaagacaca

SEQ ID NO: 1148693 - RNA, 20 nt, Human
cauccuccgccucccggguu

SEQ ID NO: 1148694 - RNA, 20 nt, Human
caucuaguuccccuguuuau

SEQ ID NO: 1148695 - RNA, 23 nt, Human
caucuaguuccccuguuuauuca

SEQ ID NO: 1148696 - RNA, 21 nt, Human
caucuaguuccccuguuuauu

SEQ ID NO: 1148697 - RNA, 13 nt, Human
caucucagcccac

SEQ ID NO: 1148698 - RNA, 21 nt, Human
caucucagcucaucuucacug

SEQ ID NO: 1148699 - RNA, 14 nt, Human
caucuccacuccag

SEQ ID NO: 1148700 - RNA, 22 nt, Human
caucucuucuggguuccuuccu

SEQ ID NO: 1148701 - RNA, 14 nt, Human
caugucgccucugc

SEQ ID NO: 1148702 - RNA, 15 nt, Human
caugucgccucugca

SEQ ID NO: 1148703 - RNA, 18 nt, Human
caugucgccucugcauuc

SEQ ID NO: 1148704 - RNA, 20 nt, Human
caugucgccucugcauucag

SEQ ID NO: 1148705 - RNA, 17 nt, Human
cauuagcaguuugcuuu

SEQ ID NO: 1148706 - RNA, 18 nt, Human
cauuagcaguuugcuuug

SEQ ID NO: 1148707 - RNA, 14 nt, Human
cauuauuugagaag

SEQ ID NO: 1148708 - RNA, 20 nt, Human
cauuauuugagaagcugcuc

SEQ ID NO: 1148709 - RNA, 22 nt, Human
cauuauuugagaagcugcucaa

SEQ ID NO: 1148710 - RNA, 13 nt, Human
cauuuaaacagau

SEQ ID NO: 1148711 - RNA, 21 nt, Human
cauuuaaacagauguccauca

SEQ ID NO: 1148712 - RNA, 14 nt, Human
cauuuaaacagaug

SEQ ID NO: 1148713 - RNA, 16 nt, Human
cauuuaaacagauguc

SEQ ID NO: 1148714 - RNA, 19 nt, Human
cauuuaaacagauguccau

SEQ ID NO: 1148715 - RNA, 12 nt, Human
cauuuuauggug

SEQ ID NO: 1148716 - RNA, 17 nt, Human
cauuuuauggugccuag

SEQ ID NO: 1148717 - RNA, 14 nt, Human
cauuuuauggugcc

SEQ ID NO: 1148718 - RNA, 18 nt, Human
ccaacccuggcacccagg

SEQ ID NO: 1148719 - RNA, 18 nt, Human
ccaaccuguucaagucua

SEQ ID NO: 1148720 - RNA, 15 nt, Human
ccaagccguggcuuc

SEQ ID NO: 1148721 - RNA, 16 nt, Human
ccaagccguggcuucc

SEQ ID NO: 1148722 - RNA, 17 nt, Human
ccaagccguggcuuccc

SEQ ID NO: 1148723 - RNA, 21 nt, Human
ccaagccguggcuucccgcuc

SEQ ID NO: 1148724 - RNA, 23 nt, Human
ccaagccguggcuucccgcucag

SEQ ID NO: 1148725 - RNA, 22 nt, Human
ccaagccuacuuuugccauuga

SEQ ID NO: 1148726 - RNA, 14 nt, Human
ccaagcuccaucuc

SEQ ID NO: 1148727 - RNA, 16 nt, Human
ccaaggcucugagcaa

SEQ ID NO: 1148728 - RNA, 13 nt, Human
ccaaguggcuccc

SEQ ID NO: 1148729 - RNA, 16 nt, Human
ccaaguggcucccaca

SEQ ID NO: 1148730 - RNA, 13 nt, Human
ccacaacacacag

SEQ ID NO: 1148731 - RNA, 12 nt, Human
ccagcuggccgg

SEQ ID NO: 1148732 - RNA, 14 nt, Human
ccagcuggccggga

SEQ ID NO: 1148733 - RNA, 20 nt, Human
ccagcuggccgggagccuga

SEQ ID NO: 1148734 - RNA, 16 nt, Human
ccagcuggguuggaaa

SEQ ID NO: 1148735 - RNA, 17 nt, Human
ccagcuggguuggaaaa

SEQ ID NO: 1148736 - RNA, 12 nt, Human
ccaggccugccu

SEQ ID NO: 1148737 - RNA, 16 nt, Human
ccaucgcugucaucuc

SEQ ID NO: 1148738 - RNA, 14 nt, Human
ccaugcugccucca

SEQ ID NO: 1148739 - RNA, 23 nt, Human
ccauggaggaaggcucuguucca

SEQ ID NO: 1148740 - RNA, 16 nt, Human
ccauguuggccaggcu

SEQ ID NO: 1148741 - RNA, 16 nt, Human
cccagaggcuggguga

SEQ ID NO: 1148742 - RNA, 13 nt, Human
cccagccccacuu

SEQ ID NO: 1148743 - RNA, 16 nt, Human
cccagccccacuuacc

SEQ ID NO: 1148744 - RNA, 23 nt, Human
cccagcccuccuuaucaaaggac

SEQ ID NO: 1148745 - RNA, 18 nt, Human
cccagccuccaagcucca

SEQ ID NO: 1148746 - RNA, 20 nt, Human
cccagccuccaagcuccauc

SEQ ID NO: 1148747 - RNA, 19 nt, Human
cccagggugggaagggcua

SEQ ID NO: 1148748 - RNA, 16 nt, Human
cccaugucucgacuca

SEQ ID NO: 1148749 - RNA, 17 nt, Human
cccaugucucgacucau

SEQ ID NO: 1148750 - RNA, 19 nt, Human
ccccagcccuccuuaucaa

SEQ ID NO: 1148751 - RNA, 23 nt, Human
ccccuggcuuuucacugcuggcu

SEQ ID NO: 1148752 - RNA, 19 nt, Human
ccccuguuuauucauaugc

SEQ ID NO: 1148753 - RNA, 14 nt, Human
ccccuuaccacugc

SEQ ID NO: 1148754 - RNA, 12 nt, Human
ccccuucccccu

SEQ ID NO: 1148755 - RNA, 20 nt, Human
ccccuuccuaauuccacagc

SEQ ID NO: 1148756 - RNA, 21 nt, Human
ccccuuccuaauuccacagcu

SEQ ID NO: 1148757 - RNA, 22 nt, Human
ccccuuccuaauuccacagcug

SEQ ID NO: 1148758 - RNA, 19 nt, Human
cccgcucagcccucccugc

SEQ ID NO: 1148759 - RNA, 23 nt, Human
cccgcucagcccucccugccccu

SEQ ID NO: 1148760 - RNA, 17 nt, Human
cccggaggggccuggca

SEQ ID NO: 1148761 - RNA, 18 nt, Human
cccggaggggccuggcag

SEQ ID NO: 1148762 - RNA, 13 nt, Human
cccucauagcccu

SEQ ID NO: 1148763 - RNA, 15 nt, Human
cccucauagcccuca

SEQ ID NO: 1148764 - RNA, 19 nt, Human
cccucauagcccucacccu

SEQ ID NO: 1148765 - RNA, 22 nt, Human
cccucauuccaccuucccaugc

SEQ ID NO: 1148766 - RNA, 19 nt, Human
cccuccaucuaaacugccc

SEQ ID NO: 1148767 - RNA, 14 nt, Human
cccucccuucaacc

SEQ ID NO: 1148768 - RNA, 23 nt, Human
cccugcacaaagcccuuccaugu

SEQ ID NO: 1148769 - RNA, 23 nt, Human
cccugcuuugggcugcccuggug

SEQ ID NO: 1148770 - RNA, 17 nt, Human
cccuggugcugccacac

SEQ ID NO: 1148771 - RNA, 21 nt, Human
cccuggugcugccacacuuca

SEQ ID NO: 1148772 - RNA, 13 nt, Human
cccuguucacucu

SEQ ID NO: 1148773 - RNA, 14 nt, Human
cccuguucacucua

SEQ ID NO: 1148774 - RNA, 22 nt, Human
cccuguucacucuacuuagcau

SEQ ID NO: 1148775 - RNA, 11 nt, Human
cccuucauuug

SEQ ID NO: 1148776 - RNA, 13 nt, Human
cccuuccuaauuc

SEQ ID NO: 1148777 - RNA, 14 nt, Human
cccuuccuaauucc

SEQ ID NO: 1148778 - RNA, 19 nt, Human
cccuuccuaauuccacagc

SEQ ID NO: 1148779 - RNA, 20 nt, Human
cccuuccuaauuccacagcu

SEQ ID NO: 1148780 - RNA, 21 nt, Human
cccuuccuaauuccacagcug

SEQ ID NO: 1148781 - RNA, 11 nt, Human
cccuucuuuuu

SEQ ID NO: 1148782 - RNA, 19 nt, Human
cccuucuuuuucuucuuuu

SEQ ID NO: 1148783 - RNA, 21 nt, Human
ccggaggggccuggcagccgu

SEQ ID NO: 1148784 - RNA, 16 nt, Human
ccgggagccugaucac

SEQ ID NO: 1148785 - RNA, 23 nt, Human
ccgggagccugaucaccugcccu

SEQ ID NO: 1148786 - RNA, 19 nt, Human
ccguguuggucuguacuga

SEQ ID NO: 1148787 - RNA, 18 nt, Human
ccguguuggucuguacug

SEQ ID NO: 1148788 - RNA, 13 nt, Human
ccuaaacauauga

SEQ ID NO: 1148789 - RNA, 13 nt, Human
ccuacuuccccuu

SEQ ID NO: 1148790 - RNA, 16 nt, Human
ccuacuuccccuuccu

SEQ ID NO: 1148791 - RNA, 21 nt, Human
ccuacuuccccuuccuaauuc

SEQ ID NO: 1148792 - RNA, 14 nt, Human
ccucacccuggggc

SEQ ID NO: 1148793 - RNA, 16 nt, Human
ccucagagccaccccu

SEQ ID NO: 1148794 - RNA, 19 nt, Human
ccuccaugcugccuccaga

SEQ ID NO: 1148795 - RNA, 18 nt, Human
ccucccccguccuggagg

SEQ ID NO: 1148796 - RNA, 15 nt, Human
ccuccccuccuccug

SEQ ID NO: 1148797 - RNA, 13 nt, Human
ccuccucucugcc

SEQ ID NO: 1148798 - RNA, 15 nt, Human
ccuccucucugcccu

SEQ ID NO: 1148799 - RNA, 16 nt, Human
ccuccucucugcccua

SEQ ID NO: 1148800 - RNA, 11 nt, Human
ccucugagccu

SEQ ID NO: 1148801 - RNA, 12 nt, Human
ccucugagccuu

SEQ ID NO: 1148802 - RNA, 13 nt, Human
ccucugaggcuga

SEQ ID NO: 1148803 - RNA, 13 nt, Human
cgccccuuccccc

SEQ ID NO: 1148804 - RNA, 12 nt, Human
cgcucagcccuc

SEQ ID NO: 1148805 - RNA, 16 nt, Human
cgcucagcccucccug

SEQ ID NO: 1148806 - RNA, 21 nt, Human
cgcucagcccucccugccccu

SEQ ID NO: 1148807 - RNA, 11 nt, Human
cggcugcccuu

SEQ ID NO: 1148808 - RNA, 12 nt, Human
cggcugcccuuu

SEQ ID NO: 1148809 - RNA, 21 nt, Human
cgggagccugaucaccugccc

SEQ ID NO: 1148810 - RNA, 17 nt, Human
cgggauuaguacacacu

SEQ ID NO: 1148811 - RNA, 11 nt, Human
cgggucacagg

SEQ ID NO: 1148812 - RNA, 19 nt, Human
cgggucacaggagggaggg

SEQ ID NO: 1148813 - RNA, 17 nt, Human
cggugagcuacaaaugc

SEQ ID NO: 1148814 - RNA, 20 nt, Human
cguccuggagguuccccagc

SEQ ID NO: 1148815 - RNA, 18 nt, Human
cguggcuucccgcucagc

SEQ ID NO: 1148816 - RNA, 19 nt, Human
cguggcuucccgcucagcc

SEQ ID NO: 1148817 - RNA, 20 nt, Human
cguggcuucccgcucagccc

SEQ ID NO: 1148818 - RNA, 21 nt, Human
cguggcuucccgcucagcccu

SEQ ID NO: 1148819 - RNA, 17 nt, Human
cguuggcuagauuaacc

SEQ ID NO: 1148820 - RNA, 18 nt, Human
cguuuaaugaaugcuuaa

SEQ ID NO: 1148821 - RNA, 13 nt, Human
cguuuaaugaaug

SEQ ID NO: 1148822 - RNA, 14 nt, Human
cguuuaaugaaugc

SEQ ID NO: 1148823 - RNA, 23 nt, Human
cuaaaaccuuccaugucaagauu

SEQ ID NO: 1148824 - RNA, 15 nt, Human
cuaaaccauugugca

SEQ ID NO: 1148825 - RNA, 16 nt, Human
cuaacaugaagaccuu

SEQ ID NO: 1148826 - RNA, 14 nt, Human
cuaaggcugaacuu

SEQ ID NO: 1148827 - RNA, 17 nt, Human
cuaaucagcauucucac

SEQ ID NO: 1148828 - RNA, 19 nt, Human
cuaaucagcauucucacuc

SEQ ID NO: 1148829 - RNA, 20 nt, Human
cuaaucagcauucucacucc

SEQ ID NO: 1148830 - RNA, 16 nt, Human
cuaauccucuuuuucu

SEQ ID NO: 1148831 - RNA, 19 nt, Human
cuaaugaaugcauaaaaug

SEQ ID NO: 1148832 - RNA, 22 nt, Human
cuaaugaaugcauaaaauguua

SEQ ID NO: 1148833 - RNA, 15 nt, Human
cuaauguuugcauau

SEQ ID NO: 1148834 - RNA, 16 nt, Human
cuaauguuugcauaua

SEQ ID NO: 1148835 - RNA, 18 nt, Human
cuaauguuugcauauaag

SEQ ID NO: 1148836 - RNA, 17 nt, Human
cuaauguuugcauauaa

SEQ ID NO: 1148837 - RNA, 14 nt, Human
cuacuuccccuucc

SEQ ID NO: 1148838 - RNA, 15 nt, Human
cuacuuccccuuccu

SEQ ID NO: 1148839 - RNA, 20 nt, Human
cuacuuccccuuccuaauuc

SEQ ID NO: 1148840 - RNA, 20 nt, Human
cuacuuccugugacuucagc

SEQ ID NO: 1148841 - RNA, 18 nt, Human
cuagacucccaagcugga

SEQ ID NO: 1148842 - RNA, 16 nt, Human
cuaggaaauccagggu

SEQ ID NO: 1148843 - RNA, 17 nt, Human
cuaggaaauccagggug

SEQ ID NO: 1148844 - RNA, 14 nt, Human
cuaguauugacaaa

SEQ ID NO: 1148845 - RNA, 15 nt, Human
cuaguauugacaaaa

SEQ ID NO: 1148846 - RNA, 17 nt, Human
cuaguauugacaaaaug

SEQ ID NO: 1148847 - RNA, 18 nt, Human
cuaguauugacaaaaugu

SEQ ID NO: 1148848 - RNA, 20 nt, Human
cuaguauugacaaaauguua

SEQ ID NO: 1148849 - RNA, 19 nt, Human
cuaguauugacaaaauguu

SEQ ID NO: 1148850 - RNA, 15 nt, Human
cuaguguaucaaaau

SEQ ID NO: 1148851 - RNA, 18 nt, Human
cuaguguaucaaaaugcu

SEQ ID NO: 1148852 - RNA, 17 nt, Human
cucaagagggcacuggu

SEQ ID NO: 1148853 - RNA, 19 nt, Human
cucaagagggcacuggugg

SEQ ID NO: 1148854 - RNA, 21 nt, Human
cucaagagggcacugguggcc

SEQ ID NO: 1148855 - RNA, 13 nt, Human
cucacauuuauau

SEQ ID NO: 1148856 - RNA, 13 nt, Human
cucacuaggcuuc

SEQ ID NO: 1148857 - RNA, 16 nt, Human
cucacuaggcuucugg

SEQ ID NO: 1148858 - RNA, 20 nt, Human
cucacuaggcuucugguuga

SEQ ID NO: 1148859 - RNA, 20 nt, Human
cucacuaucccggcugcccu

SEQ ID NO: 1148860 - RNA, 21 nt, Human
cucacuaucccggcugcccuu

SEQ ID NO: 1148861 - RNA, 16 nt, Human
cuccaucuccacucca

SEQ ID NO: 1148862 - RNA, 13 nt, Human
cuccaugcugccu

SEQ ID NO: 1148863 - RNA, 13 nt, Human
cuccaugucucug

SEQ ID NO: 1148864 - RNA, 22 nt, Human
cuccaugucucugagcauuaga

SEQ ID NO: 1148865 - RNA, 17 nt, Human
cucccaaagugcuggga

SEQ ID NO: 1148866 - RNA, 18 nt, Human
cucccaaagugcugggau

SEQ ID NO: 1148867 - RNA, 22 nt, Human
cucccaaagugcugggauuaca

SEQ ID NO: 1148868 - RNA, 20 nt, Human
cucccggcuaugggggcacu

SEQ ID NO: 1148869 - RNA, 13 nt, Human
cucccucauucca

SEQ ID NO: 1148870 - RNA, 15 nt, Human
cuccgccucccgggu

SEQ ID NO: 1148871 - RNA, 14 nt, Human
cuccucccggugcc

SEQ ID NO: 1148872 - RNA, 15 nt, Human
cuccucccggugccc

SEQ ID NO: 1148873 - RNA, 17 nt, Human
cuccucccggugcccaa

SEQ ID NO: 1148874 - RNA, 16 nt, Human
cuccugccucagccuc

SEQ ID NO: 1148875 - RNA, 17 nt, Human
cucggcucacugcaucc

SEQ ID NO: 1148876 - RNA, 18 nt, Human
cucggcucacugcauccu

SEQ ID NO: 1148877 - RNA, 21 nt, Human
cucuacagcuaaucagcauuc

SEQ ID NO: 1148878 - RNA, 16 nt, Human
cucuacuuagcauguc

SEQ ID NO: 1148879 - RNA, 17 nt, Human
cucuacuuagcaugucc

SEQ ID NO: 1148880 - RNA, 19 nt, Human
cucuacuuagcaugucccu

SEQ ID NO: 1148881 - RNA, 20 nt, Human
cucuacuuagcaugucccua

SEQ ID NO: 1148882 - RNA, 11 nt, Human
cucuccacugc

SEQ ID NO: 1148883 - RNA, 12 nt, Human
cucuccacugcc

SEQ ID NO: 1148884 - RNA, 14 nt, Human
cucuccacugccuu

SEQ ID NO: 1148885 - RNA, 15 nt, Human
cucuccacugccuuc

SEQ ID NO: 1148886 - RNA, 14 nt, Human
cucuccucuugcca

SEQ ID NO: 1148887 - RNA, 15 nt, Human
cucuccucuugccac

SEQ ID NO: 1148888 - RNA, 16 nt, Human
cucuccucuugccacu

SEQ ID NO: 1148889 - RNA, 17 nt, Human
cucuccucuugccacug

SEQ ID NO: 1148890 - RNA, 19 nt, Human
cucuccucuugccacugcc

SEQ ID NO: 1148891 - RNA, 22 nt, Human
cucuccucuugccacugccucu

SEQ ID NO: 1148892 - RNA, 15 nt, Human
cucuggcuccagcug

SEQ ID NO: 1148893 - RNA, 16 nt, Human
cucuggcuccagcugg

SEQ ID NO: 1148894 - RNA, 22 nt, Human
cucuggcuccagcuggccggga

SEQ ID NO: 1148895 - RNA, 13 nt, Human
cucuucuuaaugu

SEQ ID NO: 1148896 - RNA, 18 nt, Human
cucuucuuaauguacaua

SEQ ID NO: 1148897 - RNA, 22 nt, Human
cucuucuuaauguacauagugc

SEQ ID NO: 1148898 - RNA, 24 nt, Human
cucuucuuaauguacauagugcua

SEQ ID NO: 1148899 - RNA, 23 nt, Human
cucuucuuaauguacauagugcu

SEQ ID NO: 1148900 - RNA, 15 nt, Human
cucuugaacuccuga

SEQ ID NO: 1148901 - RNA, 18 nt, Human
cucuugaacuccugaccu

SEQ ID NO: 1148902 - RNA, 22 nt, Human
cugaaauagacccacaagaggc

SEQ ID NO: 1148903 - RNA, 16 nt, Human
cugaacucugacaaca

SEQ ID NO: 1148904 - RNA, 17 nt, Human
cugaacucugacaacag

SEQ ID NO: 1148905 - RNA, 16 nt, Human
cugagccucagucucc

SEQ ID NO: 1148906 - RNA, 21 nt, Human
cugagccucagucucccuccc

SEQ ID NO: 1148907 - RNA, 22 nt, Human
cugagccucagucucccucccu

SEQ ID NO: 1148908 - RNA, 16 nt, Human
cugagcuauguaguau

SEQ ID NO: 1148909 - RNA, 20 nt, Human
cugcacccuggauuugcaua

SEQ ID NO: 1148910 - RNA, 17 nt, Human
cugcccaggccugccug

SEQ ID NO: 1148911 - RNA, 20 nt, Human
cugcccuaaugcgcaggcug

SEQ ID NO: 1148912 - RNA, 21 nt, Human
cugcccuaaugcgcaggcugg

SEQ ID NO: 1148913 - RNA, 22 nt, Human
cugcccuaaugcgcaggcuggc

SEQ ID NO: 1148914 - RNA, 20 nt, Human
cugccugcaguacuuuaccu

SEQ ID NO: 1148915 - RNA, 21 nt, Human
cugccugcaguacuuuaccuc

SEQ ID NO: 1148916 - RNA, 15 nt, Human
cugcgggucacagga

SEQ ID NO: 1148917 - RNA, 21 nt, Human
cugcgggucacaggagggagg

SEQ ID NO: 1148918 - RNA, 22 nt, Human
cugcgggucacaggagggaggg

SEQ ID NO: 1148919 - RNA, 23 nt, Human
cugcgggucacaggagggagggg

SEQ ID NO: 1148920 - RNA, 16 nt, Human
cugcucuugaacuccu

SEQ ID NO: 1148921 - RNA, 18 nt, Human
cugcucuugaacuccuga

SEQ ID NO: 1148922 - RNA, 19 nt, Human
cugcucuugaacuccugac

SEQ ID NO: 1148923 - RNA, 13 nt, Human
cugcuggcugccu

SEQ ID NO: 1148924 - RNA, 14 nt, Human
cugcuggcugccuu

SEQ ID NO: 1148925 - RNA, 15 nt, Human
cugcuggcugccuua

SEQ ID NO: 1148926 - RNA, 12 nt, Human
cugcuguacuga

SEQ ID NO: 1148927 - RNA, 13 nt, Human
cugcuguacugaa

SEQ ID NO: 1148928 - RNA, 15 nt, Human
cugcuguacugaagu

SEQ ID NO: 1148929 - RNA, 14 nt, Human
cugcuguacugaag

SEQ ID NO: 1148930 - RNA, 13 nt, Human
cugcuuuggaaau

SEQ ID NO: 1148931 - RNA, 16 nt, Human
cugcuuugggcugccc

SEQ ID NO: 1148932 - RNA, 17 nt, Human
cugcuuugggcugcccu

SEQ ID NO: 1148933 - RNA, 15 nt, Human
cuggcacagggcagu

SEQ ID NO: 1148934 - RNA, 16 nt, Human
cuggcacagggcagug

SEQ ID NO: 1148935 - RNA, 23 nt, Human
cuggcuuuucacugcuggcugcc

SEQ ID NO: 1148936 - RNA, 15 nt, Human
cuggcuuuucacugc

SEQ ID NO: 1148937 - RNA, 14 nt, Human
cugggaggcaguga

SEQ ID NO: 1148938 - RNA, 16 nt, Human
cugggauuacaggugu

SEQ ID NO: 1148939 - RNA, 18 nt, Human
cugggauuacagguguga

SEQ ID NO: 1148940 - RNA, 15 nt, Human
cugggccccaguugu

SEQ ID NO: 1148941 - RNA, 19 nt, Human
cugggccccaguuguauuu

SEQ ID NO: 1148942 - RNA, 20 nt, Human
cuggucacaggacucugccu

SEQ ID NO: 1148943 - RNA, 21 nt, Human
cuggucacaggacucugccuc

SEQ ID NO: 1148944 - RNA, 22 nt, Human
cuggucacaggacucugccucc

SEQ ID NO: 1148945 - RNA, 23 nt, Human
cuggucacaggacucugccuccu

SEQ ID NO: 1148946 - RNA, 16 nt, Human
cuggucucgaacuccu

SEQ ID NO: 1148947 - RNA, 21 nt, Human
cuggucucgaacuccugaccu

SEQ ID NO: 1148948 - RNA, 23 nt, Human
cugguuaauauuuauaggucacu

SEQ ID NO: 1148949 - RNA, 18 nt, Human
cuguccaggcacugcugc

SEQ ID NO: 1148950 - RNA, 19 nt, Human
cuguccaggcacugcugcc

SEQ ID NO: 1148951 - RNA, 20 nt, Human
cuguccaggcacugcugccc

SEQ ID NO: 1148952 - RNA, 21 nt, Human
cuguccaggcacugcugccca

SEQ ID NO: 1148953 - RNA, 22 nt, Human
cuguccaggcacugcugcccag

SEQ ID NO: 1148954 - RNA, 23 nt, Human
cuguccaggcacugcugcccagc

SEQ ID NO: 1148955 - RNA, 18 nt, Human
cugucucaagagggcacu

SEQ ID NO: 1148956 - RNA, 19 nt, Human
cugucucaagagggcacug

SEQ ID NO: 1148957 - RNA, 20 nt, Human
cugucucaagagggcacugg

SEQ ID NO: 1148958 - RNA, 21 nt, Human
cugucucaagagggcacuggu

SEQ ID NO: 1148959 - RNA, 17 nt, Human
cuucuuuuuuugugaug

SEQ ID NO: 1148960 - RNA, 18 nt, Human
cuugcaguaucggcacug

SEQ ID NO: 1148961 - RNA, 20 nt, Human
cuugcaguaucggcacugua

SEQ ID NO: 1148962 - RNA, 19 nt, Human
cuugcaguaucggcacugu

SEQ ID NO: 1148963 - RNA, 17 nt, Human
cuugccaaauauaaaua

SEQ ID NO: 1148964 - RNA, 15 nt, Human
cuuggggccuaugca

SEQ ID NO: 1148965 - RNA, 18 nt, Human
cuuguaaaaauuaaaagu

SEQ ID NO: 1148966 - RNA, 18 nt, Human
cuuguaaaggaauuuaaa

SEQ ID NO: 1148967 - RNA, 21 nt, Human
cuuguaugaaagauggcugug

SEQ ID NO: 1148968 - RNA, 15 nt, Human
cuuuccccaugucuc

SEQ ID NO: 1148969 - RNA, 20 nt, Human
cuuuccccaugucucgacuc

SEQ ID NO: 1148970 - RNA, 21 nt, Human
cuuuccccaugucucgacuca

SEQ ID NO: 1148971 - RNA, 21 nt, Human
cuuuccgguguuuaagacauu

SEQ ID NO: 1148972 - RNA, 18 nt, Human
cuuuuaaaacacuuccau

SEQ ID NO: 1148973 - RNA, 12 nt, Human
cuuuucacugcu

SEQ ID NO: 1148974 - RNA, 16 nt, Human
cuuuucacugcuggcu

SEQ ID NO: 1148975 - RNA, 13 nt, Human
cuuuucauuugug

SEQ ID NO: 1148976 - RNA, 22 nt, Human
cuuuuuacccauuuguucauau

SEQ ID NO: 1148977 - RNA, 22 nt, Human
gaaagauggcugugccucugcc

SEQ ID NO: 1148978 - RNA, 23 nt, Human
gaaagauggcugugccucugccu

SEQ ID NO: 1148979 - RNA, 19 nt, Human
gaaagucagauucuugcau

SEQ ID NO: 1148980 - RNA, 15 nt, Human
gaaagugagcagugu

SEQ ID NO: 1148981 - RNA, 16 nt, Human
gaaagugagcaguguu

SEQ ID NO: 1148982 - RNA, 22 nt, Human
gaaagugagcaguguuagcuua

SEQ ID NO: 1148983 - RNA, 14 nt, Human
gaaaguuuacagga

SEQ ID NO: 1148984 - RNA, 16 nt, Human
gaaaguuuacaggaaa

SEQ ID NO: 1148985 - RNA, 15 nt, Human
gaacuccuaaaucaa

SEQ ID NO: 1148986 - RNA, 16 nt, Human
gaacuccuaaaucaag

SEQ ID NO: 1148987 - RNA, 13 nt, Human
gaacuccugaccu

SEQ ID NO: 1148988 - RNA, 14 nt, Human
gaacuccugaccuc

SEQ ID NO: 1148989 - RNA, 15 nt, Human
gaacuuguuuucugg

SEQ ID NO: 1148990 - RNA, 15 nt, Human
gaagauaaacgugga

SEQ ID NO: 1148991 - RNA, 21 nt, Human
gaagauaaacguggauguuac

SEQ ID NO: 1148992 - RNA, 22 nt, Human
gaaggaauaaauugcuccuuga

SEQ ID NO: 1148993 - RNA, 22 nt, Human
gaaggacccggaggggccuggc

SEQ ID NO: 1148994 - RNA, 23 nt, Human
gaaggacccggaggggccuggca

SEQ ID NO: 1148995 - RNA, 20 nt, Human
gaaggcagggagggccuggg

SEQ ID NO: 1148996 - RNA, 22 nt, Human
gaaggcagggagggccugggcc

SEQ ID NO: 1148997 - RNA, 23 nt, Human
gaaggcagggagggccugggccc

SEQ ID NO: 1148998 - RNA, 20 nt, Human
gaagguauaucuagguuuau

SEQ ID NO: 1148999 - RNA, 15 nt, Human
gaagucacugcacag

SEQ ID NO: 1149000 - RNA, 17 nt, Human
gacacagugaccauacu

SEQ ID NO: 1149001 - RNA, 17 nt, Human
gacaccuacugaguggc

SEQ ID NO: 1149002 - RNA, 19 nt, Human
gacagaucucugcuuugga

SEQ ID NO: 1149003 - RNA, 21 nt, Human
gacagaucucugcuuuggaaa

SEQ ID NO: 1149004 - RNA, 23 nt, Human
gacagaucucugcuuuggaaauc

SEQ ID NO: 1149005 - RNA, 15 nt, Human
gacaggcugcggccc

SEQ ID NO: 1149006 - RNA, 18 nt, Human
gacaggcugcggccccuc

SEQ ID NO: 1149007 - RNA, 22 nt, Human
gacaggcugcggccccuccccc

SEQ ID NO: 1149008 - RNA, 23 nt, Human
gacaggcugcggccccucccccg

SEQ ID NO: 1149009 - RNA, 22 nt, Human
gaccccucauagcccucacccu

SEQ ID NO: 1149010 - RNA, 23 nt, Human
gaccccucauagcccucacccug

SEQ ID NO: 1149011 - RNA, 23 nt, Human
gaccugauuucugagcauuuaau

SEQ ID NO: 1149012 - RNA, 21 nt, Human
gaccugccccuccucucugcc

SEQ ID NO: 1149013 - RNA, 15 nt, Human
gaccugccucggccu

SEQ ID NO: 1149014 - RNA, 19 nt, Human
gaccugccucggccuccca

SEQ ID NO: 1149015 - RNA, 17 nt, Human
gaccuuuuucugcacua

SEQ ID NO: 1149016 - RNA, 17 nt, Human
gacgggguuucaccaug

SEQ ID NO: 1149017 - RNA, 15 nt, Human
gacucagguugucug

SEQ ID NO: 1149018 - RNA, 15 nt, Human
gacucaguggggagg

SEQ ID NO: 1149019 - RNA, 23 nt, Human
gagacugucucaagagggcacug

SEQ ID NO: 1149020 - RNA, 13 nt, Human
gagacuuguauga

SEQ ID NO: 1149021 - RNA, 13 nt, Human
gagaguggcuccu

SEQ ID NO: 1149022 - RNA, 17 nt, Human
gagauacagaauuuuau

SEQ ID NO: 1149023 - RNA, 19 nt, Human
gagccucagucucccuccc

SEQ ID NO: 1149024 - RNA, 20 nt, Human
gaggaaaaccaagccguggc

SEQ ID NO: 1149025 - RNA, 21 nt, Human
gaggaaaaccaagccguggcu

SEQ ID NO: 1149026 - RNA, 23 nt, Human
gaggaaaaccaagccguggcuuc

SEQ ID NO: 1149027 - RNA, 19 nt, Human
gauacaccgggccuggaga

SEQ ID NO: 1149028 - RNA, 20 nt, Human
gauccccaagccuggcaagg

SEQ ID NO: 1149029 - RNA, 22 nt, Human
gaugacaagaaaggcugcugua

SEQ ID NO: 1149030 - RNA, 13 nt, Human
gauggcugugccu

SEQ ID NO: 1149031 - RNA, 17 nt, Human
gauggcugugccucugc

SEQ ID NO: 1149032 - RNA, 18 nt, Human
gauggcugugccucugcc

SEQ ID NO: 1149033 - RNA, 19 nt, Human
gauggcugugccucugccu

SEQ ID NO: 1149034 - RNA, 20 nt, Human
gauggcugugccucugccug

SEQ ID NO: 1149035 - RNA, 19 nt, Human
gauuccagagaguggcucc

SEQ ID NO: 1149036 - RNA, 20 nt, Human
gauuccagagaguggcuccu

SEQ ID NO: 1149037 - RNA, 22 nt, Human
gauuccagagaguggcuccucc

SEQ ID NO: 1149038 - RNA, 13 nt, Human
gcaaagcccagcu

SEQ ID NO: 1149039 - RNA, 21 nt, Human
gcaaagcccagcuugaaaccu

SEQ ID NO: 1149040 - RNA, 17 nt, Human
gcaaauccuuugugaaa

SEQ ID NO: 1149041 - RNA, 18 nt, Human
gcaaauccuuugugaaaa

SEQ ID NO: 1149042 - RNA, 12 nt, Human
gcacugcugccc

SEQ ID NO: 1149043 - RNA, 22 nt, Human
gcacugguggcccgacagccug

SEQ ID NO: 1149044 - RNA, 23 nt, Human
gcacugguggcccgacagccugg

SEQ ID NO: 1149045 - RNA, 24 nt, Human
gcacugguggcccgacagccuggc

SEQ ID NO: 1149046 - RNA, 21 nt, Human
gcacuguacaaaaaaaucuuc

SEQ ID NO: 1149047 - RNA, 18 nt, Human
gcagcacaaguguaauga

SEQ ID NO: 1149048 - RNA, 13 nt, Human
gcagcccugcuuu

SEQ ID NO: 1149049 - RNA, 14 nt, Human
gcagcccugcuuug

SEQ ID NO: 1149050 - RNA, 13 nt, Human
gcagcuuugcuca

SEQ ID NO: 1149051 - RNA, 14 nt, Human
gcagcuuugcucau

SEQ ID NO: 1149052 - RNA, 15 nt, Human
gcagcuuugcucaua

SEQ ID NO: 1149053 - RNA, 20 nt, Human
gcaggaaggcugagaggaga

SEQ ID NO: 1149054 - RNA, 12 nt, Human
gcaguuauuugc

SEQ ID NO: 1149055 - RNA, 13 nt, Human
gcauagaaguaaa

SEQ ID NO: 1149056 - RNA, 17 nt, Human
gcauagguuuaauaauu

SEQ ID NO: 1149057 - RNA, 15 nt, Human
gcauauuuuuuuucu

SEQ ID NO: 1149058 - RNA, 20 nt, Human
gcauggcaaggacugcaggg

SEQ ID NO: 1149059 - RNA, 11 nt, Human
gcauuauuuga

SEQ ID NO: 1149060 - RNA, 15 nt, Human
gcauuauuugagaag

SEQ ID NO: 1149061 - RNA, 21 nt, Human
gcauuauuugagaagcugcuc

SEQ ID NO: 1149062 - RNA, 21 nt, Human
gccacuccagaccccuggcuu

SEQ ID NO: 1149063 - RNA, 22 nt, Human
gccacuccagaccccuggcuuu

SEQ ID NO: 1149064 - RNA, 14 nt, Human
gccaguaauccugu

SEQ ID NO: 1149065 - RNA, 19 nt, Human
gccaguaauccuguaggaa

SEQ ID NO: 1149066 - RNA, 24 nt, Human
gcccaaccugcucuccucuugcca

SEQ ID NO: 1149067 - RNA, 21 nt, Human
gcccaagaauagaugcugacu

SEQ ID NO: 1149068 - RNA, 22 nt, Human
gcccaagaauagaugcugacug

SEQ ID NO: 1149069 - RNA, 20 nt, Human
gcccacauagugaugguucc

SEQ ID NO: 1149070 - RNA, 20 nt, Human
gcccaggcuggagugcaaug

SEQ ID NO: 1149071 - RNA, 14 nt, Human
gccccacuuaccgc

SEQ ID NO: 1149072 - RNA, 19 nt, Human
gccccaguuguauuuauuu

SEQ ID NO: 1149073 - RNA, 21 nt, Human
gccccauaauuuuuuuuuucc

SEQ ID NO: 1149074 - RNA, 12 nt, Human
gccccucccccg

SEQ ID NO: 1149075 - RNA, 19 nt, Human
gccccucccccguccugga

SEQ ID NO: 1149076 - RNA, 22 nt, Human
gccccucccccguccuggaggu

SEQ ID NO: 1149077 - RNA, 12 nt, Human
gcccgacagccu

SEQ ID NO: 1149078 - RNA, 14 nt, Human
gcccgacagccugg

SEQ ID NO: 1149079 - RNA, 15 nt, Human
gcccgacagccuggc

SEQ ID NO: 1149080 - RNA, 16 nt, Human
gcccgacagccuggca

SEQ ID NO: 1149081 - RNA, 20 nt, Human
gcccuccaucuaaacugccc

SEQ ID NO: 1149082 - RNA, 21 nt, Human
gcccuccaucuaaacugcccc

SEQ ID NO: 1149083 - RNA, 16 nt, Human
gcccugcuuugggcug

SEQ ID NO: 1149084 - RNA, 18 nt, Human
gcccugcuuugggcugcc

SEQ ID NO: 1149085 - RNA, 19 nt, Human
gcccugcuuugggcugccc

SEQ ID NO: 1149086 - RNA, 14 nt, Human
gccgugccuucagc

SEQ ID NO: 1149087 - RNA, 15 nt, Human
gccgugccuucagcu

SEQ ID NO: 1149088 - RNA, 17 nt, Human
gccgugccuucagcucu

SEQ ID NO: 1149089 - RNA, 19 nt, Human
gccgugccuucagcucuac

SEQ ID NO: 1149090 - RNA, 19 nt, Human
gccguggcuucccgcucag

SEQ ID NO: 1149091 - RNA, 21 nt, Human
gccguggcuucccgcucagcc

SEQ ID NO: 1149092 - RNA, 22 nt, Human
gccguggcuucccgcucagccc

SEQ ID NO: 1149093 - RNA, 22 nt, Human
gccuaugugcaugcagcaucua

SEQ ID NO: 1149094 - RNA, 15 nt, Human
gccuccgggaccccc

SEQ ID NO: 1149095 - RNA, 16 nt, Human
gccuccgggaccccca

SEQ ID NO: 1149096 - RNA, 17 nt, Human
gccuccgggacccccag

SEQ ID NO: 1149097 - RNA, 18 nt, Human
gccuccgggacccccagg

SEQ ID NO: 1149098 - RNA, 19 nt, Human
gccuccgggacccccagga

SEQ ID NO: 1149099 - RNA, 20 nt, Human
gccuccgggacccccaggac

SEQ ID NO: 1149100 - RNA, 13 nt, Human
gccuucagggagu

SEQ ID NO: 1149101 - RNA, 21 nt, Human
gccuucagggagugagggauu

SEQ ID NO: 1149102 - RNA, 13 nt, Human
gccuucaucuccc

SEQ ID NO: 1149103 - RNA, 18 nt, Human
gccuucgauacaccgggc

SEQ ID NO: 1149104 - RNA, 22 nt, Human
gccuucgauacaccgggccugg

SEQ ID NO: 1149105 - RNA, 23 nt, Human
gccuucgauacaccgggccugga

SEQ ID NO: 1149106 - RNA, 22 nt, Human
gccuuuggaaacagcucgacuu

SEQ ID NO: 1149107 - RNA, 13 nt, Human
gcgggucacagga

SEQ ID NO: 1149108 - RNA, 15 nt, Human
gcgggucacaggagg

SEQ ID NO: 1149109 - RNA, 19 nt, Human
gcgggucacaggagggagg

SEQ ID NO: 1149110 - RNA, 20 nt, Human
gcgggucacaggagggaggg

SEQ ID NO: 1149111 - RNA, 19 nt, Human
gcuaggaaauccagggugg

SEQ ID NO: 1149112 - RNA, 22 nt, Human
gcuaggaaauccaggguggugg

SEQ ID NO: 1149113 - RNA, 14 nt, Human
guagggugggccuu

SEQ ID NO: 1149114 - RNA, 17 nt, Human
guagggugggccuucag

SEQ ID NO: 1149115 - RNA, 22 nt, Human
guagggugggccuucagggagu

SEQ ID NO: 1149116 - RNA, 21 nt, Human
guagguuauuaugauuagcuu

SEQ ID NO: 1149117 - RNA, 19 nt, Human
guauaucuagguuuaugac

SEQ ID NO: 1149118 - RNA, 20 nt, Human
guauaucuagguuuaugaca

SEQ ID NO: 1149119 - RNA, 23 nt, Human
guauaucuagguuuaugacagua

SEQ ID NO: 1149120 - RNA, 13 nt, Human
guauaugucucag

SEQ ID NO: 1149121 - RNA, 15 nt, Human
guauaugucucaggu

SEQ ID NO: 1149122 - RNA, 21 nt, Human
guauaugucucaggucccugc

SEQ ID NO: 1149123 - RNA, 16 nt, Human
guauauguugggugca

SEQ ID NO: 1149124 - RNA, 13 nt, Human
guaucggcacugu

SEQ ID NO: 1149125 - RNA, 15 nt, Human
guaucggcacuguac

SEQ ID NO: 1149126 - RNA, 16 nt, Human
guaucggcacuguaca

SEQ ID NO: 1149127 - RNA, 18 nt, Human
guaucggcacuguacaaa

SEQ ID NO: 1149128 - RNA, 14 nt, Human
guaucuugcaguau

SEQ ID NO: 1149129 - RNA, 22 nt, Human
guaucuugcaguaucggcacug

SEQ ID NO: 1149130 - RNA, 22 nt, Human
guaugaaagauggcugugccuc

SEQ ID NO: 1149131 - RNA, 23 nt, Human
guaugaaagauggcugugccucu

SEQ ID NO: 1149132 - RNA, 18 nt, Human
guaugaauaaagacaccu

SEQ ID NO: 1149133 - RNA, 19 nt, Human
guaugaauaaagacaccua

SEQ ID NO: 1149134 - RNA, 13 nt, Human
guaugaucaaaug

SEQ ID NO: 1149135 - RNA, 14 nt, Human
guaugaucaaaugu

SEQ ID NO: 1149136 - RNA, 15 nt, Human
guaugaucaaauguu

SEQ ID NO: 1149137 - RNA, 16 nt, Human
guaugaucaaauguuu

SEQ ID NO: 1149138 - RNA, 17 nt, Human
guaugaucaaauguuua

SEQ ID NO: 1149139 - RNA, 22 nt, Human
guaugaucaaauguuuaaucau

SEQ ID NO: 1149140 - RNA, 17 nt, Human
guauguugaagccuuug

SEQ ID NO: 1149141 - RNA, 21 nt, Human
gucaagggcagcuuugcucau

SEQ ID NO: 1149142 - RNA, 22 nt, Human
gucagaugcugugcaaauguua

SEQ ID NO: 1149143 - RNA, 15 nt, Human
gucagauucuugcau

SEQ ID NO: 1149144 - RNA, 17 nt, Human
gucagauucuugcaucc

SEQ ID NO: 1149145 - RNA, 16 nt, Human
gucagauucuugcauc

SEQ ID NO: 1149146 - RNA, 15 nt, Human
gucccaggcugagcc

SEQ ID NO: 1149147 - RNA, 16 nt, Human
gucccaggcugagccu

SEQ ID NO: 1149148 - RNA, 17 nt, Human
gucccaggcugagccuc

SEQ ID NO: 1149149 - RNA, 18 nt, Human
gucccaggcugagccuca

SEQ ID NO: 1149150 - RNA, 19 nt, Human
gucccaggcugagccucag

SEQ ID NO: 1149151 - RNA, 21 nt, Human
gucccaggcugagccucaguc

SEQ ID NO: 1149152 - RNA, 21 nt, Human
gucccuaccgagucucuucuc

SEQ ID NO: 1149153 - RNA, 22 nt, Human
gucccuaccgagucucuucucc

SEQ ID NO: 1149154 - RNA, 23 nt, Human
gucccuaccgagucucuucucca

SEQ ID NO: 1149155 - RNA, 18 nt, Human
gucgucaaagcugaaaug

SEQ ID NO: 1149156 - RNA, 16 nt, Human
gucucacugagcacug

SEQ ID NO: 1149157 - RNA, 22 nt, Human
gucucacugagcacuguuuucu

SEQ ID NO: 1149158 - RNA, 13 nt, Human
gucucugagcauu

SEQ ID NO: 1149159 - RNA, 16 nt, Human
gucucugguuccuccc

SEQ ID NO: 1149160 - RNA, 17 nt, Human
gucucugguuccucccc

SEQ ID NO: 1149161 - RNA, 18 nt, Human
gucucuucuccacuggau

SEQ ID NO: 1149162 - RNA, 20 nt, Human
gucuguuuuaaaaaccuguu

SEQ ID NO: 1149163 - RNA, 14 nt, Human
gugagcuacaaaug

SEQ ID NO: 1149164 - RNA, 14 nt, Human
gugauccacucgcc

SEQ ID NO: 1149165 - RNA, 23 nt, Human
gugauuuuuuuuuuuuuccuguc

SEQ ID NO: 1149166 - RNA, 16 nt, Human
gugcaguuauuugcuu

SEQ ID NO: 1149167 - RNA, 13 nt, Human
gugcaucucagcc

SEQ ID NO: 1149168 - RNA, 14 nt, Human
gugcaucucagccc

SEQ ID NO: 1149169 - RNA, 20 nt, Human
gugcccaagaauagaugcug

SEQ ID NO: 1149170 - RNA, 23 nt, Human
gugcccaagaauagaugcugacu

SEQ ID NO: 1149171 - RNA, 15 nt, Human
gugccuucagcucua

SEQ ID NO: 1149172 - RNA, 13 nt, Human
guggcuccucccg

SEQ ID NO: 1149173 - RNA, 20 nt, Human
guggcuccucccggugccca

SEQ ID NO: 1149174 - RNA, 18 nt, Human
guggcuucccgcucagcc

SEQ ID NO: 1149175 - RNA, 19 nt, Human
guggcuucccgcucagccc

SEQ ID NO: 1149176 - RNA, 20 nt, Human
guggcuucccgcucagcccu

SEQ ID NO: 1149177 - RNA, 19 nt, Human
gugggccuucagggaguga

SEQ ID NO: 1149178 - RNA, 18 nt, Human
gugggcgugagaccugcc

SEQ ID NO: 1149179 - RNA, 21 nt, Human
gugggcgugagaccugccccu

SEQ ID NO: 1149180 - RNA, 22 nt, Human
gugggcgugagaccugccccuc

SEQ ID NO: 1149181 - RNA, 13 nt, Human
guggggaggggcu

SEQ ID NO: 1149182 - RNA, 17 nt, Human
guggguuuuuauuuccu

SEQ ID NO: 1149183 - RNA, 14 nt, Human
gugguaucuugcag

SEQ ID NO: 1149184 - RNA, 23 nt, Human
guggugaaaagcagguugauaaa

SEQ ID NO: 1149185 - RNA, 16 nt, Human
guguaaugaauaccuu

SEQ ID NO: 1149186 - RNA, 15 nt, Human
guguaucaaaaugcu

SEQ ID NO: 1149187 - RNA, 15 nt, Human
guguguuucugaucu

SEQ ID NO: 1149188 - RNA, 18 nt, Human
guuaacugagugccuuuu

SEQ ID NO: 1149189 - RNA, 21 nt, Human
guuacuccaaaacuucguuua

SEQ ID NO: 1149190 - RNA, 11 nt, Human
guuaucauguu

SEQ ID NO: 1149191 - RNA, 12 nt, Human
guuaucauguua

SEQ ID NO: 1149192 - RNA, 23 nt, Human
guuaucauguuaguaauaccucu

SEQ ID NO: 1149193 - RNA, 22 nt, Human
guuaucauguuaguaauaccuc

SEQ ID NO: 1149194 - RNA, 17 nt, Human
guuaucuguuugagaaa

SEQ ID NO: 1149195 - RNA, 14 nt, Human
guuaugaugugcuu

SEQ ID NO: 1149196 - RNA, 16 nt, Human
guuaugaugugcuuaa

SEQ ID NO: 1149197 - RNA, 17 nt, Human
guuaugaugugcuuaac

SEQ ID NO: 1149198 - RNA, 22 nt, Human
guuaugaugugcuuaacaggga

SEQ ID NO: 1149199 - RNA, 17 nt, Human
guuauuauauuuacaaa

SEQ ID NO: 1149200 - RNA, 23 nt, Human
guucaagugauucucaugccuca

SEQ ID NO: 1149201 - RNA, 24 nt, Human
guucacucuacuuagcaugucccu

SEQ ID NO: 1149202 - RNA, 18 nt, Human
guucauauuaagaaugau

SEQ ID NO: 1149203 - RNA, 20 nt, Human
guuccagcaauucuccugcc

SEQ ID NO: 1149204 - RNA, 21 nt, Human
guuccagcaauucuccugccu

SEQ ID NO: 1149205 - RNA, 23 nt, Human
guuccagcaauucuccugccuca

SEQ ID NO: 1149206 - RNA, 23 nt, Human
guuccuccccuccuccuggacuc

SEQ ID NO: 1149207 - RNA, 15 nt, Human
guuccugugcacagc

SEQ ID NO: 1149208 - RNA, 16 nt, Human
guuccugugcacagcc

SEQ ID NO: 1149209 - RNA, 17 nt, Human
guuccuuccucugagcc

SEQ ID NO: 1149210 - RNA, 18 nt, Human
guuccuuccucugagccu

SEQ ID NO: 1149211 - RNA, 19 nt, Human
guuccuuccucugagccuu

SEQ ID NO: 1149212 - RNA, 15 nt, Human
guucugcacacagca

SEQ ID NO: 1149213 - RNA, 16 nt, Human
guucugcacacagcac

SEQ ID NO: 1149214 - RNA, 14 nt, Human
guucuuucuuccuc

SEQ ID NO: 1149215 - RNA, 15 nt, Human
guucuuucuuccucu

SEQ ID NO: 1149216 - RNA, 16 nt, Human
guucuuucuuccucug

SEQ ID NO: 1149217 - RNA, 17 nt, Human
guucuuucuuccucugc

SEQ ID NO: 1149218 - RNA, 18 nt, Human
guucuuucuuccucugcu

SEQ ID NO: 1149219 - RNA, 19 nt, Human
guucuuucuuccucugcug

SEQ ID NO: 1149220 - RNA, 13 nt, Human
guugaagccuuug

SEQ ID NO: 1149221 - RNA, 14 nt, Human
guugaagccuuugu

SEQ ID NO: 1149222 - RNA, 10 nt, Human
guugcacagc

SEQ ID NO: 1149223 - RNA, 11 nt, Human
guugcacagca

SEQ ID NO: 1149224 - RNA, 16 nt, Human
guugcacagcaucuca

SEQ ID NO: 1149225 - RNA, 19 nt, Human
guugcacagcaucucagcu

SEQ ID NO: 1149226 - RNA, 14 nt, Human
guuggccaggcugc

SEQ ID NO: 1149227 - RNA, 14 nt, Human
guuggccaggcugg

SEQ ID NO: 1149228 - RNA, 15 nt, Human
guuggccaggcuggu

SEQ ID NO: 1149229 - RNA, 19 nt, Human
guuggccaggcugcucuug

SEQ ID NO: 1149230 - RNA, 18 nt, Human
guuggccaggcuggucuc

SEQ ID NO: 1149231 - RNA, 15 nt, Human
guuggcuagauuaac

SEQ ID NO: 1149232 - RNA, 19 nt, Human
guugucugaagucacugca

SEQ ID NO: 1149233 - RNA, 22 nt, Human
guugucugaagucacugcacag

SEQ ID NO: 1149234 - RNA, 14 nt, Human
guuguuaucuguuu

SEQ ID NO: 1149235 - RNA, 17 nt, Human
guuguuaucuguuugag

SEQ ID NO: 1149236 - RNA, 13 nt, Human
guuguuaugaugu

SEQ ID NO: 1149237 - RNA, 14 nt, Human
guuguuaugaugug

SEQ ID NO: 1149238 - RNA, 23 nt, Human
guuguuaugaugugcuuaacagg

SEQ ID NO: 1149239 - RNA, 15 nt, Human
guuguuaugaugugc

SEQ ID NO: 1149240 - RNA, 22 nt, Human
guuuacauuuuauggugccuag

SEQ ID NO: 1149241 - RNA, 15 nt, Human
guuuacauuuuaugg

SEQ ID NO: 1149242 - RNA, 18 nt, Human
guuuguuccccaagacau

SEQ ID NO: 1149243 - RNA, 17 nt, Human
guuuuaaaaaccuguuc

SEQ ID NO: 1149244 - RNA, 17 nt, Human
guuuuccucucaauaaa

SEQ ID NO: 1149245 - RNA, 21 nt, Human
guuuuuaaggguuuguggaaa

SEQ ID NO: 1149246 - RNA, 18 nt, Human
uaaaacaaacaauaccug

SEQ ID NO: 1149247 - RNA, 14 nt, Human
uaaaacaaagccac

SEQ ID NO: 1149248 - RNA, 22 nt, Human
uaaaacaaagccacuuucaauc

SEQ ID NO: 1149249 - RNA, 22 nt, Human
uaaaacaagcacuaaacaaaga

SEQ ID NO: 1149250 - RNA, 19 nt, Human
uaaaacacuuccauaaucu

SEQ ID NO: 1149251 - RNA, 16 nt, Human
uaaaaucuugaaaaug

SEQ ID NO: 1149252 - RNA, 22 nt, Human
uaaacaugacuccauagaccuu

SEQ ID NO: 1149253 - RNA, 18 nt, Human
uaaacaugacuccauaga

SEQ ID NO: 1149254 - RNA, 14 nt, Human
uaaaggaauuuaaa

SEQ ID NO: 1149255 - RNA, 14 nt, Human
uaaaguguuugaaa

SEQ ID NO: 1149256 - RNA, 15 nt, Human
uaaauguccauucuu

SEQ ID NO: 1149257 - RNA, 15 nt, Human
uaaaugucucacuga

SEQ ID NO: 1149258 - RNA, 17 nt, Human
uaaaugucucacugagc

SEQ ID NO: 1149259 - RNA, 11 nt, Human
uaacugacaag

SEQ ID NO: 1149260 - RNA, 21 nt, Human
uaacugacaagcuccauuuaa

SEQ ID NO: 1149261 - RNA, 22 nt, Human
uaacugacaagcuccauuuaaa

SEQ ID NO: 1149262 - RNA, 19 nt, Human
uaagggaaguaguuaucau

SEQ ID NO: 1149263 - RNA, 22 nt, Human
uaagggaaguaguuaucauguu

SEQ ID NO: 1149264 - RNA, 16 nt, Human
uaagucaacuuagcau

SEQ ID NO: 1149265 - RNA, 15 nt, Human
uaaguggugugugua

SEQ ID NO: 1149266 - RNA, 16 nt, Human
uaagugguguguguau

SEQ ID NO: 1149267 - RNA, 15 nt, Human
uaaucuggacuccuc

SEQ ID NO: 1149268 - RNA, 17 nt, Human
uaaucuggacuccucug

SEQ ID NO: 1149269 - RNA, 18 nt, Human
uaaucuggacuccucugu

SEQ ID NO: 1149270 - RNA, 19 nt, Human
uaaucuggacuccucuguc

SEQ ID NO: 1149271 - RNA, 20 nt, Human
uaaucuggacuccucugucc

SEQ ID NO: 1149272 - RNA, 21 nt, Human
uaaucuggacuccucugucca

SEQ ID NO: 1149273 - RNA, 22 nt, Human
uaaucuggacuccucuguccag

SEQ ID NO: 1149274 - RNA, 18 nt, Human
uaaucugggccagaauuu

SEQ ID NO: 1149275 - RNA, 23 nt, Human
uaaucugggccagaauuucaaac

SEQ ID NO: 1149276 - RNA, 14 nt, Human
uaauguuugcauau

SEQ ID NO: 1149277 - RNA, 15 nt, Human
uaauguuugcauaua

SEQ ID NO: 1149278 - RNA, 16 nt, Human
uaauguuugcauauaa

SEQ ID NO: 1149279 - RNA, 16 nt, Human
uacagcuaaucagcau

SEQ ID NO: 1149280 - RNA, 18 nt, Human
uacagcuaaucagcauuc

SEQ ID NO: 1149281 - RNA, 15 nt, Human
uacagcugagcuaug

SEQ ID NO: 1149282 - RNA, 13 nt, Human
uacagcugccugc

SEQ ID NO: 1149283 - RNA, 14 nt, Human
uacagcugccugca

SEQ ID NO: 1149284 - RNA, 14 nt, Human
uacaggauuugaaa

SEQ ID NO: 1149285 - RNA, 23 nt, Human
uacaguucggugagcuacaaaug

SEQ ID NO: 1149286 - RNA, 17 nt, Human
uaccgagucucuucucc

SEQ ID NO: 1149287 - RNA, 18 nt, Human
uaccgagucucuucucca

SEQ ID NO: 1149288 - RNA, 21 nt, Human
uaccgagucucuucuccacug

SEQ ID NO: 1149289 - RNA, 22 nt, Human
uaccgagucucuucuccacugg

SEQ ID NO: 1149290 - RNA, 17 nt, Human
uaccgcguaaugcgcca

SEQ ID NO: 1149291 - RNA, 21 nt, Human
uaccgcguaaugcgccaauaa

SEQ ID NO: 1149292 - RNA, 23 nt, Human
uaccgcguaaugcgccaauaaac

SEQ ID NO: 1149293 - RNA, 18 nt, Human
uaccucaauuuucacugu

SEQ ID NO: 1149294 - RNA, 20 nt, Human
uaccucaauuuucacugugu

SEQ ID NO: 1149295 - RNA, 21 nt, Human
uaccucaauuuucacuguguc

SEQ ID NO: 1149296 - RNA, 16 nt, Human
uaccucuaauaguaua

SEQ ID NO: 1149297 - RNA, 17 nt, Human
uaccucuaauaguauaa

SEQ ID NO: 1149298 - RNA, 18 nt, Human
uaccucuaauaguauaaa

SEQ ID NO: 1149299 - RNA, 19 nt, Human
uaccucuaauaguauaaac

SEQ ID NO: 1149300 - RNA, 14 nt, Human
uaccuuagugcagu

SEQ ID NO: 1149301 - RNA, 16 nt, Human
uaccuuagugcaguua

SEQ ID NO: 1149302 - RNA, 17 nt, Human
uaccuuagugcaguuau

SEQ ID NO: 1149303 - RNA, 18 nt, Human
uaccuuagugcaguuauu

SEQ ID NO: 1149304 - RNA, 19 nt, Human
uaccuuagugcaguuauuu

SEQ ID NO: 1149305 - RNA, 20 nt, Human
uaccuuagugcaguuauuug

SEQ ID NO: 1149306 - RNA, 22 nt, Human
uaccuuagugcaguuauuugcu

SEQ ID NO: 1149307 - RNA, 19 nt, Human
uacuccaaaacuucguuua

SEQ ID NO: 1149308 - RNA, 22 nt, Human
uacuccaaaacuucguuuaaug

SEQ ID NO: 1149309 - RNA, 12 nt, Human
uacuccucccag

SEQ ID NO: 1149310 - RNA, 16 nt, Human
uacugcauuauuugag

SEQ ID NO: 1149311 - RNA, 19 nt, Human
uacugcccaggccugccug

SEQ ID NO: 1149312 - RNA, 20 nt, Human
uacugcccaggccugccugu

SEQ ID NO: 1149313 - RNA, 21 nt, Human
uacugcccaggccugccuguu

SEQ ID NO: 1149314 - RNA, 22 nt, Human
uacugcccaggccugccuguuc

SEQ ID NO: 1149315 - RNA, 13 nt, Human
uacuugucuguuu

SEQ ID NO: 1149316 - RNA, 14 nt, Human
uacuugucuguuuu

SEQ ID NO: 1149317 - RNA, 15 nt, Human
uacuugucuguuuua

SEQ ID NO: 1149318 - RNA, 20 nt, Human
uacuugucuguuuuaaaaac

SEQ ID NO: 1149319 - RNA, 14 nt, Human
uagaauguaaaugu

SEQ ID NO: 1149320 - RNA, 15 nt, Human
uagaauguaaauguc

SEQ ID NO: 1149321 - RNA, 16 nt, Human
uagaauguaaaugucu

SEQ ID NO: 1149322 - RNA, 18 nt, Human
uagaauguaaaugucuca

SEQ ID NO: 1149323 - RNA, 17 nt, Human
uagaauguaaaugucuc

SEQ ID NO: 1149324 - RNA, 20 nt, Human
uagacccacuggacucaccu

SEQ ID NO: 1149325 - RNA, 17 nt, Human
uagaccuuuucauuugu

SEQ ID NO: 1149326 - RNA, 13 nt, Human
uagagaaggaccc

SEQ ID NO: 1149327 - RNA, 22 nt, Human
uagagaaggacccggaggggcc

SEQ ID NO: 1149328 - RNA, 15 nt, Human
uagccaguaauccug

SEQ ID NO: 1149329 - RNA, 16 nt, Human
uagccaguaauccugu

SEQ ID NO: 1149330 - RNA, 17 nt, Human
uagccaguaauccugua

SEQ ID NO: 1149331 - RNA, 18 nt, Human
uagccaguaauccuguag

SEQ ID NO: 1149332 - RNA, 22 nt, Human
uagccaguaauccuguaggaag

SEQ ID NO: 1149333 - RNA, 18 nt, Human
uagcugacaaaauacuug

SEQ ID NO: 1149334 - RNA, 20 nt, Human
uagguuauuaugauuagcuu

SEQ ID NO: 1149335 - RNA, 22 nt, Human
uagguuauuaugauuagcuuug

SEQ ID NO: 1149336 - RNA, 13 nt, Human
uaguauugacaaa

SEQ ID NO: 1149337 - RNA, 14 nt, Human
uaguauugacaaaa

SEQ ID NO: 1149338 - RNA, 17 nt, Human
uaguauugacaaaaugu

SEQ ID NO: 1149339 - RNA, 18 nt, Human
uaguauugacaaaauguu

SEQ ID NO: 1149340 - RNA, 19 nt, Human
uaguauugacaaaauguua

SEQ ID NO: 1149341 - RNA, 21 nt, Human
uaguauugacaaaauguuauu

SEQ ID NO: 1149342 - RNA, 22 nt, Human
uaguauugacaaaauguuauuu

SEQ ID NO: 1149343 - RNA, 16 nt, Human
uaguauugcaaaguca

SEQ ID NO: 1149344 - RNA, 17 nt, Human
uaguuguuguagagaaa

SEQ ID NO: 1149345 - RNA, 14 nt, Human
uauaaauagaaugu

SEQ ID NO: 1149346 - RNA, 16 nt, Human
uauaaauagaauguaa

SEQ ID NO: 1149347 - RNA, 19 nt, Human
uauaaauagaauguaaaug

SEQ ID NO: 1149348 - RNA, 20 nt, Human
uauaaauagaauguaaaugu

SEQ ID NO: 1149349 - RNA, 22 nt, Human
uauaaauagaauguaaaugucu

SEQ ID NO: 1149350 - RNA, 14 nt, Human
uauauuuugccugu

SEQ ID NO: 1149351 - RNA, 14 nt, Human
uaucaaaaugcucu

SEQ ID NO: 1149352 - RNA, 22 nt, Human
uaucaaaaugcucuuauuucau

SEQ ID NO: 1149353 - RNA, 16 nt, Human
uaucauguuaguaaua

SEQ ID NO: 1149354 - RNA, 19 nt, Human
uaucauguuaguaauaccu

SEQ ID NO: 1149355 - RNA, 21 nt, Human
uaucauguuaguaauaccucu

SEQ ID NO: 1149356 - RNA, 20 nt, Human
uaucauguuaguaauaccuc

SEQ ID NO: 1149357 - RNA, 18 nt, Human
ucaguccccgugaaggag

SEQ ID NO: 1149358 - RNA, 16 nt, Human
ucaguuaagccuuugg

SEQ ID NO: 1149359 - RNA, 17 nt, Human
ucaguuaagccuuugga

SEQ ID NO: 1149360 - RNA, 19 nt, Human
ucauguacugcauuauuug

SEQ ID NO: 1149361 - RNA, 16 nt, Human
ucauguacugcauuau

SEQ ID NO: 1149362 - RNA, 21 nt, Human
uccacuuagaaauugcauuuc

SEQ ID NO: 1149363 - RNA, 23 nt, Human
uccacuuagaaauugcauuuccu

SEQ ID NO: 1149364 - RNA, 22 nt, Human
uccagagaguggcuccucccgg

SEQ ID NO: 1149365 - RNA, 22 nt, Human
uccagauuuuuuacagcugccu

SEQ ID NO: 1149366 - RNA, 18 nt, Human
uccagcaauucuccugcc

SEQ ID NO: 1149367 - RNA, 19 nt, Human
uccagcaauucuccugccu

SEQ ID NO: 1149368 - RNA, 20 nt, Human
uccagcaauucuccugccuc

SEQ ID NO: 1149369 - RNA, 21 nt, Human
uccagcaauucuccugccuca

SEQ ID NO: 1149370 - RNA, 15 nt, Human
uccagcuggccggga

SEQ ID NO: 1149371 - RNA, 21 nt, Human
uccagcuggccgggagccuga

SEQ ID NO: 1149372 - RNA, 22 nt, Human
uccagcuggccgggagccugau

SEQ ID NO: 1149373 - RNA, 19 nt, Human
uccagcuggguuggaaaac

SEQ ID NO: 1149374 - RNA, 23 nt, Human
uccauaaucuggacuccucuguc

SEQ ID NO: 1149375 - RNA, 16 nt, Human
uccauauggauccacu

SEQ ID NO: 1149376 - RNA, 21 nt, Human
uccauauggauccacuggcug

SEQ ID NO: 1149377 - RNA, 19 nt, Human
uccauauggauccacuggc

SEQ ID NO: 1149378 - RNA, 16 nt, Human
uccaugucgccucugc

SEQ ID NO: 1149379 - RNA, 17 nt, Human
uccaugucgccucugca

SEQ ID NO: 1149380 - RNA, 18 nt, Human
uccaugucgccucugcau

SEQ ID NO: 1149381 - RNA, 19 nt, Human
uccaugucgccucugcauu

SEQ ID NO: 1149382 - RNA, 14 nt, Human
ucccaacuuguaaa

SEQ ID NO: 1149383 - RNA, 19 nt, Human
ucccaggcugagccucagu

SEQ ID NO: 1149384 - RNA, 13 nt, Human
ucccaugauuuca

SEQ ID NO: 1149385 - RNA, 14 nt, Human
ucccaugauuucau

SEQ ID NO: 1149386 - RNA, 16 nt, Human
ucccaugauuucaugu

SEQ ID NO: 1149387 - RNA, 19 nt, Human
ucccaugauuucauguacu

SEQ ID NO: 1149388 - RNA, 22 nt, Human
ucccaugauuucauguacugca

SEQ ID NO: 1149389 - RNA, 12 nt, Human
ucccaugcccug

SEQ ID NO: 1149390 - RNA, 19 nt, Human
ucccuaccgagucucuucu

SEQ ID NO: 1149391 - RNA, 21 nt, Human
ucccuaccgagucucuucucc

SEQ ID NO: 1149392 - RNA, 22 nt, Human
ucccuaccgagucucuucucca

SEQ ID NO: 1149393 - RNA, 23 nt, Human
ucccuaccgagucucuucuccac

SEQ ID NO: 1149394 - RNA, 13 nt, Human
ucccucccuuggg

SEQ ID NO: 1149395 - RNA, 14 nt, Human
ucccucccuugggg

SEQ ID NO: 1149396 - RNA, 16 nt, Human
ucccugccccccagcc

SEQ ID NO: 1149397 - RNA, 14 nt, Human
ucccugccccuccc

SEQ ID NO: 1149398 - RNA, 18 nt, Human
ucccugccccucccuuca

SEQ ID NO: 1149399 - RNA, 19 nt, Human
ucccugccccucccuucaa

SEQ ID NO: 1149400 - RNA, 17 nt, Human
ucccuucuuuuucuucu

SEQ ID NO: 1149401 - RNA, 12 nt, Human
uccuaugaugua

SEQ ID NO: 1149402 - RNA, 15 nt, Human
uccuaugauguauac

SEQ ID NO: 1149403 - RNA, 22 nt, Human
uccuaugauguauacugccacu

SEQ ID NO: 1149404 - RNA, 16 nt, Human
uccuaugauguauacu

SEQ ID NO: 1149405 - RNA, 13 nt, Human
uccuccuggacuc

SEQ ID NO: 1149406 - RNA, 13 nt, Human
uccucucaauaaa

SEQ ID NO: 1149407 - RNA, 17 nt, Human
uccucuguccaggcacu

SEQ ID NO: 1149408 - RNA, 22 nt, Human
uccucuguccaggcacugcugc

SEQ ID NO: 1149409 - RNA, 14 nt, Human
uccuuaucaaagga

SEQ ID NO: 1149410 - RNA, 15 nt, Human
uccuuaucaaaggac

SEQ ID NO: 1149411 - RNA, 17 nt, Human
uccuuaucaaaggacac

SEQ ID NO: 1149412 - RNA, 23 nt, Human
uccuugcugaaacgcaucuaguu

SEQ ID NO: 1149413 - RNA, 14 nt, Human
uccuuugugaaaaa

SEQ ID NO: 1149414 - RNA, 14 nt, Human
ucuacuauuuaugu

SEQ ID NO: 1149415 - RNA, 17 nt, Human
ucuagguuuaugacagu

SEQ ID NO: 1149416 - RNA, 22 nt, Human
ucuaucuuugagcgcccacuag

SEQ ID NO: 1149417 - RNA, 11 nt, Human
ucucacugagc

SEQ ID NO: 1149418 - RNA, 16 nt, Human
ucucacugagcacugu

SEQ ID NO: 1149419 - RNA, 18 nt, Human
ucucacugagcacuguuu

SEQ ID NO: 1149420 - RNA, 17 nt, Human
ucucacugagcacuguu

SEQ ID NO: 1149421 - RNA, 18 nt, Human
ucugcacuauaugcaaac

SEQ ID NO: 1149422 - RNA, 15 nt, Human
ucugccuccucuuca

SEQ ID NO: 1149423 - RNA, 15 nt, Human
ucugccucucuugua

SEQ ID NO: 1149424 - RNA, 13 nt, Human
ucugcugaaggaa

SEQ ID NO: 1149425 - RNA, 15 nt, Human
ucuggacuccucugu

SEQ ID NO: 1149426 - RNA, 16 nt, Human
ucuggacuccucuguc

SEQ ID NO: 1149427 - RNA, 18 nt, Human
ucuggacuccucugucca

SEQ ID NO: 1149428 - RNA, 22 nt, Human
ucuggacuccucuguccaggca

SEQ ID NO: 1149429 - RNA, 14 nt, Human
ucuuauaauuuaaa

SEQ ID NO: 1149430 - RNA, 20 nt, Human
ucuucaguuaagccuuugga

SEQ ID NO: 1149431 - RNA, 22 nt, Human
ucuucaguuaagccuuuggaaa

SEQ ID NO: 1149432 - RNA, 17 nt, Human
ucuucauggugacacuc

SEQ ID NO: 1149433 - RNA, 16 nt, Human
ucuucauggugacacu

SEQ ID NO: 1149434 - RNA, 22 nt, Human
ucuucgacuguuguuaucuguu

SEQ ID NO: 1149435 - RNA, 14 nt, Human
ucuucgacuguugu

SEQ ID NO: 1149436 - RNA, 15 nt, Human
ucuucgacuguuguu

SEQ ID NO: 1149437 - RNA, 17 nt, Human
ucuucgacuguuguuau

SEQ ID NO: 1149438 - RNA, 19 nt, Human
ucuugccaaauauaaauaa

SEQ ID NO: 1149439 - RNA, 23 nt, Human
ucuugcauggcaaggacugcagg

SEQ ID NO: 1149440 - RNA, 16 nt, Human
ucuugccacugccucu

SEQ ID NO: 1149441 - RNA, 17 nt, Human
ucuugccacugccucuu

SEQ ID NO: 1149442 - RNA, 16 nt, Human
ucuuguaauuuggauc

SEQ ID NO: 1149443 - RNA, 21 nt, Human
ucuuuuuacccauuuguucau

SEQ ID NO: 1149444 - RNA, 20 nt, Human
ugaaaauuaggauuucauga

SEQ ID NO: 1149445 - RNA, 19 nt, Human
ugaagaccuuuuucugcac

SEQ ID NO: 1149446 - RNA, 21 nt, Human
ugaagaccuuuuucugcacua

SEQ ID NO: 1149447 - RNA, 22 nt, Human
ugaagaccuuuuucugcacuau

SEQ ID NO: 1149448 - RNA, 23 nt, Human
ugaagaccuuuuucugcacuaua

SEQ ID NO: 1149449 - RNA, 16 nt, Human
ugaaucuuggugucua

SEQ ID NO: 1149450 - RNA, 14 nt, Human
ugaaugcauaaaau

SEQ ID NO: 1149451 - RNA, 15 nt, Human
ugacaacagacuucu

SEQ ID NO: 1149452 - RNA, 18 nt, Human
ugacaacagacuucugaa

SEQ ID NO: 1149453 - RNA, 19 nt, Human
ugacaacagacuucugaaa

SEQ ID NO: 1149454 - RNA, 15 nt, Human
ugacauauuuuugcu

SEQ ID NO: 1149455 - RNA, 19 nt, Human
ugacauguguuggcagccu

SEQ ID NO: 1149456 - RNA, 21 nt, Human
ugaccagccuccaugcugccu

SEQ ID NO: 1149457 - RNA, 22 nt, Human
ugaccagccuccaugcugccuc

SEQ ID NO: 1149458 - RNA, 23 nt, Human
ugaccagccuccaugcugccucc

SEQ ID NO: 1149459 - RNA, 15 nt, Human
ugacuaaaccauugu

SEQ ID NO: 1149460 - RNA, 19 nt, Human
ugacuaaaccauugugcau

SEQ ID NO: 1149461 - RNA, 20 nt, Human
ugagaaagucagauucuugc

SEQ ID NO: 1149462 - RNA, 21 nt, Human
ugagaaagucagauucuugca

SEQ ID NO: 1149463 - RNA, 12 nt, Human
ugagaccugccc

SEQ ID NO: 1149464 - RNA, 13 nt, Human
ugagaccugcccc

SEQ ID NO: 1149465 - RNA, 14 nt, Human
ugagaccugccccu

SEQ ID NO: 1149466 - RNA, 15 nt, Human
ugagaccugccccuc

SEQ ID NO: 1149467 - RNA, 22 nt, Human
ugagaccugccccuccucucug

SEQ ID NO: 1149468 - RNA, 11 nt, Human
ugagcucagcc

SEQ ID NO: 1149469 - RNA, 12 nt, Human
ugagcucagccc

SEQ ID NO: 1149470 - RNA, 20 nt, Human
ugagcucagcccuggugggc

SEQ ID NO: 1149471 - RNA, 23 nt, Human
ugagcuuaagaauuuugagcagg

SEQ ID NO: 1149472 - RNA, 20 nt, Human
ugagucccaggcugagccuc

SEQ ID NO: 1149473 - RNA, 21 nt, Human
ugagucccaggcugagccuca

SEQ ID NO: 1149474 - RNA, 21 nt, Human
ugcagagcaggaaacaugacu

SEQ ID NO: 1149475 - RNA, 21 nt, Human
ugcauauaagggaaguaguua

SEQ ID NO: 1149476 - RNA, 22 nt, Human
ugcauauaagggaaguaguuau

SEQ ID NO: 1149477 - RNA, 23 nt, Human
ugcauauaagggaaguaguuauc

SEQ ID NO: 1149478 - RNA, 17 nt, Human
ugccaaauauaaauaaa

SEQ ID NO: 1149479 - RNA, 18 nt, Human
ugccaaauauaaauaaaa

SEQ ID NO: 1149480 - RNA, 19 nt, Human
ugccaaauauaaauaaaaa

SEQ ID NO: 1149481 - RNA, 22 nt, Human
ugccaaauauaaauaaaaauaa

SEQ ID NO: 1149482 - RNA, 19 nt, Human
ugccacuaaccuuccaaaa

SEQ ID NO: 1149483 - RNA, 15 nt, Human
ugccccagggcuccc

SEQ ID NO: 1149484 - RNA, 13 nt, Human
ugccccucccuuc

SEQ ID NO: 1149485 - RNA, 14 nt, Human
ugccugugaacuga

SEQ ID NO: 1149486 - RNA, 17 nt, Human
ugccugugaacugaacu

SEQ ID NO: 1149487 - RNA, 18 nt, Human
ugccugugaacugaacuc

SEQ ID NO: 1149488 - RNA, 21 nt, Human
ugccugugaacugaacucuga

SEQ ID NO: 1149489 - RNA, 17 nt, Human
ugcuaacaugaagaccu

SEQ ID NO: 1149490 - RNA, 16 nt, Human
ugcucuccucuugcca

SEQ ID NO: 1149491 - RNA, 18 nt, Human
ugcucuccucuugccacu

SEQ ID NO: 1149492 - RNA, 21 nt, Human
ugcucuccucuugccacugcc

SEQ ID NO: 1149493 - RNA, 22 nt, Human
ugcucuccucuugccacugccu

SEQ ID NO: 1149494 - RNA, 20 nt, Human
ugcugaaacgcaucuaguuc

SEQ ID NO: 1149495 - RNA, 23 nt, Human
ugcugaaggaauaaauugcuccu

SEQ ID NO: 1149496 - RNA, 13 nt, Human
uggaaacaagaug

SEQ ID NO: 1149497 - RNA, 17 nt, Human
uggaaacagcucgacuu

SEQ ID NO: 1149498 - RNA, 22 nt, Human
uggaaacagcucgacuuuaaaa

SEQ ID NO: 1149499 - RNA, 22 nt, Human
uggaauaauccuaaacauauga

SEQ ID NO: 1149500 - RNA, 18 nt, Human
uggacucaccucccccau

SEQ ID NO: 1149501 - RNA, 20 nt, Human
uggacucaccucccccaucu

SEQ ID NO: 1149502 - RNA, 15 nt, Human
uggacuccucugucc

SEQ ID NO: 1149503 - RNA, 15 nt, Human
uggacuccugcacac

SEQ ID NO: 1149504 - RNA, 21 nt, Human
uggauccacuggcuggacaaa

SEQ ID NO: 1149505 - RNA, 19 nt, Human
uggcaggaguuggaagugu

SEQ ID NO: 1149506 - RNA, 17 nt, Human
uggccacuccagacccc

SEQ ID NO: 1149507 - RNA, 20 nt, Human
uggccacuccagaccccugg

SEQ ID NO: 1149508 - RNA, 14 nt, Human
uggcuggacaaacu

SEQ ID NO: 1149509 - RNA, 21 nt, Human
uggcuugaguuuaaauuguaa

SEQ ID NO: 1149510 - RNA, 12 nt, Human
ugggacaauuag

SEQ ID NO: 1149511 - RNA, 22 nt, Human
ugggacaauuagauaaaugucc

SEQ ID NO: 1149512 - RNA, 17 nt, Human
ugggauuacagguguga

SEQ ID NO: 1149513 - RNA, 14 nt, Human
uggguuaguggaug

SEQ ID NO: 1149514 - RNA, 16 nt, Human
uguacaaggacagccc

SEQ ID NO: 1149515 - RNA, 20 nt, Human
uguacaaggacagccccucc

SEQ ID NO: 1149516 - RNA, 23 nt, Human
uguacaaggacagccccuccucc

SEQ ID NO: 1149517 - RNA, 13 nt, Human
uguaugaucaaau

SEQ ID NO: 1149518 - RNA, 14 nt, Human
uguaugaucaaaug

SEQ ID NO: 1149519 - RNA, 15 nt, Human
uguaugaucaaaugu

SEQ ID NO: 1149520 - RNA, 16 nt, Human
uguaugaucaaauguu

SEQ ID NO: 1149521 - RNA, 18 nt, Human
uguaugaucaaauguuua

SEQ ID NO: 1149522 - RNA, 19 nt, Human
uguaugaucaaauguuuaa

SEQ ID NO: 1149523 - RNA, 20 nt, Human
uguaugaucaaauguuuaau

SEQ ID NO: 1149524 - RNA, 23 nt, Human
uguaugaucaaauguuuaaucau

SEQ ID NO: 1149525 - RNA, 20 nt, Human
uguauuuauuuaguauuuau

SEQ ID NO: 1149526 - RNA, 14 nt, Human
uguccaucagauga

SEQ ID NO: 1149527 - RNA, 16 nt, Human
uguccaucagaugaca

SEQ ID NO: 1149528 - RNA, 17 nt, Human
uguccaucagaugacaa

SEQ ID NO: 1149529 - RNA, 18 nt, Human
uguccaucagaugacaag

SEQ ID NO: 1149530 - RNA, 16 nt, Human
ugucccaacuuguaaa

SEQ ID NO: 1149531 - RNA, 16 nt, Human
ugucugaagucacugc

SEQ ID NO: 1149532 - RNA, 17 nt, Human
ugucugaagucacugca

SEQ ID NO: 1149533 - RNA, 18 nt, Human
ugucugaagucacugcac

SEQ ID NO: 1149534 - RNA, 19 nt, Human
ugucugaagucacugcaca

SEQ ID NO: 1149535 - RNA, 20 nt, Human
ugucugaagucacugcacag

SEQ ID NO: 1149536 - RNA, 16 nt, Human
ugugaaaaugugugug

SEQ ID NO: 1149537 - RNA, 17 nt, Human
ugugaaaaugugugugu

SEQ ID NO: 1149538 - RNA, 14 nt, Human
ugugcuuguuaacu

SEQ ID NO: 1149539 - RNA, 10 nt, Human
uguggcucac

SEQ ID NO: 1149540 - RNA, 20 nt, Human
ugugggcgugagaccugccc

SEQ ID NO: 1149541 - RNA, 21 nt, Human
ugugggcgugagaccugcccc

SEQ ID NO: 1149542 - RNA, 22 nt, Human
ugugggcgugagaccugccccu

SEQ ID NO: 1149543 - RNA, 18 nt, Human
uguguaugcgugugugug

SEQ ID NO: 1149544 - RNA, 15 nt, Human
ugugugcuuauguau

SEQ ID NO: 1149545 - RNA, 17 nt, Human
ugugugugaaaaugugu

SEQ ID NO: 1149546 - RNA, 20 nt, Human
ugugugugcuuauguaugag

SEQ ID NO: 1149547 - RNA, 19 nt, Human
ugugugugcuuauguauga

SEQ ID NO: 1149548 - RNA, 17 nt, Human
uguuagccccauaauuu

SEQ ID NO: 1149549 - RNA, 14 nt, Human
uguuaguaauaccu

SEQ ID NO: 1149550 - RNA, 15 nt, Human
uguuaguaauaccuc

SEQ ID NO: 1149551 - RNA, 16 nt, Human
uguuaguaauaccucu

SEQ ID NO: 1149552 - RNA, 17 nt, Human
uguucauauuaagaaug

SEQ ID NO: 1149553 - RNA, 18 nt, Human
uguucauauuaagaauga

SEQ ID NO: 1149554 - RNA, 23 nt, Human
uguucauauuaagaaugaucuga

SEQ ID NO: 1149555 - RNA, 15 nt, Human
uguucugcuuuccuc

SEQ ID NO: 1149556 - RNA, 14 nt, Human
uguuggcagccucu

SEQ ID NO: 1149557 - RNA, 20 nt, Human
uguuuacauuuuauggugcc

SEQ ID NO: 1149558 - RNA, 13 nt, Human
uuaaugaaugcuu

SEQ ID NO: 1149559 - RNA, 15 nt, Human
uuaaugaaugcuuaa

SEQ ID NO: 1149560 - RNA, 17 nt, Human
uuaaugaaugcuuaaag

SEQ ID NO: 1149561 - RNA, 21 nt, Human
uuaaugaaugcuuaaagaauu

SEQ ID NO: 1149562 - RNA, 20 nt, Human
uuaaugaaugcuuaaagaau

SEQ ID NO: 1149563 - RNA, 14 nt, Human
uuacauuuuauggu

SEQ ID NO: 1149564 - RNA, 23 nt, Human
uuacauuuuauggugccuaguau

SEQ ID NO: 1149565 - RNA, 12 nt, Human
uuuccugcccug

SEQ ID NO: 1149566 - RNA, 13 nt, Human
uuuccugcccugg

SEQ ID NO: 1149567 - RNA, 23 nt, Human
uuuccugccuuuuaguuccugug

SEQ ID NO: 1149568 - RNA, 22 nt, Human
uuuccugccuuuuaguuccugu

SEQ ID NO: 1149569 - RNA, 11 nt, Human
uuucuuccucu

SEQ ID NO: 1149570 - RNA, 13 nt, Human
uuucuuccucugc

SEQ ID NO: 1149571 - RNA, 14 nt, Human
uuucuuccucugcu

SEQ ID NO: 1149572 - RNA, 16 nt, Human
uuucuuccucugcuga

SEQ ID NO: 1149573 - RNA, 18 nt, Human
uuugaaucaucaagucuu

SEQ ID NO: 1149574 - RNA, 20 nt, Human
uuuggagucagacagaugug

SEQ ID NO: 1149575 - RNA, 16 nt, Human
uuuguaugcacuuugu

SEQ ID NO: 1149576 - RNA, 16 nt, Human
uuuuggauuggacaaa

SEQ ID NO: 1149577 - RNA, 11 nt, Human
uuuuuccuguc

SEQ ID NO: 1149578 - RNA, 11 nt, Human
uuuuuccuuuu

SEQ ID NO: 1149579 - RNA, 15 nt, Human
uuuuugaagcuguau

SEQ ID NO: 1149580 - RNA, 16 nt, Human
aacgcagcccugcuuu

SEQ ID NO: 1149581 - RNA, 23 nt, Human
aacgcaucuaguuccccuguuua

SEQ ID NO: 1149582 - RNA, 22 nt, Human
aacgcaucuaguuccccuguuu

SEQ ID NO: 1149583 - RNA, 14 nt, Human
aagaacuagcauaa

SEQ ID NO: 1149584 - RNA, 21 nt, Human
aagacaaggaaaaaauaacaa

SEQ ID NO: 1149585 - RNA, 19 nt, Human
aaggcagggagggccuggg

SEQ ID NO: 1149586 - RNA, 22 nt, Human
aaggcagggagggccugggccc

SEQ ID NO: 1149587 - RNA, 10 nt, Human
aagccuuugu

SEQ ID NO: 1149588 - RNA, 19 nt, Human
aauaaaccaaugaacgaag

SEQ ID NO: 1149589 - RNA, 22 nt, Human
aaucaaugcuauaacuauguug

SEQ ID NO: 1149590 - RNA, 20 nt, Human
aaugauguauguugaagccu

SEQ ID NO: 1149591 - RNA, 12 nt, Human
aaugaauaccuu

SEQ ID NO: 1149592 - RNA, 13 nt, Human
aaugaauaccuua

SEQ ID NO: 1149593 - RNA, 20 nt, Human
aaugaauacuuuauaaagga

SEQ ID NO: 1149594 - RNA, 14 nt, Human
aacaugaagaccuu

SEQ ID NO: 1149595 - RNA, 23 nt, Human
aacaugaagaccuuuuucugcac

SEQ ID NO: 1149596 - RNA, 18 nt, Human
aacaugaagaccuuuuuc

SEQ ID NO: 1149597 - RNA, 22 nt, Human
aacaugaagaccuuuuucugca

SEQ ID NO: 1149598 - RNA, 20 nt, Human
aacaugacuccauagaccuu

SEQ ID NO: 1149599 - RNA, 19 nt, Human
aacccucagagccaccccu

SEQ ID NO: 1149600 - RNA, 16 nt, Human
aaaagaaaagucaagg

SEQ ID NO: 1149601 - RNA, 20 nt, Human
aaaagacaaggaaaaaauaa

SEQ ID NO: 1149602 - RNA, 15 nt, Human
acucccaagcuggac

SEQ ID NO: 1149603 - RNA, 18 nt, Human
acucccugccccccagcc

SEQ ID NO: 1149604 - RNA, 20 nt, Human
acugacaagcuccauuuaaa

SEQ ID NO: 1149605 - RNA, 17 nt, Human
acugacaagcuccauuu

SEQ ID NO: 1149606 - RNA, 20 nt, Human
acugguggcccgacagccug

SEQ ID NO: 1149607 - RNA, 19 nt, Human
acugcccaggccugccugu

SEQ ID NO: 1149608 - RNA, 12 nt, Human
acugguggcccg

SEQ ID NO: 1149609 - RNA, 17 nt, Human
acuguaaaauaauaacu

SEQ ID NO: 1149610 - RNA, 20 nt, Human
acuguuucacuacucagcau

SEQ ID NO: 1149611 - RNA, 20 nt, Human
acuuaaaauauuccugcauu

SEQ ID NO: 1149612 - RNA, 12 nt, Human
acgcagcccugc

SEQ ID NO: 1149613 - RNA, 22 nt, Human
acgcagcccugcuuugggcugc

SEQ ID NO: 1149614 - RNA, 23 nt, Human
acgcagcccugcuuugggcugcc

SEQ ID NO: 1149615 - RNA, 14 nt, Human
acgcuuaaauacag

SEQ ID NO: 1149616 - RNA, 21 nt, Human
accgggcugggagcucugcag

SEQ ID NO: 1149617 - RNA, 23 nt, Human
accgggcugggagcucugcagag

SEQ ID NO: 1149618 - RNA, 19 nt, Human
accgugccuggccacgccc

SEQ ID NO: 1149619 - RNA, 11 nt, Human
acccucagagc

SEQ ID NO: 1149620 - RNA, 18 nt, Human
acccucagagccaccccu

SEQ ID NO: 1149621 - RNA, 18 nt, Human
acccuggcacccagggug

SEQ ID NO: 1149622 - RNA, 15 nt, Human
acagugcaucucagc

SEQ ID NO: 1149623 - RNA, 17 nt, Human
acagugcaucucagccc

SEQ ID NO: 1149624 - RNA, 18 nt, Human
acagugcaucucagccca

SEQ ID NO: 1149625 - RNA, 14 nt, Human
accaagccguggcu

SEQ ID NO: 1149626 - RNA, 15 nt, Human
accaagccguggcuu

SEQ ID NO: 1149627 - RNA, 16 nt, Human
accaagccguggcuuc

SEQ ID NO: 1149628 - RNA, 17 nt, Human
accaagccguggcuucc

SEQ ID NO: 1149629 - RNA, 18 nt, Human
accaagccguggcuuccc

SEQ ID NO: 1149630 - RNA, 17 nt, Human
acauguguuggcagccu

SEQ ID NO: 1149631 - RNA, 19 nt, Human
aauuauacccccugcaaag

SEQ ID NO: 1149632 - RNA, 17 nt, Human
aauuauagcucuaaugu

SEQ ID NO: 1149633 - RNA, 18 nt, Human
aauuauagcucuaauguu

SEQ ID NO: 1149634 - RNA, 19 nt, Human
aauuauagcucuaauguuu

SEQ ID NO: 1149635 - RNA, 20 nt, Human
aauuauagcucuaauguuug

SEQ ID NO: 1149636 - RNA, 22 nt, Human
aauuauagcucuaauguuugca

SEQ ID NO: 1149637 - RNA, 23 nt, Human
aauuauagcucuaauguuugcau

SEQ ID NO: 1149638 - RNA, 22 nt, Human
aauucuagcuuugagcuuaaga

SEQ ID NO: 1149639 - RNA, 14 nt, Human
aauucuccugccuc

SEQ ID NO: 1149640 - RNA, 15 nt, Human
aauucuccugccuca

SEQ ID NO: 1149641 - RNA, 16 nt, Human
aauucuccugccucag

SEQ ID NO: 1149642 - RNA, 11 nt, Human
aauuguaauag

SEQ ID NO: 1149643 - RNA, 14 nt, Human
acaaacaauaccug

SEQ ID NO: 1149644 - RNA, 22 nt, Human
acaaacugcaccaguugcugcu

SEQ ID NO: 1149645 - RNA, 20 nt, Human
acaaguguaaugaauaccuu

SEQ ID NO: 1149646 - RNA, 13 nt, Human
acaaguguaauga

SEQ ID NO: 1149647 - RNA, 16 nt, Human
acaaguguaaugaaua

SEQ ID NO: 1149648 - RNA, 14 nt, Human
aucgaccugccucg

SEQ ID NO: 1149649 - RNA, 15 nt, Human
auccuugaagguaua

SEQ ID NO: 1149650 - RNA, 14 nt, Human
auccuugaagguau

SEQ ID NO: 1149651 - RNA, 22 nt, Human
auauuuuuuuucuuuuuaccca

SEQ ID NO: 1149652 - RNA, 12 nt, Human
aucaaaggacac

SEQ ID NO: 1149653 - RNA, 15 nt, Human
augcucuuauuucau

SEQ ID NO: 1149654 - RNA, 17 nt, Human
augcucuuauuucauca

SEQ ID NO: 1149655 - RNA, 19 nt, Human
augcucuuauuucaucauu

SEQ ID NO: 1149656 - RNA, 18 nt, Human
augcucuuauuucaucau

SEQ ID NO: 1149657 - RNA, 23 nt, Human
augcauauuuuuuuucuuuuuac

SEQ ID NO: 1149658 - RNA, 17 nt, Human
augaauaaagacaccua

SEQ ID NO: 1149659 - RNA, 24 nt, Human
augaauaccuuagugcaguuauuu

SEQ ID NO: 1149660 - RNA, 14 nt, Human
auacaccgggccug

SEQ ID NO: 1149661 - RNA, 18 nt, Human
auacaccgggccuggaga

SEQ ID NO: 1149662 - RNA, 15 nt, Human
auaaguggugugugu

SEQ ID NO: 1149663 - RNA, 16 nt, Human
auaaaagacagugaaa

SEQ ID NO: 1149664 - RNA, 21 nt, Human
aguggccaagagaugcagugc

SEQ ID NO: 1149665 - RNA, 18 nt, Human
aguuacacaugaucauaa

SEQ ID NO: 1149666 - RNA, 16 nt, Human
agugcuaacaugaaga

SEQ ID NO: 1149667 - RNA, 17 nt, Human
agugcuaacaugaagac

SEQ ID NO: 1149668 - RNA, 19 nt, Human
agugcuaacaugaagaccu

SEQ ID NO: 1149669 - RNA, 22 nt, Human
agugcuaacaugaagaccuuuu

SEQ ID NO: 1149670 - RNA, 23 nt, Human
agugcuaacaugaagaccuuuuu

SEQ ID NO: 1149671 - RNA, 23 nt, Human
aguaaacaauaaaaguguccauu

SEQ ID NO: 1149672 - RNA, 16 nt, Human
agaaugaucugauuga

SEQ ID NO: 1149673 - RNA, 14 nt, Human
agaaugaucugauu

SEQ ID NO: 1149674 - RNA, 17 nt, Human
agaaugaucugauugac

SEQ ID NO: 1149675 - RNA, 17 nt, Human
agaaccaggcaacuugg

SEQ ID NO: 1149676 - RNA, 20 nt, Human
agaaccaggcaacuugggaa

SEQ ID NO: 1149677 - RNA, 15 nt, Human
agaacaaaugaagac

SEQ ID NO: 1149678 - RNA, 12 nt, Human
agaacaaaugaa

SEQ ID NO: 1149679 - RNA, 15 nt, Human
agaauuuugagcagg

SEQ ID NO: 1149680 - RNA, 19 nt, Human
agacaaaacauacauuuug

SEQ ID NO: 1149681 - RNA, 19 nt, Human
agacaaggaaaaaauaaca

SEQ ID NO: 1149682 - RNA, 13 nt, Human
agacagcccucca

SEQ ID NO: 1149683 - RNA, 14 nt, Human
agaccuuuuucugc

SEQ ID NO: 1149684 - RNA, 18 nt, Human
agaccuuuuucugcacua

SEQ ID NO: 1149685 - RNA, 20 nt, Human
agaccuuuuucugcacuaua

SEQ ID NO: 1149686 - RNA, 12 nt, Human
agcaaauccuuu

SEQ ID NO: 1149687 - RNA, 20 nt, Human
agcaaauccuuugugaaaaa

SEQ ID NO: 1149688 - RNA, 18 nt, Human
agaucucugcuuuggaaa

SEQ ID NO: 1149689 - RNA, 23 nt, Human
agaucucugcuuuggaaaucaca

SEQ ID NO: 1149690 - RNA, 18 nt, Human
agaugacaagaaaggcug

SEQ ID NO: 1149691 - RNA, 18 nt, Human
agauggcugugccucugc

SEQ ID NO: 1149692 - RNA, 19 nt, Human
agauggcugugccucugcc

SEQ ID NO: 1149693 - RNA, 20 nt, Human
agauggcugugccucugccu

SEQ ID NO: 1149694 - RNA, 21 nt, Human
agauggcugugccucugccug

SEQ ID NO: 1149695 - RNA, 22 nt, Human
agauggcugugccucugccugu

SEQ ID NO: 1149696 - RNA, 12 nt, Human
agaguggcuccu

SEQ ID NO: 1149697 - RNA, 13 nt, Human
agaguggcuccuc

SEQ ID NO: 1149698 - RNA, 14 nt, Human
agaguggcuccucc

SEQ ID NO: 1149699 - RNA, 15 nt, Human
agaguggcuccuccc

SEQ ID NO: 1149700 - RNA, 20 nt, Human
agauagauaggucagugcaa

SEQ ID NO: 1149701 - RNA, 15 nt, Human
agcaauucuccugcc

SEQ ID NO: 1149702 - RNA, 17 nt, Human
agcaauucuccugccuc

SEQ ID NO: 1149703 - RNA, 18 nt, Human
agcaauucuccugccuca

SEQ ID NO: 1149704 - RNA, 19 nt, Human
agcaauucuccugccucag

SEQ ID NO: 1149705 - RNA, 20 nt, Human
agcaauucuccugccucagc

SEQ ID NO: 1149706 - RNA, 15 nt, Human
agcaucucagcucau

SEQ ID NO: 1149707 - RNA, 17 nt, Human
aggcucuguuccacaua

SEQ ID NO: 1149708 - RNA, 13 nt, Human
aggcucuucuccu

SEQ ID NO: 1149709 - RNA, 13 nt, Human
aggcugagccuca

SEQ ID NO: 1149710 - RNA, 14 nt, Human
aggcucuucuccuu

SEQ ID NO: 1149711 - RNA, 11 nt, Human
aggcugaggac

SEQ ID NO: 1149712 - RNA, 13 nt, Human
aggcugaggacuu

SEQ ID NO: 1149713 - RNA, 16 nt, Human
aggagagcccuucauu

SEQ ID NO: 1149714 - RNA, 22 nt, Human
agcuuugucacuguuucacuac

SEQ ID NO: 1149715 - RNA, 18 nt, Human
aggaaaaaauaacaauga

SEQ ID NO: 1149716 - RNA, 19 nt, Human
aggaaaaccaagccguggc

SEQ ID NO: 1149717 - RNA, 20 nt, Human
aggaaaaccaagccguggcu

SEQ ID NO: 1149718 - RNA, 21 nt, Human
aggaaaaccaagccguggcuu

SEQ ID NO: 1149719 - RNA, 22 nt, Human
aggaaaaccaagccguggcuuc

SEQ ID NO: 1149720 - RNA, 23 nt, Human
aggaaaaccaagccguggcuucc

SEQ ID NO: 1149721 - RNA, 14 nt, Human
aggaagguacugua

SEQ ID NO: 1149722 - RNA, 15 nt, Human
aggaagguacuguau

SEQ ID NO: 1149723 - RNA, 17 nt, Human
aggaagguacuguauga

SEQ ID NO: 1149724 - RNA, 18 nt, Human
aggaagguacuguaugau

SEQ ID NO: 1149725 - RNA, 16 nt, Human
agcuggguuggaaaac

SEQ ID NO: 1149726 - RNA, 20 nt, Human
agcuggguuggaaaacagua

SEQ ID NO: 1149727 - RNA, 17 nt, Human
agccuggcacagggcag

SEQ ID NO: 1149728 - RNA, 18 nt, Human
agccuggcacagggcagu

SEQ ID NO: 1149729 - RNA, 20 nt, Human
agccuggcacagggcagugg

SEQ ID NO: 1149730 - RNA, 15 nt, Human
agccuuuggaaacag

SEQ ID NO: 1149731 - RNA, 13 nt, Human
agcuacaaaugca

SEQ ID NO: 1149732 - RNA, 15 nt, Human
cucccacaggcccuu

SEQ ID NO: 1149733 - RNA, 16 nt, Human
cucccacaggcccuuc

SEQ ID NO: 1149734 - RNA, 20 nt, Human
cucccacaggcccuuccucu

SEQ ID NO: 1149735 - RNA, 21 nt, Human
cucccacaggcccuuccucuc

SEQ ID NO: 1149736 - RNA, 20 nt, Human
cucccugaaguaagcaaaga

SEQ ID NO: 1149737 - RNA, 17 nt, Human
cucccccguccuggagg

SEQ ID NO: 1149738 - RNA, 13 nt, Human
cuccuaccuggua

SEQ ID NO: 1149739 - RNA, 12 nt, Human
cuccucugucca

SEQ ID NO: 1149740 - RNA, 15 nt, Human
cuccucuguccaggc

SEQ ID NO: 1149741 - RNA, 12 nt, Human
cuccucuugcca

SEQ ID NO: 1149742 - RNA, 15 nt, Human
cuccucuugccacug

SEQ ID NO: 1149743 - RNA, 16 nt, Human
cuccucuugccacugc

SEQ ID NO: 1149744 - RNA, 18 nt, Human
cuccucuugccacugccu

SEQ ID NO: 1149745 - RNA, 14 nt, Human
cuccuggggguucu

SEQ ID NO: 1149746 - RNA, 13 nt, Human
cuccuuucacaac

SEQ ID NO: 1149747 - RNA, 16 nt, Human
cuccuuucacaaccuu

SEQ ID NO: 1149748 - RNA, 17 nt, Human
cuccuuucacaaccuuc

SEQ ID NO: 1149749 - RNA, 20 nt, Human
cuccuuucacaaccuucugu

SEQ ID NO: 1149750 - RNA, 22 nt, Human
cucagguugucugaagucacug

SEQ ID NO: 1149751 - RNA, 14 nt, Human
cucagguugucuga

SEQ ID NO: 1149752 - RNA, 18 nt, Human
cuaucaugucaaacguga

SEQ ID NO: 1149753 - RNA, 17 nt, Human
cuauccuacuuccccuu

SEQ ID NO: 1149754 - RNA, 15 nt, Human
cucaauaaaauuaua

SEQ ID NO: 1149755 - RNA, 21 nt, Human
ccuguucacucuacuuagcau

SEQ ID NO: 1149756 - RNA, 12 nt, Human
ccuguucccauu

SEQ ID NO: 1149757 - RNA, 16 nt, Human
ccuguucugcuuuccu

SEQ ID NO: 1149758 - RNA, 20 nt, Human
ccuuaggugauccacucgcc

SEQ ID NO: 1149759 - RNA, 15 nt, Human
ccuuagugcaguuau

SEQ ID NO: 1149760 - RNA, 20 nt, Human
ccuuagugcaguuauuugcu

SEQ ID NO: 1149761 - RNA, 13 nt, Human
ccuuaucaaagga

SEQ ID NO: 1149762 - RNA, 14 nt, Human
ccuuaucaaaggac

SEQ ID NO: 1149763 - RNA, 18 nt, Human
ccuuaucaaaggacacca

SEQ ID NO: 1149764 - RNA, 15 nt, Human
ccuucccaugcccug

SEQ ID NO: 1149765 - RNA, 19 nt, Human
ccuucccccuccaauccca

SEQ ID NO: 1149766 - RNA, 18 nt, Human
ccuuccuaauuccacagc

SEQ ID NO: 1149767 - RNA, 19 nt, Human
ccuuccuaauuccacagcu

SEQ ID NO: 1149768 - RNA, 20 nt, Human
ccuuccuaauuccacagcug

SEQ ID NO: 1149769 - RNA, 21 nt, Human
ccuuccuaauuccacagcugc

SEQ ID NO: 1149770 - RNA, 14 nt, Human
ccuuccucuccacu

SEQ ID NO: 1149771 - RNA, 15 nt, Human
ccuuccucuccacug

SEQ ID NO: 1149772 - RNA, 16 nt, Human
ccuuccucuccacugc

SEQ ID NO: 1149773 - RNA, 17 nt, Human
ccuuccucuccacugcc

SEQ ID NO: 1149774 - RNA, 20 nt, Human
ccuuccucuccacugccuuc

SEQ ID NO: 1149775 - RNA, 21 nt, Human
ccuuccucuccacugccuucg

SEQ ID NO: 1149776 - RNA, 14 nt, Human
ccuuuauucuggca

SEQ ID NO: 1149777 - RNA, 13 nt, Human
cuaacuaaaacaa

SEQ ID NO: 1149778 - RNA, 20 nt, Human
cuaacuaaaacaaagccacu

SEQ ID NO: 1149779 - RNA, 17 nt, Human
cuaagucaacuuagcau

SEQ ID NO: 1149780 - RNA, 17 nt, Human
cgagucucuucuccacu

SEQ ID NO: 1149781 - RNA, 18 nt, Human
cgagucucuucuccacug

SEQ ID NO: 1149782 - RNA, 20 nt, Human
cgagucucuucuccacugga

SEQ ID NO: 1149783 - RNA, 21 nt, Human
cgagucucuucuccacuggau

SEQ ID NO: 1149784 - RNA, 22 nt, Human
cgcaggcuggcccugcccuggu

SEQ ID NO: 1149785 - RNA, 16 nt, Human
cgccaauaaaccaaug

SEQ ID NO: 1149786 - RNA, 23 nt, Human
cgccaauaaaccaaugaacgaag

SEQ ID NO: 1149787 - RNA, 20 nt, Human
cgcucugucgcccaggcugg

SEQ ID NO: 1149788 - RNA, 21 nt, Human
cgcucuuggcagguacucagc

SEQ ID NO: 1149789 - RNA, 16 nt, Human
cgggccuggagaacua

SEQ ID NO: 1149790 - RNA, 20 nt, Human
cgggccuggagaacuagaga

SEQ ID NO: 1149791 - RNA, 16 nt, Human
cgggcugggagcucug

SEQ ID NO: 1149792 - RNA, 20 nt, Human
cgggcugggagcucugcaga

SEQ ID NO: 1149793 - RNA, 16 nt, Human
cggaggggccuggcag

SEQ ID NO: 1149794 - RNA, 15 nt, Human
cggaggggccuggca

SEQ ID NO: 1149795 - RNA, 18 nt, Human
cggcuaauuuuuguauuu

SEQ ID NO: 1149796 - RNA, 18 nt, Human
ccucagccuccugaguag

SEQ ID NO: 1149797 - RNA, 13 nt, Human
ccuccgccucccg

SEQ ID NO: 1149798 - RNA, 16 nt, Human
ccuccgccucccgggu

SEQ ID NO: 1149799 - RNA, 15 nt, Human
ccuccgggaccccca

SEQ ID NO: 1149800 - RNA, 18 nt, Human
ccuccgggacccccagga

SEQ ID NO: 1149801 - RNA, 19 nt, Human
ccuccgggacccccaggac

SEQ ID NO: 1149802 - RNA, 11 nt, Human
ccucugcccug

SEQ ID NO: 1149803 - RNA, 12 nt, Human
ccucugcccugc

SEQ ID NO: 1149804 - RNA, 13 nt, Human
ccucugcccugcg

SEQ ID NO: 1149805 - RNA, 14 nt, Human
ccucugcccugcgg

SEQ ID NO: 1149806 - RNA, 15 nt, Human
ccucugccugucucc

SEQ ID NO: 1149807 - RNA, 19 nt, Human
ccucugccugucuccccca

SEQ ID NO: 1149808 - RNA, 15 nt, Human
ccgaccaccugccca

SEQ ID NO: 1149809 - RNA, 20 nt, Human
ccguccuggagguuccccag

SEQ ID NO: 1149810 - RNA, 23 nt, Human
ccguccuggagguuccccagccc

SEQ ID NO: 1149811 - RNA, 20 nt, Human
ccuaaugcgcaggcuggccc

SEQ ID NO: 1149812 - RNA, 20 nt, Human
cccuggcucccacaggcccu

SEQ ID NO: 1149813 - RNA, 11 nt, Human
cccugcccugg

SEQ ID NO: 1149814 - RNA, 12 nt, Human
cccugcccuggu

SEQ ID NO: 1149815 - RNA, 22 nt, Human
cccugcccugguuuccugcccu

SEQ ID NO: 1149816 - RNA, 23 nt, Human
cccugcccugguuuccugcccug

SEQ ID NO: 1149817 - RNA, 19 nt, Human
cccuggauccaucaggcca

SEQ ID NO: 1149818 - RNA, 14 nt, Human
cccugccccccagc

SEQ ID NO: 1149819 - RNA, 15 nt, Human
cccugccccccagcc

SEQ ID NO: 1149820 - RNA, 20 nt, Human
cccugccccccagcccuccu

SEQ ID NO: 1149821 - RNA, 17 nt, Human
cccugccccucccuuca

SEQ ID NO: 1149822 - RNA, 18 nt, Human
cccugccccucccuucaa

SEQ ID NO: 1149823 - RNA, 19 nt, Human
cccugccccucccuucaac

SEQ ID NO: 1149824 - RNA, 23 nt, Human
cccugccccucccuucaaccauu

SEQ ID NO: 1149825 - RNA, 11 nt, Human
cccuccuccug

SEQ ID NO: 1149826 - RNA, 16 nt, Human
cccuccuccuggacuc

SEQ ID NO: 1149827 - RNA, 18 nt, Human
cccuccuccuggacuccu

SEQ ID NO: 1149828 - RNA, 14 nt, Human
cccuccucucugcc

SEQ ID NO: 1149829 - RNA, 15 nt, Human
cccuccucucugccc

SEQ ID NO: 1149830 - RNA, 13 nt, Human
ccccagccccacu

SEQ ID NO: 1149831 - RNA, 14 nt, Human
ccccagccccacuu

SEQ ID NO: 1149832 - RNA, 15 nt, Human
ccccagccccacuua

SEQ ID NO: 1149833 - RNA, 14 nt, Human
ccaugucucgacuc

SEQ ID NO: 1149834 - RNA, 15 nt, Human
ccaugucucgacuca

SEQ ID NO: 1149835 - RNA, 20 nt, Human
ccaugucucugagcauuaga

SEQ ID NO: 1149836 - RNA, 12 nt, Human
ccauugugcauu

SEQ ID NO: 1149837 - RNA, 17 nt, Human
ccauugugcauucuaga

SEQ ID NO: 1149838 - RNA, 14 nt, Human
cccaaccugcucuc

SEQ ID NO: 1149839 - RNA, 20 nt, Human
ccauuuaaacagauguccau

SEQ ID NO: 1149840 - RNA, 21 nt, Human
cccaaccugcucuccucuugc

SEQ ID NO: 1149841 - RNA, 23 nt, Human
cccaaccugcucuccucuugcca

SEQ ID NO: 1149842 - RNA, 20 nt, Human
cccaacuaauuuuuguauuu

SEQ ID NO: 1149843 - RNA, 20 nt, Human
cccaagaauagaugcugacu

SEQ ID NO: 1149844 - RNA, 21 nt, Human
cccaagaauagaugcugacug

SEQ ID NO: 1149845 - RNA, 23 nt, Human
cccaagccuacuuuugccauuga

SEQ ID NO: 1149846 - RNA, 16 nt, Human
cccaagccuggcaagg

SEQ ID NO: 1149847 - RNA, 13 nt, Human
ccaggcugagccu

SEQ ID NO: 1149848 - RNA, 14 nt, Human
ccaggcugagccuc

SEQ ID NO: 1149849 - RNA, 16 nt, Human
ccaggcugagccucag

SEQ ID NO: 1149850 - RNA, 17 nt, Human
ccaggcugagccucagu

SEQ ID NO: 1149851 - RNA, 19 nt, Human
ccaggcugagccucagucu

SEQ ID NO: 1149852 - RNA, 22 nt, Human
ccaggcugagccucagucuccc

SEQ ID NO: 1149853 - RNA, 12 nt, Human
ccacuuggcauu

SEQ ID NO: 1149854 - RNA, 24 nt, Human
ccacuuucaaucuucaauccuuga

SEQ ID NO: 1149855 - RNA, 22 nt, Human
caguuauuauauuuacaaaugg

SEQ ID NO: 1149856 - RNA, 17 nt, Human
caguuauuauauuuaca

SEQ ID NO: 1149857 - RNA, 21 nt, Human
caguuauuauauuuacaaaug

SEQ ID NO: 1149858 - RNA, 20 nt, Human
cauccucuuccauauggauc

SEQ ID NO: 1149859 - RNA, 15 nt, Human
caucuaaacugcccc

SEQ ID NO: 1149860 - RNA, 21 nt, Human
caucuaaacugcccccucugc

SEQ ID NO: 1149861 - RNA, 16 nt, Human
cauagguuuaauaauu

SEQ ID NO: 1149862 - RNA, 13 nt, Human
cauuuguagguag

SEQ ID NO: 1149863 - RNA, 13 nt, Human
cauuuguucauau

SEQ ID NO: 1149864 - RNA, 14 nt, Human
cauuuguucauauu

SEQ ID NO: 1149865 - RNA, 18 nt, Human
cauuuguucauauuaaga

SEQ ID NO: 1149866 - RNA, 20 nt, Human
cauuuguucauauuaagaau

SEQ ID NO: 1149867 - RNA, 19 nt, Human
cauuuguucauauuaagaa

SEQ ID NO: 1149868 - RNA, 21 nt, Human
ccaauggagacugucucaaga

SEQ ID NO: 1149869 - RNA, 18 nt, Human
cauguuggccaggcuggu

SEQ ID NO: 1149870 - RNA, 20 nt, Human
caugggaaaugucaacaagu

SEQ ID NO: 1149871 - RNA, 14 nt, Human
cauggccgugaacu

SEQ ID NO: 1149872 - RNA, 15 nt, Human
cauggccagguggcc

SEQ ID NO: 1149873 - RNA, 21 nt, Human
caggcgugagccaccgugccu

SEQ ID NO: 1149874 - RNA, 14 nt, Human
cagacagcccucca

SEQ ID NO: 1149875 - RNA, 18 nt, Human
cagcacgggggccaagga

SEQ ID NO: 1149876 - RNA, 14 nt, Human
cagauccccaagcc

SEQ ID NO: 1149877 - RNA, 15 nt, Human
cagauccccaagccu

SEQ ID NO: 1149878 - RNA, 13 nt, Human
auucauaugcaua

SEQ ID NO: 1149879 - RNA, 14 nt, Human
auucauaugcauau

SEQ ID NO: 1149880 - RNA, 15 nt, Human
auucauaugcauauu

SEQ ID NO: 1149881 - RNA, 18 nt, Human
auucauaugcauauuuuu

SEQ ID NO: 1149882 - RNA, 16 nt, Human
auucauaugcauauuu

SEQ ID NO: 1149883 - RNA, 18 nt, Human
auuagauaaauguccauu

SEQ ID NO: 1149884 - RNA, 15 nt, Human
auuaauggaaauguu

SEQ ID NO: 1149885 - RNA, 15 nt, Human
auuacaggcuccugc

SEQ ID NO: 1149886 - RNA, 16 nt, Human
auuacaggcuccugcc

SEQ ID NO: 1149887 - RNA, 17 nt, Human
auuacaggcuccugcca

SEQ ID NO: 1149888 - RNA, 19 nt, Human
auuacaggcuccugccacc

SEQ ID NO: 1149889 - RNA, 13 nt, Human
auuacagguguga

SEQ ID NO: 1149890 - RNA, 13 nt, Human
auuuguucauauu

SEQ ID NO: 1149891 - RNA, 17 nt, Human
auuuucuauaauuuaaa

SEQ ID NO: 1149892 - RNA, 18 nt, Human
auuuucuauaauuuaaau

SEQ ID NO: 1149893 - RNA, 19 nt, Human
auuuucuauaauuuaaaua

SEQ ID NO: 1149894 - RNA, 15 nt, Human
auuuucugcaucucc

SEQ ID NO: 1149895 - RNA, 16 nt, Human
auuuucugcaucucca

SEQ ID NO: 1149896 - RNA, 19 nt, Human
auuuucugcaucuccacuu

SEQ ID NO: 1149897 - RNA, 20 nt, Human
auuuuuaucaguuacacaug

SEQ ID NO: 1149898 - RNA, 19 nt, Human
caaacauccucuuccauau

SEQ ID NO: 1149899 - RNA, 17 nt, Human
cacuccagaccccuggc

SEQ ID NO: 1149900 - RNA, 16 nt, Human
cacuagacccacugga

SEQ ID NO: 1149901 - RNA, 14 nt, Human
cacuccagaccccu

SEQ ID NO: 1149902 - RNA, 16 nt, Human
cacuccagaccccugg

SEQ ID NO: 1149903 - RNA, 15 nt, Human
cacccuggauuugca

SEQ ID NO: 1149904 - RNA, 21 nt, Human
caagcuccaucuccacuccag

SEQ ID NO: 1149905 - RNA, 17 nt, Human
caagcuccaucuccacu

SEQ ID NO: 1149906 - RNA, 18 nt, Human
caagcaccuagccucgcu

SEQ ID NO: 1149907 - RNA, 13 nt, Human
caagaucccauuu

SEQ ID NO: 1149908 - RNA, 15 nt, Human
caagaucccauuuga

SEQ ID NO: 1149909 - RNA, 18 nt, Human
caagaugaaauuccauuu

SEQ ID NO: 1149910 - RNA, 20 nt, Human
caagaugaaauuccauuugu

SEQ ID NO: 1149911 - RNA, 13 nt, Human
caagcaagaaaca

SEQ ID NO: 1149912 - RNA, 18 nt, Human
caagcaagaaacacuggg

SEQ ID NO: 1149913 - RNA, 19 nt, Human
caacucccugccccccagc

SEQ ID NO: 1149914 - RNA, 20 nt, Human
caacucccugccccccagcc

SEQ ID NO: 1149915 - RNA, 21 nt, Human
caacucccugccccccagccc

SEQ ID NO: 1149916 - RNA, 18 nt, Human
caagaauagaugcugacu

SEQ ID NO: 1149917 - RNA, 18 nt, Human
cugcaaagcccagcuuga

SEQ ID NO: 1149918 - RNA, 17 nt, Human
cugcaaccuucgccacc

SEQ ID NO: 1149919 - RNA, 19 nt, Human
cugcaaccuucgccaccug

SEQ ID NO: 1149920 - RNA, 20 nt, Human
cugcaaccuucgccaccugg

SEQ ID NO: 1149921 - RNA, 22 nt, Human
cugcaaccuucgccaccugggu

SEQ ID NO: 1149922 - RNA, 18 nt, Human
cugcaacuuguaaaugug

SEQ ID NO: 1149923 - RNA, 19 nt, Human
cugcaacuuguaaaugugg

SEQ ID NO: 1149924 - RNA, 14 nt, Human
cugcacuauaugca

SEQ ID NO: 1149925 - RNA, 17 nt, Human
cugccagucccccugcc

SEQ ID NO: 1149926 - RNA, 20 nt, Human
cugccagucccccugcccca

SEQ ID NO: 1149927 - RNA, 21 nt, Human
cugccagucccccugccccag

SEQ ID NO: 1149928 - RNA, 22 nt, Human
cugccagucccccugccccagg

SEQ ID NO: 1149929 - RNA, 13 nt, Human
cugccccccagcc

SEQ ID NO: 1149930 - RNA, 14 nt, Human
cugccccucccuuc

SEQ ID NO: 1149931 - RNA, 17 nt, Human
cugccccucccuucaac

SEQ ID NO: 1149932 - RNA, 17 nt, Human
cugccccuccucucugc

SEQ ID NO: 1149933 - RNA, 18 nt, Human
cugccccuccucucugcc

SEQ ID NO: 1149934 - RNA, 20 nt, Human
cugccccuccucucugcccu

SEQ ID NO: 1149935 - RNA, 19 nt, Human
cugccccuccucucugccc

SEQ ID NO: 1149936 - RNA, 19 nt, Human
cugcugagucccaggcuga

SEQ ID NO: 1149937 - RNA, 23 nt, Human
cugcugagucccaggcugagccu

SEQ ID NO: 1149938 - RNA, 17 nt, Human
cugugacuucagcucug

SEQ ID NO: 1149939 - RNA, 22 nt, Human
cugugacuucagcucuguuuua

SEQ ID NO: 1149940 - RNA, 15 nt, Human
cuguucacucuacuu

SEQ ID NO: 1149941 - RNA, 15 nt, Human
cuguugcugccucau

SEQ ID NO: 1149942 - RNA, 16 nt, Human
cuguugcugccucaug

SEQ ID NO: 1149943 - RNA, 17 nt, Human
cuguugcugccucaugc

SEQ ID NO: 1149944 - RNA, 18 nt, Human
cuuaaaauauuccugcau

SEQ ID NO: 1149945 - RNA, 20 nt, Human
cuuaaaauauuccugcauuu

SEQ ID NO: 1149946 - RNA, 16 nt, Human
cuuacagcaaauccuu

SEQ ID NO: 1149947 - RNA, 18 nt, Human
cuuacagcaaauccuuug

SEQ ID NO: 1149948 - RNA, 22 nt, Human
cuuaccgcguaaugcgccaaua

SEQ ID NO: 1149949 - RNA, 14 nt, Human
cuucacugugcugu

SEQ ID NO: 1149950 - RNA, 13 nt, Human
cuucacugugcug

SEQ ID NO: 1149951 - RNA, 17 nt, Human
cuucaguuaagccuuug

SEQ ID NO: 1149952 - RNA, 18 nt, Human
cuucaguuaagccuuugg

SEQ ID NO: 1149953 - RNA, 22 nt, Human
cuucaucucccaaagugcuggg

SEQ ID NO: 1149954 - RNA, 15 nt, Human
cuuccaugucgccuc

SEQ ID NO: 1149955 - RNA, 16 nt, Human
cuuccaugucgccucu

SEQ ID NO: 1149956 - RNA, 17 nt, Human
cuuccaugucgccucug

SEQ ID NO: 1149957 - RNA, 18 nt, Human
cuuccaugucgccucugc

SEQ ID NO: 1149958 - RNA, 19 nt, Human
cuuccaugucgccucugca

SEQ ID NO: 1149959 - RNA, 20 nt, Human
cuuccaugucgccucugcau

SEQ ID NO: 1149960 - RNA, 22 nt, Human
cuuucggggagaggcugaggac

SEQ ID NO: 1149961 - RNA, 17 nt, Human
cuuucuaaugugugaau

SEQ ID NO: 1149962 - RNA, 16 nt, Human
cuuugagcuuaagaau

SEQ ID NO: 1149963 - RNA, 19 nt, Human
cuuuuauuuagcaccaggg

SEQ ID NO: 1149964 - RNA, 23 nt, Human
gaacccuuaaacaguugcacagc

SEQ ID NO: 1149965 - RNA, 20 nt, Human
gaacucugacaacagacuuc

SEQ ID NO: 1149966 - RNA, 19 nt, Human
gaagacaaaacauacauuu

SEQ ID NO: 1149967 - RNA, 23 nt, Human
gaagacaaaacauacauuuugua

SEQ ID NO: 1149968 - RNA, 20 nt, Human
gaauauuagugaccucagcu

SEQ ID NO: 1149969 - RNA, 16 nt, Human
gacauuccuugcugaa

SEQ ID NO: 1149970 - RNA, 13 nt, Human
gaccauacuaauu

SEQ ID NO: 1149971 - RNA, 15 nt, Human
gacucaccuccccca

SEQ ID NO: 1149972 - RNA, 22 nt, Human
gacucaccucccccaucucuuc

SEQ ID NO: 1149973 - RNA, 12 nt, Human
gacucugccucc

SEQ ID NO: 1149974 - RNA, 16 nt, Human
gacucugccuccucuu

SEQ ID NO: 1149975 - RNA, 23 nt, Human
gacuguacuccucccaggcgccc

SEQ ID NO: 1149976 - RNA, 14 nt, Human
gacuguuguuaucu

SEQ ID NO: 1149977 - RNA, 19 nt, Human
gacuguuguuaucuguuug

SEQ ID NO: 1149978 - RNA, 20 nt, Human
gacuguuguuaucuguuuga

SEQ ID NO: 1149979 - RNA, 21 nt, Human
gacuguuguuaucuguuugag

SEQ ID NO: 1149980 - RNA, 21 nt, Human
gagcgcccacuagacccacug

SEQ ID NO: 1149981 - RNA, 17 nt, Human
gaggcaucgcaauguaa

SEQ ID NO: 1149982 - RNA, 16 nt, Human
gaguuuaaauuguaau

SEQ ID NO: 1149983 - RNA, 20 nt, Human
gauguauguugaagccuuug

SEQ ID NO: 1149984 - RNA, 21 nt, Human
gauguauguugaagccuuugu

SEQ ID NO: 1149985 - RNA, 20 nt, Human
gauuauaggcaccuaccacc

SEQ ID NO: 1149986 - RNA, 20 nt, Human
gauuuuuuacagcugccugc

SEQ ID NO: 1149987 - RNA, 14 nt, Human
gcacaaguguaaug

SEQ ID NO: 1149988 - RNA, 17 nt, Human
gcacaaguguaaugaau

SEQ ID NO: 1149989 - RNA, 19 nt, Human
gcacaaguguaaugaauac

SEQ ID NO: 1149990 - RNA, 21 nt, Human
gcacaaguguaaugaauaccu

SEQ ID NO: 1149991 - RNA, 20 nt, Human
gcacagugcaucucagccca

SEQ ID NO: 1149992 - RNA, 21 nt, Human
gcacagugcaucucagcccac

SEQ ID NO: 1149993 - RNA, 21 nt, Human
gcaccuaccaccacgcccggc

SEQ ID NO: 1149994 - RNA, 22 nt, Human
gcaccuaccaccacgcccggcu

SEQ ID NO: 1149995 - RNA, 18 nt, Human
gcacuuggagacuuguau

SEQ ID NO: 1149996 - RNA, 13 nt, Human
gccaccacgcccg

SEQ ID NO: 1149997 - RNA, 14 nt, Human
gccaccacgcccgg

SEQ ID NO: 1149998 - RNA, 12 nt, Human
gccacugccucu

SEQ ID NO: 1149999 - RNA, 13 nt, Human
gccacugccucuu

SEQ ID NO: 1150000 - RNA, 16 nt, Human
gccacugccucuuccu

SEQ ID NO: 1150001 - RNA, 17 nt, Human
gccacugccucuuccuc

SEQ ID NO: 1150002 - RNA, 21 nt, Human
gccacuugaugacccccaacc

SEQ ID NO: 1150003 - RNA, 15 nt, Human
gccagaauuucaaac

SEQ ID NO: 1150004 - RNA, 17 nt, Human
gccauuccccgucucug

SEQ ID NO: 1150005 - RNA, 18 nt, Human
gccauuccccgucucugg

SEQ ID NO: 1150006 - RNA, 17 nt, Human
gcccacuagacccacug

SEQ ID NO: 1150007 - RNA, 23 nt, Human
gcccacuagacccacuggacuca

SEQ ID NO: 1150008 - RNA, 14 nt, Human
gcccccucugcccu

SEQ ID NO: 1150009 - RNA, 16 nt, Human
gcccugcugaguccca

SEQ ID NO: 1150010 - RNA, 21 nt, Human
gcccugcugagucccaggcug

SEQ ID NO: 1150011 - RNA, 22 nt, Human
gcccugcugagucccaggcuga

SEQ ID NO: 1150012 - RNA, 23 nt, Human
gcccugcugagucccaggcugag

SEQ ID NO: 1150013 - RNA, 18 nt, Human
gccgccuccgggaccccc

SEQ ID NO: 1150014 - RNA, 19 nt, Human
gccgccuccgggaccccca

SEQ ID NO: 1150015 - RNA, 22 nt, Human
gccgccuccgggacccccagga

SEQ ID NO: 1150016 - RNA, 23 nt, Human
gccgccuccgggacccccaggac

SEQ ID NO: 1150017 - RNA, 22 nt, Human
gccucuuccucccucauuccac

SEQ ID NO: 1150018 - RNA, 17 nt, Human
gccugccuguucccauu

SEQ ID NO: 1150019 - RNA, 19 nt, Human
gccuguucccauucuugca

SEQ ID NO: 1150020 - RNA, 16 nt, Human
gcuauugucaccaggg

SEQ ID NO: 1150021 - RNA, 20 nt, Human
gcuauugucaccagggcugg

SEQ ID NO: 1150022 - RNA, 21 nt, Human
gcuauugucaccagggcugga

SEQ ID NO: 1150023 - RNA, 22 nt, Human
gcuccugccaccacgcccggcu

SEQ ID NO: 1150024 - RNA, 15 nt, Human
gcucuaauguuugca

SEQ ID NO: 1150025 - RNA, 16 nt, Human
gcucuaauguuugcau

SEQ ID NO: 1150026 - RNA, 17 nt, Human
gcucuaauguuugcaua

SEQ ID NO: 1150027 - RNA, 18 nt, Human
gcucuaauguuugcauau

SEQ ID NO: 1150028 - RNA, 20 nt, Human
gcucuacagcuaaucagcau

SEQ ID NO: 1150029 - RNA, 22 nt, Human
gcucuacagcuaaucagcauuc

SEQ ID NO: 1150030 - RNA, 19 nt, Human
gcucuaauguuugcauaua

SEQ ID NO: 1150031 - RNA, 20 nt, Human
gcucugagcaaauguggcuc

SEQ ID NO: 1150032 - RNA, 21 nt, Human
gcucugagcaaauguggcucc

SEQ ID NO: 1150033 - RNA, 19 nt, Human
gcucugucgcccaggcugg

SEQ ID NO: 1150034 - RNA, 23 nt, Human
gcucugucgcccaggcuggagug

SEQ ID NO: 1150035 - RNA, 13 nt, Human
gcucuuauuucau

SEQ ID NO: 1150036 - RNA, 14 nt, Human
gcucuuauuucauc

SEQ ID NO: 1150037 - RNA, 15 nt, Human
gcucuuauuucauca

SEQ ID NO: 1150038 - RNA, 22 nt, Human
gcugggauuacaggcuccugcc

SEQ ID NO: 1150039 - RNA, 23 nt, Human
gcugggauuacaggcuccugcca

SEQ ID NO: 1150040 - RNA, 17 nt, Human
gcugggauuacaggugu

SEQ ID NO: 1150041 - RNA, 18 nt, Human
gcugggauuacaggugug

SEQ ID NO: 1150042 - RNA, 19 nt, Human
gcuguauuagucacagaga

SEQ ID NO: 1150043 - RNA, 18 nt, Human
gcuuaaagaauucaaauu

SEQ ID NO: 1150044 - RNA, 19 nt, Human
gcuuaacagggaacgugau

SEQ ID NO: 1150045 - RNA, 15 nt, Human
gcuucaauuuauacc

SEQ ID NO: 1150046 - RNA, 15 nt, Human
gcuucccgcucagcc

SEQ ID NO: 1150047 - RNA, 16 nt, Human
gcuucccgcucagccc

SEQ ID NO: 1150048 - RNA, 17 nt, Human
gcuucccgcucagcccu

SEQ ID NO: 1150049 - RNA, 18 nt, Human
gcuucccgcucagcccuc

SEQ ID NO: 1150050 - RNA, 23 nt, Human
gcuucccgcucagcccucccugc

SEQ ID NO: 1150051 - RNA, 19 nt, Human
ggacccccaggacaggcug

SEQ ID NO: 1150052 - RNA, 20 nt, Human
ggacccggaggggccuggca

SEQ ID NO: 1150053 - RNA, 21 nt, Human
ggacccggaggggccuggcag

SEQ ID NO: 1150054 - RNA, 16 nt, Human
ggacuaggguccuggg

SEQ ID NO: 1150055 - RNA, 17 nt, Human
ggacuuagcugggagaa

SEQ ID NO: 1150056 - RNA, 18 nt, Human
ggacuuuuauuuccagug

SEQ ID NO: 1150057 - RNA, 13 nt, Human
ggagaacuagaga

SEQ ID NO: 1150058 - RNA, 16 nt, Human
ggagacugucucaaga

SEQ ID NO: 1150059 - RNA, 14 nt, Human
ggagagagacucca

SEQ ID NO: 1150060 - RNA, 20 nt, Human
ggaggaaaaccaagccgugg

SEQ ID NO: 1150061 - RNA, 21 nt, Human
ggaggaaaaccaagccguggc

SEQ ID NO: 1150062 - RNA, 22 nt, Human
ggaggaaaaccaagccguggcu

SEQ ID NO: 1150063 - RNA, 9 nt, Human
ggagguucc

SEQ ID NO: 1150064 - RNA, 19 nt, Human
ggcagccgugccuucagcu

SEQ ID NO: 1150065 - RNA, 21 nt, Human
ggcagccgugccuucagcucu

SEQ ID NO: 1150066 - RNA, 22 nt, Human
ggcagccgugccuucagcucua

SEQ ID NO: 1150067 - RNA, 21 nt, Human
ggccaaggaugccccgucccc

SEQ ID NO: 1150068 - RNA, 19 nt, Human
ggccagguggccacuccag

SEQ ID NO: 1150069 - RNA, 16 nt, Human
ggcccgacagccuggc

SEQ ID NO: 1150070 - RNA, 17 nt, Human
ggcccgacagccuggca

SEQ ID NO: 1150071 - RNA, 19 nt, Human
ggcccuuccucuccacugc

SEQ ID NO: 1150072 - RNA, 22 nt, Human
ggcccuuccucuccacugccuu

SEQ ID NO: 1150073 - RNA, 23 nt, Human
ggcccuuccucuccacugccuuc

SEQ ID NO: 1150074 - RNA, 17 nt, Human
ggcuccucccggugccc

SEQ ID NO: 1150075 - RNA, 12 nt, Human
ggcuccugccac

SEQ ID NO: 1150076 - RNA, 13 nt, Human
ggcuccugccacc

SEQ ID NO: 1150077 - RNA, 13 nt, Human
ggcuggcccugcc

SEQ ID NO: 1150078 - RNA, 14 nt, Human
ggcuggcccugccc

SEQ ID NO: 1150079 - RNA, 15 nt, Human
ggcuggcccugcccu

SEQ ID NO: 1150080 - RNA, 16 nt, Human
ggcuggcccugcccug

SEQ ID NO: 1150081 - RNA, 17 nt, Human
ggcuggcccugcccugg

SEQ ID NO: 1150082 - RNA, 20 nt, Human
aaaaagcuccaaaugcagcu

SEQ ID NO: 1150083 - RNA, 14 nt, Human
ggcuucccgcucag

SEQ ID NO: 1150084 - RNA, 17 nt, Human
aaaaaucuuccaauuua

SEQ ID NO: 1150085 - RNA, 16 nt, Human
aaaaauuacuuaguau

SEQ ID NO: 1150086 - RNA, 19 nt, Human
aaaaccaagccguggcuuc

SEQ ID NO: 1150087 - RNA, 22 nt, Human
aaaagcuccauuuuuagugaaa

SEQ ID NO: 1150088 - RNA, 13 nt, Human
gggagggccuggg

SEQ ID NO: 1150089 - RNA, 14 nt, Human
aaaccaagccgugg

SEQ ID NO: 1150090 - RNA, 16 nt, Human
aaaccaagccguggcu

SEQ ID NO: 1150091 - RNA, 23 nt, Human
aaacggccucacuaggcuucugg

SEQ ID NO: 1150092 - RNA, 12 nt, Human
aaacgugaaaau

SEQ ID NO: 1150093 - RNA, 12 nt, Human
aaacugcccccu

SEQ ID NO: 1150094 - RNA, 13 nt, Human
aaacugcccccuc

SEQ ID NO: 1150095 - RNA, 17 nt, Human
aaacugcccccucugcc

SEQ ID NO: 1150096 - RNA, 19 nt, Human
aaacugcccccucugcccu

SEQ ID NO: 1150097 - RNA, 20 nt, Human
aaacugcccccucugcccug

SEQ ID NO: 1150098 - RNA, 21 nt, Human
aaacugcccccucugcccugc

SEQ ID NO: 1150099 - RNA, 18 nt, Human
gguauaaguggugugugu

SEQ ID NO: 1150100 - RNA, 17 nt, Human
aaagaauggaaggugga

SEQ ID NO: 1150101 - RNA, 16 nt, Human
aaagaauucaaauuuu

SEQ ID NO: 1150102 - RNA, 15 nt, Human
aaagaauucaaauuu

SEQ ID NO: 1150103 - RNA, 21 nt, Human
ggugauccacucgccuucauc

SEQ ID NO: 1150104 - RNA, 18 nt, Human
ggugcaaaguucccuacu

SEQ ID NO: 1150105 - RNA, 13 nt, Human
aaaggaauuuaaa

SEQ ID NO: 1150106 - RNA, 18 nt, Human
guagcugggauuacaggc

SEQ ID NO: 1150107 - RNA, 17 nt, Human
guaggaagguacuguau

SEQ ID NO: 1150108 - RNA, 19 nt, Human
guaggaagguacuguauga

SEQ ID NO: 1150109 - RNA, 22 nt, Human
guaggaagguacuguaugauca

SEQ ID NO: 1150110 - RNA, 15 nt, Human
aaauccuuugugaaa

SEQ ID NO: 1150111 - RNA, 11 nt, Human
aaaugaaaauu

SEQ ID NO: 1150112 - RNA, 14 nt, Human
aaaugcauuucuaa

SEQ ID NO: 1150113 - RNA, 12 nt, Human
guaguuaucaug

SEQ ID NO: 1150114 - RNA, 13 nt, Human
guaguuaucaugu

SEQ ID NO: 1150115 - RNA, 14 nt, Human
guaguuaucauguu

SEQ ID NO: 1150116 - RNA, 16 nt, Human
guaguuaucauguuag

SEQ ID NO: 1150117 - RNA, 15 nt, Human
guaguuaucauguua

SEQ ID NO: 1150118 - RNA, 16 nt, Human
guaugggacuggccuc

SEQ ID NO: 1150119 - RNA, 20 nt, Human
guauugacaaaauguuauuu

SEQ ID NO: 1150120 - RNA, 20 nt, Human
aaauguuaaguugaugguga

SEQ ID NO: 1150121 - RNA, 14 nt, Human
aaauguuauuuccc

SEQ ID NO: 1150122 - RNA, 22 nt, Human
aaauguuauuucccuacauuaa

SEQ ID NO: 1150123 - RNA, 18 nt, Human
aaauuacuuaguauugca

SEQ ID NO: 1150124 - RNA, 18 nt, Human
aaauuagccaguaauccu

SEQ ID NO: 1150125 - RNA, 15 nt, Human
aaauuauagcucuaa

SEQ ID NO: 1150126 - RNA, 21 nt, Human
aaauuauagcucuaauguuug

SEQ ID NO: 1150127 - RNA, 18 nt, Human
aaauuauagcucuaaugu

SEQ ID NO: 1150128 - RNA, 17 nt, Human
aaauuucagcagcugca

SEQ ID NO: 1150129 - RNA, 18 nt, Human
aaauuucagcagcugcag

SEQ ID NO: 1150130 - RNA, 12 nt, Human
aacaauaccuga

SEQ ID NO: 1150131 - RNA, 21 nt, Human
aacaauaccugaaugcucugu

SEQ ID NO: 1150132 - RNA, 20 nt, Human
aacaauaccugaaugcucug

SEQ ID NO: 1150133 - RNA, 11 nt, Human
aacacuuccau

SEQ ID NO: 1150134 - RNA, 15 nt, Human
guccacaacacacag

SEQ ID NO: 1150135 - RNA, 15 nt, Human
gucccaacuuguaaa

SEQ ID NO: 1150136 - RNA, 16 nt, Human
aacauacauuuuguac

SEQ ID NO: 1150137 - RNA, 19 nt, Human
aacauacauuuuguaccaa

SEQ ID NO: 1150138 - RNA, 16 nt, Human
gucucccucccuuggg

SEQ ID NO: 1150139 - RNA, 15 nt, Human
aaccaaugaacgaag

SEQ ID NO: 1150140 - RNA, 15 nt, Human
gucuggcuucacaga

SEQ ID NO: 1150141 - RNA, 19 nt, Human
gucuuauauauuguagaua

SEQ ID NO: 1150142 - RNA, 11 nt, Human
aaccugcucuc

SEQ ID NO: 1150143 - RNA, 15 nt, Human
aaccugcucuccucu

SEQ ID NO: 1150144 - RNA, 20 nt, Human
aaccugcucuccucuugcca

SEQ ID NO: 1150145 - RNA, 13 nt, Human
aacucccugcccc

SEQ ID NO: 1150146 - RNA, 19 nt, Human
aacucccugccccccagcc

SEQ ID NO: 1150147 - RNA, 14 nt, Human
gugccuaguauuga

SEQ ID NO: 1150148 - RNA, 16 nt, Human
gugccuaguauugaca

SEQ ID NO: 1150149 - RNA, 18 nt, Human
gugccuaguauugacaaa

SEQ ID NO: 1150150 - RNA, 20 nt, Human
gugccuaguauugacaaaau

SEQ ID NO: 1150151 - RNA, 13 nt, Human
gugccucugccug

SEQ ID NO: 1150152 - RNA, 15 nt, Human
gugccucugccuguc

SEQ ID NO: 1150153 - RNA, 12 nt, Human
aacuugggaacu

SEQ ID NO: 1150154 - RNA, 18 nt, Human
aagaaguggggcagcagc

SEQ ID NO: 1150155 - RNA, 19 nt, Human
aagaaguggggcagcagca

SEQ ID NO: 1150156 - RNA, 20 nt, Human
gugcugggauuacaggcgug

SEQ ID NO: 1150157 - RNA, 21 nt, Human
guggauggaaggggcugacag

SEQ ID NO: 1150158 - RNA, 12 nt, Human
guggauguuacu

SEQ ID NO: 1150159 - RNA, 19 nt, Human
aagaaugaucugauugacc

SEQ ID NO: 1150160 - RNA, 21 nt, Human
aagacaaaacauacauuuugu

SEQ ID NO: 1150161 - RNA, 16 nt, Human
aagagcuuaacagugu

SEQ ID NO: 1150162 - RNA, 18 nt, Human
guggcccgacagccuggc

SEQ ID NO: 1150163 - RNA, 19 nt, Human
guggcccgacagccuggca

SEQ ID NO: 1150164 - RNA, 22 nt, Human
aagcaaagacuuuccucuuagu

SEQ ID NO: 1150165 - RNA, 17 nt, Human
gugugaaaaugugugug

SEQ ID NO: 1150166 - RNA, 18 nt, Human
guguguaugcgugugugu

SEQ ID NO: 1150167 - RNA, 14 nt, Human
guguuggucuguac

SEQ ID NO: 1150168 - RNA, 12 nt, Human
guuaagccuuug

SEQ ID NO: 1150169 - RNA, 13 nt, Human
guuaagccuuugg

SEQ ID NO: 1150170 - RNA, 16 nt, Human
guuaagccuuuggaaa

SEQ ID NO: 1150171 - RNA, 22 nt, Human
guuaaguugauggugaugaaau

SEQ ID NO: 1150172 - RNA, 14 nt, Human
guuaguaauaccuc

SEQ ID NO: 1150173 - RNA, 23 nt, Human
guuauuucccuacauuaaacaug

SEQ ID NO: 1150174 - RNA, 21 nt, Human
guuauuucccuacauuaaaca

SEQ ID NO: 1150175 - RNA, 15 nt, Human
guuccccaagacauu

SEQ ID NO: 1150176 - RNA, 20 nt, Human
guucccuacuuccugugacu

SEQ ID NO: 1150177 - RNA, 21 nt, Human
guugaugccugugaacugaac

SEQ ID NO: 1150178 - RNA, 19 nt, Human
aaggaugccccgucccccu

SEQ ID NO: 1150179 - RNA, 16 nt, Human
guugcugcuucaauuu

SEQ ID NO: 1150180 - RNA, 15 nt, Human
guuggucuguacuga

SEQ ID NO: 1150181 - RNA, 16 nt, Human
guuggucuguacugau

SEQ ID NO: 1150182 - RNA, 20 nt, Human
guuguagagaaaacaugcag

SEQ ID NO: 1150183 - RNA, 20 nt, Human
guuuaagacauuuuuggaag

SEQ ID NO: 1150184 - RNA, 14 nt, Human
aagguacuguauga

SEQ ID NO: 1150185 - RNA, 15 nt, Human
aagguacuguaugau

SEQ ID NO: 1150186 - RNA, 17 nt, Human
aagguacuguaugauca

SEQ ID NO: 1150187 - RNA, 19 nt, Human
aagguacuguaugaucaaa

SEQ ID NO: 1150188 - RNA, 20 nt, Human
aagguacuguaugaucaaau

SEQ ID NO: 1150189 - RNA, 21 nt, Human
aagguacuguaugaucaaaug

SEQ ID NO: 1150190 - RNA, 22 nt, Human
aagguacuguaugaucaaaugu

SEQ ID NO: 1150191 - RNA, 20 nt, Human
guuugggccccagaggcugg

SEQ ID NO: 1150192 - RNA, 23 nt, Human
guuuuacaauaaaaucuugaaaa

SEQ ID NO: 1150193 - RNA, 16 nt, Human
aauaaauugcuccuug

SEQ ID NO: 1150194 - RNA, 20 nt, Human
aauaaauugcuccuugacau

SEQ ID NO: 1150195 - RNA, 21 nt, Human
aauaacaaugaaaguugauaa

SEQ ID NO: 1150196 - RNA, 15 nt, Human
aauaacgauaaaaga

SEQ ID NO: 1150197 - RNA, 13 nt, Human
uaaauagaaugua

SEQ ID NO: 1150198 - RNA, 16 nt, Human
uaaauagaauguaaau

SEQ ID NO: 1150199 - RNA, 18 nt, Human
uaaauagaauguaaaugu

SEQ ID NO: 1150200 - RNA, 20 nt, Human
uaaauagaauguaaaugucu

SEQ ID NO: 1150201 - RNA, 18 nt, Human
aauagacccacaagaggc

SEQ ID NO: 1150202 - RNA, 16 nt, Human
aauagaugcugacugu

SEQ ID NO: 1150203 - RNA, 18 nt, Human
aauaggcguaacuaauuu

SEQ ID NO: 1150204 - RNA, 16 nt, Human
uaacuaacuaaaacaa

SEQ ID NO: 1150205 - RNA, 20 nt, Human
uaacuaauacagcugagcua

SEQ ID NO: 1150206 - RNA, 13 nt, Human
uaagaaugaucug

SEQ ID NO: 1150207 - RNA, 17 nt, Human
uaagacauuuuuggaag

SEQ ID NO: 1150208 - RNA, 12 nt, Human
aaucagcauucu

SEQ ID NO: 1150209 - RNA, 15 nt, Human
aaucaucaagucuuu

SEQ ID NO: 1150210 - RNA, 20 nt, Human
aauccucaguuuuugugaaa

SEQ ID NO: 1150211 - RNA, 15 nt, Human
aauccuugaagguau

SEQ ID NO: 1150212 - RNA, 20 nt, Human
aauccuugaagguauaucua

SEQ ID NO: 1150213 - RNA, 14 nt, Human
aaucuuauaauuua

SEQ ID NO: 1150214 - RNA, 16 nt, Human
aaucuuauaauuuaaa

SEQ ID NO: 1150215 - RNA, 15 nt, Human
aaucuuccaauuuag

SEQ ID NO: 1150216 - RNA, 23 nt, Human
aaucuuccaauuuaguuguugua

SEQ ID NO: 1150217 - RNA, 14 nt, Human
uaauaguauaaacc

SEQ ID NO: 1150218 - RNA, 12 nt, Human
uaaucauauaaa

SEQ ID NO: 1150219 - RNA, 13 nt, Human
uaaucauauaaau

SEQ ID NO: 1150220 - RNA, 17 nt, Human
uaaucauauaaauagaa

SEQ ID NO: 1150221 - RNA, 19 nt, Human
uaaucauauaaauagaaug

SEQ ID NO: 1150222 - RNA, 20 nt, Human
uaaucauauaaauagaaugu

SEQ ID NO: 1150223 - RNA, 21 nt, Human
uaaucauauaaauagaaugua

SEQ ID NO: 1150224 - RNA, 13 nt, Human
uaauuccacagcu

SEQ ID NO: 1150225 - RNA, 14 nt, Human
uaauuccacagcug

SEQ ID NO: 1150226 - RNA, 17 nt, Human
uaauuccacagcugcuc

SEQ ID NO: 1150227 - RNA, 14 nt, Human
uacaaggacagccc

SEQ ID NO: 1150228 - RNA, 13 nt, Human
aaugcauaaaaug

SEQ ID NO: 1150229 - RNA, 16 nt, Human
aaugcauaaaauguua

SEQ ID NO: 1150230 - RNA, 19 nt, Human
aauggacuuuuguacauag

SEQ ID NO: 1150231 - RNA, 22 nt, Human
uacaggcgugagccaccgugcc

SEQ ID NO: 1150232 - RNA, 14 nt, Human
uacaggcuccugcc

SEQ ID NO: 1150233 - RNA, 15 nt, Human
uacaggcuccugcca

SEQ ID NO: 1150234 - RNA, 17 nt, Human
uacaggcuccugccacc

SEQ ID NO: 1150235 - RNA, 16 nt, Human
uacauagugcuaacau

SEQ ID NO: 1150236 - RNA, 21 nt, Human
uacauagugcuaacaugaaga

SEQ ID NO: 1150237 - RNA, 22 nt, Human
uacauagugcuaacaugaagac

SEQ ID NO: 1150238 - RNA, 23 nt, Human
uacauagugcuaacaugaagacc

SEQ ID NO: 1150239 - RNA, 14 nt, Human
aauguggcuccugg

SEQ ID NO: 1150240 - RNA, 12 nt, Human
aauugcauuucc

SEQ ID NO: 1150241 - RNA, 16 nt, Human
aauuuaguuguuguag

SEQ ID NO: 1150242 - RNA, 18 nt, Human
aauuuauaccucaauuuu

SEQ ID NO: 1150243 - RNA, 20 nt, Human
aauuuauaccucaauuuuca

SEQ ID NO: 1150244 - RNA, 21 nt, Human
aauuuauaccucaauuuucac

SEQ ID NO: 1150245 - RNA, 15 nt, Human
uacuuaguauugcaa

SEQ ID NO: 1150246 - RNA, 20 nt, Human
uacuuaguauugcaaaguca

SEQ ID NO: 1150247 - RNA, 17 nt, Human
uacuuaguauugcaaag

SEQ ID NO: 1150248 - RNA, 14 nt, Human
uacuuccccuuccu

SEQ ID NO: 1150249 - RNA, 15 nt, Human
uacuuccccuuccua

SEQ ID NO: 1150250 - RNA, 18 nt, Human
uacuuccccuuccuaauu

SEQ ID NO: 1150251 - RNA, 20 nt, Human
uacuuccccuuccuaauucc

SEQ ID NO: 1150252 - RNA, 23 nt, Human
uacuuccugugacuucagcucug

SEQ ID NO: 1150253 - RNA, 23 nt, Human
uacuuugauauuuucaacgcagc

SEQ ID NO: 1150254 - RNA, 18 nt, Human
acaaagccacuuucaauc

SEQ ID NO: 1150255 - RNA, 18 nt, Human
acaaagcccuuccauguc

SEQ ID NO: 1150256 - RNA, 22 nt, Human
uagauaggucagugcaaauacu

SEQ ID NO: 1150257 - RNA, 14 nt, Human
uagaugcugacugu

SEQ ID NO: 1150258 - RNA, 14 nt, Human
acaagacacaguga

SEQ ID NO: 1150259 - RNA, 18 nt, Human
acaagagcuuaacagugu

SEQ ID NO: 1150260 - RNA, 19 nt, Human
acaagagcuuaacagugug

SEQ ID NO: 1150261 - RNA, 17 nt, Human
acaagcuccauuuaaac

SEQ ID NO: 1150262 - RNA, 18 nt, Human
acaagcuccauuuaaaca

SEQ ID NO: 1150263 - RNA, 22 nt, Human
acaauaaaaguguccauugaaa

SEQ ID NO: 1150264 - RNA, 18 nt, Human
acaaucucggcucacugc

SEQ ID NO: 1150265 - RNA, 20 nt, Human
acaaucucggcucacugcau

SEQ ID NO: 1150266 - RNA, 16 nt, Human
uagcuacuaauuuuaa

SEQ ID NO: 1150267 - RNA, 14 nt, Human
uagcuuauguuaac

SEQ ID NO: 1150268 - RNA, 17 nt, Human
acacagugaccauacua

SEQ ID NO: 1150269 - RNA, 17 nt, Human
uagguuuaugacaguaa

SEQ ID NO: 1150270 - RNA, 19 nt, Human
uagguuuaugacaguaauu

SEQ ID NO: 1150271 - RNA, 20 nt, Human
uagguuuaugacaguaauug

SEQ ID NO: 1150272 - RNA, 21 nt, Human
uagguuuaugacaguaauugu

SEQ ID NO: 1150273 - RNA, 12 nt, Human
uaguaauaccuc

SEQ ID NO: 1150274 - RNA, 13 nt, Human
uaguaauaccucu

SEQ ID NO: 1150275 - RNA, 15 nt, Human
uaguaauaccucuaa

SEQ ID NO: 1150276 - RNA, 14 nt, Human
uaguagagacaggg

SEQ ID NO: 1150277 - RNA, 11 nt, Human
uaguuaucaug

SEQ ID NO: 1150278 - RNA, 12 nt, Human
uaguuaucaugu

SEQ ID NO: 1150279 - RNA, 13 nt, Human
uaguuaucauguu

SEQ ID NO: 1150280 - RNA, 14 nt, Human
uaguuaucauguua

SEQ ID NO: 1150281 - RNA, 15 nt, Human
uaguuaucauguuag

SEQ ID NO: 1150282 - RNA, 16 nt, Human
uaguuaucauguuagu

SEQ ID NO: 1150283 - RNA, 23 nt, Human
uaguuaucauguuaguaauaccu

SEQ ID NO: 1150284 - RNA, 18 nt, Human
uaguuuugucacaauuau

SEQ ID NO: 1150285 - RNA, 19 nt, Human
uauaacuauguugauaaaa

SEQ ID NO: 1150286 - RNA, 21 nt, Human
uauaagggaaguaguuaucau

SEQ ID NO: 1150287 - RNA, 24 nt, Human
uauaagggaaguaguuaucauguu

SEQ ID NO: 1150288 - RNA, 22 nt, Human
uauaagggcaaauuggagaaaa

SEQ ID NO: 1150289 - RNA, 20 nt, Human
acacuuguugauuaauggaa

SEQ ID NO: 1150290 - RNA, 23 nt, Human
acacuuguugauuaauggaaaug

SEQ ID NO: 1150291 - RNA, 12 nt, Human
uauauuuacaaa

SEQ ID NO: 1150292 - RNA, 14 nt, Human
uauauuuacaaaug

SEQ ID NO: 1150293 - RNA, 16 nt, Human
uaucccggcugcccuu

SEQ ID NO: 1150294 - RNA, 14 nt, Human
uauccuacuucccc

SEQ ID NO: 1150295 - RNA, 17 nt, Human
uauccuacuuccccuuc

SEQ ID NO: 1150296 - RNA, 14 nt, Human
acagauguccauca

SEQ ID NO: 1150297 - RNA, 16 nt, Human
acagauguccaucaga

SEQ ID NO: 1150298 - RNA, 22 nt, Human
acagauguccaucagaugacaa

SEQ ID NO: 1150299 - RNA, 21 nt, Human
acagauguccaucagaugaca

SEQ ID NO: 1150300 - RNA, 23 nt, Human
acagcccuccaucuaaacugccc

SEQ ID NO: 1150301 - RNA, 20 nt, Human
uaugaaagauggcugugccu

SEQ ID NO: 1150302 - RNA, 22 nt, Human
uaugaaagauggcugugccucu

SEQ ID NO: 1150303 - RNA, 23 nt, Human
uaugaaagauggcugugccucug

SEQ ID NO: 1150304 - RNA, 13 nt, Human
uauuuccacuucu

SEQ ID NO: 1150305 - RNA, 15 nt, Human
uauuucccaugauuu

SEQ ID NO: 1150306 - RNA, 16 nt, Human
uauuucccaugauuuc

SEQ ID NO: 1150307 - RNA, 18 nt, Human
uauuucccaugauuucau

SEQ ID NO: 1150308 - RNA, 21 nt, Human
uauuucccaugauuucaugua

SEQ ID NO: 1150309 - RNA, 15 nt, Human
uauuucccuacauua

SEQ ID NO: 1150310 - RNA, 16 nt, Human
uauuucccuacauuaa

SEQ ID NO: 1150311 - RNA, 17 nt, Human
uauuucccuacauuaaa

SEQ ID NO: 1150312 - RNA, 22 nt, Human
uauuucccuacauuaaacauga

SEQ ID NO: 1150313 - RNA, 15 nt, Human
uauuuccuaugaugu

SEQ ID NO: 1150314 - RNA, 16 nt, Human
uauuuccuaugaugua

SEQ ID NO: 1150315 - RNA, 17 nt, Human
uauuuccuaugauguau

SEQ ID NO: 1150316 - RNA, 13 nt, Human
acaguugcacagc

SEQ ID NO: 1150317 - RNA, 14 nt, Human
acaguugcacagca

SEQ ID NO: 1150318 - RNA, 15 nt, Human
acaguugcacagcau

SEQ ID NO: 1150319 - RNA, 19 nt, Human
acaguugcacagcaucuca

SEQ ID NO: 1150320 - RNA, 23 nt, Human
acaguugcacagcaucucagcuc

SEQ ID NO: 1150321 - RNA, 20 nt, Human
acaguugcacagcaucucag

SEQ ID NO: 1150322 - RNA, 14 nt, Human
acauacauuuugua

SEQ ID NO: 1150323 - RNA, 16 nt, Human
acauagugaugguucc

SEQ ID NO: 1150324 - RNA, 21 nt, Human
acauagugaugguuccccugu

SEQ ID NO: 1150325 - RNA, 20 nt, Human
acauagugcuaacaugaaga

SEQ ID NO: 1150326 - RNA, 21 nt, Human
uauuuuuaucaguuacacaug

SEQ ID NO: 1150327 - RNA, 14 nt, Human
ucaaaaugcucuua

SEQ ID NO: 1150328 - RNA, 16 nt, Human
ucaaaaugcucuuauu

SEQ ID NO: 1150329 - RNA, 19 nt, Human
ucaaaaugcucuuauuuca

SEQ ID NO: 1150330 - RNA, 20 nt, Human
ucaaaaugcucuuauuucau

SEQ ID NO: 1150331 - RNA, 22 nt, Human
ucaaaaugcucuuauuucauca

SEQ ID NO: 1150332 - RNA, 21 nt, Human
ucaaaaugcucuuauuucauc

SEQ ID NO: 1150333 - RNA, 14 nt, Human
ucaaagcugaaaug

SEQ ID NO: 1150334 - RNA, 13 nt, Human
acaugaagaccuu

SEQ ID NO: 1150335 - RNA, 14 nt, Human
acaugaagaccuuu

SEQ ID NO: 1150336 - RNA, 20 nt, Human
acaugaagaccuuuuucugc

SEQ ID NO: 1150337 - RNA, 21 nt, Human
acaugaagaccuuuuucugca

SEQ ID NO: 1150338 - RNA, 18 nt, Human
acauuagcaguuugcuuu

SEQ ID NO: 1150339 - RNA, 22 nt, Human
acauuagcaguuugcuuuguau

SEQ ID NO: 1150340 - RNA, 13 nt, Human
ucaagauucagcu

SEQ ID NO: 1150341 - RNA, 14 nt, Human
ucaagauucagcua

SEQ ID NO: 1150342 - RNA, 15 nt, Human
ucaagauucagcuag

SEQ ID NO: 1150343 - RNA, 19 nt, Human
ucaagggcagcuuugcuca

SEQ ID NO: 1150344 - RNA, 20 nt, Human
ucaagggcagcuuugcucau

SEQ ID NO: 1150345 - RNA, 21 nt, Human
ucaagggcagcuuugcucaua

SEQ ID NO: 1150346 - RNA, 23 nt, Human
ucaagggcagcuuugcucauauu

SEQ ID NO: 1150347 - RNA, 17 nt, Human
ucaagugauucucaugc

SEQ ID NO: 1150348 - RNA, 20 nt, Human
ucaagugauucucaugccuc

SEQ ID NO: 1150349 - RNA, 23 nt, Human
accaauuauaagggcaaauugga

SEQ ID NO: 1150350 - RNA, 14 nt, Human
accacacuccagcu

SEQ ID NO: 1150351 - RNA, 15 nt, Human
ucaauucuugccaaa

SEQ ID NO: 1150352 - RNA, 15 nt, Human
ucaauuuucacugug

SEQ ID NO: 1150353 - RNA, 16 nt, Human
ucaauuuucacugugu

SEQ ID NO: 1150354 - RNA, 16 nt, Human
ucacaacaaccugguc

SEQ ID NO: 1150355 - RNA, 22 nt, Human
ucacacgucuggcuucacagau

SEQ ID NO: 1150356 - RNA, 17 nt, Human
accacugcucugaugaa

SEQ ID NO: 1150357 - RNA, 23 nt, Human
accacugcucugaugaagaggag

SEQ ID NO: 1150358 - RNA, 14 nt, Human
accagccuccaugc

SEQ ID NO: 1150359 - RNA, 19 nt, Human
accagccuccaugcugccu

SEQ ID NO: 1150360 - RNA, 20 nt, Human
accagccuccaugcugccuc

SEQ ID NO: 1150361 - RNA, 21 nt, Human
accagccuccaugcugccucc

SEQ ID NO: 1150362 - RNA, 15 nt, Human
ucacuacucagcaug

SEQ ID NO: 1150363 - RNA, 14 nt, Human
ucacuacucagcau

SEQ ID NO: 1150364 - RNA, 15 nt, Human
ucacuccuaccuggu

SEQ ID NO: 1150365 - RNA, 12 nt, Human
accauuccccau

SEQ ID NO: 1150366 - RNA, 23 nt, Human
accauuucuugagguaaaagcau

SEQ ID NO: 1150367 - RNA, 19 nt, Human
ucagaaguuucucagcucc

SEQ ID NO: 1150368 - RNA, 13 nt, Human
ucagcucacugca

SEQ ID NO: 1150369 - RNA, 16 nt, Human
ucagcucacugcaacc

SEQ ID NO: 1150370 - RNA, 16 nt, Human
accgcguaaugcgcca

SEQ ID NO: 1150371 - RNA, 16 nt, Human
accuaccaccacgccc

SEQ ID NO: 1150372 - RNA, 20 nt, Human
accuaccaccacgcccggcu

SEQ ID NO: 1150373 - RNA, 18 nt, Human
uccaaucccaccaacccu

SEQ ID NO: 1150374 - RNA, 21 nt, Human
accuggucacaggacucugcc

SEQ ID NO: 1150375 - RNA, 22 nt, Human
accuggucacaggacucugccu

SEQ ID NO: 1150376 - RNA, 16 nt, Human
uccaccuucccaugcc

SEQ ID NO: 1150377 - RNA, 18 nt, Human
uccaccuucccaugcccu

SEQ ID NO: 1150378 - RNA, 19 nt, Human
uccaccuucccaugcccug

SEQ ID NO: 1150379 - RNA, 13 nt, Human
uccacugccuucg

SEQ ID NO: 1150380 - RNA, 15 nt, Human
uccacugccuucgau

SEQ ID NO: 1150381 - RNA, 22 nt, Human
uccacugccuucgauacaccgg

SEQ ID NO: 1150382 - RNA, 15 nt, Human
uccagagaguggcuc

SEQ ID NO: 1150383 - RNA, 16 nt, Human
uccagagaguggcucc

SEQ ID NO: 1150384 - RNA, 17 nt, Human
uccagagaguggcuccu

SEQ ID NO: 1150385 - RNA, 19 nt, Human
uccagagaguggcuccucc

SEQ ID NO: 1150386 - RNA, 21 nt, Human
acgagaaccugaaggggaagg

SEQ ID NO: 1150387 - RNA, 16 nt, Human
uccaucuaaacugccc

SEQ ID NO: 1150388 - RNA, 18 nt, Human
uccaucuaaacugccccc

SEQ ID NO: 1150389 - RNA, 17 nt, Human
uccccaugucucgacuc

SEQ ID NO: 1150390 - RNA, 12 nt, Human
acuacucagcau

SEQ ID NO: 1150391 - RNA, 13 nt, Human
acuacucagcaug

SEQ ID NO: 1150392 - RNA, 17 nt, Human
acuacucagcauggaaa

SEQ ID NO: 1150393 - RNA, 20 nt, Human
ucccgaguagcugagauuau

SEQ ID NO: 1150394 - RNA, 13 nt, Human
ucccggcugcccu

SEQ ID NO: 1150395 - RNA, 14 nt, Human
ucccggcugcccuu

SEQ ID NO: 1150396 - RNA, 15 nt, Human
ucccggcugcccuuu

SEQ ID NO: 1150397 - RNA, 18 nt, Human
ucccggcugcccuuucug

SEQ ID NO: 1150398 - RNA, 22 nt, Human
ucccggcugcccuuucugggca

SEQ ID NO: 1150399 - RNA, 13 nt, Human
acuccagaccccu

SEQ ID NO: 1150400 - RNA, 13 nt, Human
acuccucugucca

SEQ ID NO: 1150401 - RNA, 14 nt, Human
acuccucuguccag

SEQ ID NO: 1150402 - RNA, 13 nt, Human
uccgggaccccca

SEQ ID NO: 1150403 - RNA, 16 nt, Human
uccgggacccccagga

SEQ ID NO: 1150404 - RNA, 18 nt, Human
uccgggacccccaggaca

SEQ ID NO: 1150405 - RNA, 14 nt, Human
uccuacuuccccuu

SEQ ID NO: 1150406 - RNA, 17 nt, Human
acugcauccuccgccuc

SEQ ID NO: 1150407 - RNA, 20 nt, Human
acugcauccuccgccucccg

SEQ ID NO: 1150408 - RNA, 23 nt, Human
acugcauccuccgccucccgggu

SEQ ID NO: 1150409 - RNA, 14 nt, Human
acugcauuauuuga

SEQ ID NO: 1150410 - RNA, 17 nt, Human
acugcauuauuugagaa

SEQ ID NO: 1150411 - RNA, 14 nt, Human
acugccucuuccuc

SEQ ID NO: 1150412 - RNA, 15 nt, Human
acugccucuuccucc

SEQ ID NO: 1150413 - RNA, 15 nt, Human
acugcuggcugccuu

SEQ ID NO: 1150414 - RNA, 14 nt, Human
acuggccucugcug

SEQ ID NO: 1150415 - RNA, 16 nt, Human
acuggccucugcugau

SEQ ID NO: 1150416 - RNA, 14 nt, Human
ucgacuguuguuau

SEQ ID NO: 1150417 - RNA, 17 nt, Human
ucgacuguuguuaucug

SEQ ID NO: 1150418 - RNA, 15 nt, Human
ucgacuguuguuauc

SEQ ID NO: 1150419 - RNA, 18 nt, Human
ucgcuauugucaccaggg

SEQ ID NO: 1150420 - RNA, 13 nt, Human
acugugcuguugu

SEQ ID NO: 1150421 - RNA, 14 nt, Human
acugugcuguuguu

SEQ ID NO: 1150422 - RNA, 18 nt, Human
acugugcuguuguuauga

SEQ ID NO: 1150423 - RNA, 23 nt, Human
acugugcuguuguuaugaugugc

SEQ ID NO: 1150424 - RNA, 22 nt, Human
acugugcuguuguuaugaugug

SEQ ID NO: 1150425 - RNA, 21 nt, Human
acuguguccaggugguacuuu

SEQ ID NO: 1150426 - RNA, 18 nt, Human
ucggcucacugcauccuc

SEQ ID NO: 1150427 - RNA, 22 nt, Human
ucgggcagcacaaguguaauga

SEQ ID NO: 1150428 - RNA, 21 nt, Human
ucgggcagcacaaguguaaug

SEQ ID NO: 1150429 - RNA, 17 nt, Human
ucguuugaaucacagua

SEQ ID NO: 1150430 - RNA, 20 nt, Human
ucuaaagccauuguaguccu

SEQ ID NO: 1150431 - RNA, 17 nt, Human
ucuaccaaccuguucaa

SEQ ID NO: 1150432 - RNA, 20 nt, Human
acuuaccgcguaaugcgcca

SEQ ID NO: 1150433 - RNA, 16 nt, Human
acuuagaaauugcauu

SEQ ID NO: 1150434 - RNA, 19 nt, Human
acuuaguauugcaaaguca

SEQ ID NO: 1150435 - RNA, 20 nt, Human
acuuaguauugcaaagucag

SEQ ID NO: 1150436 - RNA, 14 nt, Human
acuucagcucuguu

SEQ ID NO: 1150437 - RNA, 14 nt, Human
acuucaggcucuuc

SEQ ID NO: 1150438 - RNA, 16 nt, Human
acuucaggcucuucuc

SEQ ID NO: 1150439 - RNA, 16 nt, Human
ucuauuucauaccaug

SEQ ID NO: 1150440 - RNA, 15 nt, Human
acuuccugugacuuc

SEQ ID NO: 1150441 - RNA, 17 nt, Human
acuucguuuaaugaaug

SEQ ID NO: 1150442 - RNA, 20 nt, Human
acuucguuuaaugaaugcuu

SEQ ID NO: 1150443 - RNA, 18 nt, Human
acuucguuuaaugaaugc

SEQ ID NO: 1150444 - RNA, 16 nt, Human
ucucagcucaucuuca

SEQ ID NO: 1150445 - RNA, 20 nt, Human
ucucagcucaucuucacugc

SEQ ID NO: 1150446 - RNA, 15 nt, Human
ucugaagucacugca

SEQ ID NO: 1150447 - RNA, 16 nt, Human
ucugaagucacugcac

SEQ ID NO: 1150448 - RNA, 18 nt, Human
ucugaagucacugcacag

SEQ ID NO: 1150449 - RNA, 15 nt, Human
ucugacaacagacuu

SEQ ID NO: 1150450 - RNA, 16 nt, Human
ucugacaacagacuuc

SEQ ID NO: 1150451 - RNA, 22 nt, Human
ucuggguuccuuccucugagcc

SEQ ID NO: 1150452 - RNA, 23 nt, Human
ucuggguuccuuccucugagccu

SEQ ID NO: 1150453 - RNA, 15 nt, Human
ucuguacugauucaa

SEQ ID NO: 1150454 - RNA, 16 nt, Human
ucuguacugauucaau

SEQ ID NO: 1150455 - RNA, 17 nt, Human
ucuguacugauucaauu

SEQ ID NO: 1150456 - RNA, 23 nt, Human
ucuguacugauucaauuugaugu

SEQ ID NO: 1150457 - RNA, 17 nt, Human
ucuguucugcacacagc

SEQ ID NO: 1150458 - RNA, 18 nt, Human
ucuguucugcacacagca

SEQ ID NO: 1150459 - RNA, 19 nt, Human
ucuguucugcacacagcac

SEQ ID NO: 1150460 - RNA, 13 nt, Human
ucuuaauguacau

SEQ ID NO: 1150461 - RNA, 14 nt, Human
ucuuaauguacaua

SEQ ID NO: 1150462 - RNA, 19 nt, Human
ucuuaauguacauagugcu

SEQ ID NO: 1150463 - RNA, 16 nt, Human
ucuucuuaauguacau

SEQ ID NO: 1150464 - RNA, 24 nt, Human
ucuucuuaauguacauagugcuaa

SEQ ID NO: 1150465 - RNA, 17 nt, Human
ucuucuuaauguacaua

SEQ ID NO: 1150466 - RNA, 15 nt, Human
agaccccuggcuuuu

SEQ ID NO: 1150467 - RNA, 21 nt, Human
agaccccuggcuuuucacugc

SEQ ID NO: 1150468 - RNA, 16 nt, Human
agaccugccccuccuc

SEQ ID NO: 1150469 - RNA, 22 nt, Human
agaccugccccuccucucugcc

SEQ ID NO: 1150470 - RNA, 23 nt, Human
agaccugccccuccucucugccc

SEQ ID NO: 1150471 - RNA, 21 nt, Human
agacucaguggggaggggcug

SEQ ID NO: 1150472 - RNA, 18 nt, Human
ucuugaguuuuucaggua

SEQ ID NO: 1150473 - RNA, 14 nt, Human
ucuuucuuccucug

SEQ ID NO: 1150474 - RNA, 15 nt, Human
ucuuucuuccucugc

SEQ ID NO: 1150475 - RNA, 16 nt, Human
ucuuucuuccucugcu

SEQ ID NO: 1150476 - RNA, 17 nt, Human
ucuuucuuccucugcug

SEQ ID NO: 1150477 - RNA, 14 nt, Human
agacugucucaaga

SEQ ID NO: 1150478 - RNA, 15 nt, Human
agacuuacagcaaau

SEQ ID NO: 1150479 - RNA, 18 nt, Human
agacuuacagcaaauccu

SEQ ID NO: 1150480 - RNA, 20 nt, Human
agacuuacagcaaauccuuu

SEQ ID NO: 1150481 - RNA, 18 nt, Human
agacuuguaugaaagaug

SEQ ID NO: 1150482 - RNA, 19 nt, Human
agacuuuuuuuaaauagua

SEQ ID NO: 1150483 - RNA, 15 nt, Human
ugaaauuguauuaca

SEQ ID NO: 1150484 - RNA, 15 nt, Human
agagcuuaacagugu

SEQ ID NO: 1150485 - RNA, 13 nt, Human
agaggcugaggac

SEQ ID NO: 1150486 - RNA, 19 nt, Human
agagguccacaacacacag

SEQ ID NO: 1150487 - RNA, 15 nt, Human
agcaggcugugaguu

SEQ ID NO: 1150488 - RNA, 18 nt, Human
agcagguugauaaaucau

SEQ ID NO: 1150489 - RNA, 14 nt, Human
agcaguuugcuuug

SEQ ID NO: 1150490 - RNA, 14 nt, Human
ugaucaccugcccu

SEQ ID NO: 1150491 - RNA, 17 nt, Human
agcauuagauuucucau

SEQ ID NO: 1150492 - RNA, 18 nt, Human
agcauucucacuccuacc

SEQ ID NO: 1150493 - RNA, 20 nt, Human
agcauucucacuccuaccug

SEQ ID NO: 1150494 - RNA, 22 nt, Human
agcauucucacuccuaccuggu

SEQ ID NO: 1150495 - RNA, 15 nt, Human
agcauuuucugcauc

SEQ ID NO: 1150496 - RNA, 18 nt, Human
agcauuuucugcaucucc

SEQ ID NO: 1150497 - RNA, 19 nt, Human
agcauuuucugcaucucca

SEQ ID NO: 1150498 - RNA, 20 nt, Human
agcauuuucugcaucuccac

SEQ ID NO: 1150499 - RNA, 18 nt, Human
agccaaacauccuacaag

SEQ ID NO: 1150500 - RNA, 13 nt, Human
agccaccacgccc

SEQ ID NO: 1150501 - RNA, 18 nt, Human
ugauccacucgccuucau

SEQ ID NO: 1150502 - RNA, 22 nt, Human
ugauccuaaugaaugcauaaaa

SEQ ID NO: 1150503 - RNA, 18 nt, Human
ugaugaaauguaaauacu

SEQ ID NO: 1150504 - RNA, 19 nt, Human
ugauggguuaguggaugga

SEQ ID NO: 1150505 - RNA, 23 nt, Human
ugauggguuaguggauggaaggg

SEQ ID NO: 1150506 - RNA, 12 nt, Human
ugauuuggaaaa

SEQ ID NO: 1150507 - RNA, 14 nt, Human
ugcaaagcccagcu

SEQ ID NO: 1150508 - RNA, 15 nt, Human
ugcaaagcccagcuu

SEQ ID NO: 1150509 - RNA, 17 nt, Human
ugcaaagcccagcuuga

SEQ ID NO: 1150510 - RNA, 18 nt, Human
ugcaaagucaggaaucau

SEQ ID NO: 1150511 - RNA, 17 nt, Human
ugcaaagucaggaauca

SEQ ID NO: 1150512 - RNA, 23 nt, Human
ugcaaaguucccuacuuccugug

SEQ ID NO: 1150513 - RNA, 21 nt, Human
ugcaguaucggcacuguacaa

SEQ ID NO: 1150514 - RNA, 20 nt, Human
ugcaguaucggcacuguaca

SEQ ID NO: 1150515 - RNA, 13 nt, Human
ugcaucucagccc

SEQ ID NO: 1150516 - RNA, 14 nt, Human
ugcaucucagccca

SEQ ID NO: 1150517 - RNA, 15 nt, Human
ugcaucucagcccac

SEQ ID NO: 1150518 - RNA, 16 nt, Human
agccuugggaccccug

SEQ ID NO: 1150519 - RNA, 13 nt, Human
agcuccaucucca

SEQ ID NO: 1150520 - RNA, 15 nt, Human
agcuccaucuccacu

SEQ ID NO: 1150521 - RNA, 16 nt, Human
agcuccaucuccacuc

SEQ ID NO: 1150522 - RNA, 21 nt, Human
agcuccaucuccacuccagau

SEQ ID NO: 1150523 - RNA, 12 nt, Human
ugccucugccug

SEQ ID NO: 1150524 - RNA, 18 nt, Human
agcuggccgggagccuga

SEQ ID NO: 1150525 - RNA, 19 nt, Human
agcuggccgggagccugau

SEQ ID NO: 1150526 - RNA, 14 nt, Human
ugccuguucccauu

SEQ ID NO: 1150527 - RNA, 13 nt, Human
agcuuaacagugu

SEQ ID NO: 1150528 - RNA, 22 nt, Human
agcuuuccccaugucucgacuc

SEQ ID NO: 1150529 - RNA, 13 nt, Human
agcuuugcucaua

SEQ ID NO: 1150530 - RNA, 19 nt, Human
agcuuugcucauauuuccc

SEQ ID NO: 1150531 - RNA, 20 nt, Human
agcuuugcucauauuuccca

SEQ ID NO: 1150532 - RNA, 21 nt, Human
agcuuugcucauauuucccau

SEQ ID NO: 1150533 - RNA, 13 nt, Human
ugcucaacuugca

SEQ ID NO: 1150534 - RNA, 16 nt, Human
ugcucaacuugcaaaa

SEQ ID NO: 1150535 - RNA, 20 nt, Human
ugcucaacuugcaaaaucag

SEQ ID NO: 1150536 - RNA, 17 nt, Human
ugcucaacuugcaaaau

SEQ ID NO: 1150537 - RNA, 13 nt, Human
ugcucuuauuuca

SEQ ID NO: 1150538 - RNA, 14 nt, Human
ugcucuuauuucau

SEQ ID NO: 1150539 - RNA, 15 nt, Human
ugcucuugaacuccu

SEQ ID NO: 1150540 - RNA, 20 nt, Human
ugcucuugaacuccugaccu

SEQ ID NO: 1150541 - RNA, 22 nt, Human
ugcucuugaacuccugaccuca

SEQ ID NO: 1150542 - RNA, 18 nt, Human
aggaagcagcuuucccca

SEQ ID NO: 1150543 - RNA, 15 nt, Human
aggaaggcugagagg

SEQ ID NO: 1150544 - RNA, 15 nt, Human
aggacuaggguccug

SEQ ID NO: 1150545 - RNA, 16 nt, Human
aggacuaggguccugg

SEQ ID NO: 1150546 - RNA, 18 nt, Human
aggacuaggguccugggg

SEQ ID NO: 1150547 - RNA, 19 nt, Human
aggacuaggguccugggga

SEQ ID NO: 1150548 - RNA, 12 nt, Human
aggacucugccu

SEQ ID NO: 1150549 - RNA, 13 nt, Human
aggacucugccuc

SEQ ID NO: 1150550 - RNA, 14 nt, Human
aggacucugccucc

SEQ ID NO: 1150551 - RNA, 16 nt, Human
aggacucugccuccuc

SEQ ID NO: 1150552 - RNA, 17 nt, Human
aggacucugccuccucu

SEQ ID NO: 1150553 - RNA, 18 nt, Human
aggacucugccuccucuu

SEQ ID NO: 1150554 - RNA, 19 nt, Human
aggacucugccuccucuuc

SEQ ID NO: 1150555 - RNA, 14 nt, Human
ugcuuugggcugcc

SEQ ID NO: 1150556 - RNA, 15 nt, Human
ugcuuugggcugccc

SEQ ID NO: 1150557 - RNA, 16 nt, Human
ugcuuugggcugcccu

SEQ ID NO: 1150558 - RNA, 17 nt, Human
ugcuuugggcugcccug

SEQ ID NO: 1150559 - RNA, 17 nt, Human
uggagccaauggagacu

SEQ ID NO: 1150560 - RNA, 14 nt, Human
uggaguugaaaauc

SEQ ID NO: 1150561 - RNA, 13 nt, Human
uggauggaagggg

SEQ ID NO: 1150562 - RNA, 20 nt, Human
uggauuggacaaaaugacuu

SEQ ID NO: 1150563 - RNA, 13 nt, Human
uggauuggacaaa

SEQ ID NO: 1150564 - RNA, 15 nt, Human
uggauuggacaaaau

SEQ ID NO: 1150565 - RNA, 19 nt, Human
uggauuggacaaaaugacu

SEQ ID NO: 1150566 - RNA, 13 nt, Human
aggcccggccucu

SEQ ID NO: 1150567 - RNA, 14 nt, Human
aggcccggccucuc

SEQ ID NO: 1150568 - RNA, 15 nt, Human
aggcccggccucuca

SEQ ID NO: 1150569 - RNA, 18 nt, Human
agggaacgugauuaguga

SEQ ID NO: 1150570 - RNA, 13 nt, Human
agggaaggggaca

SEQ ID NO: 1150571 - RNA, 22 nt, Human
agggaaggggacaaggacuagg

SEQ ID NO: 1150572 - RNA, 15 nt, Human
agggaaguaguuauc

SEQ ID NO: 1150573 - RNA, 17 nt, Human
agggaaguaguuaucau

SEQ ID NO: 1150574 - RNA, 20 nt, Human
agggaaguaguuaucauguu

SEQ ID NO: 1150575 - RNA, 21 nt, Human
agggaauuucuucaacucccu

SEQ ID NO: 1150576 - RNA, 13 nt, Human
ugggacuggccuc

SEQ ID NO: 1150577 - RNA, 18 nt, Human
ugggagacugcugaguca

SEQ ID NO: 1150578 - RNA, 18 nt, Human
ugggccccaguuguauuu

SEQ ID NO: 1150579 - RNA, 22 nt, Human
ugggccccaguuguauuuauuu

SEQ ID NO: 1150580 - RNA, 14 nt, Human
agggcacugguggc

SEQ ID NO: 1150581 - RNA, 16 nt, Human
agggcacugguggccc

SEQ ID NO: 1150582 - RNA, 17 nt, Human
agggcacugguggcccg

SEQ ID NO: 1150583 - RNA, 17 nt, Human
agggcagcuuugcucau

SEQ ID NO: 1150584 - RNA, 16 nt, Human
agggcagcuuugcuca

SEQ ID NO: 1150585 - RNA, 17 nt, Human
agggcauggccaggugg

SEQ ID NO: 1150586 - RNA, 15 nt, Human
uggggaggggcugug

SEQ ID NO: 1150587 - RNA, 21 nt, Human
aggggaauaaacuguugaguc

SEQ ID NO: 1150588 - RNA, 18 nt, Human
aggguaacuaacuaaaac

SEQ ID NO: 1150589 - RNA, 17 nt, Human
ugguagcuuuucccuuc

SEQ ID NO: 1150590 - RNA, 15 nt, Human
uggugccuaguauug

SEQ ID NO: 1150591 - RNA, 19 nt, Human
uggugccuaguauugacaa

SEQ ID NO: 1150592 - RNA, 22 nt, Human
uggugccuaguauugacaaaau

SEQ ID NO: 1150593 - RNA, 24 nt, Human
uggugccuaguauugacaaaaugu

SEQ ID NO: 1150594 - RNA, 13 nt, Human
uggugcugccaca

SEQ ID NO: 1150595 - RNA, 18 nt, Human
uggugcugccacacuuca

SEQ ID NO: 1150596 - RNA, 21 nt, Human
ugguggagaggcccggccucu

SEQ ID NO: 1150597 - RNA, 12 nt, Human
ugguuuccugcc

SEQ ID NO: 1150598 - RNA, 13 nt, Human
ugguuuccugccc

SEQ ID NO: 1150599 - RNA, 14 nt, Human
ugguuuccugcccu

SEQ ID NO: 1150600 - RNA, 15 nt, Human
ugguuuccugcccug

SEQ ID NO: 1150601 - RNA, 20 nt, Human
ugguuuccugcccugggagg

SEQ ID NO: 1150602 - RNA, 19 nt, Human
uguaaauaaagaacuagca

SEQ ID NO: 1150603 - RNA, 12 nt, Human
agguuuaugaca

SEQ ID NO: 1150604 - RNA, 16 nt, Human
agguuuaugacaguaa

SEQ ID NO: 1150605 - RNA, 14 nt, Human
agguuuaugacagu

SEQ ID NO: 1150606 - RNA, 14 nt, Human
uguagagcuucugg

SEQ ID NO: 1150607 - RNA, 13 nt, Human
aguaaaauccaca

SEQ ID NO: 1150608 - RNA, 12 nt, Human
aguagagacagg

SEQ ID NO: 1150609 - RNA, 13 nt, Human
uguaucaaaaugc

SEQ ID NO: 1150610 - RNA, 14 nt, Human
uguaucaaaaugcu

SEQ ID NO: 1150611 - RNA, 15 nt, Human
uguaucaaaaugcuc

SEQ ID NO: 1150612 - RNA, 18 nt, Human
uguaucaaaaugcucuua

SEQ ID NO: 1150613 - RNA, 23 nt, Human
uguaucaaaaugcucuuauuuca

SEQ ID NO: 1150614 - RNA, 13 nt, Human
uguauuacaaauc

SEQ ID NO: 1150615 - RNA, 22 nt, Human
uguauuacaaauccaaugaaau

SEQ ID NO: 1150616 - RNA, 21 nt, Human
ugucaagggcagcuuugcuca

SEQ ID NO: 1150617 - RNA, 22 nt, Human
ugucaagggcagcuuugcucau

SEQ ID NO: 1150618 - RNA, 23 nt, Human
ugucaagggcagcuuugcucaua

SEQ ID NO: 1150619 - RNA, 12 nt, Human
aguauugacaaa

SEQ ID NO: 1150620 - RNA, 13 nt, Human
aguauugacaaaa

SEQ ID NO: 1150621 - RNA, 14 nt, Human
aguauugacaaaau

SEQ ID NO: 1150622 - RNA, 15 nt, Human
aguauugacaaaaug

SEQ ID NO: 1150623 - RNA, 16 nt, Human
aguauugacaaaaugu

SEQ ID NO: 1150624 - RNA, 17 nt, Human
aguauugacaaaauguu

SEQ ID NO: 1150625 - RNA, 18 nt, Human
aguauugacaaaauguua

SEQ ID NO: 1150626 - RNA, 21 nt, Human
aguauugacaaaauguuauuu

SEQ ID NO: 1150627 - RNA, 19 nt, Human
aguauugacaaaauguuau

SEQ ID NO: 1150628 - RNA, 20 nt, Human
aguauugacaaaauguuauu

SEQ ID NO: 1150629 - RNA, 13 nt, Human
agucucuucucca

SEQ ID NO: 1150630 - RNA, 14 nt, Human
agucucuucuccac

SEQ ID NO: 1150631 - RNA, 15 nt, Human
agucucuucuccacu

SEQ ID NO: 1150632 - RNA, 16 nt, Human
agucucuucuccacug

SEQ ID NO: 1150633 - RNA, 18 nt, Human
agucucuucuccacugga

SEQ ID NO: 1150634 - RNA, 17 nt, Human
agucucuucuccacugg

SEQ ID NO: 1150635 - RNA, 15 nt, Human
agugaaagaaaauaa

SEQ ID NO: 1150636 - RNA, 17 nt, Human
agugaaagaaaauaaca

SEQ ID NO: 1150637 - RNA, 20 nt, Human
agugaaaggaagauaaacgu

SEQ ID NO: 1150638 - RNA, 14 nt, Human
agugagggauuauc

SEQ ID NO: 1150639 - RNA, 15 nt, Human
uguggguuuuuauuu

SEQ ID NO: 1150640 - RNA, 11 nt, Human
ugugugugugc

SEQ ID NO: 1150641 - RNA, 13 nt, Human
uguuuggagacag

SEQ ID NO: 1150642 - RNA, 15 nt, Human
aguucuucgacuguu

SEQ ID NO: 1150643 - RNA, 17 nt, Human
aguucuucgacuguugu

SEQ ID NO: 1150644 - RNA, 18 nt, Human
aguucuucgacuguuguu

SEQ ID NO: 1150645 - RNA, 19 nt, Human
aguucuucgacuguuguua

SEQ ID NO: 1150646 - RNA, 22 nt, Human
aguugcauagguuuaauaauuu

SEQ ID NO: 1150647 - RNA, 23 nt, Human
aguugcugcuucaauuuauaccu

SEQ ID NO: 1150648 - RNA, 13 nt, Human
aguuggcuucuaa

SEQ ID NO: 1150649 - RNA, 21 nt, Human
uuaaaaaccuguucaagucua

SEQ ID NO: 1150650 - RNA, 18 nt, Human
uuaaaaaccuguucaagu

SEQ ID NO: 1150651 - RNA, 16 nt, Human
auaaaauuaaagcuga

SEQ ID NO: 1150652 - RNA, 12 nt, Human
auaaaauuauag

SEQ ID NO: 1150653 - RNA, 17 nt, Human
auaaaauuauagcucua

SEQ ID NO: 1150654 - RNA, 21 nt, Human
auaaaauuauagcucuaaugu

SEQ ID NO: 1150655 - RNA, 19 nt, Human
auaaaauuauagcucuaau

SEQ ID NO: 1150656 - RNA, 14 nt, Human
auaaauagaaugua

SEQ ID NO: 1150657 - RNA, 16 nt, Human
auaaauagaauguaaa

SEQ ID NO: 1150658 - RNA, 20 nt, Human
auaaauagaauguaaauguc

SEQ ID NO: 1150659 - RNA, 19 nt, Human
auaaauagaauguaaaugu

SEQ ID NO: 1150660 - RNA, 13 nt, Human
uuacagcugccug

SEQ ID NO: 1150661 - RNA, 14 nt, Human
uuacagcugccugc

SEQ ID NO: 1150662 - RNA, 13 nt, Human
uuagaaccuuucu

SEQ ID NO: 1150663 - RNA, 14 nt, Human
auagcuacuaauuu

SEQ ID NO: 1150664 - RNA, 17 nt, Human
auagcuacuaauuuuaa

SEQ ID NO: 1150665 - RNA, 18 nt, Human
auagcuacuaauuuuaaa

SEQ ID NO: 1150666 - RNA, 15 nt, Human
auagcucuaauguuu

SEQ ID NO: 1150667 - RNA, 16 nt, Human
auagcucuaauguuug

SEQ ID NO: 1150668 - RNA, 17 nt, Human
auagcucuaauguuugc

SEQ ID NO: 1150669 - RNA, 18 nt, Human
auagcucuaauguuugca

SEQ ID NO: 1150670 - RNA, 19 nt, Human
auagcucuaauguuugcau

SEQ ID NO: 1150671 - RNA, 20 nt, Human
auagcucuaauguuugcaua

SEQ ID NO: 1150672 - RNA, 21 nt, Human
auagcucuaauguuugcauau

SEQ ID NO: 1150673 - RNA, 22 nt, Human
auagcucuaauguuugcauaua

SEQ ID NO: 1150674 - RNA, 17 nt, Human
uuauuuagcaccaggga

SEQ ID NO: 1150675 - RNA, 15 nt, Human
uuauuuaguauuuau

SEQ ID NO: 1150676 - RNA, 19 nt, Human
uuauuucccuacauuaaac

SEQ ID NO: 1150677 - RNA, 22 nt, Human
uuauuucccuacauuaaacaug

SEQ ID NO: 1150678 - RNA, 11 nt, Human
uuauuuccuau

SEQ ID NO: 1150679 - RNA, 17 nt, Human
uuauuuccuaugaugua

SEQ ID NO: 1150680 - RNA, 22 nt, Human
uuauuuccuaugauguauacug

SEQ ID NO: 1150681 - RNA, 20 nt, Human
uuauuuccuaugauguauac

SEQ ID NO: 1150682 - RNA, 20 nt, Human
uucaagugauucucaugccu

SEQ ID NO: 1150683 - RNA, 22 nt, Human
uucaagugauucucaugccuca

SEQ ID NO: 1150684 - RNA, 22 nt, Human
uucaccauguuggccaggcugc

SEQ ID NO: 1150685 - RNA, 22 nt, Human
uucaccauguuggccaggcugg

SEQ ID NO: 1150686 - RNA, 22 nt, Human
auaggcaccuaccaccacgccc

SEQ ID NO: 1150687 - RNA, 23 nt, Human
auauaagggaaguaguuaucaug

SEQ ID NO: 1150688 - RNA, 14 nt, Human
auauaagggaagua

SEQ ID NO: 1150689 - RNA, 22 nt, Human
auauaagggaaguaguuaucau

SEQ ID NO: 1150690 - RNA, 19 nt, Human
auauauacucaagaguggu

SEQ ID NO: 1150691 - RNA, 13 nt, Human
uucacugcuggcu

SEQ ID NO: 1150692 - RNA, 15 nt, Human
uucacugcuggcugc

SEQ ID NO: 1150693 - RNA, 16 nt, Human
uucacugcuggcugcc

SEQ ID NO: 1150694 - RNA, 17 nt, Human
uucacugcuggcugccu

SEQ ID NO: 1150695 - RNA, 18 nt, Human
uucacugcuggcugccuu

SEQ ID NO: 1150696 - RNA, 19 nt, Human
uucacugcuggcugccuua

SEQ ID NO: 1150697 - RNA, 15 nt, Human
uucagaaagaagugg

SEQ ID NO: 1150698 - RNA, 20 nt, Human
uucaucauucacuucacugu

SEQ ID NO: 1150699 - RNA, 19 nt, Human
uucaucauucacuucacug

SEQ ID NO: 1150700 - RNA, 16 nt, Human
auaucuagguuuauga

SEQ ID NO: 1150701 - RNA, 13 nt, Human
auauuaagaauga

SEQ ID NO: 1150702 - RNA, 14 nt, Human
auauuaagaaugau

SEQ ID NO: 1150703 - RNA, 17 nt, Human
auauuaagaaugaucug

SEQ ID NO: 1150704 - RNA, 21 nt, Human
auauuccugcauuugugaaau

SEQ ID NO: 1150705 - RNA, 18 nt, Human
auauugcugaaugcaaga

SEQ ID NO: 1150706 - RNA, 19 nt, Human
auauuuucaacgcagcccu

SEQ ID NO: 1150707 - RNA, 20 nt, Human
auauuuucaacgcagcccug

SEQ ID NO: 1150708 - RNA, 20 nt, Human
uuccuuuuaaaacacuucca

SEQ ID NO: 1150709 - RNA, 21 nt, Human
uuccuuuuaaaacacuuccau

SEQ ID NO: 1150710 - RNA, 22 nt, Human
uuccuuuuaaaacacuuccaua

SEQ ID NO: 1150711 - RNA, 12 nt, Human
aucagaugacaa

SEQ ID NO: 1150712 - RNA, 17 nt, Human
aucauucacuucacugu

SEQ ID NO: 1150713 - RNA, 19 nt, Human
aucauucacuucacugugc

SEQ ID NO: 1150714 - RNA, 22 nt, Human
aucauucacuucacugugcugu

SEQ ID NO: 1150715 - RNA, 21 nt, Human
aucauucacuucacugugcug

SEQ ID NO: 1150716 - RNA, 16 nt, Human
uucugcaucuccacuu

SEQ ID NO: 1150717 - RNA, 17 nt, Human
auccaggguggugguga

SEQ ID NO: 1150718 - RNA, 17 nt, Human
aucccaggauguacaag

SEQ ID NO: 1150719 - RNA, 19 nt, Human
aucccuggcugggauccac

SEQ ID NO: 1150720 - RNA, 17 nt, Human
uugagaaagucagauuc

SEQ ID NO: 1150721 - RNA, 10 nt, Human
uugagacaga

SEQ ID NO: 1150722 - RNA, 15 nt, Human
aucuuauaauuuaaa

SEQ ID NO: 1150723 - RNA, 16 nt, Human
aucuuauaauuuaaaa

SEQ ID NO: 1150724 - RNA, 13 nt, Human
uugcuuuguaugc

SEQ ID NO: 1150725 - RNA, 16 nt, Human
uugcuuuguaugcacu

SEQ ID NO: 1150726 - RNA, 12 nt, Human
uuggaaaauaaa

SEQ ID NO: 1150727 - RNA, 15 nt, Human
uuggaaaauaaauca

SEQ ID NO: 1150728 - RNA, 21 nt, Human
augagguacaaccuguucugc

SEQ ID NO: 1150729 - RNA, 18 nt, Human
uugugaugucccaacuug

SEQ ID NO: 1150730 - RNA, 22 nt, Human
uugugaugucccaacuuguaaa

SEQ ID NO: 1150731 - RNA, 15 nt, Human
augcagaacaaauga

SEQ ID NO: 1150732 - RNA, 18 nt, Human
augcagaacaaaugaaga

SEQ ID NO: 1150733 - RNA, 19 nt, Human
augcagaacaaaugaagac

SEQ ID NO: 1150734 - RNA, 17 nt, Human
augcagagguccacaac

SEQ ID NO: 1150735 - RNA, 18 nt, Human
augcagagguccacaaca

SEQ ID NO: 1150736 - RNA, 18 nt, Human
uuuaaaaaaauuccaagu

SEQ ID NO: 1150737 - RNA, 21 nt, Human
uuuaaauauaugcuaagucuu

SEQ ID NO: 1150738 - RNA, 17 nt, Human
uuuaaggguuuguggaa

SEQ ID NO: 1150739 - RNA, 20 nt, Human
uuuaaggguuuguggaaaau

SEQ ID NO: 1150740 - RNA, 22 nt, Human
uuuaaggguuuguggaaaauga

SEQ ID NO: 1150741 - RNA, 21 nt, Human
augccccgucccccucuggcu

SEQ ID NO: 1150742 - RNA, 13 nt, Human
augcgcaggcugg

SEQ ID NO: 1150743 - RNA, 14 nt, Human
augcgcaggcuggc

SEQ ID NO: 1150744 - RNA, 18 nt, Human
augcgcaggcuggcccug

SEQ ID NO: 1150745 - RNA, 20 nt, Human
augcgcaggcuggcccugcc

SEQ ID NO: 1150746 - RNA, 22 nt, Human
augcgcaggcuggcccugcccu

SEQ ID NO: 1150747 - RNA, 23 nt, Human
augcgcaggcuggcccugcccug

SEQ ID NO: 1150748 - RNA, 12 nt, Human
augcgugugugu

SEQ ID NO: 1150749 - RNA, 16 nt, Human
augcgugugugugugu

SEQ ID NO: 1150750 - RNA, 23 nt, Human
uuuagugacuaaaccauugugca

SEQ ID NO: 1150751 - RNA, 12 nt, Human
uuuagugacuaa

SEQ ID NO: 1150752 - RNA, 18 nt, Human
augcuuaaagaauucaaa

SEQ ID NO: 1150753 - RNA, 19 nt, Human
augcuuaaagaauucaaau

SEQ ID NO: 1150754 - RNA, 21 nt, Human
augcuuaaagaauucaaauuu

SEQ ID NO: 1150755 - RNA, 20 nt, Human
augcuuaaagaauucaaauu

SEQ ID NO: 1150756 - RNA, 14 nt, Human
auggaaggggcuga

SEQ ID NO: 1150757 - RNA, 16 nt, Human
uuucacuacucagcau

SEQ ID NO: 1150758 - RNA, 21 nt, Human
uuucagaaagaaguggggaca

SEQ ID NO: 1150759 - RNA, 11 nt, Human
uuucauguacu

SEQ ID NO: 1150760 - RNA, 12 nt, Human
uuucauguacug

SEQ ID NO: 1150761 - RNA, 15 nt, Human
uuucauguacugcau

SEQ ID NO: 1150762 - RNA, 13 nt, Human
uuugagaaaguca

SEQ ID NO: 1150763 - RNA, 22 nt, Human
uuuggauuggacaaaaugacuu

SEQ ID NO: 1150764 - RNA, 14 nt, Human
uuugggcugcccug

SEQ ID NO: 1150765 - RNA, 15 nt, Human
auguauacugccacu

SEQ ID NO: 1150766 - RNA, 21 nt, Human
auguauacugccacuaaccuu

SEQ ID NO: 1150767 - RNA, 23 nt, Human
augucgucaaagcugaaauggac

SEQ ID NO: 1150768 - RNA, 18 nt, Human
augugauccuuuuggagu

SEQ ID NO: 1150769 - RNA, 16 nt, Human
augugcuuaacaggga

SEQ ID NO: 1150770 - RNA, 21 nt, Human
augugcuuaacagggaacgug

SEQ ID NO: 1150771 - RNA, 23 nt, Human
auguuaacugacaagcuccauuu

SEQ ID NO: 1150772 - RNA, 12 nt, Human
auguuauuuccc

SEQ ID NO: 1150773 - RNA, 15 nt, Human
auguugaagccuuug

SEQ ID NO: 1150774 - RNA, 18 nt, Human
uuuuaguuccugugcaca

SEQ ID NO: 1150775 - RNA, 20 nt, Human
uuuuaguuccugugcacagc

SEQ ID NO: 1150776 - RNA, 12 nt, Human
uuuucuagugua

SEQ ID NO: 1150777 - RNA, 13 nt, Human
uuuucuaguguau

SEQ ID NO: 1150778 - RNA, 17 nt, Human
uuuucuaguguaucaaa

SEQ ID NO: 1150779 - RNA, 22 nt, Human
uuuucuaguguaucaaaaugcu

SEQ ID NO: 1150780 - RNA, 16 nt, Human
uuuucuauaauuuaaa

SEQ ID NO: 1150781 - RNA, 20 nt, Human
uuuucuaguguaucaaaaug

SEQ ID NO: 1150782 - RNA, 12 nt, Human
uuuucugcacua

SEQ ID NO: 1150783 - RNA, 13 nt, Human
uuuucugcacuau

SEQ ID NO: 1150784 - RNA, 19 nt, Human
uuuucugcacuauaugcaa

SEQ ID NO: 1150785 - RNA, 17 nt, Human
auguuggccaggcuggu

SEQ ID NO: 1150786 - RNA, 14 nt, Human
auguuuaaucauau

SEQ ID NO: 1150787 - RNA, 15 nt, Human
auguuuaaucauaua

SEQ ID NO: 1150788 - RNA, 17 nt, Human
auguuuaaucauauaaa

SEQ ID NO: 1150789 - RNA, 16 nt, Human
auguuuaaucauauaa

SEQ ID NO: 1150790 - RNA, 14 nt, Human
auuaaacaugacuc

SEQ ID NO: 1150791 - RNA, 19 nt, Human
uuuuuauuuccuaugaugu

SEQ ID NO: 1150792 - RNA, 22 nt, Human
uuuuugggaaaagaaaagucaa

SEQ ID NO: 1150793 - RNA, 11 nt, Human
uuuuuguauuu

SEQ ID NO: 1150794 - RNA, 20 nt, Human
auuauauggcuugaguuuaa

SEQ ID NO: 1150795 - RNA, 15 nt, Human
auucacuucacugug

SEQ ID NO: 1150796 - RNA, 16 nt, Human
auucacuucacugugc

SEQ ID NO: 1150797 - RNA, 17 nt, Human
auucacuucacugugcu

SEQ ID NO: 1150798 - RNA, 23 nt, Human
auucacuucacugugcuguuguu

SEQ ID NO: 1150799 - RNA, 18 nt, Human
auucacuucacugugcug

SEQ ID NO: 1150800 - RNA, 20 nt, Human
auucacuucacugugcuguu

SEQ ID NO: 1150801 - RNA, 17 nt, Human
auuccaagugauugaaa

SEQ ID NO: 1150802 - RNA, 12 nt, Human
auuccacagcug

SEQ ID NO: 1150803 - RNA, 13 nt, Human
auuccacagcugc

SEQ ID NO: 1150804 - RNA, 18 nt, Human
auuccagagaguggcucc

SEQ ID NO: 1150805 - RNA, 19 nt, Human
auuccagagaguggcuccu

SEQ ID NO: 1150806 - RNA, 13 nt, Human
auugacaaaaugu

SEQ ID NO: 1150807 - RNA, 14 nt, Human
auugacaaaauguu

SEQ ID NO: 1150808 - RNA, 15 nt, Human
auugacaaaauguua

SEQ ID NO: 1150809 - RNA, 16 nt, Human
auugacaaaauguuau

SEQ ID NO: 1150810 - RNA, 17 nt, Human
auugacaaaauguuauu

SEQ ID NO: 1150811 - RNA, 22 nt, Human
auugacaaaauguuauuucccu

SEQ ID NO: 1150812 - RNA, 19 nt, Human
auugacaaaauguuauuuc

SEQ ID NO: 1150813 - RNA, 16 nt, Human
auugcauuuccugaca

SEQ ID NO: 1150814 - RNA, 16 nt, Human
auuguaguccuguaau

SEQ ID NO: 1150815 - RNA, 15 nt, Human
auuuaguuguuguag

SEQ ID NO: 1150816 - RNA, 18 nt, Human
auuuaguuguuguagaga

SEQ ID NO: 1150817 - RNA, 19 nt, Human
auuuaguuguuguagagaa

SEQ ID NO: 1150818 - RNA, 20 nt, Human
auuuaguuguuguagagaaa

SEQ ID NO: 1150819 - RNA, 12 nt, Human
auuucauguacu

SEQ ID NO: 1150820 - RNA, 16 nt, Human
auuucauguacugcau

SEQ ID NO: 1150821 - RNA, 21 nt, Human
auuucauguacugcauuauuu

SEQ ID NO: 1150822 - RNA, 20 nt, Human
auuucauguacugcauuauu

SEQ ID NO: 1150823 - RNA, 14 nt, Human
auuuccuaugaugu

SEQ ID NO: 1150824 - RNA, 15 nt, Human
auuuccuaugaugua

SEQ ID NO: 1150825 - RNA, 16 nt, Human
auuuccuaugauguau

SEQ ID NO: 1150826 - RNA, 21 nt, Human
auuuccuaugauguauacugc

SEQ ID NO: 1150827 - RNA, 20 nt, Human
auuuccuaugauguauacug

SEQ ID NO: 1150828 - RNA, 18 nt, Human
auuugagaagcugcucaa

SEQ ID NO: 1150829 - RNA, 20 nt, Human
auuugagaagcugcucaacu

SEQ ID NO: 1150830 - RNA, 20 nt, Human
auuugauguggugaaaagca

SEQ ID NO: 1150831 - RNA, 20 nt, Human
auuuggaucucuucuuaaug

SEQ ID NO: 1150832 - RNA, 13 nt, Human
caaagcccagcuu

SEQ ID NO: 1150833 - RNA, 18 nt, Human
caaagcccuuccaugucg

SEQ ID NO: 1150834 - RNA, 22 nt, Human
caaaguucccuacuuccuguga

SEQ ID NO: 1150835 - RNA, 17 nt, Human
caaauguuuaaucauau

SEQ ID NO: 1150836 - RNA, 19 nt, Human
caaauguuuaaucauauaa

SEQ ID NO: 1150837 - RNA, 20 nt, Human
caaauguuuaaucauauaaa

SEQ ID NO: 1150838 - RNA, 22 nt, Human
caaauguuuaaucauauaaaua

SEQ ID NO: 1150839 - RNA, 13 nt, Human
caaauuggagaaa

SEQ ID NO: 1150840 - RNA, 12 nt, Human
caacuugcaaaa

SEQ ID NO: 1150841 - RNA, 15 nt, Human
caacuugcaaaauca

SEQ ID NO: 1150842 - RNA, 18 nt, Human
caacuugcaaaaucaguu

SEQ ID NO: 1150843 - RNA, 19 nt, Human
caacuugcaaaaucaguuu

SEQ ID NO: 1150844 - RNA, 20 nt, Human
caacuugcaaaaucaguuuu

SEQ ID NO: 1150845 - RNA, 18 nt, Human
caagagggcacugguggc

SEQ ID NO: 1150846 - RNA, 19 nt, Human
caagagggcacugguggcc

SEQ ID NO: 1150847 - RNA, 20 nt, Human
caagagggcacugguggccc

SEQ ID NO: 1150848 - RNA, 16 nt, Human
caaggacuaggguccu

SEQ ID NO: 1150849 - RNA, 18 nt, Human
caaggacuaggguccugg

SEQ ID NO: 1150850 - RNA, 19 nt, Human
caaggacuaggguccuggg

SEQ ID NO: 1150851 - RNA, 20 nt, Human
caaggacuaggguccugggg

SEQ ID NO: 1150852 - RNA, 21 nt, Human
caaggacuaggguccugggga

SEQ ID NO: 1150853 - RNA, 11 nt, Human
caagggcagcu

SEQ ID NO: 1150854 - RNA, 14 nt, Human
caagggcagcuuug

SEQ ID NO: 1150855 - RNA, 18 nt, Human
caagggcagcuuugcuca

SEQ ID NO: 1150856 - RNA, 18 nt, Human
caaucucggcucacugca

SEQ ID NO: 1150857 - RNA, 14 nt, Human
caaucuucaauccu

SEQ ID NO: 1150858 - RNA, 15 nt, Human
caaucuucaauccuu

SEQ ID NO: 1150859 - RNA, 18 nt, Human
caaucuucaauccuugaa

SEQ ID NO: 1150860 - RNA, 19 nt, Human
cacaaucucggcucacugc

SEQ ID NO: 1150861 - RNA, 20 nt, Human
cacaaucucggcucacugca

SEQ ID NO: 1150862 - RNA, 22 nt, Human
cacaaucucggcucacugcauc

SEQ ID NO: 1150863 - RNA, 23 nt, Human
cacaaucucggcucacugcaucc

SEQ ID NO: 1150864 - RNA, 24 nt, Human
cacaaucucggcucacugcauccu

SEQ ID NO: 1150865 - RNA, 18 nt, Human
cacacagauuugagcuca

SEQ ID NO: 1150866 - RNA, 20 nt, Human
cacacagauuugagcucagc

SEQ ID NO: 1150867 - RNA, 22 nt, Human
cacacagauuugagcucagccc

SEQ ID NO: 1150868 - RNA, 15 nt, Human
cacaggacucugccu

SEQ ID NO: 1150869 - RNA, 16 nt, Human
cacaggacucugccuc

SEQ ID NO: 1150870 - RNA, 14 nt, Human
caccacgcccggcu

SEQ ID NO: 1150871 - RNA, 15 nt, Human
caccacgcccggcua

SEQ ID NO: 1150872 - RNA, 15 nt, Human
caccaguugcugcuu

SEQ ID NO: 1150873 - RNA, 18 nt, Human
caccauaggucaccuuua

SEQ ID NO: 1150874 - RNA, 19 nt, Human
caccauguuggccaggcug

SEQ ID NO: 1150875 - RNA, 20 nt, Human
caccauguuggccaggcugc

SEQ ID NO: 1150876 - RNA, 20 nt, Human
caccauguuggccaggcugg

SEQ ID NO: 1150877 - RNA, 15 nt, Human
cauuguagagcuucu

SEQ ID NO: 1150878 - RNA, 16 nt, Human
cauuguagagcuucug

SEQ ID NO: 1150879 - RNA, 17 nt, Human
cauuguagagcuucugg

SEQ ID NO: 1150880 - RNA, 19 nt, Human
cauuguagagcuucuggca

SEQ ID NO: 1150881 - RNA, 21 nt, Human
cauuguagagcuucuggcacu

SEQ ID NO: 1150882 - RNA, 16 nt, Human
cauugugcauucuaga

SEQ ID NO: 1150883 - RNA, 13 nt, Human
cauuuccugacag

SEQ ID NO: 1150884 - RNA, 20 nt, Human
cauuuccugacagaaggacu

SEQ ID NO: 1150885 - RNA, 22 nt, Human
cauuuuguaccaaccauccaau

SEQ ID NO: 1150886 - RNA, 12 nt, Human
cauuuuguacca

SEQ ID NO: 1150887 - RNA, 19 nt, Human
ccaaacauccuacaagaca

SEQ ID NO: 1150888 - RNA, 20 nt, Human
ccaaacauccuacaagacac

SEQ ID NO: 1150889 - RNA, 20 nt, Human
ccaaacauccucuuccauau

SEQ ID NO: 1150890 - RNA, 20 nt, Human
ccaaccaaguggcucccaca

SEQ ID NO: 1150891 - RNA, 14 nt, Human
ccaacccucagagc

SEQ ID NO: 1150892 - RNA, 15 nt, Human
ccaacccucagagcc

SEQ ID NO: 1150893 - RNA, 19 nt, Human
ccaagaauagaugcugacu

SEQ ID NO: 1150894 - RNA, 20 nt, Human
ccaagaauagaugcugacug

SEQ ID NO: 1150895 - RNA, 13 nt, Human
ccaagccguggcu

SEQ ID NO: 1150896 - RNA, 14 nt, Human
ccaagccguggcuu

SEQ ID NO: 1150897 - RNA, 15 nt, Human
ccaagccuggcaagg

SEQ ID NO: 1150898 - RNA, 20 nt, Human
ccaauaaaccaaugaacgaa

SEQ ID NO: 1150899 - RNA, 22 nt, Human
ccaauaguuguugauuggcagg

SEQ ID NO: 1150900 - RNA, 17 nt, Human
ccacacgagaaccugaa

SEQ ID NO: 1150901 - RNA, 12 nt, Human
ccacacuccagc

SEQ ID NO: 1150902 - RNA, 13 nt, Human
ccacacuccagcu

SEQ ID NO: 1150903 - RNA, 15 nt, Human
ccacaggcccuuccu

SEQ ID NO: 1150904 - RNA, 16 nt, Human
ccacaggcccuuccuc

SEQ ID NO: 1150905 - RNA, 17 nt, Human
ccacaggcccuuccucu

SEQ ID NO: 1150906 - RNA, 18 nt, Human
ccacaggcccuuccucuc

SEQ ID NO: 1150907 - RNA, 19 nt, Human
ccacaggcccuuccucucc

SEQ ID NO: 1150908 - RNA, 22 nt, Human
ccacaggcccuuccucuccacu

SEQ ID NO: 1150909 - RNA, 23 nt, Human
ccacaggcccuuccucuccacug

SEQ ID NO: 1150910 - RNA, 15 nt, Human
ccaccaacccucaga

SEQ ID NO: 1150911 - RNA, 15 nt, Human
ccacuagacccacug

SEQ ID NO: 1150912 - RNA, 17 nt, Human
ccacuagacccacugga

SEQ ID NO: 1150913 - RNA, 21 nt, Human
ccacuccagaccccuggcuuu

SEQ ID NO: 1150914 - RNA, 22 nt, Human
ccacuccagaccccuggcuuuu

SEQ ID NO: 1150915 - RNA, 19 nt, Human
ccacuuagaaauugcauuu

SEQ ID NO: 1150916 - RNA, 21 nt, Human
ccacuuagaaauugcauuucc

SEQ ID NO: 1150917 - RNA, 16 nt, Human
ccagaaugcuuuagga

SEQ ID NO: 1150918 - RNA, 23 nt, Human
ccagaauggucuuucuaaugugu

SEQ ID NO: 1150919 - RNA, 13 nt, Human
ccagaauuucaaa

SEQ ID NO: 1150920 - RNA, 14 nt, Human
ccagaccccuggcu

SEQ ID NO: 1150921 - RNA, 15 nt, Human
ccagaccccuggcuu

SEQ ID NO: 1150922 - RNA, 16 nt, Human
ccagaccccuggcuuu

SEQ ID NO: 1150923 - RNA, 17 nt, Human
ccagaccccuggcuuuu

SEQ ID NO: 1150924 - RNA, 18 nt, Human
ccagaccccuggcuuuuc

SEQ ID NO: 1150925 - RNA, 13 nt, Human
ccaggacaggcug

SEQ ID NO: 1150926 - RNA, 20 nt, Human
ccaggacaggcugcggcccc

SEQ ID NO: 1150927 - RNA, 21 nt, Human
ccaggcuggucucgaacuccu

SEQ ID NO: 1150928 - RNA, 12 nt, Human
ccagggaagggg

SEQ ID NO: 1150929 - RNA, 14 nt, Human
ccaguaauccugua

SEQ ID NO: 1150930 - RNA, 20 nt, Human
ccagugaaaucaguuacucu

SEQ ID NO: 1150931 - RNA, 12 nt, Human
ccauacuaauua

SEQ ID NO: 1150932 - RNA, 13 nt, Human
ccauacuaauuau

SEQ ID NO: 1150933 - RNA, 23 nt, Human
ccauacuaauuauacccccugca

SEQ ID NO: 1150934 - RNA, 12 nt, Human
ccaucagaugac

SEQ ID NO: 1150935 - RNA, 15 nt, Human
ccaugauuucaugua

SEQ ID NO: 1150936 - RNA, 18 nt, Human
ccaugauuucauguacug

SEQ ID NO: 1150937 - RNA, 21 nt, Human
ccaugauuucauguacugcau

SEQ ID NO: 1150938 - RNA, 22 nt, Human
ccaugauuucauguacugcauu

SEQ ID NO: 1150939 - RNA, 20 nt, Human
cccaaaauuagccaguaauc

SEQ ID NO: 1150940 - RNA, 15 nt, Human
cccaggccugccugu

SEQ ID NO: 1150941 - RNA, 16 nt, Human
cccaggccugccuguu

SEQ ID NO: 1150942 - RNA, 18 nt, Human
cccaggcgccccuucccc

SEQ ID NO: 1150943 - RNA, 14 nt, Human
cccaggcugagccu

SEQ ID NO: 1150944 - RNA, 15 nt, Human
cccaggcugagccuc

SEQ ID NO: 1150945 - RNA, 13 nt, Human
ccccaagccuggc

SEQ ID NO: 1150946 - RNA, 14 nt, Human
ccccaagccuggca

SEQ ID NO: 1150947 - RNA, 13 nt, Human
ccccaggacaggc

SEQ ID NO: 1150948 - RNA, 14 nt, Human
ccccaggacaggcu

SEQ ID NO: 1150949 - RNA, 15 nt, Human
ccccaggacaggcug

SEQ ID NO: 1150950 - RNA, 23 nt, Human
cccccaaccaaguggcucccaca

SEQ ID NO: 1150951 - RNA, 14 nt, Human
cccccaggacaggc

SEQ ID NO: 1150952 - RNA, 21 nt, Human
cccccaggacaggcugcggcc

SEQ ID NO: 1150953 - RNA, 16 nt, Human
cccccaucucuucugg

SEQ ID NO: 1150954 - RNA, 13 nt, Human
cccccucugcccu

SEQ ID NO: 1150955 - RNA, 14 nt, Human
cccccucugcccug

SEQ ID NO: 1150956 - RNA, 16 nt, Human
cccccucugcccugcg

SEQ ID NO: 1150957 - RNA, 16 nt, Human
ccccgucccccucugg

SEQ ID NO: 1150958 - RNA, 20 nt, Human
ccccgucccccucuggcucc

SEQ ID NO: 1150959 - RNA, 23 nt, Human
ccccguccuggagguuccccagc

SEQ ID NO: 1150960 - RNA, 21 nt, Human
ccccgucucugguuccucccc

SEQ ID NO: 1150961 - RNA, 15 nt, Human
ccccucccccguccu

SEQ ID NO: 1150962 - RNA, 20 nt, Human
ccccucccccguccuggagg

SEQ ID NO: 1150963 - RNA, 21 nt, Human
cccugguuuccugcccuggga

SEQ ID NO: 1150964 - RNA, 22 nt, Human
cccugguuuccugcccugggag

SEQ ID NO: 1150965 - RNA, 23 nt, Human
cccugguuuccugcccugggagg

SEQ ID NO: 1150966 - RNA, 17 nt, Human
cccuuaccacugcucug

SEQ ID NO: 1150967 - RNA, 21 nt, Human
cccuuaccacugcucugauga

SEQ ID NO: 1150968 - RNA, 13 nt, Human
cccuuccucucca

SEQ ID NO: 1150969 - RNA, 16 nt, Human
cccuuccucuccacug

SEQ ID NO: 1150970 - RNA, 17 nt, Human
cccuuccucuccacugc

SEQ ID NO: 1150971 - RNA, 21 nt, Human
cccuuccucuccacugccuuc

SEQ ID NO: 1150972 - RNA, 20 nt, Human
cccuuccucuccacugccuu

SEQ ID NO: 1150973 - RNA, 22 nt, Human
cccuuucugggcaccggggccu

SEQ ID NO: 1150974 - RNA, 22 nt, Human
ccgagucucuucuccacuggau

SEQ ID NO: 1150975 - RNA, 12 nt, Human
ccggcugcccuu

SEQ ID NO: 1150976 - RNA, 19 nt, Human
ccgggccuggagaacuaga

SEQ ID NO: 1150977 - RNA, 14 nt, Human
ccgugccuucagcu

SEQ ID NO: 1150978 - RNA, 15 nt, Human
ccgugccuucagcuc

SEQ ID NO: 1150979 - RNA, 16 nt, Human
ccgugccuucagcucu

SEQ ID NO: 1150980 - RNA, 17 nt, Human
ccgugccuucagcucua

SEQ ID NO: 1150981 - RNA, 15 nt, Human
ccguggcuucccgcu

SEQ ID NO: 1150982 - RNA, 21 nt, Human
ccguggcuucccgcucagccc

SEQ ID NO: 1150983 - RNA, 23 nt, Human
ccguggcuucccgcucagcccuc

SEQ ID NO: 1150984 - RNA, 12 nt, Human
ccuaaagagaua

SEQ ID NO: 1150985 - RNA, 14 nt, Human
ccuaauuccacagc

SEQ ID NO: 1150986 - RNA, 15 nt, Human
ccuaauuccacagcu

SEQ ID NO: 1150987 - RNA, 16 nt, Human
ccuaauuccacagcug

SEQ ID NO: 1150988 - RNA, 17 nt, Human
ccuaauuccacagcugc

SEQ ID NO: 1150989 - RNA, 12 nt, Human
ccuaccugguaa

SEQ ID NO: 1150990 - RNA, 17 nt, Human
ccuaucagaaguuucuc

SEQ ID NO: 1150991 - RNA, 16 nt, Human
ccucaauuuucacugu

SEQ ID NO: 1150992 - RNA, 17 nt, Human
ccucaauuuucacugug

SEQ ID NO: 1150993 - RNA, 21 nt, Human
ccucacuaggcuucugguuga

SEQ ID NO: 1150994 - RNA, 21 nt, Human
ccucacuaucccggcugcccu

SEQ ID NO: 1150995 - RNA, 22 nt, Human
ccucacuaucccggcugcccuu

SEQ ID NO: 1150996 - RNA, 21 nt, Human
ccucagguaaucgaccugccu

SEQ ID NO: 1150997 - RNA, 22 nt, Human
ccucagguaaucgaccugccuc

SEQ ID NO: 1150998 - RNA, 23 nt, Human
ccucagguaaucgaccugccucg

SEQ ID NO: 1150999 - RNA, 14 nt, Human
ccucagucucccuc

SEQ ID NO: 1151000 - RNA, 13 nt, Human
ccucccggugccc

SEQ ID NO: 1151001 - RNA, 16 nt, Human
ccucccggugcccaag

SEQ ID NO: 1151002 - RNA, 13 nt, Human
ccucccugccccu

SEQ ID NO: 1151003 - RNA, 14 nt, Human
ccuccuccuggacu

SEQ ID NO: 1151004 - RNA, 13 nt, Human
ccuccuggacucc

SEQ ID NO: 1151005 - RNA, 18 nt, Human
ccuccuuaucaaaggaca

SEQ ID NO: 1151006 - RNA, 20 nt, Human
ccuccuuaucaaaggacacc

SEQ ID NO: 1151007 - RNA, 12 nt, Human
ccucuccacugc

SEQ ID NO: 1151008 - RNA, 13 nt, Human
ccucuccacugcc

SEQ ID NO: 1151009 - RNA, 14 nt, Human
ccucuccacugccu

SEQ ID NO: 1151010 - RNA, 16 nt, Human
ccucuccacugccuuc

SEQ ID NO: 1151011 - RNA, 19 nt, Human
ccucuccacugccuucgau

SEQ ID NO: 1151012 - RNA, 13 nt, Human
ccucucugcccua

SEQ ID NO: 1151013 - RNA, 16 nt, Human
ccucuggcuccagcug

SEQ ID NO: 1151014 - RNA, 17 nt, Human
ccucuggcuccagcugg

SEQ ID NO: 1151015 - RNA, 17 nt, Human
ccucuguccaggcacug

SEQ ID NO: 1151016 - RNA, 21 nt, Human
ccucuguucugcacacagcac

SEQ ID NO: 1151017 - RNA, 15 nt, Human
ccucuuccucccuca

SEQ ID NO: 1151018 - RNA, 16 nt, Human
ccucuuccucccucau

SEQ ID NO: 1151019 - RNA, 19 nt, Human
ccucuuccucccucauucc

SEQ ID NO: 1151020 - RNA, 16 nt, Human
ccugaaugcucuguag

SEQ ID NO: 1151021 - RNA, 15 nt, Human
ccugaaugcucugua

SEQ ID NO: 1151022 - RNA, 17 nt, Human
ccugcuuugggcugccc

SEQ ID NO: 1151023 - RNA, 18 nt, Human
ccugcuuugggcugcccu

SEQ ID NO: 1151024 - RNA, 19 nt, Human
ccugcuuugggcugcccug

SEQ ID NO: 1151025 - RNA, 21 nt, Human
ccuggcagccgugccuucagc

SEQ ID NO: 1151026 - RNA, 14 nt, Human
ccuggacuccugca

SEQ ID NO: 1151027 - RNA, 12 nt, Human
ccuggcagccgu

SEQ ID NO: 1151028 - RNA, 18 nt, Human
ccuggcagccgugccuuc

SEQ ID NO: 1151029 - RNA, 19 nt, Human
ccuggcagccgugccuuca

SEQ ID NO: 1151030 - RNA, 15 nt, Human
ccuggugcugccaca

SEQ ID NO: 1151031 - RNA, 18 nt, Human
ccuggugcugccacacuu

SEQ ID NO: 1151032 - RNA, 21 nt, Human
ccuggugcugccacacuucag

SEQ ID NO: 1151033 - RNA, 12 nt, Human
ccugugcacagc

SEQ ID NO: 1151034 - RNA, 13 nt, Human
ccugugcacagcc

SEQ ID NO: 1151035 - RNA, 14 nt, Human
ccuuagaaccuuuc

SEQ ID NO: 1151036 - RNA, 15 nt, Human
ccuuagaaccuuucu

SEQ ID NO: 1151037 - RNA, 16 nt, Human
ccuuagaaccuuucuu

SEQ ID NO: 1151038 - RNA, 18 nt, Human
ccuuagaaccuuucuuac

SEQ ID NO: 1151039 - RNA, 15 nt, Human
ccuucaaagcaaaug

SEQ ID NO: 1151040 - RNA, 19 nt, Human
ccuucaaagcaaaugucuu

SEQ ID NO: 1151041 - RNA, 14 nt, Human
ccuucaaccauucc

SEQ ID NO: 1151042 - RNA, 20 nt, Human
ccuuccaugucgccucugca

SEQ ID NO: 1151043 - RNA, 21 nt, Human
ccuuccaugucgccucugcau

SEQ ID NO: 1151044 - RNA, 23 nt, Human
ccuuccaugucgccucugcauuc

SEQ ID NO: 1151045 - RNA, 20 nt, Human
ccuucgauacaccgggccug

SEQ ID NO: 1151046 - RNA, 22 nt, Human
ccuucgauacaccgggccugga

SEQ ID NO: 1151047 - RNA, 23 nt, Human
ccuucgauacaccgggccuggag

SEQ ID NO: 1151048 - RNA, 13 nt, Human
ccuucgccaccug

SEQ ID NO: 1151049 - RNA, 14 nt, Human
ccuucuuuuucuuc

SEQ ID NO: 1151050 - RNA, 16 nt, Human
ccuucuuuuucuucuu

SEQ ID NO: 1151051 - RNA, 12 nt, Human
cgcccaggcugg

SEQ ID NO: 1151052 - RNA, 19 nt, Human
cgcccaggcuggagugcaa

SEQ ID NO: 1151053 - RNA, 20 nt, Human
cgcccaggcuggagugcaau

SEQ ID NO: 1151054 - RNA, 17 nt, Human
cgcuauugucaccaggg

SEQ ID NO: 1151055 - RNA, 22 nt, Human
cgggagccugaucaccugcccu

SEQ ID NO: 1151056 - RNA, 22 nt, Human
cguauaugucucaggucccugc

SEQ ID NO: 1151057 - RNA, 14 nt, Human
cgucccccucuggc

SEQ ID NO: 1151058 - RNA, 21 nt, Human
cgucccccucuggcuccagcu

SEQ ID NO: 1151059 - RNA, 22 nt, Human
cgucccccucuggcuccagcug

SEQ ID NO: 1151060 - RNA, 12 nt, Human
cgugccuggcca

SEQ ID NO: 1151061 - RNA, 16 nt, Human
cgugccuggccacgcc

SEQ ID NO: 1151062 - RNA, 13 nt, Human
cgugccuucagcu

SEQ ID NO: 1151063 - RNA, 15 nt, Human
cgugccuucagcucu

SEQ ID NO: 1151064 - RNA, 16 nt, Human
cgugccuucagcucua

SEQ ID NO: 1151065 - RNA, 18 nt, Human
cgugccuucagcucuaca

SEQ ID NO: 1151066 - RNA, 22 nt, Human
cguuccuucaaagcaaaugucu

SEQ ID NO: 1151067 - RNA, 18 nt, Human
cguuuagcugacaaaaua

SEQ ID NO: 1151068 - RNA, 16 nt, Human
cguuuagcugacaaaa

SEQ ID NO: 1151069 - RNA, 17 nt, Human
cucaggucccugcaggg

SEQ ID NO: 1151070 - RNA, 18 nt, Human
cucaggucccugcagggc

SEQ ID NO: 1151071 - RNA, 12 nt, Human
cucauauuuccc

SEQ ID NO: 1151072 - RNA, 18 nt, Human
cucauuccaccuucccau

SEQ ID NO: 1151073 - RNA, 21 nt, Human
cucauuccaccuucccaugcc

SEQ ID NO: 1151074 - RNA, 18 nt, Human
cucauucccuccccagaa

SEQ ID NO: 1151075 - RNA, 11 nt, Human
cuccacugccu

SEQ ID NO: 1151076 - RNA, 13 nt, Human
cuccacugccuuc

SEQ ID NO: 1151077 - RNA, 15 nt, Human
cuccagaccccuggc

SEQ ID NO: 1151078 - RNA, 17 nt, Human
cuccagaccccuggcuu

SEQ ID NO: 1151079 - RNA, 18 nt, Human
cuccagaccccuggcuuu

SEQ ID NO: 1151080 - RNA, 19 nt, Human
cuccagaccccuggcuuuu

SEQ ID NO: 1151081 - RNA, 20 nt, Human
cuccagaccccuggcuuuuc

SEQ ID NO: 1151082 - RNA, 21 nt, Human
cuccagaccccuggcuuuuca

SEQ ID NO: 1151083 - RNA, 20 nt, Human
cuccaucgcugucaucucag

SEQ ID NO: 1151084 - RNA, 17 nt, Human
cuccaucuaaacugccc

SEQ ID NO: 1151085 - RNA, 18 nt, Human
cuccaucuaaacugcccc

SEQ ID NO: 1151086 - RNA, 13 nt, Human
cuccaucuccacu

SEQ ID NO: 1151087 - RNA, 14 nt, Human
cuccaucuccacuc

SEQ ID NO: 1151088 - RNA, 14 nt, Human
cucccaggcgcccc

SEQ ID NO: 1151089 - RNA, 17 nt, Human
cucccaggcgccccuuc

SEQ ID NO: 1151090 - RNA, 12 nt, Human
cucccuucaacc

SEQ ID NO: 1151091 - RNA, 18 nt, Human
cucccuucaaccauuccc

SEQ ID NO: 1151092 - RNA, 19 nt, Human
cucccuucaaccauucccc

SEQ ID NO: 1151093 - RNA, 20 nt, Human
cucccuucaaccauucccca

SEQ ID NO: 1151094 - RNA, 22 nt, Human
cuccuaucagaaguuucucagc

SEQ ID NO: 1151095 - RNA, 19 nt, Human
cuccucuugccacugccuc

SEQ ID NO: 1151096 - RNA, 14 nt, Human
cuccugaccucagg

SEQ ID NO: 1151097 - RNA, 14 nt, Human
cuccugaccuuagg

SEQ ID NO: 1151098 - RNA, 17 nt, Human
cuccugaguagcuggga

SEQ ID NO: 1151099 - RNA, 22 nt, Human
cuccugaguagcugggauuaca

SEQ ID NO: 1151100 - RNA, 11 nt, Human
cuccugccacc

SEQ ID NO: 1151101 - RNA, 21 nt, Human
cucgaggucgggcagcacaag

SEQ ID NO: 1151102 - RNA, 19 nt, Human
cucgcuauugucaccaggg

SEQ ID NO: 1151103 - RNA, 22 nt, Human
cucgcuauugucaccagggcug

SEQ ID NO: 1151104 - RNA, 21 nt, Human
cucgcuauugucaccagggcu

SEQ ID NO: 1151105 - RNA, 18 nt, Human
cucggacuuagcugggag

SEQ ID NO: 1151106 - RNA, 19 nt, Human
cucggacuuagcugggaga

SEQ ID NO: 1151107 - RNA, 22 nt, Human
cucggccucccaaagugcuggg

SEQ ID NO: 1151108 - RNA, 23 nt, Human
cucggccucccaaagugcuggga

SEQ ID NO: 1151109 - RNA, 14 nt, Human
cucggcucacugca

SEQ ID NO: 1151110 - RNA, 15 nt, Human
cucuaauguuugcau

SEQ ID NO: 1151111 - RNA, 17 nt, Human
cucuaauguuugcauau

SEQ ID NO: 1151112 - RNA, 18 nt, Human
cucuaauguuugcauaua

SEQ ID NO: 1151113 - RNA, 16 nt, Human
cucuccacugccuucg

SEQ ID NO: 1151114 - RNA, 12 nt, Human
cucucugcccua

SEQ ID NO: 1151115 - RNA, 13 nt, Human
cucucugcccuaa

SEQ ID NO: 1151116 - RNA, 21 nt, Human
cucucugcccuaaugcgcagg

SEQ ID NO: 1151117 - RNA, 16 nt, Human
cucugagcaaaugugg

SEQ ID NO: 1151118 - RNA, 15 nt, Human
cucugagccuuggga

SEQ ID NO: 1151119 - RNA, 17 nt, Human
cucugaugaagaggagu

SEQ ID NO: 1151120 - RNA, 23 nt, Human
cucugcccuaaugcgcaggcugg

SEQ ID NO: 1151121 - RNA, 11 nt, Human
cucugcccugc

SEQ ID NO: 1151122 - RNA, 12 nt, Human
cucugcccugcg

SEQ ID NO: 1151123 - RNA, 14 nt, Human
cucugccuccucuu

SEQ ID NO: 1151124 - RNA, 15 nt, Human
cucugccuccucuuc

SEQ ID NO: 1151125 - RNA, 16 nt, Human
cucugccuccucuuca

SEQ ID NO: 1151126 - RNA, 15 nt, Human
cucugcuuuggaaau

SEQ ID NO: 1151127 - RNA, 19 nt, Human
cucuguucugcacacagca

SEQ ID NO: 1151128 - RNA, 20 nt, Human
cucuguucugcacacagcac

SEQ ID NO: 1151129 - RNA, 21 nt, Human
cucuguucugcacacagcacg

SEQ ID NO: 1151130 - RNA, 19 nt, Human
cucuucaguuaagccuuug

SEQ ID NO: 1151131 - RNA, 20 nt, Human
cucuucaguuaagccuuugg

SEQ ID NO: 1151132 - RNA, 23 nt, Human
cucuucaguuaagccuuuggaaa

SEQ ID NO: 1151133 - RNA, 14 nt, Human
cucuucuccacugg

SEQ ID NO: 1151134 - RNA, 15 nt, Human
cucuucuccacugga

SEQ ID NO: 1151135 - RNA, 17 nt, Human
cucuucuccacuggaug

SEQ ID NO: 1151136 - RNA, 19 nt, Human
cucuucuccacuggaugga

SEQ ID NO: 1151137 - RNA, 13 nt, Human
cucuucuccuuuc

SEQ ID NO: 1151138 - RNA, 15 nt, Human
cucuucuccuuucac

SEQ ID NO: 1151139 - RNA, 16 nt, Human
cucuucuccuuucaca

SEQ ID NO: 1151140 - RNA, 18 nt, Human
cucuucuggguuccuucc

SEQ ID NO: 1151141 - RNA, 21 nt, Human
cugaaguaaaacaaacaauac

SEQ ID NO: 1151142 - RNA, 17 nt, Human
cugaagucacugcacag

SEQ ID NO: 1151143 - RNA, 22 nt, Human
cugaagucacugcacagugcau

SEQ ID NO: 1151144 - RNA, 17 nt, Human
cugacagacagcccucc

SEQ ID NO: 1151145 - RNA, 19 nt, Human
cugacagacagcccuccau

SEQ ID NO: 1151146 - RNA, 18 nt, Human
cugacauuccuugcugaa

SEQ ID NO: 1151147 - RNA, 16 nt, Human
cugacauuccuugcug

SEQ ID NO: 1151148 - RNA, 14 nt, Human
cugagugccuuuug

SEQ ID NO: 1151149 - RNA, 15 nt, Human
cugagugccuuuugg

SEQ ID NO: 1151150 - RNA, 16 nt, Human
cugagugccuuuuggu

SEQ ID NO: 1151151 - RNA, 16 nt, Human
cugauucaauuugaug

SEQ ID NO: 1151152 - RNA, 17 nt, Human
cugauucaauuugaugu

SEQ ID NO: 1151153 - RNA, 23 nt, Human
cugauugaccguguuggucugua

SEQ ID NO: 1151154 - RNA, 13 nt, Human
cugcacaaagccc

SEQ ID NO: 1151155 - RNA, 18 nt, Human
cugcacaaagcccuucca

SEQ ID NO: 1151156 - RNA, 20 nt, Human
cugcacaaagcccuuccaug

SEQ ID NO: 1151157 - RNA, 21 nt, Human
cugcacaaagcccuuccaugu

SEQ ID NO: 1151158 - RNA, 18 nt, Human
cugcacagugcaucucag

SEQ ID NO: 1151159 - RNA, 21 nt, Human
cugcacagugcaucucagccc

SEQ ID NO: 1151160 - RNA, 22 nt, Human
cugcacagugcaucucagccca

SEQ ID NO: 1151161 - RNA, 17 nt, Human
cugcaccaguugcugcu

SEQ ID NO: 1151162 - RNA, 20 nt, Human
cugcagagcaggaaacauga

SEQ ID NO: 1151163 - RNA, 15 nt, Human
cugcagggacugcca

SEQ ID NO: 1151164 - RNA, 17 nt, Human
cugcagggacugccagu

SEQ ID NO: 1151165 - RNA, 16 nt, Human
cugcagggccaagcac

SEQ ID NO: 1151166 - RNA, 13 nt, Human
cugccacacuuca

SEQ ID NO: 1151167 - RNA, 17 nt, Human
cugccacacuucaggcu

SEQ ID NO: 1151168 - RNA, 22 nt, Human
cugccacacuucaggcucuucu

SEQ ID NO: 1151169 - RNA, 19 nt, Human
cugccaccacgcccggcua

SEQ ID NO: 1151170 - RNA, 17 nt, Human
cugcccaaccugcucuc

SEQ ID NO: 1151171 - RNA, 19 nt, Human
cugcccaaccugcucuccu

SEQ ID NO: 1151172 - RNA, 18 nt, Human
cugcccaggccugccugu

SEQ ID NO: 1151173 - RNA, 19 nt, Human
cugcccaggccugccuguu

SEQ ID NO: 1151174 - RNA, 11 nt, Human
cugcccuggga

SEQ ID NO: 1151175 - RNA, 12 nt, Human
cugcccugggag

SEQ ID NO: 1151176 - RNA, 13 nt, Human
cugcccugggagg

SEQ ID NO: 1151177 - RNA, 15 nt, Human
cugcccugggaggca

SEQ ID NO: 1151178 - RNA, 22 nt, Human
cugcccugggaggcagugaugg

SEQ ID NO: 1151179 - RNA, 12 nt, Human
cugccucuuccu

SEQ ID NO: 1151180 - RNA, 12 nt, Human
cugcucugauga

SEQ ID NO: 1151181 - RNA, 20 nt, Human
cugcucugaugaagaggagu

SEQ ID NO: 1151182 - RNA, 18 nt, Human
cugcuuugggcugcccug

SEQ ID NO: 1151183 - RNA, 19 nt, Human
cugcuuugggcugcccugg

SEQ ID NO: 1151184 - RNA, 20 nt, Human
cugcuuugggcugcccuggu

SEQ ID NO: 1151185 - RNA, 21 nt, Human
cugcuuugggcugcccuggug

SEQ ID NO: 1151186 - RNA, 22 nt, Human
cugcuuugggcugcccuggugc

SEQ ID NO: 1151187 - RNA, 23 nt, Human
cugcuuugggcugcccuggugcu

SEQ ID NO: 1151188 - RNA, 23 nt, Human
cuggaauaauccuaaacauauga

SEQ ID NO: 1151189 - RNA, 16 nt, Human
cuggacucaccucccc

SEQ ID NO: 1151190 - RNA, 21 nt, Human
cuggauggaggaaaaccaagc

SEQ ID NO: 1151191 - RNA, 23 nt, Human
cuggauuauucaaaaugauguau

SEQ ID NO: 1151192 - RNA, 17 nt, Human
cuggcacagggcagugg

SEQ ID NO: 1151193 - RNA, 14 nt, Human
cuggcugccuuaga

SEQ ID NO: 1151194 - RNA, 19 nt, Human
cuggcugccuuagaaccuu

SEQ ID NO: 1151195 - RNA, 14 nt, Human
cuggcuucacagau

SEQ ID NO: 1151196 - RNA, 16 nt, Human
cuggcuuuucacugcu

SEQ ID NO: 1151197 - RNA, 17 nt, Human
cuggcuuuucacugcug

SEQ ID NO: 1151198 - RNA, 19 nt, Human
cuggcuuuucacugcuggc

SEQ ID NO: 1151199 - RNA, 20 nt, Human
cuggcuuuucacugcuggcu

SEQ ID NO: 1151200 - RNA, 22 nt, Human
cuggcuuuucacugcuggcugc

SEQ ID NO: 1151201 - RNA, 19 nt, Human
cugggaacaccauagguca

SEQ ID NO: 1151202 - RNA, 13 nt, Human
cugggagcucugc

SEQ ID NO: 1151203 - RNA, 14 nt, Human
cugggagcucugca

SEQ ID NO: 1151204 - RNA, 15 nt, Human
cugggagcucugcag

SEQ ID NO: 1151205 - RNA, 16 nt, Human
cugggaggcagugaug

SEQ ID NO: 1151206 - RNA, 21 nt, Human
cugggauuacaggcgugagcc

SEQ ID NO: 1151207 - RNA, 19 nt, Human
cugggauuacaggcuccug

SEQ ID NO: 1151208 - RNA, 20 nt, Human
cugggauuacaggcuccugc

SEQ ID NO: 1151209 - RNA, 21 nt, Human
cugggauuacaggcuccugcc

SEQ ID NO: 1151210 - RNA, 22 nt, Human
cugggauuacaggcuccugcca

SEQ ID NO: 1151211 - RNA, 23 nt, Human
cugggauuacaggcuccugccac

SEQ ID NO: 1151212 - RNA, 20 nt, Human
cugggaucacauguggacuu

SEQ ID NO: 1151213 - RNA, 20 nt, Human
cugggcaccggggccucgga

SEQ ID NO: 1151214 - RNA, 13 nt, Human
cuggguuggaaaa

SEQ ID NO: 1151215 - RNA, 18 nt, Human
cuggguuggaaaacagua

SEQ ID NO: 1151216 - RNA, 20 nt, Human
cugguggcccgacagccugg

SEQ ID NO: 1151217 - RNA, 17 nt, Human
cugguugaugccuguga

SEQ ID NO: 1151218 - RNA, 16 nt, Human
cuguuuauucauaugc

SEQ ID NO: 1151219 - RNA, 17 nt, Human
cuguuuauucauaugca

SEQ ID NO: 1151220 - RNA, 20 nt, Human
cuguuuauucauaugcauau

SEQ ID NO: 1151221 - RNA, 21 nt, Human
cuguuuauucauaugcauauu

SEQ ID NO: 1151222 - RNA, 16 nt, Human
cuguuuuaaaaaccug

SEQ ID NO: 1151223 - RNA, 16 nt, Human
cuuaaguuuauacucu

SEQ ID NO: 1151224 - RNA, 13 nt, Human
cuuaauguacaua

SEQ ID NO: 1151225 - RNA, 15 nt, Human
cuuaauguacauagu

SEQ ID NO: 1151226 - RNA, 17 nt, Human
cuuagaaauugcauuuc

SEQ ID NO: 1151227 - RNA, 15 nt, Human
cuuagaaccuuucuu

SEQ ID NO: 1151228 - RNA, 20 nt, Human
cuuaggugauccacucgccu

SEQ ID NO: 1151229 - RNA, 13 nt, Human
cuuauaauuuaaa

SEQ ID NO: 1151230 - RNA, 14 nt, Human
cuuauaauuuaaaa

SEQ ID NO: 1151231 - RNA, 16 nt, Human
cuuauauuguucacuu

SEQ ID NO: 1151232 - RNA, 14 nt, Human
cuuauauuguucac

SEQ ID NO: 1151233 - RNA, 14 nt, Human
cuuaucaaaggaca

SEQ ID NO: 1151234 - RNA, 16 nt, Human
cuuaucaaaggacacc

SEQ ID NO: 1151235 - RNA, 14 nt, Human
cuucaggcucuucu

SEQ ID NO: 1151236 - RNA, 15 nt, Human
cuucaggcucuucuc

SEQ ID NO: 1151237 - RNA, 16 nt, Human
cuucaggcucuucucc

SEQ ID NO: 1151238 - RNA, 17 nt, Human
cuucaggcucuucuccu

SEQ ID NO: 1151239 - RNA, 18 nt, Human
cuucaggcucuucuccuu

SEQ ID NO: 1151240 - RNA, 13 nt, Human
cuucauuuggaga

SEQ ID NO: 1151241 - RNA, 14 nt, Human
cuucauuuggagau

SEQ ID NO: 1151242 - RNA, 15 nt, Human
cuucccgcucagccc

SEQ ID NO: 1151243 - RNA, 16 nt, Human
cuucccgcucagcccu

SEQ ID NO: 1151244 - RNA, 17 nt, Human
cuucccgcucagcccuc

SEQ ID NO: 1151245 - RNA, 18 nt, Human
cuucccgcucagcccucc

SEQ ID NO: 1151246 - RNA, 14 nt, Human
cuucgacuguuguu

SEQ ID NO: 1151247 - RNA, 22 nt, Human
cuucgacuguuguuaucuguuu

SEQ ID NO: 1151248 - RNA, 23 nt, Human
cuucgacuguuguuaucuguuug

SEQ ID NO: 1151249 - RNA, 16 nt, Human
cuucgauacaccgggc

SEQ ID NO: 1151250 - RNA, 15 nt, Human
cuucguuuaaugaau

SEQ ID NO: 1151251 - RNA, 14 nt, Human
cuucuccuuucaca

SEQ ID NO: 1151252 - RNA, 17 nt, Human
cuucuccuuucacaacc

SEQ ID NO: 1151253 - RNA, 20 nt, Human
cuucuccuuucacaaccuuc

SEQ ID NO: 1151254 - RNA, 22 nt, Human
cuucuccuuucacaaccuucug

SEQ ID NO: 1151255 - RNA, 17 nt, Human
cuucuggcacuuggaga

SEQ ID NO: 1151256 - RNA, 13 nt, Human
cuugccacugccu

SEQ ID NO: 1151257 - RNA, 22 nt, Human
cuugcugaaacgcaucuaguuc

SEQ ID NO: 1151258 - RNA, 21 nt, Human
cuugcugaaacgcaucuaguu

SEQ ID NO: 1151259 - RNA, 20 nt, Human
cuugcuugauuguauggugg

SEQ ID NO: 1151260 - RNA, 22 nt, Human
cuuggagccaauggagacuguc

SEQ ID NO: 1151261 - RNA, 22 nt, Human
cuuuaaaaaauuaaucugggcc

SEQ ID NO: 1151262 - RNA, 21 nt, Human
cuuuaaaaagcuccaaaugca

SEQ ID NO: 1151263 - RNA, 16 nt, Human
cuuucuuccucugcug

SEQ ID NO: 1151264 - RNA, 19 nt, Human
cuuucuuuuuuuuuuuuga

SEQ ID NO: 1151265 - RNA, 17 nt, Human
cuuuguuuuacugucuu

SEQ ID NO: 1151266 - RNA, 22 nt, Human
gaaaagucaaggguaggguggg

SEQ ID NO: 1151267 - RNA, 19 nt, Human
gaaaauaacaauaaaagac

SEQ ID NO: 1151268 - RNA, 23 nt, Human
gaaaauaaaucaaugcuauaacu

SEQ ID NO: 1151269 - RNA, 16 nt, Human
gaaauuguauuacaaa

SEQ ID NO: 1151270 - RNA, 18 nt, Human
gaaauuguauuacaaauc

SEQ ID NO: 1151271 - RNA, 21 nt, Human
gaagacuuacagcaaauccuu

SEQ ID NO: 1151272 - RNA, 20 nt, Human
gaagacuuacagcaaauccu

SEQ ID NO: 1151273 - RNA, 13 nt, Human
gaaguaguuauca

SEQ ID NO: 1151274 - RNA, 14 nt, Human
gaaguaguuaucau

SEQ ID NO: 1151275 - RNA, 15 nt, Human
gaaguaguuaucaug

SEQ ID NO: 1151276 - RNA, 16 nt, Human
gaaguaguuaucaugu

SEQ ID NO: 1151277 - RNA, 17 nt, Human
gaaguaguuaucauguu

SEQ ID NO: 1151278 - RNA, 18 nt, Human
gaaguaguuaucauguua

SEQ ID NO: 1151279 - RNA, 21 nt, Human
gaaguaguuaucauguuagua

SEQ ID NO: 1151280 - RNA, 19 nt, Human
gaaguaguuaucauguuag

SEQ ID NO: 1151281 - RNA, 20 nt, Human
gaauaauccuaaacauauga

SEQ ID NO: 1151282 - RNA, 17 nt, Human
gaauaccuuagugcagu

SEQ ID NO: 1151283 - RNA, 20 nt, Human
gaauaccuuagugcaguuau

SEQ ID NO: 1151284 - RNA, 21 nt, Human
gaauaccuuagugcaguuauu

SEQ ID NO: 1151285 - RNA, 14 nt, Human
gaaugcauaaaaug

SEQ ID NO: 1151286 - RNA, 13 nt, Human
gaaugcuuuagga

SEQ ID NO: 1151287 - RNA, 13 nt, Human
gaauguaaauguc

SEQ ID NO: 1151288 - RNA, 14 nt, Human
gaauguaaaugucu

SEQ ID NO: 1151289 - RNA, 16 nt, Human
gaauguaaaugucuca

SEQ ID NO: 1151290 - RNA, 16 nt, Human
gaauucaaauuuuauc

SEQ ID NO: 1151291 - RNA, 18 nt, Human
gaauucaaauuuuaucug

SEQ ID NO: 1151292 - RNA, 16 nt, Human
gacagacagcccucca

SEQ ID NO: 1151293 - RNA, 14 nt, Human
gacagggcauggcc

SEQ ID NO: 1151294 - RNA, 15 nt, Human
gacagggcauggcca

SEQ ID NO: 1151295 - RNA, 20 nt, Human
gacagggcauggccaggugg

SEQ ID NO: 1151296 - RNA, 22 nt, Human
gacagggcauggccagguggcc

SEQ ID NO: 1151297 - RNA, 14 nt, Human
gaccacacuccagc

SEQ ID NO: 1151298 - RNA, 16 nt, Human
gaccacacuccagcug

SEQ ID NO: 1151299 - RNA, 22 nt, Human
gaccacacuccagcugggauca

SEQ ID NO: 1151300 - RNA, 19 nt, Human
gacccacuggacucaccuc

SEQ ID NO: 1151301 - RNA, 12 nt, Human
gacccccaggac

SEQ ID NO: 1151302 - RNA, 13 nt, Human
gacccccaggaca

SEQ ID NO: 1151303 - RNA, 18 nt, Human
gacuaaaccauugugcau

SEQ ID NO: 1151304 - RNA, 19 nt, Human
gacuaaaccauugugcauu

SEQ ID NO: 1151305 - RNA, 22 nt, Human
gacuaaaccauugugcauucua

SEQ ID NO: 1151306 - RNA, 20 nt, Human
gacugccagucccccugccc

SEQ ID NO: 1151307 - RNA, 18 nt, Human
gacuuacagcaaauccuu

SEQ ID NO: 1151308 - RNA, 15 nt, Human
gacuuagcugggaga

SEQ ID NO: 1151309 - RNA, 14 nt, Human
gacuucagcucugu

SEQ ID NO: 1151310 - RNA, 18 nt, Human
gauaauucuagcuuugag

SEQ ID NO: 1151311 - RNA, 17 nt, Human
gauaggucagugcaaau

SEQ ID NO: 1151312 - RNA, 16 nt, Human
gaucacauguggacuu

SEQ ID NO: 1151313 - RNA, 23 nt, Human
gauccuaaugaaugcauaaaaug

SEQ ID NO: 1151314 - RNA, 16 nt, Human
gauccucccaggcuuc

SEQ ID NO: 1151315 - RNA, 16 nt, Human
gaugaaauguaaauac

SEQ ID NO: 1151316 - RNA, 17 nt, Human
gaugaaauuccauuugu

SEQ ID NO: 1151317 - RNA, 20 nt, Human
gaugccugugaacugaacuc

SEQ ID NO: 1151318 - RNA, 22 nt, Human
gaugcagugccaggaacccuua

SEQ ID NO: 1151319 - RNA, 12 nt, Human
gauuucauguac

SEQ ID NO: 1151320 - RNA, 13 nt, Human
gauuucauguacu

SEQ ID NO: 1151321 - RNA, 16 nt, Human
gauuucauguacugca

SEQ ID NO: 1151322 - RNA, 19 nt, Human
gauuucauguacugcauua

SEQ ID NO: 1151323 - RNA, 20 nt, Human
gauuucauguacugcauuau

SEQ ID NO: 1151324 - RNA, 21 nt, Human
gauuucauguacugcauuauu

SEQ ID NO: 1151325 - RNA, 23 nt, Human
gcaaaguucccuacuuccuguga

SEQ ID NO: 1151326 - RNA, 18 nt, Human
gcaagcaagaaacacugg

SEQ ID NO: 1151327 - RNA, 21 nt, Human
gcaagggaauuucuucaacuc

SEQ ID NO: 1151328 - RNA, 17 nt, Human
gcacugaggaccagcca

SEQ ID NO: 1151329 - RNA, 15 nt, Human
gcagccgugccuuca

SEQ ID NO: 1151330 - RNA, 17 nt, Human
gcagccgugccuucagc

SEQ ID NO: 1151331 - RNA, 18 nt, Human
gcagccgugccuucagcu

SEQ ID NO: 1151332 - RNA, 14 nt, Human
gcagggagggccug

SEQ ID NO: 1151333 - RNA, 17 nt, Human
gcagggagggccugggc

SEQ ID NO: 1151334 - RNA, 18 nt, Human
gcagggagggccugggcc

SEQ ID NO: 1151335 - RNA, 22 nt, Human
gcagggagggccugggccccag

SEQ ID NO: 1151336 - RNA, 14 nt, Human
gcaguguuagcuua

SEQ ID NO: 1151337 - RNA, 13 nt, Human
gcaguguuagcuu

SEQ ID NO: 1151338 - RNA, 23 nt, Human
gcauauaagggaaguaguuauca

SEQ ID NO: 1151339 - RNA, 15 nt, Human
gcauauaagggaagu

SEQ ID NO: 1151340 - RNA, 20 nt, Human
gcauuagauuucucauuugc

SEQ ID NO: 1151341 - RNA, 15 nt, Human
gcauuagcuaaaacc

SEQ ID NO: 1151342 - RNA, 13 nt, Human
gcauucucacucc

SEQ ID NO: 1151343 - RNA, 15 nt, Human
gcauucucacuccua

SEQ ID NO: 1151344 - RNA, 18 nt, Human
gcauucucacuccuaccu

SEQ ID NO: 1151345 - RNA, 17 nt, Human
gcauuuucugcaucucc

SEQ ID NO: 1151346 - RNA, 18 nt, Human
gcauuuucugcaucucca

SEQ ID NO: 1151347 - RNA, 16 nt, Human
gccacuccagaccccu

SEQ ID NO: 1151348 - RNA, 18 nt, Human
gccacuccagaccccugg

SEQ ID NO: 1151349 - RNA, 19 nt, Human
gccacuccagaccccuggc

SEQ ID NO: 1151350 - RNA, 20 nt, Human
gccacuccagaccccuggcu

SEQ ID NO: 1151351 - RNA, 18 nt, Human
gccagguggccacuccag

SEQ ID NO: 1151352 - RNA, 17 nt, Human
gcccaggccugccuguu

SEQ ID NO: 1151353 - RNA, 17 nt, Human
gccccgucccccucugg

SEQ ID NO: 1151354 - RNA, 21 nt, Human
gccccgucccccucuggcucc

SEQ ID NO: 1151355 - RNA, 13 nt, Human
gccccugcacaaa

SEQ ID NO: 1151356 - RNA, 15 nt, Human
gcccucccugccccu

SEQ ID NO: 1151357 - RNA, 21 nt, Human
gcccucccugccccucccuuc

SEQ ID NO: 1151358 - RNA, 22 nt, Human
gcccuuccucuccacugccuuc

SEQ ID NO: 1151359 - RNA, 11 nt, Human
gccguggcuuc

SEQ ID NO: 1151360 - RNA, 12 nt, Human
gccguggcuucc

SEQ ID NO: 1151361 - RNA, 13 nt, Human
gccguggcuuccc

SEQ ID NO: 1151362 - RNA, 15 nt, Human
gccguggcuucccgc

SEQ ID NO: 1151363 - RNA, 14 nt, Human
gccuaaggcugaac

SEQ ID NO: 1151364 - RNA, 23 nt, Human
gccucucuuguaauuuggaucuc

SEQ ID NO: 1151365 - RNA, 12 nt, Human
gccucugcauuc

SEQ ID NO: 1151366 - RNA, 15 nt, Human
gccucugcauucagg

SEQ ID NO: 1151367 - RNA, 16 nt, Human
gccuuagaaccuuucu

SEQ ID NO: 1151368 - RNA, 17 nt, Human
gccuuagaaccuuucuu

SEQ ID NO: 1151369 - RNA, 13 nt, Human
gccuucagcucua

SEQ ID NO: 1151370 - RNA, 16 nt, Human
gccuucagcucuacag

SEQ ID NO: 1151371 - RNA, 16 nt, Human
gccuuuuaguuccugu

SEQ ID NO: 1151372 - RNA, 20 nt, Human
gccuuuuaguuccugugcac

SEQ ID NO: 1151373 - RNA, 17 nt, Human
gccuuuuaguuccugug

SEQ ID NO: 1151374 - RNA, 16 nt, Human
gcgugagaccugcccc

SEQ ID NO: 1151375 - RNA, 19 nt, Human
gcugcccuggugcugccac

SEQ ID NO: 1151376 - RNA, 20 nt, Human
gcugcccuggugcugccaca

SEQ ID NO: 1151377 - RNA, 22 nt, Human
gcugcccuggugcugccacacu

SEQ ID NO: 1151378 - RNA, 23 nt, Human
gcugcccuggugcugccacacuu

SEQ ID NO: 1151379 - RNA, 17 nt, Human
gcugcccuuucugggca

SEQ ID NO: 1151380 - RNA, 12 nt, Human
gcuggcccugcc

SEQ ID NO: 1151381 - RNA, 13 nt, Human
gcuggcccugccc

SEQ ID NO: 1151382 - RNA, 17 nt, Human
gcuggccgggagccuga

SEQ ID NO: 1151383 - RNA, 15 nt, Human
gcugggagcucugca

SEQ ID NO: 1151384 - RNA, 16 nt, Human
gcugggagcucugcag

SEQ ID NO: 1151385 - RNA, 17 nt, Human
gcugggauuacaggcgu

SEQ ID NO: 1151386 - RNA, 18 nt, Human
gcugggauuacaggcgug

SEQ ID NO: 1151387 - RNA, 19 nt, Human
gcugggauuacaggcuccu

SEQ ID NO: 1151388 - RNA, 20 nt, Human
gcugggauuacaggcuccug

SEQ ID NO: 1151389 - RNA, 21 nt, Human
gcugggauuacaggcuccugc

SEQ ID NO: 1151390 - RNA, 16 nt, Human
gcuucuguugcugccu

SEQ ID NO: 1151391 - RNA, 22 nt, Human
gcuugcagagaugaggccgcca

SEQ ID NO: 1151392 - RNA, 14 nt, Human
gcuuugggcugccc

SEQ ID NO: 1151393 - RNA, 15 nt, Human
gcuuugggcugcccu

SEQ ID NO: 1151394 - RNA, 16 nt, Human
gcuuugggcugcccug

SEQ ID NO: 1151395 - RNA, 18 nt, Human
gcuuugggcugcccuggu

SEQ ID NO: 1151396 - RNA, 20 nt, Human
ggaaaaaauaacaaugaaag

SEQ ID NO: 1151397 - RNA, 22 nt, Human
ggaaaaccaagccguggcuucc

SEQ ID NO: 1151398 - RNA, 17 nt, Human
ggaacggaucagauguc

SEQ ID NO: 1151399 - RNA, 23 nt, Human
ggaacuagacucccaagcuggac

SEQ ID NO: 1151400 - RNA, 14 nt, Human
ggaacgugauuagu

SEQ ID NO: 1151401 - RNA, 13 nt, Human
ggaagcagcuuuc

SEQ ID NO: 1151402 - RNA, 14 nt, Human
ggacuccucugucc

SEQ ID NO: 1151403 - RNA, 15 nt, Human
ggacuccucugucca

SEQ ID NO: 1151404 - RNA, 11 nt, Human
ggacucugccu

SEQ ID NO: 1151405 - RNA, 21 nt, Human
ggacugccagucccccugccc

SEQ ID NO: 1151406 - RNA, 20 nt, Human
ggauccacgacgcuuaaaua

SEQ ID NO: 1151407 - RNA, 18 nt, Human
ggcaacuugggaacuaga

SEQ ID NO: 1151408 - RNA, 23 nt, Human
ggcaacuugggaacuagacuccc

SEQ ID NO: 1151409 - RNA, 22 nt, Human
ggcagcacaaguguaaugaaua

SEQ ID NO: 1151410 - RNA, 14 nt, Human
ggcagcuuugcuca

SEQ ID NO: 1151411 - RNA, 15 nt, Human
ggcagcuuugcucau

SEQ ID NO: 1151412 - RNA, 14 nt, Human
ggcaggaaggcuga

SEQ ID NO: 1151413 - RNA, 24 nt, Human
ggcauuagcuaaaaccuuccaugu

SEQ ID NO: 1151414 - RNA, 11 nt, Human
ggccaggcugg

SEQ ID NO: 1151415 - RNA, 12 nt, Human
ggccaggcuggu

SEQ ID NO: 1151416 - RNA, 13 nt, Human
ggccccucccccg

SEQ ID NO: 1151417 - RNA, 17 nt, Human
ggccccucccccguccu

SEQ ID NO: 1151418 - RNA, 15 nt, Human
ggcugggagcucugc

SEQ ID NO: 1151419 - RNA, 12 nt, Human
ggcuucacagau

SEQ ID NO: 1151420 - RNA, 22 nt, Human
ggcuugaguuuaaauuguaaua

SEQ ID NO: 1151421 - RNA, 14 nt, Human
ggcuuuucacugcu

SEQ ID NO: 1151422 - RNA, 15 nt, Human
ggcuuuucacugcug

SEQ ID NO: 1151423 - RNA, 17 nt, Human
ggcuuuucacugcuggc

SEQ ID NO: 1151424 - RNA, 19 nt, Human
ggcuuuucacugcuggcug

SEQ ID NO: 1151425 - RNA, 22 nt, Human
ggcuuuucacugcuggcugccu

SEQ ID NO: 1151426 - RNA, 22 nt, Human
gggaaggcagggagggccuggg

SEQ ID NO: 1151427 - RNA, 18 nt, Human
gggaaguaguuaucaugu

SEQ ID NO: 1151428 - RNA, 22 nt, Human
gggaaguaguuaucauguuagu

SEQ ID NO: 1151429 - RNA, 20 nt, Human
gggaaguaguuaucauguua

SEQ ID NO: 1151430 - RNA, 17 nt, Human
gggaauuucuucaacuc

SEQ ID NO: 1151431 - RNA, 23 nt, Human
gggacaaggacuaggguccuggg

SEQ ID NO: 1151432 - RNA, 14 nt, Human
gggaccccugagcu

SEQ ID NO: 1151433 - RNA, 14 nt, Human
gggcaccggggccu

SEQ ID NO: 1151434 - RNA, 13 nt, Human
gggcacugguggc

SEQ ID NO: 1151435 - RNA, 16 nt, Human
gggcacugguggcccg

SEQ ID NO: 1151436 - RNA, 15 nt, Human
gggcauggccaggug

SEQ ID NO: 1151437 - RNA, 17 nt, Human
gggcauggccagguggc

SEQ ID NO: 1151438 - RNA, 20 nt, Human
gggcauggccagguggccac

SEQ ID NO: 1151439 - RNA, 14 nt, Human
gggccccagaggcu

SEQ ID NO: 1151440 - RNA, 11 nt, Human
gggccugggcc

SEQ ID NO: 1151441 - RNA, 18 nt, Human
ggggaggggcugugggcg

SEQ ID NO: 1151442 - RNA, 19 nt, Human
ggguaacuaacuaaaacaa

SEQ ID NO: 1151443 - RNA, 19 nt, Human
ggguuccuuccucugagcc

SEQ ID NO: 1151444 - RNA, 20 nt, Human
ggguuccuuccucugagccu

SEQ ID NO: 1151445 - RNA, 21 nt, Human
ggguuccuuccucugagccuu

SEQ ID NO: 1151446 - RNA, 17 nt, Human
ggguucuuucuuccucu

SEQ ID NO: 1151447 - RNA, 19 nt, Human
ggguucuuucuuccucugc

SEQ ID NO: 1151448 - RNA, 16 nt, Human
ggucacaggacucugc

SEQ ID NO: 1151449 - RNA, 18 nt, Human
ggucacaggacucugccu

SEQ ID NO: 1151450 - RNA, 16 nt, Human
ggugagaauagaaucu

SEQ ID NO: 1151451 - RNA, 20 nt, Human
gguggccacuccagaccccu

SEQ ID NO: 1151452 - RNA, 21 nt, Human
gguggccacuccagaccccug

SEQ ID NO: 1151453 - RNA, 22 nt, Human
gguggccacuccagaccccugg

SEQ ID NO: 1151454 - RNA, 23 nt, Human
gguggccacuccagaccccuggc

SEQ ID NO: 1151455 - RNA, 21 nt, Human
gguuaguggauggaaggggcu

SEQ ID NO: 1151456 - RNA, 22 nt, Human
gguuaguggauggaaggggcug

SEQ ID NO: 1151457 - RNA, 14 nt, Human
gguucuuucuuccu

SEQ ID NO: 1151458 - RNA, 16 nt, Human
gguucuuucuuccucu

SEQ ID NO: 1151459 - RNA, 17 nt, Human
gguucuuucuuccucug

SEQ ID NO: 1151460 - RNA, 21 nt, Human
gguugauaaaucauuuuaugu

SEQ ID NO: 1151461 - RNA, 14 nt, Human
guuuagcugacaaa

SEQ ID NO: 1151462 - RNA, 15 nt, Human
guuuagcugacaaaa

SEQ ID NO: 1151463 - RNA, 17 nt, Human
guuuagcugacaaaaua

SEQ ID NO: 1151464 - RNA, 20 nt, Human
guuuagcugacaaaauacuu

SEQ ID NO: 1151465 - RNA, 13 nt, Human
guuuccugcccug

SEQ ID NO: 1151466 - RNA, 17 nt, Human
guuuccugcccugggag

SEQ ID NO: 1151467 - RNA, 22 nt, Human
guuuccugcccugggaggcagu

SEQ ID NO: 1151468 - RNA, 19 nt, Human
guuuguggaaaaugaaaau

SEQ ID NO: 1151469 - RNA, 16 nt, Human
guuuguugugaggauu

SEQ ID NO: 1151470 - RNA, 14 nt, Human
guuuucuaguguau

SEQ ID NO: 1151471 - RNA, 23 nt, Human
guuuucuaguguaucaaaaugcu

SEQ ID NO: 1151472 - RNA, 14 nt, Human
guuuuuauuuccua

SEQ ID NO: 1151473 - RNA, 16 nt, Human
guuuuuauuuccuaug

SEQ ID NO: 1151474 - RNA, 19 nt, Human
guuuuuauuuccuaugaug

SEQ ID NO: 1151475 - RNA, 20 nt, Human
guuuuuauuuccuaugaugu

SEQ ID NO: 1151476 - RNA, 21 nt, Human
guuuuuauuuccuaugaugua

SEQ ID NO: 1151477 - RNA, 23 nt, Human
guuuuucagguauauaccuccau

SEQ ID NO: 1151478 - RNA, 15 nt, Human
uaaaaaccuguucaa

SEQ ID NO: 1151479 - RNA, 16 nt, Human
uaaacagauguccauc

SEQ ID NO: 1151480 - RNA, 21 nt, Human
uaaacagauguccaucagaug

SEQ ID NO: 1151481 - RNA, 22 nt, Human
uaaacagauguccaucagauga

SEQ ID NO: 1151482 - RNA, 23 nt, Human
uaaacagauguccaucagaugac

SEQ ID NO: 1151483 - RNA, 16 nt, Human
uaaacaguugcacagc

SEQ ID NO: 1151484 - RNA, 17 nt, Human
uaaacaguugcacagca

SEQ ID NO: 1151485 - RNA, 18 nt, Human
uaaacaguugcacagcau

SEQ ID NO: 1151486 - RNA, 19 nt, Human
uaaacaguugcacagcauc

SEQ ID NO: 1151487 - RNA, 22 nt, Human
uaaacaguugcacagcaucuca

SEQ ID NO: 1151488 - RNA, 20 nt, Human
uaaacugcccccucugcccu

SEQ ID NO: 1151489 - RNA, 21 nt, Human
uaaacugcccccucugcccug

SEQ ID NO: 1151490 - RNA, 22 nt, Human
uaaacugcccccucugcccugc

SEQ ID NO: 1151491 - RNA, 23 nt, Human
uaaacugcccccucugcccugcg

SEQ ID NO: 1151492 - RNA, 14 nt, Human
uaaagcugaaaacu

SEQ ID NO: 1151493 - RNA, 17 nt, Human
uaaauaaaaauaauccu

SEQ ID NO: 1151494 - RNA, 18 nt, Human
uaaauauaugcuaagucu

SEQ ID NO: 1151495 - RNA, 19 nt, Human
uaaaucaaguuggcuucua

SEQ ID NO: 1151496 - RNA, 12 nt, Human
uaaaucauuuua

SEQ ID NO: 1151497 - RNA, 13 nt, Human
uaaaucauuuuau

SEQ ID NO: 1151498 - RNA, 15 nt, Human
uaaaucauuuuaugu

SEQ ID NO: 1151499 - RNA, 19 nt, Human
uaaaucauuuuaugucaag

SEQ ID NO: 1151500 - RNA, 15 nt, Human
uaaauugcuccuuga

SEQ ID NO: 1151501 - RNA, 15 nt, Human
uaacagggaacguga

SEQ ID NO: 1151502 - RNA, 22 nt, Human
uaacagggaacgugauuaguga

SEQ ID NO: 1151503 - RNA, 23 nt, Human
uaacagggaacgugauuagugaa

SEQ ID NO: 1151504 - RNA, 16 nt, Human
uaacugagugccuuuu

SEQ ID NO: 1151505 - RNA, 17 nt, Human
uaacugagugccuuuug

SEQ ID NO: 1151506 - RNA, 14 nt, Human
uaagccuuuggaaa

SEQ ID NO: 1151507 - RNA, 17 nt, Human
uaagccuuuggaaacag

SEQ ID NO: 1151508 - RNA, 21 nt, Human
uaagccuuuggaaacagcucg

SEQ ID NO: 1151509 - RNA, 14 nt, Human
uaauccuguaggaa

SEQ ID NO: 1151510 - RNA, 18 nt, Human
uaauccuguaggaaggua

SEQ ID NO: 1151511 - RNA, 23 nt, Human
uaauccuguaggaagguacugua

SEQ ID NO: 1151512 - RNA, 22 nt, Human
uaauccuguaggaagguacugu

SEQ ID NO: 1151513 - RNA, 13 nt, Human
uaaucgaccugcc

SEQ ID NO: 1151514 - RNA, 14 nt, Human
uaaucgaccugccu

SEQ ID NO: 1151515 - RNA, 16 nt, Human
uaaucgaccugccucg

SEQ ID NO: 1151516 - RNA, 16 nt, Human
uaaucguguccccuau

SEQ ID NO: 1151517 - RNA, 17 nt, Human
uaaugaugucguuugaa

SEQ ID NO: 1151518 - RNA, 23 nt, Human
uaaugaugucguuugaaucacag

SEQ ID NO: 1151519 - RNA, 19 nt, Human
uaaugcgcaggcuggcccu

SEQ ID NO: 1151520 - RNA, 22 nt, Human
uaaugcgcaggcuggcccugcc

SEQ ID NO: 1151521 - RNA, 17 nt, Human
uaaugcgccaauaaacc

SEQ ID NO: 1151522 - RNA, 23 nt, Human
uaaugcgcaggcuggcccugccc

SEQ ID NO: 1151523 - RNA, 13 nt, Human
uaauuguguuuac

SEQ ID NO: 1151524 - RNA, 14 nt, Human
uaauuguguuuaca

SEQ ID NO: 1151525 - RNA, 16 nt, Human
uaauuguguuuacauu

SEQ ID NO: 1151526 - RNA, 17 nt, Human
uaauuguguuuacauuu

SEQ ID NO: 1151527 - RNA, 18 nt, Human
uaauuguguuuacauuuu

SEQ ID NO: 1151528 - RNA, 19 nt, Human
uaauuguguuuacauuuua

SEQ ID NO: 1151529 - RNA, 20 nt, Human
uaauuguguuuacauuuuau

SEQ ID NO: 1151530 - RNA, 22 nt, Human
uaauuguguuuacauuuuaugg

SEQ ID NO: 1151531 - RNA, 21 nt, Human
uaauuguguuuacauuuuaug

SEQ ID NO: 1151532 - RNA, 23 nt, Human
uaauuuggaucucuucuuaaugu

SEQ ID NO: 1151533 - RNA, 15 nt, Human
uacaagacacaguga

SEQ ID NO: 1151534 - RNA, 19 nt, Human
uacaagagcuuaacagugu

SEQ ID NO: 1151535 - RNA, 13 nt, Human
uacagaauuuuau

SEQ ID NO: 1151536 - RNA, 15 nt, Human
uacaggcauagaguu

SEQ ID NO: 1151537 - RNA, 12 nt, Human
uacauuuuaugg

SEQ ID NO: 1151538 - RNA, 17 nt, Human
uacauuuuguaccaacc

SEQ ID NO: 1151539 - RNA, 14 nt, Human
uacauuuuguacca

SEQ ID NO: 1151540 - RNA, 16 nt, Human
uacauuuuguaccaac

SEQ ID NO: 1151541 - RNA, 15 nt, Human
uaccaccacgcccgg

SEQ ID NO: 1151542 - RNA, 14 nt, Human
uacccauuuguuca

SEQ ID NO: 1151543 - RNA, 15 nt, Human
uacccauuuguucau

SEQ ID NO: 1151544 - RNA, 22 nt, Human
uacccauuuguucauauuaaga

SEQ ID NO: 1151545 - RNA, 14 nt, Human
uacugauucaauuu

SEQ ID NO: 1151546 - RNA, 17 nt, Human
uacugauucaauuugau

SEQ ID NO: 1151547 - RNA, 20 nt, Human
uacugauucaauuugaugug

SEQ ID NO: 1151548 - RNA, 11 nt, Human
uacuguaugau

SEQ ID NO: 1151549 - RNA, 13 nt, Human
uacuguaugauca

SEQ ID NO: 1151550 - RNA, 14 nt, Human
uacuguaugaucaa

SEQ ID NO: 1151551 - RNA, 15 nt, Human
uacuguaugaucaaa

SEQ ID NO: 1151552 - RNA, 16 nt, Human
uacuguaugaucaaau

SEQ ID NO: 1151553 - RNA, 17 nt, Human
uacuguaugaucaaaug

SEQ ID NO: 1151554 - RNA, 18 nt, Human
uacuguaugaucaaaugu

SEQ ID NO: 1151555 - RNA, 19 nt, Human
uacuguaugaucaaauguu

SEQ ID NO: 1151556 - RNA, 21 nt, Human
uacuguaugaucaaauguuua

SEQ ID NO: 1151557 - RNA, 22 nt, Human
uacuguaugaucaaauguuuaa

SEQ ID NO: 1151558 - RNA, 12 nt, Human
uagaaccaggca

SEQ ID NO: 1151559 - RNA, 23 nt, Human
uagaaccaggcaacuugggaacu

SEQ ID NO: 1151560 - RNA, 19 nt, Human
uagagaaaacaugcagaac

SEQ ID NO: 1151561 - RNA, 13 nt, Human
uagccccauaauu

SEQ ID NO: 1151562 - RNA, 18 nt, Human
uagcccucacccuggggc

SEQ ID NO: 1151563 - RNA, 17 nt, Human
uagcucuaauguuugca

SEQ ID NO: 1151564 - RNA, 18 nt, Human
uagcucuaauguuugcau

SEQ ID NO: 1151565 - RNA, 19 nt, Human
uagcucuaauguuugcaua

SEQ ID NO: 1151566 - RNA, 20 nt, Human
uagcucuaauguuugcauau

SEQ ID NO: 1151567 - RNA, 21 nt, Human
uagcucuaauguuugcauaua

SEQ ID NO: 1151568 - RNA, 22 nt, Human
uagcugggagaaagagagagcu

SEQ ID NO: 1151569 - RNA, 14 nt, Human
uaggaagguacugu

SEQ ID NO: 1151570 - RNA, 15 nt, Human
uaggaagguacugua

SEQ ID NO: 1151571 - RNA, 16 nt, Human
uaggaagguacuguau

SEQ ID NO: 1151572 - RNA, 18 nt, Human
uaggaagguacuguauga

SEQ ID NO: 1151573 - RNA, 24 nt, Human
uaggaagguacuguaugaucaaau

SEQ ID NO: 1151574 - RNA, 14 nt, Human
uagugaugguuccc

SEQ ID NO: 1151575 - RNA, 18 nt, Human
uagugaugguuccccugu

SEQ ID NO: 1151576 - RNA, 15 nt, Human
uaguggauggaaggg

SEQ ID NO: 1151577 - RNA, 18 nt, Human
uaguggauggaaggggcu

SEQ ID NO: 1151578 - RNA, 12 nt, Human
uaguguaucaaa

SEQ ID NO: 1151579 - RNA, 14 nt, Human
uaguguaucaaaau

SEQ ID NO: 1151580 - RNA, 17 nt, Human
uaguguaucaaaaugcu

SEQ ID NO: 1151581 - RNA, 19 nt, Human
uaguguaucaaaaugcucu

SEQ ID NO: 1151582 - RNA, 17 nt, Human
uauacccccugcaaagc

SEQ ID NO: 1151583 - RNA, 21 nt, Human
uauaccucaauuuucacugug

SEQ ID NO: 1151584 - RNA, 22 nt, Human
uauaccucaauuuucacugugu

SEQ ID NO: 1151585 - RNA, 20 nt, Human
uauacucuuauagacaacau

SEQ ID NO: 1151586 - RNA, 20 nt, Human
uauauacucaagagugguau

SEQ ID NO: 1151587 - RNA, 16 nt, Human
uauauuuccacuucuu

SEQ ID NO: 1151588 - RNA, 15 nt, Human
uaucaguuacacaug

SEQ ID NO: 1151589 - RNA, 16 nt, Human
uaucaugucaaacgug

SEQ ID NO: 1151590 - RNA, 21 nt, Human
uaucaugucaaacgugaaaau

SEQ ID NO: 1151591 - RNA, 13 nt, Human
uaucggcacugua

SEQ ID NO: 1151592 - RNA, 17 nt, Human
uaucggcacuguacaaa

SEQ ID NO: 1151593 - RNA, 21 nt, Human
uauuuucaacgcagcccugcu

SEQ ID NO: 1151594 - RNA, 23 nt, Human
ucaaacggccucacuaggcuucu

SEQ ID NO: 1151595 - RNA, 15 nt, Human
ucaaacgugaaaaug

SEQ ID NO: 1151596 - RNA, 16 nt, Human
ucaaacgugaaaaugc

SEQ ID NO: 1151597 - RNA, 17 nt, Human
ucaaugcuauaacuaug

SEQ ID NO: 1151598 - RNA, 16 nt, Human
ucacaggacucugccu

SEQ ID NO: 1151599 - RNA, 13 nt, Human
ucaccuuuauucu

SEQ ID NO: 1151600 - RNA, 18 nt, Human
ucacuccuaccugguaau

SEQ ID NO: 1151601 - RNA, 19 nt, Human
ucacucuacuuagcauguc

SEQ ID NO: 1151602 - RNA, 20 nt, Human
ucacucuacuuagcaugucc

SEQ ID NO: 1151603 - RNA, 12 nt, Human
ucacuuuuauuu

SEQ ID NO: 1151604 - RNA, 22 nt, Human
ucacuuuuauuuagcaccaggg

SEQ ID NO: 1151605 - RNA, 21 nt, Human
ucagaggggaauaaacuguug

SEQ ID NO: 1151606 - RNA, 15 nt, Human
ucaguuacucuucag

SEQ ID NO: 1151607 - RNA, 16 nt, Human
ucauucacuucacugu

SEQ ID NO: 1151608 - RNA, 17 nt, Human
ucauucacuucacugug

SEQ ID NO: 1151609 - RNA, 19 nt, Human
ucauucacuucacugugcu

SEQ ID NO: 1151610 - RNA, 20 nt, Human
ucauucacuucacugugcug

SEQ ID NO: 1151611 - RNA, 14 nt, Human
uccacaacacacag

SEQ ID NO: 1151612 - RNA, 16 nt, Human
uccauccaggccauuc

SEQ ID NO: 1151613 - RNA, 23 nt, Human
uccaugucaagauucagcuagug

SEQ ID NO: 1151614 - RNA, 14 nt, Human
uccaugucaagauu

SEQ ID NO: 1151615 - RNA, 16 nt, Human
uccaugucaagauuca

SEQ ID NO: 1151616 - RNA, 20 nt, Human
uccaugucaagauucagcua

SEQ ID NO: 1151617 - RNA, 18 nt, Human
ucccaaggcucugagcaa

SEQ ID NO: 1151618 - RNA, 22 nt, Human
ucccaaggcucugagcaaaugu

SEQ ID NO: 1151619 - RNA, 16 nt, Human
ucccaggauguacaag

SEQ ID NO: 1151620 - RNA, 20 nt, Human
ucccaggcgccccuuccccc

SEQ ID NO: 1151621 - RNA, 21 nt, Human
ucccaggcgccccuucccccu

SEQ ID NO: 1151622 - RNA, 15 nt, Human
ucccaggcugagccu

SEQ ID NO: 1151623 - RNA, 16 nt, Human
ucccaggcugagccuc

SEQ ID NO: 1151624 - RNA, 18 nt, Human
ucccaggcugagccucag

SEQ ID NO: 1151625 - RNA, 14 nt, Human
ucccauucaagauu

SEQ ID NO: 1151626 - RNA, 16 nt, Human
ucccauucaagauucc

SEQ ID NO: 1151627 - RNA, 17 nt, Human
uccccagaauggaggca

SEQ ID NO: 1151628 - RNA, 17 nt, Human
ucccccaucucuucugg

SEQ ID NO: 1151629 - RNA, 13 nt, Human
ucccccucuggcu

SEQ ID NO: 1151630 - RNA, 13 nt, Human
ucccccugcccca

SEQ ID NO: 1151631 - RNA, 15 nt, Human
uccccuguucacucu

SEQ ID NO: 1151632 - RNA, 15 nt, Human
uccccuguuuauuca

SEQ ID NO: 1151633 - RNA, 21 nt, Human
uccccuuccuaauuccacagc

SEQ ID NO: 1151634 - RNA, 22 nt, Human
uccccuuccuaauuccacagcu

SEQ ID NO: 1151635 - RNA, 15 nt, Human
ucccuacuuccugug

SEQ ID NO: 1151636 - RNA, 16 nt, Human
ucccuacuuccuguga

SEQ ID NO: 1151637 - RNA, 17 nt, Human
ucccuacuuccugugac

SEQ ID NO: 1151638 - RNA, 20 nt, Human
uccuguaggaagguacugua

SEQ ID NO: 1151639 - RNA, 22 nt, Human
uccuguaggaagguacuguaug

SEQ ID NO: 1151640 - RNA, 21 nt, Human
uccuguaggaagguacuguau

SEQ ID NO: 1151641 - RNA, 16 nt, Human
uccuucaaagcaaaug

SEQ ID NO: 1151642 - RNA, 14 nt, Human
uccuuuuggaguca

SEQ ID NO: 1151643 - RNA, 23 nt, Human
uccuuuuggagucagacagaugu

SEQ ID NO: 1151644 - RNA, 17 nt, Human
ucgcaauguaagacucg

SEQ ID NO: 1151645 - RNA, 12 nt, Human
ucgcccaggcug

SEQ ID NO: 1151646 - RNA, 14 nt, Human
ucgcccaggcugga

SEQ ID NO: 1151647 - RNA, 19 nt, Human
ucgcccaggcuggagugca

SEQ ID NO: 1151648 - RNA, 18 nt, Human
ucggacuuagcugggaga

SEQ ID NO: 1151649 - RNA, 15 nt, Human
ucucaggucccugca

SEQ ID NO: 1151650 - RNA, 12 nt, Human
ucuccugccuca

SEQ ID NO: 1151651 - RNA, 11 nt, Human
ucucuucucca

SEQ ID NO: 1151652 - RNA, 13 nt, Human
ucucuucuccacu

SEQ ID NO: 1151653 - RNA, 14 nt, Human
ucucuucuccacug

SEQ ID NO: 1151654 - RNA, 15 nt, Human
ucucuucuccacugg

SEQ ID NO: 1151655 - RNA, 16 nt, Human
ucucuucuccacugga

SEQ ID NO: 1151656 - RNA, 20 nt, Human
ucugagcauuagauuucuca

SEQ ID NO: 1151657 - RNA, 22 nt, Human
ucugagcauuagauuucucauu

SEQ ID NO: 1151658 - RNA, 14 nt, Human
ucugcacacagcac

SEQ ID NO: 1151659 - RNA, 15 nt, Human
ucuguccgagugugc

SEQ ID NO: 1151660 - RNA, 17 nt, Human
ucuguccgagugugcca

SEQ ID NO: 1151661 - RNA, 13 nt, Human
ucuuauaauuuaa

SEQ ID NO: 1151662 - RNA, 19 nt, Human
ucuucaguuaagccuuugg

SEQ ID NO: 1151663 - RNA, 21 nt, Human
ucuuccaauuuaguuguugua

SEQ ID NO: 1151664 - RNA, 13 nt, Human
ucuucuccacugg

SEQ ID NO: 1151665 - RNA, 16 nt, Human
ucuucuccacuggaug

SEQ ID NO: 1151666 - RNA, 18 nt, Human
ucuuguuuuuuuuuucca

SEQ ID NO: 1151667 - RNA, 21 nt, Human
ucuuguuuuuuuuuuccacuu

SEQ ID NO: 1151668 - RNA, 17 nt, Human
ucuuucacauuuaaaua

SEQ ID NO: 1151669 - RNA, 21 nt, Human
ugaaagauggcugugccucug

SEQ ID NO: 1151670 - RNA, 22 nt, Human
ugaaagauggcugugccucugc

SEQ ID NO: 1151671 - RNA, 23 nt, Human
ugaaagauggcugugccucugcc

SEQ ID NO: 1151672 - RNA, 19 nt, Human
ugaaaggaagauaaacgug

SEQ ID NO: 1151673 - RNA, 19 nt, Human
ugaaauggacuuuuguaca

SEQ ID NO: 1151674 - RNA, 14 nt, Human
ugaacugaacucug

SEQ ID NO: 1151675 - RNA, 17 nt, Human
ugaacugaacucugaca

SEQ ID NO: 1151676 - RNA, 19 nt, Human
ugaacugaacucugacaac

SEQ ID NO: 1151677 - RNA, 22 nt, Human
ugaacuuguaaaggaauuuaaa

SEQ ID NO: 1151678 - RNA, 18 nt, Human
ugaagaccuuuuucugca

SEQ ID NO: 1151679 - RNA, 23 nt, Human
ugaagacuuacagcaaauccuuu

SEQ ID NO: 1151680 - RNA, 15 nt, Human
ugaagaccuuuuucu

SEQ ID NO: 1151681 - RNA, 15 nt, Human
ugcacagcaucucag

SEQ ID NO: 1151682 - RNA, 24 nt, Human
ugcacagccccuaagucaacuuag

SEQ ID NO: 1151683 - RNA, 14 nt, Human
ugcacagcaucuca

SEQ ID NO: 1151684 - RNA, 19 nt, Human
ugcacagugcaucucagcc

SEQ ID NO: 1151685 - RNA, 20 nt, Human
ugcacagugcaucucagccc

SEQ ID NO: 1151686 - RNA, 13 nt, Human
ugcagcuuuaaaa

SEQ ID NO: 1151687 - RNA, 22 nt, Human
ugcagcuuuaaaaaauuaaucu

SEQ ID NO: 1151688 - RNA, 18 nt, Human
ugcauccuccgccucccg

SEQ ID NO: 1151689 - RNA, 21 nt, Human
ugcauccuccgccucccgggu

SEQ ID NO: 1151690 - RNA, 19 nt, Human
ugccuaaggcugaacuugu

SEQ ID NO: 1151691 - RNA, 15 nt, Human
ugccuaguauugaca

SEQ ID NO: 1151692 - RNA, 16 nt, Human
ugccuaguauugacaa

SEQ ID NO: 1151693 - RNA, 13 nt, Human
ugccuucagcucu

SEQ ID NO: 1151694 - RNA, 17 nt, Human
ugccuucagcucuacag

SEQ ID NO: 1151695 - RNA, 18 nt, Human
ugccuucagcucuacagc

SEQ ID NO: 1151696 - RNA, 13 nt, Human
ugcgcaggcuggc

SEQ ID NO: 1151697 - RNA, 16 nt, Human
ugcgcaggcuggcccu

SEQ ID NO: 1151698 - RNA, 17 nt, Human
ugcgcaggcuggcccug

SEQ ID NO: 1151699 - RNA, 19 nt, Human
ugcgcaggcuggcccugcc

SEQ ID NO: 1151700 - RNA, 13 nt, Human
ugcugccucaugc

SEQ ID NO: 1151701 - RNA, 14 nt, Human
ugcugccuccagaa

SEQ ID NO: 1151702 - RNA, 18 nt, Human
ugcuuguuaacugagugc

SEQ ID NO: 1151703 - RNA, 11 nt, Human
uggaaaauaaa

SEQ ID NO: 1151704 - RNA, 15 nt, Human
uggaaaauaaaucaa

SEQ ID NO: 1151705 - RNA, 21 nt, Human
uggaagugugugaucuguggg

SEQ ID NO: 1151706 - RNA, 20 nt, Human
uggagaggcccggccucuca

SEQ ID NO: 1151707 - RNA, 22 nt, Human
uggccacuccagaccccuggcu

SEQ ID NO: 1151708 - RNA, 19 nt, Human
uggcucguuggcuagauua

SEQ ID NO: 1151709 - RNA, 15 nt, Human
uggcuuuucacugcu

SEQ ID NO: 1151710 - RNA, 14 nt, Human
uggcuuuucacugc

SEQ ID NO: 1151711 - RNA, 16 nt, Human
ugggacagggcauggc

SEQ ID NO: 1151712 - RNA, 18 nt, Human
ugggccuucagggaguga

SEQ ID NO: 1151713 - RNA, 17 nt, Human
ugggcgugagaccugcc

SEQ ID NO: 1151714 - RNA, 18 nt, Human
ugggcgugagaccugccc

SEQ ID NO: 1151715 - RNA, 19 nt, Human
ugggcgugagaccugcccc

SEQ ID NO: 1151716 - RNA, 20 nt, Human
ugggcgugagaccugccccu

SEQ ID NO: 1151717 - RNA, 21 nt, Human
uggguuccagcaauucuccug

SEQ ID NO: 1151718 - RNA, 21 nt, Human
uggguuccuuccucugagccu

SEQ ID NO: 1151719 - RNA, 22 nt, Human
uggguuccuuccucugagccuu

SEQ ID NO: 1151720 - RNA, 17 nt, Human
uggguuggaaaacagua

SEQ ID NO: 1151721 - RNA, 16 nt, Human
uguaaaugucucacug

SEQ ID NO: 1151722 - RNA, 17 nt, Human
uguaaaugucucacuga

SEQ ID NO: 1151723 - RNA, 22 nt, Human
uguaaaugucucacugagcacu

SEQ ID NO: 1151724 - RNA, 20 nt, Human
uguaaaugucucacugagca

SEQ ID NO: 1151725 - RNA, 11 nt, Human
uguaaugaaua

SEQ ID NO: 1151726 - RNA, 14 nt, Human
uguaaugaauaccu

SEQ ID NO: 1151727 - RNA, 15 nt, Human
uguaaugaauaccuu

SEQ ID NO: 1151728 - RNA, 12 nt, Human
uguacuccuccc

SEQ ID NO: 1151729 - RNA, 13 nt, Human
uguacuccuccca

SEQ ID NO: 1151730 - RNA, 14 nt, Human
uguacugaaguaaa

SEQ ID NO: 1151731 - RNA, 18 nt, Human
uguacugaaguaaaacaa

SEQ ID NO: 1151732 - RNA, 15 nt, Human
uguacugauucaauu

SEQ ID NO: 1151733 - RNA, 16 nt, Human
uguacugauucaauuu

SEQ ID NO: 1151734 - RNA, 17 nt, Human
uguacugauucaauuug

SEQ ID NO: 1151735 - RNA, 17 nt, Human
uguagauaauacaguuc

SEQ ID NO: 1151736 - RNA, 15 nt, Human
uguauacugccacua

SEQ ID NO: 1151737 - RNA, 14 nt, Human
uguaugcacuuugu

SEQ ID NO: 1151738 - RNA, 20 nt, Human
ugucucaagagggcacuggu

SEQ ID NO: 1151739 - RNA, 21 nt, Human
ugucucaagagggcacuggug

SEQ ID NO: 1151740 - RNA, 23 nt, Human
ugucucaagagggcacugguggc

SEQ ID NO: 1151741 - RNA, 17 nt, Human
ugucucaggucccugca

SEQ ID NO: 1151742 - RNA, 14 nt, Human
ugugccucugccug

SEQ ID NO: 1151743 - RNA, 15 nt, Human
ugugccucugccugu

SEQ ID NO: 1151744 - RNA, 14 nt, Human
ugugcuguuguuau

SEQ ID NO: 1151745 - RNA, 16 nt, Human
ugugcuguuguuauga

SEQ ID NO: 1151746 - RNA, 19 nt, Human
ugugcuguuguuaugaugu

SEQ ID NO: 1151747 - RNA, 20 nt, Human
ugugcuguuguuaugaugug

SEQ ID NO: 1151748 - RNA, 23 nt, Human
ugugcuguuguuaugaugugcuu

SEQ ID NO: 1151749 - RNA, 22 nt, Human
ugugcuuauguaugagguacaa

SEQ ID NO: 1151750 - RNA, 15 nt, Human
ugugcuuaacaggga

SEQ ID NO: 1151751 - RNA, 19 nt, Human
ugugcuuaacagggaacgu

SEQ ID NO: 1151752 - RNA, 17 nt, Human
uguggaaaaugaaaauu

SEQ ID NO: 1151753 - RNA, 21 nt, Human
uguggcuccuggggguucuuu

SEQ ID NO: 1151754 - RNA, 21 nt, Human
uguguuuacauuuuauggugc

SEQ ID NO: 1151755 - RNA, 17 nt, Human
uguucugcacacagcac

SEQ ID NO: 1151756 - RNA, 15 nt, Human
uguugaagccuuugu

SEQ ID NO: 1151757 - RNA, 13 nt, Human
uguugcugccuca

SEQ ID NO: 1151758 - RNA, 14 nt, Human
uguugcugccucau

SEQ ID NO: 1151759 - RNA, 13 nt, Human
uguuggccaggcu

SEQ ID NO: 1151760 - RNA, 18 nt, Human
uguuggccaggcugcucu

SEQ ID NO: 1151761 - RNA, 14 nt, Human
uguuuaaucauaua

SEQ ID NO: 1151762 - RNA, 15 nt, Human
uguuuaaucauauaa

SEQ ID NO: 1151763 - RNA, 16 nt, Human
uguuuaaucauauaaa

SEQ ID NO: 1151764 - RNA, 20 nt, Human
uguuuaaucauauaaauaga

SEQ ID NO: 1151765 - RNA, 23 nt, Human
uguuuaaucauauaaauagaaug

SEQ ID NO: 1151766 - RNA, 24 nt, Human
uguuuaaucauauaaauagaaugu

SEQ ID NO: 1151767 - RNA, 17 nt, Human
uguuuacagauccccaa

SEQ ID NO: 1151768 - RNA, 17 nt, Human
uguuuuaaaaaccuguu

SEQ ID NO: 1151769 - RNA, 18 nt, Human
uuaaauaguaaaaauaaa

SEQ ID NO: 1151770 - RNA, 14 nt, Human
uuaauggaaauguu

SEQ ID NO: 1151771 - RNA, 23 nt, Human
uuacaauaaaaucuugaaaaugc

SEQ ID NO: 1151772 - RNA, 15 nt, Human
uuacagcaaauccuu

SEQ ID NO: 1151773 - RNA, 15 nt, Human
uucaaagcaaauguc

SEQ ID NO: 1151774 - RNA, 17 nt, Human
uucaaauuuuaucugcc

SEQ ID NO: 1151775 - RNA, 17 nt, Human
uucaaccauuccccaug

SEQ ID NO: 1151776 - RNA, 20 nt, Human
uucaaccauuccccauggga

SEQ ID NO: 1151777 - RNA, 13 nt, Human
uucaacgcagccc

SEQ ID NO: 1151778 - RNA, 14 nt, Human
uucaacgcagcccu

SEQ ID NO: 1151779 - RNA, 15 nt, Human
uucaacgcagcccug

SEQ ID NO: 1151780 - RNA, 16 nt, Human
uucaaucccaggaugu

SEQ ID NO: 1151781 - RNA, 22 nt, Human
uucaauccuugaagguauaucu

SEQ ID NO: 1151782 - RNA, 20 nt, Human
uucaaucuucaauccuugaa

SEQ ID NO: 1151783 - RNA, 15 nt, Human
uucaggcucuucucc

SEQ ID NO: 1151784 - RNA, 16 nt, Human
uucaggcucuucuccu

SEQ ID NO: 1151785 - RNA, 21 nt, Human
uuccacuuagaaauugcauuu

SEQ ID NO: 1151786 - RNA, 17 nt, Human
uuccaugucgccucugc

SEQ ID NO: 1151787 - RNA, 18 nt, Human
uuccaugucgccucugca

SEQ ID NO: 1151788 - RNA, 19 nt, Human
uuccaugucgccucugcau

SEQ ID NO: 1151789 - RNA, 20 nt, Human
uuccaugucgccucugcauu

SEQ ID NO: 1151790 - RNA, 21 nt, Human
uuccaugucgccucugcauuc

SEQ ID NO: 1151791 - RNA, 14 nt, Human
uuccccaagacauu

SEQ ID NO: 1151792 - RNA, 11 nt, Human
uuccugcccug

SEQ ID NO: 1151793 - RNA, 13 nt, Human
uuccugcccuggg

SEQ ID NO: 1151794 - RNA, 16 nt, Human
uuccugcccugggagg

SEQ ID NO: 1151795 - RNA, 22 nt, Human
uuccugcccugggaggcaguga

SEQ ID NO: 1151796 - RNA, 13 nt, Human
uuccuuccucuga

SEQ ID NO: 1151797 - RNA, 17 nt, Human
uuccuuccucugagccu

SEQ ID NO: 1151798 - RNA, 11 nt, Human
uucucaugccu

SEQ ID NO: 1151799 - RNA, 12 nt, Human
uucucaugccuc

SEQ ID NO: 1151800 - RNA, 14 nt, Human
uucucaugccucag

SEQ ID NO: 1151801 - RNA, 21 nt, Human
uucucaugccucagccuccug

SEQ ID NO: 1151802 - RNA, 14 nt, Human
uucugagcauuuaa

SEQ ID NO: 1151803 - RNA, 12 nt, Human
uucuguggcuca

SEQ ID NO: 1151804 - RNA, 16 nt, Human
uucuguggcucacaga

SEQ ID NO: 1151805 - RNA, 14 nt, Human
uucuucaacucccu

SEQ ID NO: 1151806 - RNA, 12 nt, Human
uucuucaagauc

SEQ ID NO: 1151807 - RNA, 17 nt, Human
uucuucaagaucccauu

SEQ ID NO: 1151808 - RNA, 18 nt, Human
uucuucaagaucccauuu

SEQ ID NO: 1151809 - RNA, 22 nt, Human
uugaccguguuggucuguacug

SEQ ID NO: 1151810 - RNA, 15 nt, Human
uugcaaaaucaguuu

SEQ ID NO: 1151811 - RNA, 21 nt, Human
uugcaaaaucaguuuuccucu

SEQ ID NO: 1151812 - RNA, 16 nt, Human
uugcaaaaucaguuuu

SEQ ID NO: 1151813 - RNA, 23 nt, Human
uugcaguaucggcacuguacaaa

SEQ ID NO: 1151814 - RNA, 22 nt, Human
uugcauacauucuucaagaucc

SEQ ID NO: 1151815 - RNA, 14 nt, Human
uugccacugccucu

SEQ ID NO: 1151816 - RNA, 15 nt, Human
uugccacugccucuu

SEQ ID NO: 1151817 - RNA, 18 nt, Human
uugccacugccucuuccu

SEQ ID NO: 1151818 - RNA, 11 nt, Human
uugcugccuca

SEQ ID NO: 1151819 - RNA, 12 nt, Human
uugcugccucau

SEQ ID NO: 1151820 - RNA, 15 nt, Human
uugcugccucaugcu

SEQ ID NO: 1151821 - RNA, 17 nt, Human
uuggauuggacaaaaug

SEQ ID NO: 1151822 - RNA, 21 nt, Human
uuggauuggacaaaaugacuu

SEQ ID NO: 1151823 - RNA, 14 nt, Human
uuggccaggcuggu

SEQ ID NO: 1151824 - RNA, 16 nt, Human
uuguaaaggaauuuaa

SEQ ID NO: 1151825 - RNA, 16 nt, Human
uuguaaaugugguaaa

SEQ ID NO: 1151826 - RNA, 21 nt, Human
uuguagagaaaacaugcagaa

SEQ ID NO: 1151827 - RNA, 15 nt, Human
uuguauuuauuuagu

SEQ ID NO: 1151828 - RNA, 14 nt, Human
uuuaaucauauaaa

SEQ ID NO: 1151829 - RNA, 18 nt, Human
uuuaaucauauaaauaga

SEQ ID NO: 1151830 - RNA, 23 nt, Human
uuuaaucauauaaauagaaugua

SEQ ID NO: 1151831 - RNA, 22 nt, Human
uuuaaucauauaaauagaaugu

SEQ ID NO: 1151832 - RNA, 14 nt, Human
uuuauucauaugca

SEQ ID NO: 1151833 - RNA, 15 nt, Human
uuuauucauaugcau

SEQ ID NO: 1151834 - RNA, 16 nt, Human
uuuauucauaugcaua

SEQ ID NO: 1151835 - RNA, 13 nt, Human
uuuauuuccagug

SEQ ID NO: 1151836 - RNA, 17 nt, Human
uuuauuuccuaugaugu

SEQ ID NO: 1151837 - RNA, 13 nt, Human
uuucaaucuucaa

SEQ ID NO: 1151838 - RNA, 15 nt, Human
uuucaaucuucaauc

SEQ ID NO: 1151839 - RNA, 18 nt, Human
uuuccuaugauguauacu

SEQ ID NO: 1151840 - RNA, 14 nt, Human
uuuccuaugaugua

SEQ ID NO: 1151841 - RNA, 23 nt, Human
uuuccugacagaaggacucaggu

SEQ ID NO: 1151842 - RNA, 15 nt, Human
uuucuaaugugugaa

SEQ ID NO: 1151843 - RNA, 14 nt, Human
uuugagcucagccc

SEQ ID NO: 1151844 - RNA, 18 nt, Human
uuugcauacauucuucaa

SEQ ID NO: 1151845 - RNA, 15 nt, Human
uuugccagugggaac

SEQ ID NO: 1151846 - RNA, 16 nt, Human
uuugccagugggaacu

SEQ ID NO: 1151847 - RNA, 17 nt, Human
uuugcauacauucuuca

SEQ ID NO: 1151848 - RNA, 14 nt, Human
uuuguucauauuaa

SEQ ID NO: 1151849 - RNA, 15 nt, Human
uuuguucauauuaag

SEQ ID NO: 1151850 - RNA, 20 nt, Human
uuuuacccauuuguucauau

SEQ ID NO: 1151851 - RNA, 17 nt, Human
uuuucaacgcagcccug

SEQ ID NO: 1151852 - RNA, 21 nt, Human
uuuucaacgcagcccugcuuu

SEQ ID NO: 1151853 - RNA, 22 nt, Human
uuuucaacgcagcccugcuuug

SEQ ID NO: 1151854 - RNA, 19 nt, Human
uuuucacugcuggcugccu

SEQ ID NO: 1151855 - RNA, 20 nt, Human
uuuucacugcuggcugccuu

SEQ ID NO: 1151856 - RNA, 19 nt, Human
uuuuccucucaauaaaauu

SEQ ID NO: 1151857 - RNA, 13 nt, Human
uuuuucugcacua

SEQ ID NO: 1151858 - RNA, 22 nt, Human
uuuuucugcacuauaugcaaac

SEQ ID NO: 1151859 - RNA, 18 nt, Human
uuuuucugcacuauaugc

SEQ ID NO: 1151860 - RNA, 22 nt, Human
aggaacguuuagcugacaaaau

SEQ ID NO: 1151861 - RNA, 14 nt, Human
aguauugacaaaau

SEQ ID NO: 1151862 - RNA, 18 nt, Human
ggauguuacuccaaaacu

SEQ ID NO: 1151863 - RNA, 14 nt, Human
ggauuggacaaaau

SEQ ID NO: 1151864 - RNA, 14 nt, Human
augaagacaaaaca

SEQ ID NO: 1151865 - RNA, 14 nt, Human
cacugcuggcugcc

SEQ ID NO: 1151866 - RNA, 19 nt, Human
aaaccaagccguggcuucc

SEQ ID NO: 1151867 - RNA, 16 nt, Barmah Forest virus
ucauuagacccaaaga

SEQ ID NO: 1151868 - RNA, 21 nt, Barmah Forest virus
gacgauggccaagaugaagac

SEQ ID NO: 1151869 - RNA, 14 nt, Barmah Forest virus
acgauggagaccag

SEQ ID NO: 1151870 - RNA, 18 nt, Barmah Forest virus
aguauccauuguaguaug

SEQ ID NO: 1151871 - RNA, 19 nt, Barmah Forest virus
guagccauagugcugggag

SEQ ID NO: 1151872 - RNA, 18 nt, Barmah Forest virus
caaagacgaagaccauca

SEQ ID NO: 1151873 - RNA, 23 nt, Barmah Forest virus
gagcuaugaugaagucuggaaug

SEQ ID NO: 1151874 - RNA, 16 nt, Barmah Forest virus
cacucaucagaacuag

SEQ ID NO: 1151875 - RNA, 13 nt, Barmah Forest virus
acaacagcaccau

SEQ ID NO: 1151876 - RNA, 22 nt, Barmah Forest virus
cuggaccaucacaguacuagcg

SEQ ID NO: 1151877 - RNA, 16 nt, Barmah Forest virus
gagacuguaaaagaag

SEQ ID NO: 1151878 - RNA, 13 nt, Barmah Forest virus
acuugcccacagg

SEQ ID NO: 1151879 - RNA, 22 nt, Barmah Forest virus
cauccaucucuacuacagcuug

SEQ ID NO: 1151880 - RNA, 19 nt, Barmah Forest virus
cgagcauuuccuacacauc

SEQ ID NO: 1151881 - RNA, 14 nt, Barmah Forest virus
ucauaguuagugua

SEQ ID NO: 1151882 - RNA, 20 nt, Barmah Forest virus
cgaagaccaucaaguacaaa

SEQ ID NO: 1151883 - RNA, 14 nt, Barmah Forest virus
agauagaugugcca

SEQ ID NO: 1151884 - RNA, 14 nt, Barmah Forest virus
accauggggcagug

SEQ ID NO: 1151885 - RNA, 15 nt, Barmah Forest virus
gugccaaaacagcug

SEQ ID NO: 1151886 - RNA, 14 nt, Barmah Forest virus
gagagaagagauua

SEQ ID NO: 1151887 - RNA, 21 nt, Barmah Forest virus
accaaaguuggauaaaaccaa

SEQ ID NO: 1151888 - RNA, 21 nt, Barmah Forest virus
gcagagccacuagccacugcc

SEQ ID NO: 1151889 - RNA, 22 nt, Barmah Forest virus
uggauauugcggacgcgcacuu

SEQ ID NO: 1151890 - RNA, 14 nt, Barmah Forest virus
ugacauucaagaaa

SEQ ID NO: 1151891 - RNA, 14 nt, Barmah Forest virus
gguagauaugaaga

SEQ ID NO: 1151892 - RNA, 22 nt, Barmah Forest virus
ccugcaaaacuuacucccauca

SEQ ID NO: 1151893 - RNA, 16 nt, Barmah Forest virus
agcaccaguccagaga

SEQ ID NO: 1151894 - RNA, 15 nt, Barmah Forest virus
gacccaaagacgaag

SEQ ID NO: 1151895 - RNA, 17 nt, Barmah Forest virus
auugauggcagauagau

SEQ ID NO: 1151896 - RNA, 14 nt, Barmah Forest virus
ggcguacugaagau

SEQ ID NO: 1151897 - RNA, 18 nt, Barmah Forest virus
ucccaucagacagacuua

SEQ ID NO: 1151898 - RNA, 12 nt, Barmah Forest virus
caacagcaccau

SEQ ID NO: 1151899 - RNA, 23 nt, Barmah Forest virus
accaugcuguuacgaaaaagacc

SEQ ID NO: 1151900 - RNA, 14 nt, Barmah Forest virus
auuuagaaaaacuu

SEQ ID NO: 1151901 - RNA, 23 nt, Barmah Forest virus
caaauuuggagcuaugaugaagu

SEQ ID NO: 1151902 - RNA, 13 nt, Barmah Forest virus
ccucggaaaggau

SEQ ID NO: 1151903 - RNA, 13 nt, Barmah Forest virus
aaacaaaaaagag

SEQ ID NO: 1151904 - RNA, 22 nt, Barmah Forest virus
cacccaugagaaaccagaagga

SEQ ID NO: 1151905 - RNA, 14 nt, Barmah Forest virus
aggauguccaggaa

SEQ ID NO: 1151906 - RNA, 20 nt, Barmah Forest virus
augucacacagaugagagaa

SEQ ID NO: 1151907 - RNA, 15 nt, Barmah Forest virus
guaacugcaugaaga

SEQ ID NO: 1151908 - RNA, 13 nt, Barmah Forest virus
auaugaaagcaga

SEQ ID NO: 1151909 - RNA, 14 nt, Barmah Forest virus
cugggcaccgagca

SEQ ID NO: 1151910 - RNA, 16 nt, Barmah Forest virus
ccaucaaguacaaaug

SEQ ID NO: 1151911 - RNA, 16 nt, Barmah Forest virus
ugagcaagacaaucca

SEQ ID NO: 1151912 - RNA, 20 nt, Barmah Forest virus
ugcaccaccaugugcaccau

SEQ ID NO: 1151913 - RNA, 17 nt, Barmah Forest virus
acucccaauacgugccc

SEQ ID NO: 1151914 - RNA, 18 nt, Barmah Forest virus
uggcaccauggggcagug

SEQ ID NO: 1151915 - RNA, 16 nt, Barmah Forest virus
uaagaaaccaacccaa

SEQ ID NO: 1151916 - RNA, 16 nt, Barmah Forest virus
gagcacgucuggagug

SEQ ID NO: 1151917 - RNA, 20 nt, Barmah Forest virus
ucugaagcaaacaaaagcag

SEQ ID NO: 1151918 - RNA, 13 nt, Barmah Forest virus
ggugcaaaugaag

SEQ ID NO: 1151919 - RNA, 15 nt, Barmah Forest virus
cagucagaugaguga

SEQ ID NO: 1151920 - RNA, 15 nt, Barmah Forest virus
ccuuacaaaauguau

SEQ ID NO: 1151921 - RNA, 19 nt, Barmah Forest virus
gaacuguagccgaacucua

SEQ ID NO: 1151922 - RNA, 16 nt, Barmah Forest virus
uaacugcaugaagauc

SEQ ID NO: 1151923 - RNA, 23 nt, Barmah Forest virus
gguagacgauggagaccagcacc

SEQ ID NO: 1151924 - RNA, 23 nt, Barmah Forest virus
guccaggccaccuacagcagaga

SEQ ID NO: 1151925 - RNA, 13 nt, Barmah Forest virus
guacaacucccaa

SEQ ID NO: 1151926 - RNA, 23 nt, Barmah Forest virus
auuccaaaacaccuuacaaaaug

SEQ ID NO: 1151927 - RNA, 20 nt, Barmah Forest virus
ccguuuauguggggaggcgc

SEQ ID NO: 1151928 - RNA, 22 nt, Barmah Forest virus
ucaagugccgguaugcaugaaa

SEQ ID NO: 1151929 - RNA, 19 nt, Barmah Forest virus
aauaaaaauuuagaaaaac

SEQ ID NO: 1151930 - RNA, 16 nt, Barmah Forest virus
gaaagcagagaucgua

SEQ ID NO: 1151931 - RNA, 17 nt, Barmah Forest virus
gcacagaagaagcccaa

SEQ ID NO: 1151932 - RNA, 12 nt, Barmah Forest virus
auuacaaugcau

SEQ ID NO: 1151933 - RNA, 18 nt, Barmah Forest virus
ggccauauaaccccugaa

SEQ ID NO: 1151934 - RNA, 17 nt, Barmah Forest virus
auauuaccccugaauag

SEQ ID NO: 1151935 - RNA, 17 nt, Barmah Forest virus
ccagcaccaguccagag

SEQ ID NO: 1151936 - RNA, 15 nt, Barmah Forest virus
gccaccaaaagaaac

SEQ ID NO: 1151937 - RNA, 23 nt, Barmah Forest virus
aacuaguuuuauuggcacugacu

SEQ ID NO: 1151938 - RNA, 19 nt, Barmah Forest virus
acaccugaagaaucagugg

SEQ ID NO: 1151939 - RNA, 14 nt, Barmah Forest virus
aagugaaaaccugg

SEQ ID NO: 1151940 - RNA, 17 nt, Barmah Forest virus
ccaagaagacaccacca

SEQ ID NO: 1151941 - RNA, 23 nt, Barmah Forest virus
ugcuuagugggggauaaagucau

SEQ ID NO: 1151942 - RNA, 23 nt, Barmah Forest virus
cacacagaugagagaacuaccaa

SEQ ID NO: 1151943 - RNA, 15 nt, Barmah Forest virus
uccguuuuacaaaau

SEQ ID NO: 1151944 - RNA, 14 nt, Barmah Forest virus
ucaugcgaggcuga

SEQ ID NO: 1151945 - RNA, 20 nt, Barmah Forest virus
agggccauauuaccccugaa

SEQ ID NO: 1151946 - RNA, 14 nt, Barmah Forest virus
gccaaguugaaagg

SEQ ID NO: 1151947 - RNA, 22 nt, Barmah Forest virus
guacccuuacuggaccaucaca

SEQ ID NO: 1151948 - RNA, 17 nt, Barmah Forest virus
caacuagugaccucaga

SEQ ID NO: 1151949 - RNA, 16 nt, Barmah Forest virus
gaaaauaugaaagcag

SEQ ID NO: 1151950 - RNA, 14 nt, Barmah Forest virus
cccaucagacagac

SEQ ID NO: 1151951 - RNA, 14 nt, Barmah Forest virus
gcaccgagcaucca

SEQ ID NO: 1151952 - RNA, 23 nt, Barmah Forest virus
caaaaccaaaaaagacccagaag

SEQ ID NO: 1151953 - RNA, 21 nt, Barmah Forest virus
cacccuauguaccccacccuc

SEQ ID NO: 1151954 - RNA, 21 nt, Barmah Forest virus
gaagccuaagaaaccaaccca

SEQ ID NO: 1151955 - RNA, 19 nt, Barmah Forest virus
uaccgucaccauuccaaaa

SEQ ID NO: 1151956 - RNA, 14 nt, Barmah Forest virus
caaguugaaaggac

SEQ ID NO: 1151957 - RNA, 20 nt, Barmah Forest virus
gaaggcgugugaagugcagu

SEQ ID NO: 1151958 - RNA, 18 nt, Barmah Forest virus
accaaaaccaaaaaagac

SEQ ID NO: 1151959 - RNA, 23 nt, Barmah Forest virus
caagacaauccaaguuggggcag

SEQ ID NO: 1151960 - RNA, 23 nt, Barmah Forest virus
cagcaucgcuuaaggcacaagua

SEQ ID NO: 1151961 - RNA, 20 nt, Barmah Forest virus
ugcuuucauaggagaugaca

SEQ ID NO: 1151962 - RNA, 17 nt, Barmah Forest virus
gcacccaccgggcacaa

SEQ ID NO: 1151963 - RNA, 21 nt, Barmah Forest virus
cuguuagagcuugcaaugcau

SEQ ID NO: 1151964 - RNA, 15 nt, Barmah Forest virus
aguucaaagggccau

SEQ ID NO: 1151965 - RNA, 13 nt, Barmah Forest virus
gcccacaaggaag

SEQ ID NO: 1151966 - RNA, 17 nt, Barmah Forest virus
gcccaagaagacaccac

SEQ ID NO: 1151967 - RNA, 18 nt, Barmah Forest virus
cccucugaccgacagcac

SEQ ID NO: 1151968 - RNA, 22 nt, Barmah Forest virus
uggcagauagaugugccaccug

SEQ ID NO: 1151969 - RNA, 20 nt, Barmah Forest virus
gaguggucggcggccgcacu

SEQ ID NO: 1151970 - RNA, 19 nt, Barmah Forest virus
aaucagacgcauccaaguu

SEQ ID NO: 1151971 - RNA, 13 nt, Barmah Forest virus
gggcccggacagc

SEQ ID NO: 1151972 - RNA, 19 nt, Barmah Forest virus
gaaaccaacccaaaagaag

SEQ ID NO: 1151973 - RNA, 14 nt, Barmah Forest virus
aguucaaagggcca

SEQ ID NO: 1151974 - RNA, 23 nt, Barmah Forest virus
gaauaguaacaaaagagaaaaac

SEQ ID NO: 1151975 - RNA, 16 nt, Barmah Forest virus
ucuagugccaaaacag

SEQ ID NO: 1151976 - RNA, 15 nt, Barmah Forest virus
cguaacugcaugaag

SEQ ID NO: 1151977 - RNA, 13 nt, Barmah Forest virus
agauccaugugcc

SEQ ID NO: 1151978 - RNA, 13 nt, Barmah Forest virus
ugccauccacagc

SEQ ID NO: 1151979 - RNA, 22 nt, Barmah Forest virus
cucaagugccgguaugcaugaa

SEQ ID NO: 1151980 - RNA, 19 nt, Barmah Forest virus
cgaaaacagucagaugagu

SEQ ID NO: 1151981 - RNA, 12 nt, Barmah Forest virus
ccgaaaauguca

SEQ ID NO: 1151982 - RNA, 15 nt, Barmah Forest virus
cgauggagaccagca

SEQ ID NO: 1151983 - RNA, 19 nt, Barmah Forest virus
uccaauacagguaagucgu

SEQ ID NO: 1151984 - RNA, 17 nt, Barmah Forest virus
  misc_feature (3)..(3): n is a, c, g or u
ugnauauaacagcacua

SEQ ID NO: 1151985 - RNA, 17 nt, Barmah Forest virus
acccuuacuggaccauc

SEQ ID NO: 1151986 - RNA, 19 nt, Barmah Forest virus
accaacccaaaagaagaag

SEQ ID NO: 1151987 - RNA, 18 nt, Barmah Forest virus
gaucgacaauccagaacu

SEQ ID NO: 1151988 - RNA, 11 nt, Barmah Forest virus
caaagggccau

SEQ ID NO: 1151989 - RNA, 13 nt, Barmah Forest virus
aguccccagcacc

SEQ ID NO: 1151990 - RNA, 22 nt, Barmah Forest virus
aaacuaaauaaaaauuuagaaa

SEQ ID NO: 1151991 - RNA, 15 nt, Barmah Forest virus
caaccaccagcgccu

SEQ ID NO: 1151992 - RNA, 11 nt, Barmah Forest virus
cugaagaucca

SEQ ID NO: 1151993 - RNA, 15 nt, Barmah Forest virus
ccagaacuagccaaa

SEQ ID NO: 1151994 - RNA, 14 nt, Barmah Forest virus
cauuccaaaacacc

SEQ ID NO: 1151995 - RNA, 17 nt, Barmah Forest virus
uacgacuaugggcacag

SEQ ID NO: 1151996 - RNA, 17 nt, Barmah Forest virus
aacauggaggucaagau

SEQ ID NO: 1151997 - RNA, 13 nt, Barmah Forest virus
caagugacauaca

SEQ ID NO: 1151998 - RNA, 13 nt, Barmah Forest virus
accuggagacagu

SEQ ID NO: 1151999 - RNA, 16 nt, Barmah Forest virus
aaguaugaucuagaau

SEQ ID NO: 1152000 - RNA, 22 nt, Barmah Forest virus
uaugcaguggauaacacagugu

SEQ ID NO: 1152001 - RNA, 12 nt, Barmah Forest virus
aguagaccaaaa

SEQ ID NO: 1152002 - RNA, 19 nt, Barmah Forest virus
gcucuggcaaaccuggaga

SEQ ID NO: 1152003 - RNA, 20 nt, Barmah Forest virus
acgaaccggcaaaacuagaa

SEQ ID NO: 1152004 - RNA, 23 nt, Barmah Forest virus
gugcgguaccgucaccauuccaa

SEQ ID NO: 1152005 - RNA, 15 nt, Barmah Forest virus
accaacccaaaagaa

SEQ ID NO: 1152006 - RNA, 13 nt, Barmah Forest virus
auaaccccugaau

SEQ ID NO: 1152007 - RNA, 15 nt, Barmah Forest virus
caugugcaccaugcu

SEQ ID NO: 1152008 - RNA, 21 nt, Barmah Forest virus
agacgauggagaccagcacca

SEQ ID NO: 1152009 - RNA, 20 nt, Barmah Forest virus
agaaaccaacccaaaagaag

SEQ ID NO: 1152010 - RNA, 22 nt, Barmah Forest virus
cacucauacuuggacccacaga

SEQ ID NO: 1152011 - RNA, 23 nt, Barmah Forest virus
cuuggcccgcugccgacccggca

SEQ ID NO: 1152012 - RNA, 23 nt, Barmah Forest virus
cauaccccaaccccaaccaccag

SEQ ID NO: 1152013 - RNA, 18 nt, Barmah Forest virus
aaaucuagcaaguaugau

SEQ ID NO: 1152014 - RNA, 21 nt, Barmah Forest virus
aguguauuacauaugcagugg

SEQ ID NO: 1152015 - RNA, 14 nt, Barmah Forest virus
uaacaccugaagaa

SEQ ID NO: 1152016 - RNA, 17 nt, Barmah Forest virus
ccaaguguccaugcaga

SEQ ID NO: 1152017 - RNA, 13 nt, Barmah Forest virus
gcaguccugcacu

SEQ ID NO: 1152018 - RNA, 18 nt, Barmah Forest virus
cgaacucuacggagaugu

SEQ ID NO: 1152019 - RNA, 16 nt, Barmah Forest virus
ccugggaguagaccaa

SEQ ID NO: 1152020 - RNA, 18 nt, Barmah Forest virus
cagucagcguagcaccug

SEQ ID NO: 1152021 - RNA, 22 nt, Barmah Forest virus
ugacgauggccaagaugaagac

SEQ ID NO: 1152022 - RNA, 17 nt, Barmah Forest virus
cugucuggacagauccu

SEQ ID NO: 1152023 - RNA, 22 nt, Barmah Forest virus
aguugaaaggaccgaaagcugc

SEQ ID NO: 1152024 - RNA, 13 nt, Barmah Forest virus
ccaccaaaaccaa

SEQ ID NO: 1152025 - RNA, 22 nt, Barmah Forest virus
gccgaacucuacggagauguag

SEQ ID NO: 1152026 - RNA, 19 nt, Barmah Forest virus
cauucaagaaaucuagcaa

SEQ ID NO: 1152027 - RNA, 12 nt, Barmah Forest virus
auacggccaccu

SEQ ID NO: 1152028 - RNA, 11 nt, Barmah Forest virus
ugguccaagug

SEQ ID NO: 1152029 - RNA, 18 nt, Barmah Forest virus
ucugaccacuacuaccac

SEQ ID NO: 1152030 - RNA, 14 nt, Barmah Forest virus
agaaauaguucaaa

SEQ ID NO: 1152031 - RNA, 12 nt, Barmah Forest virus
cucggaaaggau

SEQ ID NO: 1152032 - RNA, 19 nt, Barmah Forest virus
guggcaguacaacucccaa

SEQ ID NO: 1152033 - RNA, 18 nt, Barmah Forest virus
cgauggagaccagcacca

SEQ ID NO: 1152034 - RNA, 23 nt, Barmah Forest virus
aaacuguaaugucacacagauga

SEQ ID NO: 1152035 - RNA, 18 nt, Barmah Forest virus
acagcacgugugcaguca

SEQ ID NO: 1152036 - RNA, 22 nt, Barmah Forest virus
caaugguuggcacacaccaccu

SEQ ID NO: 1152037 - RNA, 14 nt, Barmah Forest virus
gagcuaugaugaag

SEQ ID NO: 1152038 - RNA, 24 nt, Barmah Forest virus
uuguuauguaaguauguaguagua

SEQ ID NO: 1152039 - RNA, 13 nt, Barmah Forest virus
gacccagaagccu

SEQ ID NO: 1152040 - RNA, 19 nt, Barmah Forest virus
auccaaguguccaugcaga

SEQ ID NO: 1152041 - RNA, 13 nt, Barmah Forest virus
cucuuuugacaaa

SEQ ID NO: 1152042 - RNA, 21 nt, Barmah Forest virus
gcaccugaaccgcaagugaca

SEQ ID NO: 1152043 - RNA, 21 nt, Barmah Forest virus
uugccacgcaggccuacgagc

SEQ ID NO: 1152044 - RNA, 14 nt, Barmah Forest virus
ccaagaugaagaca

SEQ ID NO: 1152045 - RNA, 14 nt, Barmah Forest virus
aaccaaaaaagacc

SEQ ID NO: 1152046 - RNA, 17 nt, Barmah Forest virus
caugagaaaccagaagg

SEQ ID NO: 1152047 - RNA, 14 nt, Barmah Forest virus
cgguagauaugaag

SEQ ID NO: 1152048 - RNA, 12 nt, Barmah Forest virus
cauaugcagugg

SEQ ID NO: 1152049 - RNA, 20 nt, Barmah Forest virus
aauuuuuaaauugaacugua

SEQ ID NO: 1152050 - RNA, 20 nt, Barmah Forest virus
acugcuacgaacaaaaucac

SEQ ID NO: 1152051 - RNA, 21 nt, Barmah Forest virus
guguuugucaacggagacagu

SEQ ID NO: 1152052 - RNA, 15 nt, Barmah Forest virus
uguaaguauguagua

SEQ ID NO: 1152053 - RNA, 20 nt, Barmah Forest virus
guaagccauugccacuugac

SEQ ID NO: 1152054 - RNA, 18 nt, Barmah Forest virus
guaagugugccauccaca

SEQ ID NO: 1152055 - RNA, 23 nt, Barmah Forest virus
gaagacgugcauuacaugaugaa

SEQ ID NO: 1152056 - RNA, 13 nt, Barmah Forest virus
gaaaaaagagaag

SEQ ID NO: 1152057 - RNA, 23 nt, Barmah Forest virus
agcugucuggacagauccuccuu

SEQ ID NO: 1152058 - RNA, 23 nt, Barmah Forest virus
acggcguacugaagauccaagug

SEQ ID NO: 1152059 - RNA, 14 nt, Barmah Forest virus
uauggugacccgca

SEQ ID NO: 1152060 - RNA, 14 nt, Barmah Forest virus
cauauaaccccuga

SEQ ID NO: 1152061 - RNA, 23 nt, Barmah Forest virus
aagacaccaccaccaaaaccaaa

SEQ ID NO: 1152062 - RNA, 19 nt, Barmah Forest virus
guagggcugcgacacagag

SEQ ID NO: 1152063 - RNA, 14 nt, Barmah Forest virus
gcagacccacugaa

SEQ ID NO: 1152064 - RNA, 17 nt, Barmah Forest virus
uagccgaacucuacgga

SEQ ID NO: 1152065 - RNA, 17 nt, Barmah Forest virus
caagaagacaccaccac

SEQ ID NO: 1152066 - RNA, 10 nt, Barmah Forest virus
ucagggccac

SEQ ID NO: 1152067 - RNA, 23 nt, Barmah Forest virus
uucacgguagauaugaagagaga

SEQ ID NO: 1152068 - RNA, 23 nt, Barmah Forest virus
ggcagguucggagacauccaaag

SEQ ID NO: 1152069 - RNA, 21 nt, Barmah Forest virus
gaaaccaacccaaaagaagaa

SEQ ID NO: 1152070 - RNA, 14 nt, Barmah Forest virus
caaaccuggagaca

SEQ ID NO: 1152071 - RNA, 16 nt, Barmah Forest virus
gacaauccagaacuag

SEQ ID NO: 1152072 - RNA, 18 nt, Barmah Forest virus
aggugcaaaugaaggggc

SEQ ID NO: 1152073 - RNA, 23 nt, Barmah Forest virus
uaaugucacacagaugagagaac

SEQ ID NO: 1152074 - RNA, 13 nt, Barmah Forest virus
gagcacagaagaa

SEQ ID NO: 1152075 - RNA, 14 nt, Barmah Forest virus
gaagccuaagaaac

SEQ ID NO: 1152076 - RNA, 21 nt, Barmah Forest virus
caacauaugauucugcagugc

SEQ ID NO: 1152077 - RNA, 17 nt, Barmah Forest virus
ccaagcagaaacaaaaa

SEQ ID NO: 1152078 - RNA, 17 nt, Barmah Forest virus
gucuaauuuguuuuuua

SEQ ID NO: 1152079 - RNA, 15 nt, Barmah Forest virus
cguccacucaucaga

SEQ ID NO: 1152080 - RNA, 17 nt, Barmah Forest virus
cuugacucgacgaugca

SEQ ID NO: 1152081 - RNA, 19 nt, Barmah Forest virus
ggcaccauggggcagugca

SEQ ID NO: 1152082 - RNA, 21 nt, Barmah Forest virus
cugaauaguaacaaaagagaa

SEQ ID NO: 1152083 - RNA, 20 nt, Barmah Forest virus
cagaacuagccaaauugaca

SEQ ID NO: 1152084 - RNA, 13 nt, Barmah Forest virus
uccaggccaccua

SEQ ID NO: 1152085 - RNA, 23 nt, Barmah Forest virus
agguacugcuacgaacaaaauca

SEQ ID NO: 1152086 - RNA, 21 nt, Barmah Forest virus
cagcccuauccguggucaccu

SEQ ID NO: 1152087 - RNA, 16 nt, Barmah Forest virus
auuugauagaggcugc

SEQ ID NO: 1152088 - RNA, 21 nt, Barmah Forest virus
ucugcagugcuaaauguagag

SEQ ID NO: 1152089 - RNA, 22 nt, Barmah Forest virus
agcucaugugaagggcacgauc

SEQ ID NO: 1152090 - RNA, 13 nt, Barmah Forest virus
guacaaaugcacu

SEQ ID NO: 1152091 - RNA, 12 nt, Barmah Forest virus
acagucaagaau

SEQ ID NO: 1152092 - RNA, 20 nt, Barmah Forest virus
caugcgaggcugaccaugcc

SEQ ID NO: 1152093 - RNA, 20 nt, Barmah Forest virus
ccugaagaaucaguggagug

SEQ ID NO: 1152094 - RNA, 22 nt, Barmah Forest virus
acgaugaaggauucugugcagg

SEQ ID NO: 1152095 - RNA, 15 nt, Barmah Forest virus
accccaaguauuaug

SEQ ID NO: 1152096 - RNA, 16 nt, Barmah Forest virus
gugccaccuggaugaa

SEQ ID NO: 1152097 - RNA, 13 nt, Barmah Forest virus
agagagaccaaag

SEQ ID NO: 1152098 - RNA, 19 nt, Barmah Forest virus
guuggaauacggccaccuu

SEQ ID NO: 1152099 - RNA, 15 nt, Barmah Forest virus
aagcaccgauccaaa

SEQ ID NO: 1152100 - RNA, 14 nt, Barmah Forest virus
gaugagagaacuac

SEQ ID NO: 1152101 - RNA, 23 nt, Barmah Forest virus
agucacgcccggaaccaagcaca

SEQ ID NO: 1152102 - RNA, 18 nt, Barmah Forest virus
auccuauugcuguagaaa

SEQ ID NO: 1152103 - RNA, 17 nt, Barmah Forest virus
cgguagauaugaagaga

SEQ ID NO: 1152104 - RNA, 14 nt, Barmah Forest virus
auuaguauagucau

SEQ ID NO: 1152105 - RNA, 12 nt, Barmah Forest virus
gaaaaugucacc

SEQ ID NO: 1152106 - RNA, 22 nt, Barmah Forest virus
aauucaugcaccaaaguuggau

SEQ ID NO: 1152107 - RNA, 12 nt, Barmah Forest virus
augucuggggaa

SEQ ID NO: 1152108 - RNA, 21 nt, Barmah Forest virus
gacgugcauuacaugaugaag

SEQ ID NO: 1152109 - RNA, 13 nt, Barmah Forest virus
aguucaaagggcc

SEQ ID NO: 1152110 - RNA, 17 nt, Barmah Forest virus
auaaccaccgaaaaugu

SEQ ID NO: 1152111 - RNA, 22 nt, Barmah Forest virus
gugcucgguguucacaggcgug

SEQ ID NO: 1152112 - RNA, 22 nt, Barmah Forest virus
uagcaaguaugaucuagaaugu

SEQ ID NO: 1152113 - RNA, 15 nt, Barmah Forest virus
cacacagaugagaga

SEQ ID NO: 1152114 - RNA, 17 nt, Barmah Forest virus
cacagagugugugaagc

SEQ ID NO: 1152115 - RNA, 15 nt, Barmah Forest virus
guguccuccagaacu

SEQ ID NO: 1152116 - RNA, 20 nt, Barmah Forest virus
gaaaacagucagaugaguga

SEQ ID NO: 1152117 - RNA, 19 nt, Barmah Forest virus
cgagagaagagauuacaau

SEQ ID NO: 1152118 - RNA, 23 nt, Barmah Forest virus
gacgauggccaagaugaagacag

SEQ ID NO: 1152119 - RNA, 19 nt, Barmah Forest virus
acacagaugagagaacuac

SEQ ID NO: 1152120 - RNA, 17 nt, Barmah Forest virus
ugaugucuaugccaaca

SEQ ID NO: 1152121 - RNA, 12 nt, Barmah Forest virus
aaggacauuaca

SEQ ID NO: 1152122 - RNA, 14 nt, Barmah Forest virus
aguauaguauuaua

SEQ ID NO: 1152123 - RNA, 18 nt, Barmah Forest virus
auccguuuuacaaaauug

SEQ ID NO: 1152124 - RNA, 20 nt, Barmah Forest virus
gaagaccguuaugccgucca

SEQ ID NO: 1152125 - RNA, 14 nt, Barmah Forest virus
acacagaugagaga

SEQ ID NO: 1152126 - RNA, 18 nt, Barmah Forest virus
gcguacugaagauccaag

SEQ ID NO: 1152127 - RNA, 21 nt, Barmah Forest virus
acucuacggagauguaggcau

SEQ ID NO: 1152128 - RNA, 15 nt, Barmah Forest virus
agaaacaaaaaagag

SEQ ID NO: 1152129 - RNA, 16 nt, Barmah Forest virus
aacaaaagagaaaaac

SEQ ID NO: 1152130 - RNA, 21 nt, Barmah Forest virus
ugcugggaggugcaaaugaag

SEQ ID NO: 1152131 - RNA, 21 nt, Barmah Forest virus
gccgaacucuacggagaugua

SEQ ID NO: 1152132 - RNA, 11 nt, Barmah Forest virus
cacagaagaag

SEQ ID NO: 1152133 - RNA, 13 nt, Barmah Forest virus
uuacgaaaaagac

SEQ ID NO: 1152134 - RNA, 16 nt, Barmah Forest virus
cacgccguaggagagg

SEQ ID NO: 1152135 - RNA, 12 nt, Barmah Forest virus
gagagaagagau

SEQ ID NO: 1152136 - RNA, 18 nt, Barmah Forest virus
uuuuaaauugaacuguag

SEQ ID NO: 1152137 - RNA, 18 nt, Barmah Forest virus
ccuaagauugcugucuga

SEQ ID NO: 1152138 - RNA, 16 nt, Barmah Forest virus
gaaggauucugugcag

SEQ ID NO: 1152139 - RNA, 21 nt, Barmah Forest virus
ggagaccagcaccaguccaga

SEQ ID NO: 1152140 - RNA, 14 nt, Barmah Forest virus
cgaccaugggccau

SEQ ID NO: 1152141 - RNA, 19 nt, Barmah Forest virus
uccuauggacaaauucacg

SEQ ID NO: 1152142 - RNA, 14 nt, Barmah Forest virus
guucaaagggccau

SEQ ID NO: 1152143 - RNA, 21 nt, Barmah Forest virus
cagacuuaacgagagaagaga

SEQ ID NO: 1152144 - RNA, 22 nt, Barmah Forest virus
aaguguauuacauaugcagugg

SEQ ID NO: 1152145 - RNA, 22 nt, Barmah Forest virus
augccguacaccauucucccac

SEQ ID NO: 1152146 - RNA, 14 nt, Barmah Forest virus
aucucaacuccaac

SEQ ID NO: 1152147 - RNA, 17 nt, Barmah Forest virus
gcaggccuacgagcacu

SEQ ID NO: 1152148 - RNA, 17 nt, Barmah Forest virus
aaggauucugugcagga

SEQ ID NO: 1152149 - RNA, 15 nt, Barmah Forest virus
cugcauucggggaaa

SEQ ID NO: 1152150 - RNA, 23 nt, Barmah Forest virus
cgaaguuacggaggugaaaggaa

SEQ ID NO: 1152151 - RNA, 13 nt, Barmah Forest virus
cccacugaagaga

SEQ ID NO: 1152152 - RNA, 17 nt, Barmah Forest virus
auaugaaagcagagauc

SEQ ID NO: 1152153 - RNA, 22 nt, Barmah Forest virus
uuccauccaucucuacuacagc

SEQ ID NO: 1152154 - RNA, 17 nt, Barmah Forest virus
ugccaaaacagcuguua

SEQ ID NO: 1152155 - RNA, 20 nt, Barmah Forest virus
acucauacuuggacccacag

SEQ ID NO: 1152156 - RNA, 18 nt, Barmah Forest virus
agaacuaccaacauauga

SEQ ID NO: 1152157 - RNA, 19 nt, Barmah Forest virus
cgauggagaccagcaccag

SEQ ID NO: 1152158 - RNA, 17 nt, Barmah Forest virus
aucacuaagcaccgauc

SEQ ID NO: 1152159 - RNA, 16 nt, Barmah Forest virus
gcuaguguccaauaca

SEQ ID NO: 1152160 - RNA, 17 nt, Barmah Forest virus
ucugucuagugccaaaa

SEQ ID NO: 1152161 - RNA, 20 nt, Barmah Forest virus
agggccauauaaccccugaa

SEQ ID NO: 1152162 - RNA, 18 nt, Barmah Forest virus
agcuaauuuuccaucagu

SEQ ID NO: 1152163 - RNA, 22 nt, Barmah Forest virus
agcaccaguccagagauacaua

SEQ ID NO: 1152164 - RNA, 12 nt, Barmah Forest virus
gaggugaaagga

SEQ ID NO: 1152165 - RNA, 15 nt, Barmah Forest virus
auucaugcaccaaag

SEQ ID NO: 1152166 - RNA, 15 nt, Barmah Forest virus
agagcacagaagaag

SEQ ID NO: 1152167 - RNA, 13 nt, Barmah Forest virus
cuacucugucuaa

SEQ ID NO: 1152168 - RNA, 15 nt, Barmah Forest virus
cagcuuggcaauggu

SEQ ID NO: 1152169 - RNA, 14 nt, Barmah Forest virus
agcucuacaaccca

SEQ ID NO: 1152170 - RNA, 13 nt, Barmah Forest virus
uuguuguaguauc

SEQ ID NO: 1152171 - RNA, 21 nt, Barmah Forest virus
cacgguagauaugaagagaga

SEQ ID NO: 1152172 - RNA, 22 nt, Barmah Forest virus
aucgacaauccagaacuagcca

SEQ ID NO: 1152173 - RNA, 20 nt, Barmah Forest virus
cauagucucacauuacuaug

SEQ ID NO: 1152174 - RNA, 23 nt, Barmah Forest virus
gcaaugaaaaguccccagcaccc

SEQ ID NO: 1152175 - RNA, 22 nt, Barmah Forest virus
auuguucaagcuagguaagcca

SEQ ID NO: 1152176 - RNA, 13 nt, Barmah Forest virus
caucaaguacaaa

SEQ ID NO: 1152177 - RNA, 23 nt, Barmah Forest virus
cgucugaagcaaacaaaagcagg

SEQ ID NO: 1152178 - RNA, 12 nt, Barmah Forest virus
cuuggacccaca

SEQ ID NO: 1152179 - RNA, 13 nt, Barmah Forest virus
gagaccagcacca

SEQ ID NO: 1152180 - RNA, 17 nt, Barmah Forest virus
cagaggucugucuagug

SEQ ID NO: 1152181 - RNA, 21 nt, Barmah Forest virus
acauaugcaguggauaacaca

SEQ ID NO: 1152182 - RNA, 13 nt, Barmah Forest virus
gcccaagaagaca

SEQ ID NO: 1152183 - RNA, 18 nt, Barmah Forest virus
agucaugaaaccagcuca

SEQ ID NO: 1152184 - RNA, 12 nt, Barmah Forest virus
uggaaaaaagag

SEQ ID NO: 1152185 - RNA, 20 nt, Barmah Forest virus
agucacuucauauaaaauua

SEQ ID NO: 1152186 - RNA, 17 nt, Barmah Forest virus
caccaccucagggccac

SEQ ID NO: 1152187 - RNA, 19 nt, Barmah Forest virus
acuuccacccuauguaccc

SEQ ID NO: 1152188 - RNA, 18 nt, Barmah Forest virus
guucacacaaaaaugaag

SEQ ID NO: 1152189 - RNA, 15 nt, Barmah Forest virus
uauaaccccugaaua

SEQ ID NO: 1152190 - RNA, 15 nt, Barmah Forest virus
ccauauuaccccuga

SEQ ID NO: 1152191 - RNA, 16 nt, Barmah Forest virus
aacauaccgaucagua

SEQ ID NO: 1152192 - RNA, 16 nt, Barmah Forest virus
gugugaagccaucgaa

SEQ ID NO: 1152193 - RNA, 19 nt, Barmah Forest virus
auacgacgcauaccuagau

SEQ ID NO: 1152194 - RNA, 18 nt, Barmah Forest virus
caauggaguacaggaggc

SEQ ID NO: 1152195 - RNA, 13 nt, Barmah Forest virus
uaaccccugaaua

SEQ ID NO: 1152196 - RNA, 22 nt, Barmah Forest virus
aagguacugcuacgaacaaaau

SEQ ID NO: 1152197 - RNA, 12 nt, Barmah Forest virus
cuacagcagaga

SEQ ID NO: 1152198 - RNA, 15 nt, Barmah Forest virus
uccacaacagcacca

SEQ ID NO: 1152199 - RNA, 18 nt, Barmah Forest virus
ggccauauuaccccugaa

SEQ ID NO: 1152200 - RNA, 14 nt, Barmah Forest virus
cacuugcccacagg

SEQ ID NO: 1152201 - RNA, 12 nt, Barmah Forest virus
cagcggccacca

SEQ ID NO: 1152202 - RNA, 19 nt, Barmah Forest virus
gccucggaaaggauccgag

SEQ ID NO: 1152203 - RNA, 22 nt, Barmah Forest virus
aaaacuaaauaaaaauuuagaa

SEQ ID NO: 1152204 - RNA, 13 nt, Barmah Forest virus
aagggccauauua

SEQ ID NO: 1152205 - RNA, 14 nt, Barmah Forest virus
cggaggugaaagga

SEQ ID NO: 1152206 - RNA, 19 nt, Barmah Forest virus
cagacaaauugauggcaga

SEQ ID NO: 1152207 - RNA, 17 nt, Barmah Forest virus
cuaucaauuagcaccag

SEQ ID NO: 1152208 - RNA, 13 nt, Barmah Forest virus
augguaaguguga

SEQ ID NO: 1152209 - RNA, 18 nt, Barmah Forest virus
cgugugaugcaccaccau

SEQ ID NO: 1152210 - RNA, 15 nt, Barmah Forest virus
ggcauccgaacucua

SEQ ID NO: 1152211 - RNA, 15 nt, Barmah Forest virus
cagcucaugugaagg

SEQ ID NO: 1152212 - RNA, 17 nt, Barmah Forest virus
agacccacugaagagau

SEQ ID NO: 1152213 - RNA, 15 nt, Barmah Forest virus
gacauucaagaaauc

SEQ ID NO: 1152214 - RNA, 13 nt, Barmah Forest virus
cacaacagcacca

SEQ ID NO: 1152215 - RNA, 18 nt, Barmah Forest virus
ggagacaguccagccaga

SEQ ID NO: 1152216 - RNA, 23 nt, Barmah Forest virus
cacagagugugugaagccaucga

SEQ ID NO: 1152217 - RNA, 17 nt, Barmah Forest virus
acgaucgacaauccaga

SEQ ID NO: 1152218 - RNA, 21 nt, Barmah Forest virus
cauaagagggaaaccaauaca

SEQ ID NO: 1152219 - RNA, 21 nt, Barmah Forest virus
ucccucugaccgacagcacgu

SEQ ID NO: 1152220 - RNA, 15 nt, Barmah Forest virus
agcuaaaagcaauac

SEQ ID NO: 1152221 - RNA, 14 nt, Barmah Forest virus
agcuugcaaugcau

SEQ ID NO: 1152222 - RNA, 23 nt, Barmah Forest virus
cacgaucgacaauccagaacuag

SEQ ID NO: 1152223 - RNA, 12 nt, Barmah Forest virus
aagacaauccaa

SEQ ID NO: 1152224 - RNA, 20 nt, Barmah Forest virus
gacagacuuaacgagagaag

SEQ ID NO: 1152225 - RNA, 18 nt, Barmah Forest virus
acaccauucucccacaag

SEQ ID NO: 1152226 - RNA, 20 nt, Barmah Forest virus
ggccauauuaccccugaaua

SEQ ID NO: 1152227 - RNA, 12 nt, Barmah Forest virus
aagggccauaua

SEQ ID NO: 1152228 - RNA, 12 nt, Barmah Forest virus
acaaaagagaaa

SEQ ID NO: 1152229 - RNA, 19 nt, Barmah Forest virus
cacccaugagcaagacaau

SEQ ID NO: 1152230 - RNA, 23 nt, Barmah Forest virus
acugcaugaagaucgagaaugac

SEQ ID NO: 1152231 - RNA, 18 nt, Barmah Forest virus
ccaaguucacccaugaga

SEQ ID NO: 1152232 - RNA, 15 nt, Barmah Forest virus
acuucuguggaggau

SEQ ID NO: 1152233 - RNA, 18 nt, Barmah Forest virus
ggccaccaaaagaaacug

SEQ ID NO: 1152234 - RNA, 18 nt, Barmah Forest virus
guaugcguaacugcauga

SEQ ID NO: 1152235 - RNA, 19 nt, Barmah Forest virus
agacccgaauucccugcaa

SEQ ID NO: 1152236 - RNA, 13 nt, Barmah Forest virus
gauucugcagugc

SEQ ID NO: 1152237 - RNA, 16 nt, Barmah Forest virus
uauguaugauaguaua

SEQ ID NO: 1152238 - RNA, 19 nt, Barmah Forest virus
aacguaugcguaacugcau

SEQ ID NO: 1152239 - RNA, 20 nt, Barmah Forest virus
cagugcaauuuagcaauggu

SEQ ID NO: 1152240 - RNA, 15 nt, Barmah Forest virus
cacucaccauacuug

SEQ ID NO: 1152241 - RNA, 13 nt, Barmah Forest virus
augaugaagugaa

SEQ ID NO: 1152242 - RNA, 20 nt, Barmah Forest virus
gcagaucgguauagcuaaaa

SEQ ID NO: 1152243 - RNA, 17 nt, Barmah Forest virus
cugggggaaguggaguu

SEQ ID NO: 1152244 - RNA, 17 nt, Barmah Forest virus
cagucagcguagcaccu

SEQ ID NO: 1152245 - RNA, 21 nt, Barmah Forest virus
ugaacuguagccgaacucuac

SEQ ID NO: 1152246 - RNA, 15 nt, Barmah Forest virus
uacaacuggcaccau

SEQ ID NO: 1152247 - RNA, 17 nt, Barmah Forest virus
aauuuagaaaaacuuaa

SEQ ID NO: 1152248 - RNA, 17 nt, Barmah Forest virus
uacggaggugaaaggaa

SEQ ID NO: 1152249 - RNA, 14 nt, Barmah Forest virus
aaaguucauacuug

SEQ ID NO: 1152250 - RNA, 22 nt, Barmah Forest virus
gucauaguuaguguagaaauag

SEQ ID NO: 1152251 - RNA, 21 nt, Barmah Forest virus
ccaaguucacccaugagaaac

SEQ ID NO: 1152252 - RNA, 17 nt, Barmah Forest virus
caagcacaccgaagaga

SEQ ID NO: 1152253 - RNA, 23 nt, Barmah Forest virus
ugcaugaaaucagacgcauccaa

SEQ ID NO: 1152254 - RNA, 19 nt, Barmah Forest virus
augcuguuacgaaaaagac

SEQ ID NO: 1152255 - RNA, 23 nt, Barmah Forest virus
augguauaauaucagacaaauug

SEQ ID NO: 1152256 - RNA, 17 nt, Barmah Forest virus
gggaugaguacagggau

SEQ ID NO: 1152257 - RNA, 15 nt, Barmah Forest virus
gaaaccaacccaaaa

SEQ ID NO: 1152258 - RNA, 18 nt, Barmah Forest virus
ucauaguuaguguagaaa

SEQ ID NO: 1152259 - RNA, 18 nt, Barmah Forest virus
ggccaccuacagcagaga

SEQ ID NO: 1152260 - RNA, 20 nt, Barmah Forest virus
cuuaaggagcaaguaccaaa

SEQ ID NO: 1152261 - RNA, 21 nt, Barmah Forest virus
gacacggguccaggccaccua

SEQ ID NO: 1152262 - RNA, 15 nt, Barmah Forest virus
uaacagguacagccu

SEQ ID NO: 1152263 - RNA, 20 nt, Barmah Forest virus
ccgucugaagcaaacaaaag

SEQ ID NO: 1152264 - RNA, 14 nt, Barmah Forest virus
cugaagcaaacaaa

SEQ ID NO: 1152265 - RNA, 17 nt, Barmah Forest virus
aacaacccgguacgacu

SEQ ID NO: 1152266 - RNA, 16 nt, Barmah Forest virus
agagcuugcaaugcau

SEQ ID NO: 1152267 - RNA, 21 nt, Barmah Forest virus
aaauuuagaaaaacuuaauau

SEQ ID NO: 1152268 - RNA, 15 nt, Barmah Forest virus
cucuacggagaugua

SEQ ID NO: 1152269 - RNA, 15 nt, Barmah Forest virus
cauuacaugaugaag

SEQ ID NO: 1152270 - RNA, 14 nt, Barmah Forest virus
ccccugugagcauc

SEQ ID NO: 1152271 - RNA, 18 nt, Barmah Forest virus
cacagaagaagcccaaga

SEQ ID NO: 1152272 - RNA, 14 nt, Barmah Forest virus
cagagugugugaag

SEQ ID NO: 1152273 - RNA, 23 nt, Barmah Forest virus
caauccaaguuggggcagaaggc

SEQ ID NO: 1152274 - RNA, 18 nt, Barmah Forest virus
gugacaccgccccaaagu

SEQ ID NO: 1152275 - RNA, 22 nt, Barmah Forest virus
gcauccaaguucacccaugaga

SEQ ID NO: 1152276 - RNA, 15 nt, Barmah Forest virus
uaacaccugaagaau

SEQ ID NO: 1152277 - RNA, 17 nt, Barmah Forest virus
auccguuuuacaaaauu

SEQ ID NO: 1152278 - RNA, 18 nt, Barmah Forest virus
auuugaagcuuaaaagac

SEQ ID NO: 1152279 - RNA, 17 nt, Barmah Forest virus
ccccaaccccaaccacc

SEQ ID NO: 1152280 - RNA, 14 nt, Barmah Forest virus
uggggaaacaacaa

SEQ ID NO: 1152281 - RNA, 18 nt, Barmah Forest virus
gacaaaagucaagaugau

SEQ ID NO: 1152282 - RNA, 21 nt, Barmah Forest virus
aguaacaaaaaucaaaaacua

SEQ ID NO: 1152283 - RNA, 21 nt, Barmah Forest virus
cauccaaguucacccaugaga

SEQ ID NO: 1152284 - RNA, 23 nt, Barmah Forest virus
agaucgguauagcuaaaagcaau

SEQ ID NO: 1152285 - RNA, 22 nt, Barmah Forest virus
agugacauacagacugggggaa

SEQ ID NO: 1152286 - RNA, 17 nt, Barmah Forest virus
cauaguuaguguagaaa

SEQ ID NO: 1152287 - RNA, 22 nt, Barmah Forest virus
gucaacggagacaguccagcca

SEQ ID NO: 1152288 - RNA, 19 nt, Barmah Forest virus
acccugcagggacccuaag

SEQ ID NO: 1152289 - RNA, 20 nt, Barmah Forest virus
acguaugggaugaguacagg

SEQ ID NO: 1152290 - RNA, 22 nt, Barmah Forest virus
gcccagguuuauuggcaaugaa

SEQ ID NO: 1152291 - RNA, 17 nt, Barmah Forest virus
gcagacccacugaagag

SEQ ID NO: 1152292 - RNA, 15 nt, Barmah Forest virus
cccagcacccaccgg

SEQ ID NO: 1152293 - RNA, 11 nt, Barmah Forest virus
cccagaagccu

SEQ ID NO: 1152294 - RNA, 13 nt, Barmah Forest virus
gaaaccagaagga

SEQ ID NO: 1152295 - RNA, 13 nt, Barmah Forest virus
uucaaagggccau

SEQ ID NO: 1152296 - RNA, 18 nt, Barmah Forest virus
caggaaauaugcgugcaa

SEQ ID NO: 1152297 - RNA, 13 nt, Barmah Forest virus
uggaucagagagc

SEQ ID NO: 1152298 - RNA, 12 nt, Barmah Forest virus
caaaauugcacg

SEQ ID NO: 1152299 - RNA, 17 nt, Barmah Forest virus
ccaagggcuagugucca

SEQ ID NO: 1152300 - RNA, 12 nt, Barmah Forest virus
augcaccaaagu

SEQ ID NO: 1152301 - RNA, 19 nt, Barmah Forest virus
uaccucugcggaauucacc

SEQ ID NO: 1152302 - RNA, 21 nt, Barmah Forest virus
aguaacaaaagagaaaaacac

SEQ ID NO: 1152303 - RNA, 15 nt, Barmah Forest virus
ccaauggaguacagg

SEQ ID NO: 1152304 - RNA, 13 nt, Barmah Forest virus
uguccgcagagga

SEQ ID NO: 1152305 - RNA, 13 nt, Barmah Forest virus
ugcaaaaacacau

SEQ ID NO: 1152306 - RNA, 18 nt, Barmah Forest virus
auaauaucagacaaauug

SEQ ID NO: 1152307 - RNA, 17 nt, Barmah Forest virus
ccauauuaccccugaau

SEQ ID NO: 1152308 - RNA, 21 nt, Barmah Forest virus
gcaugaaaucagacgcaucca

SEQ ID NO: 1152309 - RNA, 19 nt, Barmah Forest virus
ugcagucagcguagcaccu

SEQ ID NO: 1152310 - RNA, 21 nt, Barmah Forest virus
acuccaacagcuuguggcugc

SEQ ID NO: 1152311 - RNA, 15 nt, Barmah Forest virus
agaugacaacauaau

SEQ ID NO: 1152312 - RNA, 12 nt, Barmah Forest virus
uacggccaccuu

SEQ ID NO: 1152313 - RNA, 19 nt, Barmah Forest virus
uauuaccccugaauaguaa

SEQ ID NO: 1152314 - RNA, 15 nt, Barmah Forest virus
ugaagcuuaaaagac

SEQ ID NO: 1152315 - RNA, 14 nt, Barmah Forest virus
uacucccaucagac

SEQ ID NO: 1152316 - RNA, 17 nt, Barmah Forest virus
cccaugagcaagacaau

SEQ ID NO: 1152317 - RNA, 16 nt, Barmah Forest virus
aagcuagguaagccau

SEQ ID NO: 1152318 - RNA, 14 nt, Barmah Forest virus
cgaucgacaaucca

SEQ ID NO: 1152319 - RNA, 22 nt, Barmah Forest virus
  misc_feature (10)..(10): n is a, c, g or u
gccgcacugnauauaacagcac

SEQ ID NO: 1152320 - RNA, 12 nt, Barmah Forest virus
gccgaaccccag

SEQ ID NO: 1152321 - RNA, 20 nt, Barmah Forest virus
uuuguuauguaaguauguag

SEQ ID NO: 1152322 - RNA, 13 nt, Barmah Forest virus
acacaaaaaugaa

SEQ ID NO: 1152323 - RNA, 21 nt, Barmah Forest virus
acaccauucucccacaagccc

SEQ ID NO: 1152324 - RNA, 16 nt, Barmah Forest virus
guaacugcaugaagau

SEQ ID NO: 1152325 - RNA, 15 nt, Barmah Forest virus
accaugugcaccaug

SEQ ID NO: 1152326 - RNA, 14 nt, Barmah Forest virus
agauuacaaugcau

SEQ ID NO: 1152327 - RNA, 22 nt, Barmah Forest virus
auaaccaccgaaaaugucacca

SEQ ID NO: 1152328 - RNA, 17 nt, Barmah Forest virus
gaaacuguaaugucaca

SEQ ID NO: 1152329 - RNA, 18 nt, Barmah Forest virus
auaaaauuacugaugaau

SEQ ID NO: 1152330 - RNA, 15 nt, Barmah Forest virus
uaaguauguaguauu

SEQ ID NO: 1152331 - RNA, 20 nt, Barmah Forest virus
acauuacaacuggcaccaug

SEQ ID NO: 1152332 - RNA, 18 nt, Barmah Forest virus
cagacugggggaagugga

SEQ ID NO: 1152333 - RNA, 15 nt, Barmah Forest virus
aggacauuacaacug

SEQ ID NO: 1152334 - RNA, 14 nt, Barmah Forest virus
acagcaccauguga

SEQ ID NO: 1152335 - RNA, 20 nt, Barmah Forest virus
uaagauuaguuuguuaugua

SEQ ID NO: 1152336 - RNA, 12 nt, Barmah Forest virus
aguguuggagga

SEQ ID NO: 1152337 - RNA, 20 nt, Barmah Forest virus
caagaugauuccauggcacu

SEQ ID NO: 1152338 - RNA, 15 nt, Barmah Forest virus
gcacgugugcaguca

SEQ ID NO: 1152339 - RNA, 22 nt, Barmah Forest virus
cacaaaaaugaagcggacuaua

SEQ ID NO: 1152340 - RNA, 22 nt, Barmah Forest virus
caaaugaaaccgucugaagcaa

SEQ ID NO: 1152341 - RNA, 23 nt, Barmah Forest virus
cgagucuaggcuugcuaauagug

SEQ ID NO: 1152342 - RNA, 12 nt, Barmah Forest virus
cacugcccacaa

SEQ ID NO: 1152343 - RNA, 18 nt, Barmah Forest virus
agggccauauaaccccug

SEQ ID NO: 1152344 - RNA, 19 nt, Barmah Forest virus
guccacucaucagaacuag

SEQ ID NO: 1152345 - RNA, 18 nt, Barmah Forest virus
cuuguuugcaaaaacaca

SEQ ID NO: 1152346 - RNA, 22 nt, Barmah Forest virus
ggcgcacuagcucuacaaccca

SEQ ID NO: 1152347 - RNA, 22 nt, Barmah Forest virus
cggaggugaaaggaaagaucca

SEQ ID NO: 1152348 - RNA, 19 nt, Barmah Forest virus
cuccuuuugaucacaaggu

SEQ ID NO: 1152349 - RNA, 21 nt, Barmah Forest virus
cagcacccaccgggcacaaga

SEQ ID NO: 1152350 - RNA, 15 nt, Barmah Forest virus
aguacaggaggcuga

SEQ ID NO: 1152351 - RNA, 16 nt, Barmah Forest virus
acagucagaugaguga

SEQ ID NO: 1152352 - RNA, 15 nt, Barmah Forest virus
guagauaugaagaga

SEQ ID NO: 1152353 - RNA, 16 nt, Barmah Forest virus
gacaccaccaccaaaa

SEQ ID NO: 1152354 - RNA, 13 nt, Barmah Forest virus
guaaaagaaggua

SEQ ID NO: 1152355 - RNA, 13 nt, Barmah Forest virus
gaugugccaccug

SEQ ID NO: 1152356 - RNA, 12 nt, Barmah Forest virus
uaccaaaugaaa

SEQ ID NO: 1152357 - RNA, 24 nt, Barmah Forest virus
augagagaacuaccaacauaugau

SEQ ID NO: 1152358 - RNA, 22 nt, Barmah Forest virus
ccuucagaaacauaagagggaa

SEQ ID NO: 1152359 - RNA, 12 nt, Barmah Forest virus
aauaguaacaaa

SEQ ID NO: 1152360 - RNA, 21 nt, Barmah Forest virus
gcagucagcguagcaccugaa

SEQ ID NO: 1152361 - RNA, 11 nt, Barmah Forest virus
acagcaccaug

SEQ ID NO: 1152362 - RNA, 20 nt, Barmah Forest virus
gguaagugugccauccacag

SEQ ID NO: 1152363 - RNA, 19 nt, Barmah Forest virus
ccaaaguguauuacauaug

SEQ ID NO: 1152364 - RNA, 23 nt, Barmah Forest virus
gaagauccaaguguccaugcaga

SEQ ID NO: 1152365 - RNA, 14 nt, Barmah Forest virus
gcaaacaaaagcag

SEQ ID NO: 1152366 - RNA, 15 nt, Barmah Forest virus
cgcacuucacaagga

SEQ ID NO: 1152367 - RNA, 20 nt, Barmah Forest virus
aaggcgugugaagugcaguc

SEQ ID NO: 1152368 - RNA, 19 nt, Barmah Forest virus
ugacauacagacuggggga

SEQ ID NO: 1152369 - RNA, 20 nt, Barmah Forest virus
caccgaagagagaccaaagg

SEQ ID NO: 1152370 - RNA, 22 nt, Barmah Forest virus
cgguaccgucaccauuccaaaa

SEQ ID NO: 1152371 - RNA, 19 nt, Barmah Forest virus
gacagcacgugugcaguca

SEQ ID NO: 1152372 - RNA, 14 nt, Barmah Forest virus
aaugugcucaagug

SEQ ID NO: 1152373 - RNA, 15 nt, Barmah Forest virus
cacugcccacaagga

SEQ ID NO: 1152374 - RNA, 15 nt, Barmah Forest virus
uagaaaaacuuaaua

SEQ ID NO: 1152375 - RNA, 19 nt, Barmah Forest virus
auaagguagguaagugugc

SEQ ID NO: 1152376 - RNA, 15 nt, Barmah Forest virus
gcacgucuggaguga

SEQ ID NO: 1152377 - RNA, 22 nt, Barmah Forest virus
gcaaugaaaaguccccagcacc

SEQ ID NO: 1152378 - RNA, 16 nt, Barmah Forest virus
gcggaggcgcugagug

SEQ ID NO: 1152379 - RNA, 19 nt, Barmah Forest virus
uuauaagauuaguuuguua

SEQ ID NO: 1152380 - RNA, 22 nt, Barmah Forest virus
cuuccacccuauguaccccacc

SEQ ID NO: 1152381 - RNA, 22 nt, Barmah Forest virus
caaauuuggagcuaugaugaag

SEQ ID NO: 1152382 - RNA, 21 nt, Barmah Forest virus
accugaagaaucaguggagug

SEQ ID NO: 1152383 - RNA, 18 nt, Barmah Forest virus
ugagagaacuaccaacau

SEQ ID NO: 1152384 - RNA, 14 nt, Barmah Forest virus
uccuaccuguggac

SEQ ID NO: 1152385 - RNA, 15 nt, Barmah Forest virus
ccgaagagagaccaa

SEQ ID NO: 1152386 - RNA, 16 nt, Barmah Forest virus
cauauuaccccugaau

SEQ ID NO: 1152387 - RNA, 14 nt, Barmah Forest virus
uagaaaaaauucau

SEQ ID NO: 1152388 - RNA, 21 nt, Barmah Forest virus
ucaaaguucauacuugggccg

SEQ ID NO: 1152389 - RNA, 13 nt, Barmah Forest virus
agaccagcaccag

SEQ ID NO: 1152390 - RNA, 17 nt, Barmah Forest virus
acuucauauaaaauuac

SEQ ID NO: 1152391 - RNA, 14 nt, Barmah Forest virus
aguacaacucccaa

SEQ ID NO: 1152392 - RNA, 21 nt, Barmah Forest virus
ccgaacucuacggagauguag

SEQ ID NO: 1152393 - RNA, 20 nt, Barmah Forest virus
auagccucuuuugacaaaag

SEQ ID NO: 1152394 - RNA, 23 nt, Barmah Forest virus
guuaugccguccacucaucagaa

SEQ ID NO: 1152395 - RNA, 14 nt, Barmah Forest virus
gcacaccgaagaga

SEQ ID NO: 1152396 - RNA, 16 nt, Barmah Forest virus
auaugaagagagaugu

SEQ ID NO: 1152397 - RNA, 22 nt, Barmah Forest virus
gccuaagaaaccaacccaaaag

SEQ ID NO: 1152398 - RNA, 14 nt, Barmah Forest virus
gcaaaccuggagac

SEQ ID NO: 1152399 - RNA, 12 nt, Barmah Forest virus
gccaccaaaaga

SEQ ID NO: 1152400 - RNA, 13 nt, Barmah Forest virus
ccccagcacccac

SEQ ID NO: 1152401 - RNA, 14 nt, Barmah Forest virus
aaaauuacugauga

SEQ ID NO: 1152402 - RNA, 17 nt, Barmah Forest virus
auauaaccccugaauag

SEQ ID NO: 1152403 - RNA, 18 nt, Barmah Forest virus
auaguuggaauacggcca

SEQ ID NO: 1152404 - RNA, 14 nt, Barmah Forest virus
uaacugcaugaaga

SEQ ID NO: 1152405 - RNA, 22 nt, Barmah Forest virus
gaaccaagcacaccgaagagag

SEQ ID NO: 1152406 - RNA, 14 nt, Barmah Forest virus
gcucuacaacccaa

SEQ ID NO: 1152407 - RNA, 22 nt, Barmah Forest virus
auaguauuacaggaauuaguau

SEQ ID NO: 1152408 - RNA, 18 nt, Barmah Forest virus
gaaggauucugugcagga

SEQ ID NO: 1152409 - RNA, 15 nt, Barmah Forest virus
aagacaauccaaguu

SEQ ID NO: 1152410 - RNA, 14 nt, Barmah Forest virus
uaugaaagcagaga

SEQ ID NO: 1152411 - RNA, 13 nt, Barmah Forest virus
aggaaauaugcgu

SEQ ID NO: 1152412 - RNA, 13 nt, Barmah Forest virus
ugaugcaccacca

SEQ ID NO: 1152413 - RNA, 16 nt, Barmah Forest virus
accgaagagagaccaa

SEQ ID NO: 1152414 - RNA, 20 nt, Barmah Forest virus
aaccgcaagugacauacaga

SEQ ID NO: 1152415 - RNA, 15 nt, Barmah Forest virus
ugcuacgaacaaaau

SEQ ID NO: 1152416 - RNA, 15 nt, Barmah Forest virus
agggccacucaccau

SEQ ID NO: 1152417 - RNA, 13 nt, Barmah Forest virus
ccguuuuacaaaa

SEQ ID NO: 1152418 - RNA, 14 nt, Barmah Forest virus
caugagaaaccaga

SEQ ID NO: 1152419 - RNA, 22 nt, Barmah Forest virus
acagcacuauguguccuccaga

SEQ ID NO: 1152420 - RNA, 23 nt, Barmah Forest virus
aaguguauccacaacagcaccau

SEQ ID NO: 1152421 - RNA, 19 nt, Barmah Forest virus
agaaaucuagcaaguauga

SEQ ID NO: 1152422 - RNA, 12 nt, Barmah Forest virus
uccccagcaccc

SEQ ID NO: 1152423 - RNA, 21 nt, Barmah Forest virus
agauccaaguguccaugcaga

SEQ ID NO: 1152424 - RNA, 13 nt, Barmah Forest virus
caccuuacaaaau

SEQ ID NO: 1152425 - RNA, 22 nt, Barmah Forest virus
caaugaaaaguccccagcaccc

SEQ ID NO: 1152426 - RNA, 21 nt, Barmah Forest virus
ucuacgaaccggcaaaacuag

SEQ ID NO: 1152427 - RNA, 10 nt, Barmah Forest virus
cgaagagaga

SEQ ID NO: 1152428 - RNA, 18 nt, Barmah Forest virus
gccagacguaugggauga

SEQ ID NO: 1152429 - RNA, 14 nt, Barmah Forest virus
gccacgcaggccua

SEQ ID NO: 1152430 - RNA, 17 nt, Barmah Forest virus
guuacgaaaaagacccu

SEQ ID NO: 1152431 - RNA, 16 nt, Barmah Forest virus
gcaagugacauacaga

SEQ ID NO: 1152432 - RNA, 20 nt, Barmah Forest virus
gauacauaccccaaccccaa

SEQ ID NO: 1152433 - RNA, 15 nt, Barmah Forest virus
gacccacugaagaga

SEQ ID NO: 1152434 - RNA, 12 nt, Barmah Forest virus
gauaugaagaga

SEQ ID NO: 1152435 - RNA, 13 nt, Barmah Forest virus
accuuacaaaaug

SEQ ID NO: 1152436 - RNA, 12 nt, Barmah Forest virus
agucaaguugaa

SEQ ID NO: 1152437 - RNA, 13 nt, Barmah Forest virus
auaguaguucaaa

SEQ ID NO: 1152438 - RNA, 23 nt, Barmah Forest virus
cagggccacucaccauacuugug

SEQ ID NO: 1152439 - RNA, 23 nt, Barmah Forest virus
auuaccccugaauaguaacaaaa

SEQ ID NO: 1152440 - RNA, 18 nt, Barmah Forest virus
uaguucaaagggccauau

SEQ ID NO: 1152441 - RNA, 19 nt, Barmah Forest virus
ggccaagaugaagacagaa

SEQ ID NO: 1152442 - RNA, 15 nt, Barmah Forest virus
ugaagacagaagacg

SEQ ID NO: 1152443 - RNA, 17 nt, Barmah Forest virus
augcaccaccaugugca

SEQ ID NO: 1152444 - RNA, 21 nt, Barmah Forest virus
accgacagcacgugugcaguc

SEQ ID NO: 1152445 - RNA, 17 nt, Barmah Forest virus
augacaacauaauccau

SEQ ID NO: 1152446 - RNA, 23 nt, Barmah Forest virus
gacgcauaccuagauaugguaga

SEQ ID NO: 1152447 - RNA, 15 nt, Barmah Forest virus
uguaguaguaaguau

SEQ ID NO: 1152448 - RNA, 13 nt, Barmah Forest virus
uuaccccugaaua

SEQ ID NO: 1152449 - RNA, 12 nt, Barmah Forest virus
auccaaagcugc

SEQ ID NO: 1152450 - RNA, 23 nt, Barmah Forest virus
ggaggcugaacgcucuacccuaa

SEQ ID NO: 1152451 - RNA, 12 nt, Barmah Forest virus
ugaagugaaaac

SEQ ID NO: 1152452 - RNA, 15 nt, Barmah Forest virus
gcacagaagaagccc

SEQ ID NO: 1152453 - RNA, 20 nt, Barmah Forest virus
ccacaaggaaggagaccuaa

SEQ ID NO: 1152454 - RNA, 19 nt, Barmah Forest virus
ccuucagaaacauaagagg

SEQ ID NO: 1152455 - RNA, 16 nt, Barmah Forest virus
acgucgccaaguugaa

SEQ ID NO: 1152456 - RNA, 23 nt, Barmah Forest virus
guuggggcagaaggcguggagua

SEQ ID NO: 1152457 - RNA, 21 nt, Barmah Forest virus
ccaaaagaaacuguaauguca

SEQ ID NO: 1152458 - RNA, 13 nt, Barmah Forest virus
cucccaucagaca

SEQ ID NO: 1152459 - RNA, 15 nt, Barmah Forest virus
ucacuaagcaccgau

SEQ ID NO: 1152460 - RNA, 17 nt, Barmah Forest virus
uucacacaaaaaugaag

SEQ ID NO: 1152461 - RNA, 22 nt, Barmah Forest virus
gaacuucgugguccaagugugu

SEQ ID NO: 1152462 - RNA, 18 nt, Barmah Forest virus
aaaggaaagauccaugug

SEQ ID NO: 1152463 - RNA, 13 nt, Barmah Forest virus
caccgaagagaga

SEQ ID NO: 1152464 - RNA, 14 nt, Barmah Forest virus
cguaacugcaugaa

SEQ ID NO: 1152465 - RNA, 18 nt, Barmah Forest virus
uggaguacaggaggcuga

SEQ ID NO: 1152466 - RNA, 20 nt, Barmah Forest virus
ccaugguauaauaucagaca

SEQ ID NO: 1152467 - RNA, 21 nt, Barmah Forest virus
gaacucuacggagauguagga

SEQ ID NO: 1152468 - RNA, 13 nt, Barmah Forest virus
gaggaccugggag

SEQ ID NO: 1152469 - RNA, 15 nt, Barmah Forest virus
auuauauuaccugca

SEQ ID NO: 1152470 - RNA, 22 nt, Barmah Forest virus
agaugacaacauaauccauggu

SEQ ID NO: 1152471 - RNA, 22 nt, Barmah Forest virus
ucagggccacucaccauacuug

SEQ ID NO: 1152472 - RNA, 15 nt, Barmah Forest virus
cuuuccaaaaacaca

SEQ ID NO: 1152473 - RNA, 18 nt, Barmah Forest virus
aggggcccggacagcccu

SEQ ID NO: 1152474 - RNA, 15 nt, Barmah Forest virus
cguagcuuuccaaaa

SEQ ID NO: 1152475 - RNA, 23 nt, Barmah Forest virus
uccacgccguaggagaggaccau

SEQ ID NO: 1152476 - RNA, 16 nt, Barmah Forest virus
ggcauccgaacucuac

SEQ ID NO: 1152477 - RNA, 13 nt, Barmah Forest virus
aggauucugugca

SEQ ID NO: 1152478 - RNA, 17 nt, Barmah Forest virus
gagcacgucuggaguga

SEQ ID NO: 1152479 - RNA, 17 nt, Barmah Forest virus
gaugcaccaccaugugc

SEQ ID NO: 1152480 - RNA, 20 nt, Barmah Forest virus
ccaaaguuggauaaaaccaa

SEQ ID NO: 1152481 - RNA, 19 nt, Barmah Forest virus
caauccagaacuagccaaa

SEQ ID NO: 1152482 - RNA, 14 nt, Barmah Forest virus
ggucaccuggaaua

SEQ ID NO: 1152483 - RNA, 12 nt, Barmah Forest virus
ggagacauccaa

SEQ ID NO: 1152484 - RNA, 21 nt, Barmah Forest virus
acacagagugugugaagccau

SEQ ID NO: 1152485 - RNA, 17 nt, Barmah Forest virus
ccccugaauaguaacaa

SEQ ID NO: 1152486 - RNA, 15 nt, Barmah Forest virus
ugaagccaucgaaga

SEQ ID NO: 1152487 - RNA, 16 nt, Barmah Forest virus
uggacggacuggggga

SEQ ID NO: 1152488 - RNA, 14 nt, Barmah Forest virus
aguccccagcaccc

SEQ ID NO: 1152489 - RNA, 15 nt, Barmah Forest virus
cuauugcuguagaaa

SEQ ID NO: 1152490 - RNA, 15 nt, Barmah Forest virus
gcauuacaugaugaa

SEQ ID NO: 1152491 - RNA, 19 nt, Barmah Forest virus
aagcacggugaccaugugu

SEQ ID NO: 1152492 - RNA, 14 nt, Barmah Forest virus
aaaccaaaaaagac

SEQ ID NO: 1152493 - RNA, 18 nt, Barmah Forest virus
aauaucagacaaauugau

SEQ ID NO: 1152494 - RNA, 22 nt, Barmah Forest virus
uaacugcaugaagaucgagaau

SEQ ID NO: 1152495 - RNA, 19 nt, Barmah Forest virus
agaccaucaaguacaaaug

SEQ ID NO: 1152496 - RNA, 13 nt, Barmah Forest virus
cuuguuugcaaaa

SEQ ID NO: 1152497 - RNA, 21 nt, Barmah Forest virus
uaggcauccgaacucuacgga

SEQ ID NO: 1152498 - RNA, 18 nt, Barmah Forest virus
ucgccaaguugaaaggac

SEQ ID NO: 1152499 - RNA, 13 nt, Barmah Forest virus
aaagagcacagaa

SEQ ID NO: 1152500 - RNA, 22 nt, Barmah Forest virus
gcacuauguguccuccagaacu

SEQ ID NO: 1152501 - RNA, 16 nt, Barmah Forest virus
uauuaccccugaauag

SEQ ID NO: 1152502 - RNA, 19 nt, Barmah Forest virus
cacaguguggcaguacaac

SEQ ID NO: 1152503 - RNA, 20 nt, Barmah Forest virus
agggauaauccgauuugcau

SEQ ID NO: 1152504 - RNA, 21 nt, Barmah Forest virus
guucccgugugaugcaccacc

SEQ ID NO: 1152505 - RNA, 16 nt, Barmah Forest virus
agaagcccaagaagac

SEQ ID NO: 1152506 - RNA, 23 nt, Barmah Forest virus
acgggcucuggcaaaccuggaga

SEQ ID NO: 1152507 - RNA, 21 nt, Barmah Forest virus
gguacgacuaugggcacagaa

SEQ ID NO: 1152508 - RNA, 22 nt, Barmah Forest virus
uagacccaaagacgaagaccau

SEQ ID NO: 1152509 - RNA, 19 nt, Barmah Forest virus
ucauaggagaugacaacau

SEQ ID NO: 1152510 - RNA, 17 nt, Barmah Forest virus
ucaacuccaacagcuug

SEQ ID NO: 1152511 - RNA, 18 nt, Barmah Forest virus
ugcaaaacuuacucccau

SEQ ID NO: 1152512 - RNA, 13 nt, Barmah Forest virus
caugagcaagaca

SEQ ID NO: 1152513 - RNA, 19 nt, Barmah Forest virus
uauaaccccugaauaguaa

SEQ ID NO: 1152514 - RNA, 16 nt, Barmah Forest virus
uaccccugaauaguaa

SEQ ID NO: 1152515 - RNA, 15 nt, Barmah Forest virus
agaagcccaagaaga

SEQ ID NO: 1152516 - RNA, 13 nt, Barmah Forest virus
caaguugaaagga

SEQ ID NO: 1152517 - RNA, 17 nt, Barmah Forest virus
gacaaauugauggcaga

SEQ ID NO: 1152518 - RNA, 17 nt, Barmah Forest virus
ccauauaaccccugaau

SEQ ID NO: 1152519 - RNA, 16 nt, Barmah Forest virus
agagauuacaaugcau

SEQ ID NO: 1152520 - RNA, 15 nt, Barmah Forest virus
aaagucaauccagua

SEQ ID NO: 1152521 - RNA, 13 nt, Barmah Forest virus
agaaugacugcau

SEQ ID NO: 1152522 - RNA, 19 nt, Barmah Forest virus
cugaagauccaagugucca

SEQ ID NO: 1152523 - RNA, 19 nt, Barmah Forest virus
uauaguauuauaggaauua

SEQ ID NO: 1152524 - RNA, 18 nt, Barmah Forest virus
guauccacaacagcacca

SEQ ID NO: 1152525 - RNA, 16 nt, Barmah Forest virus
acgcagccaaacacaa

SEQ ID NO: 1152526 - RNA, 17 nt, Barmah Forest virus
ugcguagcuuuccaaaa

SEQ ID NO: 1152527 - RNA, 13 nt, Barmah Forest virus
gaagagagauguc

SEQ ID NO: 1152528 - RNA, 16 nt, Barmah Forest virus
gaaacauaagagggaa

SEQ ID NO: 1152529 - RNA, 23 nt, Barmah Forest virus
aagguacugcuacgaacaaaauc

SEQ ID NO: 1152530 - RNA, 14 nt, Barmah Forest virus
cccaaaagaagaag

SEQ ID NO: 1152531 - RNA, 18 nt, Barmah Forest virus
gcccaagaagacaccacc

SEQ ID NO: 1152532 - RNA, 17 nt, Barmah Forest virus
cagacccacugaagaga

SEQ ID NO: 1152533 - RNA, 12 nt, Barmah Forest virus
gcccggacagcc

SEQ ID NO: 1152534 - RNA, 15 nt, Barmah Forest virus
ucauauaaaauuacu

SEQ ID NO: 1152535 - RNA, 19 nt, Barmah Forest virus
uauaguauuacaggaauua

SEQ ID NO: 1152536 - RNA, 23 nt, Barmah Forest virus
uacacccuaucaauuagcaccag

SEQ ID NO: 1152537 - RNA, 17 nt, Barmah Forest virus
agagcucaucgagcagc

SEQ ID NO: 1152538 - RNA, 21 nt, Barmah Forest virus
aucuacgaaccggcaaaacua

SEQ ID NO: 1152539 - RNA, 21 nt, Barmah Forest virus
agagaacuaccaacauaugau

SEQ ID NO: 1152540 - RNA, 16 nt, Barmah Forest virus
gggaaacaacaacccg

SEQ ID NO: 1152541 - RNA, 23 nt, Barmah Forest virus
ccaccaaaaccaaaaaagaccca

SEQ ID NO: 1152542 - RNA, 20 nt, Barmah Forest virus
caaaauugcacggcagaaug

SEQ ID NO: 1152543 - RNA, 13 nt, Barmah Forest virus
uuaguauagucau

SEQ ID NO: 1152544 - RNA, 15 nt, Barmah Forest virus
cuauuuuugacaaua

SEQ ID NO: 1152545 - RNA, 12 nt, Barmah Forest virus
agcaccauguga

SEQ ID NO: 1152546 - RNA, 14 nt, Barmah Forest virus
uguuaacagcacug

SEQ ID NO: 1152547 - RNA, 20 nt, Barmah Forest virus
agauuacaaugcauguaccg

SEQ ID NO: 1152548 - RNA, 16 nt, Barmah Forest virus
aagucaugaaaccagc

SEQ ID NO: 1152549 - RNA, 20 nt, Barmah Forest virus
uucugcagugcuaaauguag

SEQ ID NO: 1152550 - RNA, 14 nt, Barmah Forest virus
gaagauccaagugu

SEQ ID NO: 1152551 - RNA, 19 nt, Barmah Forest virus
ccaagaugaagacagaaga

SEQ ID NO: 1152552 - RNA, 18 nt, Barmah Forest virus
agagcacagaagaagccc

SEQ ID NO: 1152553 - RNA, 21 nt, Barmah Forest virus
caaauuuggagcuaugaugaa

SEQ ID NO: 1152554 - RNA, 23 nt, Barmah Forest virus
gacccgcauaacaccugaagaau

SEQ ID NO: 1152555 - RNA, 22 nt, Barmah Forest virus
cagacacggguccaggccaccu

SEQ ID NO: 1152556 - RNA, 18 nt, Barmah Forest virus
aguguauuacauaugcag

SEQ ID NO: 1152557 - RNA, 15 nt, Barmah Forest virus
uguaguauuaaguau

SEQ ID NO: 1152558 - RNA, 14 nt, Barmah Forest virus
aaagauccaugugc

SEQ ID NO: 1152559 - RNA, 12 nt, Barmah Forest virus
aauugacauuca

SEQ ID NO: 1152560 - RNA, 22 nt, Barmah Forest virus
auaaccugauaccacuacacca

SEQ ID NO: 1152561 - RNA, 22 nt, Barmah Forest virus
cagaacuaguuuuauuggcacu

SEQ ID NO: 1152562 - RNA, 17 nt, Barmah Forest virus
ucccaucagacagacuu

SEQ ID NO: 1152563 - RNA, 21 nt, Barmah Forest virus
ccaagcacaccgaagagagac

SEQ ID NO: 1152564 - RNA, 17 nt, Barmah Forest virus
auucccugcaaaacuua

SEQ ID NO: 1152565 - RNA, 18 nt, Barmah Forest virus
aaacaccuuacaaaaugu

SEQ ID NO: 1152566 - RNA, 20 nt, Barmah Forest virus
agacgauggagaccagcacc

SEQ ID NO: 1152567 - RNA, 13 nt, Barmah Forest virus
cgacaauccagaa

SEQ ID NO: 1152568 - RNA, 16 nt, Barmah Forest virus
cuaugccguacaccau

SEQ ID NO: 1152569 - RNA, 17 nt, Barmah Forest virus
caucacaguacuagcga

SEQ ID NO: 1152570 - RNA, 13 nt, Barmah Forest virus
ggcacaagacccg

SEQ ID NO: 1152571 - RNA, 15 nt, Barmah Forest virus
cuaagaacuugaagu

SEQ ID NO: 1152572 - RNA, 19 nt, Barmah Forest virus
ccaaaagaagaaguccaaa

SEQ ID NO: 1152573 - RNA, 11 nt, Barmah Forest virus
gcuaaauguag

SEQ ID NO: 1152574 - RNA, 21 nt, Barmah Forest virus
acuguaaaagaagguacugcu

SEQ ID NO: 1152575 - RNA, 20 nt, Barmah Forest virus
ggccauauaaccccugaaua

SEQ ID NO: 1152576 - RNA, 23 nt, Barmah Forest virus
gcggaucacuugccaugguaagu

SEQ ID NO: 1152577 - RNA, 17 nt, Barmah Forest virus
ccggcuucaggcaaugu

SEQ ID NO: 1152578 - RNA, 16 nt, Barmah Forest virus
auauaaaauuacugau

SEQ ID NO: 1152579 - RNA, 17 nt, Barmah Forest virus
aagagauuacaaugcau

SEQ ID NO: 1152580 - RNA, 17 nt, Barmah Forest virus
cauagucucacauuacu

SEQ ID NO: 1152581 - RNA, 12 nt, Barmah Forest virus
agacccugcagg

SEQ ID NO: 1152582 - RNA, 19 nt, Barmah Forest virus
gccuaagaaaccaacccaa

SEQ ID NO: 1152583 - RNA, 16 nt, Barmah Forest virus
aagaaaccaacccaaa

SEQ ID NO: 1152584 - RNA, 14 nt, Barmah Forest virus
cuacagcagagauc

SEQ ID NO: 1152585 - RNA, 23 nt, Barmah Forest virus
aguaccauugaaucgaaacgccc

SEQ ID NO: 1152586 - RNA, 21 nt, Barmah Forest virus
aguagaacuguuaacagcacu

SEQ ID NO: 1152587 - RNA, 14 nt, Barmah Forest virus
uuuuaaauugaacu

SEQ ID NO: 1152588 - RNA, 18 nt, Barmah Forest virus
gaacucuacggagaugua

SEQ ID NO: 1152589 - RNA, 22 nt, Barmah Forest virus
aaguauuaugaauuacuugacu

SEQ ID NO: 1152590 - RNA, 14 nt, Barmah Forest virus
gcauaacaccugaa

SEQ ID NO: 1152591 - RNA, 18 nt, Barmah Forest virus
aaggagcaaguaccaaau

SEQ ID NO: 1152592 - RNA, 12 nt, Barmah Forest virus
aaguugaaagga

SEQ ID NO: 1152593 - RNA, 17 nt, Barmah Forest virus
uaccaaucuagaaaagu

SEQ ID NO: 1152594 - RNA, 15 nt, Barmah Forest virus
ucgcagacccacuga

SEQ ID NO: 1152595 - RNA, 16 nt, Barmah Forest virus
ugucacacagaugaga

SEQ ID NO: 1152596 - RNA, 16 nt, Barmah Forest virus
uauaaccccugaauag

SEQ ID NO: 1152597 - RNA, 12 nt, Barmah Forest virus
acucccaucaga

SEQ ID NO: 1152598 - RNA, 15 nt, Barmah Forest virus
aagagagaccaaagg

SEQ ID NO: 1152599 - RNA, 20 nt, Barmah Forest virus
gcccagguuuauuggcaaug

SEQ ID NO: 1152600 - RNA, 14 nt, Barmah Forest virus
gccgguaugcauga

SEQ ID NO: 1152601 - RNA, 14 nt, Barmah Forest virus
aaaagucaagauga

SEQ ID NO: 1152602 - RNA, 19 nt, Barmah Forest virus
ucauacuuggacccacaga

SEQ ID NO: 1152603 - RNA, 17 nt, Barmah Forest virus
ccaaaagaagaagucca

SEQ ID NO: 1152604 - RNA, 13 nt, Barmah Forest virus
uaaguauguagua

SEQ ID NO: 1152605 - RNA, 16 nt, Barmah Forest virus
acuggaaaaaagagaa

SEQ ID NO: 1152606 - RNA, 10 nt, Barmah Forest virus
gcggaggcgc

SEQ ID NO: 1152607 - RNA, 18 nt, Barmah Forest virus
gaugagguguacaaugaa

SEQ ID NO: 1152608 - RNA, 17 nt, Barmah Forest virus
ucaaguacaaaugcacu

SEQ ID NO: 1152609 - RNA, 19 nt, Barmah Forest virus
cgguagauaugaagagaga

SEQ ID NO: 1152610 - RNA, 22 nt, Barmah Forest virus
cagaugagagaacuaccaacau

SEQ ID NO: 1152611 - RNA, 23 nt, Barmah Forest virus
gauaucuuaaggagcaaguacca

SEQ ID NO: 1152612 - RNA, 17 nt, Barmah Forest virus
cuacaacccaagcagaa

SEQ ID NO: 1152613 - RNA, 22 nt, Barmah Forest virus
gaagcccaagaagacaccacca

SEQ ID NO: 1152614 - RNA, 17 nt, Barmah Forest virus
ccucagaggucugucua

SEQ ID NO: 1152615 - RNA, 22 nt, Barmah Forest virus
ccgaaguuacggaggugaaagg

SEQ ID NO: 1152616 - RNA, 13 nt, Barmah Forest virus
caguccagagaua

SEQ ID NO: 1152617 - RNA, 15 nt, Barmah Forest virus
gcacugcccacaagg

SEQ ID NO: 1152618 - RNA, 20 nt, Barmah Forest virus
guauuggcagcggccaccaa

SEQ ID NO: 1152619 - RNA, 22 nt, Barmah Forest virus
acaaaauugcacggcagaaugu

SEQ ID NO: 1152620 - RNA, 21 nt, Barmah Forest virus
cuaugguagacgauggagacc

SEQ ID NO: 1152621 - RNA, 16 nt, Barmah Forest virus
ggauguccccauccaa

SEQ ID NO: 1152622 - RNA, 21 nt, Barmah Forest virus
ccagcaccaguccagagauac

SEQ ID NO: 1152623 - RNA, 18 nt, Barmah Forest virus
gaccacuacuaccacccc

SEQ ID NO: 1152624 - RNA, 17 nt, Barmah Forest virus
aaccuaaugaauuugau

SEQ ID NO: 1152625 - RNA, 17 nt, Barmah Forest virus
uccccucauuaguucag

SEQ ID NO: 1152626 - RNA, 20 nt, Barmah Forest virus
gaccagguuacgcaggccuc

SEQ ID NO: 1152627 - RNA, 24 nt, Barmah Forest virus
caagcuagguaagccauugccacu

SEQ ID NO: 1152628 - RNA, 15 nt, Barmah Forest virus
uaucagaucccaaaa

SEQ ID NO: 1152629 - RNA, 17 nt, Barmah Forest virus
cagcacgugugcaguca

SEQ ID NO: 1152630 - RNA, 16 nt, Barmah Forest virus
caaguacaaaugcacu

SEQ ID NO: 1152631 - RNA, 12 nt, Barmah Forest virus
ugauuaagucag

SEQ ID NO: 1152632 - RNA, 20 nt, Barmah Forest virus
cacaguacuagcgagucuag

SEQ ID NO: 1152633 - RNA, 20 nt, Barmah Forest virus
uagucucacauuacuaugac

SEQ ID NO: 1152634 - RNA, 22 nt, Human
cugagcuugcagagaugaggcc

SEQ ID NO: 1152635 - RNA, 21 nt, Human
cugaccccucauagcccucac

SEQ ID NO: 1152636 - RNA, 20 nt, Human
cugaccccucauagcccuca

SEQ ID NO: 1152637 - RNA, 17 nt, Human
cugaccccucauagccc

SEQ ID NO: 1152638 - RNA, 20 nt, Human
cucguauaugucucaggucc

SEQ ID NO: 1152639 - RNA, 18 nt, Human
cucguauaugucucaggu

SEQ ID NO: 1152640 - RNA, 17 nt, Human
cucgaacuccugaccuu

SEQ ID NO: 1152641 - RNA, 16 nt, Human
cucgaacuccugaccu

SEQ ID NO: 1152642 - RNA, 13 nt, Human
cucgaacuccuga

SEQ ID NO: 1152643 - RNA, 21 nt, Human
cuaaagaagguuucagaaaga

SEQ ID NO: 1152644 - RNA, 14 nt, Human
cguuaccaggcagg

SEQ ID NO: 1152645 - RNA, 22 nt, Human
cguguccccuauccuacuuccc

SEQ ID NO: 1152646 - RNA, 21 nt, Human
cgauacaccgggccuggagaa

SEQ ID NO: 1152647 - RNA, 20 nt, Human
cgauacaccgggccuggaga

SEQ ID NO: 1152648 - RNA, 18 nt, Human
cgauacaccgggccugga

SEQ ID NO: 1152649 - RNA, 19 nt, Human
cgaguagcugagauuauag

SEQ ID NO: 1152650 - RNA, 18 nt, Human
cgcuggccgggaccccga

SEQ ID NO: 1152651 - RNA, 23 nt, Human
cgcuggccgggaccccgagccug

SEQ ID NO: 1152652 - RNA, 16 nt, Human
cucaccucccccaucu

SEQ ID NO: 1152653 - RNA, 14 nt, Human
cucacccuggggcu

SEQ ID NO: 1152654 - RNA, 18 nt, Human
cuaccuuccaguuccuca

SEQ ID NO: 1152655 - RNA, 15 nt, Human
cuaggguccugggga

SEQ ID NO: 1152656 - RNA, 14 nt, Human
cuaggguccugggg

SEQ ID NO: 1152657 - RNA, 13 nt, Human
cuaggguccuggg

SEQ ID NO: 1152658 - RNA, 21 nt, Human
cuagacccacuggacucaccu

SEQ ID NO: 1152659 - RNA, 13 nt, Human
ccuaauuccacag

SEQ ID NO: 1152660 - RNA, 21 nt, Human
ccuaaugcgcaggcuggcccu

SEQ ID NO: 1152661 - RNA, 14 nt, Human
ccgucccccucugg

SEQ ID NO: 1152662 - RNA, 22 nt, Human
ccgacagccuggcacagggcag

SEQ ID NO: 1152663 - RNA, 15 nt, Human
ccgacagccuggcac

SEQ ID NO: 1152664 - RNA, 14 nt, Human
ccgacagccuggca

SEQ ID NO: 1152665 - RNA, 13 nt, Human
ccgacagccuggc

SEQ ID NO: 1152666 - RNA, 12 nt, Human
ccgacagccugg

SEQ ID NO: 1152667 - RNA, 20 nt, Human
ccucggacuuagcugggaga

SEQ ID NO: 1152668 - RNA, 19 nt, Human
ccucggacuuagcugggag

SEQ ID NO: 1152669 - RNA, 19 nt, Human
ccuccuaucagaaguuucu

SEQ ID NO: 1152670 - RNA, 20 nt, Human
ccucccuuggggccuaugca

SEQ ID NO: 1152671 - RNA, 21 nt, Human
ccucauuccaccuucccaugc

SEQ ID NO: 1152672 - RNA, 22 nt, Human
ccugguuuccugcccugggagg

SEQ ID NO: 1152673 - RNA, 21 nt, Human
ccugguuuccugcccugggag

SEQ ID NO: 1152674 - RNA, 20 nt, Human
ccugguuuccugcccuggga

SEQ ID NO: 1152675 - RNA, 19 nt, Human
ccugguuuccugcccuggg

SEQ ID NO: 1152676 - RNA, 18 nt, Human
ccugguuuccugcccugg

SEQ ID NO: 1152677 - RNA, 18 nt, Human
ccuggggaaccugacccc

SEQ ID NO: 1152678 - RNA, 22 nt, Human
ccucuugccacugccucuuccu

SEQ ID NO: 1152679 - RNA, 23 nt, Human
ccucuugccacugccucuuccuc

SEQ ID NO: 1152680 - RNA, 18 nt, Human
ccugaccccucauagccc

SEQ ID NO: 1152681 - RNA, 20 nt, Human
ccugcugagucccaggcuga

SEQ ID NO: 1152682 - RNA, 19 nt, Human
ccugcugagucccaggcug

SEQ ID NO: 1152683 - RNA, 18 nt, Human
ccugcugagucccaggcu

SEQ ID NO: 1152684 - RNA, 17 nt, Human
ccugccucagccucccg

SEQ ID NO: 1152685 - RNA, 18 nt, Human
ccagucccccugccccag

SEQ ID NO: 1152686 - RNA, 21 nt, Human
ccaggcugcucuugaacuccu

SEQ ID NO: 1152687 - RNA, 22 nt, Human
ccauuucauuugugccagaaug

SEQ ID NO: 1152688 - RNA, 21 nt, Human
ccauuucauuugugccagaau

SEQ ID NO: 1152689 - RNA, 21 nt, Human
ccauaaucuggacuccucugu

SEQ ID NO: 1152690 - RNA, 14 nt, Human
ccauaaucuggacu

SEQ ID NO: 1152691 - RNA, 19 nt, Human
ccaugucgccucugcauuc

SEQ ID NO: 1152692 - RNA, 17 nt, Human
ccaugucgccucugcau

SEQ ID NO: 1152693 - RNA, 16 nt, Human
ccaugucgccucugca

SEQ ID NO: 1152694 - RNA, 15 nt, Human
ccaugucgccucugc

SEQ ID NO: 1152695 - RNA, 12 nt, Human
ccaugucgccuc

SEQ ID NO: 1152696 - RNA, 21 nt, Human
ccccugcaaagcccagcuuga

SEQ ID NO: 1152697 - RNA, 20 nt, Human
ccccugcaaagcccagcuug

SEQ ID NO: 1152698 - RNA, 18 nt, Human
ccccugcaaagcccagcu

SEQ ID NO: 1152699 - RNA, 18 nt, Human
ccccucuggcuccagcug

SEQ ID NO: 1152700 - RNA, 16 nt, Human
ccccucuggcuccagc

SEQ ID NO: 1152701 - RNA, 20 nt, Human
ccccucugcccugcggguca

SEQ ID NO: 1152702 - RNA, 15 nt, Human
ccccucugcccugcg

SEQ ID NO: 1152703 - RNA, 23 nt, Human
ccccucugcccugcgggucacag

SEQ ID NO: 1152704 - RNA, 20 nt, Human
cccggcuaauuuuuguauuu

SEQ ID NO: 1152705 - RNA, 16 nt, Human
cccucacccuggggcu

SEQ ID NO: 1152706 - RNA, 16 nt, Human
cccuccucucugcccu

SEQ ID NO: 1152707 - RNA, 17 nt, Human
ccccagaggcuggguga

SEQ ID NO: 1152708 - RNA, 13 nt, Human
cccaggcuggagu

SEQ ID NO: 1152709 - RNA, 18 nt, Human
cccaggcugagccucagu

SEQ ID NO: 1152710 - RNA, 17 nt, Human
cccaggcugagccucag

SEQ ID NO: 1152711 - RNA, 16 nt, Human
cccaggcugagccuca

SEQ ID NO: 1152712 - RNA, 16 nt, Human
cccacuggacucaccu

SEQ ID NO: 1152713 - RNA, 21 nt, Human
caaaccccgaccaccugccca

SEQ ID NO: 1152714 - RNA, 18 nt, Human
caaaccccgaccaccugc

SEQ ID NO: 1152715 - RNA, 22 nt, Human
caacacacagauuugagcucag

SEQ ID NO: 1152716 - RNA, 21 nt, Human
caacacacagauuugagcuca

SEQ ID NO: 1152717 - RNA, 18 nt, Human
caacuaauuuuuguauuu

SEQ ID NO: 1152718 - RNA, 16 nt, Human
auuaggauuucaugau

SEQ ID NO: 1152719 - RNA, 14 nt, Human
auuaggauuucaug

SEQ ID NO: 1152720 - RNA, 18 nt, Human
auuccugcauuugugaaa

SEQ ID NO: 1152721 - RNA, 15 nt, Human
auuccugcauuugug

SEQ ID NO: 1152722 - RNA, 19 nt, Human
cacuuguugauuaauggaa

SEQ ID NO: 1152723 - RNA, 13 nt, Human
cacugggcuucua

SEQ ID NO: 1152724 - RNA, 19 nt, Human
cagaaguuucucagcuccc

SEQ ID NO: 1152725 - RNA, 23 nt, Human
caccuuuauucuggcagaggagg

SEQ ID NO: 1152726 - RNA, 19 nt, Human
caccugcccaaccugcucu

SEQ ID NO: 1152727 - RNA, 18 nt, Human
caccugcccaaccugcuc

SEQ ID NO: 1152728 - RNA, 13 nt, Human
caccugcccaacc

SEQ ID NO: 1152729 - RNA, 12 nt, Human
caccuacugagu

SEQ ID NO: 1152730 - RNA, 15 nt, Human
caaggcucugagcaa

SEQ ID NO: 1152731 - RNA, 20 nt, Human
caauaaaaucuugaaaaugc

SEQ ID NO: 1152732 - RNA, 23 nt, Human
caaucccaccaacccucagagcc

SEQ ID NO: 1152733 - RNA, 22 nt, Human
caaucccaccaacccucagagc

SEQ ID NO: 1152734 - RNA, 17 nt, Human
caaucccaccaacccuc

SEQ ID NO: 1152735 - RNA, 16 nt, Human
caaucccaccaacccu

SEQ ID NO: 1152736 - RNA, 13 nt, Human
cacagaacccuug

SEQ ID NO: 1152737 - RNA, 13 nt, Human
caccaacccucag

SEQ ID NO: 1152738 - RNA, 21 nt, Human
caccagggaaggggacaagga

SEQ ID NO: 1152739 - RNA, 18 nt, Human
caccagggaaggggacaa

SEQ ID NO: 1152740 - RNA, 13 nt, Human
caccagggaaggg

SEQ ID NO: 1152741 - RNA, 12 nt, Human
cagcugccugca

SEQ ID NO: 1152742 - RNA, 21 nt, Human
cagcucccaaggcucugagca

SEQ ID NO: 1152743 - RNA, 19 nt, Human
cagugggacagggcauggc

SEQ ID NO: 1152744 - RNA, 14 nt, Human
cagucucccucccu

SEQ ID NO: 1152745 - RNA, 23 nt, Human
caggagggagggggaaggcaggg

SEQ ID NO: 1152746 - RNA, 15 nt, Human
caggagggaggggga

SEQ ID NO: 1152747 - RNA, 13 nt, Human
cagggagggccug

SEQ ID NO: 1152748 - RNA, 12 nt, Human
cagggagggccu

SEQ ID NO: 1152749 - RNA, 20 nt, Human
caggcuggcccugcccuggu

SEQ ID NO: 1152750 - RNA, 19 nt, Human
caggcuggcccugcccugg

SEQ ID NO: 1152751 - RNA, 18 nt, Human
caggcuggcccugcccug

SEQ ID NO: 1152752 - RNA, 17 nt, Human
caggcgccccuuccccc

SEQ ID NO: 1152753 - RNA, 15 nt, Human
caggcgccccuuccc

SEQ ID NO: 1152754 - RNA, 20 nt, Human
caggccugccuguucccauu

SEQ ID NO: 1152755 - RNA, 17 nt, Human
cagggagggccugggcc

SEQ ID NO: 1152756 - RNA, 16 nt, Human
cagggagggccugggc

SEQ ID NO: 1152757 - RNA, 14 nt, Human
cagggagggccugg

SEQ ID NO: 1152758 - RNA, 13 nt, Human
cauggccaggugg

SEQ ID NO: 1152759 - RNA, 14 nt, Human
cauggccagguggc

SEQ ID NO: 1152760 - RNA, 13 nt, Human
cauucucacuccu

SEQ ID NO: 1152761 - RNA, 18 nt, Human
cauucuagguuugcaaga

SEQ ID NO: 1152762 - RNA, 14 nt, Human
cauucucacuccua

SEQ ID NO: 1152763 - RNA, 18 nt, Human
ccaaggaugccccguccc

SEQ ID NO: 1152764 - RNA, 18 nt, Human
ccaaaugcagcuuuaaaa

SEQ ID NO: 1152765 - RNA, 15 nt, Human
ccaaaugcagcuuua

SEQ ID NO: 1152766 - RNA, 13 nt, Human
ccaaaugcagcuu

SEQ ID NO: 1152767 - RNA, 16 nt, Human
cauuugugaaaugaug

SEQ ID NO: 1152768 - RNA, 14 nt, Human
cauuugugaaauga

SEQ ID NO: 1152769 - RNA, 15 nt, Human
ccaccacgcccggcu

SEQ ID NO: 1152770 - RNA, 22 nt, Human
ccacacuucaggcucuucuccu

SEQ ID NO: 1152771 - RNA, 21 nt, Human
ccacacuucaggcucuucucc

SEQ ID NO: 1152772 - RNA, 20 nt, Human
ccacacuucaggcucuucuc

SEQ ID NO: 1152773 - RNA, 16 nt, Human
ccacacuucaggcucu

SEQ ID NO: 1152774 - RNA, 22 nt, Human
ccaccgggcugggagcucugca

SEQ ID NO: 1152775 - RNA, 19 nt, Human
ccaccgggcugggagcucu

SEQ ID NO: 1152776 - RNA, 20 nt, Human
cugaucugaugcaagcaaga

SEQ ID NO: 1152777 - RNA, 24 nt, Human
cugccuccucuucaacugaccagc

SEQ ID NO: 1152778 - RNA, 15 nt, Human
cugccuccucuucaa

SEQ ID NO: 1152779 - RNA, 14 nt, Human
cugccuccucuuca

SEQ ID NO: 1152780 - RNA, 13 nt, Human
cugccuccucuuc

SEQ ID NO: 1152781 - RNA, 22 nt, Human
cuggcagccgugccuucagcuc

SEQ ID NO: 1152782 - RNA, 21 nt, Human
cuggcagccgugccuucagcu

SEQ ID NO: 1152783 - RNA, 20 nt, Human
cuggcagccgugccuucagc

SEQ ID NO: 1152784 - RNA, 14 nt, Human
cuggcagaggaggg

SEQ ID NO: 1152785 - RNA, 16 nt, Human
cuggccgggagccuga

SEQ ID NO: 1152786 - RNA, 15 nt, Human
cuggcccugcccugg

SEQ ID NO: 1152787 - RNA, 14 nt, Human
cuggcccugcccug

SEQ ID NO: 1152788 - RNA, 13 nt, Human
cuggcccugcccu

SEQ ID NO: 1152789 - RNA, 11 nt, Human
cuggcccugcc

SEQ ID NO: 1152790 - RNA, 22 nt, Human
cuggguuccagcaauucuccug

SEQ ID NO: 1152791 - RNA, 14 nt, Human
cugggccagaauuu

SEQ ID NO: 1152792 - RNA, 12 nt, Human
cugggccagaau

SEQ ID NO: 1152793 - RNA, 16 nt, Human
cugguuuccugcccug

SEQ ID NO: 1152794 - RNA, 14 nt, Human
cugguuuccugccc

SEQ ID NO: 1152795 - RNA, 13 nt, Human
cugguuuccugcc

SEQ ID NO: 1152796 - RNA, 22 nt, Human
cuuacauuagcaguuugcuuug

SEQ ID NO: 1152797 - RNA, 21 nt, Human
cuuacauuagcaguuugcuuu

SEQ ID NO: 1152798 - RNA, 13 nt, Human
cuuagcugggaga

SEQ ID NO: 1152799 - RNA, 22 nt, Human
cuuccucugaggcugaaauuca

SEQ ID NO: 1152800 - RNA, 16 nt, Human
cuuccucugaggcuga

SEQ ID NO: 1152801 - RNA, 15 nt, Human
cuuccucugagccuu

SEQ ID NO: 1152802 - RNA, 14 nt, Human
cuuccucugagccu

SEQ ID NO: 1152803 - RNA, 15 nt, Human
cuuccucuccacugc

SEQ ID NO: 1152804 - RNA, 14 nt, Human
cuuccucuccacug

SEQ ID NO: 1152805 - RNA, 13 nt, Human
cuuccucuccacu

SEQ ID NO: 1152806 - RNA, 12 nt, Human
cuuuguaugcac

SEQ ID NO: 1152807 - RNA, 15 nt, Human
gaaaaugugugugug

SEQ ID NO: 1152808 - RNA, 12 nt, Human
gaaaaugugugu

SEQ ID NO: 1152809 - RNA, 20 nt, Human
gaacacauaauucaggaagc

SEQ ID NO: 1152810 - RNA, 17 nt, Human
gaacacauaauucagga

SEQ ID NO: 1152811 - RNA, 12 nt, Human
gaagcagcucuu

SEQ ID NO: 1152812 - RNA, 13 nt, Human
gacagccuggcac

SEQ ID NO: 1152813 - RNA, 12 nt, Human
gacagccuggca

SEQ ID NO: 1152814 - RNA, 11 nt, Human
gacagccuggc

SEQ ID NO: 1152815 - RNA, 17 nt, Human
gacaggguuucaccaug

SEQ ID NO: 1152816 - RNA, 22 nt, Human
gaccccuggcuuuucacugcug

SEQ ID NO: 1152817 - RNA, 21 nt, Human
gaccccuggcuuuucacugcu

SEQ ID NO: 1152818 - RNA, 13 nt, Human
gaccccuggcuuu

SEQ ID NO: 1152819 - RNA, 23 nt, Human
gacugucucaagagggcacuggu

SEQ ID NO: 1152820 - RNA, 22 nt, Human
gacugucucaagagggcacugg

SEQ ID NO: 1152821 - RNA, 21 nt, Human
gacugucucaagagggcacug

SEQ ID NO: 1152822 - RNA, 18 nt, Human
gacuguacuccucccagg

SEQ ID NO: 1152823 - RNA, 17 nt, Human
gacuguacuccucccag

SEQ ID NO: 1152824 - RNA, 16 nt, Human
gacuguacuccuccca

SEQ ID NO: 1152825 - RNA, 18 nt, Human
gaugucccaacuuguaaa

SEQ ID NO: 1152826 - RNA, 17 nt, Human
gaugucccaacuuguaa

SEQ ID NO: 1152827 - RNA, 23 nt, Human
gauggaggaaaaccaagccgugg

SEQ ID NO: 1152828 - RNA, 20 nt, Human
gauuucagcucacugcaacc

SEQ ID NO: 1152829 - RNA, 17 nt, Human
gauuucagcucacugca

SEQ ID NO: 1152830 - RNA, 15 nt, Human
gauuucagcucacug

SEQ ID NO: 1152831 - RNA, 18 nt, Human
gcaccuaccaccacgccc

SEQ ID NO: 1152832 - RNA, 17 nt, Human
gcaccuaccaccacgcc

SEQ ID NO: 1152833 - RNA, 23 nt, Human
gcacacagcacgggggccaagga

SEQ ID NO: 1152834 - RNA, 11 nt, Human
gcacacagcac

SEQ ID NO: 1152835 - RNA, 14 nt, Human
gcaggcuggcccug

SEQ ID NO: 1152836 - RNA, 13 nt, Human
gcaggcuggcccu

SEQ ID NO: 1152837 - RNA, 17 nt, Human
gcauggccagguggcca

SEQ ID NO: 1152838 - RNA, 14 nt, Human
gcauggccaggugg

SEQ ID NO: 1152839 - RNA, 13 nt, Human
gcauggccaggug

SEQ ID NO: 1152840 - RNA, 13 nt, Human
gcaucgcaaugua

SEQ ID NO: 1152841 - RNA, 23 nt, Human
gcaugucccuaccgagucucuuc

SEQ ID NO: 1152842 - RNA, 22 nt, Human
gccaagcaccuagccucgcucu

SEQ ID NO: 1152843 - RNA, 15 nt, Human
gcccucacccugggg

SEQ ID NO: 1152844 - RNA, 23 nt, Human
gcccuaaugcgcaggcuggcccu

SEQ ID NO: 1152845 - RNA, 20 nt, Human
gcccuaaugcgcaggcuggc

SEQ ID NO: 1152846 - RNA, 19 nt, Human
gcccuaaugcgcaggcugg

SEQ ID NO: 1152847 - RNA, 17 nt, Human
gcccuaaugcgcaggcu

SEQ ID NO: 1152848 - RNA, 16 nt, Human
gcccuaaugcgcaggc

SEQ ID NO: 1152849 - RNA, 22 nt, Human
gcccuguccugccuaaggcuga

SEQ ID NO: 1152850 - RNA, 18 nt, Human
gcccugcccugguuuccu

SEQ ID NO: 1152851 - RNA, 16 nt, Human
gcccugcccugguuuc

SEQ ID NO: 1152852 - RNA, 12 nt, Human
gcccugcccugg

SEQ ID NO: 1152853 - RNA, 11 nt, Human
gcccugcccug

SEQ ID NO: 1152854 - RNA, 12 nt, Human
gccucuuccucc

SEQ ID NO: 1152855 - RNA, 23 nt, Human
gccuguucccauucuugcauggc

SEQ ID NO: 1152856 - RNA, 19 nt, Human
gccuguucccauucuugca

SEQ ID NO: 1152857 - RNA, 23 nt, Human
gccuggcuccaaacccucgaggc

SEQ ID NO: 1152858 - RNA, 22 nt, Human
gcuaaucagcauucucacuccu

SEQ ID NO: 1152859 - RNA, 17 nt, Human
gcuaaucagcauucuca

SEQ ID NO: 1152860 - RNA, 16 nt, Human
gcuaaucagcauucuc

SEQ ID NO: 1152861 - RNA, 14 nt, Human
gcuaaucagcauuc

SEQ ID NO: 1152862 - RNA, 20 nt, Human
gcucacugcauccuccgccu

SEQ ID NO: 1152863 - RNA, 16 nt, Human
gcucacugcauccucc

SEQ ID NO: 1152864 - RNA, 21 nt, Human
gcuccugccaccacgcccggc

SEQ ID NO: 1152865 - RNA, 18 nt, Human
gcuccugccaccacgccc

SEQ ID NO: 1152866 - RNA, 12 nt, Human
gcuccugccacc

SEQ ID NO: 1152867 - RNA, 22 nt, Human
gcucccacaggcccuuccucuc

SEQ ID NO: 1152868 - RNA, 21 nt, Human
gcucccacaggcccuuccucu

SEQ ID NO: 1152869 - RNA, 20 nt, Human
gcucccacaggcccuuccuc

SEQ ID NO: 1152870 - RNA, 17 nt, Human
gcucccacaggcccuuc

SEQ ID NO: 1152871 - RNA, 16 nt, Human
gcucccacaggcccuu

SEQ ID NO: 1152872 - RNA, 19 nt, Human
ggacaaggacuaggguccu

SEQ ID NO: 1152873 - RNA, 15 nt, Human
ggaccccgagccugg

SEQ ID NO: 1152874 - RNA, 18 nt, Human
ggaccccgagccuggcuc

SEQ ID NO: 1152875 - RNA, 12 nt, Human
ggacuccucugu

SEQ ID NO: 1152876 - RNA, 22 nt, Human
ggagacugcugagucaacccaa

SEQ ID NO: 1152877 - RNA, 15 nt, Human
ggcacugguggcccg

SEQ ID NO: 1152878 - RNA, 19 nt, Human
ggccucacuaggcuucugg

SEQ ID NO: 1152879 - RNA, 17 nt, Human
ggcuccaaacccucgag

SEQ ID NO: 1152880 - RNA, 13 nt, Human
ggcucuucuccuu

SEQ ID NO: 1152881 - RNA, 12 nt, Human
ggcucuucuccu

SEQ ID NO: 1152882 - RNA, 16 nt, Human
ggcugccuuagaaccu

SEQ ID NO: 1152883 - RNA, 22 nt, Human
ggcugcccuggugcugccacac

SEQ ID NO: 1152884 - RNA, 19 nt, Human
ggcugcccuggugcugcca

SEQ ID NO: 1152885 - RNA, 16 nt, Human
ggcugcccuggugcug

SEQ ID NO: 1152886 - RNA, 15 nt, Human
ggcugcccuggugcu

SEQ ID NO: 1152887 - RNA, 14 nt, Human
ggcugcccuggugc

SEQ ID NO: 1152888 - RNA, 13 nt, Human
ggcugcccuggug

SEQ ID NO: 1152889 - RNA, 22 nt, Human
ggcugacagacagcccuccauc

SEQ ID NO: 1152890 - RNA, 16 nt, Human
ggcucuucuccuuuca

SEQ ID NO: 1152891 - RNA, 23 nt, Human
ggcucuucuccuuucacaaccuu

SEQ ID NO: 1152892 - RNA, 15 nt, Human
ggcucuucuccuuuc

SEQ ID NO: 1152893 - RNA, 14 nt, Human
ggcucuucuccuuu

SEQ ID NO: 1152894 - RNA, 13 nt, Human
gggacagagcaga

SEQ ID NO: 1152895 - RNA, 13 nt, Human
gggaaccugaccc

SEQ ID NO: 1152896 - RNA, 22 nt, Human
ggcuucccgcucagcccucccu

SEQ ID NO: 1152897 - RNA, 21 nt, Human
ggcuucccgcucagcccuccc

SEQ ID NO: 1152898 - RNA, 19 nt, Human
ggcuucccgcucagcccuc

SEQ ID NO: 1152899 - RNA, 18 nt, Human
ggcuucccgcucagcccu

SEQ ID NO: 1152900 - RNA, 17 nt, Human
ggcuucccgcucagccc

SEQ ID NO: 1152901 - RNA, 16 nt, Human
ggcuucccgcucagcc

SEQ ID NO: 1152902 - RNA, 15 nt, Human
ggcuucccgcucagc

SEQ ID NO: 1152903 - RNA, 14 nt, Human
ggcuucccgcucag

SEQ ID NO: 1152904 - RNA, 11 nt, Human
guagagacagg

SEQ ID NO: 1152905 - RNA, 14 nt, Human
guacuccucccagg

SEQ ID NO: 1152906 - RNA, 15 nt, Human
aaauauuccugcauu

SEQ ID NO: 1152907 - RNA, 12 nt, Human
aaagcugaaaac

SEQ ID NO: 1152908 - RNA, 15 nt, Human
aaagcugaaaacugc

SEQ ID NO: 1152909 - RNA, 23 nt, Human
aaagauggcugugccucugccug

SEQ ID NO: 1152910 - RNA, 22 nt, Human
aaagauggcugugccucugccu

SEQ ID NO: 1152911 - RNA, 21 nt, Human
aaagauggcugugccucugcc

SEQ ID NO: 1152912 - RNA, 22 nt, Human
aaacugcccccucugcccugcg

SEQ ID NO: 1152913 - RNA, 15 nt, Human
aaacauuaugaugug

SEQ ID NO: 1152914 - RNA, 13 nt, Human
ggggaaggcaggg

SEQ ID NO: 1152915 - RNA, 19 nt, Human
auuuuuuacagcugccugc

SEQ ID NO: 1152916 - RNA, 18 nt, Human
auuuuuuaaauugaauuc

SEQ ID NO: 1152917 - RNA, 18 nt, Human
auuuugccagugggaacu

SEQ ID NO: 1152918 - RNA, 23 nt, Human
auuugugaaaugauggugaaagu

SEQ ID NO: 1152919 - RNA, 18 nt, Human
auugguaaagaauggaag

SEQ ID NO: 1152920 - RNA, 11 nt, Human
auugacuucuu

SEQ ID NO: 1152921 - RNA, 22 nt, Human
auucucaugccucagccuccug

SEQ ID NO: 1152922 - RNA, 15 nt, Human
auucuagcuuugagc

SEQ ID NO: 1152923 - RNA, 23 nt, Human
auuccccgucucugguuccuccc

SEQ ID NO: 1152924 - RNA, 21 nt, Human
auuccagagaguggcuccucc

SEQ ID NO: 1152925 - RNA, 22 nt, Human
auucaggaagcagcuuucccca

SEQ ID NO: 1152926 - RNA, 19 nt, Human
auuauacccccugcaaagc

SEQ ID NO: 1152927 - RNA, 11 nt, Human
uuuguggaaaa

SEQ ID NO: 1152928 - RNA, 22 nt, Human
uuugugaaaugauggugaaagu

SEQ ID NO: 1152929 - RNA, 17 nt, Human
augucucugagcauuag

SEQ ID NO: 1152930 - RNA, 22 nt, Human
augucucaggucccugcagggc

SEQ ID NO: 1152931 - RNA, 17 nt, Human
augucucaggucccugc

SEQ ID NO: 1152932 - RNA, 15 nt, Human
augucgccucugcau

SEQ ID NO: 1152933 - RNA, 14 nt, Human
augucgccucugca

SEQ ID NO: 1152934 - RNA, 13 nt, Human
augucgccucugc

SEQ ID NO: 1152935 - RNA, 18 nt, Human
auguaugagguacaaccu

SEQ ID NO: 1152936 - RNA, 20 nt, Human
augguuccccuguucacucu

SEQ ID NO: 1152937 - RNA, 19 nt, Human
augguuccccuguucacuc

SEQ ID NO: 1152938 - RNA, 17 nt, Human
auggugaugaaauguaa

SEQ ID NO: 1152939 - RNA, 16 nt, Human
auggugaugaaaugua

SEQ ID NO: 1152940 - RNA, 14 nt, Human
auggugaugaaaug

SEQ ID NO: 1152941 - RNA, 17 nt, Human
augggggcacugaggac

SEQ ID NO: 1152942 - RNA, 23 nt, Human
uuucugggcaccggggccucgga

SEQ ID NO: 1152943 - RNA, 18 nt, Human
auggagacugucucaaga

SEQ ID NO: 1152944 - RNA, 16 nt, Human
augcuaagacucagug

SEQ ID NO: 1152945 - RNA, 16 nt, Human
augccucagccuccug

SEQ ID NO: 1152946 - RNA, 14 nt, Human
augcccuggaucca

SEQ ID NO: 1152947 - RNA, 17 nt, Human
augcagcaucuaaguaa

SEQ ID NO: 1152948 - RNA, 11 nt, Human
augaagaggag

SEQ ID NO: 1152949 - RNA, 11 nt, Human
uuggagacaga

SEQ ID NO: 1152950 - RNA, 12 nt, Human
uugcuccuugac

SEQ ID NO: 1152951 - RNA, 21 nt, Human
aucucuucuggguuccuuccu

SEQ ID NO: 1152952 - RNA, 15 nt, Human
aucuccacuccagau

SEQ ID NO: 1152953 - RNA, 13 nt, Human
uugaaucacagua

SEQ ID NO: 1152954 - RNA, 13 nt, Human
uugaagccuuugu

SEQ ID NO: 1152955 - RNA, 19 nt, Human
auccuacaagacacaguga

SEQ ID NO: 1152956 - RNA, 18 nt, Human
auccuacaagacacagug

SEQ ID NO: 1152957 - RNA, 14 nt, Human
uucuuuuuuuguga

SEQ ID NO: 1152958 - RNA, 13 nt, Human
auccaucaggcca

SEQ ID NO: 1152959 - RNA, 17 nt, Human
uucuccuuucacaaccu

SEQ ID NO: 1152960 - RNA, 18 nt, Human
aucagaaguuucucagcu

SEQ ID NO: 1152961 - RNA, 18 nt, Human
uucucacuccuaccuggu

SEQ ID NO: 1152962 - RNA, 16 nt, Human
uucucacuccuaccug

SEQ ID NO: 1152963 - RNA, 21 nt, Human
uuccucugaggcugaaauuca

SEQ ID NO: 1152964 - RNA, 17 nt, Human
uuccucugagccuuggg

SEQ ID NO: 1152965 - RNA, 14 nt, Human
uuccucugagccuu

SEQ ID NO: 1152966 - RNA, 18 nt, Human
uuccuaauuccacagcug

SEQ ID NO: 1152967 - RNA, 17 nt, Human
uuccuaauuccacagcu

SEQ ID NO: 1152968 - RNA, 16 nt, Human
uuccuaauuccacagc

SEQ ID NO: 1152969 - RNA, 22 nt, Human
uucccgcucagcccucccugcc

SEQ ID NO: 1152970 - RNA, 21 nt, Human
uucccgcucagcccucccugc

SEQ ID NO: 1152971 - RNA, 18 nt, Human
uucccgcucagcccuccc

SEQ ID NO: 1152972 - RNA, 16 nt, Human
uucccgcucagcccuc

SEQ ID NO: 1152973 - RNA, 18 nt, Human
auagacccacaagaggca

SEQ ID NO: 1152974 - RNA, 18 nt, Human
auacucuuauagacaaca

SEQ ID NO: 1152975 - RNA, 20 nt, Human
uuauucacuuuuauuuagca

SEQ ID NO: 1152976 - RNA, 17 nt, Human
uuaguagagacaggguu

SEQ ID NO: 1152977 - RNA, 20 nt, Human
auaauucaggaagcagcuuu

SEQ ID NO: 1152978 - RNA, 15 nt, Human
auaacuauguugaua

SEQ ID NO: 1152979 - RNA, 18 nt, Human
auaaauugcuccuugaca

SEQ ID NO: 1152980 - RNA, 16 nt, Human
auaaauugcuccuuga

SEQ ID NO: 1152981 - RNA, 13 nt, Human
auaaauugcuccu

SEQ ID NO: 1152982 - RNA, 23 nt, Human
uuaagacauuuuuggaaggggac

SEQ ID NO: 1152983 - RNA, 18 nt, Human
uuaagacauuuuuggaag

SEQ ID NO: 1152984 - RNA, 15 nt, Human
aguuucucagcuccc

SEQ ID NO: 1152985 - RNA, 13 nt, Human
aguuucucagcuc

SEQ ID NO: 1152986 - RNA, 23 nt, Human
aguuacuaucaugucaaacguga

SEQ ID NO: 1152987 - RNA, 14 nt, Human
aguggggaggggcu

SEQ ID NO: 1152988 - RNA, 15 nt, Human
aguggggacagagca

SEQ ID NO: 1152989 - RNA, 17 nt, Human
aguggauggaaggggcu

SEQ ID NO: 1152990 - RNA, 22 nt, Human
uguuaaguugauggugaugaaa

SEQ ID NO: 1152991 - RNA, 22 nt, Human
uguuaacugagugccuuuuggu

SEQ ID NO: 1152992 - RNA, 16 nt, Human
uguuaacugagugccu

SEQ ID NO: 1152993 - RNA, 16 nt, Human
agugcccuccaggaua

SEQ ID NO: 1152994 - RNA, 14 nt, Human
agugcaucucagcc

SEQ ID NO: 1152995 - RNA, 21 nt, Human
agucucuucuccacuggaugg

SEQ ID NO: 1152996 - RNA, 19 nt, Human
agucucuucuccacuggau

SEQ ID NO: 1152997 - RNA, 19 nt, Human
ugugacuucagcucuguuu

SEQ ID NO: 1152998 - RNA, 18 nt, Human
ugugacuucagcucuguu

SEQ ID NO: 1152999 - RNA, 16 nt, Human
agucccccugccccag

SEQ ID NO: 1153000 - RNA, 20 nt, Human
agucccaggcugagccucag

SEQ ID NO: 1153001 - RNA, 19 nt, Human
agucccaggcugagccuca

SEQ ID NO: 1153002 - RNA, 18 nt, Human
agucccaggcugagccuc

SEQ ID NO: 1153003 - RNA, 17 nt, Human
agucccaggcugagccu

SEQ ID NO: 1153004 - RNA, 14 nt, Human
ugucgccucugcau

SEQ ID NO: 1153005 - RNA, 16 nt, Human
ugggcugcccuggugc

SEQ ID NO: 1153006 - RNA, 15 nt, Human
ugggcugcccuggug

SEQ ID NO: 1153007 - RNA, 14 nt, Human
ugggcugcccuggu

SEQ ID NO: 1153008 - RNA, 13 nt, Human
ugggcugcccugg

SEQ ID NO: 1153009 - RNA, 15 nt, Human
agggagggccugggc

SEQ ID NO: 1153010 - RNA, 13 nt, Human
agggagggccugg

SEQ ID NO: 1153011 - RNA, 17 nt, Human
agggcacugguggcccg

SEQ ID NO: 1153012 - RNA, 16 nt, Human
ugggacuggccucugc

SEQ ID NO: 1153013 - RNA, 14 nt, Human
ugggacuggccucu

SEQ ID NO: 1153014 - RNA, 18 nt, Human
agggagcaucagugcccu

SEQ ID NO: 1153015 - RNA, 23 nt, Human
aggcuucugguugaugccuguga

SEQ ID NO: 1153016 - RNA, 20 nt, Human
ugggaacaccauaggucacc

SEQ ID NO: 1153017 - RNA, 22 nt, Human
uggcugugccucugccugucuc

SEQ ID NO: 1153018 - RNA, 19 nt, Human
uggcugugccucugccugu

SEQ ID NO: 1153019 - RNA, 18 nt, Human
uggcugugccucugccug

SEQ ID NO: 1153020 - RNA, 17 nt, Human
uggcugugccucugccu

SEQ ID NO: 1153021 - RNA, 16 nt, Human
uggcugugccucugcc

SEQ ID NO: 1153022 - RNA, 15 nt, Human
uggcugugccucugc

SEQ ID NO: 1153023 - RNA, 14 nt, Human
uggcugugccucug

SEQ ID NO: 1153024 - RNA, 13 nt, Human
aggcuccugccac

SEQ ID NO: 1153025 - RNA, 14 nt, Human
aggcgccccuuccc

SEQ ID NO: 1153026 - RNA, 21 nt, Human
uggccucugcugauccuccca

SEQ ID NO: 1153027 - RNA, 13 nt, Human
uggcccugcccug

SEQ ID NO: 1153028 - RNA, 12 nt, Human
uggcccugcccu

SEQ ID NO: 1153029 - RNA, 20 nt, Human
aggccauuccccgucucugg

SEQ ID NO: 1153030 - RNA, 22 nt, Human
uggcagccgugccuucagcucu

SEQ ID NO: 1153031 - RNA, 21 nt, Human
uggcagccgugccuucagcuc

SEQ ID NO: 1153032 - RNA, 20 nt, Human
uggcagccgugccuucagcu

SEQ ID NO: 1153033 - RNA, 19 nt, Human
uggcagccgugccuucagc

SEQ ID NO: 1153034 - RNA, 18 nt, Human
uggcagccgugccuucag

SEQ ID NO: 1153035 - RNA, 17 nt, Human
uggcagccgugccuuca

SEQ ID NO: 1153036 - RNA, 16 nt, Human
uggcacagggcagugg

SEQ ID NO: 1153037 - RNA, 15 nt, Human
uggcacagggcagug

SEQ ID NO: 1153038 - RNA, 16 nt, Human
aggcagggagggccug

SEQ ID NO: 1153039 - RNA, 23 nt, Human
uggaggaaaaccaagccguggcu

SEQ ID NO: 1153040 - RNA, 21 nt, Human
uggaggaaaaccaagccgugg

SEQ ID NO: 1153041 - RNA, 16 nt, Human
aggcaacuugggaacu

SEQ ID NO: 1153042 - RNA, 16 nt, Human
ugcugcccagccucca

SEQ ID NO: 1153043 - RNA, 14 nt, Human
ugcugcccagccuc

SEQ ID NO: 1153044 - RNA, 22 nt, Human
ugcugccacacuucaggcucuu

SEQ ID NO: 1153045 - RNA, 19 nt, Human
ugcugccacacuucaggcu

SEQ ID NO: 1153046 - RNA, 16 nt, Human
ugcugccacacuucag

SEQ ID NO: 1153047 - RNA, 15 nt, Human
ugcugccacacuuca

SEQ ID NO: 1153048 - RNA, 22 nt, Human
ugcugagucccaggcugagccu

SEQ ID NO: 1153049 - RNA, 18 nt, Human
ugcugagucccaggcuga

SEQ ID NO: 1153050 - RNA, 15 nt, Human
ugcugagucccaggc

SEQ ID NO: 1153051 - RNA, 19 nt, Human
ugcucugaugaagaggagu

SEQ ID NO: 1153052 - RNA, 18 nt, Human
ugcucugaugaagaggag

SEQ ID NO: 1153053 - RNA, 21 nt, Human
ugcuauaacuauguugauaaa

SEQ ID NO: 1153054 - RNA, 21 nt, Human
ugccuuagaaccuuucuuaca

SEQ ID NO: 1153055 - RNA, 17 nt, Human
ugccuuagaaccuuucu

SEQ ID NO: 1153056 - RNA, 14 nt, Human
ugccuuagaaccuu

SEQ ID NO: 1153057 - RNA, 23 nt, Human
agcugggauuacaggcuccugcc

SEQ ID NO: 1153058 - RNA, 22 nt, Human
agcugggauuacaggcuccugc

SEQ ID NO: 1153059 - RNA, 21 nt, Human
agcugggauuacaggcuccug

SEQ ID NO: 1153060 - RNA, 18 nt, Human
agcugggauuacaggcuc

SEQ ID NO: 1153061 - RNA, 22 nt, Human
agcugggaucacauguggacuu

SEQ ID NO: 1153062 - RNA, 15 nt, Human
ugcccuuucugggca

SEQ ID NO: 1153063 - RNA, 22 nt, Human
agcucuaucaccaaggagccaa

SEQ ID NO: 1153064 - RNA, 18 nt, Human
ugccccgucccccucugg

SEQ ID NO: 1153065 - RNA, 16 nt, Human
ugccccgucccccucu

SEQ ID NO: 1153066 - RNA, 12 nt, Human
ugccccccagcc

SEQ ID NO: 1153067 - RNA, 17 nt, Human
ugcccaggccugccugu

SEQ ID NO: 1153068 - RNA, 15 nt, Human
ugcccaggccugccu

SEQ ID NO: 1153069 - RNA, 24 nt, Human
ugcccaaccugcucuccucuugcc

SEQ ID NO: 1153070 - RNA, 23 nt, Human
ugcccaaccugcucuccucuugc

SEQ ID NO: 1153071 - RNA, 22 nt, Human
ugcccaaccugcucuccucuug

SEQ ID NO: 1153072 - RNA, 18 nt, Human
ugcccaaccugcucuccu

SEQ ID NO: 1153073 - RNA, 20 nt, Human
ugccagucccccugccccag

SEQ ID NO: 1153074 - RNA, 19 nt, Human
ugccagucccccugcccca

SEQ ID NO: 1153075 - RNA, 17 nt, Human
ugccagucccccugccc

SEQ ID NO: 1153076 - RNA, 12 nt, Human
ugccacacuuca

SEQ ID NO: 1153077 - RNA, 23 nt, Human
ugccacugccucuuccucccuca

SEQ ID NO: 1153078 - RNA, 14 nt, Human
ugcauuuccugaca

SEQ ID NO: 1153079 - RNA, 20 nt, Human
agcgcccacuagacccacug

SEQ ID NO: 1153080 - RNA, 12 nt, Human
agccugcccucc

SEQ ID NO: 1153081 - RNA, 19 nt, Human
agccugaucaccugcccug

SEQ ID NO: 1153082 - RNA, 18 nt, Human
agccugaucaccugcccu

SEQ ID NO: 1153083 - RNA, 11 nt, Human
ugcauaaaaug

SEQ ID NO: 1153084 - RNA, 23 nt, Human
agccguuuguuccccaagacauu

SEQ ID NO: 1153085 - RNA, 23 nt, Human
agcccuuccaugucgccucugca

SEQ ID NO: 1153086 - RNA, 22 nt, Human
agcccuuccaugucgccucugc

SEQ ID NO: 1153087 - RNA, 19 nt, Human
agcccuuccaugucgccuc

SEQ ID NO: 1153088 - RNA, 14 nt, Human
agcccuucauuugg

SEQ ID NO: 1153089 - RNA, 13 nt, Human
agcccuucauuug

SEQ ID NO: 1153090 - RNA, 19 nt, Human
ugagguacaaccuguucug

SEQ ID NO: 1153091 - RNA, 15 nt, Human
ugagggauuaucuuu

SEQ ID NO: 1153092 - RNA, 13 nt, Human
agcaccagggaag

SEQ ID NO: 1153093 - RNA, 12 nt, Human
agcaccagggaa

SEQ ID NO: 1153094 - RNA, 10 nt, Human
agcaccaggg

SEQ ID NO: 1153095 - RNA, 21 nt, Human
agcacagcagccccugcacaa

SEQ ID NO: 1153096 - RNA, 21 nt, Human
ugagccaccgugccuggccac

SEQ ID NO: 1153097 - RNA, 20 nt, Human
ugagccaccgugccuggcca

SEQ ID NO: 1153098 - RNA, 19 nt, Human
ugagccaccgugccuggcc

SEQ ID NO: 1153099 - RNA, 18 nt, Human
ugagccaccgugccuggc

SEQ ID NO: 1153100 - RNA, 14 nt, Human
ugagccaccgugcc

SEQ ID NO: 1153101 - RNA, 15 nt, Human
ugagccaccacgccc

SEQ ID NO: 1153102 - RNA, 19 nt, Human
ugagcaaauguggcuccug

SEQ ID NO: 1153103 - RNA, 18 nt, Human
ugagcaaauguggcuccu

SEQ ID NO: 1153104 - RNA, 16 nt, Human
ugagcaaauguggcuc

SEQ ID NO: 1153105 - RNA, 16 nt, Human
agauucaaucccagga

SEQ ID NO: 1153106 - RNA, 20 nt, Human
agauuauaggcaccuaccac

SEQ ID NO: 1153107 - RNA, 23 nt, Human
ugaccccucauagcccucacccu

SEQ ID NO: 1153108 - RNA, 20 nt, Human
ugaccccucauagcccucac

SEQ ID NO: 1153109 - RNA, 19 nt, Human
ugaccccucauagcccuca

SEQ ID NO: 1153110 - RNA, 17 nt, Human
ugaccccucauagcccu

SEQ ID NO: 1153111 - RNA, 22 nt, Human
ugacccccaaccaaguggcucc

SEQ ID NO: 1153112 - RNA, 20 nt, Human
ugaccacacuccagcuggga

SEQ ID NO: 1153113 - RNA, 19 nt, Human
ugaccacacuccagcuggg

SEQ ID NO: 1153114 - RNA, 17 nt, Human
ugaccacacuccagcug

SEQ ID NO: 1153115 - RNA, 12 nt, Human
ugaccacacucc

SEQ ID NO: 1153116 - RNA, 22 nt, Human
ugacauuguagagcuucuggca

SEQ ID NO: 1153117 - RNA, 18 nt, Human
ugacauuguagagcuucu

SEQ ID NO: 1153118 - RNA, 18 nt, Human
agauaauucuagcuuuga

SEQ ID NO: 1153119 - RNA, 16 nt, Human
ugaaugcauaaaaugu

SEQ ID NO: 1153120 - RNA, 15 nt, Human
ugaaugcauaaaaug

SEQ ID NO: 1153121 - RNA, 22 nt, Human
agagcuucuguugcugccucau

SEQ ID NO: 1153122 - RNA, 21 nt, Human
agagcuucuguugcugccuca

SEQ ID NO: 1153123 - RNA, 20 nt, Human
agagcuucuguugcugccuc

SEQ ID NO: 1153124 - RNA, 19 nt, Human
agagcuucuguugcugccu

SEQ ID NO: 1153125 - RNA, 15 nt, Human
agagcuucuggcacu

SEQ ID NO: 1153126 - RNA, 12 nt, Human
agaccugccccu

SEQ ID NO: 1153127 - RNA, 13 nt, Human
agaccugccccuc

SEQ ID NO: 1153128 - RNA, 17 nt, Human
ucuucaaaaugagcccu

SEQ ID NO: 1153129 - RNA, 22 nt, Human
agacagaaucucgcucugucgc

SEQ ID NO: 1153130 - RNA, 18 nt, Human
agacagaaucucgcucug

SEQ ID NO: 1153131 - RNA, 24 nt, Human
ucuguccaggcacugcugcccagc

SEQ ID NO: 1153132 - RNA, 16 nt, Human
ucuggguuccuuccuc

SEQ ID NO: 1153133 - RNA, 12 nt, Human
ucugcagagcag

SEQ ID NO: 1153134 - RNA, 19 nt, Human
agaaaaauaugaccacacu

SEQ ID NO: 1153135 - RNA, 21 nt, Human
ucucuucuggguuccuuccuc

SEQ ID NO: 1153136 - RNA, 20 nt, Human
ucucuucuggguuccuuccu

SEQ ID NO: 1153137 - RNA, 19 nt, Human
ucucuucuggguuccuucc

SEQ ID NO: 1153138 - RNA, 18 nt, Human
ucucuucuggguuccuuc

SEQ ID NO: 1153139 - RNA, 22 nt, Human
ucucugcccuaaugcgcaggcu

SEQ ID NO: 1153140 - RNA, 11 nt, Human
ucucugcccua

SEQ ID NO: 1153141 - RNA, 21 nt, Human
acuuguugauuaauggaaaug

SEQ ID NO: 1153142 - RNA, 19 nt, Human
acuuguugauuaauggaaa

SEQ ID NO: 1153143 - RNA, 18 nt, Human
ucucccaaagugcuggga

SEQ ID NO: 1153144 - RNA, 15 nt, Human
acuguacuccuccca

SEQ ID NO: 1153145 - RNA, 14 nt, Human
acuguacuccuccc

SEQ ID NO: 1153146 - RNA, 13 nt, Human
acuguacuccucc

SEQ ID NO: 1153147 - RNA, 13 nt, Human
ucgaccugccucg

SEQ ID NO: 1153148 - RNA, 20 nt, Human
uccuuucacaaccuucugug

SEQ ID NO: 1153149 - RNA, 19 nt, Human
uccuuucacaaccuucugu

SEQ ID NO: 1153150 - RNA, 18 nt, Human
uccuuucacaaccuucug

SEQ ID NO: 1153151 - RNA, 16 nt, Human
uccuuucacaaccuuc

SEQ ID NO: 1153152 - RNA, 16 nt, Human
uccuuccucugaggcu

SEQ ID NO: 1153153 - RNA, 17 nt, Human
uccuuccucugagccuu

SEQ ID NO: 1153154 - RNA, 16 nt, Human
uccuuccucugagccu

SEQ ID NO: 1153155 - RNA, 23 nt, Human
acuggccucugcugauccuccca

SEQ ID NO: 1153156 - RNA, 14 nt, Human
acugcuggcugccu

SEQ ID NO: 1153157 - RNA, 13 nt, Human
acugcuggcugcc

SEQ ID NO: 1153158 - RNA, 12 nt, Human
acugcuggcugc

SEQ ID NO: 1153159 - RNA, 21 nt, Human
acugcugcccagccuccaagc

SEQ ID NO: 1153160 - RNA, 18 nt, Human
acugcugcccagccucca

SEQ ID NO: 1153161 - RNA, 16 nt, Human
acugcugcccagccuc

SEQ ID NO: 1153162 - RNA, 12 nt, Human
acugcucugaug

SEQ ID NO: 1153163 - RNA, 18 nt, Human
acugcagggacugccagu

SEQ ID NO: 1153164 - RNA, 17 nt, Human
acugcagggacugccag

SEQ ID NO: 1153165 - RNA, 16 nt, Human
acugcagggacugcca

SEQ ID NO: 1153166 - RNA, 18 nt, Human
uccugugacuucagcucu

SEQ ID NO: 1153167 - RNA, 23 nt, Human
uccuggggguucuuucuuccucu

SEQ ID NO: 1153168 - RNA, 22 nt, Human
uccuggggguucuuucuuccuc

SEQ ID NO: 1153169 - RNA, 21 nt, Human
uccuggggguucuuucuuccu

SEQ ID NO: 1153170 - RNA, 19 nt, Human
uccuggggaaccugacccc

SEQ ID NO: 1153171 - RNA, 18 nt, Human
uccuggggaaccugaccc

SEQ ID NO: 1153172 - RNA, 20 nt, Human
uccugaguagcugggauuac

SEQ ID NO: 1153173 - RNA, 22 nt, Human
acugcacagugcaucucagccc

SEQ ID NO: 1153174 - RNA, 18 nt, Human
acugcacagugcaucuca

SEQ ID NO: 1153175 - RNA, 16 nt, Human
acugcacagugcaucu

SEQ ID NO: 1153176 - RNA, 23 nt, Human
acugcaaccuucgccaccugggu

SEQ ID NO: 1153177 - RNA, 20 nt, Human
acugcaaccuucgccaccug

SEQ ID NO: 1153178 - RNA, 16 nt, Human
acugagugccuuuugg

SEQ ID NO: 1153179 - RNA, 15 nt, Human
acugaggaccagcca

SEQ ID NO: 1153180 - RNA, 16 nt, Human
uccucuccacugccuu

SEQ ID NO: 1153181 - RNA, 15 nt, Human
uccucuccacugccu

SEQ ID NO: 1153182 - RNA, 14 nt, Human
uccucuccacugcc

SEQ ID NO: 1153183 - RNA, 13 nt, Human
uccucuccacugc

SEQ ID NO: 1153184 - RNA, 12 nt, Human
uccucuccacug

SEQ ID NO: 1153185 - RNA, 22 nt, Human
uccuccccuccuccuggacucc

SEQ ID NO: 1153186 - RNA, 20 nt, Human
uccuccccuccuccuggacu

SEQ ID NO: 1153187 - RNA, 18 nt, Human
uccuccccuccuccugga

SEQ ID NO: 1153188 - RNA, 16 nt, Human
uccuccccuccuccug

SEQ ID NO: 1153189 - RNA, 13 nt, Human
acucugacaacag

SEQ ID NO: 1153190 - RNA, 22 nt, Human
ucccuucaaccauuccccaugg

SEQ ID NO: 1153191 - RNA, 21 nt, Human
ucccuucaaccauuccccaug

SEQ ID NO: 1153192 - RNA, 11 nt, Human
ucccuucaacc

SEQ ID NO: 1153193 - RNA, 23 nt, Human
acuccugcacacgcuccuuccuc

SEQ ID NO: 1153194 - RNA, 14 nt, Human
acuccuaccuggua

SEQ ID NO: 1153195 - RNA, 20 nt, Human
acuccagcuggguuggaaaa

SEQ ID NO: 1153196 - RNA, 23 nt, Human
ucccucauuccaccuucccaugc

SEQ ID NO: 1153197 - RNA, 20 nt, Human
ucccgcucagcccucccugc

SEQ ID NO: 1153198 - RNA, 16 nt, Human
ucccgcucagcccucc

SEQ ID NO: 1153199 - RNA, 15 nt, Human
ucccgcucagcccuc

SEQ ID NO: 1153200 - RNA, 14 nt, Human
ucccgcucagcccu

SEQ ID NO: 1153201 - RNA, 13 nt, Human
ucccgcucagccc

SEQ ID NO: 1153202 - RNA, 18 nt, Human
acuaucccggcugcccuu

SEQ ID NO: 1153203 - RNA, 17 nt, Human
acuaucccggcugcccu

SEQ ID NO: 1153204 - RNA, 16 nt, Human
acuaucccggcugccc

SEQ ID NO: 1153205 - RNA, 22 nt, Human
acuaucaugucaaacgugaaaa

SEQ ID NO: 1153206 - RNA, 15 nt, Human
uccccaagccuggca

SEQ ID NO: 1153207 - RNA, 23 nt, Human
uccagaccccuggcuuuucacug

SEQ ID NO: 1153208 - RNA, 18 nt, Human
uccagaccccuggcuuuu

SEQ ID NO: 1153209 - RNA, 17 nt, Human
uccagaccccuggcuuu

SEQ ID NO: 1153210 - RNA, 16 nt, Human
uccagaccccuggcuu

SEQ ID NO: 1153211 - RNA, 15 nt, Human
uccagaccccuggcu

SEQ ID NO: 1153212 - RNA, 16 nt, Human
accuucuguggcucac

SEQ ID NO: 1153213 - RNA, 15 nt, Human
accuucuguggcuca

SEQ ID NO: 1153214 - RNA, 13 nt, Human
accuucuguggcu

SEQ ID NO: 1153215 - RNA, 12 nt, Human
accuucuguggc

SEQ ID NO: 1153216 - RNA, 14 nt, Human
accuuagccugccc

SEQ ID NO: 1153217 - RNA, 23 nt, Human
accuggucacaggacucugccuc

SEQ ID NO: 1153218 - RNA, 22 nt, Human
accuggucacaggacucugccu

SEQ ID NO: 1153219 - RNA, 18 nt, Human
uccaagcuccaucuccac

SEQ ID NO: 1153220 - RNA, 15 nt, Human
uccaaaugcagcuuu

SEQ ID NO: 1153221 - RNA, 14 nt, Human
uccaaaugcagcuu

SEQ ID NO: 1153222 - RNA, 18 nt, Human
ucauuugugccagaaugc

SEQ ID NO: 1153223 - RNA, 19 nt, Human
accugcucuccucuugcca

SEQ ID NO: 1153224 - RNA, 18 nt, Human
accugcucuccucuugcc

SEQ ID NO: 1153225 - RNA, 24 nt, Human
accgagucucuucuccacuggaug

SEQ ID NO: 1153226 - RNA, 21 nt, Human
accgagucucuucuccacugg

SEQ ID NO: 1153227 - RNA, 20 nt, Human
accgagucucuucuccacug

SEQ ID NO: 1153228 - RNA, 17 nt, Human
accccuggcuuuucacu

SEQ ID NO: 1153229 - RNA, 15 nt, Human
accccuggcuuuuca

SEQ ID NO: 1153230 - RNA, 12 nt, Human
accccuggcuuu

SEQ ID NO: 1153231 - RNA, 19 nt, Human
ucagcccucccugccccuc

SEQ ID NO: 1153232 - RNA, 18 nt, Human
ucagcccucccugccccu

SEQ ID NO: 1153233 - RNA, 15 nt, Human
accauuccccauggg

SEQ ID NO: 1153234 - RNA, 24 nt, Human
ucacugcacagugcaucucagccc

SEQ ID NO: 1153235 - RNA, 22 nt, Human
ucacugcacagugcaucucagc

SEQ ID NO: 1153236 - RNA, 20 nt, Human
ucacugcacagugcaucuca

SEQ ID NO: 1153237 - RNA, 15 nt, Human
ucaccucccccaucu

SEQ ID NO: 1153238 - RNA, 13 nt, Human
ucaccucccccau

SEQ ID NO: 1153239 - RNA, 19 nt, Human
accaggcaacuugggaacu

SEQ ID NO: 1153240 - RNA, 14 nt, Human
uauuuauuuaguau

SEQ ID NO: 1153241 - RNA, 20 nt, Human
uauuuagcaccagggaaggg

SEQ ID NO: 1153242 - RNA, 22 nt, Human
acagcuaaucagcauucucacu

SEQ ID NO: 1153243 - RNA, 20 nt, Human
acagcuaaucagcauucuca

SEQ ID NO: 1153244 - RNA, 15 nt, Human
acagccuggcacagg

SEQ ID NO: 1153245 - RNA, 14 nt, Human
acagccuggcacag

SEQ ID NO: 1153246 - RNA, 18 nt, Human
acagcagccccugcacaa

SEQ ID NO: 1153247 - RNA, 14 nt, Human
acagacuucugaaa

SEQ ID NO: 1153248 - RNA, 13 nt, Human
acagacuucugaa

SEQ ID NO: 1153249 - RNA, 15 nt, Human
acagacagcccucca

SEQ ID NO: 1153250 - RNA, 13 nt, Human
acagacagcccuc

SEQ ID NO: 1153251 - RNA, 13 nt, Human
uagugaugguucc

SEQ ID NO: 1153252 - RNA, 21 nt, Human
acaaggacagccccuccucca

SEQ ID NO: 1153253 - RNA, 13 nt, Human
acaagacacagug

SEQ ID NO: 1153254 - RNA, 15 nt, Human
acaacaaccugguca

SEQ ID NO: 1153255 - RNA, 16 nt, Human
uagcaccagggaaggg

SEQ ID NO: 1153256 - RNA, 14 nt, Human
uagcaccagggaag

SEQ ID NO: 1153257 - RNA, 13 nt, Human
uagcaccagggaa

SEQ ID NO: 1153258 - RNA, 15 nt, Human
uagagcuucuggcac

SEQ ID NO: 1153259 - RNA, 14 nt, Human
aauuuuuguauuuu

SEQ ID NO: 1153260 - RNA, 12 nt, Human
aauugcuccuug

SEQ ID NO: 1153261 - RNA, 22 nt, Human
uacucuucaguuaagccuuugg

SEQ ID NO: 1153262 - RNA, 18 nt, Human
uacucuuauagacaacau

SEQ ID NO: 1153263 - RNA, 14 nt, Human
uacguuaccaggca

SEQ ID NO: 1153264 - RNA, 20 nt, Human
uacauuagcaguuugcuuug

SEQ ID NO: 1153265 - RNA, 19 nt, Human
uacauuagcaguuugcuuu

SEQ ID NO: 1153266 - RNA, 20 nt, Human
uacaauaaaaucuugaaaau

SEQ ID NO: 1153267 - RNA, 20 nt, Human
uaauuauacccccugcaaag

SEQ ID NO: 1153268 - RNA, 13 nt, Human
aaucuugaaaaug

SEQ ID NO: 1153269 - RNA, 13 nt, Human
uaauaccucccuu

SEQ ID NO: 1153270 - RNA, 22 nt, Human
uaacaacuaugauuuggaaaau

SEQ ID NO: 1153271 - RNA, 21 nt, Human
uaacaacuaugauuuggaaaa

SEQ ID NO: 1153272 - RNA, 16 nt, Human
uaacaacuaugauuug

SEQ ID NO: 1153273 - RNA, 20 nt, Human
uaaauaguaaaaauaaaauu

SEQ ID NO: 1153274 - RNA, 19 nt, Human
uaaauaguaaaaauaaaau

SEQ ID NO: 1153275 - RNA, 16 nt, Human
aauaaaguacaagagc

SEQ ID NO: 1153276 - RNA, 16 nt, Human
aauaaaaucuugaaaa

SEQ ID NO: 1153277 - RNA, 18 nt, Human
uaaagaguuaguuugagu

SEQ ID NO: 1153278 - RNA, 15 nt, Human
uaaagacaccuacug

SEQ ID NO: 1153279 - RNA, 14 nt, Human
uaaagaagguuuca

SEQ ID NO: 1153280 - RNA, 12 nt, Human
uaaacugccccc

SEQ ID NO: 1153281 - RNA, 19 nt, Human
uaaaauuaaagcugaaaac

SEQ ID NO: 1153282 - RNA, 18 nt, Human
uaaaauuaaagcugaaaa

SEQ ID NO: 1153283 - RNA, 16 nt, Human
uaaaauuaaagcugaa

SEQ ID NO: 1153284 - RNA, 14 nt, Human
aagucacugcacag

SEQ ID NO: 1153285 - RNA, 12 nt, Human
aagucacugcac

SEQ ID NO: 1153286 - RNA, 19 nt, Human
aagucaaggguaggguggg

SEQ ID NO: 1153287 - RNA, 14 nt, Human
guuucucagcuccc

SEQ ID NO: 1153288 - RNA, 19 nt, Human
aaggcugagaggagagaga

SEQ ID NO: 1153289 - RNA, 12 nt, Human
guugcugccuca

SEQ ID NO: 1153290 - RNA, 18 nt, Human
guuccccuguucacucua

SEQ ID NO: 1153291 - RNA, 17 nt, Human
guuccccuguucacucu

SEQ ID NO: 1153292 - RNA, 15 nt, Human
guuccccuguucacu

SEQ ID NO: 1153293 - RNA, 22 nt, Human
guguuuaagacauuuuuggaag

SEQ ID NO: 1153294 - RNA, 14 nt, Human
guguuuaagacauu

SEQ ID NO: 1153295 - RNA, 13 nt, Human
guguuuaagacau

SEQ ID NO: 1153296 - RNA, 19 nt, Human
guguguguaugcgugugug

SEQ ID NO: 1153297 - RNA, 12 nt, Human
aagcaaaugucu

SEQ ID NO: 1153298 - RNA, 21 nt, Human
guggcuucccgcucagcccuc

SEQ ID NO: 1153299 - RNA, 17 nt, Human
guggcccgacagccugg

SEQ ID NO: 1153300 - RNA, 16 nt, Human
guggcccgacagccug

SEQ ID NO: 1153301 - RNA, 23 nt, Human
aagaccccuuaccacugcucuga

SEQ ID NO: 1153302 - RNA, 12 nt, Human
aagaccagucca

SEQ ID NO: 1153303 - RNA, 23 nt, Human
aagaagguuucagaaagaagugg

SEQ ID NO: 1153304 - RNA, 13 nt, Human
aacuuguuuucug

SEQ ID NO: 1153305 - RNA, 15 nt, Human
aacuuguaaaugugg

SEQ ID NO: 1153306 - RNA, 16 nt, Human
gugccuggccacgccc

SEQ ID NO: 1153307 - RNA, 14 nt, Human
aacugaacucugac

SEQ ID NO: 1153308 - RNA, 17 nt, Human
gugagcaggcugugagu

SEQ ID NO: 1153309 - RNA, 15 nt, Human
gugagcaggcuguga

SEQ ID NO: 1153310 - RNA, 20 nt, Human
aacuagacucccaagcugga

SEQ ID NO: 1153311 - RNA, 17 nt, Human
aaccuguucugcuuucc

SEQ ID NO: 1153312 - RNA, 13 nt, Human
aaccuguucugcu

SEQ ID NO: 1153313 - RNA, 19 nt, Human
gucugaagucacugcacag

SEQ ID NO: 1153314 - RNA, 17 nt, Human
gucugaagucacugcac

SEQ ID NO: 1153315 - RNA, 16 nt, Human
gucugaagucacugca

SEQ ID NO: 1153316 - RNA, 16 nt, Human
aaccaagccguggcuu

SEQ ID NO: 1153317 - RNA, 16 nt, Human
gucucaggucccugca

SEQ ID NO: 1153318 - RNA, 15 nt, Human
gucucaggucccugc

SEQ ID NO: 1153319 - RNA, 22 nt, Human
gucucaagagggcacugguggc

SEQ ID NO: 1153320 - RNA, 20 nt, Human
gucucaagagggcacuggug

SEQ ID NO: 1153321 - RNA, 17 nt, Human
gucucaagagggcacug

SEQ ID NO: 1153322 - RNA, 15 nt, Human
gucucaagagggcac

SEQ ID NO: 1153323 - RNA, 20 nt, Human
gucgcccaggcuggagugca

SEQ ID NO: 1153324 - RNA, 15 nt, Human
gucgcccaggcugga

SEQ ID NO: 1153325 - RNA, 14 nt, Human
gucgcccaggcugg

SEQ ID NO: 1153326 - RNA, 14 nt, Human
gucccccucuggcu

SEQ ID NO: 1153327 - RNA, 12 nt, Human
gucccccucugg

SEQ ID NO: 1153328 - RNA, 21 nt, Human
auagguauaaguggugugugu

SEQ ID NO: 1153329 - RNA, 12 nt, Human
auaaagacaccu

SEQ ID NO: 1153330 - RNA, 13 nt, Human
aguuaagccuuug

SEQ ID NO: 1153331 - RNA, 14 nt, Human
aguuaagccuuugg

SEQ ID NO: 1153332 - RNA, 21 nt, Human
aguggcuccucccggugccca

SEQ ID NO: 1153333 - RNA, 17 nt, Human
aguggcuccucccggug

SEQ ID NO: 1153334 - RNA, 13 nt, Human
aguggcuccuccc

SEQ ID NO: 1153335 - RNA, 16 nt, Human
aguaugaauaaagaca

SEQ ID NO: 1153336 - RNA, 20 nt, Human
aguaugggacuggccucugc

SEQ ID NO: 1153337 - RNA, 17 nt, Human
aguaugggacuggccuc

SEQ ID NO: 1153338 - RNA, 18 nt, Human
agugaccauacuaauuau

SEQ ID NO: 1153339 - RNA, 22 nt, Human
aucuggacuccucuguccaggc

SEQ ID NO: 1153340 - RNA, 19 nt, Human
aucuggacuccucugucca

SEQ ID NO: 1153341 - RNA, 18 nt, Human
aucuggacuccucugucc

SEQ ID NO: 1153342 - RNA, 17 nt, Human
aucuggacuccucuguc

SEQ ID NO: 1153343 - RNA, 16 nt, Human
aucuggacuccucugu

SEQ ID NO: 1153344 - RNA, 15 nt, Human
aucuggacuccucug

SEQ ID NO: 1153345 - RNA, 16 nt, Human
aucucggcucacugca

SEQ ID NO: 1153346 - RNA, 15 nt, Human
aucucggcucacugc

SEQ ID NO: 1153347 - RNA, 14 nt, Human
aucucggcucacug

SEQ ID NO: 1153348 - RNA, 15 nt, Human
aucacauguggacuu

SEQ ID NO: 1153349 - RNA, 16 nt, Human
auccccaagccuggca

SEQ ID NO: 1153350 - RNA, 13 nt, Human
auccccaagccug

SEQ ID NO: 1153351 - RNA, 12 nt, Human
auccucccaggc

SEQ ID NO: 1153352 - RNA, 22 nt, Human
auggaggaaaaccaagccgugg

SEQ ID NO: 1153353 - RNA, 20 nt, Human
auggcugugccucugccugu

SEQ ID NO: 1153354 - RNA, 19 nt, Human
auggcugugccucugccug

SEQ ID NO: 1153355 - RNA, 13 nt, Human
augucuuccugga

SEQ ID NO: 1153356 - RNA, 13 nt, Human
agccguggcuucc

SEQ ID NO: 1153357 - RNA, 17 nt, Human
agccgugccuucagcuc

SEQ ID NO: 1153358 - RNA, 16 nt, Human
agccgugccuucagcu

SEQ ID NO: 1153359 - RNA, 15 nt, Human
agccgugccuucagc

SEQ ID NO: 1153360 - RNA, 21 nt, Human
agcccuccaucuaaacugccc

SEQ ID NO: 1153361 - RNA, 17 nt, Human
agcccucacccuggggc

SEQ ID NO: 1153362 - RNA, 23 nt, Human
agaguggcuccucccggugccca

SEQ ID NO: 1153363 - RNA, 19 nt, Human
agaguggcuccucccggug

SEQ ID NO: 1153364 - RNA, 17 nt, Human
agauggcugugccucug

SEQ ID NO: 1153365 - RNA, 14 nt, Human
agauggcugugccu

SEQ ID NO: 1153366 - RNA, 20 nt, Human
agcuucuguugcugccucau

SEQ ID NO: 1153367 - RNA, 22 nt, Human
aggauguacaaggacagccccu

SEQ ID NO: 1153368 - RNA, 20 nt, Human
aggauuaaauaauguaaaua

SEQ ID NO: 1153369 - RNA, 14 nt, Human
aggauuaaauaaug

SEQ ID NO: 1153370 - RNA, 19 nt, Human
agcuucuguugcugccuca

SEQ ID NO: 1153371 - RNA, 23 nt, Human
agcugagauuauaggcaccuacc

SEQ ID NO: 1153372 - RNA, 18 nt, Human
aggcccuuccucuccacu

SEQ ID NO: 1153373 - RNA, 17 nt, Human
aggcccuuccucuccac

SEQ ID NO: 1153374 - RNA, 15 nt, Human
aggcccuuccucucc

SEQ ID NO: 1153375 - RNA, 13 nt, Human
aggcccuuccucu

SEQ ID NO: 1153376 - RNA, 19 nt, Human
aggcccuuccucuccacug

SEQ ID NO: 1153377 - RNA, 21 nt, Human
aggcgugagccaccgugccug

SEQ ID NO: 1153378 - RNA, 17 nt, Human
agguacaaccuguucug

SEQ ID NO: 1153379 - RNA, 21 nt, Human
agguaaucgaccugccucggc

SEQ ID NO: 1153380 - RNA, 15 nt, Human
aggguccuggggaac

SEQ ID NO: 1153381 - RNA, 12 nt, Human
aggguccugggg

SEQ ID NO: 1153382 - RNA, 23 nt, Human
aggguccuggggaaccugacccc

SEQ ID NO: 1153383 - RNA, 21 nt, Human
aggguccuggggaaccugacc

SEQ ID NO: 1153384 - RNA, 22 nt, Human
acccccugcaaagcccagcuug

SEQ ID NO: 1153385 - RNA, 20 nt, Human
acccccugcaaagcccagcu

SEQ ID NO: 1153386 - RNA, 18 nt, Human
acccccugcaaagcccag

SEQ ID NO: 1153387 - RNA, 17 nt, Human
acccccugcaaagccca

SEQ ID NO: 1153388 - RNA, 14 nt, Human
acccccugcaaagc

SEQ ID NO: 1153389 - RNA, 17 nt, Human
accccucauagcccuca

SEQ ID NO: 1153390 - RNA, 17 nt, Human
acacagauuugagcuca

SEQ ID NO: 1153391 - RNA, 14 nt, Human
acacgcuccuuccu

SEQ ID NO: 1153392 - RNA, 16 nt, Human
acacgcuccuuccucu

SEQ ID NO: 1153393 - RNA, 20 nt, Human
accugcccugcugaguccca

SEQ ID NO: 1153394 - RNA, 23 nt, Human
acugucucaagagggcacuggug

SEQ ID NO: 1153395 - RNA, 21 nt, Human
acugucucaagagggcacugg

SEQ ID NO: 1153396 - RNA, 20 nt, Human
acugucucaagagggcacug

SEQ ID NO: 1153397 - RNA, 18 nt, Human
acugcccccucugcccug

SEQ ID NO: 1153398 - RNA, 17 nt, Human
acugcccccucugcccu

SEQ ID NO: 1153399 - RNA, 16 nt, Human
acugcccccucugccc

SEQ ID NO: 1153400 - RNA, 15 nt, Human
acugcccccucugcc

SEQ ID NO: 1153401 - RNA, 14 nt, Human
acugcccccucugc

SEQ ID NO: 1153402 - RNA, 23 nt, Human
acuuuuauuuccagugaaaucag

SEQ ID NO: 1153403 - RNA, 19 nt, Human
aaggacagccccuccucca

SEQ ID NO: 1153404 - RNA, 13 nt, Human
aaggacagccccu

SEQ ID NO: 1153405 - RNA, 12 nt, Human
aaggcagggagg

SEQ ID NO: 1153406 - RNA, 21 nt, Human
aauauuagugaccucagcuuu

SEQ ID NO: 1153407 - RNA, 19 nt, Human
aaucacauucgaguguuuc

SEQ ID NO: 1153408 - RNA, 23 nt, Human
aaucaaguuggcuucuaaucaaa

SEQ ID NO: 1153409 - RNA, 22 nt, Human
aauguuuacagauccccaagcc

SEQ ID NO: 1153410 - RNA, 23 nt, Human
aaugcuauaacuauguugauaaa

SEQ ID NO: 1153411 - RNA, 22 nt, Human
aaugcgcaggcuggcccugccc

SEQ ID NO: 1153412 - RNA, 14 nt, Human
aaugcgcaggcugg

SEQ ID NO: 1153413 - RNA, 12 nt, Human
aacgcagcccug

SEQ ID NO: 1153414 - RNA, 11 nt, Human
aacgcagcccu

SEQ ID NO: 1153415 - RNA, 16 nt, Human
aacugagugccuuuug

SEQ ID NO: 1153416 - RNA, 14 nt, Human
aaauugcuccuuga

SEQ ID NO: 1153417 - RNA, 13 nt, Human
aaauugcuccuug

SEQ ID NO: 1153418 - RNA, 17 nt, Human
aaauuaaagcugaaaac

SEQ ID NO: 1153419 - RNA, 13 nt, Human
aaauuaaagcuga

SEQ ID NO: 1153420 - RNA, 21 nt, Human
aacccuuggagccaauggaga

SEQ ID NO: 1153421 - RNA, 12 nt, Human
aacccucagagc

SEQ ID NO: 1153422 - RNA, 15 nt, Human
aacccuauugguaaa

SEQ ID NO: 1153423 - RNA, 20 nt, Human
aaagaagguuucagaaagaa

SEQ ID NO: 1153424 - RNA, 16 nt, Human
aaacccuauugguaaa

SEQ ID NO: 1153425 - RNA, 13 nt, Human
aaacccucgaggc

SEQ ID NO: 1153426 - RNA, 24 nt, Human
aaacccucgaggcggaucuuugga

SEQ ID NO: 1153427 - RNA, 19 nt, Human
aaaauaaaauuaaagcuga

SEQ ID NO: 1153428 - RNA, 23 nt, Human
aaagcccuuccaugucgccucug

SEQ ID NO: 1153429 - RNA, 22 nt, Human
aaagcccuuccaugucgccucu

SEQ ID NO: 1153430 - RNA, 19 nt, Human
aaaucaaugcuauaacuau

SEQ ID NO: 1153431 - RNA, 14 nt, Human
caccccuaaagaga

SEQ ID NO: 1153432 - RNA, 15 nt, Human
caccccuaaagagau

SEQ ID NO: 1153433 - RNA, 13 nt, Human
cacauguggacuu

SEQ ID NO: 1153434 - RNA, 22 nt, Human
cacauaauucaggaagcagcuu

SEQ ID NO: 1153435 - RNA, 15 nt, Human
cacaggcccuuccuc

SEQ ID NO: 1153436 - RNA, 16 nt, Human
cacagcagccccugca

SEQ ID NO: 1153437 - RNA, 20 nt, Human
cacagcacgggggccaagga

SEQ ID NO: 1153438 - RNA, 22 nt, Human
cacacuucaggcucuucuccuu

SEQ ID NO: 1153439 - RNA, 21 nt, Human
cacacuucaggcucuucuccu

SEQ ID NO: 1153440 - RNA, 20 nt, Human
cacacuucaggcucuucucc

SEQ ID NO: 1153441 - RNA, 18 nt, Human
cacacuucaggcucuucu

SEQ ID NO: 1153442 - RNA, 17 nt, Human
cacacuucaggcucuuc

SEQ ID NO: 1153443 - RNA, 14 nt, Human
cacacuucaggcuc

SEQ ID NO: 1153444 - RNA, 14 nt, Human
cacacccuguuuua

SEQ ID NO: 1153445 - RNA, 23 nt, Human
cacaaccuucuguggcucacaga

SEQ ID NO: 1153446 - RNA, 19 nt, Human
cacaaccuucuguggcuca

SEQ ID NO: 1153447 - RNA, 18 nt, Human
cacaaccuucuguggcuc

SEQ ID NO: 1153448 - RNA, 17 nt, Human
cacaaccuucuguggcu

SEQ ID NO: 1153449 - RNA, 22 nt, Human
cacaacacacagauuugagcuc

SEQ ID NO: 1153450 - RNA, 18 nt, Human
cacaaagcccuuccaugu

SEQ ID NO: 1153451 - RNA, 22 nt, Human
caagugauucucaugccucagc

SEQ ID NO: 1153452 - RNA, 19 nt, Human
caaggaugccccguccccc

SEQ ID NO: 1153453 - RNA, 14 nt, Human
caaggacuaggguc

SEQ ID NO: 1153454 - RNA, 17 nt, Human
caagccguggcuucccg

SEQ ID NO: 1153455 - RNA, 16 nt, Human
caagccguggcuuccc

SEQ ID NO: 1153456 - RNA, 15 nt, Human
caagccguggcuucc

SEQ ID NO: 1153457 - RNA, 14 nt, Human
caagccguggcuuc

SEQ ID NO: 1153458 - RNA, 18 nt, Human
caacgcagcccugcuuug

SEQ ID NO: 1153459 - RNA, 15 nt, Human
caacgcagcccugcu

SEQ ID NO: 1153460 - RNA, 13 nt, Human
caacgcagcccug

SEQ ID NO: 1153461 - RNA, 12 nt, Human
caacgcagcccu

SEQ ID NO: 1153462 - RNA, 21 nt, Human
caacccucagagccaccccua

SEQ ID NO: 1153463 - RNA, 14 nt, Human
caaauguggcuccu

SEQ ID NO: 1153464 - RNA, 18 nt, Human
caaaugucuuccuggauu

SEQ ID NO: 1153465 - RNA, 16 nt, Human
uuuguaugcacuuugu

SEQ ID NO: 1153466 - RNA, 23 nt, Human
uuucugaucugaugcaagcaaga

SEQ ID NO: 1153467 - RNA, 22 nt, Human
uuuccucuuagucgagccaagu

SEQ ID NO: 1153468 - RNA, 13 nt, Human
uuuacagcugccu

SEQ ID NO: 1153469 - RNA, 15 nt, Human
uuguuuuacugucuu

SEQ ID NO: 1153470 - RNA, 18 nt, Human
uugucugaagucacugca

SEQ ID NO: 1153471 - RNA, 20 nt, Human
uugucugaagucacugcaca

SEQ ID NO: 1153472 - RNA, 17 nt, Human
uugucugaagucacugc

SEQ ID NO: 1153473 - RNA, 20 nt, Human
uuguaugauccuaaugaaug

SEQ ID NO: 1153474 - RNA, 22 nt, Human
uuguaugaaagauggcugugcc

SEQ ID NO: 1153475 - RNA, 16 nt, Human
uuggacagaagcagcu

SEQ ID NO: 1153476 - RNA, 19 nt, Human
uuggacagaagcagcucuu

SEQ ID NO: 1153477 - RNA, 22 nt, Human
uugauauuuucaacgcagcccu

SEQ ID NO: 1153478 - RNA, 13 nt, Human
uugagcucagccc

SEQ ID NO: 1153479 - RNA, 17 nt, Human
uucuuauguugcccagu

SEQ ID NO: 1153480 - RNA, 18 nt, Human
uuccugcauuugugaaau

SEQ ID NO: 1153481 - RNA, 16 nt, Human
uuccugcauuugugaa

SEQ ID NO: 1153482 - RNA, 19 nt, Human
uucccccuccaaucccacc

SEQ ID NO: 1153483 - RNA, 19 nt, Human
uuccccaugucucgacuca

SEQ ID NO: 1153484 - RNA, 11 nt, Human
uuccccauggg

SEQ ID NO: 1153485 - RNA, 14 nt, Human
uucccauucuugca

SEQ ID NO: 1153486 - RNA, 23 nt, Human
uuccagcaauucuccugccucag

SEQ ID NO: 1153487 - RNA, 22 nt, Human
uuccagcaauucuccugccuca

SEQ ID NO: 1153488 - RNA, 21 nt, Human
uuccagcaauucuccugccuc

SEQ ID NO: 1153489 - RNA, 20 nt, Human
uuccagcaauucuccugccu

SEQ ID NO: 1153490 - RNA, 21 nt, Human
uuccagagaguggcuccuccc

SEQ ID NO: 1153491 - RNA, 20 nt, Human
uuccagagaguggcuccucc

SEQ ID NO: 1153492 - RNA, 19 nt, Human
uuccagagaguggcuccuc

SEQ ID NO: 1153493 - RNA, 18 nt, Human
uuccagagaguggcuccu

SEQ ID NO: 1153494 - RNA, 17 nt, Human
uuccagagaguggcucc

SEQ ID NO: 1153495 - RNA, 17 nt, Human
uucaacugaccagccuc

SEQ ID NO: 1153496 - RNA, 20 nt, Human
uucaacgcagcccugcuuug

SEQ ID NO: 1153497 - RNA, 19 nt, Human
uucaacgcagcccugcuuu

SEQ ID NO: 1153498 - RNA, 16 nt, Human
uucaacgcagcccugc

SEQ ID NO: 1153499 - RNA, 12 nt, Human
uuagcugggaga

SEQ ID NO: 1153500 - RNA, 21 nt, Human
uuacuaucaugucaaacguga

SEQ ID NO: 1153501 - RNA, 19 nt, Human
uuacuaucaugucaaacgu

SEQ ID NO: 1153502 - RNA, 16 nt, Human
uuaagccuuuggaaac

SEQ ID NO: 1153503 - RNA, 15 nt, Human
uuaagccuuuggaaa

SEQ ID NO: 1153504 - RNA, 19 nt, Human
uguuuuuuuuuuccacuua

SEQ ID NO: 1153505 - RNA, 18 nt, Human
uguuuuuuuuuuccacuu

SEQ ID NO: 1153506 - RNA, 17 nt, Human
uguuuuguuuggagaca

SEQ ID NO: 1153507 - RNA, 19 nt, Human
uggucacaggacucugccu

SEQ ID NO: 1153508 - RNA, 20 nt, Human
uggucacaggacucugccuc

SEQ ID NO: 1153509 - RNA, 18 nt, Human
uggucacaggacucugcc

SEQ ID NO: 1153510 - RNA, 22 nt, Human
uggggguucuuucuuccucugc

SEQ ID NO: 1153511 - RNA, 20 nt, Human
uggggguucuuucuuccucu

SEQ ID NO: 1153512 - RNA, 19 nt, Human
uggggguucuuucuuccuc

SEQ ID NO: 1153513 - RNA, 15 nt, Human
uggggguucuuucuu

SEQ ID NO: 1153514 - RNA, 12 nt, Human
ugggccuucagg

SEQ ID NO: 1153515 - RNA, 15 nt, Human
ugggccuucagggag

SEQ ID NO: 1153516 - RNA, 11 nt, Human
ugggccuucag

SEQ ID NO: 1153517 - RNA, 18 nt, Human
ugggauuacaggcuccug

SEQ ID NO: 1153518 - RNA, 17 nt, Human
ugggauuacaggcguga

SEQ ID NO: 1153519 - RNA, 19 nt, Human
uggcuccucccggugccca

SEQ ID NO: 1153520 - RNA, 18 nt, Human
uggcuccucccggugccc

SEQ ID NO: 1153521 - RNA, 16 nt, Human
uggcuccucccggugc

SEQ ID NO: 1153522 - RNA, 14 nt, Human
uggcuccucccggu

SEQ ID NO: 1153523 - RNA, 20 nt, Human
uggcucccacaggcccuucc

SEQ ID NO: 1153524 - RNA, 17 nt, Human
uggcucccacaggcccu

SEQ ID NO: 1153525 - RNA, 14 nt, Human
uggcucccacaggc

SEQ ID NO: 1153526 - RNA, 20 nt, Human
uggccaggcugcucuugaac

SEQ ID NO: 1153527 - RNA, 17 nt, Human
uggccaggcugcucuug

SEQ ID NO: 1153528 - RNA, 16 nt, Human
uggccaggcugcucuu

SEQ ID NO: 1153529 - RNA, 12 nt, Human
uggcagaggagg

SEQ ID NO: 1153530 - RNA, 17 nt, Human
uggagacugucucaaga

SEQ ID NO: 1153531 - RNA, 14 nt, Human
uggagacugucuca

SEQ ID NO: 1153532 - RNA, 14 nt, Human
uggacuccucuguc

SEQ ID NO: 1153533 - RNA, 13 nt, Human
uggacuccucugu

SEQ ID NO: 1153534 - RNA, 21 nt, Human
uggagaagcucccugaaguaa

SEQ ID NO: 1153535 - RNA, 14 nt, Human
ugcucuccucuugc

SEQ ID NO: 1153536 - RNA, 12 nt, Human
ugcucuccucuu

SEQ ID NO: 1153537 - RNA, 22 nt, Human
ugcuaagacucaguggggaggg

SEQ ID NO: 1153538 - RNA, 23 nt, Human
ugcgcaggcuggcccugcccugg

SEQ ID NO: 1153539 - RNA, 22 nt, Human
ugcgcaggcuggcccugcccug

SEQ ID NO: 1153540 - RNA, 21 nt, Human
ugcgcaggcuggcccugcccu

SEQ ID NO: 1153541 - RNA, 16 nt, Human
ugccuccucuucaacu

SEQ ID NO: 1153542 - RNA, 14 nt, Human
ugccuccucuucaa

SEQ ID NO: 1153543 - RNA, 23 nt, Human
ugcccugguuuccugcccuggga

SEQ ID NO: 1153544 - RNA, 20 nt, Human
ugcccugguuuccugcccug

SEQ ID NO: 1153545 - RNA, 19 nt, Human
ugcccugguuuccugcccu

SEQ ID NO: 1153546 - RNA, 18 nt, Human
ugcccugguuuccugccc

SEQ ID NO: 1153547 - RNA, 17 nt, Human
ugcccugguuuccugcc

SEQ ID NO: 1153548 - RNA, 18 nt, Human
ugcccuggugcugccaca

SEQ ID NO: 1153549 - RNA, 17 nt, Human
ugcccuggugcugccac

SEQ ID NO: 1153550 - RNA, 16 nt, Human
ugcccuggugcugcca

SEQ ID NO: 1153551 - RNA, 14 nt, Human
ugcccuggugcugc

SEQ ID NO: 1153552 - RNA, 12 nt, Human
ugcccuggugcu

SEQ ID NO: 1153553 - RNA, 18 nt, Human
ugcccugggaggcaguga

SEQ ID NO: 1153554 - RNA, 17 nt, Human
ugcccugggaggcagug

SEQ ID NO: 1153555 - RNA, 15 nt, Human
ugcccugggaggcag

SEQ ID NO: 1153556 - RNA, 13 nt, Human
ugcccugggaggc

SEQ ID NO: 1153557 - RNA, 20 nt, Human
ugccccuccucucugcccua

SEQ ID NO: 1153558 - RNA, 19 nt, Human
ugccccuccucucugcccu

SEQ ID NO: 1153559 - RNA, 18 nt, Human
ugccccuccucucugccc

SEQ ID NO: 1153560 - RNA, 17 nt, Human
ugccccuccucucugcc

SEQ ID NO: 1153561 - RNA, 16 nt, Human
ugccccucccuucaac

SEQ ID NO: 1153562 - RNA, 15 nt, Human
ugccccucccuucaa

SEQ ID NO: 1153563 - RNA, 20 nt, Human
ugauuggcaggaguuggaag

SEQ ID NO: 1153564 - RNA, 12 nt, Human
ugauucacagug

SEQ ID NO: 1153565 - RNA, 19 nt, Human
ugaugucccaacuuguaaa

SEQ ID NO: 1153566 - RNA, 14 nt, Human
ugaugguuccccug

SEQ ID NO: 1153567 - RNA, 21 nt, Human
ugaugccugugaacugaacuc

SEQ ID NO: 1153568 - RNA, 20 nt, Human
ugaugccugugaacugaacu

SEQ ID NO: 1153569 - RNA, 15 nt, Human
ugaugccugugaacu

SEQ ID NO: 1153570 - RNA, 15 nt, Human
ugaucugugggcaca

SEQ ID NO: 1153571 - RNA, 23 nt, Human
ugaguuugggccccagaggcugg

SEQ ID NO: 1153572 - RNA, 22 nt, Human
ugaguuugggccccagaggcug

SEQ ID NO: 1153573 - RNA, 19 nt, Human
ugagucccaggcugagccu

SEQ ID NO: 1153574 - RNA, 15 nt, Human
ugagucccaggcuga

SEQ ID NO: 1153575 - RNA, 23 nt, Human
ugaggcaucgcaauguaagacuc

SEQ ID NO: 1153576 - RNA, 14 nt, Human
ugagccucagucuc

SEQ ID NO: 1153577 - RNA, 18 nt, Human
ugagcccuguccugccua

SEQ ID NO: 1153578 - RNA, 22 nt, Human
ugaccucagcuuugauauuuca

SEQ ID NO: 1153579 - RNA, 16 nt, Human
ugacagacagcccucc

SEQ ID NO: 1153580 - RNA, 15 nt, Human
ugaauaaagacaccu

SEQ ID NO: 1153581 - RNA, 14 nt, Human
ugaauaaagacacc

SEQ ID NO: 1153582 - RNA, 20 nt, Human
ugaaggagagcccuucauuu

SEQ ID NO: 1153583 - RNA, 16 nt, Human
ugaaggagagcccuuc

SEQ ID NO: 1153584 - RNA, 20 nt, Human
ugaaggaauaaauugcuccu

SEQ ID NO: 1153585 - RNA, 16 nt, Human
ugaacucugacaacag

SEQ ID NO: 1153586 - RNA, 17 nt, Human
ugaaaucaguuacucuu

SEQ ID NO: 1153587 - RNA, 16 nt, Human
ugaaaucaguuacucu

SEQ ID NO: 1153588 - RNA, 18 nt, Human
ugaaagauggcugugccu

SEQ ID NO: 1153589 - RNA, 19 nt, Human
ugaaagauggcugugccuc

SEQ ID NO: 1153590 - RNA, 19 nt, Human
ucuuuggacagaagcagcu

SEQ ID NO: 1153591 - RNA, 21 nt, Human
ucuuuggacagaagcagcucu

SEQ ID NO: 1153592 - RNA, 22 nt, Human
ucuuuggacagaagcagcucuu

SEQ ID NO: 1153593 - RNA, 17 nt, Human
ucuccucuugccacugc

SEQ ID NO: 1153594 - RNA, 22 nt, Human
ucuccucuugccacugccucuu

SEQ ID NO: 1153595 - RNA, 16 nt, Human
ucuccucuugccacug

SEQ ID NO: 1153596 - RNA, 13 nt, Human
ucuccucuugcca

SEQ ID NO: 1153597 - RNA, 14 nt, Human
ucucccucccuugg

SEQ ID NO: 1153598 - RNA, 14 nt, Human
ucuccacugccuuc

SEQ ID NO: 1153599 - RNA, 13 nt, Human
ucuccacuccaga

SEQ ID NO: 1153600 - RNA, 20 nt, Human
ucucaugccucagccuccug

SEQ ID NO: 1153601 - RNA, 19 nt, Human
ucucaugccucagccuccu

SEQ ID NO: 1153602 - RNA, 16 nt, Human
ucucaugccucagccu

SEQ ID NO: 1153603 - RNA, 13 nt, Human
ucucaugccucag

SEQ ID NO: 1153604 - RNA, 14 nt, Human
ucuaucaccaagga

SEQ ID NO: 1153605 - RNA, 16 nt, Human
ucguguccccuauccu

SEQ ID NO: 1153606 - RNA, 19 nt, Human
uccugccuaaggcugaacu

SEQ ID NO: 1153607 - RNA, 16 nt, Human
uccugccuaaggcuga

SEQ ID NO: 1153608 - RNA, 21 nt, Human
uccugcccugggaggcaguga

SEQ ID NO: 1153609 - RNA, 15 nt, Human
uccugcccugggagg

SEQ ID NO: 1153610 - RNA, 14 nt, Human
uccugcccugggag

SEQ ID NO: 1153611 - RNA, 12 nt, Human
uccugcccuggg

SEQ ID NO: 1153612 - RNA, 11 nt, Human
uccugcccugg

SEQ ID NO: 1153613 - RNA, 10 nt, Human
uccugcccug

SEQ ID NO: 1153614 - RNA, 16 nt, Human
uccugccaccacgccc

SEQ ID NO: 1153615 - RNA, 11 nt, Human
uccugccacca

SEQ ID NO: 1153616 - RNA, 16 nt, Human
uccugcauuugugaaa

SEQ ID NO: 1153617 - RNA, 17 nt, Human
uccuaucagaaguuucu

SEQ ID NO: 1153618 - RNA, 16 nt, Human
ucccaggcgccccuuc

SEQ ID NO: 1153619 - RNA, 18 nt, Human
ucccaggcgccccuuccc

SEQ ID NO: 1153620 - RNA, 15 nt, Human
uccaugcugccucca

SEQ ID NO: 1153621 - RNA, 14 nt, Human
uccaugcugccucc

SEQ ID NO: 1153622 - RNA, 14 nt, Human
uccaucaggccacu

SEQ ID NO: 1153623 - RNA, 21 nt, Human
uccauaaucuggacuccucug

SEQ ID NO: 1153624 - RNA, 22 nt, Human
uccauaaucuggacuccucugu

SEQ ID NO: 1153625 - RNA, 22 nt, Human
uccagcaauucuccugccucag

SEQ ID NO: 1153626 - RNA, 19 nt, Human
uccaaacuaccuuccaguu

SEQ ID NO: 1153627 - RNA, 16 nt, Human
ucagucucccucccuu

SEQ ID NO: 1153628 - RNA, 12 nt, Human
ucaggucccugc

SEQ ID NO: 1153629 - RNA, 21 nt, Human
ucaggcucuucuccuuucaca

SEQ ID NO: 1153630 - RNA, 16 nt, Human
ucaggcucuucuccuu

SEQ ID NO: 1153631 - RNA, 20 nt, Human
ucaggaucaaaccccgacca

SEQ ID NO: 1153632 - RNA, 20 nt, Human
ucacccuggggcuaggaaau

SEQ ID NO: 1153633 - RNA, 19 nt, Human
ucacaggagggagggggaa

SEQ ID NO: 1153634 - RNA, 23 nt, Human
ucacaggacucugccuccucuuc

SEQ ID NO: 1153635 - RNA, 19 nt, Human
ucacaggacucugccuccu

SEQ ID NO: 1153636 - RNA, 18 nt, Human
ucacaggacucugccucc

SEQ ID NO: 1153637 - RNA, 17 nt, Human
ucacaggacucugccuc

SEQ ID NO: 1153638 - RNA, 24 nt, Human
ucaacugaccagccuccaugcugc

SEQ ID NO: 1153639 - RNA, 18 nt, Human
ucaacugaccagccucca

SEQ ID NO: 1153640 - RNA, 22 nt, Human
ucaacucccugccccccagccc

SEQ ID NO: 1153641 - RNA, 21 nt, Human
ucaacucccugccccccagcc

SEQ ID NO: 1153642 - RNA, 15 nt, Human
ucaacucccugcccc

SEQ ID NO: 1153643 - RNA, 14 nt, Human
ucaacucccugccc

SEQ ID NO: 1153644 - RNA, 23 nt, Human
ucaaaccccgaccaccugcccaa

SEQ ID NO: 1153645 - RNA, 20 nt, Human
ucaaaccccgaccaccugcc

SEQ ID NO: 1153646 - RNA, 19 nt, Human
ucaaaccccgaccaccugc

SEQ ID NO: 1153647 - RNA, 17 nt, Human
uauguugaagccuuugu

SEQ ID NO: 1153648 - RNA, 18 nt, Human
uaugcagagguccacaac

SEQ ID NO: 1153649 - RNA, 18 nt, Human
uaugauuuggaaaauaaa

SEQ ID NO: 1153650 - RNA, 17 nt, Human
uaugauuuggaaaauaa

SEQ ID NO: 1153651 - RNA, 15 nt, Human
uaugauuuggaaaau

SEQ ID NO: 1153652 - RNA, 19 nt, Human
uaugaccacacuccagcug

SEQ ID NO: 1153653 - RNA, 14 nt, Human
uaugaccacacucc

SEQ ID NO: 1153654 - RNA, 18 nt, Human
uaugaauaaagacaccua

SEQ ID NO: 1153655 - RNA, 21 nt, Human
uaggugauccacucgccuuca

SEQ ID NO: 1153656 - RNA, 20 nt, Human
uagguauaaguggugugugu

SEQ ID NO: 1153657 - RNA, 17 nt, Human
uaggccguuccuucaaa

SEQ ID NO: 1153658 - RNA, 21 nt, Human
guggccacuccagaccccugg

SEQ ID NO: 1153659 - RNA, 18 nt, Human
guggagaggcccggccuc

SEQ ID NO: 1153660 - RNA, 13 nt, Human
guggacuuuuauu

SEQ ID NO: 1153661 - RNA, 18 nt, Human
gugcuuauguaugaggua

SEQ ID NO: 1153662 - RNA, 21 nt, Human
gugcugccacacuucaggcuc

SEQ ID NO: 1153663 - RNA, 12 nt, Human
gugcugccacac

SEQ ID NO: 1153664 - RNA, 18 nt, Human
gugcaugcagcaucuaag

SEQ ID NO: 1153665 - RNA, 18 nt, Human
gugcaucucagcccacau

SEQ ID NO: 1153666 - RNA, 15 nt, Human
gugcaucucagccca

SEQ ID NO: 1153667 - RNA, 22 nt, Human
gugcaaaguucccuacuuccug

SEQ ID NO: 1153668 - RNA, 20 nt, Human
gugauucucaugccucagcc

SEQ ID NO: 1153669 - RNA, 23 nt, Human
gugaggauuaaauaauguaaaua

SEQ ID NO: 1153670 - RNA, 22 nt, Human
gugagccaccgugccuggccac

SEQ ID NO: 1153671 - RNA, 21 nt, Human
gugagccaccgugccuggcca

SEQ ID NO: 1153672 - RNA, 17 nt, Human
gugagccaccgugccug

SEQ ID NO: 1153673 - RNA, 15 nt, Human
gugagccaccgugcc

SEQ ID NO: 1153674 - RNA, 16 nt, Human
gugagccaccacgccc

SEQ ID NO: 1153675 - RNA, 15 nt, Human
gugagccaccacgcc

SEQ ID NO: 1153676 - RNA, 16 nt, Human
gugaccucagcuuuga

SEQ ID NO: 1153677 - RNA, 14 nt, Human
gugaaucagagcac

SEQ ID NO: 1153678 - RNA, 16 nt, Human
gugaaaaugugugugu

SEQ ID NO: 1153679 - RNA, 17 nt, Human
gucucuucuccacugga

SEQ ID NO: 1153680 - RNA, 16 nt, Human
gucucuucuccacugg

SEQ ID NO: 1153681 - RNA, 15 nt, Human
gucucuucuccacug

SEQ ID NO: 1153682 - RNA, 14 nt, Human
gucucuucuccacu

SEQ ID NO: 1153683 - RNA, 20 nt, Human
guccuggggaaccugacccc

SEQ ID NO: 1153684 - RNA, 19 nt, Human
guccuggggaaccugaccc

SEQ ID NO: 1153685 - RNA, 16 nt, Human
gucaucucagcuggau

SEQ ID NO: 1153686 - RNA, 19 nt, Human
guauuuauuuaguauuuau

SEQ ID NO: 1153687 - RNA, 18 nt, Human
guaaugaugucguuugaa

SEQ ID NO: 1153688 - RNA, 15 nt, Human
guaaucguguccccu

SEQ ID NO: 1153689 - RNA, 14 nt, Human
guaaaaauaaaauu

SEQ ID NO: 1153690 - RNA, 13 nt, Human
guaaaaauaaaau

SEQ ID NO: 1153691 - RNA, 18 nt, Human
gguucuuucuuccucugc

SEQ ID NO: 1153692 - RNA, 20 nt, Human
gguggcccgacagccuggca

SEQ ID NO: 1153693 - RNA, 19 nt, Human
gguggcccgacagccuggc

SEQ ID NO: 1153694 - RNA, 18 nt, Human
gguggcccgacagccugg

SEQ ID NO: 1153695 - RNA, 17 nt, Human
gguggcccgacagccug

SEQ ID NO: 1153696 - RNA, 16 nt, Human
gguggcccgacagccu

SEQ ID NO: 1153697 - RNA, 22 nt, Human
ggugauagguauaaguggugug

SEQ ID NO: 1153698 - RNA, 20 nt, Human
ggucucgaacuccugaccuu

SEQ ID NO: 1153699 - RNA, 19 nt, Human
ggucucgaacuccugaccu

SEQ ID NO: 1153700 - RNA, 20 nt, Human
ggguuucaccauguuggcca

SEQ ID NO: 1153701 - RNA, 14 nt, Human
ggguucuuucuucc

SEQ ID NO: 1153702 - RNA, 16 nt, Human
ggguucuuucuuccuc

SEQ ID NO: 1153703 - RNA, 22 nt, Human
ggguuccagcaauucuccugcc

SEQ ID NO: 1153704 - RNA, 22 nt, Human
gggguucuuucuuccucugcug

SEQ ID NO: 1153705 - RNA, 20 nt, Human
gggguucuuucuuccucugc

SEQ ID NO: 1153706 - RNA, 22 nt, Human
gggccuggcagccgugccuuca

SEQ ID NO: 1153707 - RNA, 10 nt, Human
gggccuggca

SEQ ID NO: 1153708 - RNA, 21 nt, Human
ggcucccacaggcccuuccuc

SEQ ID NO: 1153709 - RNA, 20 nt, Human
ggcucccacaggcccuuccu

SEQ ID NO: 1153710 - RNA, 19 nt, Human
ggcucccacaggcccuucc

SEQ ID NO: 1153711 - RNA, 18 nt, Human
ggcucccacaggcccuuc

SEQ ID NO: 1153712 - RNA, 17 nt, Human
ggcucccacaggcccuu

SEQ ID NO: 1153713 - RNA, 12 nt, Human
ggcuccagcugg

SEQ ID NO: 1153714 - RNA, 19 nt, Human
ggcuaugggggcacugagg

SEQ ID NO: 1153715 - RNA, 22 nt, Human
ggccucggacuuagcugggaga

SEQ ID NO: 1153716 - RNA, 20 nt, Human
ggccucggacuuagcuggga

SEQ ID NO: 1153717 - RNA, 22 nt, Human
ggcccuggcucccacaggcccu

SEQ ID NO: 1153718 - RNA, 13 nt, Human
ggcccuggcuccc

SEQ ID NO: 1153719 - RNA, 22 nt, Human
ggcccugcccugguuuccugcc

SEQ ID NO: 1153720 - RNA, 20 nt, Human
ggcccugcccugguuuccug

SEQ ID NO: 1153721 - RNA, 13 nt, Human
ggcccugcccugg

SEQ ID NO: 1153722 - RNA, 12 nt, Human
ggcccugcccug

SEQ ID NO: 1153723 - RNA, 11 nt, Human
ggcccugcccu

SEQ ID NO: 1153724 - RNA, 16 nt, Human
ggccaggcugcucuug

SEQ ID NO: 1153725 - RNA, 15 nt, Human
ggccaggcugcucuu

SEQ ID NO: 1153726 - RNA, 14 nt, Human
ggccaggcugcucu

SEQ ID NO: 1153727 - RNA, 11 nt, Human
ggccaggcugc

SEQ ID NO: 1153728 - RNA, 17 nt, Human
ggccacuccagaccccu

SEQ ID NO: 1153729 - RNA, 18 nt, Human
ggcauggccagguggcca

SEQ ID NO: 1153730 - RNA, 17 nt, Human
ggcauggccagguggcc

SEQ ID NO: 1153731 - RNA, 18 nt, Human
ggcaccggggccucggac

SEQ ID NO: 1153732 - RNA, 19 nt, Human
ggauuacaggcuccugcca

SEQ ID NO: 1153733 - RNA, 22 nt, Human
ggaucaaaccccgaccaccugc

SEQ ID NO: 1153734 - RNA, 18 nt, Human
ggacuggccucugcugau

SEQ ID NO: 1153735 - RNA, 17 nt, Human
ggaaggcugagaggaga

SEQ ID NO: 1153736 - RNA, 14 nt, Human
ggaaggcagggagg

SEQ ID NO: 1153737 - RNA, 13 nt, Human
ggaaccugacccc

SEQ ID NO: 1153738 - RNA, 21 nt, Human
ggaaaaccaagccguggcuuc

SEQ ID NO: 1153739 - RNA, 23 nt, Human
gcuuuucacugcuggcugccuua

SEQ ID NO: 1153740 - RNA, 22 nt, Human
gcuuuucacugcuggcugccuu

SEQ ID NO: 1153741 - RNA, 18 nt, Human
gcuuuucacugcuggcug

SEQ ID NO: 1153742 - RNA, 14 nt, Human
gcuuuucacugcug

SEQ ID NO: 1153743 - RNA, 13 nt, Human
gcuuuucacugcu

SEQ ID NO: 1153744 - RNA, 15 nt, Human
gcuuuguaugcacuu

SEQ ID NO: 1153745 - RNA, 22 nt, Human
gcugugggcgugagaccugccc

SEQ ID NO: 1153746 - RNA, 21 nt, Human
gcugugggcgugagaccugcc

SEQ ID NO: 1153747 - RNA, 20 nt, Human
gcugugggcgugagaccugc

SEQ ID NO: 1153748 - RNA, 22 nt, Human
gcugagucccaggcugagccuc

SEQ ID NO: 1153749 - RNA, 21 nt, Human
gcugagucccaggcugagccu

SEQ ID NO: 1153750 - RNA, 21 nt, Human
gcugacuguacuccucccagg

SEQ ID NO: 1153751 - RNA, 19 nt, Human
gcugacuguacuccuccca

SEQ ID NO: 1153752 - RNA, 18 nt, Human
gcugacuguacuccuccc

SEQ ID NO: 1153753 - RNA, 17 nt, Human
gcugacagacagcccuc

SEQ ID NO: 1153754 - RNA, 23 nt, Human
gcucuucuccuuucacaaccuuc

SEQ ID NO: 1153755 - RNA, 21 nt, Human
gcucuucuccuuucacaaccu

SEQ ID NO: 1153756 - RNA, 17 nt, Human
gcucuucuccuuucaca

SEQ ID NO: 1153757 - RNA, 13 nt, Human
gcucuucuccuuu

SEQ ID NO: 1153758 - RNA, 22 nt, Human
gcucuccucuugccacugccuc

SEQ ID NO: 1153759 - RNA, 19 nt, Human
gcucuccucuugccacugc

SEQ ID NO: 1153760 - RNA, 15 nt, Human
gcucuccucuugcca

SEQ ID NO: 1153761 - RNA, 14 nt, Human
gcuccaucuccacu

SEQ ID NO: 1153762 - RNA, 23 nt, Human
gcuccagcuggccgggagccuga

SEQ ID NO: 1153763 - RNA, 17 nt, Human
gcuccagcuggccggga

SEQ ID NO: 1153764 - RNA, 16 nt, Human
gcuccaaaugcagcuu

SEQ ID NO: 1153765 - RNA, 19 nt, Human
gcuccaaacccucgaggcg

SEQ ID NO: 1153766 - RNA, 16 nt, Human
gcuccaaacccucgag

SEQ ID NO: 1153767 - RNA, 17 nt, Human
gcuccaaacccucgagg

SEQ ID NO: 1153768 - RNA, 18 nt, Human
gcuccaaacccucgaggc

SEQ ID NO: 1153769 - RNA, 15 nt, Human
gcgugagaccugccc

SEQ ID NO: 1153770 - RNA, 17 nt, Human
gccugugaacugaacuc

SEQ ID NO: 1153771 - RNA, 13 nt, Human
gccuggccacgcc

SEQ ID NO: 1153772 - RNA, 19 nt, Human
gccucugcugauccuccca

SEQ ID NO: 1153773 - RNA, 18 nt, Human
gccucugcugauccuccc

SEQ ID NO: 1153774 - RNA, 13 nt, Human
gccucugccuguc

SEQ ID NO: 1153775 - RNA, 12 nt, Human
gccucugccugu

SEQ ID NO: 1153776 - RNA, 21 nt, Human
gccucggacuuagcugggaga

SEQ ID NO: 1153777 - RNA, 20 nt, Human
gccucggacuuagcugggag

SEQ ID NO: 1153778 - RNA, 18 nt, Human
gccucagucucccucccu

SEQ ID NO: 1153779 - RNA, 15 nt, Human
gccucagucucccuc

SEQ ID NO: 1153780 - RNA, 14 nt, Human
gccucagccucccg

SEQ ID NO: 1153781 - RNA, 16 nt, Human
gccuaaggcugaacuu

SEQ ID NO: 1153782 - RNA, 20 nt, Human
gcccuuccucuccacugccu

SEQ ID NO: 1153783 - RNA, 21 nt, Human
gcccuuccucuccacugccuu

SEQ ID NO: 1153784 - RNA, 19 nt, Human
gcccuuccucuccacugcc

SEQ ID NO: 1153785 - RNA, 18 nt, Human
gcccuuccucuccacugc

SEQ ID NO: 1153786 - RNA, 17 nt, Human
gcccuuccucuccacug

SEQ ID NO: 1153787 - RNA, 23 nt, Human
gcccugguuuccugcccugggag

SEQ ID NO: 1153788 - RNA, 21 nt, Human
gcccugguuuccugcccuggg

SEQ ID NO: 1153789 - RNA, 20 nt, Human
gcccugguuuccugcccugg

SEQ ID NO: 1153790 - RNA, 19 nt, Human
gcccugguuuccugcccug

SEQ ID NO: 1153791 - RNA, 18 nt, Human
gcccugguuuccugcccu

SEQ ID NO: 1153792 - RNA, 17 nt, Human
gcccugguuuccugccc

SEQ ID NO: 1153793 - RNA, 15 nt, Human
gcccugguuuccugc

SEQ ID NO: 1153794 - RNA, 14 nt, Human
gcccugguuuccug

SEQ ID NO: 1153795 - RNA, 21 nt, Human
gcccuggugcugccacacuuc

SEQ ID NO: 1153796 - RNA, 17 nt, Human
gcccuggugcugccaca

SEQ ID NO: 1153797 - RNA, 16 nt, Human
gcccuggugcugccac

SEQ ID NO: 1153798 - RNA, 15 nt, Human
gcccuggugcugcca

SEQ ID NO: 1153799 - RNA, 16 nt, Human
gcccugggaggcagug

SEQ ID NO: 1153800 - RNA, 14 nt, Human
gcccugggaggcag

SEQ ID NO: 1153801 - RNA, 11 nt, Human
gcccugggagg

SEQ ID NO: 1153802 - RNA, 20 nt, Human
gcccuggcucccacaggccc

SEQ ID NO: 1153803 - RNA, 19 nt, Human
gcccuggcucccacaggcc

SEQ ID NO: 1153804 - RNA, 15 nt, Human
gcccuggcucccaca

SEQ ID NO: 1153805 - RNA, 23 nt, Human
gcccugcuuugggcugcccuggu

SEQ ID NO: 1153806 - RNA, 22 nt, Human
gcccugcuuugggcugcccugg

SEQ ID NO: 1153807 - RNA, 21 nt, Human
gcccugcuuugggcugcccug

SEQ ID NO: 1153808 - RNA, 20 nt, Human
gcccugcuuugggcugcccu

SEQ ID NO: 1153809 - RNA, 19 nt, Human
gcccgacagccuggcacag

SEQ ID NO: 1153810 - RNA, 17 nt, Human
gcccgacagccuggcac

SEQ ID NO: 1153811 - RNA, 17 nt, Human
gccccuucccccuccaa

SEQ ID NO: 1153812 - RNA, 12 nt, Human
gccccuuccccc

SEQ ID NO: 1153813 - RNA, 19 nt, Human
gccccuccucucugcccua

SEQ ID NO: 1153814 - RNA, 18 nt, Human
gccccuccucucugcccu

SEQ ID NO: 1153815 - RNA, 15 nt, Human
gccccucccuucaac

SEQ ID NO: 1153816 - RNA, 14 nt, Human
gccccucccuucaa

SEQ ID NO: 1153817 - RNA, 12 nt, Human
gccccucccuuc

SEQ ID NO: 1153818 - RNA, 19 nt, Human
gcacugguggcccgacagc

SEQ ID NO: 1153819 - RNA, 14 nt, Human
gcacugguggcccg

SEQ ID NO: 1153820 - RNA, 20 nt, Human
gcacugcugcccagccucca

SEQ ID NO: 1153821 - RNA, 18 nt, Human
gcacugcugcccagccuc

SEQ ID NO: 1153822 - RNA, 15 nt, Human
gcacugcugcccagc

SEQ ID NO: 1153823 - RNA, 14 nt, Human
gcacugcugcccag

SEQ ID NO: 1153824 - RNA, 19 nt, Human
gcacagugcaucucagccc

SEQ ID NO: 1153825 - RNA, 18 nt, Human
gcacagugcaucucagcc

SEQ ID NO: 1153826 - RNA, 15 nt, Human
gcacagugcaucuca

SEQ ID NO: 1153827 - RNA, 13 nt, Human
gcacagugcaucu

SEQ ID NO: 1153828 - RNA, 20 nt, Human
gcaauucuccugccucagcc

SEQ ID NO: 1153829 - RNA, 19 nt, Human
gcaauucuccugccucagc

SEQ ID NO: 1153830 - RNA, 18 nt, Human
gcaauucuccugccucag

SEQ ID NO: 1153831 - RNA, 17 nt, Human
gcaauucuccugccuca

SEQ ID NO: 1153832 - RNA, 16 nt, Human
gcaauucuccugccuc

SEQ ID NO: 1153833 - RNA, 15 nt, Human
gcaauucuccugccu

SEQ ID NO: 1153834 - RNA, 14 nt, Human
gcaauucuccugcc

SEQ ID NO: 1153835 - RNA, 15 nt, Human
gcaaauguggcuccu

SEQ ID NO: 1153836 - RNA, 16 nt, Human
gauuugagcucagccc

SEQ ID NO: 1153837 - RNA, 16 nt, Human
gauucucaugccucag

SEQ ID NO: 1153838 - RNA, 21 nt, Human
gauuacaggcuccugccacca

SEQ ID NO: 1153839 - RNA, 18 nt, Human
gauuacaggcuccugcca

SEQ ID NO: 1153840 - RNA, 17 nt, Human
gauuacaggcuccugcc

SEQ ID NO: 1153841 - RNA, 20 nt, Human
gauuacaggcgugagccacc

SEQ ID NO: 1153842 - RNA, 21 nt, Human
gaugguuccccuguucacucu

SEQ ID NO: 1153843 - RNA, 18 nt, Human
gaugguuccccuguucac

SEQ ID NO: 1153844 - RNA, 13 nt, Human
gaugguuccccug

SEQ ID NO: 1153845 - RNA, 20 nt, Human
gaugcugacuguacuccucc

SEQ ID NO: 1153846 - RNA, 17 nt, Human
gaugcugacuguacucc

SEQ ID NO: 1153847 - RNA, 21 nt, Human
gaugccccgucccccucuggc

SEQ ID NO: 1153848 - RNA, 16 nt, Human
gaugccccgucccccu

SEQ ID NO: 1153849 - RNA, 17 nt, Human
gaggggcugugggcgug

SEQ ID NO: 1153850 - RNA, 20 nt, Human
gagggagggggaaggcaggg

SEQ ID NO: 1153851 - RNA, 22 nt, Human
gagcccuguccugccuaaggcu

SEQ ID NO: 1153852 - RNA, 21 nt, Human
gagcauuagauuucucauuug

SEQ ID NO: 1153853 - RNA, 15 nt, Human
gagcauuagauuucu

SEQ ID NO: 1153854 - RNA, 17 nt, Human
gagaugaggccgccaug

SEQ ID NO: 1153855 - RNA, 21 nt, Human
gagaguggcuccucccggugc

SEQ ID NO: 1153856 - RNA, 16 nt, Human
gagaguggcuccuccc

SEQ ID NO: 1153857 - RNA, 16 nt, Human
gagagcccuucauuug

SEQ ID NO: 1153858 - RNA, 22 nt, Human
gagagagcuucuguugcugccu

SEQ ID NO: 1153859 - RNA, 19 nt, Human
gagagagcuucuguugcug

SEQ ID NO: 1153860 - RNA, 19 nt, Human
gacuuaaaauauuccugca

SEQ ID NO: 1153861 - RNA, 23 nt, Human
gacuccugcacacgcuccuuccu

SEQ ID NO: 1153862 - RNA, 14 nt, Human
gacuccucugucca

SEQ ID NO: 1153863 - RNA, 11 nt, Human
gacuccucugu

SEQ ID NO: 1153864 - RNA, 21 nt, Human
gacccccaaccaaguggcucc

SEQ ID NO: 1153865 - RNA, 12 nt, Human
gacccccaacca

SEQ ID NO: 1153866 - RNA, 22 nt, Human
gaccagccuccaugcugccucc

SEQ ID NO: 1153867 - RNA, 21 nt, Human
gaccagccuccaugcugccuc

SEQ ID NO: 1153868 - RNA, 20 nt, Human
gaccagccuccaugcugccu

SEQ ID NO: 1153869 - RNA, 14 nt, Human
gaccaccugcccaa

SEQ ID NO: 1153870 - RNA, 13 nt, Human
gaccaccugccca

SEQ ID NO: 1153871 - RNA, 16 nt, Human
gacaacagacuucuga

SEQ ID NO: 1153872 - RNA, 21 nt, Human
gaauuucuucaacucccugcc

SEQ ID NO: 1153873 - RNA, 15 nt, Human
gaaugcuguauaugu

SEQ ID NO: 1153874 - RNA, 15 nt, Human
cuuucuuccucugcu

SEQ ID NO: 1153875 - RNA, 14 nt, Human
cuuucuuccucugc

SEQ ID NO: 1153876 - RNA, 13 nt, Human
cuuucuuccucug

SEQ ID NO: 1153877 - RNA, 12 nt, Human
cuuucuuccucu

SEQ ID NO: 1153878 - RNA, 11 nt, Human
cuuucuuccuc

SEQ ID NO: 1153879 - RNA, 20 nt, Human
cuuucugggcaccggggccu

SEQ ID NO: 1153880 - RNA, 18 nt, Human
cuugaacuccugaccuca

SEQ ID NO: 1153881 - RNA, 16 nt, Human
cuugaacuccugaccu

SEQ ID NO: 1153882 - RNA, 13 nt, Human
cuugaacuccuga

SEQ ID NO: 1153883 - RNA, 15 nt, Human
cuucuguugcugccu

SEQ ID NO: 1153884 - RNA, 22 nt, Human
cuucuguggcucacagaacccu

SEQ ID NO: 1153885 - RNA, 15 nt, Human
cuucuguggcucaca

SEQ ID NO: 1153886 - RNA, 13 nt, Human
cuucuguggcuca

SEQ ID NO: 1153887 - RNA, 14 nt, Human
cuucugguugaugc

SEQ ID NO: 1153888 - RNA, 23 nt, Human
cuucuggguuccuuccucugagc

SEQ ID NO: 1153889 - RNA, 17 nt, Human
cuucuggguuccuuccu

SEQ ID NO: 1153890 - RNA, 16 nt, Human
cuucuggguuccuucc

SEQ ID NO: 1153891 - RNA, 17 nt, Human
cuucuccacuggaugga

SEQ ID NO: 1153892 - RNA, 15 nt, Human
cuucuccacuggaug

SEQ ID NO: 1153893 - RNA, 14 nt, Human
cuucuccacuggau

SEQ ID NO: 1153894 - RNA, 13 nt, Human
cuucuccacugga

SEQ ID NO: 1153895 - RNA, 15 nt, Human
cuuccucccucauuc

SEQ ID NO: 1153896 - RNA, 13 nt, Human
cuuccucccucau

SEQ ID NO: 1153897 - RNA, 19 nt, Human
cuuccuaauuccacagcug

SEQ ID NO: 1153898 - RNA, 18 nt, Human
cuuccuaauuccacagcu

SEQ ID NO: 1153899 - RNA, 17 nt, Human
cuuccuaauuccacagc

SEQ ID NO: 1153900 - RNA, 13 nt, Human
cuuccuaauucca

SEQ ID NO: 1153901 - RNA, 23 nt, Human
cuucccgcucagcccucccugcc

SEQ ID NO: 1153902 - RNA, 19 nt, Human
cuucccgcucagcccuccc

SEQ ID NO: 1153903 - RNA, 15 nt, Human
cuucagggagugagg

SEQ ID NO: 1153904 - RNA, 22 nt, Human
cuucaggcucuucuccuuucac

SEQ ID NO: 1153905 - RNA, 19 nt, Human
cuucaggcucuucuccuuu

SEQ ID NO: 1153906 - RNA, 16 nt, Human
cuucaacucccugccc

SEQ ID NO: 1153907 - RNA, 20 nt, Human
cuucaaccauuccccauggg

SEQ ID NO: 1153908 - RNA, 16 nt, Human
cuucaaccauucccca

SEQ ID NO: 1153909 - RNA, 17 nt, Human
cuucaaagcaaaugucu

SEQ ID NO: 1153910 - RNA, 14 nt, Human
cuuauagacaacau

SEQ ID NO: 1153911 - RNA, 16 nt, Human
cuguucugcacacagc

SEQ ID NO: 1153912 - RNA, 18 nt, Human
cuguucccauucuugcau

SEQ ID NO: 1153913 - RNA, 23 nt, Human
cugugggcgugagaccugccccu

SEQ ID NO: 1153914 - RNA, 22 nt, Human
cugugggcgugagaccugcccc

SEQ ID NO: 1153915 - RNA, 21 nt, Human
cugugggcgugagaccugccc

SEQ ID NO: 1153916 - RNA, 11 nt, Human
cugugccucug

SEQ ID NO: 1153917 - RNA, 23 nt, Human
cugucucaagagggcacuggugg

SEQ ID NO: 1153918 - RNA, 22 nt, Human
cugucucaagagggcacuggug

SEQ ID NO: 1153919 - RNA, 17 nt, Human
cuguccaggcacugcug

SEQ ID NO: 1153920 - RNA, 13 nt, Human
cugguuccucccc

SEQ ID NO: 1153921 - RNA, 12 nt, Human
cugguuccuccc

SEQ ID NO: 1153922 - RNA, 23 nt, Human
cugguggcccgacagccuggcac

SEQ ID NO: 1153923 - RNA, 22 nt, Human
cugguggcccgacagccuggca

SEQ ID NO: 1153924 - RNA, 21 nt, Human
cugguggcccgacagccuggc

SEQ ID NO: 1153925 - RNA, 22 nt, Human
cuggugcugccacacuucaggc

SEQ ID NO: 1153926 - RNA, 20 nt, Human
cuggugcugccacacuucag

SEQ ID NO: 1153927 - RNA, 13 nt, Human
cuggugcugccac

SEQ ID NO: 1153928 - RNA, 12 nt, Human
cuggugcugcca

SEQ ID NO: 1153929 - RNA, 19 nt, Human
cuggucacaggacucugcc

SEQ ID NO: 1153930 - RNA, 18 nt, Human
cuggucacaggacucugc

SEQ ID NO: 1153931 - RNA, 21 nt, Human
cuggcacuuggagacuuguau

SEQ ID NO: 1153932 - RNA, 14 nt, Human
cuggcacuuggaga

SEQ ID NO: 1153933 - RNA, 20 nt, Human
cuggacuccucuguccaggc

SEQ ID NO: 1153934 - RNA, 19 nt, Human
cuggacuccucuguccagg

SEQ ID NO: 1153935 - RNA, 18 nt, Human
cuggacuccucuguccag

SEQ ID NO: 1153936 - RNA, 17 nt, Human
cuggacuccucugucca

SEQ ID NO: 1153937 - RNA, 14 nt, Human
cuggacuccucugu

SEQ ID NO: 1153938 - RNA, 12 nt, Human
cugcuggcugcc

SEQ ID NO: 1153939 - RNA, 22 nt, Human
cugcugcccagccuccaagcuc

SEQ ID NO: 1153940 - RNA, 15 nt, Human
cugcugcccagccuc

SEQ ID NO: 1153941 - RNA, 12 nt, Human
cugcugcccagc

SEQ ID NO: 1153942 - RNA, 18 nt, Human
cugcugaaggaauaaauu

SEQ ID NO: 1153943 - RNA, 17 nt, Human
cugcugaaggaauaaau

SEQ ID NO: 1153944 - RNA, 21 nt, Human
cugcucuccucuugccacugc

SEQ ID NO: 1153945 - RNA, 20 nt, Human
cugcucuccucuugccacug

SEQ ID NO: 1153946 - RNA, 14 nt, Human
cugcucuccucuug

SEQ ID NO: 1153947 - RNA, 21 nt, Human
cugcccuuucugggcaccggg

SEQ ID NO: 1153948 - RNA, 22 nt, Human
cugcccugcugagucccaggcu

SEQ ID NO: 1153949 - RNA, 20 nt, Human
cugcccugcgggucacagga

SEQ ID NO: 1153950 - RNA, 23 nt, Human
cucccuucaaccauuccccaugg

SEQ ID NO: 1153951 - RNA, 22 nt, Human
cucccuucaaccauuccccaug

SEQ ID NO: 1153952 - RNA, 21 nt, Human
cucccuucaaccauuccccau

SEQ ID NO: 1153953 - RNA, 22 nt, Human
cucccaggcgccccuucccccu

SEQ ID NO: 1153954 - RNA, 20 nt, Human
cucccaggcgccccuucccc

SEQ ID NO: 1153955 - RNA, 19 nt, Human
cucccaggcgccccuuccc

SEQ ID NO: 1153956 - RNA, 14 nt, Human
cucccacaggcccu

SEQ ID NO: 1153957 - RNA, 16 nt, Human
cucccaaagugcuggg

SEQ ID NO: 1153958 - RNA, 17 nt, Human
cuccaugcugccuccag

SEQ ID NO: 1153959 - RNA, 16 nt, Human
cuccaugcugccucca

SEQ ID NO: 1153960 - RNA, 15 nt, Human
cuccaugcugccucc

SEQ ID NO: 1153961 - RNA, 14 nt, Human
cuccaugcugccuc

SEQ ID NO: 1153962 - RNA, 19 nt, Human
cuccagcuggguuggaaaa

SEQ ID NO: 1153963 - RNA, 23 nt, Human
cuccagcuggccgggagccugau

SEQ ID NO: 1153964 - RNA, 22 nt, Human
cuccagcuggccgggagccuga

SEQ ID NO: 1153965 - RNA, 16 nt, Human
cuccacuggauggagg

SEQ ID NO: 1153966 - RNA, 14 nt, Human
cuccacuggaugga

SEQ ID NO: 1153967 - RNA, 13 nt, Human
cuccacuggaugg

SEQ ID NO: 1153968 - RNA, 16 nt, Human
cuccacugccuucgau

SEQ ID NO: 1153969 - RNA, 15 nt, Human
cuccacugccuucga

SEQ ID NO: 1153970 - RNA, 14 nt, Human
cuccacugccuucg

SEQ ID NO: 1153971 - RNA, 15 nt, Human
cuccaaacccucgag

SEQ ID NO: 1153972 - RNA, 17 nt, Human
cuccaaacccucgaggc

SEQ ID NO: 1153973 - RNA, 21 nt, Human
cuccaaacccucgaggcggau

SEQ ID NO: 1153974 - RNA, 24 nt, Human
cucagguaaucgaccugccucggc

SEQ ID NO: 1153975 - RNA, 22 nt, Human
cucagguaaucgaccugccucg

SEQ ID NO: 1153976 - RNA, 20 nt, Human
cucagguaaucgaccugccu

SEQ ID NO: 1153977 - RNA, 19 nt, Human
cucagcucccaaggcucug

SEQ ID NO: 1153978 - RNA, 15 nt, Human
cucagcucccaaggc

SEQ ID NO: 1153979 - RNA, 21 nt, Human
cucagcccucccugccccucc

SEQ ID NO: 1153980 - RNA, 20 nt, Human
cucagcccucccugccccuc

SEQ ID NO: 1153981 - RNA, 19 nt, Human
cucagcccucccugccccu

SEQ ID NO: 1153982 - RNA, 14 nt, Human
cucagcccucccug

SEQ ID NO: 1153983 - RNA, 15 nt, Human
cucagagccaccccu

SEQ ID NO: 1153984 - RNA, 20 nt, Human
cucacugcauccuccgccuc

SEQ ID NO: 1153985 - RNA, 17 nt, Human
cucacagaacccuugga

SEQ ID NO: 1153986 - RNA, 11 nt, Human
cuauugguaaa

SEQ ID NO: 1153987 - RNA, 19 nt, Human
cuaugggggcacugaggac

SEQ ID NO: 1153988 - RNA, 19 nt, Human
cuaugauuuggaaaauaaa

SEQ ID NO: 1153989 - RNA, 15 nt, Human
cuaugauuuggaaaa

SEQ ID NO: 1153990 - RNA, 22 nt, Human
cuacuuagcaugucccuaccga

SEQ ID NO: 1153991 - RNA, 17 nt, Human
cuacuuagcaugucccu

SEQ ID NO: 1153992 - RNA, 23 nt, Human
cuaccgagucucuucuccacugg

SEQ ID NO: 1153993 - RNA, 22 nt, Human
cuaccgagucucuucuccacug

SEQ ID NO: 1153994 - RNA, 21 nt, Human
cuaccgagucucuucuccacu

SEQ ID NO: 1153995 - RNA, 19 nt, Human
cuaccgagucucuucucca

SEQ ID NO: 1153996 - RNA, 17 nt, Human
cuaccgagucucuucuc

SEQ ID NO: 1153997 - RNA, 22 nt, Human
cuacagcuaaucagcauucuca

SEQ ID NO: 1153998 - RNA, 21 nt, Human
cuacagcuaaucagcauucuc

SEQ ID NO: 1153999 - RNA, 19 nt, Human
cuacagcuaaucagcauuc

SEQ ID NO: 1154000 - RNA, 18 nt, Human
cuacagcuaaucagcauu

SEQ ID NO: 1154001 - RNA, 16 nt, Human
cuaauuccacagcugc

SEQ ID NO: 1154002 - RNA, 15 nt, Human
cuaauuccacagcug

SEQ ID NO: 1154003 - RNA, 14 nt, Human
cuaauuccacagcu

SEQ ID NO: 1154004 - RNA, 22 nt, Human
cuaauuauacccccugcaaagc

SEQ ID NO: 1154005 - RNA, 23 nt, Human
cuaaugcgcaggcuggcccugcc

SEQ ID NO: 1154006 - RNA, 22 nt, Human
cuaaugcgcaggcuggcccugc

SEQ ID NO: 1154007 - RNA, 20 nt, Human
cuaaugcgcaggcuggcccu

SEQ ID NO: 1154008 - RNA, 19 nt, Human
cuaaugcgcaggcuggccc

SEQ ID NO: 1154009 - RNA, 16 nt, Human
cuaaugcgcaggcugg

SEQ ID NO: 1154010 - RNA, 15 nt, Human
cuaaugcgcaggcug

SEQ ID NO: 1154011 - RNA, 21 nt, Human
cuaaucagcauucucacuccu

SEQ ID NO: 1154012 - RNA, 21 nt, Human
cuaaacugcccccucugcccu

SEQ ID NO: 1154013 - RNA, 13 nt, Human
cuaaacugccccc

SEQ ID NO: 1154014 - RNA, 12 nt, Human
cuaaacugcccc

SEQ ID NO: 1154015 - RNA, 20 nt, Human
cguuuguuccccaagacauu

SEQ ID NO: 1154016 - RNA, 23 nt, Human
cgggaccccgagccuggcuccaa

SEQ ID NO: 1154017 - RNA, 17 nt, Human
cggacuuagcugggaga

SEQ ID NO: 1154018 - RNA, 16 nt, Human
cggacuuagcugggag

SEQ ID NO: 1154019 - RNA, 18 nt, Human
cgcccggcuaauuuuugu

SEQ ID NO: 1154020 - RNA, 18 nt, Human
cgcccaacuaauuuuugu

SEQ ID NO: 1154021 - RNA, 24 nt, Human
cgcagcccugcuuugggcugcccu

SEQ ID NO: 1154022 - RNA, 15 nt, Human
cgcagcccugcuuug

SEQ ID NO: 1154023 - RNA, 13 nt, Human
cgcagcccugcuu

SEQ ID NO: 1154024 - RNA, 13 nt, Human
cgagccuggcucc

SEQ ID NO: 1154025 - RNA, 23 nt, Human
ccuuuguaaauugucagaugcug

SEQ ID NO: 1154026 - RNA, 21 nt, Human
ccuuuguaaauugucagaugc

SEQ ID NO: 1154027 - RNA, 23 nt, Human
ccuugacauuguagagcuucugg

SEQ ID NO: 1154028 - RNA, 18 nt, Human
ccuuccaugucgccucug

SEQ ID NO: 1154029 - RNA, 18 nt, Human
ccuggcuuuucacugcug

SEQ ID NO: 1154030 - RNA, 17 nt, Human
ccuggcuuuucacugcu

SEQ ID NO: 1154031 - RNA, 16 nt, Human
ccuggcuuuucacugc

SEQ ID NO: 1154032 - RNA, 13 nt, Human
ccuggccacgccc

SEQ ID NO: 1154033 - RNA, 16 nt, Human
ccuggagaacuagaga

SEQ ID NO: 1154034 - RNA, 13 nt, Human
ccuggagaacuag

SEQ ID NO: 1154035 - RNA, 12 nt, Human
ccuggagaacua

SEQ ID NO: 1154036 - RNA, 22 nt, Human
ccugccuguucccauucuugca

SEQ ID NO: 1154037 - RNA, 12 nt, Human
ccugccucagcc

SEQ ID NO: 1154038 - RNA, 23 nt, Human
ccugcccugguuuccugcccugg

SEQ ID NO: 1154039 - RNA, 22 nt, Human
ccugcccugguuuccugcccug

SEQ ID NO: 1154040 - RNA, 21 nt, Human
ccugcccugguuuccugcccu

SEQ ID NO: 1154041 - RNA, 20 nt, Human
ccugcccugguuuccugccc

SEQ ID NO: 1154042 - RNA, 19 nt, Human
ccugcccugguuuccugcc

SEQ ID NO: 1154043 - RNA, 14 nt, Human
ccugcccugguuuc

SEQ ID NO: 1154044 - RNA, 22 nt, Human
ccugcccugggaggcagugaug

SEQ ID NO: 1154045 - RNA, 20 nt, Human
ccugcccugggaggcaguga

SEQ ID NO: 1154046 - RNA, 15 nt, Human
ccugcccugggaggc

SEQ ID NO: 1154047 - RNA, 14 nt, Human
ccugcccugggagg

SEQ ID NO: 1154048 - RNA, 12 nt, Human
ccugcccuggga

SEQ ID NO: 1154049 - RNA, 10 nt, Human
ccugcccugg

SEQ ID NO: 1154050 - RNA, 22 nt, Human
ccugccccuccucucugcccua

SEQ ID NO: 1154051 - RNA, 21 nt, Human
ccugccccuccucucugcccu

SEQ ID NO: 1154052 - RNA, 20 nt, Human
ccugccccuccucucugccc

SEQ ID NO: 1154053 - RNA, 19 nt, Human
ccugccccuccucucugcc

SEQ ID NO: 1154054 - RNA, 18 nt, Human
ccugccccuccucucugc

SEQ ID NO: 1154055 - RNA, 18 nt, Human
ccugccccucccuucaac

SEQ ID NO: 1154056 - RNA, 16 nt, Human
ccugccccucccuuca

SEQ ID NO: 1154057 - RNA, 15 nt, Human
ccugccccucccuuc

SEQ ID NO: 1154058 - RNA, 14 nt, Human
ccugccccucccuu

SEQ ID NO: 1154059 - RNA, 19 nt, Human
ccugccaccacgcccggcu

SEQ ID NO: 1154060 - RNA, 15 nt, Human
ccugccaccacgccc

SEQ ID NO: 1154061 - RNA, 23 nt, Human
ccugcauuugugaaaugauggug

SEQ ID NO: 1154062 - RNA, 21 nt, Human
ccugcacacgcuccuuccucu

SEQ ID NO: 1154063 - RNA, 19 nt, Human
ccugcaaagcccagcuuga

SEQ ID NO: 1154064 - RNA, 23 nt, Human
ccugcacaaagcccuuccauguc

SEQ ID NO: 1154065 - RNA, 22 nt, Human
ccugcacaaagcccuuccaugu

SEQ ID NO: 1154066 - RNA, 18 nt, Human
ccugcaaagcccagcuug

SEQ ID NO: 1154067 - RNA, 17 nt, Human
ccugcaaagcccagcuu

SEQ ID NO: 1154068 - RNA, 16 nt, Human
ccugcaaagcccagcu

SEQ ID NO: 1154069 - RNA, 15 nt, Human
ccugcaaagcccagc

SEQ ID NO: 1154070 - RNA, 14 nt, Human
ccugcaaagcccag

SEQ ID NO: 1154071 - RNA, 19 nt, Human
ccugaaguaagcaaagacu

SEQ ID NO: 1154072 - RNA, 11 nt, Human
ccucuuccuga

SEQ ID NO: 1154073 - RNA, 21 nt, Human
ccuaccgagucucuucuccac

SEQ ID NO: 1154074 - RNA, 20 nt, Human
ccuaccgagucucuucucca

SEQ ID NO: 1154075 - RNA, 19 nt, Human
ccuaccgagucucuucucc

SEQ ID NO: 1154076 - RNA, 17 nt, Human
ccuaccgagucucuucu

SEQ ID NO: 1154077 - RNA, 16 nt, Human
ccuaccgagucucuuc

SEQ ID NO: 1154078 - RNA, 11 nt, Human
ccguggcuucc

SEQ ID NO: 1154079 - RNA, 14 nt, Human
ccguggcuucccgc

SEQ ID NO: 1154080 - RNA, 17 nt, Human
ccggaggggccuggcag

SEQ ID NO: 1154081 - RNA, 16 nt, Human
ccggaggggccuggca

SEQ ID NO: 1154082 - RNA, 15 nt, Human
ccggaggggccuggc

SEQ ID NO: 1154083 - RNA, 14 nt, Human
ccggaggggccugg

SEQ ID NO: 1154084 - RNA, 21 nt, Human
ccgagucucuucuccacugga

SEQ ID NO: 1154085 - RNA, 20 nt, Human
ccgagucucuucuccacugg

SEQ ID NO: 1154086 - RNA, 19 nt, Human
ccgagucucuucuccacug

SEQ ID NO: 1154087 - RNA, 18 nt, Human
ccgagucucuucuccacu

SEQ ID NO: 1154088 - RNA, 16 nt, Human
ccgagucucuucucca

SEQ ID NO: 1154089 - RNA, 14 nt, Human
ccgagucucuucuc

SEQ ID NO: 1154090 - RNA, 20 nt, Human
ccgaguagcugagauuauag

SEQ ID NO: 1154091 - RNA, 20 nt, Human
cccuuccaugucgccucugc

SEQ ID NO: 1154092 - RNA, 18 nt, Human
cccuucaaccauucccca

SEQ ID NO: 1154093 - RNA, 14 nt, Human
cccuucaaccauuc

SEQ ID NO: 1154094 - RNA, 20 nt, Human
cccuuagaaguuuguuguga

SEQ ID NO: 1154095 - RNA, 15 nt, Human
cccuggugcugccac

SEQ ID NO: 1154096 - RNA, 14 nt, Human
cccuggugcugcca

SEQ ID NO: 1154097 - RNA, 13 nt, Human
cccuggugcugcc

SEQ ID NO: 1154098 - RNA, 16 nt, Human
cccuggugcugccaca

SEQ ID NO: 1154099 - RNA, 23 nt, Human
cccugcugagucccaggcugagc

SEQ ID NO: 1154100 - RNA, 21 nt, Human
cccugcugagucccaggcuga

SEQ ID NO: 1154101 - RNA, 21 nt, Human
cccugcgggucacaggaggga

SEQ ID NO: 1154102 - RNA, 19 nt, Human
cccugcgggucacaggagg

SEQ ID NO: 1154103 - RNA, 21 nt, Human
cccucuguucugcacacagca

SEQ ID NO: 1154104 - RNA, 20 nt, Human
cccucuguucugcacacagc

SEQ ID NO: 1154105 - RNA, 22 nt, Human
cccucuggcuccagcuggccgg

SEQ ID NO: 1154106 - RNA, 17 nt, Human
cccucuggcuccagcug

SEQ ID NO: 1154107 - RNA, 16 nt, Human
cccucuggcuccagcu

SEQ ID NO: 1154108 - RNA, 12 nt, Human
cccucuggcucc

SEQ ID NO: 1154109 - RNA, 14 nt, Human
cccucugcccugcg

SEQ ID NO: 1154110 - RNA, 13 nt, Human
cccucugcccugc

SEQ ID NO: 1154111 - RNA, 12 nt, Human
cccucugcccug

SEQ ID NO: 1154112 - RNA, 14 nt, Human
cccucccugccccu

SEQ ID NO: 1154113 - RNA, 14 nt, Human
cccgcucagcccuc

SEQ ID NO: 1154114 - RNA, 12 nt, Human
cccucccacagc

SEQ ID NO: 1154115 - RNA, 13 nt, Human
cccgcucagcccu

SEQ ID NO: 1154116 - RNA, 12 nt, Human
cccgcucagccc

SEQ ID NO: 1154117 - RNA, 14 nt, Human
cccucccacagcgc

SEQ ID NO: 1154118 - RNA, 15 nt, Human
cccgcucagcccucc

SEQ ID NO: 1154119 - RNA, 18 nt, Human
cccgacagccuggcacag

SEQ ID NO: 1154120 - RNA, 15 nt, Human
cccgacagccuggca

SEQ ID NO: 1154121 - RNA, 13 nt, Human
cccgagccuggcu

SEQ ID NO: 1154122 - RNA, 15 nt, Human
cccgagccuggcucc

SEQ ID NO: 1154123 - RNA, 14 nt, Human
cccgacagccuggc

SEQ ID NO: 1154124 - RNA, 15 nt, Human
ccccuguucacucua

SEQ ID NO: 1154125 - RNA, 22 nt, Human
ccccuggcuuuucacugcuggc

SEQ ID NO: 1154126 - RNA, 20 nt, Human
ccccuggcuuuucacugcug

SEQ ID NO: 1154127 - RNA, 18 nt, Human
ccccuggcuuuucacugc

SEQ ID NO: 1154128 - RNA, 14 nt, Human
ccccucugcccugc

SEQ ID NO: 1154129 - RNA, 13 nt, Human
ccccucugcccug

SEQ ID NO: 1154130 - RNA, 12 nt, Human
ccccucugcccu

SEQ ID NO: 1154131 - RNA, 17 nt, Human
ccccuccucucugcccu

SEQ ID NO: 1154132 - RNA, 15 nt, Human
ccccuccucucugcc

SEQ ID NO: 1154133 - RNA, 22 nt, Human
ccccuccuccuggacuccugca

SEQ ID NO: 1154134 - RNA, 18 nt, Human
ccccuccuccuggacucc

SEQ ID NO: 1154135 - RNA, 15 nt, Human
ccccucccuucaacc

SEQ ID NO: 1154136 - RNA, 23 nt, Human
ccccuccaaucccaccaacccuc

SEQ ID NO: 1154137 - RNA, 20 nt, Human
ccccucauagcccucacccu

SEQ ID NO: 1154138 - RNA, 21 nt, Human
cccccugcaaagcccagcuug

SEQ ID NO: 1154139 - RNA, 19 nt, Human
cccccugcaaagcccagcu

SEQ ID NO: 1154140 - RNA, 18 nt, Human
cccccugcaaagcccagc

SEQ ID NO: 1154141 - RNA, 21 nt, Human
cccccucuggcuccagcuggc

SEQ ID NO: 1154142 - RNA, 19 nt, Human
cccccucuggcuccagcug

SEQ ID NO: 1154143 - RNA, 12 nt, Human
cccccucuggcu

SEQ ID NO: 1154144 - RNA, 22 nt, Human
ccccauaauuuuuuuuuuccuu

SEQ ID NO: 1154145 - RNA, 14 nt, Human
cccaucucuucugg

SEQ ID NO: 1154146 - RNA, 13 nt, Human
cccaguuguauuu

SEQ ID NO: 1154147 - RNA, 19 nt, Human
cccacauagugaugguucc

SEQ ID NO: 1154148 - RNA, 18 nt, Human
cccacaggcccuuccucu

SEQ ID NO: 1154149 - RNA, 16 nt, Human
cccacaggcccuuccu

SEQ ID NO: 1154150 - RNA, 13 nt, Human
cccacagcgcugg

SEQ ID NO: 1154151 - RNA, 21 nt, Human
ccagguggccacuccagaccc

SEQ ID NO: 1154152 - RNA, 16 nt, Human
ccagguggccacucca

SEQ ID NO: 1154153 - RNA, 24 nt, Human
ccagauuuuuuacagcugccugca

SEQ ID NO: 1154154 - RNA, 22 nt, Human
ccagagaguggcuccucccggu

SEQ ID NO: 1154155 - RNA, 18 nt, Human
ccagagaguggcuccucc

SEQ ID NO: 1154156 - RNA, 16 nt, Human
ccagagaguggcuccu

SEQ ID NO: 1154157 - RNA, 15 nt, Human
ccagagaguggcucc

SEQ ID NO: 1154158 - RNA, 14 nt, Human
ccagagaguggcuc

SEQ ID NO: 1154159 - RNA, 24 nt, Human
ccagaccccuggcuuuucacugcu

SEQ ID NO: 1154160 - RNA, 21 nt, Human
ccacugccuucgauacaccgg

SEQ ID NO: 1154161 - RNA, 16 nt, Human
ccacugccucuuccuc

SEQ ID NO: 1154162 - RNA, 13 nt, Human
ccacugccucuuc

SEQ ID NO: 1154163 - RNA, 14 nt, Human
ccaccuucccaugc

SEQ ID NO: 1154164 - RNA, 16 nt, Human
agcuuuucccuucuuu

SEQ ID NO: 1154165 - RNA, 13 nt, Human
agcuuuucccuuc

SEQ ID NO: 1154166 - RNA, 23 nt, Human
agcuucuguugcugccucaugcu

SEQ ID NO: 1154167 - RNA, 22 nt, Human
aggaacguaaucguguccccua

SEQ ID NO: 1154168 - RNA, 17 nt, Human
aggaaauccaggguggu

SEQ ID NO: 1154169 - RNA, 22 nt, Human
agcuucuguugcugccucaugc

SEQ ID NO: 1154170 - RNA, 21 nt, Human
agcuucuguugcugccucaug

SEQ ID NO: 1154171 - RNA, 14 nt, Human
agcuggguuggaaa

SEQ ID NO: 1154172 - RNA, 22 nt, Human
aggcacugcugcccagccucca

SEQ ID NO: 1154173 - RNA, 16 nt, Human
aggcacugcugcccag

SEQ ID NO: 1154174 - RNA, 14 nt, Human
aggcacugcugccc

SEQ ID NO: 1154175 - RNA, 17 nt, Human
aggacccggaggggccu

SEQ ID NO: 1154176 - RNA, 21 nt, Human
aggcugaacuuguuuucuggg

SEQ ID NO: 1154177 - RNA, 20 nt, Human
aggcugaacuuguuuucugg

SEQ ID NO: 1154178 - RNA, 19 nt, Human
agguaaucgaccugccucg

SEQ ID NO: 1154179 - RNA, 18 nt, Human
agguaaucgaccugccuc

SEQ ID NO: 1154180 - RNA, 17 nt, Human
agguaaucgaccugccu

SEQ ID NO: 1154181 - RNA, 23 nt, Human
agagagcuucuguugcugccuca

SEQ ID NO: 1154182 - RNA, 20 nt, Human
agagagcuucuguugcugcc

SEQ ID NO: 1154183 - RNA, 16 nt, Human
agagagcuucuguugc

SEQ ID NO: 1154184 - RNA, 16 nt, Human
agagaguggcuccucc

SEQ ID NO: 1154185 - RNA, 14 nt, Human
agagaguggcuccu

SEQ ID NO: 1154186 - RNA, 15 nt, Human
agagcccuucauuug

SEQ ID NO: 1154187 - RNA, 23 nt, Human
agauggcugugccucugccuguc

SEQ ID NO: 1154188 - RNA, 23 nt, Human
agccccauaauuuuuuuuuuccu

SEQ ID NO: 1154189 - RNA, 17 nt, Human
aucugggccagaauuuc

SEQ ID NO: 1154190 - RNA, 15 nt, Human
aucugggccagaauu

SEQ ID NO: 1154191 - RNA, 13 nt, Human
aucaccugcccug

SEQ ID NO: 1154192 - RNA, 12 nt, Human
aucaccugcccu

SEQ ID NO: 1154193 - RNA, 14 nt, Human
aucccggcugcccu

SEQ ID NO: 1154194 - RNA, 16 nt, Human
auggaggaaaaccaag

SEQ ID NO: 1154195 - RNA, 13 nt, Human
auggaaauguuua

SEQ ID NO: 1154196 - RNA, 16 nt, Human
augaugugugaaaacu

SEQ ID NO: 1154197 - RNA, 23 nt, Human
augauguauguugaagccuuugu

SEQ ID NO: 1154198 - RNA, 18 nt, Human
agucaaggguaggguggg

SEQ ID NO: 1154199 - RNA, 19 nt, Human
agugauucucaugccucag

SEQ ID NO: 1154200 - RNA, 18 nt, Human
agugauucucaugccuca

SEQ ID NO: 1154201 - RNA, 22 nt, Human
auacccccugcaaagcccagcu

SEQ ID NO: 1154202 - RNA, 19 nt, Human
aacugaccagccuccaugc

SEQ ID NO: 1154203 - RNA, 14 nt, Human
aacugaccagccuc

SEQ ID NO: 1154204 - RNA, 23 nt, Human
aacugaacucugacaacagacuu

SEQ ID NO: 1154205 - RNA, 20 nt, Human
aacugaacucugacaacaga

SEQ ID NO: 1154206 - RNA, 19 nt, Human
aacugaacucugacaacag

SEQ ID NO: 1154207 - RNA, 16 nt, Human
aacugaacucugacaa

SEQ ID NO: 1154208 - RNA, 13 nt, Human
aacagcucgacuu

SEQ ID NO: 1154209 - RNA, 18 nt, Human
aaauugcauuuccugaca

SEQ ID NO: 1154210 - RNA, 16 nt, Human
aaauaguaaaaauaaa

SEQ ID NO: 1154211 - RNA, 13 nt, Human
aaauaguaaaaau

SEQ ID NO: 1154212 - RNA, 22 nt, Human
aaauacuguuuuuaacaacuau

SEQ ID NO: 1154213 - RNA, 22 nt, Human
aaauaaaauuaaagcugaaaac

SEQ ID NO: 1154214 - RNA, 11 nt, Human
aaacugccccc

SEQ ID NO: 1154215 - RNA, 20 nt, Human
aaggacuaggguccugggga

SEQ ID NO: 1154216 - RNA, 18 nt, Human
aaggacuaggguccuggg

SEQ ID NO: 1154217 - RNA, 21 nt, Human
aaggacccggaggggccuggc

SEQ ID NO: 1154218 - RNA, 18 nt, Human
aaggacccggaggggccu

SEQ ID NO: 1154219 - RNA, 11 nt, Human
aagcagcucuu

SEQ ID NO: 1154220 - RNA, 23 nt, Human
aauaaaauuaaagcugaaaacug

SEQ ID NO: 1154221 - RNA, 22 nt, Human
aauggucuuucuaaugugugaa

SEQ ID NO: 1154222 - RNA, 18 nt, Human
aauccaggguggugguga

SEQ ID NO: 1154223 - RNA, 18 nt, Human
acuuguaaaugugguaaa

SEQ ID NO: 1154224 - RNA, 20 nt, Human
acuuguaaaugugguaaaga

SEQ ID NO: 1154225 - RNA, 20 nt, Human
acugcccccucugcccugcg

SEQ ID NO: 1154226 - RNA, 19 nt, Human
acugcccccucugcccugc

SEQ ID NO: 1154227 - RNA, 19 nt, Human
acugucucaagagggcacu

SEQ ID NO: 1154228 - RNA, 23 nt, Human
acugguggcccgacagccuggca

SEQ ID NO: 1154229 - RNA, 22 nt, Human
acugguggcccgacagccuggc

SEQ ID NO: 1154230 - RNA, 21 nt, Human
acugguggcccgacagccugg

SEQ ID NO: 1154231 - RNA, 18 nt, Human
accugccccuccucucug

SEQ ID NO: 1154232 - RNA, 14 nt, Human
accugccccuccuc

SEQ ID NO: 1154233 - RNA, 21 nt, Human
accugcccaaccugcucuccu

SEQ ID NO: 1154234 - RNA, 13 nt, Human
accuuuauucugg

SEQ ID NO: 1154235 - RNA, 12 nt, Human
accuuuauucug

SEQ ID NO: 1154236 - RNA, 22 nt, Human
accugccccuccucucugcccu

SEQ ID NO: 1154237 - RNA, 20 nt, Human
accugccccuccucucugcc

SEQ ID NO: 1154238 - RNA, 14 nt, Human
acucaguggggagg

SEQ ID NO: 1154239 - RNA, 16 nt, Human
acuaggguccugggga

SEQ ID NO: 1154240 - RNA, 15 nt, Human
acuaggguccugggg

SEQ ID NO: 1154241 - RNA, 22 nt, Human
acaggugugagccaccacgccc

SEQ ID NO: 1154242 - RNA, 21 nt, Human
acaggugugagccaccacgcc

SEQ ID NO: 1154243 - RNA, 21 nt, Human
acagcugcucaauaaaguaca

SEQ ID NO: 1154244 - RNA, 21 nt, Human
acagaacacauaauucaggaa

SEQ ID NO: 1154245 - RNA, 15 nt, Human
acagaagcagcucuu

SEQ ID NO: 1154246 - RNA, 12 nt, Human
acagaagcagcu

SEQ ID NO: 1154247 - RNA, 13 nt, Human
acagaagcagcuc

SEQ ID NO: 1154248 - RNA, 14 nt, Human
acagaagcagcucu

SEQ ID NO: 1154249 - RNA, 19 nt, Human
acacgcuccuuccucugag

SEQ ID NO: 1154250 - RNA, 17 nt, Human
acacgcuccuuccucug

SEQ ID NO: 1154251 - RNA, 18 nt, Human
acaacuaugauuuggaaa

SEQ ID NO: 1154252 - RNA, 23 nt, Human
acaaguaugaauaaagacaccua

SEQ ID NO: 1154253 - RNA, 21 nt, Human
acaaguaugaauaaagacacc

SEQ ID NO: 1154254 - RNA, 22 nt, Human
accccuaaagagauacuuugau

SEQ ID NO: 1154255 - RNA, 18 nt, Human
accccgaccaccugccca

SEQ ID NO: 1154256 - RNA, 20 nt, Human
accacgcccggcuaauuuuu

SEQ ID NO: 1154257 - RNA, 14 nt, Human
accacgcccggcua

SEQ ID NO: 1154258 - RNA, 20 nt, Human
cugcccugguuuccugcccu

SEQ ID NO: 1154259 - RNA, 21 nt, Human
cugcccugguuuccugcccug

SEQ ID NO: 1154260 - RNA, 19 nt, Human
cugcccugguuuccugccc

SEQ ID NO: 1154261 - RNA, 18 nt, Human
cugcccugguuuccugcc

SEQ ID NO: 1154262 - RNA, 17 nt, Human
cugcccugguuuccugc

SEQ ID NO: 1154263 - RNA, 23 nt, Human
cugcccuggugcugccacacuuc

SEQ ID NO: 1154264 - RNA, 16 nt, Human
cugcccuggugcugcc

SEQ ID NO: 1154265 - RNA, 15 nt, Human
cugcccuggugcugc

SEQ ID NO: 1154266 - RNA, 14 nt, Human
cugcccuggugcug

SEQ ID NO: 1154267 - RNA, 13 nt, Human
cugcccuggugcu

SEQ ID NO: 1154268 - RNA, 12 nt, Human
cugcccuggugc

SEQ ID NO: 1154269 - RNA, 19 nt, Human
cugccuguucccauucuug

SEQ ID NO: 1154270 - RNA, 15 nt, Human
cugccuguucccauu

SEQ ID NO: 1154271 - RNA, 17 nt, Human
cuggauccaucaggcca

SEQ ID NO: 1154272 - RNA, 15 nt, Human
cuggagaacuagaga

SEQ ID NO: 1154273 - RNA, 14 nt, Human
cuggagaacuagag

SEQ ID NO: 1154274 - RNA, 23 nt, Human
cuggacuccucuguccaggcacu

SEQ ID NO: 1154275 - RNA, 22 nt, Human
cuggacuccucuguccaggcac

SEQ ID NO: 1154276 - RNA, 20 nt, Human
cuggaucuccauucucucag

SEQ ID NO: 1154277 - RNA, 19 nt, Human
cuggauccaucaggccacu

SEQ ID NO: 1154278 - RNA, 13 nt, Human
cuggcagccgugc

SEQ ID NO: 1154279 - RNA, 22 nt, Human
cuggcucccacaggcccuuccu

SEQ ID NO: 1154280 - RNA, 22 nt, Human
cuggccgggaccccgagccugg

SEQ ID NO: 1154281 - RNA, 19 nt, Human
cuggcucccacaggcccuu

SEQ ID NO: 1154282 - RNA, 19 nt, Human
cuggcagccgugccuucag

SEQ ID NO: 1154283 - RNA, 18 nt, Human
cuggcagccgugccuuca

SEQ ID NO: 1154284 - RNA, 17 nt, Human
cuggcagccgugccuuc

SEQ ID NO: 1154285 - RNA, 16 nt, Human
cugugaacugaacucu

SEQ ID NO: 1154286 - RNA, 15 nt, Human
cugugaacugaacuc

SEQ ID NO: 1154287 - RNA, 13 nt, Human
cugugaacugaac

SEQ ID NO: 1154288 - RNA, 13 nt, Human
cuguucacucuac

SEQ ID NO: 1154289 - RNA, 14 nt, Human
cuguugcugccuca

SEQ ID NO: 1154290 - RNA, 20 nt, Human
cuuacauuagcaguuugcuu

SEQ ID NO: 1154291 - RNA, 13 nt, Human
cuuccucugcuga

SEQ ID NO: 1154292 - RNA, 12 nt, Human
cuuccucugcug

SEQ ID NO: 1154293 - RNA, 11 nt, Human
cuuccucugcu

SEQ ID NO: 1154294 - RNA, 21 nt, Human
cuuccucuccacugccuucga

SEQ ID NO: 1154295 - RNA, 19 nt, Human
cuuccucuccacugccuuc

SEQ ID NO: 1154296 - RNA, 17 nt, Human
cuuccucuccacugccu

SEQ ID NO: 1154297 - RNA, 16 nt, Human
cuuccucuccacugcc

SEQ ID NO: 1154298 - RNA, 22 nt, Human
gaaaauuaggauuucaugauuu

SEQ ID NO: 1154299 - RNA, 18 nt, Human
gaaaauuaggauuucaug

SEQ ID NO: 1154300 - RNA, 19 nt, Human
gaaaacugcaacuuguaaa

SEQ ID NO: 1154301 - RNA, 18 nt, Human
gaaagaaguggggacaga

SEQ ID NO: 1154302 - RNA, 19 nt, Human
gacauuguagagcuucugg

SEQ ID NO: 1154303 - RNA, 20 nt, Human
gacccggaggggccuggcag

SEQ ID NO: 1154304 - RNA, 19 nt, Human
gacccggaggggccuggca

SEQ ID NO: 1154305 - RNA, 18 nt, Human
gacccggaggggccuggc

SEQ ID NO: 1154306 - RNA, 17 nt, Human
gacccggaggggccugg

SEQ ID NO: 1154307 - RNA, 16 nt, Human
gaccccugagcuugca

SEQ ID NO: 1154308 - RNA, 23 nt, Human
gaccucagguaaucgaccugccu

SEQ ID NO: 1154309 - RNA, 22 nt, Human
gaccucagguaaucgaccugcc

SEQ ID NO: 1154310 - RNA, 18 nt, Human
gacuuuuauuuccaguga

SEQ ID NO: 1154311 - RNA, 15 nt, Human
gagauuauguucuuu

SEQ ID NO: 1154312 - RNA, 22 nt, Human
gagagcuucuguugcugccuca

SEQ ID NO: 1154313 - RNA, 12 nt, Human
gagggccugggc

SEQ ID NO: 1154314 - RNA, 22 nt, Human
gaucaaaccccgaccaccugcc

SEQ ID NO: 1154315 - RNA, 23 nt, Human
gauauuuucaacgcagcccugcu

SEQ ID NO: 1154316 - RNA, 22 nt, Human
gauauuuucaacgcagcccugc

SEQ ID NO: 1154317 - RNA, 21 nt, Human
gauauuuucaacgcagcccug

SEQ ID NO: 1154318 - RNA, 19 nt, Human
gauauuuucaacgcagccc

SEQ ID NO: 1154319 - RNA, 18 nt, Human
gauacuuugauauuuuca

SEQ ID NO: 1154320 - RNA, 17 nt, Human
gaucugaugcaagcaag

SEQ ID NO: 1154321 - RNA, 20 nt, Human
gcaaccuucgccaccugggu

SEQ ID NO: 1154322 - RNA, 17 nt, Human
gcauccuccgccucccg

SEQ ID NO: 1154323 - RNA, 17 nt, Human
gccauugacuucuuccc

SEQ ID NO: 1154324 - RNA, 17 nt, Human
gcccccucugcccugcg

SEQ ID NO: 1154325 - RNA, 16 nt, Human
gcccccucugcccugc

SEQ ID NO: 1154326 - RNA, 15 nt, Human
gcccccucugcccug

SEQ ID NO: 1154327 - RNA, 16 nt, Human
gcccuuccucuccacu

SEQ ID NO: 1154328 - RNA, 15 nt, Human
gcccuuccucuccac

SEQ ID NO: 1154329 - RNA, 14 nt, Human
gcccuuccucucca

SEQ ID NO: 1154330 - RNA, 12 nt, Human
gcccuuccucuc

SEQ ID NO: 1154331 - RNA, 22 nt, Human
gcccuuccaugucgccucugca

SEQ ID NO: 1154332 - RNA, 21 nt, Human
gcccuuccaugucgccucugc

SEQ ID NO: 1154333 - RNA, 12 nt, Human
gcccuuccaugu

SEQ ID NO: 1154334 - RNA, 20 nt, Human
gcccugcgggucacaggagg

SEQ ID NO: 1154335 - RNA, 19 nt, Human
gccuccugaguagcuggga

SEQ ID NO: 1154336 - RNA, 19 nt, Human
gccucaugcuaagacucag

SEQ ID NO: 1154337 - RNA, 17 nt, Human
gcgcaggcuggcccugc

SEQ ID NO: 1154338 - RNA, 16 nt, Human
gcgcaggcuggcccug

SEQ ID NO: 1154339 - RNA, 15 nt, Human
gcgcaggcuggcccu

SEQ ID NO: 1154340 - RNA, 14 nt, Human
gcgcaggcuggccc

SEQ ID NO: 1154341 - RNA, 23 nt, Human
gcugcucuugaacuccugaccuc

SEQ ID NO: 1154342 - RNA, 13 nt, Human
gcugccucaugcu

SEQ ID NO: 1154343 - RNA, 20 nt, Human
gcuggcugccuuagaaccuu

SEQ ID NO: 1154344 - RNA, 14 nt, Human
gcuggcugccuuag

SEQ ID NO: 1154345 - RNA, 11 nt, Human
gcuggcugccu

SEQ ID NO: 1154346 - RNA, 16 nt, Human
gcugugccucugccug

SEQ ID NO: 1154347 - RNA, 15 nt, Human
gcugugccucugccu

SEQ ID NO: 1154348 - RNA, 14 nt, Human
gcugugccucugcc

SEQ ID NO: 1154349 - RNA, 16 nt, Human
ggaaauccaggguggu

SEQ ID NO: 1154350 - RNA, 22 nt, Human
ggacagggcauggccagguggc

SEQ ID NO: 1154351 - RNA, 15 nt, Human
ggacagggcauggcc

SEQ ID NO: 1154352 - RNA, 21 nt, Human
ggaucuuuggacagaagcagc

SEQ ID NO: 1154353 - RNA, 22 nt, Human
ggaucuuuggacagaagcagcu

SEQ ID NO: 1154354 - RNA, 20 nt, Human
ggcagggagggccugggccc

SEQ ID NO: 1154355 - RNA, 19 nt, Human
ggcagggagggccugggcc

SEQ ID NO: 1154356 - RNA, 18 nt, Human
ggcagggagggccugggc

SEQ ID NO: 1154357 - RNA, 17 nt, Human
ggcagggagggccuggg

SEQ ID NO: 1154358 - RNA, 10 nt, Human
ggcagggagg

SEQ ID NO: 1154359 - RNA, 16 nt, Human
ggcagccucuucaaaa

SEQ ID NO: 1154360 - RNA, 20 nt, Human
ggcaucgcaauguaagacuc

SEQ ID NO: 1154361 - RNA, 17 nt, Human
ggccuucagggagugag

SEQ ID NO: 1154362 - RNA, 15 nt, Human
ggccuggcagccgug

SEQ ID NO: 1154363 - RNA, 14 nt, Human
ggccuggcagccgu

SEQ ID NO: 1154364 - RNA, 11 nt, Human
ggccugccugu

SEQ ID NO: 1154365 - RNA, 23 nt, Human
ggcuacaccuuagccugcccucc

SEQ ID NO: 1154366 - RNA, 22 nt, Human
ggcuacaccuuagccugcccuc

SEQ ID NO: 1154367 - RNA, 18 nt, Human
ggcuaauuuuuguuuugu

SEQ ID NO: 1154368 - RNA, 18 nt, Human
ggcgugagaccugccccu

SEQ ID NO: 1154369 - RNA, 17 nt, Human
ggcgugagaccugcccc

SEQ ID NO: 1154370 - RNA, 16 nt, Human
ggcgugagaccugccc

SEQ ID NO: 1154371 - RNA, 14 nt, Human
ggcgugagaccugc

SEQ ID NO: 1154372 - RNA, 18 nt, Human
ggcugcccuuucugggca

SEQ ID NO: 1154373 - RNA, 14 nt, Human
ggcugcccuuucug

SEQ ID NO: 1154374 - RNA, 11 nt, Human
ggcugcccuuu

SEQ ID NO: 1154375 - RNA, 10 nt, Human
ggcugcccuu

SEQ ID NO: 1154376 - RNA, 12 nt, Human
ggcugcccuggu

SEQ ID NO: 1154377 - RNA, 20 nt, Human
aaauauuccugcauuuguga

SEQ ID NO: 1154378 - RNA, 22 nt, Human
guacaaccuguucugcuuuccu

SEQ ID NO: 1154379 - RNA, 17 nt, Human
guaaucgaccugccucg

SEQ ID NO: 1154380 - RNA, 15 nt, Human
guaaucgaccugccu

SEQ ID NO: 1154381 - RNA, 19 nt, Human
gguuuccugcccugggagg

SEQ ID NO: 1154382 - RNA, 16 nt, Human
gguuuccugcccuggg

SEQ ID NO: 1154383 - RNA, 15 nt, Human
gguuuccugcccugg

SEQ ID NO: 1154384 - RNA, 13 nt, Human
gguuuccugcccu

SEQ ID NO: 1154385 - RNA, 12 nt, Human
gguuuccugccc

SEQ ID NO: 1154386 - RNA, 23 nt, Human
gguagggugggccuucagggagu

SEQ ID NO: 1154387 - RNA, 11 nt, Human
gguaggguggg

SEQ ID NO: 1154388 - RNA, 15 nt, Human
gggugguggugauag

SEQ ID NO: 1154389 - RNA, 17 nt, Human
aaaccuucacuuaggaa

SEQ ID NO: 1154390 - RNA, 20 nt, Human
gggcuaggaaauccagggug

SEQ ID NO: 1154391 - RNA, 19 nt, Human
gggcgugagaccugccccu

SEQ ID NO: 1154392 - RNA, 18 nt, Human
gggcgugagaccugcccc

SEQ ID NO: 1154393 - RNA, 23 nt, Human
aaaaugcuguauuagucacagag

SEQ ID NO: 1154394 - RNA, 15 nt, Human
aaaauauuccugcau

SEQ ID NO: 1154395 - RNA, 22 nt, Human
aaaauaugaccacacuccagcu

SEQ ID NO: 1154396 - RNA, 20 nt, Human
ccauaauuuuuuuuuuccuu

SEQ ID NO: 1154397 - RNA, 20 nt, Human
ccagcuugaaaccuucacuu

SEQ ID NO: 1154398 - RNA, 18 nt, Human
ccagcuugaaaccuucac

SEQ ID NO: 1154399 - RNA, 17 nt, Human
ccaggcaacuugggaac

SEQ ID NO: 1154400 - RNA, 22 nt, Human
ccaggauguacaaggacagccc

SEQ ID NO: 1154401 - RNA, 14 nt, Human
ccagucccccugcc

SEQ ID NO: 1154402 - RNA, 22 nt, Human
cccauaauuuuuuuuuuccuuu

SEQ ID NO: 1154403 - RNA, 23 nt, Human
cccauaauuuuuuuuuuccuuuu

SEQ ID NO: 1154404 - RNA, 17 nt, Human
ccccugcaaagcccagc

SEQ ID NO: 1154405 - RNA, 16 nt, Human
ccccugcaaagcccag

SEQ ID NO: 1154406 - RNA, 15 nt, Human
ccccugcaaagccca

SEQ ID NO: 1154407 - RNA, 13 nt, Human
cccggcugcccuu

SEQ ID NO: 1154408 - RNA, 12 nt, Human
cccggcugcccu

SEQ ID NO: 1154409 - RNA, 13 nt, Human
cccucagagccac

SEQ ID NO: 1154410 - RNA, 23 nt, Human
ccucauuuuugaauacaggcaua

SEQ ID NO: 1154411 - RNA, 20 nt, Human
ccugggccccaguuguauuu

SEQ ID NO: 1154412 - RNA, 19 nt, Human
ccuguccugccuaaggcug

SEQ ID NO: 1154413 - RNA, 17 nt, Human
ccuguccugccuaaggc

SEQ ID NO: 1154414 - RNA, 15 nt, Human
ccugguuuccugccc

SEQ ID NO: 1154415 - RNA, 16 nt, Human
ccugguuuccugcccu

SEQ ID NO: 1154416 - RNA, 14 nt, Human
ccugguuuccugcc

SEQ ID NO: 1154417 - RNA, 13 nt, Human
ccugguuuccugc

SEQ ID NO: 1154418 - RNA, 17 nt, Human
ccugugaacugaacucu

SEQ ID NO: 1154419 - RNA, 16 nt, Human
ccugugaacugaacuc

SEQ ID NO: 1154420 - RNA, 18 nt, Human
ccugugacuucagcucug

SEQ ID NO: 1154421 - RNA, 17 nt, Human
ccugccccagggcuccc

SEQ ID NO: 1154422 - RNA, 21 nt, Human
ccugaguagcugggauuacag

SEQ ID NO: 1154423 - RNA, 14 nt, Human
cucaauaaaguaca

SEQ ID NO: 1154424 - RNA, 11 nt, Human
cucacaaaaga

SEQ ID NO: 1154425 - RNA, 17 nt, Human
cuacguuaccaggcagg

SEQ ID NO: 1154426 - RNA, 11 nt, Human
cgugugugugu

SEQ ID NO: 1154427 - RNA, 14 nt, Human
cgacagccuggcac

SEQ ID NO: 1154428 - RNA, 13 nt, Human
cgacagccuggca

SEQ ID NO: 1154429 - RNA, 12 nt, Human
cgacagccuggc

SEQ ID NO: 1154430 - RNA, 15 nt, Human
ccuuucacaaccuuc

SEQ ID NO: 1154431 - RNA, 13 nt, Human
cgcaggcuggccc

SEQ ID NO: 1154432 - RNA, 16 nt, Human
cgagucucuucuccac

SEQ ID NO: 1154433 - RNA, 13 nt, Human
cgccucugcauuc

SEQ ID NO: 1154434 - RNA, 23 nt, Human
cgguguuuaagacauuuuuggaa

SEQ ID NO: 1154435 - RNA, 20 nt, Human
cugaguagcugggauuacag

SEQ ID NO: 1154436 - RNA, 15 nt, Human
cugaguagcugggau

SEQ ID NO: 1154437 - RNA, 14 nt, Human
cugaguagcuggga

SEQ ID NO: 1154438 - RNA, 22 nt, Human
cugaggacuuaaaauauuccug

SEQ ID NO: 1154439 - RNA, 14 nt, Human
cugaggaccagcca

SEQ ID NO: 1154440 - RNA, 19 nt, Human
cugacaacagacuucugaa

SEQ ID NO: 1154441 - RNA, 18 nt, Human
cugacaacagacuucuga

SEQ ID NO: 1154442 - RNA, 15 nt, Human
cugacaacagacuuc

SEQ ID NO: 1154443 - RNA, 20 nt, Human
cucuucaacugaccagccuc

SEQ ID NO: 1154444 - RNA, 17 nt, Human
cucuucaacugaccagc

SEQ ID NO: 1154445 - RNA, 16 nt, Human
cucuucaacugaccag

SEQ ID NO: 1154446 - RNA, 12 nt, Human
cucuguccaggc

SEQ ID NO: 1154447 - RNA, 15 nt, Human
cucuaucaccaagga

SEQ ID NO: 1154448 - RNA, 23 nt, Human
cuccuggggguucuuucuuccuc

SEQ ID NO: 1154449 - RNA, 22 nt, Human
cuccuggggguucuuucuuccu

SEQ ID NO: 1154450 - RNA, 20 nt, Human
cuccuggggguucuuucuuc

SEQ ID NO: 1154451 - RNA, 18 nt, Human
cuccuggggguucuuucu

SEQ ID NO: 1154452 - RNA, 15 nt, Human
cuccuggacuccugc

SEQ ID NO: 1154453 - RNA, 23 nt, Human
cuccucuucaacugaccagccuc

SEQ ID NO: 1154454 - RNA, 18 nt, Human
cuccucuucaacugacca

SEQ ID NO: 1154455 - RNA, 19 nt, Human
cuccucucugcccuaaugc

SEQ ID NO: 1154456 - RNA, 15 nt, Human
cuccucucugcccua

SEQ ID NO: 1154457 - RNA, 14 nt, Human
cuccucucugcccu

SEQ ID NO: 1154458 - RNA, 13 nt, Human
cuccucucugccc

SEQ ID NO: 1154459 - RNA, 13 nt, Human
cucccccaucucu

SEQ ID NO: 1154460 - RNA, 19 nt, Human
cuccaagcuccaucuccac

SEQ ID NO: 1154461 - RNA, 18 nt, Human
cuccaagcuccaucucca

SEQ ID NO: 1154462 - RNA, 14 nt, Human
cuccaagcuccauc

SEQ ID NO: 1154463 - RNA, 16 nt, Human
cucaugccucagccuc

SEQ ID NO: 1154464 - RNA, 12 nt, Human
cucaugccucag

SEQ ID NO: 1154465 - RNA, 17 nt, Human
cucagucucccucccuu

SEQ ID NO: 1154466 - RNA, 16 nt, Human
cucagucucccucccu

SEQ ID NO: 1154467 - RNA, 15 nt, Human
cucagucucccuccc

SEQ ID NO: 1154468 - RNA, 13 nt, Human
cucagucucccuc

SEQ ID NO: 1154469 - RNA, 14 nt, Human
ccacagcugcucaa

SEQ ID NO: 1154470 - RNA, 23 nt, Human
ccacagcgcuggccgggaccccg

SEQ ID NO: 1154471 - RNA, 13 nt, Human
ccacgcccggcua

SEQ ID NO: 1154472 - RNA, 20 nt, Human
cauguuggccaggcugcucu

SEQ ID NO: 1154473 - RNA, 23 nt, Human
caugucccuaccgagucucuucu

SEQ ID NO: 1154474 - RNA, 22 nt, Human
caugucccuaccgagucucuuc

SEQ ID NO: 1154475 - RNA, 16 nt, Human
caugucccuaccgagu

SEQ ID NO: 1154476 - RNA, 19 nt, Human
caugucaaacgugaaaaug

SEQ ID NO: 1154477 - RNA, 14 nt, Human
caugucaaacguga

SEQ ID NO: 1154478 - RNA, 20 nt, Human
caguggggaggggcuguggg

SEQ ID NO: 1154479 - RNA, 18 nt, Human
cagugcaucucagcccac

SEQ ID NO: 1154480 - RNA, 17 nt, Human
cagugcaucucagccca

SEQ ID NO: 1154481 - RNA, 16 nt, Human
cagugcaucucagccc

SEQ ID NO: 1154482 - RNA, 15 nt, Human
cagugcaucucagcc

SEQ ID NO: 1154483 - RNA, 12 nt, Human
cagugcaucuca

SEQ ID NO: 1154484 - RNA, 23 nt, Human
cagguugucugaagucacugcac

SEQ ID NO: 1154485 - RNA, 22 nt, Human
cagguugucugaagucacugca

SEQ ID NO: 1154486 - RNA, 15 nt, Human
caggccacuugauga

SEQ ID NO: 1154487 - RNA, 20 nt, Human
cagagguccacaacacacag

SEQ ID NO: 1154488 - RNA, 15 nt, Human
cagagguccacaaca

SEQ ID NO: 1154489 - RNA, 19 nt, Human
cagauccccaagccuggca

SEQ ID NO: 1154490 - RNA, 13 nt, Human
caagacacaguga

SEQ ID NO: 1154491 - RNA, 22 nt, Human
caacuaugauuuggaaaauaaa

SEQ ID NO: 1154492 - RNA, 19 nt, Human
caacuaugauuuggaaaau

SEQ ID NO: 1154493 - RNA, 18 nt, Human
caacuaugauuuggaaaa

SEQ ID NO: 1154494 - RNA, 17 nt, Human
caacuaugauuuggaaa

SEQ ID NO: 1154495 - RNA, 14 nt, Human
caaccauuccccau

SEQ ID NO: 1154496 - RNA, 13 nt, Human
caaaugcagcuuu

SEQ ID NO: 1154497 - RNA, 19 nt, Human
caauucuccugccucagcc

SEQ ID NO: 1154498 - RNA, 17 nt, Human
caauucuccugccucag

SEQ ID NO: 1154499 - RNA, 14 nt, Human
caccuuuauucugg

SEQ ID NO: 1154500 - RNA, 20 nt, Human
caccuaccaccacgcccggc

SEQ ID NO: 1154501 - RNA, 20 nt, Human
cacuuagaaauugcauuucc

SEQ ID NO: 1154502 - RNA, 24 nt, Human
cacuuagaaauugcauuuccugac

SEQ ID NO: 1154503 - RNA, 19 nt, Human
cacuuagaaauugcauuuc

SEQ ID NO: 1154504 - RNA, 17 nt, Human
cacuuagaaauugcauu

SEQ ID NO: 1154505 - RNA, 22 nt, Human
cacugguggcccgacagccugg

SEQ ID NO: 1154506 - RNA, 21 nt, Human
cacugguggcccgacagccug

SEQ ID NO: 1154507 - RNA, 13 nt, Human
cacugguggcccg

SEQ ID NO: 1154508 - RNA, 22 nt, Human
cagaauauuagugaccucagcu

SEQ ID NO: 1154509 - RNA, 15 nt, Human
cagaaguuucucagc

SEQ ID NO: 1154510 - RNA, 15 nt, Human
cagaacacauaauuc

SEQ ID NO: 1154511 - RNA, 20 nt, Human
auuuucaacgcagcccugcu

SEQ ID NO: 1154512 - RNA, 18 nt, Human
auuuucaacgcagcccug

SEQ ID NO: 1154513 - RNA, 20 nt, Human
auuuccagugaaaucaguua

SEQ ID NO: 1154514 - RNA, 22 nt, Human
auuucauuugugccagaaugcu

SEQ ID NO: 1154515 - RNA, 16 nt, Human
auuucaaacggccuca

SEQ ID NO: 1154516 - RNA, 14 nt, Human
auucuccugccuca

SEQ ID NO: 1154517 - RNA, 13 nt, Human
auucuccugccuc

SEQ ID NO: 1154518 - RNA, 12 nt, Human
auucuccugccu

SEQ ID NO: 1154519 - RNA, 21 nt, Human
auucucaugccucagccuccu

SEQ ID NO: 1154520 - RNA, 15 nt, Human
auucucaugccucag

SEQ ID NO: 1154521 - RNA, 14 nt, Human
auucucaugccuca

SEQ ID NO: 1154522 - RNA, 21 nt, Human
uuuugugaugucccaacuugu

SEQ ID NO: 1154523 - RNA, 12 nt, Human
augugugugugc

SEQ ID NO: 1154524 - RNA, 22 nt, Human
uuucucauuugccaauaauaau

SEQ ID NO: 1154525 - RNA, 21 nt, Human
uuuccuuuuaaaacacuucca

SEQ ID NO: 1154526 - RNA, 15 nt, Human
augggacuggccucu

SEQ ID NO: 1154527 - RNA, 16 nt, Human
uuuauuuuuugggaaa

SEQ ID NO: 1154528 - RNA, 13 nt, Human
uuuauuuuuuggg

SEQ ID NO: 1154529 - RNA, 14 nt, Human
augcuguauauguu

SEQ ID NO: 1154530 - RNA, 23 nt, Human
augcgcaggcuggcccugcccug

SEQ ID NO: 1154531 - RNA, 21 nt, Human
uuuaaaaaauuaaucugggcc

SEQ ID NO: 1154532 - RNA, 17 nt, Human
uuuaaaaaauuaaucug

SEQ ID NO: 1154533 - RNA, 19 nt, Human
uuguuuuuuuuuuccacuu

SEQ ID NO: 1154534 - RNA, 18 nt, Human
uuguuuuuuuuuuccacu

SEQ ID NO: 1154535 - RNA, 15 nt, Human
augauccuaaugaau

SEQ ID NO: 1154536 - RNA, 22 nt, Human
uuguaaaaauuaaaaguuaugg

SEQ ID NO: 1154537 - RNA, 23 nt, Human
augaaagauggcugugccucugc

SEQ ID NO: 1154538 - RNA, 20 nt, Human
augaaagauggcugugccuc

SEQ ID NO: 1154539 - RNA, 19 nt, Human
augaaagauggcugugccu

SEQ ID NO: 1154540 - RNA, 15 nt, Human
aucuaaacugccccc

SEQ ID NO: 1154541 - RNA, 22 nt, Human
uucuccuuucacaaccuucugu

SEQ ID NO: 1154542 - RNA, 18 nt, Human
uucuccuuucacaaccuu

SEQ ID NO: 1154543 - RNA, 17 nt, Human
aucagugcccuccagga

SEQ ID NO: 1154544 - RNA, 15 nt, Human
aucagugcccuccag

SEQ ID NO: 1154545 - RNA, 13 nt, Human
aucagugcccucc

SEQ ID NO: 1154546 - RNA, 13 nt, Human
uuccucugagccu

SEQ ID NO: 1154547 - RNA, 19 nt, Human
uuccucuccacugccuucg

SEQ ID NO: 1154548 - RNA, 18 nt, Human
uuccucuccacugccuuc

SEQ ID NO: 1154549 - RNA, 13 nt, Human
uucccuacuuccu

SEQ ID NO: 1154550 - RNA, 15 nt, Human
uucccgcucagcccu

SEQ ID NO: 1154551 - RNA, 14 nt, Human
uucccgcucagccc

SEQ ID NO: 1154552 - RNA, 12 nt, Human
uucccgcucagc

SEQ ID NO: 1154553 - RNA, 21 nt, Human
auauuccugcauuugugaaau

SEQ ID NO: 1154554 - RNA, 22 nt, Human
uuccagugaaaucaguuacucu

SEQ ID NO: 1154555 - RNA, 15 nt, Human
uuccaccuucccaug

SEQ ID NO: 1154556 - RNA, 14 nt, Human
uucagcucacugca

SEQ ID NO: 1154557 - RNA, 18 nt, Human
uuauacccccugcaaagc

SEQ ID NO: 1154558 - RNA, 14 nt, Human
uuagccccauaauu

SEQ ID NO: 1154559 - RNA, 16 nt, Human
uuagcaguuugcuuug

SEQ ID NO: 1154560 - RNA, 16 nt, Human
aguuucucagcuccca

SEQ ID NO: 1154561 - RNA, 19 nt, Human
uuaaaauauuccugcauuu

SEQ ID NO: 1154562 - RNA, 16 nt, Human
uuaaaauauuccugca

SEQ ID NO: 1154563 - RNA, 17 nt, Human
aguucccuacuuccugu

SEQ ID NO: 1154564 - RNA, 16 nt, Human
uguucccauucuugca

SEQ ID NO: 1154565 - RNA, 18 nt, Human
agucucccucccuugggg

SEQ ID NO: 1154566 - RNA, 14 nt, Human
agucucccucccuu

SEQ ID NO: 1154567 - RNA, 23 nt, Human
ugugaacugaacucugacaacag

SEQ ID NO: 1154568 - RNA, 14 nt, Human
ugugaacugaacuc

SEQ ID NO: 1154569 - RNA, 22 nt, Human
ugucccuaccgagucucuucuc

SEQ ID NO: 1154570 - RNA, 21 nt, Human
ugucccuaccgagucucuucu

SEQ ID NO: 1154571 - RNA, 20 nt, Human
ugucccuaccgagucucuuc

SEQ ID NO: 1154572 - RNA, 21 nt, Human
uguccaggcacugcugcccag

SEQ ID NO: 1154573 - RNA, 20 nt, Human
uguccaggcacugcugccca

SEQ ID NO: 1154574 - RNA, 19 nt, Human
uguccaggcacugcugccc

SEQ ID NO: 1154575 - RNA, 22 nt, Human
agucacagagauaauucuagcu

SEQ ID NO: 1154576 - RNA, 15 nt, Human
uguauuagucacaga

SEQ ID NO: 1154577 - RNA, 20 nt, Human
agguugucugaagucacugc

SEQ ID NO: 1154578 - RNA, 16 nt, Human
agguugucugaaguca

SEQ ID NO: 1154579 - RNA, 20 nt, Human
aggugugagccaccacgccc

SEQ ID NO: 1154580 - RNA, 22 nt, Human
aggugauccacucgccuucauc

SEQ ID NO: 1154581 - RNA, 21 nt, Human
uguaaauacuguuuuuaacaa

SEQ ID NO: 1154582 - RNA, 15 nt, Human
ugguguguguaugcg

SEQ ID NO: 1154583 - RNA, 19 nt, Human
agguccacaacacacagau

SEQ ID NO: 1154584 - RNA, 17 nt, Human
agguccacaacacacag

SEQ ID NO: 1154585 - RNA, 21 nt, Human
uggucucgaacuccugaccuu

SEQ ID NO: 1154586 - RNA, 20 nt, Human
uggucucgaacuccugaccu

SEQ ID NO: 1154587 - RNA, 19 nt, Human
uggucucgaacuccugacc

SEQ ID NO: 1154588 - RNA, 22 nt, Human
ugguaauuuaagauuccagaga

SEQ ID NO: 1154589 - RNA, 22 nt, Human
ugggucuuguuuuuuuuuucca

SEQ ID NO: 1154590 - RNA, 12 nt, Human
aggguagggugg

SEQ ID NO: 1154591 - RNA, 15 nt, Human
agggggaaggcaggg

SEQ ID NO: 1154592 - RNA, 13 nt, Human
ugggaacuagacu

SEQ ID NO: 1154593 - RNA, 17 nt, Human
uggcuucccgcucagcc

SEQ ID NO: 1154594 - RNA, 18 nt, Human
uggcuucccgcucagccc

SEQ ID NO: 1154595 - RNA, 16 nt, Human
uggcuucccgcucagc

SEQ ID NO: 1154596 - RNA, 15 nt, Human
uggcuucccgcucag

SEQ ID NO: 1154597 - RNA, 19 nt, Human
aggcuggcccugcccuggu

SEQ ID NO: 1154598 - RNA, 18 nt, Human
aggcuggcccugcccugg

SEQ ID NO: 1154599 - RNA, 17 nt, Human
aggcuggcccugcccug

SEQ ID NO: 1154600 - RNA, 16 nt, Human
aggcuggcccugcccu

SEQ ID NO: 1154601 - RNA, 15 nt, Human
aggcuggcccugccc

SEQ ID NO: 1154602 - RNA, 14 nt, Human
aggcuggcccugcc

SEQ ID NO: 1154603 - RNA, 12 nt, Human
aggcuggcccug

SEQ ID NO: 1154604 - RNA, 23 nt, Human
aggcugcucuugaacuccugacc

SEQ ID NO: 1154605 - RNA, 20 nt, Human
aggcuccugccaccacgccc

SEQ ID NO: 1154606 - RNA, 14 nt, Human
aggcuccugccacc

SEQ ID NO: 1154607 - RNA, 15 nt, Human
uggccgggagccuga

SEQ ID NO: 1154608 - RNA, 23 nt, Human
uggccgggaccccgagccuggcu

SEQ ID NO: 1154609 - RNA, 15 nt, Human
uggccgggaccccga

SEQ ID NO: 1154610 - RNA, 17 nt, Human
uggccgggaccccgagc

SEQ ID NO: 1154611 - RNA, 19 nt, Human
uggcccgacagccuggcac

SEQ ID NO: 1154612 - RNA, 18 nt, Human
uggcccgacagccuggca

SEQ ID NO: 1154613 - RNA, 17 nt, Human
uggcccgacagccuggc

SEQ ID NO: 1154614 - RNA, 16 nt, Human
uggcccgacagccugg

SEQ ID NO: 1154615 - RNA, 15 nt, Human
uggcccgacagccug

SEQ ID NO: 1154616 - RNA, 14 nt, Human
uggcccgacagccu

SEQ ID NO: 1154617 - RNA, 20 nt, Human
uggccaggcuggucucgaac

SEQ ID NO: 1154618 - RNA, 13 nt, Human
aggccugccuguu

SEQ ID NO: 1154619 - RNA, 16 nt, Human
uggcagccucuucaaa

SEQ ID NO: 1154620 - RNA, 15 nt, Human
uggcagccucuucaa

SEQ ID NO: 1154621 - RNA, 23 nt, Human
uggcagccgugccuucagcucua

SEQ ID NO: 1154622 - RNA, 16 nt, Human
uggcagccgugccuuc

SEQ ID NO: 1154623 - RNA, 19 nt, Human
uggagucagacagaugugg

SEQ ID NO: 1154624 - RNA, 17 nt, Human
aggaugccccguccccc

SEQ ID NO: 1154625 - RNA, 14 nt, Human
aggagggaggggga

SEQ ID NO: 1154626 - RNA, 21 nt, Human
aggagggagcaucagugcccu

SEQ ID NO: 1154627 - RNA, 21 nt, Human
ugcuuugggcugcccuggugc

SEQ ID NO: 1154628 - RNA, 20 nt, Human
ugcuuugggcugcccuggug

SEQ ID NO: 1154629 - RNA, 19 nt, Human
ugcuuugggcugcccuggu

SEQ ID NO: 1154630 - RNA, 18 nt, Human
ugcuuugggcugcccugg

SEQ ID NO: 1154631 - RNA, 21 nt, Human
ugcuggcugccuuagaaccuu

SEQ ID NO: 1154632 - RNA, 15 nt, Human
ugcuggcugccuuag

SEQ ID NO: 1154633 - RNA, 14 nt, Human
ugcugacuguacuc

SEQ ID NO: 1154634 - RNA, 22 nt, Human
agcuggaucuccauucucucag

SEQ ID NO: 1154635 - RNA, 11 nt, Human
ugccucugccu

SEQ ID NO: 1154636 - RNA, 15 nt, Human
ugccucagccuccug

SEQ ID NO: 1154637 - RNA, 15 nt, Human
ugccucagccucccg

SEQ ID NO: 1154638 - RNA, 21 nt, Human
agcucugcagagcaggaaaca

SEQ ID NO: 1154639 - RNA, 17 nt, Human
agcucuaucaccaagga

SEQ ID NO: 1154640 - RNA, 23 nt, Human
ugcccuaaugcgcaggcuggccc

SEQ ID NO: 1154641 - RNA, 20 nt, Human
ugcccuaaugcgcaggcugg

SEQ ID NO: 1154642 - RNA, 18 nt, Human
ugcccccucugcccugcg

SEQ ID NO: 1154643 - RNA, 17 nt, Human
ugcccccucugcccugc

SEQ ID NO: 1154644 - RNA, 16 nt, Human
ugcccccucugcccug

SEQ ID NO: 1154645 - RNA, 15 nt, Human
ugcccccucugcccu

SEQ ID NO: 1154646 - RNA, 14 nt, Human
ugcccccucugccc

SEQ ID NO: 1154647 - RNA, 20 nt, Human
ugccacugccucuuccuccc

SEQ ID NO: 1154648 - RNA, 19 nt, Human
ugccacugccucuuccucc

SEQ ID NO: 1154649 - RNA, 18 nt, Human
ugccacugccucuuccuc

SEQ ID NO: 1154650 - RNA, 17 nt, Human
ugccacugccucuuccu

SEQ ID NO: 1154651 - RNA, 13 nt, Human
ugccacugccucu

SEQ ID NO: 1154652 - RNA, 13 nt, Human
ugcauuuccugac

SEQ ID NO: 1154653 - RNA, 22 nt, Human
agcgcuggccgggaccccgagc

SEQ ID NO: 1154654 - RNA, 16 nt, Human
agcgcuggccgggacc

SEQ ID NO: 1154655 - RNA, 17 nt, Human
agccuccaugcugccuc

SEQ ID NO: 1154656 - RNA, 21 nt, Human
agccuccaagcuccaucucca

SEQ ID NO: 1154657 - RNA, 22 nt, Human
agccucagucucccucccuugg

SEQ ID NO: 1154658 - RNA, 20 nt, Human
agccucagucucccucccuu

SEQ ID NO: 1154659 - RNA, 19 nt, Human
agccucagucucccucccu

SEQ ID NO: 1154660 - RNA, 16 nt, Human
agccucagucucccuc

SEQ ID NO: 1154661 - RNA, 13 nt, Human
agccucagucucc

SEQ ID NO: 1154662 - RNA, 20 nt, Human
agcccugcuuugggcugccc

SEQ ID NO: 1154663 - RNA, 19 nt, Human
agcccugcuuugggcugcc

SEQ ID NO: 1154664 - RNA, 17 nt, Human
agcccugcuuugggcug

SEQ ID NO: 1154665 - RNA, 17 nt, Human
ugauuucagcucacugc

SEQ ID NO: 1154666 - RNA, 16 nt, Human
ugauucucaugccuca

SEQ ID NO: 1154667 - RNA, 15 nt, Human
ugauucucaugccuc

SEQ ID NO: 1154668 - RNA, 14 nt, Human
ugauucucaugccu

SEQ ID NO: 1154669 - RNA, 13 nt, Human
ugauucucaugcc

SEQ ID NO: 1154670 - RNA, 23 nt, Human
agcccagcuugaaaccuucacuu

SEQ ID NO: 1154671 - RNA, 17 nt, Human
ugauuaauggaaauguu

SEQ ID NO: 1154672 - RNA, 17 nt, Human
ugauggugaugaaaugu

SEQ ID NO: 1154673 - RNA, 16 nt, Human
ugauggugaugaaaug

SEQ ID NO: 1154674 - RNA, 15 nt, Human
ugauggugaugaaau

SEQ ID NO: 1154675 - RNA, 17 nt, Human
agcaccuagccucgcuc

SEQ ID NO: 1154676 - RNA, 16 nt, Human
ugagcauuagauuucu

SEQ ID NO: 1154677 - RNA, 14 nt, Human
ugagcauuagauuu

SEQ ID NO: 1154678 - RNA, 15 nt, Human
ugagcaaauguggcu

SEQ ID NO: 1154679 - RNA, 20 nt, Human
ugagacagaaucucgcucug

SEQ ID NO: 1154680 - RNA, 22 nt, Human
agauuccagagaguggcuccuc

SEQ ID NO: 1154681 - RNA, 21 nt, Human
agauuccagagaguggcuccu

SEQ ID NO: 1154682 - RNA, 21 nt, Human
ugacucguauaugucucaggu

SEQ ID NO: 1154683 - RNA, 18 nt, Human
agauccccaagccuggca

SEQ ID NO: 1154684 - RNA, 15 nt, Human
ugaaguaagcaaaga

SEQ ID NO: 1154685 - RNA, 14 nt, Human
ugaaguaagcaaag

SEQ ID NO: 1154686 - RNA, 13 nt, Human
ugaaguaagcaaa

SEQ ID NO: 1154687 - RNA, 15 nt, Human
ugaacuccugaccuc

SEQ ID NO: 1154688 - RNA, 23 nt, Human
ugaaauagacccacaagaggcag

SEQ ID NO: 1154689 - RNA, 16 nt, Human
ucuuuuuuugugaugu

SEQ ID NO: 1154690 - RNA, 14 nt, Human
ucuuuuuuugugau

SEQ ID NO: 1154691 - RNA, 17 nt, Human
agagaguggcuccuccc

SEQ ID NO: 1154692 - RNA, 16 nt, Human
agacucccaagcugga

SEQ ID NO: 1154693 - RNA, 21 nt, Human
agacuccagcuggguuggaaa

SEQ ID NO: 1154694 - RNA, 15 nt, Human
ucuguugcugccuca

SEQ ID NO: 1154695 - RNA, 15 nt, Human
ucugggccagaauuu

SEQ ID NO: 1154696 - RNA, 14 nt, Human
ucugggccagaauu

SEQ ID NO: 1154697 - RNA, 16 nt, Human
agaauagaugcugacu

SEQ ID NO: 1154698 - RNA, 20 nt, Human
agaaguggggacagagcaga

SEQ ID NO: 1154699 - RNA, 18 nt, Human
ucugcuuuccucuuccug

SEQ ID NO: 1154700 - RNA, 13 nt, Human
ucugcuuuccucu

SEQ ID NO: 1154701 - RNA, 12 nt, Human
ucugcuuuccuc

SEQ ID NO: 1154702 - RNA, 22 nt, Human
ucugcccugcgggucacaggag

SEQ ID NO: 1154703 - RNA, 12 nt, Human
ucugcccugcgg

SEQ ID NO: 1154704 - RNA, 11 nt, Human
ucugcccugcg

SEQ ID NO: 1154705 - RNA, 10 nt, Human
ucugcccugc

SEQ ID NO: 1154706 - RNA, 20 nt, Human
agaaauugcauuuccugaca

SEQ ID NO: 1154707 - RNA, 17 nt, Human
agaaauugcauuuccug

SEQ ID NO: 1154708 - RNA, 21 nt, Human
ucugaugcaagcaagaaacac

SEQ ID NO: 1154709 - RNA, 16 nt, Human
ucugaugcaagcaaga

SEQ ID NO: 1154710 - RNA, 16 nt, Human
ucuccuuucacaaccu

SEQ ID NO: 1154711 - RNA, 19 nt, Human
ucucauuugccaauaauaa

SEQ ID NO: 1154712 - RNA, 21 nt, Human
ucucaugccucagccuccuga

SEQ ID NO: 1154713 - RNA, 19 nt, Human
acuuccccuuccuaauucc

SEQ ID NO: 1154714 - RNA, 13 nt, Human
acuuccccuuccu

SEQ ID NO: 1154715 - RNA, 14 nt, Human
acuuagcugggaga

SEQ ID NO: 1154716 - RNA, 23 nt, Human
ucuacagcuaaucagcauucuca

SEQ ID NO: 1154717 - RNA, 20 nt, Human
ucuacagcuaaucagcauuc

SEQ ID NO: 1154718 - RNA, 22 nt, Human
uccugcacacgcuccuuccucu

SEQ ID NO: 1154719 - RNA, 21 nt, Human
uccugcacacgcuccuuccuc

SEQ ID NO: 1154720 - RNA, 14 nt, Human
uccugcacacgcuc

SEQ ID NO: 1154721 - RNA, 23 nt, Human
acugcacagugcaucucagccca

SEQ ID NO: 1154722 - RNA, 20 nt, Human
acugcaacuuguaaaugugg

SEQ ID NO: 1154723 - RNA, 20 nt, Human
acugaacucugacaacagac

SEQ ID NO: 1154724 - RNA, 21 nt, Human
uccugaauuuuauuuuuuggg

SEQ ID NO: 1154725 - RNA, 21 nt, Human
uccucccaggcgccccuuccc

SEQ ID NO: 1154726 - RNA, 19 nt, Human
uccucccaggcgccccuuc

SEQ ID NO: 1154727 - RNA, 13 nt, Human
uccucccaggcgc

SEQ ID NO: 1154728 - RNA, 16 nt, Human
acucugccuccucuuc

SEQ ID NO: 1154729 - RNA, 12 nt, Human
acucugccuccu

SEQ ID NO: 1154730 - RNA, 18 nt, Human
uccgguguuuaagacauu

SEQ ID NO: 1154731 - RNA, 12 nt, Human
acuccucccagg

SEQ ID NO: 1154732 - RNA, 21 nt, Human
acuccagaccccuggcuuuuc

SEQ ID NO: 1154733 - RNA, 19 nt, Human
acuccagaccccuggcuuu

SEQ ID NO: 1154734 - RNA, 18 nt, Human
acuccagaccccuggcuu

SEQ ID NO: 1154735 - RNA, 15 nt, Human
acuccagaccccugg

SEQ ID NO: 1154736 - RNA, 19 nt, Human
acuagacucccaagcugga

SEQ ID NO: 1154737 - RNA, 15 nt, Human
acguuaccaggcagg

SEQ ID NO: 1154738 - RNA, 15 nt, Human
acgcuccuuccucug

SEQ ID NO: 1154739 - RNA, 14 nt, Human
acgcuccuuccucu

SEQ ID NO: 1154740 - RNA, 13 nt, Human
uccagaccccugg

SEQ ID NO: 1154741 - RNA, 18 nt, Human
uccagaauggucuuucua

SEQ ID NO: 1154742 - RNA, 11 nt, Human
ucaugauuuuu

SEQ ID NO: 1154743 - RNA, 13 nt, Human
ucauccauccagg

SEQ ID NO: 1154744 - RNA, 18 nt, Human
accgagucucuucuccac

SEQ ID NO: 1154745 - RNA, 17 nt, Human
accgagucucuucucca

SEQ ID NO: 1154746 - RNA, 16 nt, Human
accgagucucuucucc

SEQ ID NO: 1154747 - RNA, 20 nt, Human
ucaguggggcccauggaugu

SEQ ID NO: 1154748 - RNA, 16 nt, Human
ucaguggggaggggcu

SEQ ID NO: 1154749 - RNA, 20 nt, Human
ucagugcccuccaggauaga

SEQ ID NO: 1154750 - RNA, 21 nt, Human
acccggaggggccuggcagcc

SEQ ID NO: 1154751 - RNA, 18 nt, Human
acccggaggggccuggca

SEQ ID NO: 1154752 - RNA, 19 nt, Human
acccucgaggcggaucuuu

SEQ ID NO: 1154753 - RNA, 21 nt, Human
accccuggcuuuucacugcug

SEQ ID NO: 1154754 - RNA, 20 nt, Human
accccuggcuuuucacugcu

SEQ ID NO: 1154755 - RNA, 19 nt, Human
accccuggcuuuucacugc

SEQ ID NO: 1154756 - RNA, 18 nt, Human
accccuggcuuuucacug

SEQ ID NO: 1154757 - RNA, 15 nt, Human
accccugagcuugca

SEQ ID NO: 1154758 - RNA, 17 nt, Human
ucagcccucccugcccc

SEQ ID NO: 1154759 - RNA, 16 nt, Human
ucagcccucccugccc

SEQ ID NO: 1154760 - RNA, 15 nt, Human
ucagcccucccugcc

SEQ ID NO: 1154761 - RNA, 14 nt, Human
ucagcccucccugc

SEQ ID NO: 1154762 - RNA, 13 nt, Human
ucagcccucccug

SEQ ID NO: 1154763 - RNA, 13 nt, Human
ucacugcauccuc

SEQ ID NO: 1154764 - RNA, 20 nt, Human
ucacuaucccggcugcccuu

SEQ ID NO: 1154765 - RNA, 19 nt, Human
ucacuaucccggcugcccu

SEQ ID NO: 1154766 - RNA, 16 nt, Human
ucacuaggcuucuggu

SEQ ID NO: 1154767 - RNA, 22 nt, Human
ucaccauguuggccaggcuggu

SEQ ID NO: 1154768 - RNA, 23 nt, Human
ucacagaugugugauucacagug

SEQ ID NO: 1154769 - RNA, 21 nt, Human
ucacagaugugugauucacag

SEQ ID NO: 1154770 - RNA, 14 nt, Human
ucacaaccuucugu

SEQ ID NO: 1154771 - RNA, 18 nt, Human
ucaaccauuccccauggg

SEQ ID NO: 1154772 - RNA, 15 nt, Human
ucaaccauuccccau

SEQ ID NO: 1154773 - RNA, 22 nt, Human
acaggcuccugccaccacgccc

SEQ ID NO: 1154774 - RNA, 21 nt, Human
acaggcuccugccaccacgcc

SEQ ID NO: 1154775 - RNA, 15 nt, Human
acaggcuccugccac

SEQ ID NO: 1154776 - RNA, 13 nt, Human
acaggcuccugcc

SEQ ID NO: 1154777 - RNA, 12 nt, Human
acaggcuccugc

SEQ ID NO: 1154778 - RNA, 22 nt, Human
acaggcgugagccaccgugccu

SEQ ID NO: 1154779 - RNA, 21 nt, Human
uauuagugaccucagcuuuga

SEQ ID NO: 1154780 - RNA, 19 nt, Human
uauuagugaccucagcuuu

SEQ ID NO: 1154781 - RNA, 15 nt, Human
acaggacucugccuc

SEQ ID NO: 1154782 - RNA, 14 nt, Human
acaggacucugccu

SEQ ID NO: 1154783 - RNA, 11 nt, Human
acagccuggca

SEQ ID NO: 1154784 - RNA, 12 nt, Human
acagccuggcac

SEQ ID NO: 1154785 - RNA, 18 nt, Human
acagccguuuguucccca

SEQ ID NO: 1154786 - RNA, 15 nt, Human
acagauuugagcuca

SEQ ID NO: 1154787 - RNA, 14 nt, Human
acagauuugagcuc

SEQ ID NO: 1154788 - RNA, 22 nt, Human
acagaucucugcuuuggaaauc

SEQ ID NO: 1154789 - RNA, 18 nt, Human
acagauccccaagccugg

SEQ ID NO: 1154790 - RNA, 17 nt, Human
acagauccccaagccug

SEQ ID NO: 1154791 - RNA, 21 nt, Human
acaccuuagccugcccuccuu

SEQ ID NO: 1154792 - RNA, 16 nt, Human
acaccgggccuggaga

SEQ ID NO: 1154793 - RNA, 14 nt, Human
acaccgggccugga

SEQ ID NO: 1154794 - RNA, 16 nt, Human
uaggaaauccagggug

SEQ ID NO: 1154795 - RNA, 19 nt, Human
acaaggacuaggguccugg

SEQ ID NO: 1154796 - RNA, 18 nt, Human
acaaggacuaggguccug

SEQ ID NO: 1154797 - RNA, 22 nt, Human
acaaggacagccccuccuccau

SEQ ID NO: 1154798 - RNA, 23 nt, Human
uagaugcugacuguacuccuccc

SEQ ID NO: 1154799 - RNA, 20 nt, Human
uacuaucaugucaaacguga

SEQ ID NO: 1154800 - RNA, 24 nt, Human
uacgcuccaucgcugucaucucag

SEQ ID NO: 1154801 - RNA, 22 nt, Human
aauuaaucugggccagaauuuc

SEQ ID NO: 1154802 - RNA, 11 nt, Human
aaugugugugu

SEQ ID NO: 1154803 - RNA, 20 nt, Human
uacagauccccaagccuggc

SEQ ID NO: 1154804 - RNA, 23 nt, Human
aauggcacaaucucggcucacug

SEQ ID NO: 1154805 - RNA, 22 nt, Human
aaugcuguauuagucacagaga

SEQ ID NO: 1154806 - RNA, 17 nt, Human
aaugaaugcauaaaaug

SEQ ID NO: 1154807 - RNA, 15 nt, Human
uaaugaaugcauaaa

SEQ ID NO: 1154808 - RNA, 18 nt, Human
aaucugggccagaauuuc

SEQ ID NO: 1154809 - RNA, 17 nt, Human
aaucugggccagaauuu

SEQ ID NO: 1154810 - RNA, 16 nt, Human
aaucugggccagaauu

SEQ ID NO: 1154811 - RNA, 15 nt, Human
aaucgaccugccucg

SEQ ID NO: 1154812 - RNA, 21 nt, Human
uaagauuccagagaguggcuc

SEQ ID NO: 1154813 - RNA, 14 nt, Human
uaagauuccagaga

SEQ ID NO: 1154814 - RNA, 15 nt, Human
aauauuccugcauuu

SEQ ID NO: 1154815 - RNA, 14 nt, Human
aauaguuguugauu

SEQ ID NO: 1154816 - RNA, 20 nt, Human
aaguucccuacuuccuguga

SEQ ID NO: 1154817 - RNA, 17 nt, Human
aaguucccuacuuccug

SEQ ID NO: 1154818 - RNA, 14 nt, Human
aaguucccuacuuc

SEQ ID NO: 1154819 - RNA, 23 nt, Human
aaguuaagaauguucuuauguug

SEQ ID NO: 1154820 - RNA, 11 nt, Human
aaguuaagaau

SEQ ID NO: 1154821 - RNA, 17 nt, Human
aagugauucucaugccu

SEQ ID NO: 1154822 - RNA, 19 nt, Human
aagugauucucaugccuca

SEQ ID NO: 1154823 - RNA, 16 nt, Human
aagugauucucaugcc

SEQ ID NO: 1154824 - RNA, 13 nt, Human
aagugauucucau

SEQ ID NO: 1154825 - RNA, 22 nt, Human
uaaaaagcuccaaaugcagcuu

SEQ ID NO: 1154826 - RNA, 22 nt, Human
aagucacugcacagugcaucuc

SEQ ID NO: 1154827 - RNA, 13 nt, Human
guuuggagacaga

SEQ ID NO: 1154828 - RNA, 20 nt, Human
guuugcuuuguaugcacuuu

SEQ ID NO: 1154829 - RNA, 23 nt, Human
aagguuucagaaagaagugggga

SEQ ID NO: 1154830 - RNA, 15 nt, Human
aagccguggcuuccc

SEQ ID NO: 1154831 - RNA, 14 nt, Human
aagccguggcuucc

SEQ ID NO: 1154832 - RNA, 13 nt, Human
aagccguggcuuc

SEQ ID NO: 1154833 - RNA, 23 nt, Human
guuacucuucaguuaagccuuug

SEQ ID NO: 1154834 - RNA, 19 nt, Human
guuaauauuuauaggucac

SEQ ID NO: 1154835 - RNA, 13 nt, Human
aagcccagcuuga

SEQ ID NO: 1154836 - RNA, 18 nt, Human
aagauggcugugccucug

SEQ ID NO: 1154837 - RNA, 16 nt, Human
aagauggcugugccuc

SEQ ID NO: 1154838 - RNA, 20 nt, Human
gugauucacagugugaaucu

SEQ ID NO: 1154839 - RNA, 23 nt, Human
gugaugguuccccuguucacucu

SEQ ID NO: 1154840 - RNA, 21 nt, Human
aacugcccccucugcccugcg

SEQ ID NO: 1154841 - RNA, 20 nt, Human
aacugcccccucugcccugc

SEQ ID NO: 1154842 - RNA, 19 nt, Human
aacugcccccucugcccug

SEQ ID NO: 1154843 - RNA, 18 nt, Human
aacugcccccucugcccu

SEQ ID NO: 1154844 - RNA, 17 nt, Human
aacugcccccucugccc

SEQ ID NO: 1154845 - RNA, 16 nt, Human
aacugcccccucugcc

SEQ ID NO: 1154846 - RNA, 16 nt, Human
aacucugacaacagac

SEQ ID NO: 1154847 - RNA, 23 nt, Human
gugagaccugccccuccucucug

SEQ ID NO: 1154848 - RNA, 16 nt, Human
gugagaccugccccuc

SEQ ID NO: 1154849 - RNA, 15 nt, Human
gugagaccugccccu

SEQ ID NO: 1154850 - RNA, 14 nt, Human
gugagaccugcccc

SEQ ID NO: 1154851 - RNA, 13 nt, Human
gugagaccugccc

SEQ ID NO: 1154852 - RNA, 16 nt, Human
gugacuucagcucugu

SEQ ID NO: 1154853 - RNA, 22 nt, Human
gugacauguguuggcagccucu

SEQ ID NO: 1154854 - RNA, 14 nt, Human
aacuccugaccuca

SEQ ID NO: 1154855 - RNA, 12 nt, Human
aacuccugaccu

SEQ ID NO: 1154856 - RNA, 15 nt, Human
aacuauguugauaaa

SEQ ID NO: 1154857 - RNA, 12 nt, Human
aacgugaaaaug

SEQ ID NO: 1154858 - RNA, 21 nt, Human
aaccuucgccaccuggguucc

SEQ ID NO: 1154859 - RNA, 23 nt, Human
aaccuggucacaggacucugccu

SEQ ID NO: 1154860 - RNA, 22 nt, Human
gucuuguuuuuuuuuuccacuu

SEQ ID NO: 1154861 - RNA, 12 nt, Human
gucgccucugca

SEQ ID NO: 1154862 - RNA, 17 nt, Human
gucacuuuguuuuacug

SEQ ID NO: 1154863 - RNA, 23 nt, Human
gucacugcacagugcaucucagc

SEQ ID NO: 1154864 - RNA, 20 nt, Human
gucacugcacagugcaucuc

SEQ ID NO: 1154865 - RNA, 16 nt, Human
gucacaggagggaggg

SEQ ID NO: 1154866 - RNA, 19 nt, Human
gucacaggacucugccucc

SEQ ID NO: 1154867 - RNA, 18 nt, Human
gucacaggacucugccuc

SEQ ID NO: 1154868 - RNA, 17 nt, Human
gucacaggacucugccu

SEQ ID NO: 1154869 - RNA, 18 nt, Human
aaauugucagaugcugug

SEQ ID NO: 1154870 - RNA, 19 nt, Human
aaauuaggauuucaugauu

SEQ ID NO: 1154871 - RNA, 18 nt, Human
aaauuaggauuucaugau

SEQ ID NO: 1154872 - RNA, 14 nt, Human
aaauuaaucugggc

SEQ ID NO: 1154873 - RNA, 15 nt, Human
aaauguggcuccugg

SEQ ID NO: 1154874 - RNA, 14 nt, Human
aaaugucuuccugg

SEQ ID NO: 1154875 - RNA, 11 nt, Human
guauuuauuca

SEQ ID NO: 1154876 - RNA, 21 nt, Human
cacauagugaugguuccccug

SEQ ID NO: 1154877 - RNA, 17 nt, Human
cacagugcaucucagcc

SEQ ID NO: 1154878 - RNA, 14 nt, Human
cacagugcaucuca

SEQ ID NO: 1154879 - RNA, 21 nt, Human
cacaggagggagggggaaggc

SEQ ID NO: 1154880 - RNA, 19 nt, Human
cacaggagggagggggaag

SEQ ID NO: 1154881 - RNA, 14 nt, Human
cacaggagggaggg

SEQ ID NO: 1154882 - RNA, 16 nt, Human
caauucuccugccuca

SEQ ID NO: 1154883 - RNA, 15 nt, Human
caauucuccugccuc

SEQ ID NO: 1154884 - RNA, 14 nt, Human
caauucuccugccu

SEQ ID NO: 1154885 - RNA, 13 nt, Human
caauucuccugcc

SEQ ID NO: 1154886 - RNA, 19 nt, Human
caaguggcucccacacccu

SEQ ID NO: 1154887 - RNA, 21 nt, Human
caagugauucucaugccucag

SEQ ID NO: 1154888 - RNA, 20 nt, Human
caagugauucucaugccuca

SEQ ID NO: 1154889 - RNA, 18 nt, Human
caagugauucucaugccu

SEQ ID NO: 1154890 - RNA, 17 nt, Human
caagugauucucaugcc

SEQ ID NO: 1154891 - RNA, 19 nt, Human
caaggguagggugggccuu

SEQ ID NO: 1154892 - RNA, 18 nt, Human
caaggguagggugggccu

SEQ ID NO: 1154893 - RNA, 22 nt, Human
caaggacugcagggacugccag

SEQ ID NO: 1154894 - RNA, 15 nt, Human
caaggacugcaggga

SEQ ID NO: 1154895 - RNA, 18 nt, Human
caaggacagccccuccuc

SEQ ID NO: 1154896 - RNA, 14 nt, Human
caagccuggcaagg

SEQ ID NO: 1154897 - RNA, 18 nt, Human
caagccguggcuucccgc

SEQ ID NO: 1154898 - RNA, 17 nt, Human
caagagggcacuggugg

SEQ ID NO: 1154899 - RNA, 15 nt, Human
caagagggcacuggu

SEQ ID NO: 1154900 - RNA, 14 nt, Human
caagagggcacugg

SEQ ID NO: 1154901 - RNA, 13 nt, Human
caagagggcacug

SEQ ID NO: 1154902 - RNA, 19 nt, Human
caacugaccagccuccaug

SEQ ID NO: 1154903 - RNA, 17 nt, Human
caacugaccagccucca

SEQ ID NO: 1154904 - RNA, 15 nt, Human
caacugaccagccuc

SEQ ID NO: 1154905 - RNA, 16 nt, Human
caaccuucuguggcuc

SEQ ID NO: 1154906 - RNA, 19 nt, Human
caaccuucgccaccugggu

SEQ ID NO: 1154907 - RNA, 20 nt, Human
caaccuguucugcuuuccuc

SEQ ID NO: 1154908 - RNA, 17 nt, Human
caacccuggcacccagg

SEQ ID NO: 1154909 - RNA, 18 nt, Human
caacccucagagccaccc

SEQ ID NO: 1154910 - RNA, 13 nt, Human
caacccucagagc

SEQ ID NO: 1154911 - RNA, 15 nt, Human
caaaugucuuccugg

SEQ ID NO: 1154912 - RNA, 19 nt, Human
caaagugcugggauuacag

SEQ ID NO: 1154913 - RNA, 13 nt, Human
uuuuuuccacuua

SEQ ID NO: 1154914 - RNA, 17 nt, Human
uuuuacaauaaaaucuu

SEQ ID NO: 1154915 - RNA, 19 nt, Human
uuuuacaaaaaagaaaaga

SEQ ID NO: 1154916 - RNA, 20 nt, Human
uuuuaaacccuauugguaaa

SEQ ID NO: 1154917 - RNA, 14 nt, Human
uuuguauuuuuagu

SEQ ID NO: 1154918 - RNA, 22 nt, Human
uuucacaaccuucuguggcuca

SEQ ID NO: 1154919 - RNA, 16 nt, Human
uuucacaaccuucugu

SEQ ID NO: 1154920 - RNA, 21 nt, Human
uuucaacgcagcccugcuuug

SEQ ID NO: 1154921 - RNA, 20 nt, Human
uuucaacgcagcccugcuuu

SEQ ID NO: 1154922 - RNA, 16 nt, Human
uuucaacgcagcccug

SEQ ID NO: 1154923 - RNA, 15 nt, Human
uuucaacgcagcccu

SEQ ID NO: 1154924 - RNA, 16 nt, Human
uuuacagcugccugca

SEQ ID NO: 1154925 - RNA, 15 nt, Human
uuuacagcugccugc

SEQ ID NO: 1154926 - RNA, 19 nt, Human
uuuaagacauuuuuggaag

SEQ ID NO: 1154927 - RNA, 23 nt, Human
uuuaacaacuaugauuuggaaaa

SEQ ID NO: 1154928 - RNA, 18 nt, Human
uuguuuggagacagaguc

SEQ ID NO: 1154929 - RNA, 21 nt, Human
uuguggaaaaugaaaauuagg

SEQ ID NO: 1154930 - RNA, 21 nt, Human
uugugccagaaugcuuuagga

SEQ ID NO: 1154931 - RNA, 16 nt, Human
uugugccagaaugcuu

SEQ ID NO: 1154932 - RNA, 14 nt, Human
uugugaaaugaugg

SEQ ID NO: 1154933 - RNA, 21 nt, Human
uugucugaagucacugcacag

SEQ ID NO: 1154934 - RNA, 13 nt, Human
uuguaaauuguca

SEQ ID NO: 1154935 - RNA, 21 nt, Human
uuguaaaugugguaaagaguu

SEQ ID NO: 1154936 - RNA, 16 nt, Human
uuguaaaugugguaaa

SEQ ID NO: 1154937 - RNA, 17 nt, Human
uugaugacccccaacca

SEQ ID NO: 1154938 - RNA, 17 nt, Human
uugaacuccugaccuca

SEQ ID NO: 1154939 - RNA, 15 nt, Human
uucuggcagaggagg

SEQ ID NO: 1154940 - RNA, 18 nt, Human
uucugcuuuccucuuccu

SEQ ID NO: 1154941 - RNA, 12 nt, Human
uucuccacugga

SEQ ID NO: 1154942 - RNA, 20 nt, Human
uucucauuugccaauaauaa

SEQ ID NO: 1154943 - RNA, 13 nt, Human
uucuacuauuuau

SEQ ID NO: 1154944 - RNA, 23 nt, Human
uucuaaugugugaaucagagcac

SEQ ID NO: 1154945 - RNA, 15 nt, Human
uuccugcauuuguga

SEQ ID NO: 1154946 - RNA, 16 nt, Human
uuccaugucgccucug

SEQ ID NO: 1154947 - RNA, 21 nt, Human
uucacaaccuucuguggcuca

SEQ ID NO: 1154948 - RNA, 15 nt, Human
uucaaccauucccca

SEQ ID NO: 1154949 - RNA, 19 nt, Human
uuagugaccucagcuuuga

SEQ ID NO: 1154950 - RNA, 16 nt, Human
ugucucaggucccugc

SEQ ID NO: 1154951 - RNA, 19 nt, Human
ugucucaagagggcacugg

SEQ ID NO: 1154952 - RNA, 18 nt, Human
ugucucaagagggcacug

SEQ ID NO: 1154953 - RNA, 17 nt, Human
ugucucaagagggcacu

SEQ ID NO: 1154954 - RNA, 22 nt, Human
uguccugccuaaggcugaacuu

SEQ ID NO: 1154955 - RNA, 13 nt, Human
uguccccuauccu

SEQ ID NO: 1154956 - RNA, 13 nt, Human
ugucaucucagcu

SEQ ID NO: 1154957 - RNA, 13 nt, Human
uguaugcgugugu

SEQ ID NO: 1154958 - RNA, 22 nt, Human
uguaugaaagauggcugugccu

SEQ ID NO: 1154959 - RNA, 13 nt, Human
ugguugcauccua

SEQ ID NO: 1154960 - RNA, 23 nt, Human
ugguuccuccccuccuccuggac

SEQ ID NO: 1154961 - RNA, 18 nt, Human
ugguuccuccccuccucc

SEQ ID NO: 1154962 - RNA, 12 nt, Human
ugguuccucccc

SEQ ID NO: 1154963 - RNA, 23 nt, Human
ugguuccccuguucacucuacuu

SEQ ID NO: 1154964 - RNA, 20 nt, Human
ugguuccccuguucacucua

SEQ ID NO: 1154965 - RNA, 19 nt, Human
ugguuccccuguucacucu

SEQ ID NO: 1154966 - RNA, 18 nt, Human
ugguuccccuguucacuc

SEQ ID NO: 1154967 - RNA, 11 nt, Human
ugguuccccug

SEQ ID NO: 1154968 - RNA, 21 nt, Human
ugguggcccgacagccuggca

SEQ ID NO: 1154969 - RNA, 19 nt, Human
ugguggcccgacagccugg

SEQ ID NO: 1154970 - RNA, 19 nt, Human
ugggaucacauguggacuu

SEQ ID NO: 1154971 - RNA, 22 nt, Human
uggcuuuucacugcuggcugcc

SEQ ID NO: 1154972 - RNA, 21 nt, Human
uggcuuuucacugcuggcugc

SEQ ID NO: 1154973 - RNA, 19 nt, Human
uggcuuuucacugcuggcu

SEQ ID NO: 1154974 - RNA, 18 nt, Human
uggcuuuucacugcuggc

SEQ ID NO: 1154975 - RNA, 16 nt, Human
uggcuuuucacugcug

SEQ ID NO: 1154976 - RNA, 22 nt, Human
uggcuucccgcucagcccuccc

SEQ ID NO: 1154977 - RNA, 21 nt, Human
uggcuucccgcucagcccucc

SEQ ID NO: 1154978 - RNA, 20 nt, Human
uggcuucccgcucagcccuc

SEQ ID NO: 1154979 - RNA, 19 nt, Human
uggcuucccgcucagcccu

SEQ ID NO: 1154980 - RNA, 17 nt, Human
uggcuccagcuggccgg

SEQ ID NO: 1154981 - RNA, 13 nt, Human
ugcuuuggaaauc

SEQ ID NO: 1154982 - RNA, 16 nt, Human
ugcuuguuaacugagu

SEQ ID NO: 1154983 - RNA, 14 nt, Human
ugcuuguuaacuga

SEQ ID NO: 1154984 - RNA, 13 nt, Human
ugccucuuccucc

SEQ ID NO: 1154985 - RNA, 18 nt, Human
ugccucugccugucuccc

SEQ ID NO: 1154986 - RNA, 14 nt, Human
ugccucugccuguc

SEQ ID NO: 1154987 - RNA, 13 nt, Human
ugccucugccugu

SEQ ID NO: 1154988 - RNA, 15 nt, Human
ugcccugguuuccug

SEQ ID NO: 1154989 - RNA, 21 nt, Human
ugcccuggugcugccacacuu

SEQ ID NO: 1154990 - RNA, 20 nt, Human
ugcccuggugcugccacacu

SEQ ID NO: 1154991 - RNA, 18 nt, Human
ugcccuggauccaucagg

SEQ ID NO: 1154992 - RNA, 23 nt, Human
ugcccugcugagucccaggcuga

SEQ ID NO: 1154993 - RNA, 22 nt, Human
ugcccugcugagucccaggcug

SEQ ID NO: 1154994 - RNA, 18 nt, Human
ugcccugcugagucccag

SEQ ID NO: 1154995 - RNA, 19 nt, Human
ugcccugcgggucacagga

SEQ ID NO: 1154996 - RNA, 15 nt, Human
ugccaccacgcccgg

SEQ ID NO: 1154997 - RNA, 15 nt, Human
ugcauccuccgccuc

SEQ ID NO: 1154998 - RNA, 14 nt, Human
ugcauccuccgccu

SEQ ID NO: 1154999 - RNA, 19 nt, Human
ugcagagguccacaacaca

SEQ ID NO: 1155000 - RNA, 18 nt, Human
ugcacagugcaucucagc

SEQ ID NO: 1155001 - RNA, 17 nt, Human
ugcacagugcaucucag

SEQ ID NO: 1155002 - RNA, 16 nt, Human
ugcacagugcaucuca

SEQ ID NO: 1155003 - RNA, 15 nt, Human
ugcacagugcaucuc

SEQ ID NO: 1155004 - RNA, 17 nt, Human
ugcacaaagcccuucca

SEQ ID NO: 1155005 - RNA, 15 nt, Human
ugcacaaagcccuuc

SEQ ID NO: 1155006 - RNA, 18 nt, Human
ugcaacuuguaaaugugg

SEQ ID NO: 1155007 - RNA, 16 nt, Human
ugcaacuuguaaaugu

SEQ ID NO: 1155008 - RNA, 21 nt, Human
ugcaaccuucgccaccugggu

SEQ ID NO: 1155009 - RNA, 18 nt, Human
ugcaaccuucgccaccug

SEQ ID NO: 1155010 - RNA, 16 nt, Human
ugauuuuuuuuuuuca

SEQ ID NO: 1155011 - RNA, 13 nt, Human
ugauuuuuuucca

SEQ ID NO: 1155012 - RNA, 21 nt, Human
ugaucugaugcaagcaagaaa

SEQ ID NO: 1155013 - RNA, 20 nt, Human
ugaucugaugcaagcaagaa

SEQ ID NO: 1155014 - RNA, 14 nt, Human
ugauccacucgccu

SEQ ID NO: 1155015 - RNA, 18 nt, Human
ugauagguauaaguggug

SEQ ID NO: 1155016 - RNA, 23 nt, Human
ugaggacuuaaaauauuccugca

SEQ ID NO: 1155017 - RNA, 22 nt, Human
ugacuguacuccucccaggcgc

SEQ ID NO: 1155018 - RNA, 18 nt, Human
ugacuguacuccucccag

SEQ ID NO: 1155019 - RNA, 17 nt, Human
ugacuguacuccuccca

SEQ ID NO: 1155020 - RNA, 16 nt, Human
ugacuguacuccuccc

SEQ ID NO: 1155021 - RNA, 16 nt, Human
ugaccucagcuuugau

SEQ ID NO: 1155022 - RNA, 19 nt, Human
ucuugaacuccugaccuca

SEQ ID NO: 1155023 - RNA, 17 nt, Human
ucuugaacuccugaccu

SEQ ID NO: 1155024 - RNA, 18 nt, Human
ucuucuuuuuuugugaug

SEQ ID NO: 1155025 - RNA, 17 nt, Human
ucuucuuuuuuugugau

SEQ ID NO: 1155026 - RNA, 16 nt, Human
ucuucuuuuuuuguga

SEQ ID NO: 1155027 - RNA, 14 nt, Human
ucuucuccuuucac

SEQ ID NO: 1155028 - RNA, 13 nt, Human
ucuucuccuuuca

SEQ ID NO: 1155029 - RNA, 12 nt, Human
ucuucuccacug

SEQ ID NO: 1155030 - RNA, 17 nt, Human
ucuuccuggauuauuca

SEQ ID NO: 1155031 - RNA, 21 nt, Human
ucugguuccuccccuccuccu

SEQ ID NO: 1155032 - RNA, 20 nt, Human
ucugguuccuccccuccucc

SEQ ID NO: 1155033 - RNA, 13 nt, Human
ucugguuccuccc

SEQ ID NO: 1155034 - RNA, 15 nt, Human
ucuggcuccagcugg

SEQ ID NO: 1155035 - RNA, 22 nt, Human
ucugcugauccucccaggcuuc

SEQ ID NO: 1155036 - RNA, 17 nt, Human
ucugcauucaggaucaa

SEQ ID NO: 1155037 - RNA, 23 nt, Human
ucugaggcugaaauucagaauau

SEQ ID NO: 1155038 - RNA, 11 nt, Human
ucugaggcuga

SEQ ID NO: 1155039 - RNA, 19 nt, Human
ucuccugccucagccuccc

SEQ ID NO: 1155040 - RNA, 17 nt, Human
ucuccugccucagccuc

SEQ ID NO: 1155041 - RNA, 19 nt, Human
ucucaagagggcacuggug

SEQ ID NO: 1155042 - RNA, 18 nt, Human
ucucaagagggcacuggu

SEQ ID NO: 1155043 - RNA, 17 nt, Human
ucucaagagggcacugg

SEQ ID NO: 1155044 - RNA, 14 nt, Human
ucuaaugugugaau

SEQ ID NO: 1155045 - RNA, 22 nt, Human
ucggccucccaaagugcuggga

SEQ ID NO: 1155046 - RNA, 15 nt, Human
ucgaacuccugaccu

SEQ ID NO: 1155047 - RNA, 17 nt, Human
ucgaggcggaucuuugg

SEQ ID NO: 1155048 - RNA, 22 nt, Human
ucgaggcggaucuuuggacaga

SEQ ID NO: 1155049 - RNA, 19 nt, Human
uccuuuuaaaacacuucca

SEQ ID NO: 1155050 - RNA, 14 nt, Human
uccugccucagccu

SEQ ID NO: 1155051 - RNA, 21 nt, Human
uccucuuccugaauuuuauuu

SEQ ID NO: 1155052 - RNA, 15 nt, Human
uccuacaagacacag

SEQ ID NO: 1155053 - RNA, 18 nt, Human
uccuaauuccacagcugc

SEQ ID NO: 1155054 - RNA, 17 nt, Human
uccuaauuccacagcug

SEQ ID NO: 1155055 - RNA, 16 nt, Human
uccuaauuccacagcu

SEQ ID NO: 1155056 - RNA, 15 nt, Human
uccuaauuccacagc

SEQ ID NO: 1155057 - RNA, 22 nt, Human
uccuaaugaaugcauaaaaugu

SEQ ID NO: 1155058 - RNA, 20 nt, Human
ucccugccccucccuucaac

SEQ ID NO: 1155059 - RNA, 11 nt, Human
uccaggguggu

SEQ ID NO: 1155060 - RNA, 15 nt, Human
uccaccuucccaugc

SEQ ID NO: 1155061 - RNA, 23 nt, Human
ucauuccaccuucccaugcccug

SEQ ID NO: 1155062 - RNA, 21 nt, Human
ucauagcccucacccuggggc

SEQ ID NO: 1155063 - RNA, 15 nt, Human
ucaggcucuucuccu

SEQ ID NO: 1155064 - RNA, 22 nt, Human
ucagccuccugaguagcuggga

SEQ ID NO: 1155065 - RNA, 20 nt, Human
ucagccuccugaguagcugg

SEQ ID NO: 1155066 - RNA, 23 nt, Human
ucagcauucucacuccuaccugg

SEQ ID NO: 1155067 - RNA, 20 nt, Human
ucagcauucucacuccuacc

SEQ ID NO: 1155068 - RNA, 17 nt, Human
ucagcauucucacuccu

SEQ ID NO: 1155069 - RNA, 22 nt, Human
ucacugcuggcugccuuagaac

SEQ ID NO: 1155070 - RNA, 18 nt, Human
ucacugcuggcugccuua

SEQ ID NO: 1155071 - RNA, 17 nt, Human
ucacugcuggcugccuu

SEQ ID NO: 1155072 - RNA, 16 nt, Human
ucacugcuggcugccu

SEQ ID NO: 1155073 - RNA, 15 nt, Human
ucacugcuggcugcc

SEQ ID NO: 1155074 - RNA, 14 nt, Human
ucacugcuggcugc

SEQ ID NO: 1155075 - RNA, 13 nt, Human
ucacugcuggcug

SEQ ID NO: 1155076 - RNA, 12 nt, Human
ucacugcuggcu

SEQ ID NO: 1155077 - RNA, 19 nt, Human
ucacugcauccuccgccuc

SEQ ID NO: 1155078 - RNA, 18 nt, Human
ucacugcauccuccgccu

SEQ ID NO: 1155079 - RNA, 18 nt, Human
ucaacgcagcccugcuuu

SEQ ID NO: 1155080 - RNA, 15 nt, Human
ucaacgcagcccugc

SEQ ID NO: 1155081 - RNA, 14 nt, Human
ucaacgcagcccug

SEQ ID NO: 1155082 - RNA, 19 nt, Human
uauuuucaacgcagcccug

SEQ ID NO: 1155083 - RNA, 21 nt, Human
uauuccugcauuugugaaaug

SEQ ID NO: 1155084 - RNA, 20 nt, Human
uauuccugcauuugugaaau

SEQ ID NO: 1155085 - RNA, 19 nt, Human
uauuccugcauuugugaaa

SEQ ID NO: 1155086 - RNA, 17 nt, Human
uauuccugcauuuguga

SEQ ID NO: 1155087 - RNA, 14 nt, Human
uauguugauaaaag

SEQ ID NO: 1155088 - RNA, 12 nt, Human
gggagcucugca

SEQ ID NO: 1155089 - RNA, 21 nt, Human
gggagccugaucaccugcccu

SEQ ID NO: 1155090 - RNA, 23 nt, Human
gggacugccagucccccugcccc

SEQ ID NO: 1155091 - RNA, 16 nt, Human
gggaccccgagccugg

SEQ ID NO: 1155092 - RNA, 13 nt, Human
ggcuuuucacugc

SEQ ID NO: 1155093 - RNA, 11 nt, Human
ggcuugcugcc

SEQ ID NO: 1155094 - RNA, 16 nt, Human
ggcugugccucugccu

SEQ ID NO: 1155095 - RNA, 13 nt, Human
ggcugugccucug

SEQ ID NO: 1155096 - RNA, 15 nt, Human
ggcugggagcucugc

SEQ ID NO: 1155097 - RNA, 11 nt, Human
ggccugggccc

SEQ ID NO: 1155098 - RNA, 17 nt, Human
ggccucggacuuagcug

SEQ ID NO: 1155099 - RNA, 15 nt, Human
ggccgggagccugau

SEQ ID NO: 1155100 - RNA, 22 nt, Human
ggccgggaccccgagccuggcu

SEQ ID NO: 1155101 - RNA, 23 nt, Human
ggccgggaccccgagccuggcuc

SEQ ID NO: 1155102 - RNA, 21 nt, Human
ggcagugggacagggcauggc

SEQ ID NO: 1155103 - RNA, 17 nt, Human
ggaugccccgucccccu

SEQ ID NO: 1155104 - RNA, 21 nt, Human
ggaggggccuggcagccgugc

SEQ ID NO: 1155105 - RNA, 18 nt, Human
ggaggggccuggcagccg

SEQ ID NO: 1155106 - RNA, 14 nt, Human
ggaggggccuggca

SEQ ID NO: 1155107 - RNA, 13 nt, Human
ggaggggccuggc

SEQ ID NO: 1155108 - RNA, 13 nt, Human
ggagggccugggc

SEQ ID NO: 1155109 - RNA, 16 nt, Human
ggacagccccuccucc

SEQ ID NO: 1155110 - RNA, 15 nt, Human
ggacagccccuccuc

SEQ ID NO: 1155111 - RNA, 12 nt, Human
gcuuuucacugc

SEQ ID NO: 1155112 - RNA, 14 nt, Human
ggacagaagcagcu

SEQ ID NO: 1155113 - RNA, 15 nt, Human
ggacagaagcagcuc

SEQ ID NO: 1155114 - RNA, 16 nt, Human
ggacagaagcagcucu

SEQ ID NO: 1155115 - RNA, 17 nt, Human
ggacagaagcagcucuu

SEQ ID NO: 1155116 - RNA, 19 nt, Human
gcuuugggcugcccuggug

SEQ ID NO: 1155117 - RNA, 19 nt, Human
gcuucuguugcugccucau

SEQ ID NO: 1155118 - RNA, 18 nt, Human
gcuucuguugcugccuca

SEQ ID NO: 1155119 - RNA, 17 nt, Human
gcuucuguugcugccuc

SEQ ID NO: 1155120 - RNA, 13 nt, Human
gcugucaucucag

SEQ ID NO: 1155121 - RNA, 23 nt, Human
gcuggucucgaacuccugaccuu

SEQ ID NO: 1155122 - RNA, 22 nt, Human
gcuggucucgaacuccugaccu

SEQ ID NO: 1155123 - RNA, 19 nt, Human
gcuggucucgaacuccuga

SEQ ID NO: 1155124 - RNA, 19 nt, Human
gcuggcccuggcucccaca

SEQ ID NO: 1155125 - RNA, 16 nt, Human
gcuggcccugcccugg

SEQ ID NO: 1155126 - RNA, 15 nt, Human
gcuggcccugcccug

SEQ ID NO: 1155127 - RNA, 14 nt, Human
gcuggcccugcccu

SEQ ID NO: 1155128 - RNA, 23 nt, Human
gcuggaaugauuucagcucacug

SEQ ID NO: 1155129 - RNA, 20 nt, Human
gcugccuuagaaccuuucuu

SEQ ID NO: 1155130 - RNA, 15 nt, Human
gcugccuuagaaccu

SEQ ID NO: 1155131 - RNA, 17 nt, Human
gcugcccuggugcugcc

SEQ ID NO: 1155132 - RNA, 18 nt, Human
gcugcccuggugcugcca

SEQ ID NO: 1155133 - RNA, 15 nt, Human
gcugcccuggugcug

SEQ ID NO: 1155134 - RNA, 14 nt, Human
gcugcccuggugcu

SEQ ID NO: 1155135 - RNA, 13 nt, Human
gcugcccuggugc

SEQ ID NO: 1155136 - RNA, 12 nt, Human
gcugcccuggug

SEQ ID NO: 1155137 - RNA, 23 nt, Human
gcugccacacuucaggcucuucu

SEQ ID NO: 1155138 - RNA, 22 nt, Human
gcugccacacuucaggcucuuc

SEQ ID NO: 1155139 - RNA, 21 nt, Human
gcugccacacuucaggcucuu

SEQ ID NO: 1155140 - RNA, 18 nt, Human
gcugccacacuucaggcu

SEQ ID NO: 1155141 - RNA, 17 nt, Human
gcugccacacuucaggc

SEQ ID NO: 1155142 - RNA, 15 nt, Human
gcugccacacuucag

SEQ ID NO: 1155143 - RNA, 16 nt, Human
gcugagaggagagaga

SEQ ID NO: 1155144 - RNA, 19 nt, Human
gcucuuggcagguacucag

SEQ ID NO: 1155145 - RNA, 21 nt, Human
gcucuugaacuccugaccuca

SEQ ID NO: 1155146 - RNA, 19 nt, Human
gcucuugaacuccugaccu

SEQ ID NO: 1155147 - RNA, 16 nt, Human
gcucuugaacuccuga

SEQ ID NO: 1155148 - RNA, 14 nt, Human
gcucuugaacuccu

SEQ ID NO: 1155149 - RNA, 22 nt, Human
gcuccuuccucugaggcugaaa

SEQ ID NO: 1155150 - RNA, 20 nt, Human
gcuccuuccucugaggcuga

SEQ ID NO: 1155151 - RNA, 18 nt, Human
gcuccuuccucugaggcu

SEQ ID NO: 1155152 - RNA, 16 nt, Human
gcuccucccggugccc

SEQ ID NO: 1155153 - RNA, 14 nt, Human
gcuccucccggugc

SEQ ID NO: 1155154 - RNA, 23 nt, Human
gcuccuggggguucuuucuuccu

SEQ ID NO: 1155155 - RNA, 15 nt, Human
gcucccacaggcccu

SEQ ID NO: 1155156 - RNA, 13 nt, Human
gcuccaaacccuc

SEQ ID NO: 1155157 - RNA, 21 nt, Human
gcucagcccucccugccccuc

SEQ ID NO: 1155158 - RNA, 19 nt, Human
gcucagcccucccugcccc

SEQ ID NO: 1155159 - RNA, 18 nt, Human
gcucagcccucccugccc

SEQ ID NO: 1155160 - RNA, 17 nt, Human
gcucagcccucccugcc

SEQ ID NO: 1155161 - RNA, 16 nt, Human
gcucagcccucccugc

SEQ ID NO: 1155162 - RNA, 15 nt, Human
gcucagcccucccug

SEQ ID NO: 1155163 - RNA, 12 nt, Human
gcucagcccucc

SEQ ID NO: 1155164 - RNA, 22 nt, Human
gcucacagaacccuuggagcca

SEQ ID NO: 1155165 - RNA, 20 nt, Human
gcuauaacuauguugauaaa

SEQ ID NO: 1155166 - RNA, 13 nt, Human
gcgccccuucccc

SEQ ID NO: 1155167 - RNA, 22 nt, Human
gcgcaggcuggcccugcccugg

SEQ ID NO: 1155168 - RNA, 21 nt, Human
gcgcaggcuggcccugcccug

SEQ ID NO: 1155169 - RNA, 20 nt, Human
gcgcaggcuggcccugcccu

SEQ ID NO: 1155170 - RNA, 19 nt, Human
gcgcaggcuggcccugccc

SEQ ID NO: 1155171 - RNA, 18 nt, Human
gcgcaggcuggcccugcc

SEQ ID NO: 1155172 - RNA, 22 nt, Human
gccuggcagccgugccuucagc

SEQ ID NO: 1155173 - RNA, 21 nt, Human
gccuggcagccgugccuucag

SEQ ID NO: 1155174 - RNA, 20 nt, Human
gccuggcagccgugccuuca

SEQ ID NO: 1155175 - RNA, 12 nt, Human
gccuggcagccg

SEQ ID NO: 1155176 - RNA, 19 nt, Human
gccuggcacagggcagugg

SEQ ID NO: 1155177 - RNA, 18 nt, Human
gccuggcacagggcagug

SEQ ID NO: 1155178 - RNA, 14 nt, Human
gccuggcacagggc

SEQ ID NO: 1155179 - RNA, 13 nt, Human
gccuggcacaggg

SEQ ID NO: 1155180 - RNA, 21 nt, Human
gcccagcuugaaaccuucacu

SEQ ID NO: 1155181 - RNA, 14 nt, Human
gcccaaccugcucu

SEQ ID NO: 1155182 - RNA, 22 nt, Human
gccaggcuggucucgaacuccu

SEQ ID NO: 1155183 - RNA, 22 nt, Human
gccaggcugcucuugaacuccu

SEQ ID NO: 1155184 - RNA, 14 nt, Human
gccaggcugcucuu

SEQ ID NO: 1155185 - RNA, 13 nt, Human
gccaggcugcucu

SEQ ID NO: 1155186 - RNA, 20 nt, Human
gccacgcccaacuaauuuuu

SEQ ID NO: 1155187 - RNA, 11 nt, Human
gccaccugggu

SEQ ID NO: 1155188 - RNA, 22 nt, Human
gccaccgugccuggccacgccc

SEQ ID NO: 1155189 - RNA, 17 nt, Human
gccaccgugccuggcca

SEQ ID NO: 1155190 - RNA, 23 nt, Human
gccacacuucaggcucuucuccu

SEQ ID NO: 1155191 - RNA, 22 nt, Human
gccacacuucaggcucuucucc

SEQ ID NO: 1155192 - RNA, 20 nt, Human
gccacacuucaggcucuucu

SEQ ID NO: 1155193 - RNA, 21 nt, Human
gccaauggagacugucucaag

SEQ ID NO: 1155194 - RNA, 19 nt, Human
gccaauggagacugucuca

SEQ ID NO: 1155195 - RNA, 16 nt, Human
gccaauggagacuguc

SEQ ID NO: 1155196 - RNA, 20 nt, Human
gccaauaauaauaccucccu

SEQ ID NO: 1155197 - RNA, 12 nt, Human
gcauuugugaaa

SEQ ID NO: 1155198 - RNA, 15 nt, Human
gcaucucagcccaca

SEQ ID NO: 1155199 - RNA, 14 nt, Human
gcaucucagcccac

SEQ ID NO: 1155200 - RNA, 13 nt, Human
gcaucucagccca

SEQ ID NO: 1155201 - RNA, 12 nt, Human
gcaucucagccc

SEQ ID NO: 1155202 - RNA, 23 nt, Human
gcaucagugcccuccaggauaga

SEQ ID NO: 1155203 - RNA, 15 nt, Human
gcaucagugcccucc

SEQ ID NO: 1155204 - RNA, 21 nt, Human
gcagugggacagggcauggcc

SEQ ID NO: 1155205 - RNA, 14 nt, Human
gcagccgugccuuc

SEQ ID NO: 1155206 - RNA, 24 nt, Human
gcagcccugcuuugggcugcccug

SEQ ID NO: 1155207 - RNA, 18 nt, Human
gcagauguccuugaugcu

SEQ ID NO: 1155208 - RNA, 21 nt, Human
gcagagguccacaacacacag

SEQ ID NO: 1155209 - RNA, 16 nt, Human
gcacagggcaguggga

SEQ ID NO: 1155210 - RNA, 20 nt, Human
gaugugcuuguuaacugagu

SEQ ID NO: 1155211 - RNA, 19 nt, Human
gaugugcuuguuaacugag

SEQ ID NO: 1155212 - RNA, 17 nt, Human
gauccuuuuggagucag

SEQ ID NO: 1155213 - RNA, 15 nt, Human
gauccuuuuggaguc

SEQ ID NO: 1155214 - RNA, 15 nt, Human
gaguggcuccucccg

SEQ ID NO: 1155215 - RNA, 13 nt, Human
gaguggcuccucc

SEQ ID NO: 1155216 - RNA, 18 nt, Human
gagucucuucuccacugg

SEQ ID NO: 1155217 - RNA, 17 nt, Human
gagucucuucuccacug

SEQ ID NO: 1155218 - RNA, 16 nt, Human
gagucucuucuccacu

SEQ ID NO: 1155219 - RNA, 15 nt, Human
gagucucuucuccac

SEQ ID NO: 1155220 - RNA, 14 nt, Human
gagucucuucucca

SEQ ID NO: 1155221 - RNA, 12 nt, Human
gagucucuucuc

SEQ ID NO: 1155222 - RNA, 23 nt, Human
gagucucgcuauugucaccaggg

SEQ ID NO: 1155223 - RNA, 19 nt, Human
gagucccaggcugagccuc

SEQ ID NO: 1155224 - RNA, 18 nt, Human
gagucccaggcugagccu

SEQ ID NO: 1155225 - RNA, 18 nt, Human
gagguccacaacacacag

SEQ ID NO: 1155226 - RNA, 20 nt, Human
gaggggccuggcagccgugc

SEQ ID NO: 1155227 - RNA, 18 nt, Human
gaggggccuggcagccgu

SEQ ID NO: 1155228 - RNA, 14 nt, Human
gaggggccuggcag

SEQ ID NO: 1155229 - RNA, 13 nt, Human
gaggggccuggca

SEQ ID NO: 1155230 - RNA, 18 nt, Human
gagggcacugguggcccg

SEQ ID NO: 1155231 - RNA, 16 nt, Human
gagggcacugguggcc

SEQ ID NO: 1155232 - RNA, 12 nt, Human
gagggcacuggu

SEQ ID NO: 1155233 - RNA, 13 nt, Human
gaggcccggccuc

SEQ ID NO: 1155234 - RNA, 19 nt, Human
gaggcggaucuuuggacag

SEQ ID NO: 1155235 - RNA, 21 nt, Human
gagcuucuguugcugccucau

SEQ ID NO: 1155236 - RNA, 18 nt, Human
gagcuucuguugcugccu

SEQ ID NO: 1155237 - RNA, 14 nt, Human
gagcuucuggcacu

SEQ ID NO: 1155238 - RNA, 15 nt, Human
gagcuuaacagugug

SEQ ID NO: 1155239 - RNA, 16 nt, Human
gagcucugcagagcag

SEQ ID NO: 1155240 - RNA, 18 nt, Human
gagccucagucucccucc

SEQ ID NO: 1155241 - RNA, 20 nt, Human
gagccaccgugccuggccac

SEQ ID NO: 1155242 - RNA, 14 nt, Human
gagccaccgugccu

SEQ ID NO: 1155243 - RNA, 15 nt, Human
gaauagaugcugacu

SEQ ID NO: 1155244 - RNA, 15 nt, Human
gaauaaauugcuccu

SEQ ID NO: 1155245 - RNA, 14 nt, Human
gaauaaagacaccu

SEQ ID NO: 1155246 - RNA, 14 nt, Human
gaaggcagggaggg

SEQ ID NO: 1155247 - RNA, 13 nt, Human
gaaggcagggagg

SEQ ID NO: 1155248 - RNA, 11 nt, Human
gaagccuuugu

SEQ ID NO: 1155249 - RNA, 10 nt, Human
gaagccuuug

SEQ ID NO: 1155250 - RNA, 12 nt, Human
gaaccugacccc

SEQ ID NO: 1155251 - RNA, 11 nt, Human
gaaccugaccc

SEQ ID NO: 1155252 - RNA, 19 nt, Human
gaaauugcauuuccugaca

SEQ ID NO: 1155253 - RNA, 20 nt, Human
gaaacaugacucguauaugu

SEQ ID NO: 1155254 - RNA, 20 nt, Human
gaaacagcucgacuuuaaaa

SEQ ID NO: 1155255 - RNA, 15 nt, Human
gaaacagcucgacuu

SEQ ID NO: 1155256 - RNA, 22 nt, Human
gaaacacugggcuucuagaacc

SEQ ID NO: 1155257 - RNA, 21 nt, Human
gaaaaccaagccguggcuucc

SEQ ID NO: 1155258 - RNA, 19 nt, Human
gaaaaccaagccguggcuu

SEQ ID NO: 1155259 - RNA, 18 nt, Human
gaaaaccaagccguggcu

SEQ ID NO: 1155260 - RNA, 14 nt, Human
cuuuucccuucuuu

SEQ ID NO: 1155261 - RNA, 20 nt, Human
cuuuucacugcuggcugccu

SEQ ID NO: 1155262 - RNA, 18 nt, Human
cuuuucacugcuggcugc

SEQ ID NO: 1155263 - RNA, 17 nt, Human
cuuuucacugcuggcug

SEQ ID NO: 1155264 - RNA, 18 nt, Human
cuuuggacagaagcagcu

SEQ ID NO: 1155265 - RNA, 19 nt, Human
cuuuggacagaagcagcuc

SEQ ID NO: 1155266 - RNA, 20 nt, Human
cuuuggacagaagcagcucu

SEQ ID NO: 1155267 - RNA, 21 nt, Human
cuuuggacagaagcagcucuu

SEQ ID NO: 1155268 - RNA, 20 nt, Human
cuuuauucuggcagaggagg

SEQ ID NO: 1155269 - RNA, 21 nt, Human
cuuguuuuuuuuuuccacuua

SEQ ID NO: 1155270 - RNA, 20 nt, Human
cuuguuuuuuuuuuccacuu

SEQ ID NO: 1155271 - RNA, 19 nt, Human
cuuguuuuuuuuuuccacu

SEQ ID NO: 1155272 - RNA, 14 nt, Human
cuuguuuucuggga

SEQ ID NO: 1155273 - RNA, 15 nt, Human
cuugccacugccucu

SEQ ID NO: 1155274 - RNA, 14 nt, Human
cuugccacugccuc

SEQ ID NO: 1155275 - RNA, 15 nt, Human
cuucgccaccugggu

SEQ ID NO: 1155276 - RNA, 14 nt, Human
cuucgccaccuggg

SEQ ID NO: 1155277 - RNA, 21 nt, Human
cuucgauacaccgggccugga

SEQ ID NO: 1155278 - RNA, 16 nt, Human
cuuccugugacuucag

SEQ ID NO: 1155279 - RNA, 13 nt, Human
cuuccugugacuu

SEQ ID NO: 1155280 - RNA, 15 nt, Human
cuucccccuccaauc

SEQ ID NO: 1155281 - RNA, 12 nt, Human
cuucccccucca

SEQ ID NO: 1155282 - RNA, 23 nt, Human
cuucaacugaccagccuccaugc

SEQ ID NO: 1155283 - RNA, 20 nt, Human
cuucaacugaccagccucca

SEQ ID NO: 1155284 - RNA, 17 nt, Human
cuucaacugaccagccu

SEQ ID NO: 1155285 - RNA, 18 nt, Human
cuuagaaguuuguuguga

SEQ ID NO: 1155286 - RNA, 16 nt, Human
cuuagaaauugcauuu

SEQ ID NO: 1155287 - RNA, 18 nt, Human
cuuaagaauuuugagcag

SEQ ID NO: 1155288 - RNA, 22 nt, Human
cuguuuuacaaaaaagaaaaga

SEQ ID NO: 1155289 - RNA, 17 nt, Human
cugugccucugccuguc

SEQ ID NO: 1155290 - RNA, 16 nt, Human
cugugccucugccugu

SEQ ID NO: 1155291 - RNA, 15 nt, Human
cugugccucugccug

SEQ ID NO: 1155292 - RNA, 14 nt, Human
cugugccucugccu

SEQ ID NO: 1155293 - RNA, 13 nt, Human
cugugccucugcc

SEQ ID NO: 1155294 - RNA, 12 nt, Human
cugugccucugc

SEQ ID NO: 1155295 - RNA, 19 nt, Human
cuguauuagucacagagau

SEQ ID NO: 1155296 - RNA, 17 nt, Human
cuguauuagucacagag

SEQ ID NO: 1155297 - RNA, 21 nt, Human
cuguacuccucccaggcgccc

SEQ ID NO: 1155298 - RNA, 19 nt, Human
cuguacuccucccaggcgc

SEQ ID NO: 1155299 - RNA, 16 nt, Human
cuguacuccucccagg

SEQ ID NO: 1155300 - RNA, 15 nt, Human
cuguacuccucccag

SEQ ID NO: 1155301 - RNA, 14 nt, Human
cuguacuccuccca

SEQ ID NO: 1155302 - RNA, 23 nt, Human
cuggggguucuuucuuccucugc

SEQ ID NO: 1155303 - RNA, 20 nt, Human
cuggggguucuuucuuccuc

SEQ ID NO: 1155304 - RNA, 18 nt, Human
cugggauuacaggcguga

SEQ ID NO: 1155305 - RNA, 22 nt, Human
cugccuccagaauggucuuucu

SEQ ID NO: 1155306 - RNA, 14 nt, Human
cugccuccagaaug

SEQ ID NO: 1155307 - RNA, 17 nt, Human
cugccucagccucccga

SEQ ID NO: 1155308 - RNA, 21 nt, Human
cugccccuccucucugcccua

SEQ ID NO: 1155309 - RNA, 17 nt, Human
cugcccagccuccaagc

SEQ ID NO: 1155310 - RNA, 20 nt, Human
cugcauccuccgccucccgg

SEQ ID NO: 1155311 - RNA, 19 nt, Human
cugcauccuccgccucccg

SEQ ID NO: 1155312 - RNA, 22 nt, Human
cugcacacgcuccuuccucuga

SEQ ID NO: 1155313 - RNA, 20 nt, Human
cugcacacgcuccuuccucu

SEQ ID NO: 1155314 - RNA, 14 nt, Human
cugcacacagcacg

SEQ ID NO: 1155315 - RNA, 13 nt, Human
cugcacacagcac

SEQ ID NO: 1155316 - RNA, 17 nt, Human
cugcaaagcccagcuug

SEQ ID NO: 1155317 - RNA, 15 nt, Human
cugcaaagcccagcu

SEQ ID NO: 1155318 - RNA, 13 nt, Human
cugcaaagcccag

SEQ ID NO: 1155319 - RNA, 15 nt, Human
cugaucaccugcccu

SEQ ID NO: 1155320 - RNA, 20 nt, Human
cugagucccaggcugagccu

SEQ ID NO: 1155321 - RNA, 21 nt, Human
cugagcaaauguggcuccugg

SEQ ID NO: 1155322 - RNA, 20 nt, Human
cugagcaaauguggcuccug

SEQ ID NO: 1155323 - RNA, 17 nt, Human
cugagcaaauguggcuc

SEQ ID NO: 1155324 - RNA, 15 nt, Human
cugagcaaauguggc

SEQ ID NO: 1155325 - RNA, 23 nt, Human
cugagauuauaggcaccuaccac

SEQ ID NO: 1155326 - RNA, 17 nt, Human
cugacuguacuccuccc

SEQ ID NO: 1155327 - RNA, 23 nt, Human
cugaccagccuccaugcugccuc

SEQ ID NO: 1155328 - RNA, 21 nt, Human
cugaccagccuccaugcugcc

SEQ ID NO: 1155329 - RNA, 17 nt, Human
cugaccagccuccaugc

SEQ ID NO: 1155330 - RNA, 16 nt, Human
cugaagucacugcaca

SEQ ID NO: 1155331 - RNA, 15 nt, Human
cugaagucacugcac

SEQ ID NO: 1155332 - RNA, 14 nt, Human
cugaagucacugca

SEQ ID NO: 1155333 - RNA, 13 nt, Human
cugaagucacugc

SEQ ID NO: 1155334 - RNA, 13 nt, Human
cucuucuccacug

SEQ ID NO: 1155335 - RNA, 12 nt, Human
cucuucuccacu

SEQ ID NO: 1155336 - RNA, 22 nt, Human
cucugucgcccaggcuggagug

SEQ ID NO: 1155337 - RNA, 18 nt, Human
cucugucgcccaggcugg

SEQ ID NO: 1155338 - RNA, 15 nt, Human
cucugucgcccaggc

SEQ ID NO: 1155339 - RNA, 22 nt, Human
cucugcccuaaugcgcaggcug

SEQ ID NO: 1155340 - RNA, 20 nt, Human
cucugcccuaaugcgcaggc

SEQ ID NO: 1155341 - RNA, 22 nt, Human
cucugacaacagacuucugaaa

SEQ ID NO: 1155342 - RNA, 21 nt, Human
cucugacaacagacuucugaa

SEQ ID NO: 1155343 - RNA, 16 nt, Human
cucugacaacagacuu

SEQ ID NO: 1155344 - RNA, 23 nt, Human
cucgcucugucgcccaggcugga

SEQ ID NO: 1155345 - RNA, 15 nt, Human
cucgccuucaucucc

SEQ ID NO: 1155346 - RNA, 22 nt, Human
cuccuuaucaaaggacaccauu

SEQ ID NO: 1155347 - RNA, 17 nt, Human
cuccuuaucaaaggaca

SEQ ID NO: 1155348 - RNA, 12 nt, Human
cuccuggacucc

SEQ ID NO: 1155349 - RNA, 11 nt, Human
cuccuggacuc

SEQ ID NO: 1155350 - RNA, 19 nt, Human
cuccugccucagccucccg

SEQ ID NO: 1155351 - RNA, 13 nt, Human
cuccugccucagc

SEQ ID NO: 1155352 - RNA, 12 nt, Human
cuccugccucag

SEQ ID NO: 1155353 - RNA, 11 nt, Human
cuccugccuca

SEQ ID NO: 1155354 - RNA, 19 nt, Human
cuccuccuggacuccugca

SEQ ID NO: 1155355 - RNA, 15 nt, Human
cuccuccuggacucc

SEQ ID NO: 1155356 - RNA, 14 nt, Human
cuccuccuggacuc

SEQ ID NO: 1155357 - RNA, 23 nt, Human
cuccucccaggcgccccuucccc

SEQ ID NO: 1155358 - RNA, 22 nt, Human
cuccucccaggcgccccuuccc

SEQ ID NO: 1155359 - RNA, 17 nt, Human
cuccucccaggcgcccc

SEQ ID NO: 1155360 - RNA, 19 nt, Human
cucccuuggggccuaugca

SEQ ID NO: 1155361 - RNA, 21 nt, Human
cucccugccccucccuucaac

SEQ ID NO: 1155362 - RNA, 20 nt, Human
cucccugccccucccuucaa

SEQ ID NO: 1155363 - RNA, 18 nt, Human
cucccugccccucccuuc

SEQ ID NO: 1155364 - RNA, 17 nt, Human
cucccugccccucccuu

SEQ ID NO: 1155365 - RNA, 14 nt, Human
cucccugccccucc

SEQ ID NO: 1155366 - RNA, 13 nt, Human
cucccugccccuc

SEQ ID NO: 1155367 - RNA, 23 nt, Human
cucccugccccccagcccuccuu

SEQ ID NO: 1155368 - RNA, 17 nt, Human
cucccugccccccagcc

SEQ ID NO: 1155369 - RNA, 21 nt, Human
cucccggugcccaagaauaga

SEQ ID NO: 1155370 - RNA, 15 nt, Human
cucccggugcccaag

SEQ ID NO: 1155371 - RNA, 20 nt, Human
cuccccuccuccuggacucc

SEQ ID NO: 1155372 - RNA, 12 nt, Human
cuccccuccucc

SEQ ID NO: 1155373 - RNA, 22 nt, Human
cuccaaucccaccaacccucag

SEQ ID NO: 1155374 - RNA, 21 nt, Human
cucauagcccucacccugggg

SEQ ID NO: 1155375 - RNA, 20 nt, Human
cucauagcccucacccuggg

SEQ ID NO: 1155376 - RNA, 17 nt, Human
cucauagcccucacccu

SEQ ID NO: 1155377 - RNA, 13 nt, Human
cucauagcccuca

SEQ ID NO: 1155378 - RNA, 21 nt, Human
cucagcccacauagugauggu

SEQ ID NO: 1155379 - RNA, 19 nt, Human
cucagcccacauagugaug

SEQ ID NO: 1155380 - RNA, 19 nt, Human
cucacuccuaccugguaau

SEQ ID NO: 1155381 - RNA, 17 nt, Human
cucacuccuaccuggua

SEQ ID NO: 1155382 - RNA, 16 nt, Human
cucacuccuaccuggu

SEQ ID NO: 1155383 - RNA, 15 nt, Human
cucacuccuaccugg

SEQ ID NO: 1155384 - RNA, 13 nt, Human
cucacuccuaccu

SEQ ID NO: 1155385 - RNA, 22 nt, Human
cuauuuaugugauccuuuugga

SEQ ID NO: 1155386 - RNA, 19 nt, Human
cuauugucaccagggcugg

SEQ ID NO: 1155387 - RNA, 20 nt, Human
cuaugcagagguccacaaca

SEQ ID NO: 1155388 - RNA, 10 nt, Human
cgcagcccug

SEQ ID NO: 1155389 - RNA, 14 nt, Human
cgaacuccugaccu

SEQ ID NO: 1155390 - RNA, 12 nt, Human
ccuugggacccc

SEQ ID NO: 1155391 - RNA, 21 nt, Human
ccuucuguggcucacagaacc

SEQ ID NO: 1155392 - RNA, 14 nt, Human
ccuucuguggcuca

SEQ ID NO: 1155393 - RNA, 15 nt, Human
ccuucgauacaccgg

SEQ ID NO: 1155394 - RNA, 14 nt, Human
ccuuccucugaggc

SEQ ID NO: 1155395 - RNA, 13 nt, Human
ccuuccucugagg

SEQ ID NO: 1155396 - RNA, 20 nt, Human
ccuuccucugagccuuggga

SEQ ID NO: 1155397 - RNA, 16 nt, Human
ccuuccucugagccuu

SEQ ID NO: 1155398 - RNA, 15 nt, Human
ccuuccucugagccu

SEQ ID NO: 1155399 - RNA, 14 nt, Human
ccuucacuuaggaa

SEQ ID NO: 1155400 - RNA, 20 nt, Human
ccuuaccacugcucugauga

SEQ ID NO: 1155401 - RNA, 17 nt, Human
ccuuaccacugcucuga

SEQ ID NO: 1155402 - RNA, 23 nt, Human
ccuggucacaggacucugccucc

SEQ ID NO: 1155403 - RNA, 22 nt, Human
ccuggucacaggacucugccuc

SEQ ID NO: 1155404 - RNA, 21 nt, Human
ccuggucacaggacucugccu

SEQ ID NO: 1155405 - RNA, 23 nt, Human
ccuggggguucuuucuuccucug

SEQ ID NO: 1155406 - RNA, 22 nt, Human
ccuggggguucuuucuuccucu

SEQ ID NO: 1155407 - RNA, 21 nt, Human
ccuggggguucuuucuuccuc

SEQ ID NO: 1155408 - RNA, 18 nt, Human
ccuggggguucuuucuuc

SEQ ID NO: 1155409 - RNA, 24 nt, Human
ccuggcuuuucacugcuggcugcc

SEQ ID NO: 1155410 - RNA, 23 nt, Human
ccuggcuuuucacugcuggcugc

SEQ ID NO: 1155411 - RNA, 22 nt, Human
ccuggcuuuucacugcuggcug

SEQ ID NO: 1155412 - RNA, 21 nt, Human
ccuggcuuuucacugcuggcu

SEQ ID NO: 1155413 - RNA, 20 nt, Human
ccuggcuuuucacugcuggc

SEQ ID NO: 1155414 - RNA, 23 nt, Human
ccuggcucccacaggcccuuccu

SEQ ID NO: 1155415 - RNA, 17 nt, Human
ccuggcucccacaggcc

SEQ ID NO: 1155416 - RNA, 22 nt, Human
ccuggcuccaaacccucgaggc

SEQ ID NO: 1155417 - RNA, 22 nt, Human
ccuggcagccgugccuucagcu

SEQ ID NO: 1155418 - RNA, 23 nt, Human
ccugcuuugggcugcccuggugc

SEQ ID NO: 1155419 - RNA, 22 nt, Human
ccugcuuugggcugcccuggug

SEQ ID NO: 1155420 - RNA, 21 nt, Human
ccugcuuugggcugcccuggu

SEQ ID NO: 1155421 - RNA, 20 nt, Human
ccugcuuugggcugcccugg

SEQ ID NO: 1155422 - RNA, 15 nt, Human
ccugcugagucccag

SEQ ID NO: 1155423 - RNA, 22 nt, Human
ccugcucuccucuugccacugc

SEQ ID NO: 1155424 - RNA, 21 nt, Human
ccugcucuccucuugccacug

SEQ ID NO: 1155425 - RNA, 19 nt, Human
ccugcucuccucuugccac

SEQ ID NO: 1155426 - RNA, 18 nt, Human
ccugcucuccucuugcca

SEQ ID NO: 1155427 - RNA, 16 nt, Human
ccugcucuccucuugc

SEQ ID NO: 1155428 - RNA, 22 nt, Human
ccugcgggucacaggagggagg

SEQ ID NO: 1155429 - RNA, 18 nt, Human
ccugcgggucacaggagg

SEQ ID NO: 1155430 - RNA, 14 nt, Human
ccugccccccagcc

SEQ ID NO: 1155431 - RNA, 20 nt, Human
ccugcaguacuuuaccuccu

SEQ ID NO: 1155432 - RNA, 18 nt, Human
ccugcaguacuuuaccuc

SEQ ID NO: 1155433 - RNA, 15 nt, Human
ccugcagggccaagc

SEQ ID NO: 1155434 - RNA, 20 nt, Human
ccugcacaaagcccuuccau

SEQ ID NO: 1155435 - RNA, 16 nt, Human
ccugacagaaggacuc

SEQ ID NO: 1155436 - RNA, 24 nt, Human
ccucccugccccucccuucaacca

SEQ ID NO: 1155437 - RNA, 22 nt, Human
ccucccugccccucccuucaac

SEQ ID NO: 1155438 - RNA, 21 nt, Human
ccucccugccccucccuucaa

SEQ ID NO: 1155439 - RNA, 18 nt, Human
ccucccugccccucccuu

SEQ ID NO: 1155440 - RNA, 16 nt, Human
ccuccaugcugccucc

SEQ ID NO: 1155441 - RNA, 15 nt, Human
ccuccaugcugccuc

SEQ ID NO: 1155442 - RNA, 14 nt, Human
ccuccaugcugccu

SEQ ID NO: 1155443 - RNA, 18 nt, Human
ccuccaucuaaacugccc

SEQ ID NO: 1155444 - RNA, 23 nt, Human
ccuccaaucccaccaacccucag

SEQ ID NO: 1155445 - RNA, 22 nt, Human
ccucauagcccucacccugggg

SEQ ID NO: 1155446 - RNA, 21 nt, Human
ccucauagcccucacccuggg

SEQ ID NO: 1155447 - RNA, 18 nt, Human
ccucauagcccucacccu

SEQ ID NO: 1155448 - RNA, 17 nt, Human
ccucauagcccucaccc

SEQ ID NO: 1155449 - RNA, 19 nt, Human
ccuaugcagagguccacaa

SEQ ID NO: 1155450 - RNA, 15 nt, Human
ccuacuuccugugac

SEQ ID NO: 1155451 - RNA, 13 nt, Human
ccuacuuccugug

SEQ ID NO: 1155452 - RNA, 23 nt, Human
ccuaccgagucucuucuccacug

SEQ ID NO: 1155453 - RNA, 22 nt, Human
ccuaccgagucucuucuccacu

SEQ ID NO: 1155454 - RNA, 15 nt, Human
ccuacaagacacagu

SEQ ID NO: 1155455 - RNA, 19 nt, Human
ccgggcugggagcucugca

SEQ ID NO: 1155456 - RNA, 18 nt, Human
ccgggcugggagcucugc

SEQ ID NO: 1155457 - RNA, 13 nt, Human
ccgggcugggagc

SEQ ID NO: 1155458 - RNA, 18 nt, Human
ccgggaccccgagccugg

SEQ ID NO: 1155459 - RNA, 17 nt, Human
ccgggaccccgagccug

SEQ ID NO: 1155460 - RNA, 22 nt, Human
ccgcucagcccucccugccccu

SEQ ID NO: 1155461 - RNA, 21 nt, Human
ccgcucagcccucccugcccc

SEQ ID NO: 1155462 - RNA, 19 nt, Human
ccgcucagcccucccugcc

SEQ ID NO: 1155463 - RNA, 15 nt, Human
ccgcucagcccuccc

SEQ ID NO: 1155464 - RNA, 13 nt, Human
ccgcucagcccuc

SEQ ID NO: 1155465 - RNA, 12 nt, Human
ccgcucagcccu

SEQ ID NO: 1155466 - RNA, 11 nt, Human
ccgcucagccc

SEQ ID NO: 1155467 - RNA, 19 nt, Human
cccugguuuccugcccugg

SEQ ID NO: 1155468 - RNA, 18 nt, Human
cccugguuuccugcccug

SEQ ID NO: 1155469 - RNA, 17 nt, Human
cccugguuuccugcccu

SEQ ID NO: 1155470 - RNA, 16 nt, Human
cccugguuuccugccc

SEQ ID NO: 1155471 - RNA, 18 nt, Human
cccugggaggcagugaug

SEQ ID NO: 1155472 - RNA, 22 nt, Human
cccuggcuuuucacugcuggcu

SEQ ID NO: 1155473 - RNA, 19 nt, Human
cccuggcuuuucacugcug

SEQ ID NO: 1155474 - RNA, 18 nt, Human
cccuggcuuuucacugcu

SEQ ID NO: 1155475 - RNA, 22 nt, Human
cccugcuuugggcugcccuggu

SEQ ID NO: 1155476 - RNA, 20 nt, Human
cccugcuuugggcugcccug

SEQ ID NO: 1155477 - RNA, 19 nt, Human
cccugcuuugggcugcccu

SEQ ID NO: 1155478 - RNA, 18 nt, Human
cccugcuuugggcugccc

SEQ ID NO: 1155479 - RNA, 17 nt, Human
cccugcuuugggcugcc

SEQ ID NO: 1155480 - RNA, 20 nt, Human
cccugcaaagcccagcuuga

SEQ ID NO: 1155481 - RNA, 19 nt, Human
cccugcaaagcccagcuug

SEQ ID NO: 1155482 - RNA, 17 nt, Human
cccugcaaagcccagcu

SEQ ID NO: 1155483 - RNA, 16 nt, Human
cccugcaaagcccagc

SEQ ID NO: 1155484 - RNA, 15 nt, Human
cccugcaaagcccag

SEQ ID NO: 1155485 - RNA, 22 nt, Human
cccuauccuacuuccccuuccu

SEQ ID NO: 1155486 - RNA, 21 nt, Human
cccuaccgagucucuucucca

SEQ ID NO: 1155487 - RNA, 18 nt, Human
cccuaccgagucucuucu

SEQ ID NO: 1155488 - RNA, 23 nt, Human
cccuaaugcgcaggcuggcccug

SEQ ID NO: 1155489 - RNA, 22 nt, Human
cccuaaugcgcaggcuggcccu

SEQ ID NO: 1155490 - RNA, 21 nt, Human
cccuaaugcgcaggcuggccc

SEQ ID NO: 1155491 - RNA, 17 nt, Human
cccuaaugcgcaggcug

SEQ ID NO: 1155492 - RNA, 22 nt, Human
cccgucucugguuccuccccuc

SEQ ID NO: 1155493 - RNA, 18 nt, Human
cccggugcccaagaauag

SEQ ID NO: 1155494 - RNA, 23 nt, Human
cccaccgggcugggagcucugca

SEQ ID NO: 1155495 - RNA, 19 nt, Human
cccacagcgcuggccggga

SEQ ID NO: 1155496 - RNA, 17 nt, Human
cccaaggcucugagcaa

SEQ ID NO: 1155497 - RNA, 13 nt, Human
cccaaccugcucu

SEQ ID NO: 1155498 - RNA, 15 nt, Human
cccaacccuggcacc

SEQ ID NO: 1155499 - RNA, 18 nt, Human
ccauguuggccaggcugg

SEQ ID NO: 1155500 - RNA, 21 nt, Human
ccauguuggccaggcugcucu

SEQ ID NO: 1155501 - RNA, 18 nt, Human
ccauguuggccaggcugc

SEQ ID NO: 1155502 - RNA, 21 nt, Human
ccaugggaaaugucaacaagu

SEQ ID NO: 1155503 - RNA, 16 nt, Human
ccaucuaaacugcccc

SEQ ID NO: 1155504 - RNA, 15 nt, Human
ccaucuaaacugccc

SEQ ID NO: 1155505 - RNA, 14 nt, Human
ccaucuaaacugcc

SEQ ID NO: 1155506 - RNA, 21 nt, Human
ccauaguaugggacuggccuc

SEQ ID NO: 1155507 - RNA, 12 nt, Human
ccauaggucacc

SEQ ID NO: 1155508 - RNA, 21 nt, Human
ccagggcuggaaugauuucag

SEQ ID NO: 1155509 - RNA, 19 nt, Human
ccaggcgccccuucccccu

SEQ ID NO: 1155510 - RNA, 18 nt, Human
ccaggcgccccuuccccc

SEQ ID NO: 1155511 - RNA, 16 nt, Human
ccagccuccaugcugc

SEQ ID NO: 1155512 - RNA, 15 nt, Human
ccagccuccaugcug

SEQ ID NO: 1155513 - RNA, 21 nt, Human
ccagccuccaagcuccaucuc

SEQ ID NO: 1155514 - RNA, 21 nt, Human
ccagcccuccuuaucaaagga

SEQ ID NO: 1155515 - RNA, 21 nt, Human
ccagcaauucuccugccucag

SEQ ID NO: 1155516 - RNA, 20 nt, Human
ccagcaauucuccugccuca

SEQ ID NO: 1155517 - RNA, 19 nt, Human
ccagcaauucuccugccuc

SEQ ID NO: 1155518 - RNA, 18 nt, Human
ccagcaauucuccugccu

SEQ ID NO: 1155519 - RNA, 16 nt, Human
ccagcaauucuccugc

SEQ ID NO: 1155520 - RNA, 11 nt, Human
ccacugccucu

SEQ ID NO: 1155521 - RNA, 20 nt, Human
ccacuccagaccccuggcuu

SEQ ID NO: 1155522 - RNA, 19 nt, Human
ccacuccagaccccuggcu

SEQ ID NO: 1155523 - RNA, 17 nt, Human
ccacuccagaccccugg

SEQ ID NO: 1155524 - RNA, 14 nt, Human
ccaccugcccaacc

SEQ ID NO: 1155525 - RNA, 23 nt, Human
ccacauagugaugguuccccugu

SEQ ID NO: 1155526 - RNA, 22 nt, Human
ccacauagugaugguuccccug

SEQ ID NO: 1155527 - RNA, 21 nt, Human
ccacauagugaugguuccccu

SEQ ID NO: 1155528 - RNA, 19 nt, Human
ccacauagugaugguuccc

SEQ ID NO: 1155529 - RNA, 17 nt, Human
ccacacuccagcuggga

SEQ ID NO: 1155530 - RNA, 14 nt, Human
ccacacuccagcug

SEQ ID NO: 1155531 - RNA, 17 nt, Human
cauuccccgucucuggu

SEQ ID NO: 1155532 - RNA, 13 nt, Human
cauuccccauggg

SEQ ID NO: 1155533 - RNA, 22 nt, Human
cauuccaccuucccaugcccug

SEQ ID NO: 1155534 - RNA, 17 nt, Human
cauuccaccuucccaug

SEQ ID NO: 1155535 - RNA, 18 nt, Human
cauguguuggcagccucu

SEQ ID NO: 1155536 - RNA, 14 nt, Human
caugucucgacuca

SEQ ID NO: 1155537 - RNA, 14 nt, Human
caugcagcaucuaa

SEQ ID NO: 1155538 - RNA, 23 nt, Human
caugacucguauaugucucaggu

SEQ ID NO: 1155539 - RNA, 20 nt, Human
caugacucguauaugucuca

SEQ ID NO: 1155540 - RNA, 19 nt, Human
cauccuacaagacacagug

SEQ ID NO: 1155541 - RNA, 18 nt, Human
cauccuacaagacacagu

SEQ ID NO: 1155542 - RNA, 12 nt, Human
cauccauccagg

SEQ ID NO: 1155543 - RNA, 22 nt, Human
cauagugaugguuccccuguuc

SEQ ID NO: 1155544 - RNA, 19 nt, Human
cauagugaugguuccccug

SEQ ID NO: 1155545 - RNA, 18 nt, Human
cauagugaugguuccccu

SEQ ID NO: 1155546 - RNA, 15 nt, Human
cagugcccuccagga

SEQ ID NO: 1155547 - RNA, 17 nt, Human
cagucccccugccccag

SEQ ID NO: 1155548 - RNA, 16 nt, Human
cagucccccugcccca

SEQ ID NO: 1155549 - RNA, 23 nt, Human
caguccccgugaaggagagcccu

SEQ ID NO: 1155550 - RNA, 21 nt, Human
caggugugagccaccacgccc

SEQ ID NO: 1155551 - RNA, 18 nt, Human
caggugugagccaccacg

SEQ ID NO: 1155552 - RNA, 21 nt, Human
cagguggccacuccagacccc

SEQ ID NO: 1155553 - RNA, 19 nt, Human
cagguggccacuccagacc

SEQ ID NO: 1155554 - RNA, 16 nt, Human
cagguggccacuccag

SEQ ID NO: 1155555 - RNA, 15 nt, Human
cagguggccacucca

SEQ ID NO: 1155556 - RNA, 20 nt, Human
cagguaaucgaccugccucg

SEQ ID NO: 1155557 - RNA, 19 nt, Human
cagguaaucgaccugccuc

SEQ ID NO: 1155558 - RNA, 18 nt, Human
cagguaaucgaccugccu

SEQ ID NO: 1155559 - RNA, 17 nt, Human
cagguaaucgaccugcc

SEQ ID NO: 1155560 - RNA, 20 nt, Human
cagggcauggccagguggcc

SEQ ID NO: 1155561 - RNA, 17 nt, Human
cagggaaggggacaagg

SEQ ID NO: 1155562 - RNA, 15 nt, Human
cagggaaggggacaa

SEQ ID NO: 1155563 - RNA, 14 nt, Human
caggcugugaguuu

SEQ ID NO: 1155564 - RNA, 23 nt, Human
caggcuggucucgaacuccugac

SEQ ID NO: 1155565 - RNA, 22 nt, Human
caggcuggucucgaacuccuga

SEQ ID NO: 1155566 - RNA, 20 nt, Human
caggcuggucucgaacuccu

SEQ ID NO: 1155567 - RNA, 17 nt, Human
caggcuggcccugcccu

SEQ ID NO: 1155568 - RNA, 16 nt, Human
caggcuggcccugccc

SEQ ID NO: 1155569 - RNA, 15 nt, Human
caggcuggcccugcc

SEQ ID NO: 1155570 - RNA, 14 nt, Human
caggcuggcccugc

SEQ ID NO: 1155571 - RNA, 12 nt, Human
caggcuggcccu

SEQ ID NO: 1155572 - RNA, 23 nt, Human
caggcugcucuugaacuccugac

SEQ ID NO: 1155573 - RNA, 20 nt, Human
caggcugcucuugaacuccu

SEQ ID NO: 1155574 - RNA, 12 nt, Human
caggcugcucuu

SEQ ID NO: 1155575 - RNA, 21 nt, Human
caggcugagccucagucuccc

SEQ ID NO: 1155576 - RNA, 17 nt, Human
caggcugagccucaguc

SEQ ID NO: 1155577 - RNA, 16 nt, Human
caggcugagccucagu

SEQ ID NO: 1155578 - RNA, 15 nt, Human
caggcugagccucag

SEQ ID NO: 1155579 - RNA, 14 nt, Human
caggcugagccuca

SEQ ID NO: 1155580 - RNA, 13 nt, Human
caggcugagccuc

SEQ ID NO: 1155581 - RNA, 12 nt, Human
caggcugagccu

SEQ ID NO: 1155582 - RNA, 22 nt, Human
caggcucuucuccuuucacaac

SEQ ID NO: 1155583 - RNA, 18 nt, Human
caggcucuucuccuuuca

SEQ ID NO: 1155584 - RNA, 15 nt, Human
caggcucuucuccuu

SEQ ID NO: 1155585 - RNA, 14 nt, Human
caggcucuucuccu

SEQ ID NO: 1155586 - RNA, 12 nt, Human
caggcucuucuc

SEQ ID NO: 1155587 - RNA, 18 nt, Human
caggcuccugccaccacg

SEQ ID NO: 1155588 - RNA, 16 nt, Human
caggcuccugccacca

SEQ ID NO: 1155589 - RNA, 15 nt, Human
caggcuccugccacc

SEQ ID NO: 1155590 - RNA, 14 nt, Human
caggcuccugccac

SEQ ID NO: 1155591 - RNA, 13 nt, Human
caggcuccugcca

SEQ ID NO: 1155592 - RNA, 23 nt, Human
caggcccuuccucuccacugccu

SEQ ID NO: 1155593 - RNA, 21 nt, Human
caggcccuuccucuccacugc

SEQ ID NO: 1155594 - RNA, 20 nt, Human
caggcccuuccucuccacug

SEQ ID NO: 1155595 - RNA, 19 nt, Human
caggcccuuccucuccacu

SEQ ID NO: 1155596 - RNA, 17 nt, Human
caggcccuuccucucca

SEQ ID NO: 1155597 - RNA, 16 nt, Human
caggcccuuccucucc

SEQ ID NO: 1155598 - RNA, 15 nt, Human
caggcccuuccucuc

SEQ ID NO: 1155599 - RNA, 21 nt, Human
caggccauuccccgucucugg

SEQ ID NO: 1155600 - RNA, 18 nt, Human
caggccauuccccgucuc

SEQ ID NO: 1155601 - RNA, 20 nt, Human
caggcaggaaggcugagagg

SEQ ID NO: 1155602 - RNA, 19 nt, Human
caggauguacaaggacagc

SEQ ID NO: 1155603 - RNA, 13 nt, Human
caggauagacuuu

SEQ ID NO: 1155604 - RNA, 16 nt, Human
caggaguuggaagugu

SEQ ID NO: 1155605 - RNA, 16 nt, Human
caggacucugccuccu

SEQ ID NO: 1155606 - RNA, 15 nt, Human
caggacucugccucc

SEQ ID NO: 1155607 - RNA, 13 nt, Human
caggacucugccu

SEQ ID NO: 1155608 - RNA, 12 nt, Human
caggacucugcc

SEQ ID NO: 1155609 - RNA, 19 nt, Human
caggaaggcugagaggaga

SEQ ID NO: 1155610 - RNA, 14 nt, Human
caggaagcagcuuu

SEQ ID NO: 1155611 - RNA, 14 nt, Human
cagcuuugauauuu

SEQ ID NO: 1155612 - RNA, 23 nt, Human
cagcuuuccccaugucucgacuc

SEQ ID NO: 1155613 - RNA, 22 nt, Human
cagcuuuaaaaaauuaaucugg

SEQ ID NO: 1155614 - RNA, 17 nt, Human
cagcuggguuggaaaac

SEQ ID NO: 1155615 - RNA, 16 nt, Human
cagcuggguuggaaaa

SEQ ID NO: 1155616 - RNA, 23 nt, Human
cagcugggaucacauguggacuu

SEQ ID NO: 1155617 - RNA, 19 nt, Human
cagcuggccgggagccuga

SEQ ID NO: 1155618 - RNA, 21 nt, Human
cagcugcucaauaaaguacaa

SEQ ID NO: 1155619 - RNA, 21 nt, Human
cagcucacugcaaccuucgcc

SEQ ID NO: 1155620 - RNA, 15 nt, Human
cagcucacugcaacc

SEQ ID NO: 1155621 - RNA, 14 nt, Human
cagcucacugcaac

SEQ ID NO: 1155622 - RNA, 12 nt, Human
cagcucacugca

SEQ ID NO: 1155623 - RNA, 19 nt, Human
cagcuaaucagcauucuca

SEQ ID NO: 1155624 - RNA, 21 nt, Human
cagccuggcacagggcagugg

SEQ ID NO: 1155625 - RNA, 20 nt, Human
cagccuggcacagggcagug

SEQ ID NO: 1155626 - RNA, 13 nt, Human
cagccuggcacag

SEQ ID NO: 1155627 - RNA, 10 nt, Human
cagccuggca

SEQ ID NO: 1155628 - RNA, 15 nt, Human
cagccuccugaguag

SEQ ID NO: 1155629 - RNA, 20 nt, Human
cagccuccaugcugccucca

SEQ ID NO: 1155630 - RNA, 17 nt, Human
cagccuccaugcugccu

SEQ ID NO: 1155631 - RNA, 15 nt, Human
cagccuccaugcugc

SEQ ID NO: 1155632 - RNA, 14 nt, Human
cagccuccaugcug

SEQ ID NO: 1155633 - RNA, 20 nt, Human
cagccuccaagcuccaucuc

SEQ ID NO: 1155634 - RNA, 14 nt, Human
cagccuccaagcuc

SEQ ID NO: 1155635 - RNA, 20 nt, Human
cagccgugccuucagcucua

SEQ ID NO: 1155636 - RNA, 18 nt, Human
cagccgugccuucagcuc

SEQ ID NO: 1155637 - RNA, 16 nt, Human
cagccgugccuucagc

SEQ ID NO: 1155638 - RNA, 14 nt, Human
cagccgugccuuca

SEQ ID NO: 1155639 - RNA, 9 nt, Human
cagccgugc

SEQ ID NO: 1155640 - RNA, 23 nt, Human
cagcccugcuuugggcugcccug

SEQ ID NO: 1155641 - RNA, 22 nt, Human
cagcccugcuuugggcugcccu

SEQ ID NO: 1155642 - RNA, 21 nt, Human
cagcccugcuuugggcugccc

SEQ ID NO: 1155643 - RNA, 20 nt, Human
cagcccugcuuugggcugcc

SEQ ID NO: 1155644 - RNA, 19 nt, Human
cagcccugcuuugggcugc

SEQ ID NO: 1155645 - RNA, 13 nt, Human
cagcccugcuuug

SEQ ID NO: 1155646 - RNA, 11 nt, Human
cagcccugcuu

SEQ ID NO: 1155647 - RNA, 22 nt, Human
cagcccucccugccccucccuu

SEQ ID NO: 1155648 - RNA, 18 nt, Human
cagcccucccugccccuc

SEQ ID NO: 1155649 - RNA, 17 nt, Human
cagcccucccugccccu

SEQ ID NO: 1155650 - RNA, 16 nt, Human
cagcccucccugcccc

SEQ ID NO: 1155651 - RNA, 15 nt, Human
cagcccucccugccc

SEQ ID NO: 1155652 - RNA, 13 nt, Human
cagcccucccugc

SEQ ID NO: 1155653 - RNA, 23 nt, Human
cagcccuccaucuaaacugcccc

SEQ ID NO: 1155654 - RNA, 22 nt, Human
cagcccuccaucuaaacugccc

SEQ ID NO: 1155655 - RNA, 18 nt, Human
cagccuccaugcugccuc

SEQ ID NO: 1155656 - RNA, 19 nt, Human
cagcccacauagugauggu

SEQ ID NO: 1155657 - RNA, 15 nt, Human
cagcauucucacucc

SEQ ID NO: 1155658 - RNA, 14 nt, Human
cagcauucucacuc

SEQ ID NO: 1155659 - RNA, 23 nt, Human
cagcagccccugcacaaagcccu

SEQ ID NO: 1155660 - RNA, 16 nt, Human
cagcagccccugcaca

SEQ ID NO: 1155661 - RNA, 13 nt, Human
cagcagccccugc

SEQ ID NO: 1155662 - RNA, 20 nt, Human
cagcaauucuccugccucag

SEQ ID NO: 1155663 - RNA, 19 nt, Human
cagcaauucuccugccuca

SEQ ID NO: 1155664 - RNA, 18 nt, Human
cagcaauucuccugccuc

SEQ ID NO: 1155665 - RNA, 17 nt, Human
cagcaauucuccugccu

SEQ ID NO: 1155666 - RNA, 16 nt, Human
cagcaauucuccugcc

SEQ ID NO: 1155667 - RNA, 15 nt, Human
cagcaauucuccugc

SEQ ID NO: 1155668 - RNA, 22 nt, Human
cagauuuuuuacagcugccugc

SEQ ID NO: 1155669 - RNA, 19 nt, Human
cagauuuuuuacagcugcc

SEQ ID NO: 1155670 - RNA, 15 nt, Human
cagaugcugugcaaa

SEQ ID NO: 1155671 - RNA, 22 nt, Human
cagagccaccccuaaagagaua

SEQ ID NO: 1155672 - RNA, 18 nt, Human
cagagcacagcagccccu

SEQ ID NO: 1155673 - RNA, 18 nt, Human
cagagaguggcuccuccc

SEQ ID NO: 1155674 - RNA, 15 nt, Human
cagagaguggcuccu

SEQ ID NO: 1155675 - RNA, 14 nt, Human
cagagaguggcucc

SEQ ID NO: 1155676 - RNA, 13 nt, Human
cagagaguggcuc

SEQ ID NO: 1155677 - RNA, 20 nt, Human
cagacuuuuuuuaaauagua

SEQ ID NO: 1155678 - RNA, 23 nt, Human
cagaccccuggcuuuucacugcu

SEQ ID NO: 1155679 - RNA, 22 nt, Human
cagaccccuggcuuuucacugc

SEQ ID NO: 1155680 - RNA, 21 nt, Human
cagaccccuggcuuuucacug

SEQ ID NO: 1155681 - RNA, 18 nt, Human
cagaccccuggcuuuuca

SEQ ID NO: 1155682 - RNA, 16 nt, Human
cagaccccuggcuuuu

SEQ ID NO: 1155683 - RNA, 15 nt, Human
cagaccccuggcuuu

SEQ ID NO: 1155684 - RNA, 14 nt, Human
cagaccccuggcuu

SEQ ID NO: 1155685 - RNA, 13 nt, Human
cagaccccuggcu

SEQ ID NO: 1155686 - RNA, 15 nt, Human
cagaaucucgcucug

SEQ ID NO: 1155687 - RNA, 22 nt, Human
cagaacccuuggagccaaugga

SEQ ID NO: 1155688 - RNA, 13 nt, Human
cagaagcagcucu

SEQ ID NO: 1155689 - RNA, 14 nt, Human
cagaagcagcucuu

SEQ ID NO: 1155690 - RNA, 24 nt, Human
cagaaagaaguggggacagagcag

SEQ ID NO: 1155691 - RNA, 18 nt, Human
cacuuuuauuuagcacca

SEQ ID NO: 1155692 - RNA, 19 nt, Human
cacuugaugacccccaacc

SEQ ID NO: 1155693 - RNA, 20 nt, Human
cacuuccauaaucuggacuc

SEQ ID NO: 1155694 - RNA, 23 nt, Human
cacuucaggcucuucuccuuuca

SEQ ID NO: 1155695 - RNA, 20 nt, Human
cacuucaggcucuucuccuu

SEQ ID NO: 1155696 - RNA, 16 nt, Human
cacuucaggcucuucu

SEQ ID NO: 1155697 - RNA, 15 nt, Human
cacuucaggcucuuc

SEQ ID NO: 1155698 - RNA, 14 nt, Human
cacuucaggcucuu

SEQ ID NO: 1155699 - RNA, 18 nt, Human
cacuggacucaccucccc

SEQ ID NO: 1155700 - RNA, 15 nt, Human
cacuggacucaccuc

SEQ ID NO: 1155701 - RNA, 21 nt, Human
cacugcuggcugccuuagaac

SEQ ID NO: 1155702 - RNA, 16 nt, Human
cacugcuggcugccuu

SEQ ID NO: 1155703 - RNA, 15 nt, Human
cacugcuggcugccu

SEQ ID NO: 1155704 - RNA, 14 nt, Human
cacugcuggcugcc

SEQ ID NO: 1155705 - RNA, 13 nt, Human
cacugcuggcugc

SEQ ID NO: 1155706 - RNA, 12 nt, Human
cacugcuggcug

SEQ ID NO: 1155707 - RNA, 17 nt, Human
cacugcugcccagccuc

SEQ ID NO: 1155708 - RNA, 15 nt, Human
cacugcugcccagcc

SEQ ID NO: 1155709 - RNA, 20 nt, Human
cacugcucugaugaagagga

SEQ ID NO: 1155710 - RNA, 22 nt, Human
cacugccuucgauacaccgggc

SEQ ID NO: 1155711 - RNA, 20 nt, Human
cacugccuucgauacaccgg

SEQ ID NO: 1155712 - RNA, 16 nt, Human
cacugccucuuccucc

SEQ ID NO: 1155713 - RNA, 23 nt, Human
cacugcacagugcaucucagccc

SEQ ID NO: 1155714 - RNA, 22 nt, Human
cacugcacagugcaucucagcc

SEQ ID NO: 1155715 - RNA, 21 nt, Human
cacugcacagugcaucucagc

SEQ ID NO: 1155716 - RNA, 19 nt, Human
cacugcacagugcaucuca

SEQ ID NO: 1155717 - RNA, 18 nt, Human
cacugcacagugcaucuc

SEQ ID NO: 1155718 - RNA, 23 nt, Human
cacugcaaccuucgccaccuggg

SEQ ID NO: 1155719 - RNA, 22 nt, Human
cacugcaaccuucgccaccugg

SEQ ID NO: 1155720 - RNA, 14 nt, Human
cacugcaaccuucg

SEQ ID NO: 1155721 - RNA, 14 nt, Human
cacucuacuuagca

SEQ ID NO: 1155722 - RNA, 14 nt, Human
cacuccuaccuggu

SEQ ID NO: 1155723 - RNA, 13 nt, Human
cacuccuaccugg

SEQ ID NO: 1155724 - RNA, 19 nt, Human
cacuaucccggcugcccuu

SEQ ID NO: 1155725 - RNA, 18 nt, Human
cacuaucccggcugcccu

SEQ ID NO: 1155726 - RNA, 13 nt, Human
cacgugacagccg

SEQ ID NO: 1155727 - RNA, 15 nt, Human
cacgggggccaagga

SEQ ID NO: 1155728 - RNA, 14 nt, Human
cacgcuccuuccuc

SEQ ID NO: 1155729 - RNA, 14 nt, Human
caccuucccaugcc

SEQ ID NO: 1155730 - RNA, 13 nt, Human
caccuucccaugc

SEQ ID NO: 1155731 - RNA, 22 nt, Human
caccuuagccugcccuccuuuc

SEQ ID NO: 1155732 - RNA, 21 nt, Human
caccucccccaucucuucugg

SEQ ID NO: 1155733 - RNA, 14 nt, Human
caccucccccaucu

SEQ ID NO: 1155734 - RNA, 20 nt, Human
caccgugccuggccacgccc

SEQ ID NO: 1155735 - RNA, 15 nt, Human
caccgugccuggcca

SEQ ID NO: 1155736 - RNA, 15 nt, Human
caccggggccucgga

SEQ ID NO: 1155737 - RNA, 13 nt, Human
caccgggccugga

SEQ ID NO: 1155738 - RNA, 16 nt, Human
agcaaauguggcuccu

SEQ ID NO: 1155739 - RNA, 20 nt, Human
agcaaaugucuuccuggauu

SEQ ID NO: 1155740 - RNA, 17 nt, Human
agcaaaugucuuccugg

SEQ ID NO: 1155741 - RNA, 13 nt, Human
agcccucccugcc

SEQ ID NO: 1155742 - RNA, 12 nt, Human
agcccucccugc

SEQ ID NO: 1155743 - RNA, 23 nt, Human
agcccuccaucuaaacugccccc

SEQ ID NO: 1155744 - RNA, 18 nt, Human
agaagguuucagaaagaa

SEQ ID NO: 1155745 - RNA, 21 nt, Human
acuuuccucuuagucgagcca

SEQ ID NO: 1155746 - RNA, 23 nt, Human
agaggagggagcaucagugcccu

SEQ ID NO: 1155747 - RNA, 15 nt, Human
aggggccuggcagcc

SEQ ID NO: 1155748 - RNA, 13 nt, Human
aggggccuggcag

SEQ ID NO: 1155749 - RNA, 12 nt, Human
aggggccuggca

SEQ ID NO: 1155750 - RNA, 23 nt, Human
agggacugccagucccccugccc

SEQ ID NO: 1155751 - RNA, 23 nt, Human
aggcuggucucgaacuccugacc

SEQ ID NO: 1155752 - RNA, 11 nt, Human
aggcugagccu

SEQ ID NO: 1155753 - RNA, 22 nt, Human
aggcccuuccucuccacugccu

SEQ ID NO: 1155754 - RNA, 20 nt, Human
aggacccggaggggccuggc

SEQ ID NO: 1155755 - RNA, 18 nt, Human
aggacccggaggggccug

SEQ ID NO: 1155756 - RNA, 22 nt, Human
aggacccggaggggccuggcag

SEQ ID NO: 1155757 - RNA, 21 nt, Human
aggacccggaggggccuggca

SEQ ID NO: 1155758 - RNA, 20 nt, Human
aggaauaaauugcuccuuga

SEQ ID NO: 1155759 - RNA, 19 nt, Human
aggaauaaauugcuccuug

SEQ ID NO: 1155760 - RNA, 22 nt, Human
aggaaggcugagaggagagaga

SEQ ID NO: 1155761 - RNA, 16 nt, Human
agcuuuuaaacccuau

SEQ ID NO: 1155762 - RNA, 21 nt, Human
agcuaaucagcauucucacuc

SEQ ID NO: 1155763 - RNA, 16 nt, Human
agcuaaucagcauucu

SEQ ID NO: 1155764 - RNA, 23 nt, Human
agcccucccugccccucccuuca

SEQ ID NO: 1155765 - RNA, 22 nt, Human
agcccucccugccccucccuuc

SEQ ID NO: 1155766 - RNA, 20 nt, Human
agccuggcuccaaacccucg

SEQ ID NO: 1155767 - RNA, 19 nt, Human
agcccucccugccccuccc

SEQ ID NO: 1155768 - RNA, 17 nt, Human
agcccucccugccccuc

SEQ ID NO: 1155769 - RNA, 16 nt, Human
agcccucccugccccu

SEQ ID NO: 1155770 - RNA, 15 nt, Human
agcccucccugcccc

SEQ ID NO: 1155771 - RNA, 22 nt, Human
agccuggcuccaaacccucgag

SEQ ID NO: 1155772 - RNA, 15 nt, Human
agccuuuggaaacag

SEQ ID NO: 1155773 - RNA, 18 nt, Human
augaccacacuccagcug

SEQ ID NO: 1155774 - RNA, 17 nt, Human
aucucugcuuuggaaau

SEQ ID NO: 1155775 - RNA, 16 nt, Human
aucucugcuuuggaaa

SEQ ID NO: 1155776 - RNA, 15 nt, Human
aucccggcugcccuu

SEQ ID NO: 1155777 - RNA, 18 nt, Human
auccccaagccuggcaag

SEQ ID NO: 1155778 - RNA, 13 nt, Human
auccacucgccuu

SEQ ID NO: 1155779 - RNA, 18 nt, Human
auggcugugccucugccu

SEQ ID NO: 1155780 - RNA, 17 nt, Human
auggcugugccucugcc

SEQ ID NO: 1155781 - RNA, 16 nt, Human
auggcugugccucugc

SEQ ID NO: 1155782 - RNA, 15 nt, Human
auggcugugccucug

SEQ ID NO: 1155783 - RNA, 21 nt, Human
augcuuuaggauguacaguua

SEQ ID NO: 1155784 - RNA, 18 nt, Human
augcuuuaggauguacag

SEQ ID NO: 1155785 - RNA, 15 nt, Human
augcugccuccagaa

SEQ ID NO: 1155786 - RNA, 12 nt, Human
augcugccucca

SEQ ID NO: 1155787 - RNA, 21 nt, Human
augcugacuguacuccuccca

SEQ ID NO: 1155788 - RNA, 20 nt, Human
augcugacuguacuccuccc

SEQ ID NO: 1155789 - RNA, 19 nt, Human
augcugacuguacuccucc

SEQ ID NO: 1155790 - RNA, 19 nt, Human
auacccccugcaaagccca

SEQ ID NO: 1155791 - RNA, 17 nt, Human
auacccccugcaaagcc

SEQ ID NO: 1155792 - RNA, 21 nt, Human
auacccccugcaaagcccagc

SEQ ID NO: 1155793 - RNA, 20 nt, Human
auacccccugcaaagcccag

SEQ ID NO: 1155794 - RNA, 15 nt, Human
auaauguaaauaaag

SEQ ID NO: 1155795 - RNA, 14 nt, Human
auaguaaaaauaaa

SEQ ID NO: 1155796 - RNA, 13 nt, Human
auaguaaaaauaa

SEQ ID NO: 1155797 - RNA, 19 nt, Human
agucaugcguuuaaucaca

SEQ ID NO: 1155798 - RNA, 17 nt, Human
agugaccucagcuuuga

SEQ ID NO: 1155799 - RNA, 18 nt, Human
agugaccucagcuuugau

SEQ ID NO: 1155800 - RNA, 21 nt, Human
agugauucucaugccucagcc

SEQ ID NO: 1155801 - RNA, 20 nt, Human
agugauggguuaguggaugg

SEQ ID NO: 1155802 - RNA, 21 nt, Human
agugggacagggcauggccag

SEQ ID NO: 1155803 - RNA, 19 nt, Human
agugggacagggcauggcc

SEQ ID NO: 1155804 - RNA, 22 nt, Human
aacauccuacaagacacaguga

SEQ ID NO: 1155805 - RNA, 15 nt, Human
aacauccuacaagac

SEQ ID NO: 1155806 - RNA, 19 nt, Human
aaaauuaggauuucaugau

SEQ ID NO: 1155807 - RNA, 23 nt, Human
aaaauuaaucugggccagaauuu

SEQ ID NO: 1155808 - RNA, 17 nt, Human
aagauucaaucccagga

SEQ ID NO: 1155809 - RNA, 15 nt, Human
aaggacuaggguccu

SEQ ID NO: 1155810 - RNA, 13 nt, Human
aaggacuaggguc

SEQ ID NO: 1155811 - RNA, 22 nt, Human
aaggacccggaggggccuggca

SEQ ID NO: 1155812 - RNA, 18 nt, Human
aaguugauggugaugaaa

SEQ ID NO: 1155813 - RNA, 15 nt, Human
aaguggggacagagc

SEQ ID NO: 1155814 - RNA, 20 nt, Human
aaucuggacuccucugucca

SEQ ID NO: 1155815 - RNA, 18 nt, Human
aaucuggacuccucuguc

SEQ ID NO: 1155816 - RNA, 17 nt, Human
aaucuggacuccucugu

SEQ ID NO: 1155817 - RNA, 16 nt, Human
aaucuggacuccucug

SEQ ID NO: 1155818 - RNA, 15 nt, Human
aaucuggacuccucu

SEQ ID NO: 1155819 - RNA, 18 nt, Human
aaucucggcucacugcau

SEQ ID NO: 1155820 - RNA, 23 nt, Human
aaucucgcucugucgcccaggcu

SEQ ID NO: 1155821 - RNA, 23 nt, Human
aaugauguauguugaagccuuug

SEQ ID NO: 1155822 - RNA, 21 nt, Human
aaugcgcaggcuggcccugcc

SEQ ID NO: 1155823 - RNA, 20 nt, Human
aaugcgcaggcuggcccugc

SEQ ID NO: 1155824 - RNA, 19 nt, Human
aaugcgcaggcuggcccug

SEQ ID NO: 1155825 - RNA, 18 nt, Human
aaugcgcaggcuggcccu

SEQ ID NO: 1155826 - RNA, 17 nt, Human
aaugcgcaggcuggccc

SEQ ID NO: 1155827 - RNA, 15 nt, Human
aaugcgcaggcuggc

SEQ ID NO: 1155828 - RNA, 18 nt, Human
acaaccuucuguggcuca

SEQ ID NO: 1155829 - RNA, 12 nt, Human
accaccugccca

SEQ ID NO: 1155830 - RNA, 17 nt, Human
accauaggucaccuuua

SEQ ID NO: 1155831 - RNA, 21 nt, Human
accauacuaauuauacccccu

SEQ ID NO: 1155832 - RNA, 16 nt, Human
accauacuaauuauac

SEQ ID NO: 1155833 - RNA, 13 nt, Human
accauacuaauua

SEQ ID NO: 1155834 - RNA, 15 nt, Human
acauccuacaagaca

SEQ ID NO: 1155835 - RNA, 20 nt, Human
acauaauucaggaagcagcu

SEQ ID NO: 1155836 - RNA, 16 nt, Human
acagcugccugcagua

SEQ ID NO: 1155837 - RNA, 12 nt, Human
acagcugccugc

SEQ ID NO: 1155838 - RNA, 13 nt, Human
acagugcaucuca

SEQ ID NO: 1155839 - RNA, 13 nt, Human
acuucagcucugu

SEQ ID NO: 1155840 - RNA, 22 nt, Human
acuuaaaauauuccugcauuug

SEQ ID NO: 1155841 - RNA, 22 nt, Human
acuuucaggccacauggcuaaa

SEQ ID NO: 1155842 - RNA, 23 nt, Human
acugaccagccuccaugcugccu

SEQ ID NO: 1155843 - RNA, 20 nt, Human
acugaccagccuccaugcug

SEQ ID NO: 1155844 - RNA, 15 nt, Human
acugaccagccucca

SEQ ID NO: 1155845 - RNA, 13 nt, Human
acugaccagccuc

SEQ ID NO: 1155846 - RNA, 21 nt, Human
acucuacuuagcaugucccua

SEQ ID NO: 1155847 - RNA, 20 nt, Human
acucuacuuagcaugucccu

SEQ ID NO: 1155848 - RNA, 19 nt, Human
acugccagucccccugccc

SEQ ID NO: 1155849 - RNA, 18 nt, Human
acugccagucccccugcc

SEQ ID NO: 1155850 - RNA, 13 nt, Human
accugcccaaccu

SEQ ID NO: 1155851 - RNA, 23 nt, Human
accugccccuccucucugcccua

SEQ ID NO: 1155852 - RNA, 22 nt, Human
accucagguaaucgaccugccu

SEQ ID NO: 1155853 - RNA, 23 nt, Human
accucagguaaucgaccugccuc

SEQ ID NO: 1155854 - RNA, 17 nt, Human
gcccucacccuggggcu

SEQ ID NO: 1155855 - RNA, 16 nt, Human
gcccucacccuggggc

SEQ ID NO: 1155856 - RNA, 11 nt, Human
gccuccaugcu

SEQ ID NO: 1155857 - RNA, 17 nt, Human
gccuccaagcuccaucu

SEQ ID NO: 1155858 - RNA, 13 nt, Human
gccucggacuuag

SEQ ID NO: 1155859 - RNA, 19 nt, Human
gcuccucccggugcccaag

SEQ ID NO: 1155860 - RNA, 16 nt, Human
gcugagccucagucuc

SEQ ID NO: 1155861 - RNA, 12 nt, Human
gcugagccucag

SEQ ID NO: 1155862 - RNA, 20 nt, Human
gcugaacuuguuuucuggga

SEQ ID NO: 1155863 - RNA, 17 nt, Human
gcugagucccaggcuga

SEQ ID NO: 1155864 - RNA, 12 nt, Human
gcugugccucug

SEQ ID NO: 1155865 - RNA, 16 nt, Human
gcuuuccucuuccuga

SEQ ID NO: 1155866 - RNA, 22 nt, Human
gcuuuccccaugucucgacuca

SEQ ID NO: 1155867 - RNA, 21 nt, Human
gcuuuccccaugucucgacuc

SEQ ID NO: 1155868 - RNA, 17 nt, Human
ggaacaccauaggucac

SEQ ID NO: 1155869 - RNA, 17 nt, Human
ggaaaugucaacaagua

SEQ ID NO: 1155870 - RNA, 16 nt, Human
ggagcaucagugcccu

SEQ ID NO: 1155871 - RNA, 16 nt, Human
ggagccaauggagacu

SEQ ID NO: 1155872 - RNA, 21 nt, Human
ggauguacaaggacagccccu

SEQ ID NO: 1155873 - RNA, 21 nt, Human
ggaguuggaagugugugaucu

SEQ ID NO: 1155874 - RNA, 22 nt, Human
ggcacaaucucggcucacugca

SEQ ID NO: 1155875 - RNA, 16 nt, Human
ggcacagggcaguggg

SEQ ID NO: 1155876 - RNA, 17 nt, Human
ggcccuuccucuccacu

SEQ ID NO: 1155877 - RNA, 18 nt, Human
ggcccuuccucuccacug

SEQ ID NO: 1155878 - RNA, 15 nt, Human
ggcccuuccucucca

SEQ ID NO: 1155879 - RNA, 13 nt, Human
ggcccuuccucuc

SEQ ID NO: 1155880 - RNA, 15 nt, Human
ggcccgacagccugg

SEQ ID NO: 1155881 - RNA, 19 nt, Human
ggcucacugcauccuccgc

SEQ ID NO: 1155882 - RNA, 16 nt, Human
ggcucacugcauccuc

SEQ ID NO: 1155883 - RNA, 23 nt, Human
aaaguucccuacuuccugugacu

SEQ ID NO: 1155884 - RNA, 21 nt, Human
aaaguucccuacuuccuguga

SEQ ID NO: 1155885 - RNA, 20 nt, Human
gguuccuuccucugagccuu

SEQ ID NO: 1155886 - RNA, 19 nt, Human
gguuccuuccucugagccu

SEQ ID NO: 1155887 - RNA, 16 nt, Human
gguuccuccccuccuc

SEQ ID NO: 1155888 - RNA, 15 nt, Human
gguuccccuguucac

SEQ ID NO: 1155889 - RNA, 24 nt, Human
gguuccagcaauucuccugccuca

SEQ ID NO: 1155890 - RNA, 23 nt, Human
gguuccagcaauucuccugccuc

SEQ ID NO: 1155891 - RNA, 13 nt, Human
aaagcaaaugucu

SEQ ID NO: 1155892 - RNA, 19 nt, Human
aaagacaccuacugagugg

SEQ ID NO: 1155893 - RNA, 13 nt, Human
aaagacaccuacu

SEQ ID NO: 1155894 - RNA, 18 nt, Human
aaagaaguggggacagag

SEQ ID NO: 1155895 - RNA, 16 nt, Human
gguccacaacacacag

SEQ ID NO: 1155896 - RNA, 14 nt, Human
gguagcuuuucccu

SEQ ID NO: 1155897 - RNA, 24 nt, Human
gguacaaccuguucugcuuuccuc

SEQ ID NO: 1155898 - RNA, 23 nt, Human
gguacaaccuguucugcuuuccu

SEQ ID NO: 1155899 - RNA, 18 nt, Human
gguaaucgaccugccucg

SEQ ID NO: 1155900 - RNA, 17 nt, Human
gguaaucgaccugccuc

SEQ ID NO: 1155901 - RNA, 14 nt, Human
gguaaucgaccugc

SEQ ID NO: 1155902 - RNA, 12 nt, Human
ggggccuggcag

SEQ ID NO: 1155903 - RNA, 11 nt, Human
ggggccuggca

SEQ ID NO: 1155904 - RNA, 22 nt, Human
aaacauccuacaagacacagug

SEQ ID NO: 1155905 - RNA, 18 nt, Human
aaacauccuacaagacac

SEQ ID NO: 1155906 - RNA, 12 nt, Human
aaaaugugugug

SEQ ID NO: 1155907 - RNA, 18 nt, Human
gggcugggagcucugcag

SEQ ID NO: 1155908 - RNA, 16 nt, Human
gggcugggagcucugc

SEQ ID NO: 1155909 - RNA, 21 nt, Human
gggcugcccuggugcugccac

SEQ ID NO: 1155910 - RNA, 15 nt, Human
gggcugcccuggugc

SEQ ID NO: 1155911 - RNA, 14 nt, Human
gggcugcccuggug

SEQ ID NO: 1155912 - RNA, 13 nt, Human
gggcugcccuggu

SEQ ID NO: 1155913 - RNA, 23 nt, Human
gggcuacaccuuagccugcccuc

SEQ ID NO: 1155914 - RNA, 22 nt, Human
gggccucggacuuagcugggag

SEQ ID NO: 1155915 - RNA, 21 nt, Human
aaaaugcuguauuagucacag

SEQ ID NO: 1155916 - RNA, 12 nt, Human
gggauuacaggu

SEQ ID NO: 1155917 - RNA, 21 nt, Human
gggauuacaggcuccugccac

SEQ ID NO: 1155918 - RNA, 16 nt, Human
gggauuacaggcuccu

SEQ ID NO: 1155919 - RNA, 13 nt, Human
gggauuacaggcu

SEQ ID NO: 1155920 - RNA, 14 nt, Human
gggauuacaggcgu

SEQ ID NO: 1155921 - RNA, 23 nt, Human
aaaaauaugaccacacuccagcu

SEQ ID NO: 1155922 - RNA, 21 nt, Human
aaaaauaugaccacacuccag

SEQ ID NO: 1155923 - RNA, 18 nt, Human
gaaauccagggugguggu

SEQ ID NO: 1155924 - RNA, 13 nt, Human
gaaauccagggug

SEQ ID NO: 1155925 - RNA, 15 nt, Human
gaaguggggacagag

SEQ ID NO: 1155926 - RNA, 21 nt, Human
gaauuuuauuuuuugggaaaa

SEQ ID NO: 1155927 - RNA, 19 nt, Human
gacagccuggcacagggca

SEQ ID NO: 1155928 - RNA, 13 nt, Human
gacagcccuccau

SEQ ID NO: 1155929 - RNA, 18 nt, Human
gacuaggguccuggggaa

SEQ ID NO: 1155930 - RNA, 16 nt, Human
gacuaggguccugggg

SEQ ID NO: 1155931 - RNA, 15 nt, Human
gacuaggguccuggg

SEQ ID NO: 1155932 - RNA, 11 nt, Human
gacuuuccucu

SEQ ID NO: 1155933 - RNA, 23 nt, Human
gagaaggacccggaggggccugg

SEQ ID NO: 1155934 - RNA, 22 nt, Human
gagaaggacccggaggggccug

SEQ ID NO: 1155935 - RNA, 20 nt, Human
gagaaggacccggaggggcc

SEQ ID NO: 1155936 - RNA, 13 nt, Human
gagaccugccccu

SEQ ID NO: 1155937 - RNA, 12 nt, Human
gagaccugcccc

SEQ ID NO: 1155938 - RNA, 11 nt, Human
gagaccugccc

SEQ ID NO: 1155939 - RNA, 20 nt, Human
gauuacaggugugagccacc

SEQ ID NO: 1155940 - RNA, 22 nt, Human
gcacaaucucggcucacugcau

SEQ ID NO: 1155941 - RNA, 21 nt, Human
gcacaaucucggcucacugca

SEQ ID NO: 1155942 - RNA, 13 nt, Human
gcagggagggccu

SEQ ID NO: 1155943 - RNA, 10 nt, Human
gcagggaggg

SEQ ID NO: 1155944 - RNA, 21 nt, Human
gcaggcuggcccugcccuggu

SEQ ID NO: 1155945 - RNA, 20 nt, Human
gcaggcuggcccugcccugg

SEQ ID NO: 1155946 - RNA, 19 nt, Human
gcaggcuggcccugcccug

SEQ ID NO: 1155947 - RNA, 18 nt, Human
gcaggcuggcccugcccu

SEQ ID NO: 1155948 - RNA, 17 nt, Human
gcaggcuggcccugccc

SEQ ID NO: 1155949 - RNA, 16 nt, Human
gcaggcuggcccugcc

SEQ ID NO: 1155950 - RNA, 15 nt, Human
gcaggcuggcccugc

SEQ ID NO: 1155951 - RNA, 21 nt, Human
cuuccauaaucuggacuccuc

SEQ ID NO: 1155952 - RNA, 11 nt, Human
cuuccauaauc

SEQ ID NO: 1155953 - RNA, 21 nt, Human
cuucuguugcugccucaugcu

SEQ ID NO: 1155954 - RNA, 20 nt, Human
cuucuguugcugccucaugc

SEQ ID NO: 1155955 - RNA, 19 nt, Human
cuucuguugcugccucaug

SEQ ID NO: 1155956 - RNA, 18 nt, Human
cuucuguugcugccucau

SEQ ID NO: 1155957 - RNA, 17 nt, Human
cuucuguugcugccuca

SEQ ID NO: 1155958 - RNA, 17 nt, Human
cuucuagaaccaggcaa

SEQ ID NO: 1155959 - RNA, 13 nt, Human
cuucuagaaccag

SEQ ID NO: 1155960 - RNA, 16 nt, Human
cuuucacaaccuucug

SEQ ID NO: 1155961 - RNA, 14 nt, Human
cuuucacaaccuuc

SEQ ID NO: 1155962 - RNA, 15 nt, Human
cuuuguaaauuguca

SEQ ID NO: 1155963 - RNA, 21 nt, Human
cuuugggcugcccuggugcug

SEQ ID NO: 1155964 - RNA, 20 nt, Human
cuuugggcugcccuggugcu

SEQ ID NO: 1155965 - RNA, 19 nt, Human
cuuugggcugcccuggugc

SEQ ID NO: 1155966 - RNA, 15 nt, Human
cuuugggcugcccug

SEQ ID NO: 1155967 - RNA, 14 nt, Human
cuuugggcugcccu

SEQ ID NO: 1155968 - RNA, 22 nt, Human
cuuugauauuuucaacgcagcc

SEQ ID NO: 1155969 - RNA, 23 nt, Human
gaaaaugcuguauuagucacaga

SEQ ID NO: 1155970 - RNA, 21 nt, Human
cuuuuuuuuuuuugagacaga

SEQ ID NO: 1155971 - RNA, 20 nt, Human
cuuuuuuuuuuuugagacag

SEQ ID NO: 1155972 - RNA, 13 nt, Human
cuuuuggagucag

SEQ ID NO: 1155973 - RNA, 13 nt, Human
cuuuugccauuga

SEQ ID NO: 1155974 - RNA, 18 nt, Human
cuggcucccacaggcccu

SEQ ID NO: 1155975 - RNA, 15 nt, Human
cuggcucccacaggc

SEQ ID NO: 1155976 - RNA, 20 nt, Human
cuggcuccagcuggccggga

SEQ ID NO: 1155977 - RNA, 18 nt, Human
cuggcuccagcuggccgg

SEQ ID NO: 1155978 - RNA, 14 nt, Human
cuggcuccagcugg

SEQ ID NO: 1155979 - RNA, 13 nt, Human
cuggcuccagcug

SEQ ID NO: 1155980 - RNA, 19 nt, Human
cuggcuccaaacccucgag

SEQ ID NO: 1155981 - RNA, 20 nt, Human
cuggcuccaaacccucgagg

SEQ ID NO: 1155982 - RNA, 17 nt, Human
cuggggaaccugacccc

SEQ ID NO: 1155983 - RNA, 16 nt, Human
cuggggaaccugaccc

SEQ ID NO: 1155984 - RNA, 15 nt, Human
cuggggaaccugacc

SEQ ID NO: 1155985 - RNA, 23 nt, Human
cuggguuccuuccucugagccuu

SEQ ID NO: 1155986 - RNA, 22 nt, Human
cuggguuccuuccucugagccu

SEQ ID NO: 1155987 - RNA, 18 nt, Human
cuggguuccuuccucuga

SEQ ID NO: 1155988 - RNA, 22 nt, Human
cugguuuccugcccugggaggc

SEQ ID NO: 1155989 - RNA, 21 nt, Human
cugguuuccugcccugggagg

SEQ ID NO: 1155990 - RNA, 18 nt, Human
cugguuuccugcccuggg

SEQ ID NO: 1155991 - RNA, 12 nt, Human
cuguccugccua

SEQ ID NO: 1155992 - RNA, 16 nt, Human
cugucgcccaggcugg

SEQ ID NO: 1155993 - RNA, 13 nt, Human
cugcauuugugaa

SEQ ID NO: 1155994 - RNA, 20 nt, Human
cugcauucaggaucaaaccc

SEQ ID NO: 1155995 - RNA, 22 nt, Human
cugcauuugugaaaugauggug

SEQ ID NO: 1155996 - RNA, 17 nt, Human
cugcauuugugaaauga

SEQ ID NO: 1155997 - RNA, 15 nt, Human
cugcauuugugaaau

SEQ ID NO: 1155998 - RNA, 14 nt, Human
cugcauuugugaaa

SEQ ID NO: 1155999 - RNA, 23 nt, Human
cugcccugguuuccugcccuggg

SEQ ID NO: 1156000 - RNA, 22 nt, Human
cugcccugguuuccugcccugg

SEQ ID NO: 1156001 - RNA, 21 nt, Human
cugcccuggugcugccacacu

SEQ ID NO: 1156002 - RNA, 20 nt, Human
cugcccuggugcugccacac

SEQ ID NO: 1156003 - RNA, 19 nt, Human
cugcccuggugcugccaca

SEQ ID NO: 1156004 - RNA, 18 nt, Human
cugcccuggugcugccac

SEQ ID NO: 1156005 - RNA, 17 nt, Human
cugcccuggugcugcca

SEQ ID NO: 1156006 - RNA, 13 nt, Human
cugccccucccuu

SEQ ID NO: 1156007 - RNA, 19 nt, Human
cugcccccucugcccugcg

SEQ ID NO: 1156008 - RNA, 18 nt, Human
cugcccccucugcccugc

SEQ ID NO: 1156009 - RNA, 17 nt, Human
cugcccccucugcccug

SEQ ID NO: 1156010 - RNA, 16 nt, Human
cugcccccucugcccu

SEQ ID NO: 1156011 - RNA, 15 nt, Human
cugcccccucugccc

SEQ ID NO: 1156012 - RNA, 14 nt, Human
cugcccccucugcc

SEQ ID NO: 1156013 - RNA, 19 nt, Human
cugccccagggcucccggc

SEQ ID NO: 1156014 - RNA, 14 nt, Human
cugacagaaggacu

SEQ ID NO: 1156015 - RNA, 22 nt, Human
cugaaggaauaaauugcuccuu

SEQ ID NO: 1156016 - RNA, 22 nt, Human
cucuugccacugccucuuccuc

SEQ ID NO: 1156017 - RNA, 20 nt, Human
cucuugccacugccucuucc

SEQ ID NO: 1156018 - RNA, 19 nt, Human
cucuugccacugccucuuc

SEQ ID NO: 1156019 - RNA, 18 nt, Human
cucuugccacugccucuu

SEQ ID NO: 1156020 - RNA, 17 nt, Human
cucuugccacugccucu

SEQ ID NO: 1156021 - RNA, 16 nt, Human
cucuugccacugccuc

SEQ ID NO: 1156022 - RNA, 14 nt, Human
cucugguuccuccc

SEQ ID NO: 1156023 - RNA, 20 nt, Human
cucgggauuaguacacacuu

SEQ ID NO: 1156024 - RNA, 14 nt, Human
cucagcgaaugaau

SEQ ID NO: 1156025 - RNA, 13 nt, Human
cucagccuccuga

SEQ ID NO: 1156026 - RNA, 12 nt, Human
cucagccuccug

SEQ ID NO: 1156027 - RNA, 17 nt, Human
cuaucccggcugcccuu

SEQ ID NO: 1156028 - RNA, 16 nt, Human
cuaucccggcugcccu

SEQ ID NO: 1156029 - RNA, 15 nt, Human
cuaucccggcugccc

SEQ ID NO: 1156030 - RNA, 20 nt, Human
cucaugccucagccuccuga

SEQ ID NO: 1156031 - RNA, 18 nt, Human
cucaugccucagccuccu

SEQ ID NO: 1156032 - RNA, 14 nt, Human
cuccagaccccugg

SEQ ID NO: 1156033 - RNA, 23 nt, Human
cuaaacugcccccucugcccugc

SEQ ID NO: 1156034 - RNA, 22 nt, Human
cuaaacugcccccucugcccug

SEQ ID NO: 1156035 - RNA, 23 nt, Human
cgugagccaccgugccuggccac

SEQ ID NO: 1156036 - RNA, 16 nt, Human
cgugagaccugccccu

SEQ ID NO: 1156037 - RNA, 14 nt, Human
cgugagaccugccc

SEQ ID NO: 1156038 - RNA, 13 nt, Human
cgugagaccugcc

SEQ ID NO: 1156039 - RNA, 15 nt, Human
cuacaagacacagug

SEQ ID NO: 1156040 - RNA, 21 nt, Human
cgcaggcuggcccugcccugg

SEQ ID NO: 1156041 - RNA, 20 nt, Human
cgcaggcuggcccugcccug

SEQ ID NO: 1156042 - RNA, 19 nt, Human
cgcaggcuggcccugcccu

SEQ ID NO: 1156043 - RNA, 18 nt, Human
cgcaggcuggcccugccc

SEQ ID NO: 1156044 - RNA, 17 nt, Human
cgcaggcuggcccugcc

SEQ ID NO: 1156045 - RNA, 15 nt, Human
cgcaggcuggcccug

SEQ ID NO: 1156046 - RNA, 14 nt, Human
cgcaggcuggcccu

SEQ ID NO: 1156047 - RNA, 16 nt, Human
cgaccugccucggccu

SEQ ID NO: 1156048 - RNA, 21 nt, Human
cggcucacugcauccuccgcc

SEQ ID NO: 1156049 - RNA, 17 nt, Human
cggcucacugcauccuc

SEQ ID NO: 1156050 - RNA, 18 nt, Human
cggaggggccuggcagcc

SEQ ID NO: 1156051 - RNA, 14 nt, Human
cgaccaccugccca

SEQ ID NO: 1156052 - RNA, 12 nt, Human
cgaccaccugcc

SEQ ID NO: 1156053 - RNA, 18 nt, Human
ccaggcacugcugcccag

SEQ ID NO: 1156054 - RNA, 16 nt, Human
ccaggcacugcugccc

SEQ ID NO: 1156055 - RNA, 15 nt, Human
cccagcuugaaaccu

SEQ ID NO: 1156056 - RNA, 18 nt, Human
cccacuagacccacugga

SEQ ID NO: 1156057 - RNA, 13 nt, Human
ccccagaggcugg

SEQ ID NO: 1156058 - RNA, 17 nt, Human
cccuauugguaaagaau

SEQ ID NO: 1156059 - RNA, 19 nt, Human
ccccucuggcuccagcugg

SEQ ID NO: 1156060 - RNA, 15 nt, Human
cccucacccuggggc

SEQ ID NO: 1156061 - RNA, 19 nt, Human
cccuggcucccacaggccc

SEQ ID NO: 1156062 - RNA, 17 nt, Human
cccuggcucccacaggc

SEQ ID NO: 1156063 - RNA, 13 nt, Human
cccuggcuuuuca

SEQ ID NO: 1156064 - RNA, 17 nt, Human
cccuggcuuuucacugc

SEQ ID NO: 1156065 - RNA, 18 nt, Human
ccgucucugguuccuccc

SEQ ID NO: 1156066 - RNA, 23 nt, Human
ccggcuaugggggcacugaggac

SEQ ID NO: 1156067 - RNA, 22 nt, Human
ccggcuaugggggcacugagga

SEQ ID NO: 1156068 - RNA, 17 nt, Human
ccggcuaugggggcacu

SEQ ID NO: 1156069 - RNA, 19 nt, Human
ccggcuaauuuuuguauuu

SEQ ID NO: 1156070 - RNA, 22 nt, Human
ccuccaaucccaccaacccuca

SEQ ID NO: 1156071 - RNA, 22 nt, Human
ccuccaagcuccaucuccacuc

SEQ ID NO: 1156072 - RNA, 21 nt, Human
ccuccaagcuccaucuccacu

SEQ ID NO: 1156073 - RNA, 13 nt, Human
ccucagccuccug

SEQ ID NO: 1156074 - RNA, 20 nt, Human
ccucccaggcgccccuuccc

SEQ ID NO: 1156075 - RNA, 14 nt, Human
ccucccaggcgccc

SEQ ID NO: 1156076 - RNA, 18 nt, Human
ccucugcugauccuccca

SEQ ID NO: 1156077 - RNA, 15 nt, Human
ccucugcugauccuc

SEQ ID NO: 1156078 - RNA, 12 nt, Human
ccucugccuguc

SEQ ID NO: 1156079 - RNA, 12 nt, Human
ccucucugcccu

SEQ ID NO: 1156080 - RNA, 14 nt, Human
ccucuugccacugc

SEQ ID NO: 1156081 - RNA, 21 nt, Human
ccuggauccaucaggccacuu

SEQ ID NO: 1156082 - RNA, 18 nt, Human
ccuggcacagggcagugg

SEQ ID NO: 1156083 - RNA, 17 nt, Human
ccuggcacagggcagug

SEQ ID NO: 1156084 - RNA, 16 nt, Human
ccuggcacagggcagu

SEQ ID NO: 1156085 - RNA, 12 nt, Human
auugcuccuuga

SEQ ID NO: 1156086 - RNA, 17 nt, Human
auuagcaguuugcuuug

SEQ ID NO: 1156087 - RNA, 23 nt, Human
auuagauuucucauuugccaaua

SEQ ID NO: 1156088 - RNA, 23 nt, Human
auguuugggagacugcugaguca

SEQ ID NO: 1156089 - RNA, 16 nt, Human
auuugccaauaauaau

SEQ ID NO: 1156090 - RNA, 15 nt, Human
auuugccaauaauaa

SEQ ID NO: 1156091 - RNA, 14 nt, Human
auuugugccagaau

SEQ ID NO: 1156092 - RNA, 12 nt, Human
auuuggaaaaua

SEQ ID NO: 1156093 - RNA, 13 nt, Human
auuuggaaaauaa

SEQ ID NO: 1156094 - RNA, 15 nt, Human
cacuccagcugggau

SEQ ID NO: 1156095 - RNA, 12 nt, Human
cacuccagcugg

SEQ ID NO: 1156096 - RNA, 11 nt, Human
cacuccagcug

SEQ ID NO: 1156097 - RNA, 14 nt, Human
cacuaggcuucugg

SEQ ID NO: 1156098 - RNA, 23 nt, Human
cacuuaggaacguaaucgugucc

SEQ ID NO: 1156099 - RNA, 23 nt, Human
cacugguggcccgacagccuggc

SEQ ID NO: 1156100 - RNA, 18 nt, Human
cacugcauccuccgccuc

SEQ ID NO: 1156101 - RNA, 16 nt, Human
cacugcauccuccgcc

SEQ ID NO: 1156102 - RNA, 14 nt, Human
cacugcauccuccg

SEQ ID NO: 1156103 - RNA, 23 nt, Human
cacaggcccuuccucuccacugc

SEQ ID NO: 1156104 - RNA, 19 nt, Human
cacagcgcuggccgggacc

SEQ ID NO: 1156105 - RNA, 22 nt, Human
cacagcgcuggccgggaccccg

SEQ ID NO: 1156106 - RNA, 20 nt, Human
caauggagacugucucaaga

SEQ ID NO: 1156107 - RNA, 21 nt, Human
caaguaugaauaaagacaccu

SEQ ID NO: 1156108 - RNA, 19 nt, Human
caaguaugaauaaagacac

SEQ ID NO: 1156109 - RNA, 16 nt, Human
caaguaugaauaaaga

SEQ ID NO: 1156110 - RNA, 19 nt, Human
caagcucuaucaccaagga

SEQ ID NO: 1156111 - RNA, 16 nt, Human
cagauuugagcucagc

SEQ ID NO: 1156112 - RNA, 14 nt, Human
cagauuugagcuca

SEQ ID NO: 1156113 - RNA, 13 nt, Human
cagauuugagcuc

SEQ ID NO: 1156114 - RNA, 13 nt, Human
cagccccugcaca

SEQ ID NO: 1156115 - RNA, 23 nt, Human
caggcacugcugcccagccucca

SEQ ID NO: 1156116 - RNA, 17 nt, Human
caggcacugcugcccag

SEQ ID NO: 1156117 - RNA, 16 nt, Human
caggcacugcugccca

SEQ ID NO: 1156118 - RNA, 18 nt, Human
cagggagggccugggccc

SEQ ID NO: 1156119 - RNA, 23 nt, Human
ccaccgggcugggagcucugcag

SEQ ID NO: 1156120 - RNA, 11 nt, Human
ccaacuuguaa

SEQ ID NO: 1156121 - RNA, 12 nt, Human
ccaaaugcagcu

SEQ ID NO: 1156122 - RNA, 22 nt, Human
ccaaagugcugggauuacaggu

SEQ ID NO: 1156123 - RNA, 22 nt, Human
ccaaagugcugggauuacaggc

SEQ ID NO: 1156124 - RNA, 19 nt, Human
ccaaagugcugggauuaca

SEQ ID NO: 1156125 - RNA, 17 nt, Human
cauucucacuccuaccu

SEQ ID NO: 1156126 - RNA, 16 nt, Human
cauucucacuccuacc

SEQ ID NO: 1156127 - RNA, 13 nt, Human
cauuaugaugugu

SEQ ID NO: 1156128 - RNA, 20 nt, Human
cauuuuugaauacaggcaua

SEQ ID NO: 1156129 - RNA, 18 nt, Human
cauuuuugaauacaggca

SEQ ID NO: 1156130 - RNA, 18 nt, Human
cauuucauuugugccaga

SEQ ID NO: 1156131 - RNA, 12 nt, Human
caucgcaaugua

SEQ ID NO: 1156132 - RNA, 14 nt, Human
caugcugccuccag

SEQ ID NO: 1156133 - RNA, 12 nt, Human
caugcugccucc

SEQ ID NO: 1156134 - RNA, 23 nt, Human
cauaaucuggacuccucugucca

SEQ ID NO: 1156135 - RNA, 22 nt, Human
cauaaucuggacuccucugucc

SEQ ID NO: 1156136 - RNA, 21 nt, Human
cauaaucuggacuccucuguc

SEQ ID NO: 1156137 - RNA, 20 nt, Human
cauaaucuggacuccucugu

SEQ ID NO: 1156138 - RNA, 21 nt, Human
caguuugcuuuguaugcacuu

SEQ ID NO: 1156139 - RNA, 14 nt, Human
caguuugcuuugua

SEQ ID NO: 1156140 - RNA, 12 nt, Human
caguuugcuuug

SEQ ID NO: 1156141 - RNA, 19 nt, Human
cauagcccucacccugggg

SEQ ID NO: 1156142 - RNA, 15 nt, Human
cauagcccucacccu

SEQ ID NO: 1156143 - RNA, 12 nt, Human
cauagcccucac

SEQ ID NO: 1156144 - RNA, 17 nt, Human
auugcauuuccugacag

SEQ ID NO: 1156145 - RNA, 16 nt, Human
auucaaaaugauguau

SEQ ID NO: 1156146 - RNA, 16 nt, Human
auguuggccaggcugg

SEQ ID NO: 1156147 - RNA, 16 nt, Human
auguuggccaggcugc

SEQ ID NO: 1156148 - RNA, 16 nt, Human
auguugaagccuuugu

SEQ ID NO: 1156149 - RNA, 23 nt, Human
uuuuaaggguuuguggaaaauga

SEQ ID NO: 1156150 - RNA, 20 nt, Human
uuuuaaggguuuguggaaaa

SEQ ID NO: 1156151 - RNA, 22 nt, Human
uuuuaaaacacuuccauaaucu

SEQ ID NO: 1156152 - RNA, 16 nt, Human
uuuuaaaacacuucca

SEQ ID NO: 1156153 - RNA, 16 nt, Human
uuugugagcaggcugu

SEQ ID NO: 1156154 - RNA, 13 nt, Human
uuuguaaauuguc

SEQ ID NO: 1156155 - RNA, 24 nt, Human
augucccuaccgagucucuucucc

SEQ ID NO: 1156156 - RNA, 20 nt, Human
augucccaacuuguaaaaau

SEQ ID NO: 1156157 - RNA, 22 nt, Human
auggccagguggccacuccaga

SEQ ID NO: 1156158 - RNA, 16 nt, Human
auggccagguggccac

SEQ ID NO: 1156159 - RNA, 22 nt, Human
auggcacaaucucggcucacug

SEQ ID NO: 1156160 - RNA, 19 nt, Human
auggcaaggacugcaggga

SEQ ID NO: 1156161 - RNA, 24 nt, Human
uuucacugcuggcugccuuagaac

SEQ ID NO: 1156162 - RNA, 22 nt, Human
uuucacugcuggcugccuuaga

SEQ ID NO: 1156163 - RNA, 20 nt, Human
uuucacugcuggcugccuua

SEQ ID NO: 1156164 - RNA, 18 nt, Human
uuucacugcuggcugccu

SEQ ID NO: 1156165 - RNA, 17 nt, Human
uuucacugcuggcugcc

SEQ ID NO: 1156166 - RNA, 14 nt, Human
uuucacugcuggcu

SEQ ID NO: 1156167 - RNA, 18 nt, Human
augccccgucccccucug

SEQ ID NO: 1156168 - RNA, 19 nt, Human
augauuucagcucacugca

SEQ ID NO: 1156169 - RNA, 17 nt, Human
augauuucagcucacug

SEQ ID NO: 1156170 - RNA, 15 nt, Human
augaccacacuccag

SEQ ID NO: 1156171 - RNA, 18 nt, Human
uugggccccagaggcugg

SEQ ID NO: 1156172 - RNA, 22 nt, Human
aucuuuggacagaagcagcucu

SEQ ID NO: 1156173 - RNA, 23 nt, Human
aucuuuggacagaagcagcucuu

SEQ ID NO: 1156174 - RNA, 18 nt, Human
aucugaugcaagcaagaa

SEQ ID NO: 1156175 - RNA, 23 nt, Human
uugauggugaugaaauguaaaua

SEQ ID NO: 1156176 - RNA, 19 nt, Human
aucucuucuggguuccuuc

SEQ ID NO: 1156177 - RNA, 11 nt, Human
aucucagccca

SEQ ID NO: 1156178 - RNA, 14 nt, Human
auccuacaagacac

SEQ ID NO: 1156179 - RNA, 19 nt, Human
auccuaaugaaugcauaaa

SEQ ID NO: 1156180 - RNA, 13 nt, Human
auccuaaugaaug

SEQ ID NO: 1156181 - RNA, 12 nt, Human
auccuaaugaau

SEQ ID NO: 1156182 - RNA, 16 nt, Human
uugaaaguuuacagga

SEQ ID NO: 1156183 - RNA, 15 nt, Human
uucuuucuuccucug

SEQ ID NO: 1156184 - RNA, 13 nt, Human
uucuuucuuccuc

SEQ ID NO: 1156185 - RNA, 13 nt, Human
uucuuccucugcu

SEQ ID NO: 1156186 - RNA, 12 nt, Human
uucuuccucugc

SEQ ID NO: 1156187 - RNA, 11 nt, Human
uucuuccucug

SEQ ID NO: 1156188 - RNA, 17 nt, Human
uucuguugcugccucau

SEQ ID NO: 1156189 - RNA, 16 nt, Human
uucuguugcugccuca

SEQ ID NO: 1156190 - RNA, 15 nt, Human
uucuguugcugccuc

SEQ ID NO: 1156191 - RNA, 15 nt, Human
aucccaccaacccuc

SEQ ID NO: 1156192 - RNA, 22 nt, Human
uucugguugaugccugugaacu

SEQ ID NO: 1156193 - RNA, 15 nt, Human
uucugcacacagcac

SEQ ID NO: 1156194 - RNA, 14 nt, Human
uucuccugccucag

SEQ ID NO: 1156195 - RNA, 13 nt, Human
uucuccugccuca

SEQ ID NO: 1156196 - RNA, 12 nt, Human
uucuccugccuc

SEQ ID NO: 1156197 - RNA, 13 nt, Human
uucucagcuccca

SEQ ID NO: 1156198 - RNA, 20 nt, Human
uucgauacaccgggccugga

SEQ ID NO: 1156199 - RNA, 23 nt, Human
aucaaguuggcuucuaaucaaag

SEQ ID NO: 1156200 - RNA, 22 nt, Human
aucaaguuggcuucuaaucaaa

SEQ ID NO: 1156201 - RNA, 20 nt, Human
uuccuucaaagcaaaugucu

SEQ ID NO: 1156202 - RNA, 16 nt, Human
uuccucuccacugccu

SEQ ID NO: 1156203 - RNA, 15 nt, Human
uuccucuccacugcc

SEQ ID NO: 1156204 - RNA, 14 nt, Human
uuccucuccacugc

SEQ ID NO: 1156205 - RNA, 13 nt, Human
uuccucuccacug

SEQ ID NO: 1156206 - RNA, 12 nt, Human
uuccucuccacu

SEQ ID NO: 1156207 - RNA, 17 nt, Human
uucccuacuuccuguga

SEQ ID NO: 1156208 - RNA, 16 nt, Human
uucccuacuuccugug

SEQ ID NO: 1156209 - RNA, 14 nt, Human
uucccuacuuccug

SEQ ID NO: 1156210 - RNA, 22 nt, Human
uuccccuuccuaauuccacagc

SEQ ID NO: 1156211 - RNA, 17 nt, Human
uuccccuguucacucua

SEQ ID NO: 1156212 - RNA, 14 nt, Human
uuccccuguucacu

SEQ ID NO: 1156213 - RNA, 23 nt, Human
uuccauaaucuggacuccucugu

SEQ ID NO: 1156214 - RNA, 22 nt, Human
uuccauaaucuggacuccucug

SEQ ID NO: 1156215 - RNA, 19 nt, Human
uuccauaaucuggacuccu

SEQ ID NO: 1156216 - RNA, 15 nt, Human
uucacuuacagcacc

SEQ ID NO: 1156217 - RNA, 21 nt, Human
auagugaggcaucgcaaugua

SEQ ID NO: 1156218 - RNA, 17 nt, Human
uucaagugauucucaug

SEQ ID NO: 1156219 - RNA, 12 nt, Human
uuagcaccaggg

SEQ ID NO: 1156220 - RNA, 22 nt, Human
auaaucuggacuccucugucca

SEQ ID NO: 1156221 - RNA, 20 nt, Human
auaaucuggacuccucuguc

SEQ ID NO: 1156222 - RNA, 19 nt, Human
auaaucuggacuccucugu

SEQ ID NO: 1156223 - RNA, 18 nt, Human
auaaucuggacuccucug

SEQ ID NO: 1156224 - RNA, 17 nt, Human
uuagaaauugcauuucc

SEQ ID NO: 1156225 - RNA, 23 nt, Human
uuacucuucaguuaagccuuugg

SEQ ID NO: 1156226 - RNA, 18 nt, Human
uuacaggcuccugccacc

SEQ ID NO: 1156227 - RNA, 16 nt, Human
uuacaggcuccugcca

SEQ ID NO: 1156228 - RNA, 24 nt, Human
uuacaggcgugagccaccgugccu

SEQ ID NO: 1156229 - RNA, 21 nt, Human
uuaaucugggccagaauuuca

SEQ ID NO: 1156230 - RNA, 22 nt, Human
uuaauauuuauaggucacuuug

SEQ ID NO: 1156231 - RNA, 15 nt, Human
aguucccuacuuccu

SEQ ID NO: 1156232 - RNA, 21 nt, Human
aguuacucuucaguuaagccu

SEQ ID NO: 1156233 - RNA, 20 nt, Human
agugcugggauuacaggugu

SEQ ID NO: 1156234 - RNA, 20 nt, Human
agugcugggauuacaggcgu

SEQ ID NO: 1156235 - RNA, 17 nt, Human
agugcaucucagcccac

SEQ ID NO: 1156236 - RNA, 16 nt, Human
agugcaucucagccca

SEQ ID NO: 1156237 - RNA, 15 nt, Human
agugcaucucagccc

SEQ ID NO: 1156238 - RNA, 13 nt, Human
ugugccucugccu

SEQ ID NO: 1156239 - RNA, 12 nt, Human
ugugccucugcc

SEQ ID NO: 1156240 - RNA, 16 nt, Human
agucagacagaugugg

SEQ ID NO: 1156241 - RNA, 13 nt, Human
ugucgccucugca

SEQ ID NO: 1156242 - RNA, 16 nt, Human
ugucgcccaggcugga

SEQ ID NO: 1156243 - RNA, 15 nt, Human
ugucgcccaggcugg

SEQ ID NO: 1156244 - RNA, 13 nt, Human
agucacugcacag

SEQ ID NO: 1156245 - RNA, 15 nt, Human
aguaaaaauaaaauu

SEQ ID NO: 1156246 - RNA, 12 nt, Human
aguaaaaauaaa

SEQ ID NO: 1156247 - RNA, 17 nt, Human
agguggccacuccagac

SEQ ID NO: 1156248 - RNA, 14 nt, Human
agguggccacucca

SEQ ID NO: 1156249 - RNA, 19 nt, Human
aggucaccuuuauucuggc

SEQ ID NO: 1156250 - RNA, 18 nt, Human
aggucaccuuuauucugg

SEQ ID NO: 1156251 - RNA, 20 nt, Human
agguauaaguggugugugua

SEQ ID NO: 1156252 - RNA, 19 nt, Human
agguauaaguggugugugu

SEQ ID NO: 1156253 - RNA, 15 nt, Human
uggucucgaacuccu

SEQ ID NO: 1156254 - RNA, 19 nt, Human
uggucuaucuuugagcgcc

SEQ ID NO: 1156255 - RNA, 23 nt, Human
uggucacaggacucugccuccuc

SEQ ID NO: 1156256 - RNA, 22 nt, Human
uggucacaggacucugccuccu

SEQ ID NO: 1156257 - RNA, 21 nt, Human
ugguagcuuuucccuucuuuu

SEQ ID NO: 1156258 - RNA, 20 nt, Human
ugguagcuuuucccuucuuu

SEQ ID NO: 1156259 - RNA, 23 nt, Human
aggggccuggcagccgugccuuc

SEQ ID NO: 1156260 - RNA, 18 nt, Human
aggggccuggcagccgug

SEQ ID NO: 1156261 - RNA, 23 nt, Human
uggggcuaggaaauccagggugg

SEQ ID NO: 1156262 - RNA, 17 nt, Human
uggggacagagcagaac

SEQ ID NO: 1156263 - RNA, 21 nt, Human
ugggcugcccuggugcugcca

SEQ ID NO: 1156264 - RNA, 20 nt, Human
ugggcugcccuggugcugcc

SEQ ID NO: 1156265 - RNA, 19 nt, Human
ugggcugcccuggugcugc

SEQ ID NO: 1156266 - RNA, 17 nt, Human
ugggcugcccuggugcu

SEQ ID NO: 1156267 - RNA, 18 nt, Human
ugggccagaauuucaaac

SEQ ID NO: 1156268 - RNA, 17 nt, Human
ugggccagaauuucaaa

SEQ ID NO: 1156269 - RNA, 14 nt, Human
uggcccugcccugg

SEQ ID NO: 1156270 - RNA, 19 nt, Human
uggccagguggccacucca

SEQ ID NO: 1156271 - RNA, 17 nt, Human
uggccagguggccacuc

SEQ ID NO: 1156272 - RNA, 16 nt, Human
uggccagguggccacu

SEQ ID NO: 1156273 - RNA, 15 nt, Human
uggccagguggccac

SEQ ID NO: 1156274 - RNA, 11 nt, Human
uggccaggugg

SEQ ID NO: 1156275 - RNA, 18 nt, Human
uggcacagggcaguggga

SEQ ID NO: 1156276 - RNA, 15 nt, Human
uggauggaaggggcu

SEQ ID NO: 1156277 - RNA, 20 nt, Human
aggcaccuaccaccacgccc

SEQ ID NO: 1156278 - RNA, 14 nt, Human
uggagaacuagaga

SEQ ID NO: 1156279 - RNA, 23 nt, Human
uggaaggggacacgugacagccg

SEQ ID NO: 1156280 - RNA, 17 nt, Human
aggacagccccuccucc

SEQ ID NO: 1156281 - RNA, 13 nt, Human
ugcugugcaaaug

SEQ ID NO: 1156282 - RNA, 20 nt, Human
ugcugggauuacagguguga

SEQ ID NO: 1156283 - RNA, 14 nt, Human
ugcuggcugccuua

SEQ ID NO: 1156284 - RNA, 13 nt, Human
ugcuggcugccuu

SEQ ID NO: 1156285 - RNA, 15 nt, Human
aggaaauccagggug

SEQ ID NO: 1156286 - RNA, 14 nt, Human
aggaaauccagggu

SEQ ID NO: 1156287 - RNA, 22 nt, Human
ugcugacuguacuccucccagg

SEQ ID NO: 1156288 - RNA, 21 nt, Human
ugcugacuguacuccucccag

SEQ ID NO: 1156289 - RNA, 19 nt, Human
ugcugacuguacuccuccc

SEQ ID NO: 1156290 - RNA, 16 nt, Human
ugcugacuguacuccu

SEQ ID NO: 1156291 - RNA, 17 nt, Human
ugcgggucacaggaggg

SEQ ID NO: 1156292 - RNA, 16 nt, Human
ugcgggucacaggagg

SEQ ID NO: 1156293 - RNA, 14 nt, Human
ugcgggucacagga

SEQ ID NO: 1156294 - RNA, 23 nt, Human
ugcccaagaauagaugcugacug

SEQ ID NO: 1156295 - RNA, 22 nt, Human
ugcccaagaauagaugcugacu

SEQ ID NO: 1156296 - RNA, 21 nt, Human
ugcccaagaauagaugcugac

SEQ ID NO: 1156297 - RNA, 23 nt, Human
ugccacacuucaggcucuucucc

SEQ ID NO: 1156298 - RNA, 22 nt, Human
ugccacacuucaggcucuucuc

SEQ ID NO: 1156299 - RNA, 16 nt, Human
ugccacacuucaggcu

SEQ ID NO: 1156300 - RNA, 15 nt, Human
ugccacacuucaggc

SEQ ID NO: 1156301 - RNA, 14 nt, Human
ugccacacuucagg

SEQ ID NO: 1156302 - RNA, 13 nt, Human
ugccacacuucag

SEQ ID NO: 1156303 - RNA, 22 nt, Human
ugccaauaauaauaccucccuu

SEQ ID NO: 1156304 - RNA, 21 nt, Human
ugccaauaauaauaccucccu

SEQ ID NO: 1156305 - RNA, 18 nt, Human
ugcaguacuuuaccuccu

SEQ ID NO: 1156306 - RNA, 20 nt, Human
agccuccaugcugccuccag

SEQ ID NO: 1156307 - RNA, 18 nt, Human
agccuccaugcugccucc

SEQ ID NO: 1156308 - RNA, 19 nt, Human
agccguuuguuccccaaga

SEQ ID NO: 1156309 - RNA, 23 nt, Human
agccguggcuucccgcucagccc

SEQ ID NO: 1156310 - RNA, 22 nt, Human
agccguggcuucccgcucagcc

SEQ ID NO: 1156311 - RNA, 21 nt, Human
agccguggcuucccgcucagc

SEQ ID NO: 1156312 - RNA, 14 nt, Human
agccguggcuuccc

SEQ ID NO: 1156313 - RNA, 24 nt, Human
ugcacacagcacgggggccaagga

SEQ ID NO: 1156314 - RNA, 12 nt, Human
ugcacacagcac

SEQ ID NO: 1156315 - RNA, 23 nt, Human
agcccugcuuugggcugcccugg

SEQ ID NO: 1156316 - RNA, 22 nt, Human
agcccugcuuugggcugcccug

SEQ ID NO: 1156317 - RNA, 21 nt, Human
agcccugcuuugggcugcccu

SEQ ID NO: 1156318 - RNA, 14 nt, Human
ugaugaagaggagu

SEQ ID NO: 1156319 - RNA, 13 nt, Human
ugaugaagaggag

SEQ ID NO: 1156320 - RNA, 18 nt, Human
ugauccuuuuggagucag

SEQ ID NO: 1156321 - RNA, 18 nt, Human
agccaccgugccuggcca

SEQ ID NO: 1156322 - RNA, 23 nt, Human
ugauauuuucaacgcagcccugc

SEQ ID NO: 1156323 - RNA, 22 nt, Human
ugauauuuucaacgcagcccug

SEQ ID NO: 1156324 - RNA, 21 nt, Human
ugauauuuucaacgcagcccu

SEQ ID NO: 1156325 - RNA, 19 nt, Human
ugauauuuucaacgcagcc

SEQ ID NO: 1156326 - RNA, 13 nt, Human
ugaguagcuggga

SEQ ID NO: 1156327 - RNA, 20 nt, Human
agauuucucauuugccaaua

SEQ ID NO: 1156328 - RNA, 19 nt, Human
agauuccagagaguggcuc

SEQ ID NO: 1156329 - RNA, 18 nt, Human
agauuccagagaguggcu

SEQ ID NO: 1156330 - RNA, 23 nt, Human
agaugcugacuguacuccuccca

SEQ ID NO: 1156331 - RNA, 20 nt, Human
agaugcugacuguacuccuc

SEQ ID NO: 1156332 - RNA, 16 nt, Human
ugaauaaagacaccua

SEQ ID NO: 1156333 - RNA, 21 nt, Human
ugaagucacugcacagugcau

SEQ ID NO: 1156334 - RNA, 16 nt, Human
ugaagucacugcacag

SEQ ID NO: 1156335 - RNA, 15 nt, Human
ugaagucacugcaca

SEQ ID NO: 1156336 - RNA, 14 nt, Human
ugaagucacugcac

SEQ ID NO: 1156337 - RNA, 12 nt, Human
ugaagccuuugu

SEQ ID NO: 1156338 - RNA, 16 nt, Human
agagacuccagcuggg

SEQ ID NO: 1156339 - RNA, 19 nt, Human
ucuuucuaaugugugaauc

SEQ ID NO: 1156340 - RNA, 18 nt, Human
ucuuucuaaugugugaau

SEQ ID NO: 1156341 - RNA, 14 nt, Human
agaccccuggcuuu

SEQ ID NO: 1156342 - RNA, 18 nt, Human
ucuucuggguuccuuccu

SEQ ID NO: 1156343 - RNA, 14 nt, Human
ucuuccucugcuga

SEQ ID NO: 1156344 - RNA, 12 nt, Human
ucuuccucugcu

SEQ ID NO: 1156345 - RNA, 11 nt, Human
ucuuccucugc

SEQ ID NO: 1156346 - RNA, 19 nt, Human
ucuucaacugaccagccuc

SEQ ID NO: 1156347 - RNA, 16 nt, Human
ucuucaacugaccagc

SEQ ID NO: 1156348 - RNA, 15 nt, Human
ucuucaacucccugc

SEQ ID NO: 1156349 - RNA, 23 nt, Human
agaagcucccugaaguaagcaaa

SEQ ID NO: 1156350 - RNA, 14 nt, Human
ucugccugucuccc

SEQ ID NO: 1156351 - RNA, 12 nt, Human
ucugccugucuc

SEQ ID NO: 1156352 - RNA, 12 nt, Human
agaagcagcucu

SEQ ID NO: 1156353 - RNA, 13 nt, Human
agaagcagcucuu

SEQ ID NO: 1156354 - RNA, 15 nt, Human
ucucggcucacugca

SEQ ID NO: 1156355 - RNA, 20 nt, Human
ucucgcuauugucaccaggg

SEQ ID NO: 1156356 - RNA, 17 nt, Human
ucucgaacuccugaccu

SEQ ID NO: 1156357 - RNA, 16 nt, Human
acuuguuuucugggaa

SEQ ID NO: 1156358 - RNA, 14 nt, Human
acuuguaugaaaga

SEQ ID NO: 1156359 - RNA, 18 nt, Human
ucucacuccuaccuggua

SEQ ID NO: 1156360 - RNA, 17 nt, Human
ucucacuccuaccuggu

SEQ ID NO: 1156361 - RNA, 16 nt, Human
ucucacuccuaccugg

SEQ ID NO: 1156362 - RNA, 13 nt, Human
ucucacuccuacc

SEQ ID NO: 1156363 - RNA, 17 nt, Human
acuuccauaaucuggac

SEQ ID NO: 1156364 - RNA, 20 nt, Human
acuucaggcucuucuccuuu

SEQ ID NO: 1156365 - RNA, 18 nt, Human
acuucaggcucuucuccu

SEQ ID NO: 1156366 - RNA, 17 nt, Human
acuucaggcucuucucc

SEQ ID NO: 1156367 - RNA, 23 nt, Human
ucuaaacugcccccucugcccug

SEQ ID NO: 1156368 - RNA, 22 nt, Human
ucuaaacugcccccucugcccu

SEQ ID NO: 1156369 - RNA, 16 nt, Human
ucuaaacugcccccuc

SEQ ID NO: 1156370 - RNA, 13 nt, Human
ucuaaacugcccc

SEQ ID NO: 1156371 - RNA, 19 nt, Human
ucggggagaggcugaggac

SEQ ID NO: 1156372 - RNA, 20 nt, Human
acuguacuccucccaggcgc

SEQ ID NO: 1156373 - RNA, 19 nt, Human
uccucuugccacugccucu

SEQ ID NO: 1156374 - RNA, 14 nt, Human
uccucugaggcuga

SEQ ID NO: 1156375 - RNA, 17 nt, Human
uccucugagccuuggga

SEQ ID NO: 1156376 - RNA, 13 nt, Human
uccucugagccuu

SEQ ID NO: 1156377 - RNA, 12 nt, Human
uccucugagccu

SEQ ID NO: 1156378 - RNA, 15 nt, Human
uccucucugcccuaa

SEQ ID NO: 1156379 - RNA, 14 nt, Human
uccucucugcccua

SEQ ID NO: 1156380 - RNA, 13 nt, Human
uccucucugcccu

SEQ ID NO: 1156381 - RNA, 12 nt, Human
uccucucugccc

SEQ ID NO: 1156382 - RNA, 18 nt, Human
uccucuccacugccuucg

SEQ ID NO: 1156383 - RNA, 17 nt, Human
uccucuccacugccuuc

SEQ ID NO: 1156384 - RNA, 21 nt, Human
acucuucaguuaagccuuugg

SEQ ID NO: 1156385 - RNA, 20 nt, Human
acucuucaguuaagccuuug

SEQ ID NO: 1156386 - RNA, 23 nt, Human
acucugacaacagacuucugaaa

SEQ ID NO: 1156387 - RNA, 22 nt, Human
acucugacaacagacuucugaa

SEQ ID NO: 1156388 - RNA, 20 nt, Human
acucugacaacagacuucug

SEQ ID NO: 1156389 - RNA, 18 nt, Human
acucugacaacagacuuc

SEQ ID NO: 1156390 - RNA, 17 nt, Human
acucugacaacagacuu

SEQ ID NO: 1156391 - RNA, 14 nt, Human
acucguauaugucu

SEQ ID NO: 1156392 - RNA, 20 nt, Human
acucaccucccccaucucuu

SEQ ID NO: 1156393 - RNA, 19 nt, Human
acucaccucccccaucucu

SEQ ID NO: 1156394 - RNA, 13 nt, Human
acuauguugauaa

SEQ ID NO: 1156395 - RNA, 16 nt, Human
acuaugauuuggaaaa

SEQ ID NO: 1156396 - RNA, 15 nt, Human
acuaugauuuggaaa

SEQ ID NO: 1156397 - RNA, 19 nt, Human
ucccaccaacccucagagc

SEQ ID NO: 1156398 - RNA, 22 nt, Human
ucccacaggcccuuccucucca

SEQ ID NO: 1156399 - RNA, 21 nt, Human
ucccacaggcccuuccucucc

SEQ ID NO: 1156400 - RNA, 17 nt, Human
ucccacaggcccuuccu

SEQ ID NO: 1156401 - RNA, 15 nt, Human
ucccacaggcccuuc

SEQ ID NO: 1156402 - RNA, 20 nt, Human
ucccaaagugcugggauuac

SEQ ID NO: 1156403 - RNA, 17 nt, Human
accuucgccaccugggu

SEQ ID NO: 1156404 - RNA, 15 nt, Human
accuucgccaccugg

SEQ ID NO: 1156405 - RNA, 17 nt, Human
accuucccaugcccugg

SEQ ID NO: 1156406 - RNA, 19 nt, Human
uccaaaugcagcuuuaaaa

SEQ ID NO: 1156407 - RNA, 14 nt, Human
ucauuuuugaauac

SEQ ID NO: 1156408 - RNA, 17 nt, Human
accugcucuccucuugc

SEQ ID NO: 1156409 - RNA, 12 nt, Human
accugcucuccu

SEQ ID NO: 1156410 - RNA, 17 nt, Human
accugccucggccuccc

SEQ ID NO: 1156411 - RNA, 17 nt, Human
accugaccccugacccc

SEQ ID NO: 1156412 - RNA, 15 nt, Human
ucagugcuucgcaga

SEQ ID NO: 1156413 - RNA, 22 nt, Human
ucagguugucugaagucacugc

SEQ ID NO: 1156414 - RNA, 15 nt, Human
acccggaggggccug

SEQ ID NO: 1156415 - RNA, 14 nt, Human
acccucgaggcgga

SEQ ID NO: 1156416 - RNA, 18 nt, Human
acccucgaggcggaucuu

SEQ ID NO: 1156417 - RNA, 21 nt, Human
ucagguaaucgaccugccucg

SEQ ID NO: 1156418 - RNA, 20 nt, Human
ucagguaaucgaccugccuc

SEQ ID NO: 1156419 - RNA, 19 nt, Human
ucagguaaucgaccugccu

SEQ ID NO: 1156420 - RNA, 18 nt, Human
ucagguaaucgaccugcc

SEQ ID NO: 1156421 - RNA, 13 nt, Human
ucaggccacuuga

SEQ ID NO: 1156422 - RNA, 21 nt, Human
ucagaugcugugcaaauguua

SEQ ID NO: 1156423 - RNA, 21 nt, Human
ucagagccaccccuaaagaga

SEQ ID NO: 1156424 - RNA, 21 nt, Human
acccacuggacucaccucccc

SEQ ID NO: 1156425 - RNA, 17 nt, Human
acccacuggacucaccu

SEQ ID NO: 1156426 - RNA, 14 nt, Human
acccacuggacuca

SEQ ID NO: 1156427 - RNA, 18 nt, Human
accauguuggccaggcug

SEQ ID NO: 1156428 - RNA, 15 nt, Human
ucacugcacagugca

SEQ ID NO: 1156429 - RNA, 21 nt, Human
ucacugcaaccuucgccaccu

SEQ ID NO: 1156430 - RNA, 21 nt, Human
ucacagaacccuuggagccaa

SEQ ID NO: 1156431 - RNA, 15 nt, Human
accaacccucagagc

SEQ ID NO: 1156432 - RNA, 22 nt, Human
ucaagugauucucaugccucag

SEQ ID NO: 1156433 - RNA, 21 nt, Human
ucaagugauucucaugccuca

SEQ ID NO: 1156434 - RNA, 21 nt, Human
ucaagagggcacugguggccc

SEQ ID NO: 1156435 - RNA, 20 nt, Human
ucaagagggcacugguggcc

SEQ ID NO: 1156436 - RNA, 23 nt, Human
ucaaagcaaaugucuuccuggau

SEQ ID NO: 1156437 - RNA, 15 nt, Human
ucaaagcaaaugucu

SEQ ID NO: 1156438 - RNA, 22 nt, Human
acaggcccuuccucuccacugc

SEQ ID NO: 1156439 - RNA, 15 nt, Human
acaggcccuuccucu

SEQ ID NO: 1156440 - RNA, 13 nt, Human
acaggcccuuccu

SEQ ID NO: 1156441 - RNA, 16 nt, Human
acaggacucugccucc

SEQ ID NO: 1156442 - RNA, 16 nt, Human
acagccccuccuccau

SEQ ID NO: 1156443 - RNA, 14 nt, Human
acagccccuccucc

SEQ ID NO: 1156444 - RNA, 23 nt, Human
acagcccuccaucuaaacugccc

SEQ ID NO: 1156445 - RNA, 17 nt, Human
acagcagccccugcaca

SEQ ID NO: 1156446 - RNA, 19 nt, Human
acagcacgggggccaagga

SEQ ID NO: 1156447 - RNA, 22 nt, Human
acagauuugagcucagcccugg

SEQ ID NO: 1156448 - RNA, 15 nt, Human
uaucccggcugcccu

SEQ ID NO: 1156449 - RNA, 14 nt, Human
acacuuccauaauc

SEQ ID NO: 1156450 - RNA, 22 nt, Human
acacuucaggcucuucuccuuu

SEQ ID NO: 1156451 - RNA, 19 nt, Human
acacuucaggcucuucucc

SEQ ID NO: 1156452 - RNA, 15 nt, Human
acacuucaggcucuu

SEQ ID NO: 1156453 - RNA, 15 nt, Human
uauaggcaccuacca

SEQ ID NO: 1156454 - RNA, 13 nt, Human
uaguagagacggg

SEQ ID NO: 1156455 - RNA, 16 nt, Human
uaguaaaaauaaaauu

SEQ ID NO: 1156456 - RNA, 13 nt, Human
uaguaaaaauaaa

SEQ ID NO: 1156457 - RNA, 23 nt, Human
acacacagauuugagcucagccc

SEQ ID NO: 1156458 - RNA, 15 nt, Human
uagggugggccuuca

SEQ ID NO: 1156459 - RNA, 13 nt, Human
uaggguccugggg

SEQ ID NO: 1156460 - RNA, 19 nt, Human
uagggauggggcugugggg

SEQ ID NO: 1156461 - RNA, 13 nt, Human
uagcuuuucccuu

SEQ ID NO: 1156462 - RNA, 14 nt, Human
aauuccacagcugc

SEQ ID NO: 1156463 - RNA, 13 nt, Human
aauuccacagcug

SEQ ID NO: 1156464 - RNA, 12 nt, Human
aauuccacagcu

SEQ ID NO: 1156465 - RNA, 23 nt, Human
uacccccugcaaagcccagcuug

SEQ ID NO: 1156466 - RNA, 19 nt, Human
uacccccugcaaagcccag

SEQ ID NO: 1156467 - RNA, 15 nt, Human
uacccccugcaaagc

SEQ ID NO: 1156468 - RNA, 17 nt, Human
uacaccgggccuggaga

SEQ ID NO: 1156469 - RNA, 15 nt, Human
uacaccgggccugga

SEQ ID NO: 1156470 - RNA, 12 nt, Human
aauguaaauaaa

SEQ ID NO: 1156471 - RNA, 22 nt, Human
uaauuuuuuuuuuccuuuuaaa

SEQ ID NO: 1156472 - RNA, 21 nt, Human
uaauuuuuguauuuuuaguag

SEQ ID NO: 1156473 - RNA, 15 nt, Human
uaauuuuuguauuuu

SEQ ID NO: 1156474 - RNA, 24 nt, Human
aaugauuucagcucacugcaaccu

SEQ ID NO: 1156475 - RNA, 12 nt, Human
aaucccaggaug

SEQ ID NO: 1156476 - RNA, 19 nt, Human
aaucagcauucucacuccu

SEQ ID NO: 1156477 - RNA, 18 nt, Human
aaucagcauucucacucc

SEQ ID NO: 1156478 - RNA, 15 nt, Human
aauauuuauagguca

SEQ ID NO: 1156479 - RNA, 16 nt, Human
uaacuauguugauaaa

SEQ ID NO: 1156480 - RNA, 13 nt, Human
uaaaugugguaaa

SEQ ID NO: 1156481 - RNA, 21 nt, Human
aagugauucucaugccucagc

SEQ ID NO: 1156482 - RNA, 20 nt, Human
aagugauucucaugccucag

SEQ ID NO: 1156483 - RNA, 22 nt, Human
uaaaauauuccugcauuuguga

SEQ ID NO: 1156484 - RNA, 13 nt, Human
uaaaauauuccug

SEQ ID NO: 1156485 - RNA, 21 nt, Human
aagucaugcguuuaaucacau

SEQ ID NO: 1156486 - RNA, 13 nt, Human
aaguaagcaaaga

SEQ ID NO: 1156487 - RNA, 23 nt, Human
aaggcucugagcaaauguggcuc

SEQ ID NO: 1156488 - RNA, 21 nt, Human
aaggaauaaauugcuccuuga

SEQ ID NO: 1156489 - RNA, 20 nt, Human
aagcuccaucuccacuccag

SEQ ID NO: 1156490 - RNA, 14 nt, Human
aagcuccaucucca

SEQ ID NO: 1156491 - RNA, 23 nt, Human
aagcccuuccaugucgccucugc

SEQ ID NO: 1156492 - RNA, 20 nt, Human
aagcccuuccaugucgccuc

SEQ ID NO: 1156493 - RNA, 15 nt, Human
aagcccuuccauguc

SEQ ID NO: 1156494 - RNA, 20 nt, Human
gugugugaaaaugugugugu

SEQ ID NO: 1156495 - RNA, 23 nt, Human
aagauggcugugccucugccugu

SEQ ID NO: 1156496 - RNA, 21 nt, Human
aagauggcugugccucugccu

SEQ ID NO: 1156497 - RNA, 20 nt, Human
aagauggcugugccucugcc

SEQ ID NO: 1156498 - RNA, 17 nt, Human
gugggaagggcuacacc

SEQ ID NO: 1156499 - RNA, 12 nt, Human
gugccucugccu

SEQ ID NO: 1156500 - RNA, 22 nt, Human
gugaugguuccccuguucacuc

SEQ ID NO: 1156501 - RNA, 16 nt, Human
gugaugguuccccugu

SEQ ID NO: 1156502 - RNA, 14 nt, Human
gugaugguuccccu

SEQ ID NO: 1156503 - RNA, 23 nt, Human
aacucugacaacagacuucugaa

SEQ ID NO: 1156504 - RNA, 22 nt, Human
aacucugacaacagacuucuga

SEQ ID NO: 1156505 - RNA, 20 nt, Human
aacucugacaacagacuucu

SEQ ID NO: 1156506 - RNA, 21 nt, Human
aacuaugauuuggaaaauaaa

SEQ ID NO: 1156507 - RNA, 16 nt, Human
aacuaugauuuggaaa

SEQ ID NO: 1156508 - RNA, 23 nt, Human
aacuagacucccaagcuggacua

SEQ ID NO: 1156509 - RNA, 11 nt, Human
aaccugacccc

SEQ ID NO: 1156510 - RNA, 13 nt, Human
aacccaauaguug

SEQ ID NO: 1156511 - RNA, 18 nt, Human
aaccaagccguggcuucc

SEQ ID NO: 1156512 - RNA, 19 nt, Human
gucucgaacuccugaccuu

SEQ ID NO: 1156513 - RNA, 18 nt, Human
gucucgaacuccugaccu

SEQ ID NO: 1156514 - RNA, 13 nt, Human
gucucgaacuccu

SEQ ID NO: 1156515 - RNA, 21 nt, Human
gucaacaaguaugaauaaaga

SEQ ID NO: 1156516 - RNA, 17 nt, Human
gucaaacgugaaaaugc

SEQ ID NO: 1156517 - RNA, 15 nt, Human
gucaaacgugaaaau

SEQ ID NO: 1156518 - RNA, 14 nt, Human
gucaaacgugaaaa

SEQ ID NO: 1156519 - RNA, 12 nt, Human
aaaugugugugu

SEQ ID NO: 1156520 - RNA, 15 nt, Human
guaugcgugugugug

SEQ ID NO: 1156521 - RNA, 15 nt, Human
guauaaguggugugu

SEQ ID NO: 1156522 - RNA, 19 nt, Human
cacagugcaucucagccca

SEQ ID NO: 1156523 - RNA, 18 nt, Human
cacagugcaucucagccc

SEQ ID NO: 1156524 - RNA, 22 nt, Human
cacaggcccuuccucuccacug

SEQ ID NO: 1156525 - RNA, 21 nt, Human
cacaggcccuuccucuccacu

SEQ ID NO: 1156526 - RNA, 19 nt, Human
cacaggcccuuccucucca

SEQ ID NO: 1156527 - RNA, 18 nt, Human
cacaggcccuuccucucc

SEQ ID NO: 1156528 - RNA, 17 nt, Human
cacaggcccuuccucuc

SEQ ID NO: 1156529 - RNA, 16 nt, Human
cacaggcccuuccucu

SEQ ID NO: 1156530 - RNA, 22 nt, Human
cacagcugcucaauaaaguaca

SEQ ID NO: 1156531 - RNA, 12 nt, Human
cacagcugcuca

SEQ ID NO: 1156532 - RNA, 22 nt, Human
cacagauuugagcucagcccug

SEQ ID NO: 1156533 - RNA, 18 nt, Human
cacagauuugagcucagc

SEQ ID NO: 1156534 - RNA, 17 nt, Human
cacagauuugagcucag

SEQ ID NO: 1156535 - RNA, 16 nt, Human
cacagauuugagcuca

SEQ ID NO: 1156536 - RNA, 14 nt, Human
cacacuccagcugg

SEQ ID NO: 1156537 - RNA, 18 nt, Human
caauaauaauaccucccu

SEQ ID NO: 1156538 - RNA, 14 nt, Human
caaggagccaaaca

SEQ ID NO: 1156539 - RNA, 23 nt, Human
caagggaauuucuucaacucccu

SEQ ID NO: 1156540 - RNA, 17 nt, Human
caagagcuuaacagugu

SEQ ID NO: 1156541 - RNA, 16 nt, Human
caacuuguaaaugugg

SEQ ID NO: 1156542 - RNA, 12 nt, Human
caacuugggaac

SEQ ID NO: 1156543 - RNA, 20 nt, Human
caaccuucuguggcucacag

SEQ ID NO: 1156544 - RNA, 19 nt, Human
caaccuucuguggcucaca

SEQ ID NO: 1156545 - RNA, 17 nt, Human
caaccuucuguggcuca

SEQ ID NO: 1156546 - RNA, 16 nt, Human
caaccuggucacagga

SEQ ID NO: 1156547 - RNA, 23 nt, Human
caaccugcucuccucuugccacu

SEQ ID NO: 1156548 - RNA, 21 nt, Human
caaccugcucuccucuugcca

SEQ ID NO: 1156549 - RNA, 18 nt, Human
caaccugcucuccucuug

SEQ ID NO: 1156550 - RNA, 21 nt, Human
caaaguucccuacuuccugug

SEQ ID NO: 1156551 - RNA, 20 nt, Human
caaaguucccuacuuccugu

SEQ ID NO: 1156552 - RNA, 18 nt, Human
caaagugcugggauuaca

SEQ ID NO: 1156553 - RNA, 21 nt, Human
caaaaugagcccuguccugcc

SEQ ID NO: 1156554 - RNA, 11 nt, Human
uuuuuccuuuu

SEQ ID NO: 1156555 - RNA, 20 nt, Human
uuuggagucagacagaugug

SEQ ID NO: 1156556 - RNA, 16 nt, Human
uuucuuccucugcuga

SEQ ID NO: 1156557 - RNA, 14 nt, Human
uuucuuccucugcu

SEQ ID NO: 1156558 - RNA, 13 nt, Human
uuucuuccucugc

SEQ ID NO: 1156559 - RNA, 11 nt, Human
uuucuuccucu

SEQ ID NO: 1156560 - RNA, 13 nt, Human
uuuccugcccugg

SEQ ID NO: 1156561 - RNA, 12 nt, Human
uuuccugcccug

SEQ ID NO: 1156562 - RNA, 14 nt, Human
uguuggcagccucu

SEQ ID NO: 1156563 - RNA, 15 nt, Human
uguucugcuuuccuc

SEQ ID NO: 1156564 - RNA, 17 nt, Human
uguuagccccauaauuu

SEQ ID NO: 1156565 - RNA, 19 nt, Human
ugugugugcuuauguauga

SEQ ID NO: 1156566 - RNA, 20 nt, Human
ugugugugcuuauguaugag

SEQ ID NO: 1156567 - RNA, 17 nt, Human
ugugugugaaaaugugu

SEQ ID NO: 1156568 - RNA, 15 nt, Human
ugugugcuuauguau

SEQ ID NO: 1156569 - RNA, 18 nt, Human
uguguaugcgugugugug

SEQ ID NO: 1156570 - RNA, 22 nt, Human
ugugggcgugagaccugccccu

SEQ ID NO: 1156571 - RNA, 21 nt, Human
ugugggcgugagaccugcccc

SEQ ID NO: 1156572 - RNA, 20 nt, Human
ugugggcgugagaccugccc

SEQ ID NO: 1156573 - RNA, 10 nt, Human
uguggcucac

SEQ ID NO: 1156574 - RNA, 14 nt, Human
ugugcuuguuaacu

SEQ ID NO: 1156575 - RNA, 17 nt, Human
ugugaaaaugugugugu

SEQ ID NO: 1156576 - RNA, 16 nt, Human
ugugaaaaugugugug

SEQ ID NO: 1156577 - RNA, 20 nt, Human
ugucugaagucacugcacag

SEQ ID NO: 1156578 - RNA, 19 nt, Human
ugucugaagucacugcaca

SEQ ID NO: 1156579 - RNA, 18 nt, Human
ugucugaagucacugcac

SEQ ID NO: 1156580 - RNA, 17 nt, Human
ugucugaagucacugca

SEQ ID NO: 1156581 - RNA, 16 nt, Human
ugucugaagucacugc

SEQ ID NO: 1156582 - RNA, 16 nt, Human
ugucccaacuuguaaa

SEQ ID NO: 1156583 - RNA, 20 nt, Human
uguauuuauuuaguauuuau

SEQ ID NO: 1156584 - RNA, 23 nt, Human
uguacaaggacagccccuccucc

SEQ ID NO: 1156585 - RNA, 20 nt, Human
uguacaaggacagccccucc

SEQ ID NO: 1156586 - RNA, 16 nt, Human
uguacaaggacagccc

SEQ ID NO: 1156587 - RNA, 14 nt, Human
uggguuaguggaug

SEQ ID NO: 1156588 - RNA, 17 nt, Human
ugggauuacagguguga

SEQ ID NO: 1156589 - RNA, 20 nt, Human
uggccacuccagaccccugg

SEQ ID NO: 1156590 - RNA, 17 nt, Human
uggccacuccagacccc

SEQ ID NO: 1156591 - RNA, 19 nt, Human
uggcaggaguuggaagugu

SEQ ID NO: 1156592 - RNA, 15 nt, Human
uggacuccugcacac

SEQ ID NO: 1156593 - RNA, 15 nt, Human
uggacuccucugucc

SEQ ID NO: 1156594 - RNA, 20 nt, Human
uggacucaccucccccaucu

SEQ ID NO: 1156595 - RNA, 18 nt, Human
uggacucaccucccccau

SEQ ID NO: 1156596 - RNA, 15 nt, Human
uggacagaagcagcu

SEQ ID NO: 1156597 - RNA, 16 nt, Human
uggacagaagcagcuc

SEQ ID NO: 1156598 - RNA, 17 nt, Human
uggacagaagcagcucu

SEQ ID NO: 1156599 - RNA, 18 nt, Human
uggacagaagcagcucuu

SEQ ID NO: 1156600 - RNA, 22 nt, Human
uggaaacagcucgacuuuaaaa

SEQ ID NO: 1156601 - RNA, 17 nt, Human
uggaaacagcucgacuu

SEQ ID NO: 1156602 - RNA, 23 nt, Human
ugcugaaggaauaaauugcuccu

SEQ ID NO: 1156603 - RNA, 22 nt, Human
ugcucuccucuugccacugccu

SEQ ID NO: 1156604 - RNA, 21 nt, Human
ugcucuccucuugccacugcc

SEQ ID NO: 1156605 - RNA, 18 nt, Human
ugcucuccucuugccacu

SEQ ID NO: 1156606 - RNA, 16 nt, Human
ugcucuccucuugcca

SEQ ID NO: 1156607 - RNA, 21 nt, Human
ugccugugaacugaacucuga

SEQ ID NO: 1156608 - RNA, 18 nt, Human
ugccugugaacugaacuc

SEQ ID NO: 1156609 - RNA, 17 nt, Human
ugccugugaacugaacu

SEQ ID NO: 1156610 - RNA, 14 nt, Human
ugccugugaacuga

SEQ ID NO: 1156611 - RNA, 13 nt, Human
ugccccucccuuc

SEQ ID NO: 1156612 - RNA, 15 nt, Human
ugccccagggcuccc

SEQ ID NO: 1156613 - RNA, 21 nt, Human
ugcagagcaggaaacaugacu

SEQ ID NO: 1156614 - RNA, 21 nt, Human
ugagucccaggcugagccuca

SEQ ID NO: 1156615 - RNA, 20 nt, Human
ugagucccaggcugagccuc

SEQ ID NO: 1156616 - RNA, 23 nt, Human
ugagcuuaagaauuuugagcagg

SEQ ID NO: 1156617 - RNA, 20 nt, Human
ugagcucagcccuggugggc

SEQ ID NO: 1156618 - RNA, 12 nt, Human
ugagcucagccc

SEQ ID NO: 1156619 - RNA, 11 nt, Human
ugagcucagcc

SEQ ID NO: 1156620 - RNA, 22 nt, Human
ugagaccugccccuccucucug

SEQ ID NO: 1156621 - RNA, 15 nt, Human
ugagaccugccccuc

SEQ ID NO: 1156622 - RNA, 14 nt, Human
ugagaccugccccu

SEQ ID NO: 1156623 - RNA, 13 nt, Human
ugagaccugcccc

SEQ ID NO: 1156624 - RNA, 12 nt, Human
ugagaccugccc

SEQ ID NO: 1156625 - RNA, 23 nt, Human
ugaccagccuccaugcugccucc

SEQ ID NO: 1156626 - RNA, 22 nt, Human
ugaccagccuccaugcugccuc

SEQ ID NO: 1156627 - RNA, 21 nt, Human
ugaccagccuccaugcugccu

SEQ ID NO: 1156628 - RNA, 19 nt, Human
ugacauguguuggcagccu

SEQ ID NO: 1156629 - RNA, 15 nt, Human
ugacauauuuuugcu

SEQ ID NO: 1156630 - RNA, 19 nt, Human
ugacaacagacuucugaaa

SEQ ID NO: 1156631 - RNA, 18 nt, Human
ugacaacagacuucugaa

SEQ ID NO: 1156632 - RNA, 15 nt, Human
ugacaacagacuucu

SEQ ID NO: 1156633 - RNA, 14 nt, Human
ugaaugcauaaaau

SEQ ID NO: 1156634 - RNA, 16 nt, Human
ugaaucuuggugucua

SEQ ID NO: 1156635 - RNA, 20 nt, Human
ugaaaauuaggauuucauga

SEQ ID NO: 1156636 - RNA, 17 nt, Human
ucuugccacugccucuu

SEQ ID NO: 1156637 - RNA, 16 nt, Human
ucuugccacugccucu

SEQ ID NO: 1156638 - RNA, 23 nt, Human
ucuugcauggcaaggacugcagg

SEQ ID NO: 1156639 - RNA, 22 nt, Human
ucuucaguuaagccuuuggaaa

SEQ ID NO: 1156640 - RNA, 20 nt, Human
ucuucaguuaagccuuugga

SEQ ID NO: 1156641 - RNA, 19 nt, Human
ucuucaguuaagccuuugg

SEQ ID NO: 1156642 - RNA, 22 nt, Human
ucuggacuccucuguccaggca

SEQ ID NO: 1156643 - RNA, 18 nt, Human
ucuggacuccucugucca

SEQ ID NO: 1156644 - RNA, 16 nt, Human
ucuggacuccucuguc

SEQ ID NO: 1156645 - RNA, 15 nt, Human
ucuggacuccucugu

SEQ ID NO: 1156646 - RNA, 13 nt, Human
ucugcugaaggaa

SEQ ID NO: 1156647 - RNA, 15 nt, Human
ucugccuccucuuca

SEQ ID NO: 1156648 - RNA, 22 nt, Human
ucuaucuuugagcgcccacuag

SEQ ID NO: 1156649 - RNA, 14 nt, Human
ucuacuauuuaugu

SEQ ID NO: 1156650 - RNA, 17 nt, Human
uccuuaucaaaggacac

SEQ ID NO: 1156651 - RNA, 15 nt, Human
uccuuaucaaaggac

SEQ ID NO: 1156652 - RNA, 14 nt, Human
uccuuaucaaagga

SEQ ID NO: 1156653 - RNA, 22 nt, Human
uccucuguccaggcacugcugc

SEQ ID NO: 1156654 - RNA, 17 nt, Human
uccucuguccaggcacu

SEQ ID NO: 1156655 - RNA, 13 nt, Human
uccuccuggacuc

SEQ ID NO: 1156656 - RNA, 17 nt, Human
ucccuucuuuuucuucu

SEQ ID NO: 1156657 - RNA, 19 nt, Human
ucccugccccucccuucaa

SEQ ID NO: 1156658 - RNA, 18 nt, Human
ucccugccccucccuuca

SEQ ID NO: 1156659 - RNA, 14 nt, Human
ucccugccccuccc

SEQ ID NO: 1156660 - RNA, 16 nt, Human
ucccugccccccagcc

SEQ ID NO: 1156661 - RNA, 14 nt, Human
ucccucccuugggg

SEQ ID NO: 1156662 - RNA, 13 nt, Human
ucccucccuuggg

SEQ ID NO: 1156663 - RNA, 23 nt, Human
ucccuaccgagucucuucuccac

SEQ ID NO: 1156664 - RNA, 22 nt, Human
ucccuaccgagucucuucucca

SEQ ID NO: 1156665 - RNA, 21 nt, Human
ucccuaccgagucucuucucc

SEQ ID NO: 1156666 - RNA, 19 nt, Human
ucccuaccgagucucuucu

SEQ ID NO: 1156667 - RNA, 12 nt, Human
ucccaugcccug

SEQ ID NO: 1156668 - RNA, 19 nt, Human
ucccaggcugagccucagu

SEQ ID NO: 1156669 - RNA, 14 nt, Human
ucccaacuuguaaa

SEQ ID NO: 1156670 - RNA, 19 nt, Human
uccaugucgccucugcauu

SEQ ID NO: 1156671 - RNA, 18 nt, Human
uccaugucgccucugcau

SEQ ID NO: 1156672 - RNA, 17 nt, Human
uccaugucgccucugca

SEQ ID NO: 1156673 - RNA, 16 nt, Human
uccaugucgccucugc

SEQ ID NO: 1156674 - RNA, 23 nt, Human
uccauaaucuggacuccucuguc

SEQ ID NO: 1156675 - RNA, 19 nt, Human
uccagcuggguuggaaaac

SEQ ID NO: 1156676 - RNA, 22 nt, Human
uccagcuggccgggagccugau

SEQ ID NO: 1156677 - RNA, 21 nt, Human
uccagcuggccgggagccuga

SEQ ID NO: 1156678 - RNA, 15 nt, Human
uccagcuggccggga

SEQ ID NO: 1156679 - RNA, 21 nt, Human
uccagcaauucuccugccuca

SEQ ID NO: 1156680 - RNA, 20 nt, Human
uccagcaauucuccugccuc

SEQ ID NO: 1156681 - RNA, 19 nt, Human
uccagcaauucuccugccu

SEQ ID NO: 1156682 - RNA, 18 nt, Human
uccagcaauucuccugcc

SEQ ID NO: 1156683 - RNA, 22 nt, Human
uccagauuuuuuacagcugccu

SEQ ID NO: 1156684 - RNA, 22 nt, Human
uccagagaguggcuccucccgg

SEQ ID NO: 1156685 - RNA, 23 nt, Human
uccacuuagaaauugcauuuccu

SEQ ID NO: 1156686 - RNA, 21 nt, Human
uccacuuagaaauugcauuuc

SEQ ID NO: 1156687 - RNA, 17 nt, Human
ucaguuaagccuuugga

SEQ ID NO: 1156688 - RNA, 16 nt, Human
ucaguuaagccuuugg

SEQ ID NO: 1156689 - RNA, 18 nt, Human
ucaguccccgugaaggag

SEQ ID NO: 1156690 - RNA, 22 nt, Human
uagagaaggacccggaggggcc

SEQ ID NO: 1156691 - RNA, 13 nt, Human
uagagaaggaccc

SEQ ID NO: 1156692 - RNA, 20 nt, Human
uagacccacuggacucaccu

SEQ ID NO: 1156693 - RNA, 22 nt, Human
uacugcccaggccugccuguuc

SEQ ID NO: 1156694 - RNA, 21 nt, Human
uacugcccaggccugccuguu

SEQ ID NO: 1156695 - RNA, 20 nt, Human
uacugcccaggccugccugu

SEQ ID NO: 1156696 - RNA, 19 nt, Human
uacugcccaggccugccug

SEQ ID NO: 1156697 - RNA, 12 nt, Human
uacuccucccag

SEQ ID NO: 1156698 - RNA, 22 nt, Human
uaccgagucucuucuccacugg

SEQ ID NO: 1156699 - RNA, 21 nt, Human
uaccgagucucuucuccacug

SEQ ID NO: 1156700 - RNA, 18 nt, Human
uaccgagucucuucucca

SEQ ID NO: 1156701 - RNA, 17 nt, Human
uaccgagucucuucucc

SEQ ID NO: 1156702 - RNA, 14 nt, Human
uacagcugccugca

SEQ ID NO: 1156703 - RNA, 13 nt, Human
uacagcugccugc

SEQ ID NO: 1156704 - RNA, 18 nt, Human
uacagcuaaucagcauuc

SEQ ID NO: 1156705 - RNA, 16 nt, Human
uacagcuaaucagcau

SEQ ID NO: 1156706 - RNA, 23 nt, Human
uaaucugggccagaauuucaaac

SEQ ID NO: 1156707 - RNA, 18 nt, Human
uaaucugggccagaauuu

SEQ ID NO: 1156708 - RNA, 22 nt, Human
uaaucuggacuccucuguccag

SEQ ID NO: 1156709 - RNA, 21 nt, Human
uaaucuggacuccucugucca

SEQ ID NO: 1156710 - RNA, 20 nt, Human
uaaucuggacuccucugucc

SEQ ID NO: 1156711 - RNA, 19 nt, Human
uaaucuggacuccucuguc

SEQ ID NO: 1156712 - RNA, 18 nt, Human
uaaucuggacuccucugu

SEQ ID NO: 1156713 - RNA, 17 nt, Human
uaaucuggacuccucug

SEQ ID NO: 1156714 - RNA, 15 nt, Human
uaaucuggacuccuc

SEQ ID NO: 1156715 - RNA, 16 nt, Human
uaagugguguguguau

SEQ ID NO: 1156716 - RNA, 15 nt, Human
uaaguggugugugua

SEQ ID NO: 1156717 - RNA, 16 nt, Human
uaaaaucuugaaaaug

SEQ ID NO: 1156718 - RNA, 19 nt, Human
uaaaacacuuccauaaucu

SEQ ID NO: 1156719 - RNA, 21 nt, Human
guuuuuaaggguuuguggaaa

SEQ ID NO: 1156720 - RNA, 18 nt, Human
guuuguuccccaagacau

SEQ ID NO: 1156721 - RNA, 22 nt, Human
guugucugaagucacugcacag

SEQ ID NO: 1156722 - RNA, 19 nt, Human
guugucugaagucacugca

SEQ ID NO: 1156723 - RNA, 18 nt, Human
guuggccaggcuggucuc

SEQ ID NO: 1156724 - RNA, 19 nt, Human
guuggccaggcugcucuug

SEQ ID NO: 1156725 - RNA, 15 nt, Human
guuggccaggcuggu

SEQ ID NO: 1156726 - RNA, 14 nt, Human
guuggccaggcugg

SEQ ID NO: 1156727 - RNA, 14 nt, Human
guuggccaggcugc

SEQ ID NO: 1156728 - RNA, 14 nt, Human
guugaagccuuugu

SEQ ID NO: 1156729 - RNA, 13 nt, Human
guugaagccuuug

SEQ ID NO: 1156730 - RNA, 19 nt, Human
guucuuucuuccucugcug

SEQ ID NO: 1156731 - RNA, 18 nt, Human
guucuuucuuccucugcu

SEQ ID NO: 1156732 - RNA, 17 nt, Human
guucuuucuuccucugc

SEQ ID NO: 1156733 - RNA, 16 nt, Human
guucuuucuuccucug

SEQ ID NO: 1156734 - RNA, 15 nt, Human
guucuuucuuccucu

SEQ ID NO: 1156735 - RNA, 14 nt, Human
guucuuucuuccuc

SEQ ID NO: 1156736 - RNA, 16 nt, Human
guucugcacacagcac

SEQ ID NO: 1156737 - RNA, 15 nt, Human
guucugcacacagca

SEQ ID NO: 1156738 - RNA, 19 nt, Human
guuccuuccucugagccuu

SEQ ID NO: 1156739 - RNA, 18 nt, Human
guuccuuccucugagccu

SEQ ID NO: 1156740 - RNA, 17 nt, Human
guuccuuccucugagcc

SEQ ID NO: 1156741 - RNA, 23 nt, Human
guuccuccccuccuccuggacuc

SEQ ID NO: 1156742 - RNA, 23 nt, Human
guuccagcaauucuccugccuca

SEQ ID NO: 1156743 - RNA, 21 nt, Human
guuccagcaauucuccugccu

SEQ ID NO: 1156744 - RNA, 20 nt, Human
guuccagcaauucuccugcc

SEQ ID NO: 1156745 - RNA, 24 nt, Human
guucacucuacuuagcaugucccu

SEQ ID NO: 1156746 - RNA, 23 nt, Human
guucaagugauucucaugccuca

SEQ ID NO: 1156747 - RNA, 18 nt, Human
guuaacugagugccuuuu

SEQ ID NO: 1156748 - RNA, 15 nt, Human
guguguuucugaucu

SEQ ID NO: 1156749 - RNA, 13 nt, Human
guggggaggggcu

SEQ ID NO: 1156750 - RNA, 22 nt, Human
gugggcgugagaccugccccuc

SEQ ID NO: 1156751 - RNA, 21 nt, Human
gugggcgugagaccugccccu

SEQ ID NO: 1156752 - RNA, 18 nt, Human
gugggcgugagaccugcc

SEQ ID NO: 1156753 - RNA, 19 nt, Human
gugggccuucagggaguga

SEQ ID NO: 1156754 - RNA, 20 nt, Human
guggcuucccgcucagcccu

SEQ ID NO: 1156755 - RNA, 19 nt, Human
guggcuucccgcucagccc

SEQ ID NO: 1156756 - RNA, 18 nt, Human
guggcuucccgcucagcc

SEQ ID NO: 1156757 - RNA, 20 nt, Human
guggcuccucccggugccca

SEQ ID NO: 1156758 - RNA, 13 nt, Human
guggcuccucccg

SEQ ID NO: 1156759 - RNA, 15 nt, Human
gugccuucagcucua

SEQ ID NO: 1156760 - RNA, 23 nt, Human
gugcccaagaauagaugcugacu

SEQ ID NO: 1156761 - RNA, 20 nt, Human
gugcccaagaauagaugcug

SEQ ID NO: 1156762 - RNA, 14 nt, Human
gugcaucucagccc

SEQ ID NO: 1156763 - RNA, 13 nt, Human
gugcaucucagcc

SEQ ID NO: 1156764 - RNA, 14 nt, Human
gugauccacucgcc

SEQ ID NO: 1156765 - RNA, 18 nt, Human
gucucuucuccacuggau

SEQ ID NO: 1156766 - RNA, 17 nt, Human
gucucugguuccucccc

SEQ ID NO: 1156767 - RNA, 16 nt, Human
gucucugguuccuccc

SEQ ID NO: 1156768 - RNA, 13 nt, Human
gucucugagcauu

SEQ ID NO: 1156769 - RNA, 23 nt, Human
gucccuaccgagucucuucucca

SEQ ID NO: 1156770 - RNA, 22 nt, Human
gucccuaccgagucucuucucc

SEQ ID NO: 1156771 - RNA, 21 nt, Human
gucccuaccgagucucuucuc

SEQ ID NO: 1156772 - RNA, 21 nt, Human
gucccaggcugagccucaguc

SEQ ID NO: 1156773 - RNA, 19 nt, Human
gucccaggcugagccucag

SEQ ID NO: 1156774 - RNA, 18 nt, Human
gucccaggcugagccuca

SEQ ID NO: 1156775 - RNA, 17 nt, Human
gucccaggcugagccuc

SEQ ID NO: 1156776 - RNA, 16 nt, Human
gucccaggcugagccu

SEQ ID NO: 1156777 - RNA, 15 nt, Human
gucccaggcugagcc

SEQ ID NO: 1156778 - RNA, 22 nt, Human
gucagaugcugugcaaauguua

SEQ ID NO: 1156779 - RNA, 17 nt, Human
guauguugaagccuuug

SEQ ID NO: 1156780 - RNA, 19 nt, Human
guaugaauaaagacaccua

SEQ ID NO: 1156781 - RNA, 18 nt, Human
guaugaauaaagacaccu

SEQ ID NO: 1156782 - RNA, 23 nt, Human
guaugaaagauggcugugccucu

SEQ ID NO: 1156783 - RNA, 22 nt, Human
guaugaaagauggcugugccuc

SEQ ID NO: 1156784 - RNA, 16 nt, Human
guauauguugggugca

SEQ ID NO: 1156785 - RNA, 21 nt, Human
guauaugucucaggucccugc

SEQ ID NO: 1156786 - RNA, 15 nt, Human
guauaugucucaggu

SEQ ID NO: 1156787 - RNA, 13 nt, Human
guauaugucucag

SEQ ID NO: 1156788 - RNA, 22 nt, Human
guagggugggccuucagggagu

SEQ ID NO: 1156789 - RNA, 17 nt, Human
guagggugggccuucag

SEQ ID NO: 1156790 - RNA, 14 nt, Human
guagggugggccuu

SEQ ID NO: 1156791 - RNA, 22 nt, Human
gcuaggaaauccaggguggugg

SEQ ID NO: 1156792 - RNA, 19 nt, Human
gcuaggaaauccagggugg

SEQ ID NO: 1156793 - RNA, 20 nt, Human
gcgggucacaggagggaggg

SEQ ID NO: 1156794 - RNA, 19 nt, Human
gcgggucacaggagggagg

SEQ ID NO: 1156795 - RNA, 15 nt, Human
gcgggucacaggagg

SEQ ID NO: 1156796 - RNA, 13 nt, Human
gcgggucacagga

SEQ ID NO: 1156797 - RNA, 22 nt, Human
gccuuuggaaacagcucgacuu

SEQ ID NO: 1156798 - RNA, 23 nt, Human
gccuucgauacaccgggccugga

SEQ ID NO: 1156799 - RNA, 22 nt, Human
gccuucgauacaccgggccugg

SEQ ID NO: 1156800 - RNA, 18 nt, Human
gccuucgauacaccgggc

SEQ ID NO: 1156801 - RNA, 13 nt, Human
gccuucaucuccc

SEQ ID NO: 1156802 - RNA, 21 nt, Human
gccuucagggagugagggauu

SEQ ID NO: 1156803 - RNA, 13 nt, Human
gccuucagggagu

SEQ ID NO: 1156804 - RNA, 22 nt, Human
gccuaugugcaugcagcaucua

SEQ ID NO: 1156805 - RNA, 22 nt, Human
gccguggcuucccgcucagccc

SEQ ID NO: 1156806 - RNA, 21 nt, Human
gccguggcuucccgcucagcc

SEQ ID NO: 1156807 - RNA, 19 nt, Human
gccguggcuucccgcucag

SEQ ID NO: 1156808 - RNA, 19 nt, Human
gccgugccuucagcucuac

SEQ ID NO: 1156809 - RNA, 17 nt, Human
gccgugccuucagcucu

SEQ ID NO: 1156810 - RNA, 15 nt, Human
gccgugccuucagcu

SEQ ID NO: 1156811 - RNA, 14 nt, Human
gccgugccuucagc

SEQ ID NO: 1156812 - RNA, 19 nt, Human
gcccugcuuugggcugccc

SEQ ID NO: 1156813 - RNA, 18 nt, Human
gcccugcuuugggcugcc

SEQ ID NO: 1156814 - RNA, 16 nt, Human
gcccugcuuugggcug

SEQ ID NO: 1156815 - RNA, 18 nt, Human
gccgggaccccgagccug

SEQ ID NO: 1156816 - RNA, 19 nt, Human
gccgggaccccgagccugg

SEQ ID NO: 1156817 - RNA, 23 nt, Human
gccgggaccccgagccuggcucc

SEQ ID NO: 1156818 - RNA, 21 nt, Human
gcccuccaucuaaacugcccc

SEQ ID NO: 1156819 - RNA, 20 nt, Human
gcccuccaucuaaacugccc

SEQ ID NO: 1156820 - RNA, 16 nt, Human
gcccgacagccuggca

SEQ ID NO: 1156821 - RNA, 15 nt, Human
gcccgacagccuggc

SEQ ID NO: 1156822 - RNA, 14 nt, Human
gcccgacagccugg

SEQ ID NO: 1156823 - RNA, 12 nt, Human
gcccgacagccu

SEQ ID NO: 1156824 - RNA, 21 nt, Human
gccccauaauuuuuuuuuucc

SEQ ID NO: 1156825 - RNA, 19 nt, Human
gccccaguuguauuuauuu

SEQ ID NO: 1156826 - RNA, 20 nt, Human
gcccaggcuggagugcaaug

SEQ ID NO: 1156827 - RNA, 20 nt, Human
gcccacauagugaugguucc

SEQ ID NO: 1156828 - RNA, 22 nt, Human
gcccaagaauagaugcugacug

SEQ ID NO: 1156829 - RNA, 21 nt, Human
gcccaagaauagaugcugacu

SEQ ID NO: 1156830 - RNA, 24 nt, Human
gcccaaccugcucuccucuugcca

SEQ ID NO: 1156831 - RNA, 22 nt, Human
gccacuccagaccccuggcuuu

SEQ ID NO: 1156832 - RNA, 21 nt, Human
gccacuccagaccccuggcuu

SEQ ID NO: 1156833 - RNA, 20 nt, Human
gcauggcaaggacugcaggg

SEQ ID NO: 1156834 - RNA, 20 nt, Human
gcaggaaggcugagaggaga

SEQ ID NO: 1156835 - RNA, 14 nt, Human
gcagcccugcuuug

SEQ ID NO: 1156836 - RNA, 13 nt, Human
gcagcccugcuuu

SEQ ID NO: 1156837 - RNA, 24 nt, Human
gcacugguggcccgacagccuggc

SEQ ID NO: 1156838 - RNA, 23 nt, Human
gcacugguggcccgacagccugg

SEQ ID NO: 1156839 - RNA, 22 nt, Human
gcacugguggcccgacagccug

SEQ ID NO: 1156840 - RNA, 12 nt, Human
gcacugcugccc

SEQ ID NO: 1156841 - RNA, 21 nt, Human
gcaaagcccagcuugaaaccu

SEQ ID NO: 1156842 - RNA, 13 nt, Human
gcaaagcccagcu

SEQ ID NO: 1156843 - RNA, 22 nt, Human
gauuccagagaguggcuccucc

SEQ ID NO: 1156844 - RNA, 20 nt, Human
gauuccagagaguggcuccu

SEQ ID NO: 1156845 - RNA, 19 nt, Human
gauuccagagaguggcucc

SEQ ID NO: 1156846 - RNA, 20 nt, Human
gauggcugugccucugccug

SEQ ID NO: 1156847 - RNA, 19 nt, Human
gauggcugugccucugccu

SEQ ID NO: 1156848 - RNA, 18 nt, Human
gauggcugugccucugcc

SEQ ID NO: 1156849 - RNA, 17 nt, Human
gauggcugugccucugc

SEQ ID NO: 1156850 - RNA, 13 nt, Human
gauggcugugccu

SEQ ID NO: 1156851 - RNA, 13 nt, Human
gaucuuuggacag

SEQ ID NO: 1156852 - RNA, 21 nt, Human
gaucuuuggacagaagcagcu

SEQ ID NO: 1156853 - RNA, 20 nt, Human
gauccccaagccuggcaagg

SEQ ID NO: 1156854 - RNA, 19 nt, Human
gauacaccgggccuggaga

SEQ ID NO: 1156855 - RNA, 23 nt, Human
gaggaaaaccaagccguggcuuc

SEQ ID NO: 1156856 - RNA, 21 nt, Human
gaggaaaaccaagccguggcu

SEQ ID NO: 1156857 - RNA, 20 nt, Human
gaggaaaaccaagccguggc

SEQ ID NO: 1156858 - RNA, 19 nt, Human
gagccucagucucccuccc

SEQ ID NO: 1156859 - RNA, 13 nt, Human
gagaguggcuccu

SEQ ID NO: 1156860 - RNA, 13 nt, Human
gagacuuguauga

SEQ ID NO: 1156861 - RNA, 23 nt, Human
gagacugucucaagagggcacug

SEQ ID NO: 1156862 - RNA, 22 nt, Human
gagacugucucaagagggcacu

SEQ ID NO: 1156863 - RNA, 15 nt, Human
gacucaguggggagg

SEQ ID NO: 1156864 - RNA, 15 nt, Human
gacucagguugucug

SEQ ID NO: 1156865 - RNA, 17 nt, Human
gacgggguuucaccaug

SEQ ID NO: 1156866 - RNA, 19 nt, Human
gaccugccucggccuccca

SEQ ID NO: 1156867 - RNA, 15 nt, Human
gaccugccucggccu

SEQ ID NO: 1156868 - RNA, 21 nt, Human
gaccugccccuccucucugcc

SEQ ID NO: 1156869 - RNA, 23 nt, Human
gaccccucauagcccucacccug

SEQ ID NO: 1156870 - RNA, 22 nt, Human
gaccccucauagcccucacccu

SEQ ID NO: 1156871 - RNA, 20 nt, Human
gaccccgagccuggcuccaa

SEQ ID NO: 1156872 - RNA, 23 nt, Human
gacagaucucugcuuuggaaauc

SEQ ID NO: 1156873 - RNA, 21 nt, Human
gacagaucucugcuuuggaaa

SEQ ID NO: 1156874 - RNA, 19 nt, Human
gacagaucucugcuuugga

SEQ ID NO: 1156875 - RNA, 17 nt, Human
gacaccuacugaguggc

SEQ ID NO: 1156876 - RNA, 17 nt, Human
gacacagugaccauacu

SEQ ID NO: 1156877 - RNA, 15 nt, Human
gaagucacugcacag

SEQ ID NO: 1156878 - RNA, 23 nt, Human
gaaggcagggagggccugggccc

SEQ ID NO: 1156879 - RNA, 22 nt, Human
gaaggcagggagggccugggcc

SEQ ID NO: 1156880 - RNA, 20 nt, Human
gaaggcagggagggccuggg

SEQ ID NO: 1156881 - RNA, 18 nt, Human
gaaggcagggagggccug

SEQ ID NO: 1156882 - RNA, 23 nt, Human
gaaggacccggaggggccuggca

SEQ ID NO: 1156883 - RNA, 22 nt, Human
gaaggacccggaggggccuggc

SEQ ID NO: 1156884 - RNA, 22 nt, Human
gaaggaauaaauugcuccuuga

SEQ ID NO: 1156885 - RNA, 15 nt, Human
gaacuuguuuucugg

SEQ ID NO: 1156886 - RNA, 14 nt, Human
gaacuccugaccuc

SEQ ID NO: 1156887 - RNA, 13 nt, Human
gaacuccugaccu

SEQ ID NO: 1156888 - RNA, 16 nt, Human
gaacuccuaaaucaag

SEQ ID NO: 1156889 - RNA, 15 nt, Human
gaacuccuaaaucaa

SEQ ID NO: 1156890 - RNA, 16 nt, Human
gaaaguuuacaggaaa

SEQ ID NO: 1156891 - RNA, 14 nt, Human
gaaaguuuacagga

SEQ ID NO: 1156892 - RNA, 23 nt, Human
gaaagauggcugugccucugccu

SEQ ID NO: 1156893 - RNA, 22 nt, Human
gaaagauggcugugccucugcc

SEQ ID NO: 1156894 - RNA, 16 nt, Human
cuuuucacugcuggcu

SEQ ID NO: 1156895 - RNA, 12 nt, Human
cuuuucacugcu

SEQ ID NO: 1156896 - RNA, 18 nt, Human
cuuuuaaaacacuuccau

SEQ ID NO: 1156897 - RNA, 21 nt, Human
cuuuccgguguuuaagacauu

SEQ ID NO: 1156898 - RNA, 21 nt, Human
cuuuccccaugucucgacuca

SEQ ID NO: 1156899 - RNA, 20 nt, Human
cuuuccccaugucucgacuc

SEQ ID NO: 1156900 - RNA, 15 nt, Human
cuuuccccaugucuc

SEQ ID NO: 1156901 - RNA, 21 nt, Human
cuuguaugaaagauggcugug

SEQ ID NO: 1156902 - RNA, 18 nt, Human
cuuguaaaaauuaaaagu

SEQ ID NO: 1156903 - RNA, 15 nt, Human
cuuggggccuaugca

SEQ ID NO: 1156904 - RNA, 17 nt, Human
cuucuuuuuuugugaug

SEQ ID NO: 1156905 - RNA, 21 nt, Human
cugucucaagagggcacuggu

SEQ ID NO: 1156906 - RNA, 20 nt, Human
cugucucaagagggcacugg

SEQ ID NO: 1156907 - RNA, 19 nt, Human
cugucucaagagggcacug

SEQ ID NO: 1156908 - RNA, 18 nt, Human
cugucucaagagggcacu

SEQ ID NO: 1156909 - RNA, 23 nt, Human
cuguccaggcacugcugcccagc

SEQ ID NO: 1156910 - RNA, 22 nt, Human
cuguccaggcacugcugcccag

SEQ ID NO: 1156911 - RNA, 21 nt, Human
cuguccaggcacugcugccca

SEQ ID NO: 1156912 - RNA, 20 nt, Human
cuguccaggcacugcugccc

SEQ ID NO: 1156913 - RNA, 19 nt, Human
cuguccaggcacugcugcc

SEQ ID NO: 1156914 - RNA, 18 nt, Human
cuguccaggcacugcugc

SEQ ID NO: 1156915 - RNA, 23 nt, Human
cugguuaauauuuauaggucacu

SEQ ID NO: 1156916 - RNA, 21 nt, Human
cuggucucgaacuccugaccu

SEQ ID NO: 1156917 - RNA, 16 nt, Human
cuggucucgaacuccu

SEQ ID NO: 1156918 - RNA, 23 nt, Human
cuggucacaggacucugccuccu

SEQ ID NO: 1156919 - RNA, 22 nt, Human
cuggucacaggacucugccucc

SEQ ID NO: 1156920 - RNA, 21 nt, Human
cuggucacaggacucugccuc

SEQ ID NO: 1156921 - RNA, 20 nt, Human
cuggucacaggacucugccu

SEQ ID NO: 1156922 - RNA, 19 nt, Human
cugggccccaguuguauuu

SEQ ID NO: 1156923 - RNA, 15 nt, Human
cugggccccaguugu

SEQ ID NO: 1156924 - RNA, 18 nt, Human
cugggauuacagguguga

SEQ ID NO: 1156925 - RNA, 16 nt, Human
cugggauuacaggugu

SEQ ID NO: 1156926 - RNA, 14 nt, Human
cugggaggcaguga

SEQ ID NO: 1156927 - RNA, 23 nt, Human
cuggcuuuucacugcuggcugcc

SEQ ID NO: 1156928 - RNA, 16 nt, Human
cuggcacagggcagug

SEQ ID NO: 1156929 - RNA, 15 nt, Human
cuggcacagggcagu

SEQ ID NO: 1156930 - RNA, 17 nt, Human
cugcuuugggcugcccu

SEQ ID NO: 1156931 - RNA, 16 nt, Human
cugcuuugggcugccc

SEQ ID NO: 1156932 - RNA, 13 nt, Human
cugcuuuggaaau

SEQ ID NO: 1156933 - RNA, 15 nt, Human
cugcuggcugccuua

SEQ ID NO: 1156934 - RNA, 14 nt, Human
cugcuggcugccuu

SEQ ID NO: 1156935 - RNA, 13 nt, Human
cugcuggcugccu

SEQ ID NO: 1156936 - RNA, 19 nt, Human
cugcucuugaacuccugac

SEQ ID NO: 1156937 - RNA, 18 nt, Human
cugcucuugaacuccuga

SEQ ID NO: 1156938 - RNA, 16 nt, Human
cugcucuugaacuccu

SEQ ID NO: 1156939 - RNA, 23 nt, Human
cugcgggucacaggagggagggg

SEQ ID NO: 1156940 - RNA, 22 nt, Human
cugcgggucacaggagggaggg

SEQ ID NO: 1156941 - RNA, 21 nt, Human
cugcgggucacaggagggagg

SEQ ID NO: 1156942 - RNA, 15 nt, Human
cugcgggucacagga

SEQ ID NO: 1156943 - RNA, 21 nt, Human
cugccugcaguacuuuaccuc

SEQ ID NO: 1156944 - RNA, 20 nt, Human
cugccugcaguacuuuaccu

SEQ ID NO: 1156945 - RNA, 22 nt, Human
cugcccuaaugcgcaggcuggc

SEQ ID NO: 1156946 - RNA, 21 nt, Human
cugcccuaaugcgcaggcugg

SEQ ID NO: 1156947 - RNA, 20 nt, Human
cugcccuaaugcgcaggcug

SEQ ID NO: 1156948 - RNA, 17 nt, Human
cugcccaggccugccug

SEQ ID NO: 1156949 - RNA, 22 nt, Human
cugagccucagucucccucccu

SEQ ID NO: 1156950 - RNA, 21 nt, Human
cugagccucagucucccuccc

SEQ ID NO: 1156951 - RNA, 16 nt, Human
cugagccucagucucc

SEQ ID NO: 1156952 - RNA, 17 nt, Human
cugaacucugacaacag

SEQ ID NO: 1156953 - RNA, 16 nt, Human
cugaacucugacaaca

SEQ ID NO: 1156954 - RNA, 22 nt, Human
cugaaauagacccacaagaggc

SEQ ID NO: 1156955 - RNA, 15 nt, Human
cucuugaacuccuga

SEQ ID NO: 1156956 - RNA, 22 nt, Human
cucuggcuccagcuggccggga

SEQ ID NO: 1156957 - RNA, 16 nt, Human
cucuggcuccagcugg

SEQ ID NO: 1156958 - RNA, 15 nt, Human
cucuggcuccagcug

SEQ ID NO: 1156959 - RNA, 22 nt, Human
cucuccucuugccacugccucu

SEQ ID NO: 1156960 - RNA, 19 nt, Human
cucuccucuugccacugcc

SEQ ID NO: 1156961 - RNA, 17 nt, Human
cucuccucuugccacug

SEQ ID NO: 1156962 - RNA, 16 nt, Human
cucuccucuugccacu

SEQ ID NO: 1156963 - RNA, 15 nt, Human
cucuccucuugccac

SEQ ID NO: 1156964 - RNA, 14 nt, Human
cucuccucuugcca

SEQ ID NO: 1156965 - RNA, 15 nt, Human
cucuccacugccuuc

SEQ ID NO: 1156966 - RNA, 14 nt, Human
cucuccacugccuu

SEQ ID NO: 1156967 - RNA, 12 nt, Human
cucuccacugcc

SEQ ID NO: 1156968 - RNA, 11 nt, Human
cucuccacugc

SEQ ID NO: 1156969 - RNA, 20 nt, Human
cucuacuuagcaugucccua

SEQ ID NO: 1156970 - RNA, 19 nt, Human
cucuacuuagcaugucccu

SEQ ID NO: 1156971 - RNA, 17 nt, Human
cucuacuuagcaugucc

SEQ ID NO: 1156972 - RNA, 16 nt, Human
cucuacuuagcauguc

SEQ ID NO: 1156973 - RNA, 21 nt, Human
cucuacagcuaaucagcauuc

SEQ ID NO: 1156974 - RNA, 18 nt, Human
cucggcucacugcauccu

SEQ ID NO: 1156975 - RNA, 17 nt, Human
cucggcucacugcaucc

SEQ ID NO: 1156976 - RNA, 16 nt, Human
cuccugccucagccuc

SEQ ID NO: 1156977 - RNA, 17 nt, Human
cuccucccggugcccaa

SEQ ID NO: 1156978 - RNA, 15 nt, Human
cuccucccggugccc

SEQ ID NO: 1156979 - RNA, 14 nt, Human
cuccucccggugcc

SEQ ID NO: 1156980 - RNA, 15 nt, Human
cuccgccucccgggu

SEQ ID NO: 1156981 - RNA, 13 nt, Human
cucccucauucca

SEQ ID NO: 1156982 - RNA, 20 nt, Human
cucccggcuaugggggcacu

SEQ ID NO: 1156983 - RNA, 22 nt, Human
cucccaaagugcugggauuaca

SEQ ID NO: 1156984 - RNA, 18 nt, Human
cucccaaagugcugggau

SEQ ID NO: 1156985 - RNA, 17 nt, Human
cucccaaagugcuggga

SEQ ID NO: 1156986 - RNA, 22 nt, Human
cuccaugucucugagcauuaga

SEQ ID NO: 1156987 - RNA, 13 nt, Human
cuccaugucucug

SEQ ID NO: 1156988 - RNA, 13 nt, Human
cuccaugcugccu

SEQ ID NO: 1156989 - RNA, 16 nt, Human
cuccaucuccacucca

SEQ ID NO: 1156990 - RNA, 21 nt, Human
cucacuaucccggcugcccuu

SEQ ID NO: 1156991 - RNA, 20 nt, Human
cucacuaucccggcugcccu

SEQ ID NO: 1156992 - RNA, 20 nt, Human
cucacuaggcuucugguuga

SEQ ID NO: 1156993 - RNA, 16 nt, Human
cucacuaggcuucugg

SEQ ID NO: 1156994 - RNA, 13 nt, Human
cucacuaggcuuc

SEQ ID NO: 1156995 - RNA, 21 nt, Human
cucaagagggcacugguggcc

SEQ ID NO: 1156996 - RNA, 19 nt, Human
cucaagagggcacuggugg

SEQ ID NO: 1156997 - RNA, 17 nt, Human
cucaagagggcacuggu

SEQ ID NO: 1156998 - RNA, 17 nt, Human
cuaggaaauccagggug

SEQ ID NO: 1156999 - RNA, 16 nt, Human
cuaggaaauccagggu

SEQ ID NO: 1157000 - RNA, 18 nt, Human
cuagacucccaagcugga

SEQ ID NO: 1157001 - RNA, 20 nt, Human
cuacuuccugugacuucagc

SEQ ID NO: 1157002 - RNA, 20 nt, Human
cuacuuccccuuccuaauuc

SEQ ID NO: 1157003 - RNA, 15 nt, Human
cuacuuccccuuccu

SEQ ID NO: 1157004 - RNA, 14 nt, Human
cuacuuccccuucc

SEQ ID NO: 1157005 - RNA, 22 nt, Human
cuaaugaaugcauaaaauguua

SEQ ID NO: 1157006 - RNA, 19 nt, Human
cuaaugaaugcauaaaaug

SEQ ID NO: 1157007 - RNA, 16 nt, Human
cuaauccucuuuuucu

SEQ ID NO: 1157008 - RNA, 20 nt, Human
cuaaucagcauucucacucc

SEQ ID NO: 1157009 - RNA, 19 nt, Human
cuaaucagcauucucacuc

SEQ ID NO: 1157010 - RNA, 17 nt, Human
cuaaucagcauucucac

SEQ ID NO: 1157011 - RNA, 14 nt, Human
cuaaggcugaacuu

SEQ ID NO: 1157012 - RNA, 21 nt, Human
cguggcuucccgcucagcccu

SEQ ID NO: 1157013 - RNA, 20 nt, Human
cguggcuucccgcucagccc

SEQ ID NO: 1157014 - RNA, 19 nt, Human
cguggcuucccgcucagcc

SEQ ID NO: 1157015 - RNA, 18 nt, Human
cguggcuucccgcucagc

SEQ ID NO: 1157016 - RNA, 19 nt, Human
cgggucacaggagggaggg

SEQ ID NO: 1157017 - RNA, 11 nt, Human
cgggucacagg

SEQ ID NO: 1157018 - RNA, 17 nt, Human
cgggauuaguacacacu

SEQ ID NO: 1157019 - RNA, 21 nt, Human
cgggagccugaucaccugccc

SEQ ID NO: 1157020 - RNA, 12 nt, Human
cggcugcccuuu

SEQ ID NO: 1157021 - RNA, 11 nt, Human
cggcugcccuu

SEQ ID NO: 1157022 - RNA, 21 nt, Human
cgcucagcccucccugccccu

SEQ ID NO: 1157023 - RNA, 16 nt, Human
cgcucagcccucccug

SEQ ID NO: 1157024 - RNA, 12 nt, Human
cgcucagcccuc

SEQ ID NO: 1157025 - RNA, 13 nt, Human
cgccccuuccccc

SEQ ID NO: 1157026 - RNA, 19 nt, Human
cgccccucccacagcgcug

SEQ ID NO: 1157027 - RNA, 21 nt, Human
cgccccucccacagcgcuggc

SEQ ID NO: 1157028 - RNA, 13 nt, Human
ccucugaggcuga

SEQ ID NO: 1157029 - RNA, 12 nt, Human
ccucugagccuu

SEQ ID NO: 1157030 - RNA, 11 nt, Human
ccucugagccu

SEQ ID NO: 1157031 - RNA, 16 nt, Human
ccuccucucugcccua

SEQ ID NO: 1157032 - RNA, 15 nt, Human
ccuccucucugcccu

SEQ ID NO: 1157033 - RNA, 13 nt, Human
ccuccucucugcc

SEQ ID NO: 1157034 - RNA, 15 nt, Human
ccuccccuccuccug

SEQ ID NO: 1157035 - RNA, 19 nt, Human
ccuccaugcugccuccaga

SEQ ID NO: 1157036 - RNA, 16 nt, Human
ccucagagccaccccu

SEQ ID NO: 1157037 - RNA, 14 nt, Human
ccucacccuggggc

SEQ ID NO: 1157038 - RNA, 21 nt, Human
ccuacuuccccuuccuaauuc

SEQ ID NO: 1157039 - RNA, 16 nt, Human
ccuacuuccccuuccu

SEQ ID NO: 1157040 - RNA, 13 nt, Human
ccuacuuccccuu

SEQ ID NO: 1157041 - RNA, 23 nt, Human
ccgggagccugaucaccugcccu

SEQ ID NO: 1157042 - RNA, 16 nt, Human
ccgggagccugaucac

SEQ ID NO: 1157043 - RNA, 21 nt, Human
ccggaggggccuggcagccgu

SEQ ID NO: 1157044 - RNA, 19 nt, Human
cccuucuuuuucuucuuuu

SEQ ID NO: 1157045 - RNA, 11 nt, Human
cccuucuuuuu

SEQ ID NO: 1157046 - RNA, 21 nt, Human
cccuuccuaauuccacagcug

SEQ ID NO: 1157047 - RNA, 20 nt, Human
cccuuccuaauuccacagcu

SEQ ID NO: 1157048 - RNA, 19 nt, Human
cccuuccuaauuccacagc

SEQ ID NO: 1157049 - RNA, 14 nt, Human
cccuuccuaauucc

SEQ ID NO: 1157050 - RNA, 13 nt, Human
cccuuccuaauuc

SEQ ID NO: 1157051 - RNA, 11 nt, Human
cccuucauuug

SEQ ID NO: 1157052 - RNA, 22 nt, Human
cccuguucacucuacuuagcau

SEQ ID NO: 1157053 - RNA, 14 nt, Human
cccuguucacucua

SEQ ID NO: 1157054 - RNA, 13 nt, Human
cccuguucacucu

SEQ ID NO: 1157055 - RNA, 21 nt, Human
cccuggugcugccacacuuca

SEQ ID NO: 1157056 - RNA, 17 nt, Human
cccuggugcugccacac

SEQ ID NO: 1157057 - RNA, 23 nt, Human
cccugcuuugggcugcccuggug

SEQ ID NO: 1157058 - RNA, 23 nt, Human
cccugcacaaagcccuuccaugu

SEQ ID NO: 1157059 - RNA, 14 nt, Human
cccucccuucaacc

SEQ ID NO: 1157060 - RNA, 19 nt, Human
cccuccaucuaaacugccc

SEQ ID NO: 1157061 - RNA, 22 nt, Human
cccucauuccaccuucccaugc

SEQ ID NO: 1157062 - RNA, 19 nt, Human
cccucauagcccucacccu

SEQ ID NO: 1157063 - RNA, 15 nt, Human
cccucauagcccuca

SEQ ID NO: 1157064 - RNA, 13 nt, Human
cccucauagcccu

SEQ ID NO: 1157065 - RNA, 18 nt, Human
cccggaggggccuggcag

SEQ ID NO: 1157066 - RNA, 17 nt, Human
cccggaggggccuggca

SEQ ID NO: 1157067 - RNA, 23 nt, Human
cccgcucagcccucccugccccu

SEQ ID NO: 1157068 - RNA, 19 nt, Human
cccgcucagcccucccugc

SEQ ID NO: 1157069 - RNA, 22 nt, Human
ccccuuccuaauuccacagcug

SEQ ID NO: 1157070 - RNA, 21 nt, Human
ccccuuccuaauuccacagcu

SEQ ID NO: 1157071 - RNA, 20 nt, Human
ccccuuccuaauuccacagc

SEQ ID NO: 1157072 - RNA, 12 nt, Human
ccccuucccccu

SEQ ID NO: 1157073 - RNA, 14 nt, Human
ccccuuaccacugc

SEQ ID NO: 1157074 - RNA, 23 nt, Human
ccccuggcuuuucacugcuggcu

SEQ ID NO: 1157075 - RNA, 19 nt, Human
ccccagcccuccuuaucaa

SEQ ID NO: 1157076 - RNA, 17 nt, Human
cccaugucucgacucau

SEQ ID NO: 1157077 - RNA, 16 nt, Human
cccaugucucgacuca

SEQ ID NO: 1157078 - RNA, 19 nt, Human
cccagggugggaagggcua

SEQ ID NO: 1157079 - RNA, 20 nt, Human
cccagccuccaagcuccauc

SEQ ID NO: 1157080 - RNA, 18 nt, Human
cccagccuccaagcucca

SEQ ID NO: 1157081 - RNA, 23 nt, Human
cccagcccuccuuaucaaaggac

SEQ ID NO: 1157082 - RNA, 16 nt, Human
cccagaggcuggguga

SEQ ID NO: 1157083 - RNA, 16 nt, Human
ccauguuggccaggcu

SEQ ID NO: 1157084 - RNA, 14 nt, Human
ccaugcugccucca

SEQ ID NO: 1157085 - RNA, 16 nt, Human
ccaucgcugucaucuc

SEQ ID NO: 1157086 - RNA, 12 nt, Human
ccaggccugccu

SEQ ID NO: 1157087 - RNA, 17 nt, Human
ccagcuggguuggaaaa

SEQ ID NO: 1157088 - RNA, 16 nt, Human
ccagcuggguuggaaa

SEQ ID NO: 1157089 - RNA, 20 nt, Human
ccagcuggccgggagccuga

SEQ ID NO: 1157090 - RNA, 14 nt, Human
ccagcuggccggga

SEQ ID NO: 1157091 - RNA, 12 nt, Human
ccagcuggccgg

SEQ ID NO: 1157092 - RNA, 13 nt, Human
ccacaacacacag

SEQ ID NO: 1157093 - RNA, 16 nt, Human
ccaaguggcucccaca

SEQ ID NO: 1157094 - RNA, 13 nt, Human
ccaaguggcuccc

SEQ ID NO: 1157095 - RNA, 16 nt, Human
ccaaggcucugagcaa

SEQ ID NO: 1157096 - RNA, 14 nt, Human
ccaagcuccaucuc

SEQ ID NO: 1157097 - RNA, 22 nt, Human
ccaagccuacuuuugccauuga

SEQ ID NO: 1157098 - RNA, 23 nt, Human
ccaagccguggcuucccgcucag

SEQ ID NO: 1157099 - RNA, 21 nt, Human
ccaagccguggcuucccgcuc

SEQ ID NO: 1157100 - RNA, 17 nt, Human
ccaagccguggcuuccc

SEQ ID NO: 1157101 - RNA, 16 nt, Human
ccaagccguggcuucc

SEQ ID NO: 1157102 - RNA, 15 nt, Human
ccaagccguggcuuc

SEQ ID NO: 1157103 - RNA, 18 nt, Human
ccaacccuggcacccagg

SEQ ID NO: 1157104 - RNA, 18 nt, Human
cauuagcaguuugcuuug

SEQ ID NO: 1157105 - RNA, 17 nt, Human
cauuagcaguuugcuuu

SEQ ID NO: 1157106 - RNA, 20 nt, Human
caugucgccucugcauucag

SEQ ID NO: 1157107 - RNA, 18 nt, Human
caugucgccucugcauuc

SEQ ID NO: 1157108 - RNA, 15 nt, Human
caugucgccucugca

SEQ ID NO: 1157109 - RNA, 14 nt, Human
caugucgccucugc

SEQ ID NO: 1157110 - RNA, 22 nt, Human
caucucuucuggguuccuuccu

SEQ ID NO: 1157111 - RNA, 14 nt, Human
caucuccacuccag

SEQ ID NO: 1157112 - RNA, 13 nt, Human
caucucagcccac

SEQ ID NO: 1157113 - RNA, 20 nt, Human
cauccuccgccucccggguu

SEQ ID NO: 1157114 - RNA, 16 nt, Human
cauccuacaagacaca

SEQ ID NO: 1157115 - RNA, 21 nt, Human
cauccuaacuccaugucucug

SEQ ID NO: 1157116 - RNA, 14 nt, Human
cauccuaacuccau

SEQ ID NO: 1157117 - RNA, 17 nt, Human
cauccuacaagacacag

SEQ ID NO: 1157118 - RNA, 20 nt, Human
cauacuaauuauacccccug

SEQ ID NO: 1157119 - RNA, 19 nt, Human
cauaaucuggacuccucug

SEQ ID NO: 1157120 - RNA, 20 nt, Human
caguuaagccuuuggaaaca

SEQ ID NO: 1157121 - RNA, 17 nt, Human
caguuaagccuuuggaa

SEQ ID NO: 1157122 - RNA, 15 nt, Human
caguuaagccuuugg

SEQ ID NO: 1157123 - RNA, 14 nt, Human
caguuaagccuuug

SEQ ID NO: 1157124 - RNA, 16 nt, Human
cagugggacagggcau

SEQ ID NO: 1157125 - RNA, 11 nt, Human
cagugggaacu

SEQ ID NO: 1157126 - RNA, 19 nt, Human
cugccccuccucucugccc

SEQ ID NO: 1157127 - RNA, 20 nt, Human
cugccccuccucucugcccu

SEQ ID NO: 1157128 - RNA, 18 nt, Human
cugccccuccucucugcc

SEQ ID NO: 1157129 - RNA, 17 nt, Human
cugccccuccucucugc

SEQ ID NO: 1157130 - RNA, 17 nt, Human
cugccccucccuucaac

SEQ ID NO: 1157131 - RNA, 14 nt, Human
cugccccucccuuc

SEQ ID NO: 1157132 - RNA, 13 nt, Human
cugccccccagcc

SEQ ID NO: 1157133 - RNA, 22 nt, Human
cugccagucccccugccccagg

SEQ ID NO: 1157134 - RNA, 21 nt, Human
cugccagucccccugccccag

SEQ ID NO: 1157135 - RNA, 20 nt, Human
cugccagucccccugcccca

SEQ ID NO: 1157136 - RNA, 17 nt, Human
cugccagucccccugcc

SEQ ID NO: 1157137 - RNA, 19 nt, Human
cugcaacuuguaaaugugg

SEQ ID NO: 1157138 - RNA, 18 nt, Human
cugcaacuuguaaaugug

SEQ ID NO: 1157139 - RNA, 22 nt, Human
cugcaaccuucgccaccugggu

SEQ ID NO: 1157140 - RNA, 20 nt, Human
cugcaaccuucgccaccugg

SEQ ID NO: 1157141 - RNA, 19 nt, Human
cugcaaccuucgccaccug

SEQ ID NO: 1157142 - RNA, 17 nt, Human
cugcaaccuucgccacc

SEQ ID NO: 1157143 - RNA, 18 nt, Human
cugcaaagcccagcuuga

SEQ ID NO: 1157144 - RNA, 23 nt, Human
cugcugagucccaggcugagccu

SEQ ID NO: 1157145 - RNA, 19 nt, Human
cugcugagucccaggcuga

SEQ ID NO: 1157146 - RNA, 22 nt, Human
cugugacuucagcucuguuuua

SEQ ID NO: 1157147 - RNA, 17 nt, Human
cugugacuucagcucug

SEQ ID NO: 1157148 - RNA, 15 nt, Human
cuguucacucuacuu

SEQ ID NO: 1157149 - RNA, 17 nt, Human
cuguugcugccucaugc

SEQ ID NO: 1157150 - RNA, 16 nt, Human
cuguugcugccucaug

SEQ ID NO: 1157151 - RNA, 15 nt, Human
cuguugcugccucau

SEQ ID NO: 1157152 - RNA, 20 nt, Human
cuuaaaauauuccugcauuu

SEQ ID NO: 1157153 - RNA, 18 nt, Human
cuuaaaauauuccugcau

SEQ ID NO: 1157154 - RNA, 20 nt, Human
cuuccaugucgccucugcau

SEQ ID NO: 1157155 - RNA, 19 nt, Human
cuuccaugucgccucugca

SEQ ID NO: 1157156 - RNA, 18 nt, Human
cuuccaugucgccucugc

SEQ ID NO: 1157157 - RNA, 17 nt, Human
cuuccaugucgccucug

SEQ ID NO: 1157158 - RNA, 16 nt, Human
cuuccaugucgccucu

SEQ ID NO: 1157159 - RNA, 15 nt, Human
cuuccaugucgccuc

SEQ ID NO: 1157160 - RNA, 22 nt, Human
cuucaucucccaaagugcuggg

SEQ ID NO: 1157161 - RNA, 18 nt, Human
cuucaguuaagccuuugg

SEQ ID NO: 1157162 - RNA, 17 nt, Human
cuucaguuaagccuuug

SEQ ID NO: 1157163 - RNA, 19 nt, Human
cuuuuauuuagcaccaggg

SEQ ID NO: 1157164 - RNA, 16 nt, Human
cuuugagcuuaagaau

SEQ ID NO: 1157165 - RNA, 17 nt, Human
cuuucuaaugugugaau

SEQ ID NO: 1157166 - RNA, 22 nt, Human
cuuucggggagaggcugaggac

SEQ ID NO: 1157167 - RNA, 20 nt, Human
gaacucugacaacagacuuc

SEQ ID NO: 1157168 - RNA, 20 nt, Human
gaauauuagugaccucagcu

SEQ ID NO: 1157169 - RNA, 15 nt, Human
gacagaagcagcucu

SEQ ID NO: 1157170 - RNA, 13 nt, Human
gaccauacuaauu

SEQ ID NO: 1157171 - RNA, 16 nt, Human
gacagaagcagcucuu

SEQ ID NO: 1157172 - RNA, 23 nt, Human
gacuguacuccucccaggcgccc

SEQ ID NO: 1157173 - RNA, 16 nt, Human
gacucugccuccucuu

SEQ ID NO: 1157174 - RNA, 12 nt, Human
gacucugccucc

SEQ ID NO: 1157175 - RNA, 22 nt, Human
gacucaccucccccaucucuuc

SEQ ID NO: 1157176 - RNA, 15 nt, Human
gacucaccuccccca

SEQ ID NO: 1157177 - RNA, 21 nt, Human
gagcgcccacuagacccacug

SEQ ID NO: 1157178 - RNA, 17 nt, Human
gaggcaucgcaauguaa

SEQ ID NO: 1157179 - RNA, 20 nt, Human
gauuuuuuacagcugccugc

SEQ ID NO: 1157180 - RNA, 20 nt, Human
gauuauaggcaccuaccacc

SEQ ID NO: 1157181 - RNA, 21 nt, Human
gauguauguugaagccuuugu

SEQ ID NO: 1157182 - RNA, 20 nt, Human
gauguauguugaagccuuug

SEQ ID NO: 1157183 - RNA, 21 nt, Human
gcacagugcaucucagcccac

SEQ ID NO: 1157184 - RNA, 20 nt, Human
gcacagugcaucucagccca

SEQ ID NO: 1157185 - RNA, 22 nt, Human
gcaccuaccaccacgcccggcu

SEQ ID NO: 1157186 - RNA, 21 nt, Human
gcaccuaccaccacgcccggc

SEQ ID NO: 1157187 - RNA, 18 nt, Human
gcacuuggagacuuguau

SEQ ID NO: 1157188 - RNA, 14 nt, Human
gccaccacgcccgg

SEQ ID NO: 1157189 - RNA, 13 nt, Human
gccaccacgcccg

SEQ ID NO: 1157190 - RNA, 21 nt, Human
gccacuugaugacccccaacc

SEQ ID NO: 1157191 - RNA, 17 nt, Human
gccacugccucuuccuc

SEQ ID NO: 1157192 - RNA, 16 nt, Human
gccacugccucuuccu

SEQ ID NO: 1157193 - RNA, 13 nt, Human
gccacugccucuu

SEQ ID NO: 1157194 - RNA, 12 nt, Human
gccacugccucu

SEQ ID NO: 1157195 - RNA, 15 nt, Human
gccagaauuucaaac

SEQ ID NO: 1157196 - RNA, 18 nt, Human
gccauuccccgucucugg

SEQ ID NO: 1157197 - RNA, 17 nt, Human
gccauuccccgucucug

SEQ ID NO: 1157198 - RNA, 23 nt, Human
gcccacuagacccacuggacuca

SEQ ID NO: 1157199 - RNA, 17 nt, Human
gcccacuagacccacug

SEQ ID NO: 1157200 - RNA, 14 nt, Human
gcccccucugcccu

SEQ ID NO: 1157201 - RNA, 16 nt, Human
gcccugcugaguccca

SEQ ID NO: 1157202 - RNA, 23 nt, Human
gcccugcugagucccaggcugag

SEQ ID NO: 1157203 - RNA, 22 nt, Human
gcccugcugagucccaggcuga

SEQ ID NO: 1157204 - RNA, 21 nt, Human
gcccugcugagucccaggcug

SEQ ID NO: 1157205 - RNA, 22 nt, Human
gccucuuccucccucauuccac

SEQ ID NO: 1157206 - RNA, 17 nt, Human
gccugccuguucccauu

SEQ ID NO: 1157207 - RNA, 21 nt, Human
gcuauugucaccagggcugga

SEQ ID NO: 1157208 - RNA, 20 nt, Human
gcuauugucaccagggcugg

SEQ ID NO: 1157209 - RNA, 16 nt, Human
gcuauugucaccaggg

SEQ ID NO: 1157210 - RNA, 22 nt, Human
gcucuacagcuaaucagcauuc

SEQ ID NO: 1157211 - RNA, 20 nt, Human
gcucuacagcuaaucagcau

SEQ ID NO: 1157212 - RNA, 22 nt, Human
gcuccugccaccacgcccggcu

SEQ ID NO: 1157213 - RNA, 21 nt, Human
gcucugagcaaauguggcucc

SEQ ID NO: 1157214 - RNA, 20 nt, Human
gcucugagcaaauguggcuc

SEQ ID NO: 1157215 - RNA, 23 nt, Human
gcucugucgcccaggcuggagug

SEQ ID NO: 1157216 - RNA, 19 nt, Human
gcucugucgcccaggcugg

SEQ ID NO: 1157217 - RNA, 18 nt, Human
gcugggauuacaggugug

SEQ ID NO: 1157218 - RNA, 17 nt, Human
gcugggauuacaggugu

SEQ ID NO: 1157219 - RNA, 23 nt, Human
gcugggauuacaggcuccugcca

SEQ ID NO: 1157220 - RNA, 22 nt, Human
gcugggauuacaggcuccugcc

SEQ ID NO: 1157221 - RNA, 19 nt, Human
gcuguauuagucacagaga

SEQ ID NO: 1157222 - RNA, 23 nt, Human
gcuucccgcucagcccucccugc

SEQ ID NO: 1157223 - RNA, 18 nt, Human
gcuucccgcucagcccuc

SEQ ID NO: 1157224 - RNA, 17 nt, Human
gcuucccgcucagcccu

SEQ ID NO: 1157225 - RNA, 16 nt, Human
gcuucccgcucagccc

SEQ ID NO: 1157226 - RNA, 15 nt, Human
gcuucccgcucagcc

SEQ ID NO: 1157227 - RNA, 21 nt, Human
ggacccggaggggccuggcag

SEQ ID NO: 1157228 - RNA, 20 nt, Human
ggacccggaggggccuggca

SEQ ID NO: 1157229 - RNA, 21 nt, Human
ggaccccgagccuggcuccaa

SEQ ID NO: 1157230 - RNA, 14 nt, Human
ggagagagacucca

SEQ ID NO: 1157231 - RNA, 16 nt, Human
ggagacugucucaaga

SEQ ID NO: 1157232 - RNA, 13 nt, Human
ggagaacuagaga

SEQ ID NO: 1157233 - RNA, 18 nt, Human
ggacuuuuauuuccagug

SEQ ID NO: 1157234 - RNA, 17 nt, Human
ggacuuagcugggagaa

SEQ ID NO: 1157235 - RNA, 16 nt, Human
ggacuaggguccuggg

SEQ ID NO: 1157236 - RNA, 22 nt, Human
ggaggaaaaccaagccguggcu

SEQ ID NO: 1157237 - RNA, 21 nt, Human
ggaggaaaaccaagccguggc

SEQ ID NO: 1157238 - RNA, 20 nt, Human
ggaggaaaaccaagccgugg

SEQ ID NO: 1157239 - RNA, 22 nt, Human
ggcagccgugccuucagcucua

SEQ ID NO: 1157240 - RNA, 21 nt, Human
ggcagccgugccuucagcucu

SEQ ID NO: 1157241 - RNA, 19 nt, Human
ggcagccgugccuucagcu

SEQ ID NO: 1157242 - RNA, 18 nt, Human
ggcagccgugccuucagc

SEQ ID NO: 1157243 - RNA, 21 nt, Human
ggccaaggaugccccgucccc

SEQ ID NO: 1157244 - RNA, 19 nt, Human
ggccagguggccacuccag

SEQ ID NO: 1157245 - RNA, 17 nt, Human
ggcccgacagccuggca

SEQ ID NO: 1157246 - RNA, 16 nt, Human
ggcccgacagccuggc

SEQ ID NO: 1157247 - RNA, 23 nt, Human
ggcccuuccucuccacugccuuc

SEQ ID NO: 1157248 - RNA, 22 nt, Human
ggcccuuccucuccacugccuu

SEQ ID NO: 1157249 - RNA, 19 nt, Human
ggcccuuccucuccacugc

SEQ ID NO: 1157250 - RNA, 17 nt, Human
ggcuggcccugcccugg

SEQ ID NO: 1157251 - RNA, 16 nt, Human
ggcuggcccugcccug

SEQ ID NO: 1157252 - RNA, 15 nt, Human
ggcuggcccugcccu

SEQ ID NO: 1157253 - RNA, 14 nt, Human
ggcuggcccugccc

SEQ ID NO: 1157254 - RNA, 13 nt, Human
ggcuggcccugcc

SEQ ID NO: 1157255 - RNA, 13 nt, Human
ggcuccugccacc

SEQ ID NO: 1157256 - RNA, 12 nt, Human
ggcuccugccac

SEQ ID NO: 1157257 - RNA, 17 nt, Human
ggcuccucccggugccc

SEQ ID NO: 1157258 - RNA, 20 nt, Human
aaaaagcuccaaaugcagcu

SEQ ID NO: 1157259 - RNA, 13 nt, Human
gggagggccuggg

SEQ ID NO: 1157260 - RNA, 19 nt, Human
aaaaccaagccguggcuuc

SEQ ID NO: 1157261 - RNA, 18 nt, Human
ggugcaaaguucccuacu

SEQ ID NO: 1157262 - RNA, 21 nt, Human
ggugauccacucgccuucauc

SEQ ID NO: 1157263 - RNA, 17 nt, Human
aaagaauggaaggugga

SEQ ID NO: 1157264 - RNA, 18 nt, Human
gguauaaguggugugugu

SEQ ID NO: 1157265 - RNA, 21 nt, Human
aaacugcccccucugcccugc

SEQ ID NO: 1157266 - RNA, 20 nt, Human
aaacugcccccucugcccug

SEQ ID NO: 1157267 - RNA, 19 nt, Human
aaacugcccccucugcccu

SEQ ID NO: 1157268 - RNA, 17 nt, Human
aaacugcccccucugcc

SEQ ID NO: 1157269 - RNA, 13 nt, Human
aaacugcccccuc

SEQ ID NO: 1157270 - RNA, 12 nt, Human
aaacugcccccu

SEQ ID NO: 1157271 - RNA, 12 nt, Human
aaacgugaaaau

SEQ ID NO: 1157272 - RNA, 23 nt, Human
aaacggccucacuaggcuucugg

SEQ ID NO: 1157273 - RNA, 16 nt, Human
aaaccaagccguggcu

SEQ ID NO: 1157274 - RNA, 14 nt, Human
aaaccaagccgugg

SEQ ID NO: 1157275 - RNA, 18 nt, Human
caagaauagaugcugacu

SEQ ID NO: 1157276 - RNA, 21 nt, Human
caacucccugccccccagccc

SEQ ID NO: 1157277 - RNA, 20 nt, Human
caacucccugccccccagcc

SEQ ID NO: 1157278 - RNA, 19 nt, Human
caacucccugccccccagc

SEQ ID NO: 1157279 - RNA, 18 nt, Human
caagcaagaaacacuggg

SEQ ID NO: 1157280 - RNA, 13 nt, Human
caagcaagaaaca

SEQ ID NO: 1157281 - RNA, 18 nt, Human
caagcaccuagccucgcu

SEQ ID NO: 1157282 - RNA, 17 nt, Human
caagcuccaucuccacu

SEQ ID NO: 1157283 - RNA, 21 nt, Human
caagcuccaucuccacuccag

SEQ ID NO: 1157284 - RNA, 16 nt, Human
cacuccagaccccugg

SEQ ID NO: 1157285 - RNA, 14 nt, Human
cacuccagaccccu

SEQ ID NO: 1157286 - RNA, 16 nt, Human
cacuagacccacugga

SEQ ID NO: 1157287 - RNA, 17 nt, Human
cacuccagaccccuggc

SEQ ID NO: 1157288 - RNA, 13 nt, Human
auuacagguguga

SEQ ID NO: 1157289 - RNA, 19 nt, Human
auuacaggcuccugccacc

SEQ ID NO: 1157290 - RNA, 17 nt, Human
auuacaggcuccugcca

SEQ ID NO: 1157291 - RNA, 16 nt, Human
auuacaggcuccugcc

SEQ ID NO: 1157292 - RNA, 15 nt, Human
auuacaggcuccugc

SEQ ID NO: 1157293 - RNA, 15 nt, Human
auuaauggaaauguu

SEQ ID NO: 1157294 - RNA, 15 nt, Human
cagauccccaagccu

SEQ ID NO: 1157295 - RNA, 14 nt, Human
cagauccccaagcc

SEQ ID NO: 1157296 - RNA, 18 nt, Human
cagcacgggggccaagga

SEQ ID NO: 1157297 - RNA, 14 nt, Human
cagacagcccucca

SEQ ID NO: 1157298 - RNA, 21 nt, Human
caggcgugagccaccgugccu

SEQ ID NO: 1157299 - RNA, 20 nt, Human
cagcgcuggccgggaccccg

SEQ ID NO: 1157300 - RNA, 15 nt, Human
cauggccagguggcc

SEQ ID NO: 1157301 - RNA, 14 nt, Human
cauggccgugaacu

SEQ ID NO: 1157302 - RNA, 20 nt, Human
caugggaaaugucaacaagu

SEQ ID NO: 1157303 - RNA, 18 nt, Human
cauguuggccaggcuggu

SEQ ID NO: 1157304 - RNA, 21 nt, Human
ccaauggagacugucucaaga

SEQ ID NO: 1157305 - RNA, 21 nt, Human
caucuaaacugcccccucugc

SEQ ID NO: 1157306 - RNA, 15 nt, Human
caucuaaacugcccc

SEQ ID NO: 1157307 - RNA, 22 nt, Human
ccaggcugagccucagucuccc

SEQ ID NO: 1157308 - RNA, 19 nt, Human
ccaggcugagccucagucu

SEQ ID NO: 1157309 - RNA, 17 nt, Human
ccaggcugagccucagu

SEQ ID NO: 1157310 - RNA, 16 nt, Human
ccaggcugagccucag

SEQ ID NO: 1157311 - RNA, 14 nt, Human
ccaggcugagccuc

SEQ ID NO: 1157312 - RNA, 13 nt, Human
ccaggcugagccu

SEQ ID NO: 1157313 - RNA, 16 nt, Human
cccaagccuggcaagg

SEQ ID NO: 1157314 - RNA, 23 nt, Human
cccaagccuacuuuugccauuga

SEQ ID NO: 1157315 - RNA, 21 nt, Human
cccaagaauagaugcugacug

SEQ ID NO: 1157316 - RNA, 20 nt, Human
cccaagaauagaugcugacu

SEQ ID NO: 1157317 - RNA, 20 nt, Human
cccaacuaauuuuuguauuu

SEQ ID NO: 1157318 - RNA, 23 nt, Human
cccaaccugcucuccucuugcca

SEQ ID NO: 1157319 - RNA, 21 nt, Human
cccaaccugcucuccucuugc

SEQ ID NO: 1157320 - RNA, 14 nt, Human
cccaaccugcucuc

SEQ ID NO: 1157321 - RNA, 20 nt, Human
ccaugucucugagcauuaga

SEQ ID NO: 1157322 - RNA, 15 nt, Human
ccaugucucgacuca

SEQ ID NO: 1157323 - RNA, 14 nt, Human
ccaugucucgacuc

SEQ ID NO: 1157324 - RNA, 15 nt, Human
cccuccucucugccc

SEQ ID NO: 1157325 - RNA, 22 nt, Human
cccucgaggcggaucuuuggac

SEQ ID NO: 1157326 - RNA, 23 nt, Human
cccucgaggcggaucuuuggaca

SEQ ID NO: 1157327 - RNA, 14 nt, Human
cccuccucucugcc

SEQ ID NO: 1157328 - RNA, 18 nt, Human
cccuccuccuggacuccu

SEQ ID NO: 1157329 - RNA, 16 nt, Human
cccuccuccuggacuc

SEQ ID NO: 1157330 - RNA, 11 nt, Human
cccuccuccug

SEQ ID NO: 1157331 - RNA, 23 nt, Human
cccugccccucccuucaaccauu

SEQ ID NO: 1157332 - RNA, 19 nt, Human
cccugccccucccuucaac

SEQ ID NO: 1157333 - RNA, 18 nt, Human
cccugccccucccuucaa

SEQ ID NO: 1157334 - RNA, 17 nt, Human
cccugccccucccuuca

SEQ ID NO: 1157335 - RNA, 20 nt, Human
cccugccccccagcccuccu

SEQ ID NO: 1157336 - RNA, 15 nt, Human
cccugccccccagcc

SEQ ID NO: 1157337 - RNA, 14 nt, Human
cccugccccccagc

SEQ ID NO: 1157338 - RNA, 19 nt, Human
cccuggauccaucaggcca

SEQ ID NO: 1157339 - RNA, 23 nt, Human
cccugcccugguuuccugcccug

SEQ ID NO: 1157340 - RNA, 22 nt, Human
cccugcccugguuuccugcccu

SEQ ID NO: 1157341 - RNA, 12 nt, Human
cccugcccuggu

SEQ ID NO: 1157342 - RNA, 11 nt, Human
cccugcccugg

SEQ ID NO: 1157343 - RNA, 20 nt, Human
cccuggcucccacaggcccu

SEQ ID NO: 1157344 - RNA, 20 nt, Human
ccuaaugcgcaggcuggccc

SEQ ID NO: 1157345 - RNA, 15 nt, Human
ccgaccaccugccca

SEQ ID NO: 1157346 - RNA, 19 nt, Human
ccucugccugucuccccca

SEQ ID NO: 1157347 - RNA, 15 nt, Human
ccucugccugucucc

SEQ ID NO: 1157348 - RNA, 14 nt, Human
ccucugcccugcgg

SEQ ID NO: 1157349 - RNA, 13 nt, Human
ccucugcccugcg

SEQ ID NO: 1157350 - RNA, 12 nt, Human
ccucugcccugc

SEQ ID NO: 1157351 - RNA, 11 nt, Human
ccucugcccug

SEQ ID NO: 1157352 - RNA, 16 nt, Human
ccuccgccucccgggu

SEQ ID NO: 1157353 - RNA, 13 nt, Human
ccuccgccucccg

SEQ ID NO: 1157354 - RNA, 18 nt, Human
ccucagccuccugaguag

SEQ ID NO: 1157355 - RNA, 18 nt, Human
cggcuaauuuuuguauuu

SEQ ID NO: 1157356 - RNA, 15 nt, Human
cggaggggccuggca

SEQ ID NO: 1157357 - RNA, 16 nt, Human
cggaggggccuggcag

SEQ ID NO: 1157358 - RNA, 20 nt, Human
cgggcugggagcucugcaga

SEQ ID NO: 1157359 - RNA, 16 nt, Human
cgggcugggagcucug

SEQ ID NO: 1157360 - RNA, 20 nt, Human
cgggccuggagaacuagaga

SEQ ID NO: 1157361 - RNA, 16 nt, Human
cgggccuggagaacua

SEQ ID NO: 1157362 - RNA, 21 nt, Human
cgcucuuggcagguacucagc

SEQ ID NO: 1157363 - RNA, 20 nt, Human
cgcucugucgcccaggcugg

SEQ ID NO: 1157364 - RNA, 22 nt, Human
cgcaggcuggcccugcccuggu

SEQ ID NO: 1157365 - RNA, 21 nt, Human
cgagucucuucuccacuggau

SEQ ID NO: 1157366 - RNA, 20 nt, Human
cgagucucuucuccacugga

SEQ ID NO: 1157367 - RNA, 18 nt, Human
cgagucucuucuccacug

SEQ ID NO: 1157368 - RNA, 17 nt, Human
cgagucucuucuccacu

SEQ ID NO: 1157369 - RNA, 14 nt, Human
ccuuuauucuggca

SEQ ID NO: 1157370 - RNA, 21 nt, Human
ccuuccucuccacugccuucg

SEQ ID NO: 1157371 - RNA, 20 nt, Human
ccuuccucuccacugccuuc

SEQ ID NO: 1157372 - RNA, 17 nt, Human
ccuuccucuccacugcc

SEQ ID NO: 1157373 - RNA, 16 nt, Human
ccuuccucuccacugc

SEQ ID NO: 1157374 - RNA, 15 nt, Human
ccuuccucuccacug

SEQ ID NO: 1157375 - RNA, 14 nt, Human
ccuuccucuccacu

SEQ ID NO: 1157376 - RNA, 21 nt, Human
ccuuccuaauuccacagcugc

SEQ ID NO: 1157377 - RNA, 20 nt, Human
ccuuccuaauuccacagcug

SEQ ID NO: 1157378 - RNA, 19 nt, Human
ccuuccuaauuccacagcu

SEQ ID NO: 1157379 - RNA, 18 nt, Human
ccuuccuaauuccacagc

SEQ ID NO: 1157380 - RNA, 19 nt, Human
ccuucccccuccaauccca

SEQ ID NO: 1157381 - RNA, 15 nt, Human
ccuucccaugcccug

SEQ ID NO: 1157382 - RNA, 18 nt, Human
ccuuaucaaaggacacca

SEQ ID NO: 1157383 - RNA, 14 nt, Human
ccuuaucaaaggac

SEQ ID NO: 1157384 - RNA, 13 nt, Human
ccuuaucaaagga

SEQ ID NO: 1157385 - RNA, 20 nt, Human
ccuuaggugauccacucgcc

SEQ ID NO: 1157386 - RNA, 16 nt, Human
ccuguucugcuuuccu

SEQ ID NO: 1157387 - RNA, 12 nt, Human
ccuguucccauu

SEQ ID NO: 1157388 - RNA, 21 nt, Human
ccuguucacucuacuuagcau

SEQ ID NO: 1157389 - RNA, 17 nt, Human
cuauccuacuuccccuu

SEQ ID NO: 1157390 - RNA, 18 nt, Human
cuaucaugucaaacguga

SEQ ID NO: 1157391 - RNA, 14 nt, Human
cucagguugucuga

SEQ ID NO: 1157392 - RNA, 22 nt, Human
cucagguugucugaagucacug

SEQ ID NO: 1157393 - RNA, 20 nt, Human
cuccuuucacaaccuucugu

SEQ ID NO: 1157394 - RNA, 17 nt, Human
cuccuuucacaaccuuc

SEQ ID NO: 1157395 - RNA, 16 nt, Human
cuccuuucacaaccuu

SEQ ID NO: 1157396 - RNA, 13 nt, Human
cuccuuucacaac

SEQ ID NO: 1157397 - RNA, 14 nt, Human
cuccuggggguucu

SEQ ID NO: 1157398 - RNA, 18 nt, Human
cuccucuugccacugccu

SEQ ID NO: 1157399 - RNA, 16 nt, Human
cuccucuugccacugc

SEQ ID NO: 1157400 - RNA, 15 nt, Human
cuccucuugccacug

SEQ ID NO: 1157401 - RNA, 12 nt, Human
cuccucuugcca

SEQ ID NO: 1157402 - RNA, 15 nt, Human
cuccucuguccaggc

SEQ ID NO: 1157403 - RNA, 12 nt, Human
cuccucugucca

SEQ ID NO: 1157404 - RNA, 13 nt, Human
cuccuaccuggua

SEQ ID NO: 1157405 - RNA, 20 nt, Human
cucccugaaguaagcaaaga

SEQ ID NO: 1157406 - RNA, 21 nt, Human
cucccacaggcccuuccucuc

SEQ ID NO: 1157407 - RNA, 20 nt, Human
cucccacaggcccuuccucu

SEQ ID NO: 1157408 - RNA, 16 nt, Human
cucccacaggcccuuc

SEQ ID NO: 1157409 - RNA, 15 nt, Human
cucccacaggcccuu

SEQ ID NO: 1157410 - RNA, 16 nt, Human
auugcauuuccugaca

SEQ ID NO: 1157411 - RNA, 19 nt, Human
auuccagagaguggcuccu

SEQ ID NO: 1157412 - RNA, 18 nt, Human
auuccagagaguggcucc

SEQ ID NO: 1157413 - RNA, 13 nt, Human
auuccacagcugc

SEQ ID NO: 1157414 - RNA, 12 nt, Human
auuccacagcug

SEQ ID NO: 1157415 - RNA, 11 nt, Human
uuuuuguauuu

SEQ ID NO: 1157416 - RNA, 22 nt, Human
uuuuugggaaaagaaaagucaa

SEQ ID NO: 1157417 - RNA, 17 nt, Human
auguuggccaggcuggu

SEQ ID NO: 1157418 - RNA, 15 nt, Human
auguugaagccuuug

SEQ ID NO: 1157419 - RNA, 18 nt, Human
augugauccuuuuggagu

SEQ ID NO: 1157420 - RNA, 14 nt, Human
uuugggcugcccug

SEQ ID NO: 1157421 - RNA, 21 nt, Human
uuucagaaagaaguggggaca

SEQ ID NO: 1157422 - RNA, 14 nt, Human
auggaaggggcuga

SEQ ID NO: 1157423 - RNA, 16 nt, Human
augcgugugugugugu

SEQ ID NO: 1157424 - RNA, 12 nt, Human
augcgugugugu

SEQ ID NO: 1157425 - RNA, 22 nt, Human
augcgcaggcuggcccugcccu

SEQ ID NO: 1157426 - RNA, 20 nt, Human
augcgcaggcuggcccugcc

SEQ ID NO: 1157427 - RNA, 18 nt, Human
augcgcaggcuggcccug

SEQ ID NO: 1157428 - RNA, 14 nt, Human
augcgcaggcuggc

SEQ ID NO: 1157429 - RNA, 13 nt, Human
augcgcaggcugg

SEQ ID NO: 1157430 - RNA, 21 nt, Human
augccccgucccccucuggcu

SEQ ID NO: 1157431 - RNA, 22 nt, Human
uuuaaggguuuguggaaaauga

SEQ ID NO: 1157432 - RNA, 20 nt, Human
uuuaaggguuuguggaaaau

SEQ ID NO: 1157433 - RNA, 17 nt, Human
uuuaaggguuuguggaa

SEQ ID NO: 1157434 - RNA, 18 nt, Human
augcagagguccacaaca

SEQ ID NO: 1157435 - RNA, 17 nt, Human
augcagagguccacaac

SEQ ID NO: 1157436 - RNA, 22 nt, Human
uugugaugucccaacuuguaaa

SEQ ID NO: 1157437 - RNA, 18 nt, Human
uugugaugucccaacuug

SEQ ID NO: 1157438 - RNA, 21 nt, Human
augagguacaaccuguucugc

SEQ ID NO: 1157439 - RNA, 15 nt, Human
uuggaaaauaaauca

SEQ ID NO: 1157440 - RNA, 12 nt, Human
uuggaaaauaaa

SEQ ID NO: 1157441 - RNA, 16 nt, Human
uugcuuuguaugcacu

SEQ ID NO: 1157442 - RNA, 13 nt, Human
uugcuuuguaugc

SEQ ID NO: 1157443 - RNA, 10 nt, Human
uugagacaga

SEQ ID NO: 1157444 - RNA, 17 nt, Human
aucccaggauguacaag

SEQ ID NO: 1157445 - RNA, 17 nt, Human
auccaggguggugguga

SEQ ID NO: 1157446 - RNA, 22 nt, Human
uuccuuuuaaaacacuuccaua

SEQ ID NO: 1157447 - RNA, 21 nt, Human
uuccuuuuaaaacacuuccau

SEQ ID NO: 1157448 - RNA, 20 nt, Human
uuccuuuuaaaacacuucca

SEQ ID NO: 1157449 - RNA, 20 nt, Human
auauuuucaacgcagcccug

SEQ ID NO: 1157450 - RNA, 19 nt, Human
auauuuucaacgcagcccu

SEQ ID NO: 1157451 - RNA, 15 nt, Human
uucagaaagaagugg

SEQ ID NO: 1157452 - RNA, 19 nt, Human
uucacugcuggcugccuua

SEQ ID NO: 1157453 - RNA, 18 nt, Human
uucacugcuggcugccuu

SEQ ID NO: 1157454 - RNA, 17 nt, Human
uucacugcuggcugccu

SEQ ID NO: 1157455 - RNA, 16 nt, Human
uucacugcuggcugcc

SEQ ID NO: 1157456 - RNA, 15 nt, Human
uucacugcuggcugc

SEQ ID NO: 1157457 - RNA, 13 nt, Human
uucacugcuggcu

SEQ ID NO: 1157458 - RNA, 22 nt, Human
auaggcaccuaccaccacgccc

SEQ ID NO: 1157459 - RNA, 22 nt, Human
uucaccauguuggccaggcugg

SEQ ID NO: 1157460 - RNA, 22 nt, Human
uucaccauguuggccaggcugc

SEQ ID NO: 1157461 - RNA, 22 nt, Human
uucaagugauucucaugccuca

SEQ ID NO: 1157462 - RNA, 20 nt, Human
uucaagugauucucaugccu

SEQ ID NO: 1157463 - RNA, 15 nt, Human
uuauuuaguauuuau

SEQ ID NO: 1157464 - RNA, 17 nt, Human
uuauuuagcaccaggga

SEQ ID NO: 1157465 - RNA, 13 nt, Human
uuagaaccuuucu

SEQ ID NO: 1157466 - RNA, 14 nt, Human
uuacagcugccugc

SEQ ID NO: 1157467 - RNA, 13 nt, Human
uuacagcugccug

SEQ ID NO: 1157468 - RNA, 16 nt, Human
auaaaauuaaagcuga

SEQ ID NO: 1157469 - RNA, 13 nt, Human
aguuggcuucuaa

SEQ ID NO: 1157470 - RNA, 13 nt, Human
uguuuggagacag

SEQ ID NO: 1157471 - RNA, 11 nt, Human
ugugugugugc

SEQ ID NO: 1157472 - RNA, 14 nt, Human
agugagggauuauc

SEQ ID NO: 1157473 - RNA, 17 nt, Human
agucucuucuccacugg

SEQ ID NO: 1157474 - RNA, 18 nt, Human
agucucuucuccacugga

SEQ ID NO: 1157475 - RNA, 16 nt, Human
agucucuucuccacug

SEQ ID NO: 1157476 - RNA, 15 nt, Human
agucucuucuccacu

SEQ ID NO: 1157477 - RNA, 14 nt, Human
agucucuucuccac

SEQ ID NO: 1157478 - RNA, 13 nt, Human
agucucuucucca

SEQ ID NO: 1157479 - RNA, 12 nt, Human
aguagagacagg

SEQ ID NO: 1157480 - RNA, 14 nt, Human
uguagagcuucugg

SEQ ID NO: 1157481 - RNA, 19 nt, Human
uguaaauaaagaacuagca

SEQ ID NO: 1157482 - RNA, 20 nt, Human
ugguuuccugcccugggagg

SEQ ID NO: 1157483 - RNA, 15 nt, Human
ugguuuccugcccug

SEQ ID NO: 1157484 - RNA, 14 nt, Human
ugguuuccugcccu

SEQ ID NO: 1157485 - RNA, 13 nt, Human
ugguuuccugccc

SEQ ID NO: 1157486 - RNA, 12 nt, Human
ugguuuccugcc

SEQ ID NO: 1157487 - RNA, 21 nt, Human
ugguggagaggcccggccucu

SEQ ID NO: 1157488 - RNA, 18 nt, Human
uggugcugccacacuuca

SEQ ID NO: 1157489 - RNA, 13 nt, Human
uggugcugccaca

SEQ ID NO: 1157490 - RNA, 17 nt, Human
ugguagcuuuucccuuc

SEQ ID NO: 1157491 - RNA, 21 nt, Human
aggggaauaaacuguugaguc

SEQ ID NO: 1157492 - RNA, 15 nt, Human
uggggaggggcugug

SEQ ID NO: 1157493 - RNA, 17 nt, Human
agggcauggccaggugg

SEQ ID NO: 1157494 - RNA, 16 nt, Human
agggcacugguggccc

SEQ ID NO: 1157495 - RNA, 14 nt, Human
agggcacugguggc

SEQ ID NO: 1157496 - RNA, 22 nt, Human
ugggccccaguuguauuuauuu

SEQ ID NO: 1157497 - RNA, 18 nt, Human
ugggccccaguuguauuu

SEQ ID NO: 1157498 - RNA, 18 nt, Human
ugggagacugcugaguca

SEQ ID NO: 1157499 - RNA, 13 nt, Human
ugggacuggccuc

SEQ ID NO: 1157500 - RNA, 21 nt, Human
agggaauuucuucaacucccu

SEQ ID NO: 1157501 - RNA, 22 nt, Human
agggaaggggacaaggacuagg

SEQ ID NO: 1157502 - RNA, 13 nt, Human
agggaaggggaca

SEQ ID NO: 1157503 - RNA, 15 nt, Human
aggcccggccucuca

SEQ ID NO: 1157504 - RNA, 14 nt, Human
aggcccggccucuc

SEQ ID NO: 1157505 - RNA, 13 nt, Human
aggcccggccucu

SEQ ID NO: 1157506 - RNA, 13 nt, Human
uggauggaagggg

SEQ ID NO: 1157507 - RNA, 17 nt, Human
uggagccaauggagacu

SEQ ID NO: 1157508 - RNA, 17 nt, Human
ugcuuugggcugcccug

SEQ ID NO: 1157509 - RNA, 16 nt, Human
ugcuuugggcugcccu

SEQ ID NO: 1157510 - RNA, 15 nt, Human
ugcuuugggcugccc

SEQ ID NO: 1157511 - RNA, 14 nt, Human
ugcuuugggcugcc

SEQ ID NO: 1157512 - RNA, 19 nt, Human
aggacucugccuccucuuc

SEQ ID NO: 1157513 - RNA, 18 nt, Human
aggacucugccuccucuu

SEQ ID NO: 1157514 - RNA, 17 nt, Human
aggacucugccuccucu

SEQ ID NO: 1157515 - RNA, 16 nt, Human
aggacucugccuccuc

SEQ ID NO: 1157516 - RNA, 14 nt, Human
aggacucugccucc

SEQ ID NO: 1157517 - RNA, 13 nt, Human
aggacucugccuc

SEQ ID NO: 1157518 - RNA, 12 nt, Human
aggacucugccu

SEQ ID NO: 1157519 - RNA, 19 nt, Human
aggacuaggguccugggga

SEQ ID NO: 1157520 - RNA, 18 nt, Human
aggacuaggguccugggg

SEQ ID NO: 1157521 - RNA, 16 nt, Human
aggacuaggguccugg

SEQ ID NO: 1157522 - RNA, 15 nt, Human
aggacuaggguccug

SEQ ID NO: 1157523 - RNA, 15 nt, Human
aggaaggcugagagg

SEQ ID NO: 1157524 - RNA, 18 nt, Human
aggaagcagcuuucccca

SEQ ID NO: 1157525 - RNA, 22 nt, Human
ugcucuugaacuccugaccuca

SEQ ID NO: 1157526 - RNA, 20 nt, Human
ugcucuugaacuccugaccu

SEQ ID NO: 1157527 - RNA, 15 nt, Human
ugcucuugaacuccu

SEQ ID NO: 1157528 - RNA, 22 nt, Human
agcuuuccccaugucucgacuc

SEQ ID NO: 1157529 - RNA, 13 nt, Human
agcuuaacagugu

SEQ ID NO: 1157530 - RNA, 14 nt, Human
ugccuguucccauu

SEQ ID NO: 1157531 - RNA, 19 nt, Human
agcuggccgggagccugau

SEQ ID NO: 1157532 - RNA, 18 nt, Human
agcuggccgggagccuga

SEQ ID NO: 1157533 - RNA, 12 nt, Human
ugccucugccug

SEQ ID NO: 1157534 - RNA, 21 nt, Human
agcuccaucuccacuccagau

SEQ ID NO: 1157535 - RNA, 16 nt, Human
agcuccaucuccacuc

SEQ ID NO: 1157536 - RNA, 15 nt, Human
agcuccaucuccacu

SEQ ID NO: 1157537 - RNA, 13 nt, Human
agcuccaucucca

SEQ ID NO: 1157538 - RNA, 16 nt, Human
agccuugggaccccug

SEQ ID NO: 1157539 - RNA, 15 nt, Human
ugcaucucagcccac

SEQ ID NO: 1157540 - RNA, 14 nt, Human
ugcaucucagccca

SEQ ID NO: 1157541 - RNA, 13 nt, Human
ugcaucucagccc

SEQ ID NO: 1157542 - RNA, 23 nt, Human
ugcaaaguucccuacuuccugug

SEQ ID NO: 1157543 - RNA, 17 nt, Human
ugcaaagcccagcuuga

SEQ ID NO: 1157544 - RNA, 15 nt, Human
ugcaaagcccagcuu

SEQ ID NO: 1157545 - RNA, 14 nt, Human
ugcaaagcccagcu

SEQ ID NO: 1157546 - RNA, 12 nt, Human
ugauuuggaaaa

SEQ ID NO: 1157547 - RNA, 23 nt, Human
ugauggguuaguggauggaaggg

SEQ ID NO: 1157548 - RNA, 19 nt, Human
ugauggguuaguggaugga

SEQ ID NO: 1157549 - RNA, 18 nt, Human
ugaugaaauguaaauacu

SEQ ID NO: 1157550 - RNA, 22 nt, Human
ugauccuaaugaaugcauaaaa

SEQ ID NO: 1157551 - RNA, 18 nt, Human
ugauccacucgccuucau

SEQ ID NO: 1157552 - RNA, 13 nt, Human
agccaccacgccc

SEQ ID NO: 1157553 - RNA, 18 nt, Human
agccaaacauccuacaag

SEQ ID NO: 1157554 - RNA, 22 nt, Human
agcauucucacuccuaccuggu

SEQ ID NO: 1157555 - RNA, 20 nt, Human
agcauucucacuccuaccug

SEQ ID NO: 1157556 - RNA, 18 nt, Human
agcauucucacuccuacc

SEQ ID NO: 1157557 - RNA, 17 nt, Human
agcauuagauuucucau

SEQ ID NO: 1157558 - RNA, 14 nt, Human
ugaucaccugcccu

SEQ ID NO: 1157559 - RNA, 14 nt, Human
agcaguuugcuuug

SEQ ID NO: 1157560 - RNA, 15 nt, Human
agcaggcugugaguu

SEQ ID NO: 1157561 - RNA, 19 nt, Human
agagguccacaacacacag

SEQ ID NO: 1157562 - RNA, 13 nt, Human
agaggcugaggac

SEQ ID NO: 1157563 - RNA, 15 nt, Human
agagcuuaacagugu

SEQ ID NO: 1157564 - RNA, 19 nt, Human
agacuuuuuuuaaauagua

SEQ ID NO: 1157565 - RNA, 18 nt, Human
agacuuguaugaaagaug

SEQ ID NO: 1157566 - RNA, 14 nt, Human
agacugucucaaga

SEQ ID NO: 1157567 - RNA, 17 nt, Human
ucuuucuuccucugcug

SEQ ID NO: 1157568 - RNA, 16 nt, Human
ucuuucuuccucugcu

SEQ ID NO: 1157569 - RNA, 15 nt, Human
ucuuucuuccucugc

SEQ ID NO: 1157570 - RNA, 14 nt, Human
ucuuucuuccucug

SEQ ID NO: 1157571 - RNA, 21 nt, Human
agacucaguggggaggggcug

SEQ ID NO: 1157572 - RNA, 23 nt, Human
agaccugccccuccucucugccc

SEQ ID NO: 1157573 - RNA, 22 nt, Human
agaccugccccuccucucugcc

SEQ ID NO: 1157574 - RNA, 16 nt, Human
agaccugccccuccuc

SEQ ID NO: 1157575 - RNA, 21 nt, Human
agaccccuggcuuuucacugc

SEQ ID NO: 1157576 - RNA, 15 nt, Human
agaccccuggcuuuu

SEQ ID NO: 1157577 - RNA, 19 nt, Human
ucuguucugcacacagcac

SEQ ID NO: 1157578 - RNA, 18 nt, Human
ucuguucugcacacagca

SEQ ID NO: 1157579 - RNA, 17 nt, Human
ucuguucugcacacagc

SEQ ID NO: 1157580 - RNA, 23 nt, Human
ucuggguuccuuccucugagccu

SEQ ID NO: 1157581 - RNA, 22 nt, Human
ucuggguuccuuccucugagcc

SEQ ID NO: 1157582 - RNA, 16 nt, Human
ucugacaacagacuuc

SEQ ID NO: 1157583 - RNA, 15 nt, Human
ucugacaacagacuu

SEQ ID NO: 1157584 - RNA, 18 nt, Human
ucugaagucacugcacag

SEQ ID NO: 1157585 - RNA, 16 nt, Human
ucugaagucacugcac

SEQ ID NO: 1157586 - RNA, 15 nt, Human
ucugaagucacugca

SEQ ID NO: 1157587 - RNA, 23 nt, Human
ucugaugcaagcaagaaacacug

SEQ ID NO: 1157588 - RNA, 15 nt, Human
acuuccugugacuuc

SEQ ID NO: 1157589 - RNA, 16 nt, Human
acuucaggcucuucuc

SEQ ID NO: 1157590 - RNA, 14 nt, Human
acuucaggcucuuc

SEQ ID NO: 1157591 - RNA, 14 nt, Human
acuucagcucuguu

SEQ ID NO: 1157592 - RNA, 16 nt, Human
acuuagaaauugcauu

SEQ ID NO: 1157593 - RNA, 17 nt, Human
ucguuugaaucacagua

SEQ ID NO: 1157594 - RNA, 18 nt, Human
ucggcucacugcauccuc

SEQ ID NO: 1157595 - RNA, 18 nt, Human
ucgcuauugucaccaggg

SEQ ID NO: 1157596 - RNA, 16 nt, Human
acuggccucugcugau

SEQ ID NO: 1157597 - RNA, 14 nt, Human
acuggccucugcug

SEQ ID NO: 1157598 - RNA, 15 nt, Human
acugcuggcugccuu

SEQ ID NO: 1157599 - RNA, 15 nt, Human
acugccucuuccucc

SEQ ID NO: 1157600 - RNA, 14 nt, Human
acugccucuuccuc

SEQ ID NO: 1157601 - RNA, 23 nt, Human
acugcauccuccgccucccgggu

SEQ ID NO: 1157602 - RNA, 20 nt, Human
acugcauccuccgccucccg

SEQ ID NO: 1157603 - RNA, 17 nt, Human
acugcauccuccgccuc

SEQ ID NO: 1157604 - RNA, 14 nt, Human
uccuacuuccccuu

SEQ ID NO: 1157605 - RNA, 14 nt, Human
acuccucuguccag

SEQ ID NO: 1157606 - RNA, 13 nt, Human
acuccucugucca

SEQ ID NO: 1157607 - RNA, 13 nt, Human
acuccagaccccu

SEQ ID NO: 1157608 - RNA, 22 nt, Human
ucccggcugcccuuucugggca

SEQ ID NO: 1157609 - RNA, 18 nt, Human
ucccggcugcccuuucug

SEQ ID NO: 1157610 - RNA, 15 nt, Human
ucccggcugcccuuu

SEQ ID NO: 1157611 - RNA, 14 nt, Human
ucccggcugcccuu

SEQ ID NO: 1157612 - RNA, 13 nt, Human
ucccggcugcccu

SEQ ID NO: 1157613 - RNA, 20 nt, Human
ucccgaguagcugagauuau

SEQ ID NO: 1157614 - RNA, 17 nt, Human
uccccaugucucgacuc

SEQ ID NO: 1157615 - RNA, 18 nt, Human
uccaucuaaacugccccc

SEQ ID NO: 1157616 - RNA, 16 nt, Human
uccaucuaaacugccc

SEQ ID NO: 1157617 - RNA, 13 nt, Human
ucccacagcgcug

SEQ ID NO: 1157618 - RNA, 19 nt, Human
uccagagaguggcuccucc

SEQ ID NO: 1157619 - RNA, 17 nt, Human
uccagagaguggcuccu

SEQ ID NO: 1157620 - RNA, 16 nt, Human
uccagagaguggcucc

SEQ ID NO: 1157621 - RNA, 15 nt, Human
uccagagaguggcuc

SEQ ID NO: 1157622 - RNA, 22 nt, Human
uccacugccuucgauacaccgg

SEQ ID NO: 1157623 - RNA, 15 nt, Human
uccacugccuucgau

SEQ ID NO: 1157624 - RNA, 13 nt, Human
uccacugccuucg

SEQ ID NO: 1157625 - RNA, 19 nt, Human
uccaccuucccaugcccug

SEQ ID NO: 1157626 - RNA, 18 nt, Human
uccaccuucccaugcccu

SEQ ID NO: 1157627 - RNA, 16 nt, Human
uccaccuucccaugcc

SEQ ID NO: 1157628 - RNA, 21 nt, Human
accuggucacaggacucugcc

SEQ ID NO: 1157629 - RNA, 18 nt, Human
uccaaucccaccaacccu

SEQ ID NO: 1157630 - RNA, 20 nt, Human
accuaccaccacgcccggcu

SEQ ID NO: 1157631 - RNA, 16 nt, Human
accuaccaccacgccc

SEQ ID NO: 1157632 - RNA, 16 nt, Human
ucagcucacugcaacc

SEQ ID NO: 1157633 - RNA, 13 nt, Human
ucagcucacugca

SEQ ID NO: 1157634 - RNA, 19 nt, Human
ucagaaguuucucagcucc

SEQ ID NO: 1157635 - RNA, 12 nt, Human
accauuccccau

SEQ ID NO: 1157636 - RNA, 15 nt, Human
ucacuccuaccuggu

SEQ ID NO: 1157637 - RNA, 21 nt, Human
accagccuccaugcugccucc

SEQ ID NO: 1157638 - RNA, 20 nt, Human
accagccuccaugcugccuc

SEQ ID NO: 1157639 - RNA, 19 nt, Human
accagccuccaugcugccu

SEQ ID NO: 1157640 - RNA, 14 nt, Human
accagccuccaugc

SEQ ID NO: 1157641 - RNA, 23 nt, Human
accacugcucugaugaagaggag

SEQ ID NO: 1157642 - RNA, 17 nt, Human
accacugcucugaugaa

SEQ ID NO: 1157643 - RNA, 15 nt, Human
accacugcucugaug

SEQ ID NO: 1157644 - RNA, 22 nt, Human
ucacacgucuggcuucacagau

SEQ ID NO: 1157645 - RNA, 16 nt, Human
ucacaacaaccugguc

SEQ ID NO: 1157646 - RNA, 14 nt, Human
accacacuccagcu

SEQ ID NO: 1157647 - RNA, 20 nt, Human
ucaagugauucucaugccuc

SEQ ID NO: 1157648 - RNA, 17 nt, Human
ucaagugauucucaugc

SEQ ID NO: 1157649 - RNA, 22 nt, Human
acauuagcaguuugcuuuguau

SEQ ID NO: 1157650 - RNA, 18 nt, Human
acauuagcaguuugcuuu

SEQ ID NO: 1157651 - RNA, 21 nt, Human
acauagugaugguuccccugu

SEQ ID NO: 1157652 - RNA, 16 nt, Human
acauagugaugguucc

SEQ ID NO: 1157653 - RNA, 23 nt, Human
uaugaaagauggcugugccucug

SEQ ID NO: 1157654 - RNA, 22 nt, Human
uaugaaagauggcugugccucu

SEQ ID NO: 1157655 - RNA, 20 nt, Human
uaugaaagauggcugugccu

SEQ ID NO: 1157656 - RNA, 17 nt, Human
uauccuacuuccccuuc

SEQ ID NO: 1157657 - RNA, 14 nt, Human
uauccuacuucccc

SEQ ID NO: 1157658 - RNA, 16 nt, Human
uaucccggcugcccuu

SEQ ID NO: 1157659 - RNA, 23 nt, Human
acacuuguugauuaauggaaaug

SEQ ID NO: 1157660 - RNA, 20 nt, Human
acacuuguugauuaauggaa

SEQ ID NO: 1157661 - RNA, 19 nt, Human
uauaacuauguugauaaaa

SEQ ID NO: 1157662 - RNA, 14 nt, Human
uaguagagacaggg

SEQ ID NO: 1157663 - RNA, 17 nt, Human
acacagugaccauacua

SEQ ID NO: 1157664 - RNA, 20 nt, Human
acaaucucggcucacugcau

SEQ ID NO: 1157665 - RNA, 18 nt, Human
acaaucucggcucacugc

SEQ ID NO: 1157666 - RNA, 19 nt, Human
acaagagcuuaacagugug

SEQ ID NO: 1157667 - RNA, 18 nt, Human
acaagagcuuaacagugu

SEQ ID NO: 1157668 - RNA, 14 nt, Human
acaagacacaguga

SEQ ID NO: 1157669 - RNA, 14 nt, Human
uagaugcugacugu

SEQ ID NO: 1157670 - RNA, 18 nt, Human
acaaagcccuuccauguc

SEQ ID NO: 1157671 - RNA, 23 nt, Human
uacuuugauauuuucaacgcagc

SEQ ID NO: 1157672 - RNA, 23 nt, Human
uacuuccugugacuucagcucug

SEQ ID NO: 1157673 - RNA, 20 nt, Human
uacuuccccuuccuaauucc

SEQ ID NO: 1157674 - RNA, 18 nt, Human
uacuuccccuuccuaauu

SEQ ID NO: 1157675 - RNA, 15 nt, Human
uacuuccccuuccua

SEQ ID NO: 1157676 - RNA, 14 nt, Human
uacuuccccuuccu

SEQ ID NO: 1157677 - RNA, 12 nt, Human
aauugcauuucc

SEQ ID NO: 1157678 - RNA, 14 nt, Human
aauguggcuccugg

SEQ ID NO: 1157679 - RNA, 14 nt, Human
aauguauuuuuccu

SEQ ID NO: 1157680 - RNA, 17 nt, Human
uacaggcuccugccacc

SEQ ID NO: 1157681 - RNA, 15 nt, Human
uacaggcuccugcca

SEQ ID NO: 1157682 - RNA, 14 nt, Human
uacaggcuccugcc

SEQ ID NO: 1157683 - RNA, 22 nt, Human
uacaggcgugagccaccgugcc

SEQ ID NO: 1157684 - RNA, 16 nt, Human
aaugcauaaaauguua

SEQ ID NO: 1157685 - RNA, 13 nt, Human
aaugcauaaaaug

SEQ ID NO: 1157686 - RNA, 14 nt, Human
uacaaggacagccc

SEQ ID NO: 1157687 - RNA, 17 nt, Human
uaauuccacagcugcuc

SEQ ID NO: 1157688 - RNA, 14 nt, Human
uaauuccacagcug

SEQ ID NO: 1157689 - RNA, 13 nt, Human
uaauuccacagcu

SEQ ID NO: 1157690 - RNA, 12 nt, Human
aaucagcauucu

SEQ ID NO: 1157691 - RNA, 17 nt, Human
uaagacauuuuuggaag

SEQ ID NO: 1157692 - RNA, 16 nt, Human
aauagaugcugacugu

SEQ ID NO: 1157693 - RNA, 18 nt, Human
aauagacccacaagaggc

SEQ ID NO: 1157694 - RNA, 20 nt, Human
aauaaauugcuccuugacau

SEQ ID NO: 1157695 - RNA, 16 nt, Human
aauaaauugcuccuug

SEQ ID NO: 1157696 - RNA, 23 nt, Human
guuuuacaauaaaaucuugaaaa

SEQ ID NO: 1157697 - RNA, 20 nt, Human
guuugggccccagaggcugg

SEQ ID NO: 1157698 - RNA, 20 nt, Human
guuuaagacauuuuuggaag

SEQ ID NO: 1157699 - RNA, 19 nt, Human
aaggaugccccgucccccu

SEQ ID NO: 1157700 - RNA, 21 nt, Human
guugaugccugugaacugaac

SEQ ID NO: 1157701 - RNA, 20 nt, Human
guucccuacuuccugugacu

SEQ ID NO: 1157702 - RNA, 15 nt, Human
guuccccaagacauu

SEQ ID NO: 1157703 - RNA, 22 nt, Human
guuaaguugauggugaugaaau

SEQ ID NO: 1157704 - RNA, 16 nt, Human
guuaagccuuuggaaa

SEQ ID NO: 1157705 - RNA, 13 nt, Human
guuaagccuuugg

SEQ ID NO: 1157706 - RNA, 12 nt, Human
guuaagccuuug

SEQ ID NO: 1157707 - RNA, 18 nt, Human
guguguaugcgugugugu

SEQ ID NO: 1157708 - RNA, 17 nt, Human
gugugaaaaugugugug

SEQ ID NO: 1157709 - RNA, 22 nt, Human
aagcaaagacuuuccucuuagu

SEQ ID NO: 1157710 - RNA, 19 nt, Human
guggcccgacagccuggca

SEQ ID NO: 1157711 - RNA, 18 nt, Human
guggcccgacagccuggc

SEQ ID NO: 1157712 - RNA, 16 nt, Human
aagagcuuaacagugu

SEQ ID NO: 1157713 - RNA, 21 nt, Human
guggauggaaggggcugacag

SEQ ID NO: 1157714 - RNA, 20 nt, Human
gugcugggauuacaggcgug

SEQ ID NO: 1157715 - RNA, 12 nt, Human
aacuugggaacu

SEQ ID NO: 1157716 - RNA, 15 nt, Human
gugccucugccuguc

SEQ ID NO: 1157717 - RNA, 13 nt, Human
gugccucugccug

SEQ ID NO: 1157718 - RNA, 19 nt, Human
aacucccugccccccagcc

SEQ ID NO: 1157719 - RNA, 13 nt, Human
aacucccugcccc

SEQ ID NO: 1157720 - RNA, 20 nt, Human
aaccugcucuccucuugcca

SEQ ID NO: 1157721 - RNA, 15 nt, Human
aaccugcucuccucu

SEQ ID NO: 1157722 - RNA, 11 nt, Human
aaccugcucuc

SEQ ID NO: 1157723 - RNA, 15 nt, Human
gucuggcuucacaga

SEQ ID NO: 1157724 - RNA, 16 nt, Human
gucucccucccuuggg

SEQ ID NO: 1157725 - RNA, 15 nt, Human
gucccaacuuguaaa

SEQ ID NO: 1157726 - RNA, 15 nt, Human
guccacaacacacag

SEQ ID NO: 1157727 - RNA, 11 nt, Human
aacacuuccau

SEQ ID NO: 1157728 - RNA, 20 nt, Human
aaauguuaaguugaugguga

SEQ ID NO: 1157729 - RNA, 16 nt, Human
guaugggacuggccuc

SEQ ID NO: 1157730 - RNA, 11 nt, Human
aaaugaaaauu

SEQ ID NO: 1157731 - RNA, 18 nt, Human
guagcugggauuacaggc

SEQ ID NO: 1157732 - RNA, 13 nt, Human
agccuggcuccaa

SEQ ID NO: 1157733 - RNA, 20 nt, Human
agccuggcacagggcagugg

SEQ ID NO: 1157734 - RNA, 18 nt, Human
agccuggcacagggcagu

SEQ ID NO: 1157735 - RNA, 17 nt, Human
agccuggcacagggcag

SEQ ID NO: 1157736 - RNA, 20 nt, Human
agcuggguuggaaaacagua

SEQ ID NO: 1157737 - RNA, 16 nt, Human
agcuggguuggaaaac

SEQ ID NO: 1157738 - RNA, 23 nt, Human
aggaaaaccaagccguggcuucc

SEQ ID NO: 1157739 - RNA, 22 nt, Human
aggaaaaccaagccguggcuuc

SEQ ID NO: 1157740 - RNA, 21 nt, Human
aggaaaaccaagccguggcuu

SEQ ID NO: 1157741 - RNA, 20 nt, Human
aggaaaaccaagccguggcu

SEQ ID NO: 1157742 - RNA, 19 nt, Human
aggaaaaccaagccguggc

SEQ ID NO: 1157743 - RNA, 16 nt, Human
aggagagcccuucauu

SEQ ID NO: 1157744 - RNA, 17 nt, Human
aggcaucgcaauguaag

SEQ ID NO: 1157745 - RNA, 13 nt, Human
aggcugaggacuu

SEQ ID NO: 1157746 - RNA, 11 nt, Human
aggcugaggac

SEQ ID NO: 1157747 - RNA, 14 nt, Human
aggcucuucuccuu

SEQ ID NO: 1157748 - RNA, 13 nt, Human
aggcugagccuca

SEQ ID NO: 1157749 - RNA, 13 nt, Human
aggcucuucuccu

SEQ ID NO: 1157750 - RNA, 20 nt, Human
agcaauucuccugccucagc

SEQ ID NO: 1157751 - RNA, 19 nt, Human
agcaauucuccugccucag

SEQ ID NO: 1157752 - RNA, 18 nt, Human
agcaauucuccugccuca

SEQ ID NO: 1157753 - RNA, 17 nt, Human
agcaauucuccugccuc

SEQ ID NO: 1157754 - RNA, 15 nt, Human
agcaauucuccugcc

SEQ ID NO: 1157755 - RNA, 15 nt, Human
agaguggcuccuccc

SEQ ID NO: 1157756 - RNA, 14 nt, Human
agaguggcuccucc

SEQ ID NO: 1157757 - RNA, 13 nt, Human
agaguggcuccuc

SEQ ID NO: 1157758 - RNA, 12 nt, Human
agaguggcuccu

SEQ ID NO: 1157759 - RNA, 22 nt, Human
agauggcugugccucugccugu

SEQ ID NO: 1157760 - RNA, 21 nt, Human
agauggcugugccucugccug

SEQ ID NO: 1157761 - RNA, 20 nt, Human
agauggcugugccucugccu

SEQ ID NO: 1157762 - RNA, 19 nt, Human
agauggcugugccucugcc

SEQ ID NO: 1157763 - RNA, 18 nt, Human
agauggcugugccucugc

SEQ ID NO: 1157764 - RNA, 23 nt, Human
agaucucugcuuuggaaaucaca

SEQ ID NO: 1157765 - RNA, 18 nt, Human
agaucucugcuuuggaaa

SEQ ID NO: 1157766 - RNA, 13 nt, Human
agacagcccucca

SEQ ID NO: 1157767 - RNA, 15 nt, Human
agaauuuugagcagg

SEQ ID NO: 1157768 - RNA, 20 nt, Human
agaaccaggcaacuugggaa

SEQ ID NO: 1157769 - RNA, 17 nt, Human
agaaccaggcaacuugg

SEQ ID NO: 1157770 - RNA, 15 nt, Human
auaaguggugugugu

SEQ ID NO: 1157771 - RNA, 18 nt, Human
auacaccgggccuggaga

SEQ ID NO: 1157772 - RNA, 14 nt, Human
auacaccgggccug

SEQ ID NO: 1157773 - RNA, 17 nt, Human
augaauaaagacaccua

SEQ ID NO: 1157774 - RNA, 12 nt, Human
aucaaaggacac

SEQ ID NO: 1157775 - RNA, 14 nt, Human
aucgaccugccucg

SEQ ID NO: 1157776 - RNA, 16 nt, Human
aauucuccugccucag

SEQ ID NO: 1157777 - RNA, 15 nt, Human
aauucuccugccuca

SEQ ID NO: 1157778 - RNA, 14 nt, Human
aauucuccugccuc

SEQ ID NO: 1157779 - RNA, 22 nt, Human
aauucuagcuuugagcuuaaga

SEQ ID NO: 1157780 - RNA, 19 nt, Human
aauuauacccccugcaaag

SEQ ID NO: 1157781 - RNA, 17 nt, Human
acauguguuggcagccu

SEQ ID NO: 1157782 - RNA, 18 nt, Human
accaagccguggcuuccc

SEQ ID NO: 1157783 - RNA, 17 nt, Human
accaagccguggcuucc

SEQ ID NO: 1157784 - RNA, 16 nt, Human
accaagccguggcuuc

SEQ ID NO: 1157785 - RNA, 15 nt, Human
accaagccguggcuu

SEQ ID NO: 1157786 - RNA, 14 nt, Human
accaagccguggcu

SEQ ID NO: 1157787 - RNA, 18 nt, Human
acagugcaucucagccca

SEQ ID NO: 1157788 - RNA, 17 nt, Human
acagugcaucucagccc

SEQ ID NO: 1157789 - RNA, 15 nt, Human
acagugcaucucagc

SEQ ID NO: 1157790 - RNA, 18 nt, Human
acccuggcacccagggug

SEQ ID NO: 1157791 - RNA, 18 nt, Human
acccucagagccaccccu

SEQ ID NO: 1157792 - RNA, 11 nt, Human
acccucagagc

SEQ ID NO: 1157793 - RNA, 19 nt, Human
accgugccuggccacgccc

SEQ ID NO: 1157794 - RNA, 23 nt, Human
accgggcugggagcucugcagag

SEQ ID NO: 1157795 - RNA, 21 nt, Human
accgggcugggagcucugcag

SEQ ID NO: 1157796 - RNA, 23 nt, Human
acgcagcccugcuuugggcugcc

SEQ ID NO: 1157797 - RNA, 22 nt, Human
acgcagcccugcuuugggcugc

SEQ ID NO: 1157798 - RNA, 12 nt, Human
acgcagcccugc

SEQ ID NO: 1157799 - RNA, 20 nt, Human
acuuaaaauauuccugcauu

SEQ ID NO: 1157800 - RNA, 12 nt, Human
acugguggcccg

SEQ ID NO: 1157801 - RNA, 19 nt, Human
acugcccaggccugccugu

SEQ ID NO: 1157802 - RNA, 20 nt, Human
acugguggcccgacagccug

SEQ ID NO: 1157803 - RNA, 18 nt, Human
acucccugccccccagcc

SEQ ID NO: 1157804 - RNA, 15 nt, Human
acucccaagcuggac

SEQ ID NO: 1157805 - RNA, 16 nt, Human
aaaagaaaagucaagg

SEQ ID NO: 1157806 - RNA, 19 nt, Human
aacccucagagccaccccu

SEQ ID NO: 1157807 - RNA, 20 nt, Human
aaugauguauguugaagccu

SEQ ID NO: 1157808 - RNA, 22 nt, Human
aaucaaugcuauaacuauguug

SEQ ID NO: 1157809 - RNA, 10 nt, Human
aagccuuugu

SEQ ID NO: 1157810 - RNA, 22 nt, Human
aaggcagggagggccugggccc

SEQ ID NO: 1157811 - RNA, 19 nt, Human
aaggcagggagggccuggg

SEQ ID NO: 1157812 - RNA, 14 nt, Human
aagaacuagcauaa

SEQ ID NO: 1157813 - RNA, 16 nt, Human
aacgcagcccugcuuu

SEQ ID NO: 1157814 - RNA, 20 nt, Human
caccauguuggccaggcugg

SEQ ID NO: 1157815 - RNA, 20 nt, Human
caccauguuggccaggcugc

SEQ ID NO: 1157816 - RNA, 19 nt, Human
caccauguuggccaggcug

SEQ ID NO: 1157817 - RNA, 18 nt, Human
caccauaggucaccuuua

SEQ ID NO: 1157818 - RNA, 15 nt, Human
caccacgcccggcua

SEQ ID NO: 1157819 - RNA, 14 nt, Human
caccacgcccggcu

SEQ ID NO: 1157820 - RNA, 16 nt, Human
cacaggacucugccuc

SEQ ID NO: 1157821 - RNA, 15 nt, Human
cacaggacucugccu

SEQ ID NO: 1157822 - RNA, 22 nt, Human
cacacagauuugagcucagccc

SEQ ID NO: 1157823 - RNA, 20 nt, Human
cacacagauuugagcucagc

SEQ ID NO: 1157824 - RNA, 18 nt, Human
cacacagauuugagcuca

SEQ ID NO: 1157825 - RNA, 24 nt, Human
cacaaucucggcucacugcauccu

SEQ ID NO: 1157826 - RNA, 23 nt, Human
cacaaucucggcucacugcaucc

SEQ ID NO: 1157827 - RNA, 22 nt, Human
cacaaucucggcucacugcauc

SEQ ID NO: 1157828 - RNA, 20 nt, Human
cacaaucucggcucacugca

SEQ ID NO: 1157829 - RNA, 19 nt, Human
cacaaucucggcucacugc

SEQ ID NO: 1157830 - RNA, 18 nt, Human
caaucucggcucacugca

SEQ ID NO: 1157831 - RNA, 21 nt, Human
caaggacuaggguccugggga

SEQ ID NO: 1157832 - RNA, 20 nt, Human
caaggacuaggguccugggg

SEQ ID NO: 1157833 - RNA, 19 nt, Human
caaggacuaggguccuggg

SEQ ID NO: 1157834 - RNA, 18 nt, Human
caaggacuaggguccugg

SEQ ID NO: 1157835 - RNA, 16 nt, Human
caaggacuaggguccu

SEQ ID NO: 1157836 - RNA, 20 nt, Human
caagagggcacugguggccc

SEQ ID NO: 1157837 - RNA, 19 nt, Human
caagagggcacugguggcc

SEQ ID NO: 1157838 - RNA, 18 nt, Human
caagagggcacugguggc

SEQ ID NO: 1157839 - RNA, 22 nt, Human
caaaguucccuacuuccuguga

SEQ ID NO: 1157840 - RNA, 18 nt, Human
caaagcccuuccaugucg

SEQ ID NO: 1157841 - RNA, 13 nt, Human
caaagcccagcuu

SEQ ID NO: 1157842 - RNA, 20 nt, Human
uuuucacugcuggcugccuu

SEQ ID NO: 1157843 - RNA, 19 nt, Human
uuuucacugcuggcugccu

SEQ ID NO: 1157844 - RNA, 22 nt, Human
uuuucaacgcagcccugcuuug

SEQ ID NO: 1157845 - RNA, 21 nt, Human
uuuucaacgcagcccugcuuu

SEQ ID NO: 1157846 - RNA, 17 nt, Human
uuuucaacgcagcccug

SEQ ID NO: 1157847 - RNA, 16 nt, Human
uuuuacagcugccugc

SEQ ID NO: 1157848 - RNA, 16 nt, Human
uuugccagugggaacu

SEQ ID NO: 1157849 - RNA, 15 nt, Human
uuugccagugggaac

SEQ ID NO: 1157850 - RNA, 14 nt, Human
uuugagcucagccc

SEQ ID NO: 1157851 - RNA, 15 nt, Human
uuucuaaugugugaa

SEQ ID NO: 1157852 - RNA, 23 nt, Human
uuuccugacagaaggacucaggu

SEQ ID NO: 1157853 - RNA, 13 nt, Human
uuuauuuccagug

SEQ ID NO: 1157854 - RNA, 15 nt, Human
uuguauuuauuuagu

SEQ ID NO: 1157855 - RNA, 14 nt, Human
uuggccaggcuggu

SEQ ID NO: 1157856 - RNA, 15 nt, Human
uugcugccucaugcu

SEQ ID NO: 1157857 - RNA, 12 nt, Human
uugcugccucau

SEQ ID NO: 1157858 - RNA, 11 nt, Human
uugcugccuca

SEQ ID NO: 1157859 - RNA, 18 nt, Human
uugccacugccucuuccu

SEQ ID NO: 1157860 - RNA, 15 nt, Human
uugccacugccucuu

SEQ ID NO: 1157861 - RNA, 14 nt, Human
uugccacugccucu

SEQ ID NO: 1157862 - RNA, 14 nt, Human
uucuucaacucccu

SEQ ID NO: 1157863 - RNA, 16 nt, Human
uucuguggcucacaga

SEQ ID NO: 1157864 - RNA, 12 nt, Human
uucuguggcuca

SEQ ID NO: 1157865 - RNA, 21 nt, Human
uucucaugccucagccuccug

SEQ ID NO: 1157866 - RNA, 14 nt, Human
uucucaugccucag

SEQ ID NO: 1157867 - RNA, 12 nt, Human
uucucaugccuc

SEQ ID NO: 1157868 - RNA, 11 nt, Human
uucucaugccu

SEQ ID NO: 1157869 - RNA, 17 nt, Human
uuccuuccucugagccu

SEQ ID NO: 1157870 - RNA, 13 nt, Human
uuccuuccucuga

SEQ ID NO: 1157871 - RNA, 22 nt, Human
uuccugcccugggaggcaguga

SEQ ID NO: 1157872 - RNA, 16 nt, Human
uuccugcccugggagg

SEQ ID NO: 1157873 - RNA, 13 nt, Human
uuccugcccuggg

SEQ ID NO: 1157874 - RNA, 11 nt, Human
uuccugcccug

SEQ ID NO: 1157875 - RNA, 14 nt, Human
uuccccaagacauu

SEQ ID NO: 1157876 - RNA, 21 nt, Human
uuccaugucgccucugcauuc

SEQ ID NO: 1157877 - RNA, 20 nt, Human
uuccaugucgccucugcauu

SEQ ID NO: 1157878 - RNA, 19 nt, Human
uuccaugucgccucugcau

SEQ ID NO: 1157879 - RNA, 18 nt, Human
uuccaugucgccucugca

SEQ ID NO: 1157880 - RNA, 17 nt, Human
uuccaugucgccucugc

SEQ ID NO: 1157881 - RNA, 21 nt, Human
uuccacuuagaaauugcauuu

SEQ ID NO: 1157882 - RNA, 16 nt, Human
uucaggcucuucuccu

SEQ ID NO: 1157883 - RNA, 15 nt, Human
uucaggcucuucucc

SEQ ID NO: 1157884 - RNA, 16 nt, Human
uucaaucccaggaugu

SEQ ID NO: 1157885 - RNA, 15 nt, Human
uucaacgcagcccug

SEQ ID NO: 1157886 - RNA, 14 nt, Human
uucaacgcagcccu

SEQ ID NO: 1157887 - RNA, 13 nt, Human
uucaacgcagccc

SEQ ID NO: 1157888 - RNA, 20 nt, Human
uucaaccauuccccauggga

SEQ ID NO: 1157889 - RNA, 17 nt, Human
uucaaccauuccccaug

SEQ ID NO: 1157890 - RNA, 15 nt, Human
uucaaagcaaauguc

SEQ ID NO: 1157891 - RNA, 23 nt, Human
uuacaauaaaaucuugaaaaugc

SEQ ID NO: 1157892 - RNA, 14 nt, Human
uuaauggaaauguu

SEQ ID NO: 1157893 - RNA, 18 nt, Human
uuaaauaguaaaaauaaa

SEQ ID NO: 1157894 - RNA, 17 nt, Human
uguuuacagauccccaa

SEQ ID NO: 1157895 - RNA, 18 nt, Human
uguuggccaggcugcucu

SEQ ID NO: 1157896 - RNA, 13 nt, Human
uguuggccaggcu

SEQ ID NO: 1157897 - RNA, 14 nt, Human
uguugcugccucau

SEQ ID NO: 1157898 - RNA, 13 nt, Human
uguugcugccuca

SEQ ID NO: 1157899 - RNA, 15 nt, Human
uguugaagccuuugu

SEQ ID NO: 1157900 - RNA, 17 nt, Human
uguucugcacacagcac

SEQ ID NO: 1157901 - RNA, 21 nt, Human
uguggcuccuggggguucuuu

SEQ ID NO: 1157902 - RNA, 17 nt, Human
uguggaaaaugaaaauu

SEQ ID NO: 1157903 - RNA, 22 nt, Human
ugugcuuauguaugagguacaa

SEQ ID NO: 1157904 - RNA, 15 nt, Human
ugugccucugccugu

SEQ ID NO: 1157905 - RNA, 14 nt, Human
ugugccucugccug

SEQ ID NO: 1157906 - RNA, 17 nt, Human
ugucucaggucccugca

SEQ ID NO: 1157907 - RNA, 23 nt, Human
ugucucaagagggcacugguggc

SEQ ID NO: 1157908 - RNA, 21 nt, Human
ugucucaagagggcacuggug

SEQ ID NO: 1157909 - RNA, 20 nt, Human
ugucucaagagggcacuggu

SEQ ID NO: 1157910 - RNA, 14 nt, Human
uguaugcacuuugu

SEQ ID NO: 1157911 - RNA, 13 nt, Human
uguacuccuccca

SEQ ID NO: 1157912 - RNA, 12 nt, Human
uguacuccuccc

SEQ ID NO: 1157913 - RNA, 17 nt, Human
uggguuggaaaacagua

SEQ ID NO: 1157914 - RNA, 22 nt, Human
uggguuccuuccucugagccuu

SEQ ID NO: 1157915 - RNA, 21 nt, Human
uggguuccuuccucugagccu

SEQ ID NO: 1157916 - RNA, 21 nt, Human
uggguuccagcaauucuccug

SEQ ID NO: 1157917 - RNA, 20 nt, Human
ugggcgugagaccugccccu

SEQ ID NO: 1157918 - RNA, 19 nt, Human
ugggcgugagaccugcccc

SEQ ID NO: 1157919 - RNA, 18 nt, Human
ugggcgugagaccugccc

SEQ ID NO: 1157920 - RNA, 17 nt, Human
ugggcgugagaccugcc

SEQ ID NO: 1157921 - RNA, 18 nt, Human
ugggccuucagggaguga

SEQ ID NO: 1157922 - RNA, 16 nt, Human
ugggacagggcauggc

SEQ ID NO: 1157923 - RNA, 14 nt, Human
uggcuuuucacugc

SEQ ID NO: 1157924 - RNA, 15 nt, Human
uggcuuuucacugcu

SEQ ID NO: 1157925 - RNA, 16 nt, Human
uggcuccaaacccucg

SEQ ID NO: 1157926 - RNA, 18 nt, Human
uggcuccaaacccucgag

SEQ ID NO: 1157927 - RNA, 20 nt, Human
uggcuccaaacccucgaggc

SEQ ID NO: 1157928 - RNA, 22 nt, Human
uggccacuccagaccccuggcu

SEQ ID NO: 1157929 - RNA, 20 nt, Human
uggagaggcccggccucuca

SEQ ID NO: 1157930 - RNA, 21 nt, Human
uggaagugugugaucuguggg

SEQ ID NO: 1157931 - RNA, 15 nt, Human
uggaaaauaaaucaa

SEQ ID NO: 1157932 - RNA, 11 nt, Human
uggaaaauaaa

SEQ ID NO: 1157933 - RNA, 18 nt, Human
ugcuuguuaacugagugc

SEQ ID NO: 1157934 - RNA, 14 nt, Human
ugcugccuccagaa

SEQ ID NO: 1157935 - RNA, 13 nt, Human
ugcugccucaugc

SEQ ID NO: 1157936 - RNA, 19 nt, Human
ugcgcaggcuggcccugcc

SEQ ID NO: 1157937 - RNA, 17 nt, Human
ugcgcaggcuggcccug

SEQ ID NO: 1157938 - RNA, 16 nt, Human
ugcgcaggcuggcccu

SEQ ID NO: 1157939 - RNA, 13 nt, Human
ugcgcaggcuggc

SEQ ID NO: 1157940 - RNA, 18 nt, Human
ugccuucagcucuacagc

SEQ ID NO: 1157941 - RNA, 17 nt, Human
ugccuucagcucuacag

SEQ ID NO: 1157942 - RNA, 13 nt, Human
ugccuucagcucu

SEQ ID NO: 1157943 - RNA, 19 nt, Human
ugccuaaggcugaacuugu

SEQ ID NO: 1157944 - RNA, 21 nt, Human
ugcauccuccgccucccgggu

SEQ ID NO: 1157945 - RNA, 18 nt, Human
ugcauccuccgccucccg

SEQ ID NO: 1157946 - RNA, 22 nt, Human
ugcagcuuuaaaaaauuaaucu

SEQ ID NO: 1157947 - RNA, 13 nt, Human
ugcagcuuuaaaa

SEQ ID NO: 1157948 - RNA, 20 nt, Human
ugcacagugcaucucagccc

SEQ ID NO: 1157949 - RNA, 19 nt, Human
ugcacagugcaucucagcc

SEQ ID NO: 1157950 - RNA, 19 nt, Human
ugaacugaacucugacaac

SEQ ID NO: 1157951 - RNA, 17 nt, Human
ugaacugaacucugaca

SEQ ID NO: 1157952 - RNA, 14 nt, Human
ugaacugaacucug

SEQ ID NO: 1157953 - RNA, 23 nt, Human
ugaaagauggcugugccucugcc

SEQ ID NO: 1157954 - RNA, 22 nt, Human
ugaaagauggcugugccucugc

SEQ ID NO: 1157955 - RNA, 21 nt, Human
ugaaagauggcugugccucug

SEQ ID NO: 1157956 - RNA, 21 nt, Human
ucuuguuuuuuuuuuccacuu

SEQ ID NO: 1157957 - RNA, 18 nt, Human
ucuuguuuuuuuuuucca

SEQ ID NO: 1157958 - RNA, 16 nt, Human
ucuucuccacuggaug

SEQ ID NO: 1157959 - RNA, 13 nt, Human
ucuucuccacugg

SEQ ID NO: 1157960 - RNA, 14 nt, Human
ucugcacacagcac

SEQ ID NO: 1157961 - RNA, 22 nt, Human
ucugagcauuagauuucucauu

SEQ ID NO: 1157962 - RNA, 20 nt, Human
ucugagcauuagauuucuca

SEQ ID NO: 1157963 - RNA, 16 nt, Human
ucucuucuccacugga

SEQ ID NO: 1157964 - RNA, 15 nt, Human
ucucuucuccacugg

SEQ ID NO: 1157965 - RNA, 14 nt, Human
ucucuucuccacug

SEQ ID NO: 1157966 - RNA, 13 nt, Human
ucucuucuccacu

SEQ ID NO: 1157967 - RNA, 11 nt, Human
ucucuucucca

SEQ ID NO: 1157968 - RNA, 12 nt, Human
ucuccugccuca

SEQ ID NO: 1157969 - RNA, 15 nt, Human
ucucaggucccugca

SEQ ID NO: 1157970 - RNA, 18 nt, Human
ucggacuuagcugggaga

SEQ ID NO: 1157971 - RNA, 19 nt, Human
ucgcccaggcuggagugca

SEQ ID NO: 1157972 - RNA, 14 nt, Human
ucgcccaggcugga

SEQ ID NO: 1157973 - RNA, 12 nt, Human
ucgcccaggcug

SEQ ID NO: 1157974 - RNA, 17 nt, Human
ucgcaauguaagacucg

SEQ ID NO: 1157975 - RNA, 23 nt, Human
uccuuuuggagucagacagaugu

SEQ ID NO: 1157976 - RNA, 14 nt, Human
uccuuuuggaguca

SEQ ID NO: 1157977 - RNA, 16 nt, Human
uccuucaaagcaaaug

SEQ ID NO: 1157978 - RNA, 17 nt, Human
ucccuacuuccugugac

SEQ ID NO: 1157979 - RNA, 16 nt, Human
ucccuacuuccuguga

SEQ ID NO: 1157980 - RNA, 15 nt, Human
ucccuacuuccugug

SEQ ID NO: 1157981 - RNA, 22 nt, Human
uccccuuccuaauuccacagcu

SEQ ID NO: 1157982 - RNA, 21 nt, Human
uccccuuccuaauuccacagc

SEQ ID NO: 1157983 - RNA, 15 nt, Human
uccccuguucacucu

SEQ ID NO: 1157984 - RNA, 13 nt, Human
ucccccugcccca

SEQ ID NO: 1157985 - RNA, 13 nt, Human
ucccccucuggcu

SEQ ID NO: 1157986 - RNA, 17 nt, Human
ucccccaucucuucugg

SEQ ID NO: 1157987 - RNA, 18 nt, Human
ucccaggcugagccucag

SEQ ID NO: 1157988 - RNA, 16 nt, Human
ucccaggcugagccuc

SEQ ID NO: 1157989 - RNA, 15 nt, Human
ucccaggcugagccu

SEQ ID NO: 1157990 - RNA, 21 nt, Human
ucccaggcgccccuucccccu

SEQ ID NO: 1157991 - RNA, 20 nt, Human
ucccaggcgccccuuccccc

SEQ ID NO: 1157992 - RNA, 16 nt, Human
ucccaggauguacaag

SEQ ID NO: 1157993 - RNA, 22 nt, Human
ucccaaggcucugagcaaaugu

SEQ ID NO: 1157994 - RNA, 18 nt, Human
ucccaaggcucugagcaa

SEQ ID NO: 1157995 - RNA, 16 nt, Human
uccauccaggccauuc

SEQ ID NO: 1157996 - RNA, 14 nt, Human
uccacaacacacag

SEQ ID NO: 1157997 - RNA, 15 nt, Human
ucaguuacucuucag

SEQ ID NO: 1157998 - RNA, 21 nt, Human
ucagaggggaauaaacuguug

SEQ ID NO: 1157999 - RNA, 22 nt, Human
ucacuuuuauuuagcaccaggg

SEQ ID NO: 1158000 - RNA, 12 nt, Human
ucacuuuuauuu

SEQ ID NO: 1158001 - RNA, 20 nt, Human
ucacucuacuuagcaugucc

SEQ ID NO: 1158002 - RNA, 19 nt, Human
ucacucuacuuagcauguc

SEQ ID NO: 1158003 - RNA, 18 nt, Human
ucacuccuaccugguaau

SEQ ID NO: 1158004 - RNA, 13 nt, Human
ucaccuuuauucu

SEQ ID NO: 1158005 - RNA, 16 nt, Human
ucacaggacucugccu

SEQ ID NO: 1158006 - RNA, 17 nt, Human
ucaaugcuauaacuaug

SEQ ID NO: 1158007 - RNA, 16 nt, Human
ucaaacgugaaaaugc

SEQ ID NO: 1158008 - RNA, 15 nt, Human
ucaaacgugaaaaug

SEQ ID NO: 1158009 - RNA, 23 nt, Human
ucaaacggccucacuaggcuucu

SEQ ID NO: 1158010 - RNA, 21 nt, Human
uauuuucaacgcagcccugcu

SEQ ID NO: 1158011 - RNA, 21 nt, Human
uaucaugucaaacgugaaaau

SEQ ID NO: 1158012 - RNA, 16 nt, Human
uaucaugucaaacgug

SEQ ID NO: 1158013 - RNA, 20 nt, Human
uauacucuuauagacaacau

SEQ ID NO: 1158014 - RNA, 17 nt, Human
uauacccccugcaaagc

SEQ ID NO: 1158015 - RNA, 18 nt, Human
uaguggauggaaggggcu

SEQ ID NO: 1158016 - RNA, 15 nt, Human
uaguggauggaaggg

SEQ ID NO: 1158017 - RNA, 18 nt, Human
uagugaugguuccccugu

SEQ ID NO: 1158018 - RNA, 14 nt, Human
uagugaugguuccc

SEQ ID NO: 1158019 - RNA, 22 nt, Human
uagcugggagaaagagagagcu

SEQ ID NO: 1158020 - RNA, 18 nt, Human
uagcccucacccuggggc

SEQ ID NO: 1158021 - RNA, 13 nt, Human
uagccccauaauu

SEQ ID NO: 1158022 - RNA, 23 nt, Human
uagaaccaggcaacuugggaacu

SEQ ID NO: 1158023 - RNA, 12 nt, Human
uagaaccaggca

SEQ ID NO: 1158024 - RNA, 15 nt, Human
uaccaccacgcccgg

SEQ ID NO: 1158025 - RNA, 15 nt, Human
uacaggcauagaguu

SEQ ID NO: 1158026 - RNA, 19 nt, Human
uacaagagcuuaacagugu

SEQ ID NO: 1158027 - RNA, 15 nt, Human
uacaagacacaguga

SEQ ID NO: 1158028 - RNA, 23 nt, Human
uaaugcgcaggcuggcccugccc

SEQ ID NO: 1158029 - RNA, 22 nt, Human
uaaugcgcaggcuggcccugcc

SEQ ID NO: 1158030 - RNA, 19 nt, Human
uaaugcgcaggcuggcccu

SEQ ID NO: 1158031 - RNA, 23 nt, Human
uaaugaugucguuugaaucacag

SEQ ID NO: 1158032 - RNA, 17 nt, Human
uaaugaugucguuugaa

SEQ ID NO: 1158033 - RNA, 16 nt, Human
uaaucguguccccuau

SEQ ID NO: 1158034 - RNA, 16 nt, Human
uaaucgaccugccucg

SEQ ID NO: 1158035 - RNA, 14 nt, Human
uaaucgaccugccu

SEQ ID NO: 1158036 - RNA, 13 nt, Human
uaaucgaccugcc

SEQ ID NO: 1158037 - RNA, 21 nt, Human
uaagccuuuggaaacagcucg

SEQ ID NO: 1158038 - RNA, 17 nt, Human
uaagccuuuggaaacag

SEQ ID NO: 1158039 - RNA, 14 nt, Human
uaagccuuuggaaa

SEQ ID NO: 1158040 - RNA, 17 nt, Human
uaacugagugccuuuug

SEQ ID NO: 1158041 - RNA, 16 nt, Human
uaacugagugccuuuu

SEQ ID NO: 1158042 - RNA, 15 nt, Human
uaaauugcuccuuga

SEQ ID NO: 1158043 - RNA, 19 nt, Human
uaaaucaaguuggcuucua

SEQ ID NO: 1158044 - RNA, 14 nt, Human
uaaagcugaaaacu

SEQ ID NO: 1158045 - RNA, 23 nt, Human
uaaacugcccccucugcccugcg

SEQ ID NO: 1158046 - RNA, 22 nt, Human
uaaacugcccccucugcccugc

SEQ ID NO: 1158047 - RNA, 21 nt, Human
uaaacugcccccucugcccug

SEQ ID NO: 1158048 - RNA, 20 nt, Human
uaaacugcccccucugcccu

SEQ ID NO: 1158049 - RNA, 16 nt, Human
guuuguugugaggauu

SEQ ID NO: 1158050 - RNA, 19 nt, Human
guuuguggaaaaugaaaau

SEQ ID NO: 1158051 - RNA, 22 nt, Human
guuuccugcccugggaggcagu

SEQ ID NO: 1158052 - RNA, 17 nt, Human
guuuccugcccugggag

SEQ ID NO: 1158053 - RNA, 13 nt, Human
guuuccugcccug

SEQ ID NO: 1158054 - RNA, 17 nt, Human
gguucuuucuuccucug

SEQ ID NO: 1158055 - RNA, 16 nt, Human
gguucuuucuuccucu

SEQ ID NO: 1158056 - RNA, 14 nt, Human
gguucuuucuuccu

SEQ ID NO: 1158057 - RNA, 22 nt, Human
gguuaguggauggaaggggcug

SEQ ID NO: 1158058 - RNA, 21 nt, Human
gguuaguggauggaaggggcu

SEQ ID NO: 1158059 - RNA, 23 nt, Human
gguggccacuccagaccccuggc

SEQ ID NO: 1158060 - RNA, 22 nt, Human
gguggccacuccagaccccugg

SEQ ID NO: 1158061 - RNA, 21 nt, Human
gguggccacuccagaccccug

SEQ ID NO: 1158062 - RNA, 20 nt, Human
gguggccacuccagaccccu

SEQ ID NO: 1158063 - RNA, 18 nt, Human
ggucacaggacucugccu

SEQ ID NO: 1158064 - RNA, 16 nt, Human
ggucacaggacucugc

SEQ ID NO: 1158065 - RNA, 19 nt, Human
ggguucuuucuuccucugc

SEQ ID NO: 1158066 - RNA, 17 nt, Human
ggguucuuucuuccucu

SEQ ID NO: 1158067 - RNA, 21 nt, Human
ggguuccuuccucugagccuu

SEQ ID NO: 1158068 - RNA, 20 nt, Human
ggguuccuuccucugagccu

SEQ ID NO: 1158069 - RNA, 19 nt, Human
ggguuccuuccucugagcc

SEQ ID NO: 1158070 - RNA, 18 nt, Human
ggggaggggcugugggcg

SEQ ID NO: 1158071 - RNA, 11 nt, Human
gggccugggcc

SEQ ID NO: 1158072 - RNA, 14 nt, Human
gggccccagaggcu

SEQ ID NO: 1158073 - RNA, 20 nt, Human
gggcauggccagguggccac

SEQ ID NO: 1158074 - RNA, 17 nt, Human
gggcauggccagguggc

SEQ ID NO: 1158075 - RNA, 15 nt, Human
gggcauggccaggug

SEQ ID NO: 1158076 - RNA, 16 nt, Human
gggcacugguggcccg

SEQ ID NO: 1158077 - RNA, 13 nt, Human
gggcacugguggc

SEQ ID NO: 1158078 - RNA, 14 nt, Human
gggcaccggggccu

SEQ ID NO: 1158079 - RNA, 14 nt, Human
gggaccccugagcu

SEQ ID NO: 1158080 - RNA, 18 nt, Human
gggaccccgagccuggcu

SEQ ID NO: 1158081 - RNA, 20 nt, Human
gggaccccgagccuggcucc

SEQ ID NO: 1158082 - RNA, 23 nt, Human
gggacaaggacuaggguccuggg

SEQ ID NO: 1158083 - RNA, 17 nt, Human
gggaauuucuucaacuc

SEQ ID NO: 1158084 - RNA, 22 nt, Human
gggaaggcagggagggccuggg

SEQ ID NO: 1158085 - RNA, 22 nt, Human
ggcuuuucacugcuggcugccu

SEQ ID NO: 1158086 - RNA, 19 nt, Human
ggcuuuucacugcuggcug

SEQ ID NO: 1158087 - RNA, 17 nt, Human
ggcuuuucacugcuggc

SEQ ID NO: 1158088 - RNA, 15 nt, Human
ggcuuuucacugcug

SEQ ID NO: 1158089 - RNA, 14 nt, Human
ggcuuuucacugcu

SEQ ID NO: 1158090 - RNA, 12 nt, Human
ggcuucacagau

SEQ ID NO: 1158091 - RNA, 12 nt, Human
ggccaggcuggu

SEQ ID NO: 1158092 - RNA, 11 nt, Human
ggccaggcugg

SEQ ID NO: 1158093 - RNA, 14 nt, Human
ggcaggaaggcuga

SEQ ID NO: 1158094 - RNA, 23 nt, Human
ggcaacuugggaacuagacuccc

SEQ ID NO: 1158095 - RNA, 18 nt, Human
ggcaacuugggaacuaga

SEQ ID NO: 1158096 - RNA, 21 nt, Human
ggacugccagucccccugccc

SEQ ID NO: 1158097 - RNA, 11 nt, Human
ggacucugccu

SEQ ID NO: 1158098 - RNA, 15 nt, Human
ggacuccucugucca

SEQ ID NO: 1158099 - RNA, 14 nt, Human
ggacuccucugucc

SEQ ID NO: 1158100 - RNA, 13 nt, Human
ggaagcagcuuuc

SEQ ID NO: 1158101 - RNA, 23 nt, Human
ggaacuagacucccaagcuggac

SEQ ID NO: 1158102 - RNA, 22 nt, Human
ggaaaaccaagccguggcuucc

SEQ ID NO: 1158103 - RNA, 18 nt, Human
gcuuugggcugcccuggu

SEQ ID NO: 1158104 - RNA, 16 nt, Human
gcuuugggcugcccug

SEQ ID NO: 1158105 - RNA, 15 nt, Human
gcuuugggcugcccu

SEQ ID NO: 1158106 - RNA, 14 nt, Human
gcuuugggcugccc

SEQ ID NO: 1158107 - RNA, 22 nt, Human
gcuugcagagaugaggccgcca

SEQ ID NO: 1158108 - RNA, 16 nt, Human
gcuucuguugcugccu

SEQ ID NO: 1158109 - RNA, 21 nt, Human
gcugggauuacaggcuccugc

SEQ ID NO: 1158110 - RNA, 20 nt, Human
gcugggauuacaggcuccug

SEQ ID NO: 1158111 - RNA, 19 nt, Human
gcugggauuacaggcuccu

SEQ ID NO: 1158112 - RNA, 18 nt, Human
gcugggauuacaggcgug

SEQ ID NO: 1158113 - RNA, 17 nt, Human
gcugggauuacaggcgu

SEQ ID NO: 1158114 - RNA, 16 nt, Human
gcugggagcucugcag

SEQ ID NO: 1158115 - RNA, 15 nt, Human
gcugggagcucugca

SEQ ID NO: 1158116 - RNA, 17 nt, Human
gcuggccgggagccuga

SEQ ID NO: 1158117 - RNA, 13 nt, Human
gcuggcccugccc

SEQ ID NO: 1158118 - RNA, 13 nt, Human
gcuggccgggacc

SEQ ID NO: 1158119 - RNA, 12 nt, Human
gcuggcccugcc

SEQ ID NO: 1158120 - RNA, 17 nt, Human
gcugcccuuucugggca

SEQ ID NO: 1158121 - RNA, 23 nt, Human
gcugcccuggugcugccacacuu

SEQ ID NO: 1158122 - RNA, 22 nt, Human
gcugcccuggugcugccacacu

SEQ ID NO: 1158123 - RNA, 20 nt, Human
gcugcccuggugcugccaca

SEQ ID NO: 1158124 - RNA, 19 nt, Human
gcugcccuggugcugccac

SEQ ID NO: 1158125 - RNA, 16 nt, Human
gcgugagaccugcccc

SEQ ID NO: 1158126 - RNA, 19 nt, Human
gcgcuggccgggaccccga

SEQ ID NO: 1158127 - RNA, 16 nt, Human
gccuucagcucuacag

SEQ ID NO: 1158128 - RNA, 13 nt, Human
gccuucagcucua

SEQ ID NO: 1158129 - RNA, 17 nt, Human
gccuuagaaccuuucuu

SEQ ID NO: 1158130 - RNA, 16 nt, Human
gccuuagaaccuuucu

SEQ ID NO: 1158131 - RNA, 15 nt, Human
gccucugcauucagg

SEQ ID NO: 1158132 - RNA, 12 nt, Human
gccucugcauuc

SEQ ID NO: 1158133 - RNA, 14 nt, Human
gccuaaggcugaac

SEQ ID NO: 1158134 - RNA, 15 nt, Human
gccguggcuucccgc

SEQ ID NO: 1158135 - RNA, 13 nt, Human
gccguggcuuccc

SEQ ID NO: 1158136 - RNA, 12 nt, Human
gccguggcuucc

SEQ ID NO: 1158137 - RNA, 11 nt, Human
gccguggcuuc

SEQ ID NO: 1158138 - RNA, 22 nt, Human
gcccuuccucuccacugccuuc

SEQ ID NO: 1158139 - RNA, 21 nt, Human
gcccucccugccccucccuuc

SEQ ID NO: 1158140 - RNA, 15 nt, Human
gcccucccugccccu

SEQ ID NO: 1158141 - RNA, 13 nt, Human
gccccugcacaaa

SEQ ID NO: 1158142 - RNA, 18 nt, Human
gccccucccacagcgcug

SEQ ID NO: 1158143 - RNA, 21 nt, Human
gccccgucccccucuggcucc

SEQ ID NO: 1158144 - RNA, 17 nt, Human
gccccgucccccucugg

SEQ ID NO: 1158145 - RNA, 17 nt, Human
gcccaggccugccuguu

SEQ ID NO: 1158146 - RNA, 18 nt, Human
gccagguggccacuccag

SEQ ID NO: 1158147 - RNA, 20 nt, Human
gccacuccagaccccuggcu

SEQ ID NO: 1158148 - RNA, 19 nt, Human
gccacuccagaccccuggc

SEQ ID NO: 1158149 - RNA, 18 nt, Human
gccacuccagaccccugg

SEQ ID NO: 1158150 - RNA, 16 nt, Human
gccacuccagaccccu

SEQ ID NO: 1158151 - RNA, 18 nt, Human
gcauucucacuccuaccu

SEQ ID NO: 1158152 - RNA, 15 nt, Human
gcauucucacuccua

SEQ ID NO: 1158153 - RNA, 13 nt, Human
gcauucucacucc

SEQ ID NO: 1158154 - RNA, 20 nt, Human
gcauuagauuucucauuugc

SEQ ID NO: 1158155 - RNA, 22 nt, Human
gcagggagggccugggccccag

SEQ ID NO: 1158156 - RNA, 18 nt, Human
gcagggagggccugggcc

SEQ ID NO: 1158157 - RNA, 17 nt, Human
gcagggagggccugggc

SEQ ID NO: 1158158 - RNA, 14 nt, Human
gcagggagggccug

SEQ ID NO: 1158159 - RNA, 18 nt, Human
gcagccgugccuucagcu

SEQ ID NO: 1158160 - RNA, 17 nt, Human
gcagccgugccuucagc

SEQ ID NO: 1158161 - RNA, 15 nt, Human
gcagccgugccuuca

SEQ ID NO: 1158162 - RNA, 17 nt, Human
gcacugaggaccagcca

SEQ ID NO: 1158163 - RNA, 21 nt, Human
gcaagggaauuucuucaacuc

SEQ ID NO: 1158164 - RNA, 18 nt, Human
gcaagcaagaaacacugg

SEQ ID NO: 1158165 - RNA, 23 nt, Human
gcaaaguucccuacuuccuguga

SEQ ID NO: 1158166 - RNA, 20 nt, Human
gaugccugugaacugaacuc

SEQ ID NO: 1158167 - RNA, 16 nt, Human
gaugaaauguaaauac

SEQ ID NO: 1158168 - RNA, 16 nt, Human
gauccucccaggcuuc

SEQ ID NO: 1158169 - RNA, 23 nt, Human
gauccuaaugaaugcauaaaaug

SEQ ID NO: 1158170 - RNA, 16 nt, Human
gaucacauguggacuu

SEQ ID NO: 1158171 - RNA, 18 nt, Human
gauaauucuagcuuugag

SEQ ID NO: 1158172 - RNA, 14 nt, Human
gacuucagcucugu

SEQ ID NO: 1158173 - RNA, 15 nt, Human
gacuuagcugggaga

SEQ ID NO: 1158174 - RNA, 20 nt, Human
gacugccagucccccugccc

SEQ ID NO: 1158175 - RNA, 19 nt, Human
gacccacuggacucaccuc

SEQ ID NO: 1158176 - RNA, 22 nt, Human
gaccacacuccagcugggauca

SEQ ID NO: 1158177 - RNA, 16 nt, Human
gaccacacuccagcug

SEQ ID NO: 1158178 - RNA, 14 nt, Human
gaccacacuccagc

SEQ ID NO: 1158179 - RNA, 22 nt, Human
gacagggcauggccagguggcc

SEQ ID NO: 1158180 - RNA, 20 nt, Human
gacagggcauggccaggugg

SEQ ID NO: 1158181 - RNA, 15 nt, Human
gacagggcauggcca

SEQ ID NO: 1158182 - RNA, 14 nt, Human
gacagggcauggcc

SEQ ID NO: 1158183 - RNA, 16 nt, Human
gacagacagcccucca

SEQ ID NO: 1158184 - RNA, 13 nt, Human
gaaugcuuuagga

SEQ ID NO: 1158185 - RNA, 14 nt, Human
gaaugcauaaaaug

SEQ ID NO: 1158186 - RNA, 23 nt, Human
gaaaauaaaucaaugcuauaacu

SEQ ID NO: 1158187 - RNA, 22 nt, Human
gaaaagucaaggguaggguggg

SEQ ID NO: 1158188 - RNA, 17 nt, Human
cuuuguuuuacugucuu

SEQ ID NO: 1158189 - RNA, 19 nt, Human
cuuucuuuuuuuuuuuuga

SEQ ID NO: 1158190 - RNA, 16 nt, Human
cuuucuuccucugcug

SEQ ID NO: 1158191 - RNA, 21 nt, Human
cuuuaaaaagcuccaaaugca

SEQ ID NO: 1158192 - RNA, 22 nt, Human
cuuuaaaaaauuaaucugggcc

SEQ ID NO: 1158193 - RNA, 22 nt, Human
cuuggagccaauggagacuguc

SEQ ID NO: 1158194 - RNA, 13 nt, Human
cuugccacugccu

SEQ ID NO: 1158195 - RNA, 17 nt, Human
cuucuggcacuuggaga

SEQ ID NO: 1158196 - RNA, 22 nt, Human
cuucuccuuucacaaccuucug

SEQ ID NO: 1158197 - RNA, 20 nt, Human
cuucuccuuucacaaccuuc

SEQ ID NO: 1158198 - RNA, 17 nt, Human
cuucuccuuucacaacc

SEQ ID NO: 1158199 - RNA, 14 nt, Human
cuucuccuuucaca

SEQ ID NO: 1158200 - RNA, 16 nt, Human
cuucgauacaccgggc

SEQ ID NO: 1158201 - RNA, 18 nt, Human
cuucccgcucagcccucc

SEQ ID NO: 1158202 - RNA, 17 nt, Human
cuucccgcucagcccuc

SEQ ID NO: 1158203 - RNA, 16 nt, Human
cuucccgcucagcccu

SEQ ID NO: 1158204 - RNA, 15 nt, Human
cuucccgcucagccc

SEQ ID NO: 1158205 - RNA, 14 nt, Human
cuucauuuggagau

SEQ ID NO: 1158206 - RNA, 13 nt, Human
cuucauuuggaga

SEQ ID NO: 1158207 - RNA, 18 nt, Human
cuucaggcucuucuccuu

SEQ ID NO: 1158208 - RNA, 17 nt, Human
cuucaggcucuucuccu

SEQ ID NO: 1158209 - RNA, 16 nt, Human
cuucaggcucuucucc

SEQ ID NO: 1158210 - RNA, 15 nt, Human
cuucaggcucuucuc

SEQ ID NO: 1158211 - RNA, 14 nt, Human
cuucaggcucuucu

SEQ ID NO: 1158212 - RNA, 16 nt, Human
cuuaucaaaggacacc

SEQ ID NO: 1158213 - RNA, 14 nt, Human
cuuaucaaaggaca

SEQ ID NO: 1158214 - RNA, 20 nt, Human
cuuaggugauccacucgccu

SEQ ID NO: 1158215 - RNA, 15 nt, Human
cuuagaaccuuucuu

SEQ ID NO: 1158216 - RNA, 17 nt, Human
cuuagaaauugcauuuc

SEQ ID NO: 1158217 - RNA, 16 nt, Human
cuuaaguuuauacucu

SEQ ID NO: 1158218 - RNA, 17 nt, Human
cugguugaugccuguga

SEQ ID NO: 1158219 - RNA, 20 nt, Human
cugguggcccgacagccugg

SEQ ID NO: 1158220 - RNA, 18 nt, Human
cuggguuggaaaacagua

SEQ ID NO: 1158221 - RNA, 13 nt, Human
cuggguuggaaaa

SEQ ID NO: 1158222 - RNA, 20 nt, Human
cugggcaccggggccucgga

SEQ ID NO: 1158223 - RNA, 20 nt, Human
cugggaucacauguggacuu

SEQ ID NO: 1158224 - RNA, 23 nt, Human
cugggauuacaggcuccugccac

SEQ ID NO: 1158225 - RNA, 22 nt, Human
cugggauuacaggcuccugcca

SEQ ID NO: 1158226 - RNA, 21 nt, Human
cugggauuacaggcuccugcc

SEQ ID NO: 1158227 - RNA, 20 nt, Human
cugggauuacaggcuccugc

SEQ ID NO: 1158228 - RNA, 19 nt, Human
cugggauuacaggcuccug

SEQ ID NO: 1158229 - RNA, 21 nt, Human
cugggauuacaggcgugagcc

SEQ ID NO: 1158230 - RNA, 16 nt, Human
cugggaggcagugaug

SEQ ID NO: 1158231 - RNA, 15 nt, Human
cugggagcucugcag

SEQ ID NO: 1158232 - RNA, 14 nt, Human
cugggagcucugca

SEQ ID NO: 1158233 - RNA, 13 nt, Human
cugggagcucugc

SEQ ID NO: 1158234 - RNA, 19 nt, Human
cugggaacaccauagguca

SEQ ID NO: 1158235 - RNA, 22 nt, Human
cuggcuuuucacugcuggcugc

SEQ ID NO: 1158236 - RNA, 20 nt, Human
cuggcuuuucacugcuggcu

SEQ ID NO: 1158237 - RNA, 19 nt, Human
cuggcuuuucacugcuggc

SEQ ID NO: 1158238 - RNA, 17 nt, Human
cuggcuuuucacugcug

SEQ ID NO: 1158239 - RNA, 16 nt, Human
cuggcuuuucacugcu

SEQ ID NO: 1158240 - RNA, 15 nt, Human
cuggcuuuucacugc

SEQ ID NO: 1158241 - RNA, 14 nt, Human
cuggcuucacagau

SEQ ID NO: 1158242 - RNA, 19 nt, Human
cuggcugccuuagaaccuu

SEQ ID NO: 1158243 - RNA, 14 nt, Human
cuggcugccuuaga

SEQ ID NO: 1158244 - RNA, 17 nt, Human
cuggcacagggcagugg

SEQ ID NO: 1158245 - RNA, 23 nt, Human
cuggauuauucaaaaugauguau

SEQ ID NO: 1158246 - RNA, 21 nt, Human
cuggauggaggaaaaccaagc

SEQ ID NO: 1158247 - RNA, 16 nt, Human
cuggacucaccucccc

SEQ ID NO: 1158248 - RNA, 23 nt, Human
cugcuuugggcugcccuggugcu

SEQ ID NO: 1158249 - RNA, 22 nt, Human
cugcuuugggcugcccuggugc

SEQ ID NO: 1158250 - RNA, 21 nt, Human
cugcuuugggcugcccuggug

SEQ ID NO: 1158251 - RNA, 20 nt, Human
cugcuuugggcugcccuggu

SEQ ID NO: 1158252 - RNA, 19 nt, Human
cugcuuugggcugcccugg

SEQ ID NO: 1158253 - RNA, 18 nt, Human
cugcuuugggcugcccug

SEQ ID NO: 1158254 - RNA, 20 nt, Human
cugcucugaugaagaggagu

SEQ ID NO: 1158255 - RNA, 12 nt, Human
cugcucugauga

SEQ ID NO: 1158256 - RNA, 12 nt, Human
cugccucuuccu

SEQ ID NO: 1158257 - RNA, 22 nt, Human
cugcccugggaggcagugaugg

SEQ ID NO: 1158258 - RNA, 15 nt, Human
cugcccugggaggca

SEQ ID NO: 1158259 - RNA, 13 nt, Human
cugcccugggagg

SEQ ID NO: 1158260 - RNA, 12 nt, Human
cugcccugggag

SEQ ID NO: 1158261 - RNA, 11 nt, Human
cugcccuggga

SEQ ID NO: 1158262 - RNA, 19 nt, Human
cugcccaggccugccuguu

SEQ ID NO: 1158263 - RNA, 18 nt, Human
cugcccaggccugccugu

SEQ ID NO: 1158264 - RNA, 19 nt, Human
cugcccaaccugcucuccu

SEQ ID NO: 1158265 - RNA, 17 nt, Human
cugcccaaccugcucuc

SEQ ID NO: 1158266 - RNA, 19 nt, Human
cugccaccacgcccggcua

SEQ ID NO: 1158267 - RNA, 22 nt, Human
cugccacacuucaggcucuucu

SEQ ID NO: 1158268 - RNA, 17 nt, Human
cugccacacuucaggcu

SEQ ID NO: 1158269 - RNA, 13 nt, Human
cugccacacuuca

SEQ ID NO: 1158270 - RNA, 16 nt, Human
cugcagggccaagcac

SEQ ID NO: 1158271 - RNA, 17 nt, Human
cugcagggacugccagu

SEQ ID NO: 1158272 - RNA, 15 nt, Human
cugcagggacugcca

SEQ ID NO: 1158273 - RNA, 20 nt, Human
cugcagagcaggaaacauga

SEQ ID NO: 1158274 - RNA, 22 nt, Human
cugcacagugcaucucagccca

SEQ ID NO: 1158275 - RNA, 21 nt, Human
cugcacagugcaucucagccc

SEQ ID NO: 1158276 - RNA, 18 nt, Human
cugcacagugcaucucag

SEQ ID NO: 1158277 - RNA, 21 nt, Human
cugcacaaagcccuuccaugu

SEQ ID NO: 1158278 - RNA, 20 nt, Human
cugcacaaagcccuuccaug

SEQ ID NO: 1158279 - RNA, 18 nt, Human
cugcacaaagcccuucca

SEQ ID NO: 1158280 - RNA, 13 nt, Human
cugcacaaagccc

SEQ ID NO: 1158281 - RNA, 16 nt, Human
cugagugccuuuuggu

SEQ ID NO: 1158282 - RNA, 15 nt, Human
cugagugccuuuugg

SEQ ID NO: 1158283 - RNA, 14 nt, Human
cugagugccuuuug

SEQ ID NO: 1158284 - RNA, 19 nt, Human
cugacagacagcccuccau

SEQ ID NO: 1158285 - RNA, 17 nt, Human
cugacagacagcccucc

SEQ ID NO: 1158286 - RNA, 22 nt, Human
cugaagucacugcacagugcau

SEQ ID NO: 1158287 - RNA, 17 nt, Human
cugaagucacugcacag

SEQ ID NO: 1158288 - RNA, 18 nt, Human
cucuucuggguuccuucc

SEQ ID NO: 1158289 - RNA, 18 nt, Human
cucuugaacuccugaccu

SEQ ID NO: 1158290 - RNA, 16 nt, Human
cucuucuccuuucaca

SEQ ID NO: 1158291 - RNA, 15 nt, Human
cucuucuccuuucac

SEQ ID NO: 1158292 - RNA, 13 nt, Human
cucuucuccuuuc

SEQ ID NO: 1158293 - RNA, 19 nt, Human
cucuucuccacuggaugga

SEQ ID NO: 1158294 - RNA, 17 nt, Human
cucuucuccacuggaug

SEQ ID NO: 1158295 - RNA, 15 nt, Human
cucuucuccacugga

SEQ ID NO: 1158296 - RNA, 14 nt, Human
cucuucuccacugg

SEQ ID NO: 1158297 - RNA, 23 nt, Human
cucuucaguuaagccuuuggaaa

SEQ ID NO: 1158298 - RNA, 20 nt, Human
cucuucaguuaagccuuugg

SEQ ID NO: 1158299 - RNA, 19 nt, Human
cucuucaguuaagccuuug

SEQ ID NO: 1158300 - RNA, 21 nt, Human
cucuguucugcacacagcacg

SEQ ID NO: 1158301 - RNA, 20 nt, Human
cucuguucugcacacagcac

SEQ ID NO: 1158302 - RNA, 19 nt, Human
cucuguucugcacacagca

SEQ ID NO: 1158303 - RNA, 15 nt, Human
cucugcuuuggaaau

SEQ ID NO: 1158304 - RNA, 16 nt, Human
cucugccuccucuuca

SEQ ID NO: 1158305 - RNA, 15 nt, Human
cucugccuccucuuc

SEQ ID NO: 1158306 - RNA, 14 nt, Human
cucugccuccucuu

SEQ ID NO: 1158307 - RNA, 12 nt, Human
cucugcccugcg

SEQ ID NO: 1158308 - RNA, 11 nt, Human
cucugcccugc

SEQ ID NO: 1158309 - RNA, 23 nt, Human
cucugcccuaaugcgcaggcugg

SEQ ID NO: 1158310 - RNA, 17 nt, Human
cucugaugaagaggagu

SEQ ID NO: 1158311 - RNA, 15 nt, Human
cucugagccuuggga

SEQ ID NO: 1158312 - RNA, 16 nt, Human
cucugagcaaaugugg

SEQ ID NO: 1158313 - RNA, 21 nt, Human
cucucugcccuaaugcgcagg

SEQ ID NO: 1158314 - RNA, 13 nt, Human
cucucugcccuaa

SEQ ID NO: 1158315 - RNA, 12 nt, Human
cucucugcccua

SEQ ID NO: 1158316 - RNA, 16 nt, Human
cucuccacugccuucg

SEQ ID NO: 1158317 - RNA, 14 nt, Human
cucggcucacugca

SEQ ID NO: 1158318 - RNA, 23 nt, Human
cucggccucccaaagugcuggga

SEQ ID NO: 1158319 - RNA, 22 nt, Human
cucggccucccaaagugcuggg

SEQ ID NO: 1158320 - RNA, 19 nt, Human
cucggacuuagcugggaga

SEQ ID NO: 1158321 - RNA, 18 nt, Human
cucggacuuagcugggag

SEQ ID NO: 1158322 - RNA, 21 nt, Human
cucgcuauugucaccagggcu

SEQ ID NO: 1158323 - RNA, 22 nt, Human
cucgcuauugucaccagggcug

SEQ ID NO: 1158324 - RNA, 19 nt, Human
cucgcuauugucaccaggg

SEQ ID NO: 1158325 - RNA, 11 nt, Human
cuccugccacc

SEQ ID NO: 1158326 - RNA, 22 nt, Human
cuccugaguagcugggauuaca

SEQ ID NO: 1158327 - RNA, 17 nt, Human
cuccugaguagcuggga

SEQ ID NO: 1158328 - RNA, 14 nt, Human
cuccugaccuuagg

SEQ ID NO: 1158329 - RNA, 14 nt, Human
cuccugaccucagg

SEQ ID NO: 1158330 - RNA, 19 nt, Human
cuccucuugccacugccuc

SEQ ID NO: 1158331 - RNA, 22 nt, Human
cuccuaucagaaguuucucagc

SEQ ID NO: 1158332 - RNA, 20 nt, Human
cucccuucaaccauucccca

SEQ ID NO: 1158333 - RNA, 19 nt, Human
cucccuucaaccauucccc

SEQ ID NO: 1158334 - RNA, 18 nt, Human
cucccuucaaccauuccc

SEQ ID NO: 1158335 - RNA, 12 nt, Human
cucccuucaacc

SEQ ID NO: 1158336 - RNA, 17 nt, Human
cucccaggcgccccuuc

SEQ ID NO: 1158337 - RNA, 14 nt, Human
cucccaggcgcccc

SEQ ID NO: 1158338 - RNA, 14 nt, Human
cuccaucuccacuc

SEQ ID NO: 1158339 - RNA, 13 nt, Human
cuccaucuccacu

SEQ ID NO: 1158340 - RNA, 18 nt, Human
cuccaucuaaacugcccc

SEQ ID NO: 1158341 - RNA, 17 nt, Human
cuccaucuaaacugccc

SEQ ID NO: 1158342 - RNA, 20 nt, Human
cuccaucgcugucaucucag

SEQ ID NO: 1158343 - RNA, 21 nt, Human
cuccagaccccuggcuuuuca

SEQ ID NO: 1158344 - RNA, 20 nt, Human
cuccagaccccuggcuuuuc

SEQ ID NO: 1158345 - RNA, 19 nt, Human
cuccagaccccuggcuuuu

SEQ ID NO: 1158346 - RNA, 18 nt, Human
cuccagaccccuggcuuu

SEQ ID NO: 1158347 - RNA, 17 nt, Human
cuccagaccccuggcuu

SEQ ID NO: 1158348 - RNA, 15 nt, Human
cuccagaccccuggc

SEQ ID NO: 1158349 - RNA, 13 nt, Human
cuccacugccuuc

SEQ ID NO: 1158350 - RNA, 11 nt, Human
cuccacugccu

SEQ ID NO: 1158351 - RNA, 21 nt, Human
cucauuccaccuucccaugcc

SEQ ID NO: 1158352 - RNA, 18 nt, Human
cucauuccaccuucccau

SEQ ID NO: 1158353 - RNA, 18 nt, Human
cucaggucccugcagggc

SEQ ID NO: 1158354 - RNA, 17 nt, Human
cucaggucccugcaggg

SEQ ID NO: 1158355 - RNA, 22 nt, Human
cguuccuucaaagcaaaugucu

SEQ ID NO: 1158356 - RNA, 18 nt, Human
cgugccuucagcucuaca

SEQ ID NO: 1158357 - RNA, 16 nt, Human
cgugccuucagcucua

SEQ ID NO: 1158358 - RNA, 15 nt, Human
cgugccuucagcucu

SEQ ID NO: 1158359 - RNA, 13 nt, Human
cgugccuucagcu

SEQ ID NO: 1158360 - RNA, 16 nt, Human
cgugccuggccacgcc

SEQ ID NO: 1158361 - RNA, 12 nt, Human
cgugccuggcca

SEQ ID NO: 1158362 - RNA, 22 nt, Human
cgucccccucuggcuccagcug

SEQ ID NO: 1158363 - RNA, 21 nt, Human
cgucccccucuggcuccagcu

SEQ ID NO: 1158364 - RNA, 14 nt, Human
cgucccccucuggc

SEQ ID NO: 1158365 - RNA, 22 nt, Human
cguauaugucucaggucccugc

SEQ ID NO: 1158366 - RNA, 22 nt, Human
cgggagccugaucaccugcccu

SEQ ID NO: 1158367 - RNA, 17 nt, Human
cgcuauugucaccaggg

SEQ ID NO: 1158368 - RNA, 16 nt, Human
cggaucuuuggacaga

SEQ ID NO: 1158369 - RNA, 19 nt, Human
cggaucuuuggacagaagc

SEQ ID NO: 1158370 - RNA, 20 nt, Human
cgcccaggcuggagugcaau

SEQ ID NO: 1158371 - RNA, 19 nt, Human
cgcccaggcuggagugcaa

SEQ ID NO: 1158372 - RNA, 12 nt, Human
cgcccaggcugg

SEQ ID NO: 1158373 - RNA, 16 nt, Human
ccuucuuuuucuucuu

SEQ ID NO: 1158374 - RNA, 14 nt, Human
ccuucuuuuucuuc

SEQ ID NO: 1158375 - RNA, 13 nt, Human
ccuucgccaccug

SEQ ID NO: 1158376 - RNA, 23 nt, Human
ccuucgauacaccgggccuggag

SEQ ID NO: 1158377 - RNA, 22 nt, Human
ccuucgauacaccgggccugga

SEQ ID NO: 1158378 - RNA, 20 nt, Human
ccuucgauacaccgggccug

SEQ ID NO: 1158379 - RNA, 23 nt, Human
ccuuccaugucgccucugcauuc

SEQ ID NO: 1158380 - RNA, 21 nt, Human
ccuuccaugucgccucugcau

SEQ ID NO: 1158381 - RNA, 20 nt, Human
ccuuccaugucgccucugca

SEQ ID NO: 1158382 - RNA, 19 nt, Human
ccuuccaugucgccucugc

SEQ ID NO: 1158383 - RNA, 14 nt, Human
ccuucaaccauucc

SEQ ID NO: 1158384 - RNA, 19 nt, Human
ccuucaaagcaaaugucuu

SEQ ID NO: 1158385 - RNA, 15 nt, Human
ccuucaaagcaaaug

SEQ ID NO: 1158386 - RNA, 18 nt, Human
ccuuagaaccuuucuuac

SEQ ID NO: 1158387 - RNA, 16 nt, Human
ccuuagaaccuuucuu

SEQ ID NO: 1158388 - RNA, 15 nt, Human
ccuuagaaccuuucu

SEQ ID NO: 1158389 - RNA, 14 nt, Human
ccuuagaaccuuuc

SEQ ID NO: 1158390 - RNA, 21 nt, Human
ccuggugcugccacacuucag

SEQ ID NO: 1158391 - RNA, 18 nt, Human
ccuggugcugccacacuu

SEQ ID NO: 1158392 - RNA, 15 nt, Human
ccuggugcugccaca

SEQ ID NO: 1158393 - RNA, 19 nt, Human
ccuggcagccgugccuuca

SEQ ID NO: 1158394 - RNA, 18 nt, Human
ccuggcagccgugccuuc

SEQ ID NO: 1158395 - RNA, 12 nt, Human
ccuggcagccgu

SEQ ID NO: 1158396 - RNA, 14 nt, Human
ccuggacuccugca

SEQ ID NO: 1158397 - RNA, 20 nt, Human
ccuggcuccaaacccucgag

SEQ ID NO: 1158398 - RNA, 13 nt, Human
ccugggaggcagu

SEQ ID NO: 1158399 - RNA, 21 nt, Human
ccuggcagccgugccuucagc

SEQ ID NO: 1158400 - RNA, 19 nt, Human
ccugcuuugggcugcccug

SEQ ID NO: 1158401 - RNA, 18 nt, Human
ccugcuuugggcugcccu

SEQ ID NO: 1158402 - RNA, 17 nt, Human
ccugcuuugggcugccc

SEQ ID NO: 1158403 - RNA, 19 nt, Human
ccucuuccucccucauucc

SEQ ID NO: 1158404 - RNA, 16 nt, Human
ccucuuccucccucau

SEQ ID NO: 1158405 - RNA, 15 nt, Human
ccucuuccucccuca

SEQ ID NO: 1158406 - RNA, 21 nt, Human
ccucuguucugcacacagcac

SEQ ID NO: 1158407 - RNA, 17 nt, Human
ccucuguccaggcacug

SEQ ID NO: 1158408 - RNA, 17 nt, Human
ccucuggcuccagcugg

SEQ ID NO: 1158409 - RNA, 16 nt, Human
ccucuggcuccagcug

SEQ ID NO: 1158410 - RNA, 13 nt, Human
ccucucugcccua

SEQ ID NO: 1158411 - RNA, 19 nt, Human
ccucuccacugccuucgau

SEQ ID NO: 1158412 - RNA, 16 nt, Human
ccucuccacugccuuc

SEQ ID NO: 1158413 - RNA, 14 nt, Human
ccucuccacugccu

SEQ ID NO: 1158414 - RNA, 13 nt, Human
ccucuccacugcc

SEQ ID NO: 1158415 - RNA, 12 nt, Human
ccucuccacugc

SEQ ID NO: 1158416 - RNA, 20 nt, Human
ccuccuuaucaaaggacacc

SEQ ID NO: 1158417 - RNA, 18 nt, Human
ccuccuuaucaaaggaca

SEQ ID NO: 1158418 - RNA, 13 nt, Human
ccuccuggacucc

SEQ ID NO: 1158419 - RNA, 14 nt, Human
ccuccuccuggacu

SEQ ID NO: 1158420 - RNA, 13 nt, Human
ccucccugccccu

SEQ ID NO: 1158421 - RNA, 16 nt, Human
ccucccggugcccaag

SEQ ID NO: 1158422 - RNA, 13 nt, Human
ccucccggugccc

SEQ ID NO: 1158423 - RNA, 14 nt, Human
ccucagucucccuc

SEQ ID NO: 1158424 - RNA, 23 nt, Human
ccucagguaaucgaccugccucg

SEQ ID NO: 1158425 - RNA, 22 nt, Human
ccucagguaaucgaccugccuc

SEQ ID NO: 1158426 - RNA, 21 nt, Human
ccucagguaaucgaccugccu

SEQ ID NO: 1158427 - RNA, 22 nt, Human
ccucacuaucccggcugcccuu

SEQ ID NO: 1158428 - RNA, 21 nt, Human
ccucacuaucccggcugcccu

SEQ ID NO: 1158429 - RNA, 21 nt, Human
ccucacuaggcuucugguuga

SEQ ID NO: 1158430 - RNA, 17 nt, Human
ccuaucagaaguuucuc

SEQ ID NO: 1158431 - RNA, 12 nt, Human
ccuaccugguaa

SEQ ID NO: 1158432 - RNA, 17 nt, Human
ccuaauuccacagcugc

SEQ ID NO: 1158433 - RNA, 16 nt, Human
ccuaauuccacagcug

SEQ ID NO: 1158434 - RNA, 15 nt, Human
ccuaauuccacagcu

SEQ ID NO: 1158435 - RNA, 14 nt, Human
ccuaauuccacagc

SEQ ID NO: 1158436 - RNA, 12 nt, Human
ccuaaagagaua

SEQ ID NO: 1158437 - RNA, 23 nt, Human
ccguggcuucccgcucagcccuc

SEQ ID NO: 1158438 - RNA, 21 nt, Human
ccguggcuucccgcucagccc

SEQ ID NO: 1158439 - RNA, 15 nt, Human
ccguggcuucccgcu

SEQ ID NO: 1158440 - RNA, 17 nt, Human
ccgugccuucagcucua

SEQ ID NO: 1158441 - RNA, 16 nt, Human
ccgugccuucagcucu

SEQ ID NO: 1158442 - RNA, 15 nt, Human
ccgugccuucagcuc

SEQ ID NO: 1158443 - RNA, 14 nt, Human
ccgugccuucagcu

SEQ ID NO: 1158444 - RNA, 19 nt, Human
ccgggccuggagaacuaga

SEQ ID NO: 1158445 - RNA, 12 nt, Human
ccggcugcccuu

SEQ ID NO: 1158446 - RNA, 22 nt, Human
ccgagucucuucuccacuggau

SEQ ID NO: 1158447 - RNA, 16 nt, Human
ccgagccuggcuccaa

SEQ ID NO: 1158448 - RNA, 19 nt, Human
ccgagccuggcuccaaacc

SEQ ID NO: 1158449 - RNA, 22 nt, Human
cccuuucugggcaccggggccu

SEQ ID NO: 1158450 - RNA, 20 nt, Human
cccuuccucuccacugccuu

SEQ ID NO: 1158451 - RNA, 21 nt, Human
cccuuccucuccacugccuuc

SEQ ID NO: 1158452 - RNA, 17 nt, Human
cccuuccucuccacugc

SEQ ID NO: 1158453 - RNA, 16 nt, Human
cccuuccucuccacug

SEQ ID NO: 1158454 - RNA, 13 nt, Human
cccuuccucucca

SEQ ID NO: 1158455 - RNA, 21 nt, Human
cccuuaccacugcucugauga

SEQ ID NO: 1158456 - RNA, 17 nt, Human
cccuuaccacugcucug

SEQ ID NO: 1158457 - RNA, 23 nt, Human
cccugguuuccugcccugggagg

SEQ ID NO: 1158458 - RNA, 22 nt, Human
cccugguuuccugcccugggag

SEQ ID NO: 1158459 - RNA, 21 nt, Human
cccugguuuccugcccuggga

SEQ ID NO: 1158460 - RNA, 21 nt, Human
ccccgucucugguuccucccc

SEQ ID NO: 1158461 - RNA, 20 nt, Human
ccccgucccccucuggcucc

SEQ ID NO: 1158462 - RNA, 16 nt, Human
ccccgucccccucugg

SEQ ID NO: 1158463 - RNA, 16 nt, Human
cccccucugcccugcg

SEQ ID NO: 1158464 - RNA, 14 nt, Human
cccccucugcccug

SEQ ID NO: 1158465 - RNA, 13 nt, Human
cccccucugcccu

SEQ ID NO: 1158466 - RNA, 16 nt, Human
cccccaucucuucugg

SEQ ID NO: 1158467 - RNA, 23 nt, Human
cccccaaccaaguggcucccaca

SEQ ID NO: 1158468 - RNA, 14 nt, Human
ccccaagccuggca

SEQ ID NO: 1158469 - RNA, 13 nt, Human
ccccaagccuggc

SEQ ID NO: 1158470 - RNA, 15 nt, Human
cccaggcugagccuc

SEQ ID NO: 1158471 - RNA, 14 nt, Human
cccaggcugagccu

SEQ ID NO: 1158472 - RNA, 18 nt, Human
cccaggcgccccuucccc

SEQ ID NO: 1158473 - RNA, 16 nt, Human
cccaggccugccuguu

SEQ ID NO: 1158474 - RNA, 15 nt, Human
cccaggccugccugu

SEQ ID NO: 1158475 - RNA, 23 nt, Human
ccauacuaauuauacccccugca

SEQ ID NO: 1158476 - RNA, 13 nt, Human
ccauacuaauuau

SEQ ID NO: 1158477 - RNA, 12 nt, Human
ccauacuaauua

SEQ ID NO: 1158478 - RNA, 20 nt, Human
ccagugaaaucaguuacucu

SEQ ID NO: 1158479 - RNA, 12 nt, Human
ccagggaagggg

SEQ ID NO: 1158480 - RNA, 21 nt, Human
ccaggcuggucucgaacuccu

SEQ ID NO: 1158481 - RNA, 18 nt, Human
ccagaccccuggcuuuuc

SEQ ID NO: 1158482 - RNA, 17 nt, Human
ccagaccccuggcuuuu

SEQ ID NO: 1158483 - RNA, 16 nt, Human
ccagaccccuggcuuu

SEQ ID NO: 1158484 - RNA, 15 nt, Human
ccagaccccuggcuu

SEQ ID NO: 1158485 - RNA, 14 nt, Human
ccagaccccuggcu

SEQ ID NO: 1158486 - RNA, 13 nt, Human
ccagaauuucaaa

SEQ ID NO: 1158487 - RNA, 23 nt, Human
ccagaauggucuuucuaaugugu

SEQ ID NO: 1158488 - RNA, 16 nt, Human
ccagaaugcuuuagga

SEQ ID NO: 1158489 - RNA, 21 nt, Human
ccacuuagaaauugcauuucc

SEQ ID NO: 1158490 - RNA, 19 nt, Human
ccacuuagaaauugcauuu

SEQ ID NO: 1158491 - RNA, 22 nt, Human
ccacuccagaccccuggcuuuu

SEQ ID NO: 1158492 - RNA, 21 nt, Human
ccacuccagaccccuggcuuu

SEQ ID NO: 1158493 - RNA, 17 nt, Human
ccacuagacccacugga

SEQ ID NO: 1158494 - RNA, 15 nt, Human
ccacuagacccacug

SEQ ID NO: 1158495 - RNA, 15 nt, Human
ccaccaacccucaga

SEQ ID NO: 1158496 - RNA, 23 nt, Human
ccacaggcccuuccucuccacug

SEQ ID NO: 1158497 - RNA, 22 nt, Human
ccacaggcccuuccucuccacu

SEQ ID NO: 1158498 - RNA, 19 nt, Human
ccacaggcccuuccucucc

SEQ ID NO: 1158499 - RNA, 18 nt, Human
ccacaggcccuuccucuc

SEQ ID NO: 1158500 - RNA, 17 nt, Human
ccacaggcccuuccucu

SEQ ID NO: 1158501 - RNA, 16 nt, Human
ccacaggcccuuccuc

SEQ ID NO: 1158502 - RNA, 15 nt, Human
ccacaggcccuuccu

SEQ ID NO: 1158503 - RNA, 13 nt, Human
ccacacuccagcu

SEQ ID NO: 1158504 - RNA, 12 nt, Human
ccacacuccagc

SEQ ID NO: 1158505 - RNA, 22 nt, Human
ccaauaguuguugauuggcagg

SEQ ID NO: 1158506 - RNA, 15 nt, Human
ccaagccuggcaagg

SEQ ID NO: 1158507 - RNA, 14 nt, Human
ccaagccguggcuu

SEQ ID NO: 1158508 - RNA, 13 nt, Human
ccaagccguggcu

SEQ ID NO: 1158509 - RNA, 20 nt, Human
ccaagaauagaugcugacug

SEQ ID NO: 1158510 - RNA, 19 nt, Human
ccaagaauagaugcugacu

SEQ ID NO: 1158511 - RNA, 15 nt, Human
ccaacccucagagcc

SEQ ID NO: 1158512 - RNA, 14 nt, Human
ccaacccucagagc

SEQ ID NO: 1158513 - RNA, 20 nt, Human
ccaaccaaguggcucccaca

SEQ ID NO: 1158514 - RNA, 20 nt, Human
ccaaacauccuacaagacac

SEQ ID NO: 1158515 - RNA, 19 nt, Human
ccaaacauccuacaagaca

SEQ ID NO: 1158516 - RNA, 20 nt, Human
cauuuccugacagaaggacu

SEQ ID NO: 1158517 - RNA, 13 nt, Human
cauuuccugacag

SEQ ID NO: 1158518 - RNA, 21 nt, Human
cauuguagagcuucuggcacu

SEQ ID NO: 1158519 - RNA, 19 nt, Human
cauuguagagcuucuggca

SEQ ID NO: 1158520 - RNA, 17 nt, Human
cauuguagagcuucugg

SEQ ID NO: 1158521 - RNA, 16 nt, Human
cauuguagagcuucug

SEQ ID NO: 1158522 - RNA, 15 nt, Human
cauuguagagcuucu

SEQ ID NO: 1158523 - RNA, 16 nt, Human
agauaacaaucuguau

SEQ ID NO: 1158524 - RNA, 20 nt, Human
accuuacauuugaaaucuau

SEQ ID NO: 1158525 - RNA, 15 nt, Human
aaaaaauauuuuccu

SEQ ID NO: 1158526 - RNA, 15 nt, Human
aaauauuuauuuuaa

SEQ ID NO: 1158527 - RNA, 20 nt, Human
aaauauuuauuuuaauaaug

SEQ ID NO: 1158528 - RNA, 21 nt, Human
aaauauuuauuuuaauaaugu

SEQ ID NO: 1158529 - RNA, 24 nt, Human
aaauagcucaggugucccugcacu

SEQ ID NO: 1158530 - RNA, 16 nt, Human
aaagccuccuccagcc

SEQ ID NO: 1158531 - RNA, 14 nt, Human
aaagcccugugcuc

SEQ ID NO: 1158532 - RNA, 13 nt, Human
aaagcccugugcu

SEQ ID NO: 1158533 - RNA, 14 nt, Human
aaaggcuaccuuug

SEQ ID NO: 1158534 - RNA, 16 nt, Human
aaaggcuccaggagca

SEQ ID NO: 1158535 - RNA, 14 nt, Human
aaaggcagaagcaa

SEQ ID NO: 1158536 - RNA, 19 nt, Human
aaaggcagaagcaacccaa

SEQ ID NO: 1158537 - RNA, 19 nt, Human
aaaggcuccaggagcagcc

SEQ ID NO: 1158538 - RNA, 20 nt, Human
aaaggcuccaggagcagcca

SEQ ID NO: 1158539 - RNA, 13 nt, Human
aaaguggaaaaau

SEQ ID NO: 1158540 - RNA, 13 nt, Human
aaauaaaacuuuu

SEQ ID NO: 1158541 - RNA, 16 nt, Human
aaauaaaacuuuuuaa

SEQ ID NO: 1158542 - RNA, 19 nt, Human
aaauaaaacuuuuuaaaau

SEQ ID NO: 1158543 - RNA, 17 nt, Human
aaaauaaaacuuuuuaa

SEQ ID NO: 1158544 - RNA, 14 nt, Human
aaaaguuaaaaagu

SEQ ID NO: 1158545 - RNA, 18 nt, Human
aaaaguucugcagauaaa

SEQ ID NO: 1158546 - RNA, 21 nt, Human
aaaaucuacacuccagugaga

SEQ ID NO: 1158547 - RNA, 16 nt, Human
aaaaagaaacauuugg

SEQ ID NO: 1158548 - RNA, 15 nt, Human
aaaaagaaaggaggg

SEQ ID NO: 1158549 - RNA, 19 nt, Human
aaaaucucaaauuucuaaa

SEQ ID NO: 1158550 - RNA, 22 nt, Human
aaaaucucaaauuucuaaaucu

SEQ ID NO: 1158551 - RNA, 16 nt, Human
aaaaucucaauauuuc

SEQ ID NO: 1158552 - RNA, 17 nt, Human
aaaaucucaauauuuca

SEQ ID NO: 1158553 - RNA, 16 nt, Human
aaacacuguucucugc

SEQ ID NO: 1158554 - RNA, 18 nt, Human
aaacucuccucugcugcu

SEQ ID NO: 1158555 - RNA, 18 nt, Human
aaaccaucauugaaaucu

SEQ ID NO: 1158556 - RNA, 19 nt, Human
aaagaguguggcaaaauaa

SEQ ID NO: 1158557 - RNA, 17 nt, Human
aaagauauuuugcuuug

SEQ ID NO: 1158558 - RNA, 20 nt, Human
aaagauauuuugcuuuguga

SEQ ID NO: 1158559 - RNA, 12 nt, Human
aaagauauuuug

SEQ ID NO: 1158560 - RNA, 16 nt, Human
aaagauauuuugcuuu

SEQ ID NO: 1158561 - RNA, 17 nt, Human
aaccuagggugauauua

SEQ ID NO: 1158562 - RNA, 13 nt, Human
aaccacgcuggac

SEQ ID NO: 1158563 - RNA, 15 nt, Human
aaccacuucagcuga

SEQ ID NO: 1158564 - RNA, 21 nt, Human
aaauucuugcaaaguaucccu

SEQ ID NO: 1158565 - RNA, 19 nt, Human
aaauugacacuuaaaaaug

SEQ ID NO: 1158566 - RNA, 22 nt, Human
aaauugacacuuaaaaaugguu

SEQ ID NO: 1158567 - RNA, 17 nt, Human
aaaucuuauaauuuaaa

SEQ ID NO: 1158568 - RNA, 18 nt, Human
aacaaauuuacagagaca

SEQ ID NO: 1158569 - RNA, 14 nt, Human
aacugauaaagaug

SEQ ID NO: 1158570 - RNA, 15 nt, Human
aacugacucuuaaga

SEQ ID NO: 1158571 - RNA, 18 nt, Human
aacugacucuuaagaaga

SEQ ID NO: 1158572 - RNA, 19 nt, Human
aacugacucuuaagaagac

SEQ ID NO: 1158573 - RNA, 20 nt, Human
aacugacucuuaagaagacu

SEQ ID NO: 1158574 - RNA, 15 nt, Human
aacuuaaucuaaaug

SEQ ID NO: 1158575 - RNA, 16 nt, Human
aacuuaaucuaaaugg

SEQ ID NO: 1158576 - RNA, 18 nt, Human
aacuuaaucuaaauggaa

SEQ ID NO: 1158577 - RNA, 21 nt, Human
aacuuuaugcuaagugaaaua

SEQ ID NO: 1158578 - RNA, 20 nt, Human
aacuuuaugcuaagugaaau

SEQ ID NO: 1158579 - RNA, 18 nt, Human
aaugcgugcauaccacuu

SEQ ID NO: 1158580 - RNA, 19 nt, Human
aaugcgugcauaccacuuu

SEQ ID NO: 1158581 - RNA, 21 nt, Human
aaugcgugcauaccacuuuug

SEQ ID NO: 1158582 - RNA, 23 nt, Human
aaugccuuacccucauguucuua

SEQ ID NO: 1158583 - RNA, 21 nt, Human
aaugcuggcuguuggcugggg

SEQ ID NO: 1158584 - RNA, 23 nt, Human
aauguuucaaacauauauaacaa

SEQ ID NO: 1158585 - RNA, 15 nt, Human
aauguuugccucugc

SEQ ID NO: 1158586 - RNA, 16 nt, Human
aauguuugccucugcc

SEQ ID NO: 1158587 - RNA, 15 nt, Human
aaugugaaaagaaaa

SEQ ID NO: 1158588 - RNA, 17 nt, Human
aaugugaaaagaaaaau

SEQ ID NO: 1158589 - RNA, 14 nt, Human
aaucaccgaaaacg

SEQ ID NO: 1158590 - RNA, 15 nt, Human
aaucaccgaaaacgu

SEQ ID NO: 1158591 - RNA, 13 nt, Human
aauagacaauuua

SEQ ID NO: 1158592 - RNA, 18 nt, Human
aauagacaauuuauuaug

SEQ ID NO: 1158593 - RNA, 11 nt, Human
aauauacugua

SEQ ID NO: 1158594 - RNA, 12 nt, Human
aauauacuguaa

SEQ ID NO: 1158595 - RNA, 13 nt, Human
aauauacuguaaa

SEQ ID NO: 1158596 - RNA, 14 nt, Human
aauauacuguaaag

SEQ ID NO: 1158597 - RNA, 15 nt, Human
aauauacuguaaaga

SEQ ID NO: 1158598 - RNA, 16 nt, Human
aauauacuguaaagaa

SEQ ID NO: 1158599 - RNA, 17 nt, Human
aauauacuguaaagaaa

SEQ ID NO: 1158600 - RNA, 18 nt, Human
aauauacuguaaagaaag

SEQ ID NO: 1158601 - RNA, 21 nt, Human
aauauacuguaaagaaagaga

SEQ ID NO: 1158602 - RNA, 22 nt, Human
aauauacuguaaagaaagagag

SEQ ID NO: 1158603 - RNA, 23 nt, Human
aauauacuguaaagaaagagaga

SEQ ID NO: 1158604 - RNA, 20 nt, Human
aauacucuacccucuuagaa

SEQ ID NO: 1158605 - RNA, 22 nt, Human
aauacucuacccucuuagaaaa

SEQ ID NO: 1158606 - RNA, 15 nt, Human
aauccaaugaaauga

SEQ ID NO: 1158607 - RNA, 19 nt, Human
aauccagacccggcugcgu

SEQ ID NO: 1158608 - RNA, 16 nt, Human
aaucucaaauuucuaa

SEQ ID NO: 1158609 - RNA, 17 nt, Human
aaucucaaauuucuaaa

SEQ ID NO: 1158610 - RNA, 18 nt, Human
aaucucaaauuucuaaau

SEQ ID NO: 1158611 - RNA, 21 nt, Human
aaugauuaugaauuacauuug

SEQ ID NO: 1158612 - RNA, 23 nt, Human
aaugauuaugaauuacauuugua

SEQ ID NO: 1158613 - RNA, 15 nt, Human
aaugauuaugaauua

SEQ ID NO: 1158614 - RNA, 15 nt, Human
aaggauguucuagca

SEQ ID NO: 1158615 - RNA, 15 nt, Human
aaggauugcuacugu

SEQ ID NO: 1158616 - RNA, 18 nt, Human
aagcuggucccacucagu

SEQ ID NO: 1158617 - RNA, 21 nt, Human
aagcuggucccacucagucca

SEQ ID NO: 1158618 - RNA, 21 nt, Human
aagcgauucuucugcuucagc

SEQ ID NO: 1158619 - RNA, 12 nt, Human
aagauaaaugug

SEQ ID NO: 1158620 - RNA, 13 nt, Human
aagauaaaugugc

SEQ ID NO: 1158621 - RNA, 14 nt, Human
aagauaaaugugcu

SEQ ID NO: 1158622 - RNA, 20 nt, Human
aagccagcaggcucucaggc

SEQ ID NO: 1158623 - RNA, 23 nt, Human
aagccagcaggcucucaggccag

SEQ ID NO: 1158624 - RNA, 14 nt, Human
aagcagcguuucua

SEQ ID NO: 1158625 - RNA, 17 nt, Human
aagcagcguuucuauga

SEQ ID NO: 1158626 - RNA, 20 nt, Human
aagcagcguuucuaugacac

SEQ ID NO: 1158627 - RNA, 21 nt, Human
aagcagcguuucuaugacaca

SEQ ID NO: 1158628 - RNA, 22 nt, Human
aagcagcguuucuaugacacau

SEQ ID NO: 1158629 - RNA, 22 nt, Human
aaguccucuuuucugagaggac

SEQ ID NO: 1158630 - RNA, 18 nt, Human
aaguccaagcauuuagau

SEQ ID NO: 1158631 - RNA, 18 nt, Human
aaguccucuuuucugaga

SEQ ID NO: 1158632 - RNA, 19 nt, Human
aaguagaagucuuagaugu

SEQ ID NO: 1158633 - RNA, 20 nt, Human
aaguagaagucuuagaugua

SEQ ID NO: 1158634 - RNA, 21 nt, Human
aaguagaagucuuagauguau

SEQ ID NO: 1158635 - RNA, 18 nt, Human
aaguaucccuacuguaau

SEQ ID NO: 1158636 - RNA, 23 nt, Human
aaguaucccuacuguaauuugug

SEQ ID NO: 1158637 - RNA, 18 nt, Human
aagggacgcuacccggga

SEQ ID NO: 1158638 - RNA, 13 nt, Human
aagggcccagaga

SEQ ID NO: 1158639 - RNA, 19 nt, Human
aaggucauuuuuuuuaaga

SEQ ID NO: 1158640 - RNA, 21 nt, Human
aaguggaaaaauagccugccu

SEQ ID NO: 1158641 - RNA, 19 nt, Human
aaguggaaaaauagccugc

SEQ ID NO: 1158642 - RNA, 15 nt, Human
acuuuuauaaacuuu

SEQ ID NO: 1158643 - RNA, 20 nt, Human
acuuuucauaaccuagccuu

SEQ ID NO: 1158644 - RNA, 16 nt, Human
acuuuucuuucagcca

SEQ ID NO: 1158645 - RNA, 14 nt, Human
acuuuucuuugugg

SEQ ID NO: 1158646 - RNA, 19 nt, Human
agaaaauaguggugugauu

SEQ ID NO: 1158647 - RNA, 10 nt, Human
agaaaauaua

SEQ ID NO: 1158648 - RNA, 11 nt, Human
agaaaauauac

SEQ ID NO: 1158649 - RNA, 16 nt, Human
agaaaaucaggcuggc

SEQ ID NO: 1158650 - RNA, 22 nt, Human
acuuuauuuucuauaauuuaaa

SEQ ID NO: 1158651 - RNA, 16 nt, Human
acuuuguucuggcucu

SEQ ID NO: 1158652 - RNA, 17 nt, Human
acuuuguucuggcucuu

SEQ ID NO: 1158653 - RNA, 19 nt, Human
acuuuguucuggcucuucc

SEQ ID NO: 1158654 - RNA, 20 nt, Human
acuuuguucuggcucuucca

SEQ ID NO: 1158655 - RNA, 13 nt, Human
acuuuuauaaacu

SEQ ID NO: 1158656 - RNA, 22 nt, Human
agaaaguacuucuccacccugc

SEQ ID NO: 1158657 - RNA, 23 nt, Human
agaaaguacuucuccacccugcu

SEQ ID NO: 1158658 - RNA, 14 nt, Human
agaaaguucaugcu

SEQ ID NO: 1158659 - RNA, 17 nt, Human
acuggaagcacagcuuc

SEQ ID NO: 1158660 - RNA, 19 nt, Human
acuggaagcacagcuucau

SEQ ID NO: 1158661 - RNA, 15 nt, Human
acuggagaaaaugga

SEQ ID NO: 1158662 - RNA, 18 nt, Human
acugguuccauggccucu

SEQ ID NO: 1158663 - RNA, 19 nt, Human
acuguaagaaaauaucacu

SEQ ID NO: 1158664 - RNA, 22 nt, Human
acuguaagaaaauaucacuugu

SEQ ID NO: 1158665 - RNA, 18 nt, Human
acucugucucaguccaug

SEQ ID NO: 1158666 - RNA, 20 nt, Human
acucugucucaguccaugaa

SEQ ID NO: 1158667 - RNA, 18 nt, Human
acuuguaaaggaauuuaa

SEQ ID NO: 1158668 - RNA, 16 nt, Human
acuugguuuuuaaaaa

SEQ ID NO: 1158669 - RNA, 14 nt, Human
acuugggccacugu

SEQ ID NO: 1158670 - RNA, 15 nt, Human
acuugggccacugug

SEQ ID NO: 1158671 - RNA, 12 nt, Human
acuucagacaua

SEQ ID NO: 1158672 - RNA, 22 nt, Human
acugugcugagucugaaggcug

SEQ ID NO: 1158673 - RNA, 20 nt, Human
acugugcugagucugaaggc

SEQ ID NO: 1158674 - RNA, 12 nt, Human
accugucccccu

SEQ ID NO: 1158675 - RNA, 15 nt, Human
accugucccccugac

SEQ ID NO: 1158676 - RNA, 16 nt, Human
accugucccccugaca

SEQ ID NO: 1158677 - RNA, 13 nt, Human
accuuucccaucu

SEQ ID NO: 1158678 - RNA, 18 nt, Human
accuuucccaucuuccaa

SEQ ID NO: 1158679 - RNA, 15 nt, Human
accuuuaagagaaau

SEQ ID NO: 1158680 - RNA, 17 nt, Human
accuuggcugcagggag

SEQ ID NO: 1158681 - RNA, 18 nt, Human
accuuggcugcagggagu

SEQ ID NO: 1158682 - RNA, 21 nt, Human
accucugcagcaauaaagcag

SEQ ID NO: 1158683 - RNA, 18 nt, Human
accucugcagcaauaaag

SEQ ID NO: 1158684 - RNA, 20 nt, Human
accucugcagcaauaaagca

SEQ ID NO: 1158685 - RNA, 11 nt, Human
acgcugugcug

SEQ ID NO: 1158686 - RNA, 12 nt, Human
acgcugugcugc

SEQ ID NO: 1158687 - RNA, 14 nt, Human
acgcugugcugccc

SEQ ID NO: 1158688 - RNA, 15 nt, Human
acgcugugcugcccu

SEQ ID NO: 1158689 - RNA, 13 nt, Human
acgucugacaggc

SEQ ID NO: 1158690 - RNA, 14 nt, Human
acgucugacaggca

SEQ ID NO: 1158691 - RNA, 15 nt, Human
acgucugacaggcaa

SEQ ID NO: 1158692 - RNA, 15 nt, Human
acuaaguuuuuaugg

SEQ ID NO: 1158693 - RNA, 11 nt, Human
acgugaguccu

SEQ ID NO: 1158694 - RNA, 13 nt, Human
acuaagagagaau

SEQ ID NO: 1158695 - RNA, 15 nt, Human
acuaagagagaauga

SEQ ID NO: 1158696 - RNA, 19 nt, Human
acucaguccauagcagaga

SEQ ID NO: 1158697 - RNA, 20 nt, Human
acuaguauuucuaugaaaua

SEQ ID NO: 1158698 - RNA, 13 nt, Human
acucaaaagcugg

SEQ ID NO: 1158699 - RNA, 18 nt, Human
acucaaaagcugggcagg

SEQ ID NO: 1158700 - RNA, 15 nt, Human
acucuagggaaaaac

SEQ ID NO: 1158701 - RNA, 17 nt, Human
acucuagggaaaaacca

SEQ ID NO: 1158702 - RNA, 23 nt, Human
acucuaucaaguauuauaccuuu

SEQ ID NO: 1158703 - RNA, 17 nt, Human
acucuauguucuaagaa

SEQ ID NO: 1158704 - RNA, 19 nt, Human
acucugucgcccagucugg

SEQ ID NO: 1158705 - RNA, 15 nt, Human
acacgcgugcacaca

SEQ ID NO: 1158706 - RNA, 17 nt, Human
acacgcgugcacacacc

SEQ ID NO: 1158707 - RNA, 20 nt, Human
acacagcucuguccugggag

SEQ ID NO: 1158708 - RNA, 19 nt, Human
acacagaggcugccucucc

SEQ ID NO: 1158709 - RNA, 11 nt, Human
acacagcucuu

SEQ ID NO: 1158710 - RNA, 13 nt, Human
acacagcucuucu

SEQ ID NO: 1158711 - RNA, 22 nt, Human
acacauuuuauuuuauuaugca

SEQ ID NO: 1158712 - RNA, 12 nt, Human
acacauuuuucu

SEQ ID NO: 1158713 - RNA, 20 nt, Human
acacauuuuuuaaaugcacc

SEQ ID NO: 1158714 - RNA, 22 nt, Human
acacauuuuuuaaaugcaccug

SEQ ID NO: 1158715 - RNA, 13 nt, Human
acaagaaaugaaa

SEQ ID NO: 1158716 - RNA, 17 nt, Human
acaaggauugcuacugu

SEQ ID NO: 1158717 - RNA, 12 nt, Human
acaaggcaaggc

SEQ ID NO: 1158718 - RNA, 14 nt, Human
acaaggcaaggcug

SEQ ID NO: 1158719 - RNA, 22 nt, Human
acaaaauguaggguuauaauaa

SEQ ID NO: 1158720 - RNA, 15 nt, Human
acaaggcaaggcugu

SEQ ID NO: 1158721 - RNA, 13 nt, Human
aauuuugugaagc

SEQ ID NO: 1158722 - RNA, 19 nt, Human
acagccacggccaggccag

SEQ ID NO: 1158723 - RNA, 18 nt, Human
acagccacggccaggcca

SEQ ID NO: 1158724 - RNA, 20 nt, Human
acagccacacacacagaaaa

SEQ ID NO: 1158725 - RNA, 21 nt, Human
acagccacacacacagaaaau

SEQ ID NO: 1158726 - RNA, 22 nt, Human
acagccacacacacagaaaaua

SEQ ID NO: 1158727 - RNA, 23 nt, Human
acagccacacacacagaaaauau

SEQ ID NO: 1158728 - RNA, 15 nt, Human
acagccacggccagg

SEQ ID NO: 1158729 - RNA, 16 nt, Human
acagccacggccaggc

SEQ ID NO: 1158730 - RNA, 17 nt, Human
acagccacggccaggcc

SEQ ID NO: 1158731 - RNA, 16 nt, Human
acagcucuucuccagg

SEQ ID NO: 1158732 - RNA, 17 nt, Human
acagcucuucuccaggc

SEQ ID NO: 1158733 - RNA, 18 nt, Human
acagcucuucuccaggcu

SEQ ID NO: 1158734 - RNA, 12 nt, Human
acaggcaagcac

SEQ ID NO: 1158735 - RNA, 15 nt, Human
acaggcaagcaccuc

SEQ ID NO: 1158736 - RNA, 22 nt, Human
acaggaugguucccuugaugaa

SEQ ID NO: 1158737 - RNA, 14 nt, Human
acacugcauguuug

SEQ ID NO: 1158738 - RNA, 15 nt, Human
acacugcauguuugu

SEQ ID NO: 1158739 - RNA, 15 nt, Human
acacuguacugcaau

SEQ ID NO: 1158740 - RNA, 13 nt, Human
acagacaaagcgu

SEQ ID NO: 1158741 - RNA, 13 nt, Human
acagacacaggcc

SEQ ID NO: 1158742 - RNA, 14 nt, Human
acagacacaggccc

SEQ ID NO: 1158743 - RNA, 15 nt, Human
acagaggcagcccca

SEQ ID NO: 1158744 - RNA, 19 nt, Human
acagaggcagccccauucu

SEQ ID NO: 1158745 - RNA, 23 nt, Human
acagaggcagccccauucugccu

SEQ ID NO: 1158746 - RNA, 15 nt, Human
acagacacaggcccg

SEQ ID NO: 1158747 - RNA, 14 nt, Human
acagaggggguggc

SEQ ID NO: 1158748 - RNA, 15 nt, Human
acagagugagacucu

SEQ ID NO: 1158749 - RNA, 19 nt, Human
acagagugagacucugucu

SEQ ID NO: 1158750 - RNA, 21 nt, Human
acagagugagacucugucuca

SEQ ID NO: 1158751 - RNA, 10 nt, Human
acagccacac

SEQ ID NO: 1158752 - RNA, 11 nt, Human
acagccacaca

SEQ ID NO: 1158753 - RNA, 12 nt, Human
acagccacacac

SEQ ID NO: 1158754 - RNA, 13 nt, Human
acagccacacaca

SEQ ID NO: 1158755 - RNA, 14 nt, Human
acagccacacacac

SEQ ID NO: 1158756 - RNA, 15 nt, Human
acagccacacacaca

SEQ ID NO: 1158757 - RNA, 16 nt, Human
acagccacacacacag

SEQ ID NO: 1158758 - RNA, 17 nt, Human
acagccacacacacaga

SEQ ID NO: 1158759 - RNA, 18 nt, Human
acagccacacacacagaa

SEQ ID NO: 1158760 - RNA, 19 nt, Human
acagccacacacacagaaa

SEQ ID NO: 1158761 - RNA, 16 nt, Human
accccuccaugugggc

SEQ ID NO: 1158762 - RNA, 19 nt, Human
accccuccaugugggcuag

SEQ ID NO: 1158763 - RNA, 11 nt, Human
acccccugaau

SEQ ID NO: 1158764 - RNA, 16 nt, Human
acccaccucagccucc

SEQ ID NO: 1158765 - RNA, 20 nt, Human
accauauuaccacagacaua

SEQ ID NO: 1158766 - RNA, 19 nt, Human
acccaagggccuggccuga

SEQ ID NO: 1158767 - RNA, 22 nt, Human
acccaagggccuggccugagcu

SEQ ID NO: 1158768 - RNA, 23 nt, Human
acccaagggccuggccugagcug

SEQ ID NO: 1158769 - RNA, 17 nt, Human
acccacaagaaaugaaa

SEQ ID NO: 1158770 - RNA, 21 nt, Human
acccacaagaaaugaaagcag

SEQ ID NO: 1158771 - RNA, 13 nt, Human
acccaccucagcc

SEQ ID NO: 1158772 - RNA, 14 nt, Human
acccaccucagccu

SEQ ID NO: 1158773 - RNA, 15 nt, Human
acccaccucagccuc

SEQ ID NO: 1158774 - RNA, 14 nt, Human
accauauuaccaca

SEQ ID NO: 1158775 - RNA, 16 nt, Human
accauauuaccacaga

SEQ ID NO: 1158776 - RNA, 15 nt, Human
acaucagcacgauuu

SEQ ID NO: 1158777 - RNA, 17 nt, Human
acaucagcacgauuucu

SEQ ID NO: 1158778 - RNA, 18 nt, Human
acaucagcacgauuucug

SEQ ID NO: 1158779 - RNA, 19 nt, Human
acaucagcacgauuucugu

SEQ ID NO: 1158780 - RNA, 12 nt, Human
acaugcauacac

SEQ ID NO: 1158781 - RNA, 13 nt, Human
acaugcauacaca

SEQ ID NO: 1158782 - RNA, 14 nt, Human
acaugcauacacac

SEQ ID NO: 1158783 - RNA, 15 nt, Human
acaugcauacacaca

SEQ ID NO: 1158784 - RNA, 16 nt, Human
acaugcauacacacac

SEQ ID NO: 1158785 - RNA, 17 nt, Human
acaugcauacacacaca

SEQ ID NO: 1158786 - RNA, 24 nt, Human
acaugcauacacacacacacacag

SEQ ID NO: 1158787 - RNA, 16 nt, Human
acaugugcacaugcac

SEQ ID NO: 1158788 - RNA, 18 nt, Human
acaugugcacaugcacgu

SEQ ID NO: 1158789 - RNA, 19 nt, Human
acaggguuuugccauguug

SEQ ID NO: 1158790 - RNA, 19 nt, Human
acaggcaaugcuggcuguu

SEQ ID NO: 1158791 - RNA, 23 nt, Human
acaggcaaugcuggcuguuggcu

SEQ ID NO: 1158792 - RNA, 14 nt, Human
acaggcacccacca

SEQ ID NO: 1158793 - RNA, 23 nt, Human
acauaaugcgugcauaccacuuu

SEQ ID NO: 1158794 - RNA, 22 nt, Human
acauaaugcgugcauaccacuu

SEQ ID NO: 1158795 - RNA, 15 nt, Human
acauuuauucugcuc

SEQ ID NO: 1158796 - RNA, 12 nt, Human
accaagcccagu

SEQ ID NO: 1158797 - RNA, 13 nt, Human
accagcagaaaug

SEQ ID NO: 1158798 - RNA, 14 nt, Human
accagcagaaaugc

SEQ ID NO: 1158799 - RNA, 17 nt, Human
accagccaguaaauggg

SEQ ID NO: 1158800 - RNA, 12 nt, Human
agggucccuggu

SEQ ID NO: 1158801 - RNA, 11 nt, Human
agggucccugg

SEQ ID NO: 1158802 - RNA, 19 nt, Human
aggggccucuuaugggcug

SEQ ID NO: 1158803 - RNA, 20 nt, Human
aggggccucuuaugggcugg

SEQ ID NO: 1158804 - RNA, 21 nt, Human
aggggccucuuaugggcuggg

SEQ ID NO: 1158805 - RNA, 19 nt, Human
aggguaucaggugcugcca

SEQ ID NO: 1158806 - RNA, 21 nt, Human
aggguaucaggugcugccauc

SEQ ID NO: 1158807 - RNA, 15 nt, Human
aggguaucuggugac

SEQ ID NO: 1158808 - RNA, 20 nt, Human
agguaaaagcaucacaugaa

SEQ ID NO: 1158809 - RNA, 22 nt, Human
aggucuguucuuuccaaaguac

SEQ ID NO: 1158810 - RNA, 23 nt, Human
aggucuguucuuuccaaaguaca

SEQ ID NO: 1158811 - RNA, 14 nt, Human
agguucaaagauau

SEQ ID NO: 1158812 - RNA, 15 nt, Human
agguucaaagauauu

SEQ ID NO: 1158813 - RNA, 22 nt, Human
agguucccuuugacgccauccc

SEQ ID NO: 1158814 - RNA, 23 nt, Human
agguucccuuugacgccauccca

SEQ ID NO: 1158815 - RNA, 19 nt, Human
aggugcuaggaacacuccu

SEQ ID NO: 1158816 - RNA, 22 nt, Human
aggugcuaggaacacuccuuca

SEQ ID NO: 1158817 - RNA, 23 nt, Human
aggugcuaggaacacuccuucac

SEQ ID NO: 1158818 - RNA, 15 nt, Human
agguuaauaaaguaa

SEQ ID NO: 1158819 - RNA, 21 nt, Human
aggcuagaaccaccugccuau

SEQ ID NO: 1158820 - RNA, 22 nt, Human
aggcccuucucuccagccccug

SEQ ID NO: 1158821 - RNA, 23 nt, Human
aggcccuucucuccagccccugg

SEQ ID NO: 1158822 - RNA, 20 nt, Human
aggcccuucucuccagcccc

SEQ ID NO: 1158823 - RNA, 21 nt, Human
aggcccuucucuccagccccu

SEQ ID NO: 1158824 - RNA, 17 nt, Human
agggacgcuacccggga

SEQ ID NO: 1158825 - RNA, 15 nt, Human
aggcuagauguaugu

SEQ ID NO: 1158826 - RNA, 16 nt, Human
aggcuagauguaugua

SEQ ID NO: 1158827 - RNA, 17 nt, Human
aggcuagauguauguac

SEQ ID NO: 1158828 - RNA, 13 nt, Human
aggcuguauccca

SEQ ID NO: 1158829 - RNA, 18 nt, Human
aggcuguaucccaugagc

SEQ ID NO: 1158830 - RNA, 20 nt, Human
aggcugucaauuacaggaag

SEQ ID NO: 1158831 - RNA, 21 nt, Human
aggcugucaauuacaggaagu

SEQ ID NO: 1158832 - RNA, 22 nt, Human
agggacagaggggguggccucc

SEQ ID NO: 1158833 - RNA, 23 nt, Human
agggacagaggggguggccuccc

SEQ ID NO: 1158834 - RNA, 20 nt, Human
agcuccgcuuucuacccagc

SEQ ID NO: 1158835 - RNA, 21 nt, Human
agcuccgcuuucuacccagcg

SEQ ID NO: 1158836 - RNA, 23 nt, Human
agcuccgcuuucuacccagcgag

SEQ ID NO: 1158837 - RNA, 12 nt, Human
agcuccuucugu

SEQ ID NO: 1158838 - RNA, 13 nt, Human
agcuccuucuguc

SEQ ID NO: 1158839 - RNA, 23 nt, Human
agcugcgguccacccaggagccc

SEQ ID NO: 1158840 - RNA, 18 nt, Human
aggauguucugggacaca

SEQ ID NO: 1158841 - RNA, 14 nt, Human
aggauuauuggaaa

SEQ ID NO: 1158842 - RNA, 15 nt, Human
aggauguucugggac

SEQ ID NO: 1158843 - RNA, 16 nt, Human
aggauguucugggaca

SEQ ID NO: 1158844 - RNA, 23 nt, Human
aggaugguucccuugaugaagaa

SEQ ID NO: 1158845 - RNA, 13 nt, Human
aggaccucaggug

SEQ ID NO: 1158846 - RNA, 21 nt, Human
aggaugcuuguacauaaugcg

SEQ ID NO: 1158847 - RNA, 23 nt, Human
aggaugcuuguacauaaugcgug

SEQ ID NO: 1158848 - RNA, 20 nt, Human
aggaauccagacccggcugc

SEQ ID NO: 1158849 - RNA, 21 nt, Human
aggaaucaugugccaagcaga

SEQ ID NO: 1158850 - RNA, 17 nt, Human
aggaauccagacccggc

SEQ ID NO: 1158851 - RNA, 19 nt, Human
agauauaugcucugcaugu

SEQ ID NO: 1158852 - RNA, 23 nt, Human
agaggguggugaccucugccuga

SEQ ID NO: 1158853 - RNA, 11 nt, Human
agagugggagc

SEQ ID NO: 1158854 - RNA, 19 nt, Human
agaguggggauaugauuua

SEQ ID NO: 1158855 - RNA, 14 nt, Human
agagugugccugaa

SEQ ID NO: 1158856 - RNA, 17 nt, Human
agaguguggcaaaauaa

SEQ ID NO: 1158857 - RNA, 12 nt, Human
agagggcacaga

SEQ ID NO: 1158858 - RNA, 20 nt, Human
agaggguggugaccucugcc

SEQ ID NO: 1158859 - RNA, 22 nt, Human
agaggguggugaccucugccug

SEQ ID NO: 1158860 - RNA, 16 nt, Human
agaggaaggagaggag

SEQ ID NO: 1158861 - RNA, 14 nt, Human
agaggacuuuucuu

SEQ ID NO: 1158862 - RNA, 15 nt, Human
agaggagagaggacc

SEQ ID NO: 1158863 - RNA, 16 nt, Human
agaggagagaggaccc

SEQ ID NO: 1158864 - RNA, 15 nt, Human
agagcccaggccucc

SEQ ID NO: 1158865 - RNA, 13 nt, Human
agagcccaggccu

SEQ ID NO: 1158866 - RNA, 14 nt, Human
agagcccaggccuc

SEQ ID NO: 1158867 - RNA, 12 nt, Human
agagaaaauaaa

SEQ ID NO: 1158868 - RNA, 13 nt, Human
agagaaaauaaaa

SEQ ID NO: 1158869 - RNA, 14 nt, Human
agagaaaauaaaaa

SEQ ID NO: 1158870 - RNA, 17 nt, Human
agacuggaagcacagcu

SEQ ID NO: 1158871 - RNA, 19 nt, Human
agacuggaagcacagcuuc

SEQ ID NO: 1158872 - RNA, 23 nt, Human
agagaggguggugaccucugccu

SEQ ID NO: 1158873 - RNA, 22 nt, Human
agagaggguggugaccucugcc

SEQ ID NO: 1158874 - RNA, 20 nt, Human
agagaggguggugaccucug

SEQ ID NO: 1158875 - RNA, 21 nt, Human
agagaggguggugaccucugc

SEQ ID NO: 1158876 - RNA, 19 nt, Human
agagcccaccuuggcucaa

SEQ ID NO: 1158877 - RNA, 13 nt, Human
agagcccacgccc

SEQ ID NO: 1158878 - RNA, 16 nt, Human
agagcccacgccccca

SEQ ID NO: 1158879 - RNA, 17 nt, Human
agagcccacgcccccac

SEQ ID NO: 1158880 - RNA, 15 nt, Human
agagaaaauaaaaag

SEQ ID NO: 1158881 - RNA, 16 nt, Human
agagaaaauaaaaagu

SEQ ID NO: 1158882 - RNA, 17 nt, Human
agagaaaauaaaaaguu

SEQ ID NO: 1158883 - RNA, 18 nt, Human
agagaaaauaaaaaguua

SEQ ID NO: 1158884 - RNA, 17 nt, Human
agagaacuuccagaucc

SEQ ID NO: 1158885 - RNA, 10 nt, Human
agagaagaga

SEQ ID NO: 1158886 - RNA, 14 nt, Human
agacagcccgggcu

SEQ ID NO: 1158887 - RNA, 15 nt, Human
agacagcccgggcuc

SEQ ID NO: 1158888 - RNA, 16 nt, Human
agacagcccgggcucu

SEQ ID NO: 1158889 - RNA, 22 nt, Human
agacgcugugcugcccugccca

SEQ ID NO: 1158890 - RNA, 18 nt, Human
agacggagucccaccuug

SEQ ID NO: 1158891 - RNA, 11 nt, Human
agacagcucuu

SEQ ID NO: 1158892 - RNA, 12 nt, Human
agacagcucuua

SEQ ID NO: 1158893 - RNA, 12 nt, Human
agacagcugccu

SEQ ID NO: 1158894 - RNA, 21 nt, Human
agacgcugugcugcccugccc

SEQ ID NO: 1158895 - RNA, 13 nt, Human
agccccauucugc

SEQ ID NO: 1158896 - RNA, 16 nt, Human
agccccauucugccug

SEQ ID NO: 1158897 - RNA, 17 nt, Human
agccccauucugccugc

SEQ ID NO: 1158898 - RNA, 13 nt, Human
agccccagugccc

SEQ ID NO: 1158899 - RNA, 14 nt, Human
agccccagugccca

SEQ ID NO: 1158900 - RNA, 15 nt, Human
agccccagugcccac

SEQ ID NO: 1158901 - RNA, 18 nt, Human
agccagcaggcucucagg

SEQ ID NO: 1158902 - RNA, 19 nt, Human
agccagcaggcucucaggc

SEQ ID NO: 1158903 - RNA, 20 nt, Human
agccagcaggcucucaggcc

SEQ ID NO: 1158904 - RNA, 21 nt, Human
agccagcaggcucucaggcca

SEQ ID NO: 1158905 - RNA, 21 nt, Human
agccgccaugcuccuggccca

SEQ ID NO: 1158906 - RNA, 13 nt, Human
agccgcuggggcc

SEQ ID NO: 1158907 - RNA, 21 nt, Human
agccgggcgugguggugagug

SEQ ID NO: 1158908 - RNA, 21 nt, Human
agccucccaaagugcugggau

SEQ ID NO: 1158909 - RNA, 22 nt, Human
agccucccacgacugcccggca

SEQ ID NO: 1158910 - RNA, 18 nt, Human
agccucccgaguagcugg

SEQ ID NO: 1158911 - RNA, 19 nt, Human
agccucccgaguagcuggg

SEQ ID NO: 1158912 - RNA, 20 nt, Human
agccucccgaguagcuggga

SEQ ID NO: 1158913 - RNA, 22 nt, Human
agccucccgaguagcugggacu

SEQ ID NO: 1158914 - RNA, 14 nt, Human
agccuccuccagcc

SEQ ID NO: 1158915 - RNA, 22 nt, Human
agcauccuggcacccggccccu

SEQ ID NO: 1158916 - RNA, 23 nt, Human
agcauccuggcacccggccccug

SEQ ID NO: 1158917 - RNA, 23 nt, Human
agcaugccuggauggggcugcac

SEQ ID NO: 1158918 - RNA, 23 nt, Human
agccaagugugguagagugugcc

SEQ ID NO: 1158919 - RNA, 13 nt, Human
agcagcguuucua

SEQ ID NO: 1158920 - RNA, 18 nt, Human
agcagcguuucuaugaca

SEQ ID NO: 1158921 - RNA, 19 nt, Human
agcagugcaugcugucccu

SEQ ID NO: 1158922 - RNA, 20 nt, Human
agcagugcaugcugucccuu

SEQ ID NO: 1158923 - RNA, 23 nt, Human
agcacacuugacaucaacugcau

SEQ ID NO: 1158924 - RNA, 12 nt, Human
agcacagacccu

SEQ ID NO: 1158925 - RNA, 18 nt, Human
agcacagacccugcccug

SEQ ID NO: 1158926 - RNA, 19 nt, Human
agcacagacccugcccugu

SEQ ID NO: 1158927 - RNA, 20 nt, Human
agcacagacccugcccugug

SEQ ID NO: 1158928 - RNA, 14 nt, Human
augucuuuucuugc

SEQ ID NO: 1158929 - RNA, 22 nt, Human
augugaaacuggauuaaacuua

SEQ ID NO: 1158930 - RNA, 19 nt, Human
auggucaccaaaucagcug

SEQ ID NO: 1158931 - RNA, 15 nt, Human
auggucggaaaacau

SEQ ID NO: 1158932 - RNA, 15 nt, Human
auguaauuaaguacu

SEQ ID NO: 1158933 - RNA, 17 nt, Human
auguaauuaaguacuau

SEQ ID NO: 1158934 - RNA, 23 nt, Human
auguaauuaaguacuauguauca

SEQ ID NO: 1158935 - RNA, 13 nt, Human
auguucugggaca

SEQ ID NO: 1158936 - RNA, 19 nt, Human
auguuugccucugccucug

SEQ ID NO: 1158937 - RNA, 22 nt, Human
auguuugccucugccucugaca

SEQ ID NO: 1158938 - RNA, 15 nt, Human
auguuuucaggcuag

SEQ ID NO: 1158939 - RNA, 20 nt, Human
augugggcuaguugggcuuc

SEQ ID NO: 1158940 - RNA, 17 nt, Human
auguucuaagaagugaa

SEQ ID NO: 1158941 - RNA, 16 nt, Human
auguucucucuucucc

SEQ ID NO: 1158942 - RNA, 11 nt, Human
auguucuggga

SEQ ID NO: 1158943 - RNA, 12 nt, Human
auguucugggac

SEQ ID NO: 1158944 - RNA, 15 nt, Human
auggauuuccagcca

SEQ ID NO: 1158945 - RNA, 18 nt, Human
auggauuuccagccaaag

SEQ ID NO: 1158946 - RNA, 15 nt, Human
augcuuguacauaau

SEQ ID NO: 1158947 - RNA, 12 nt, Human
augcugcccugu

SEQ ID NO: 1158948 - RNA, 12 nt, Human
augcuuguacau

SEQ ID NO: 1158949 - RNA, 13 nt, Human
augcuuguacaua

SEQ ID NO: 1158950 - RNA, 14 nt, Human
augcuuguacauaa

SEQ ID NO: 1158951 - RNA, 16 nt, Human
augcucuuuacuucau

SEQ ID NO: 1158952 - RNA, 11 nt, Human
augcugcccug

SEQ ID NO: 1158953 - RNA, 16 nt, Human
augaugccaugaggaa

SEQ ID NO: 1158954 - RNA, 17 nt, Human
augaugccaugaggaac

SEQ ID NO: 1158955 - RNA, 24 nt, Human
augauguuuuccaugaguccccug

SEQ ID NO: 1158956 - RNA, 15 nt, Human
augcacaaacagagg

SEQ ID NO: 1158957 - RNA, 16 nt, Human
augcacaaacagaggc

SEQ ID NO: 1158958 - RNA, 17 nt, Human
augcacaaacagaggcc

SEQ ID NO: 1158959 - RNA, 18 nt, Human
augcacaaacagaggccg

SEQ ID NO: 1158960 - RNA, 16 nt, Human
augcacagaguuguua

SEQ ID NO: 1158961 - RNA, 17 nt, Human
augcacagaguuguuac

SEQ ID NO: 1158962 - RNA, 18 nt, Human
augcacagaguuguuaca

SEQ ID NO: 1158963 - RNA, 16 nt, Human
augcaugaaguaauau

SEQ ID NO: 1158964 - RNA, 20 nt, Human
augcaugaaguaauaugcac

SEQ ID NO: 1158965 - RNA, 19 nt, Human
augccucucucaggccaaa

SEQ ID NO: 1158966 - RNA, 20 nt, Human
auccucccaccucagccucc

SEQ ID NO: 1158967 - RNA, 18 nt, Human
auccucccaccucagccu

SEQ ID NO: 1158968 - RNA, 19 nt, Human
auccucccaccucagccuc

SEQ ID NO: 1158969 - RNA, 15 nt, Human
aucccauuuaaaaaa

SEQ ID NO: 1158970 - RNA, 14 nt, Human
aucccauuuaaaaa

SEQ ID NO: 1158971 - RNA, 15 nt, Human
auccagacccggcug

SEQ ID NO: 1158972 - RNA, 15 nt, Human
auccccuguagagug

SEQ ID NO: 1158973 - RNA, 11 nt, Human
auccuccaggu

SEQ ID NO: 1158974 - RNA, 13 nt, Human
auccuccaggugc

SEQ ID NO: 1158975 - RNA, 15 nt, Human
auccucccaccucag

SEQ ID NO: 1158976 - RNA, 18 nt, Human
aucaccaacgucugugcc

SEQ ID NO: 1158977 - RNA, 19 nt, Human
aucaccaacgucugugcca

SEQ ID NO: 1158978 - RNA, 20 nt, Human
aucaccaacgucugugccau

SEQ ID NO: 1158979 - RNA, 21 nt, Human
aucacagccucugaaaaccaa

SEQ ID NO: 1158980 - RNA, 17 nt, Human
auauuuauuuuaauaau

SEQ ID NO: 1158981 - RNA, 14 nt, Human
auauuuauuuuaau

SEQ ID NO: 1158982 - RNA, 15 nt, Human
auauuuauuuuaaua

SEQ ID NO: 1158983 - RNA, 14 nt, Human
aucaccgaaaacgu

SEQ ID NO: 1158984 - RNA, 19 nt, Human
aucaccgaaaacguggcug

SEQ ID NO: 1158985 - RNA, 21 nt, Human
aucaccgaaaacguggcugcu

SEQ ID NO: 1158986 - RNA, 19 nt, Human
aucagcacgauuucuguuu

SEQ ID NO: 1158987 - RNA, 20 nt, Human
aucagcacgauuucuguuua

SEQ ID NO: 1158988 - RNA, 23 nt, Human
aucagcacgauuucuguuuagau

SEQ ID NO: 1158989 - RNA, 18 nt, Human
aucagccugcuccagcug

SEQ ID NO: 1158990 - RNA, 19 nt, Human
aucagccugcuccagcugu

SEQ ID NO: 1158991 - RNA, 20 nt, Human
aucagccugcuccagcuguu

SEQ ID NO: 1158992 - RNA, 12 nt, Human
aucagcugcuac

SEQ ID NO: 1158993 - RNA, 22 nt, Human
aucugcuuuuuaaagaaugcuc

SEQ ID NO: 1158994 - RNA, 17 nt, Human
aucuugaauuguaagga

SEQ ID NO: 1158995 - RNA, 14 nt, Human
aucuucuuuauaau

SEQ ID NO: 1158996 - RNA, 13 nt, Human
augaggcauuugu

SEQ ID NO: 1158997 - RNA, 21 nt, Human
augaccuuucaauaggaaaaa

SEQ ID NO: 1158998 - RNA, 22 nt, Human
augaccuuucaauaggaaaaac

SEQ ID NO: 1158999 - RNA, 23 nt, Human
augaccuuucaauaggaaaaacu

SEQ ID NO: 1159000 - RNA, 16 nt, Human
augaaagacuguacaa

SEQ ID NO: 1159001 - RNA, 17 nt, Human
augaaagacuguacaaa

SEQ ID NO: 1159002 - RNA, 19 nt, Human
augaaagacuguacaaagu

SEQ ID NO: 1159003 - RNA, 12 nt, Human
aguccuguaaug

SEQ ID NO: 1159004 - RNA, 13 nt, Human
agucugaaggcug

SEQ ID NO: 1159005 - RNA, 15 nt, Human
agucugaaggcuggg

SEQ ID NO: 1159006 - RNA, 16 nt, Human
agucugaaggcugggu

SEQ ID NO: 1159007 - RNA, 17 nt, Human
agucugaaggcuggguu

SEQ ID NO: 1159008 - RNA, 22 nt, Human
aguccuggcaugggaaugaaug

SEQ ID NO: 1159009 - RNA, 20 nt, Human
aguccuggcaugggaaugaa

SEQ ID NO: 1159010 - RNA, 21 nt, Human
aguccuggcaugggaaugaau

SEQ ID NO: 1159011 - RNA, 16 nt, Human
agucugauucccaagc

SEQ ID NO: 1159012 - RNA, 18 nt, Human
agucugauucccaagcuc

SEQ ID NO: 1159013 - RNA, 20 nt, Human
agucugauucccaagcucug

SEQ ID NO: 1159014 - RNA, 17 nt, Human
agucuggaaugcagugg

SEQ ID NO: 1159015 - RNA, 18 nt, Human
agucuggaaugcaguggu

SEQ ID NO: 1159016 - RNA, 14 nt, Human
agugaagacaauga

SEQ ID NO: 1159017 - RNA, 16 nt, Human
agugaagacaaugacu

SEQ ID NO: 1159018 - RNA, 14 nt, Human
aguaugguggcugg

SEQ ID NO: 1159019 - RNA, 13 nt, Human
agucaaauugugu

SEQ ID NO: 1159020 - RNA, 23 nt, Human
agucaaauugugugaaagguacu

SEQ ID NO: 1159021 - RNA, 15 nt, Human
aguaugaggcauuug

SEQ ID NO: 1159022 - RNA, 16 nt, Human
aguaugaggcauuugu

SEQ ID NO: 1159023 - RNA, 17 nt, Human
aguaugaggcauuuguu

SEQ ID NO: 1159024 - RNA, 11 nt, Human
aguaucuugaa

SEQ ID NO: 1159025 - RNA, 12 nt, Human
aguaucuugaag

SEQ ID NO: 1159026 - RNA, 15 nt, Human
aguaucuugaagacu

SEQ ID NO: 1159027 - RNA, 23 nt, Human
aguggcuuaaaacaacacucaca

SEQ ID NO: 1159028 - RNA, 14 nt, Human
agugggagcugccu

SEQ ID NO: 1159029 - RNA, 15 nt, Human
agugggagcugccug

SEQ ID NO: 1159030 - RNA, 16 nt, Human
agugggagcugccugu

SEQ ID NO: 1159031 - RNA, 17 nt, Human
aguguauuuuuuuacua

SEQ ID NO: 1159032 - RNA, 18 nt, Human
aguguauuuuuuuacuaa

SEQ ID NO: 1159033 - RNA, 12 nt, Human
aguuaaauaaau

SEQ ID NO: 1159034 - RNA, 14 nt, Human
aguuacagacaaag

SEQ ID NO: 1159035 - RNA, 16 nt, Human
aguuacagacaaagcg

SEQ ID NO: 1159036 - RNA, 22 nt, Human
aguugaaaaucuuauaauuuaa

SEQ ID NO: 1159037 - RNA, 17 nt, Human
aguuacagacaaagcgu

SEQ ID NO: 1159038 - RNA, 19 nt, Human
aguucagguaacaggcaga

SEQ ID NO: 1159039 - RNA, 20 nt, Human
aguucagguaacaggcagau

SEQ ID NO: 1159040 - RNA, 23 nt, Human
aguugaaaaucuuauaauuuaaa

SEQ ID NO: 1159041 - RNA, 14 nt, Human
aguugaagacagag

SEQ ID NO: 1159042 - RNA, 20 nt, Human
aguuguuugauucagacagc

SEQ ID NO: 1159043 - RNA, 13 nt, Human
auaaagcagcguu

SEQ ID NO: 1159044 - RNA, 14 nt, Human
auaaagcagcguuu

SEQ ID NO: 1159045 - RNA, 18 nt, Human
auaaagcagcguuucuau

SEQ ID NO: 1159046 - RNA, 19 nt, Human
auaaagcagcguuucuaug

SEQ ID NO: 1159047 - RNA, 20 nt, Human
auaaagcagcguuucuauga

SEQ ID NO: 1159048 - RNA, 15 nt, Human
auaaaagacagugaa

SEQ ID NO: 1159049 - RNA, 21 nt, Human
auaaacuuuaccuuuuuuaua

SEQ ID NO: 1159050 - RNA, 17 nt, Human
auaaaacuuuuuaaaau

SEQ ID NO: 1159051 - RNA, 24 nt, Human
auaaacuuuaccuuuuuuauacau

SEQ ID NO: 1159052 - RNA, 10 nt, Human
auaaaaaguu

SEQ ID NO: 1159053 - RNA, 11 nt, Human
auaaaaaguua

SEQ ID NO: 1159054 - RNA, 12 nt, Human
auaaaaaguuaa

SEQ ID NO: 1159055 - RNA, 13 nt, Human
auaaaaaguuaaa

SEQ ID NO: 1159056 - RNA, 18 nt, Human
auaaaaaguuaaaaaguu

SEQ ID NO: 1159057 - RNA, 15 nt, Human
auaaaacuuuuuaaa

SEQ ID NO: 1159058 - RNA, 18 nt, Human
auaaaggauuaaugucaa

SEQ ID NO: 1159059 - RNA, 12 nt, Human
auaacauguaau

SEQ ID NO: 1159060 - RNA, 18 nt, Human
auaccugucccccugaca

SEQ ID NO: 1159061 - RNA, 11 nt, Human
auacccacccc

SEQ ID NO: 1159062 - RNA, 12 nt, Human
auacccaccccc

SEQ ID NO: 1159063 - RNA, 13 nt, Human
auacccaccccca

SEQ ID NO: 1159064 - RNA, 21 nt, Human
auaaugcgugcauaccacuuu

SEQ ID NO: 1159065 - RNA, 15 nt, Human
auaauguaagcucua

SEQ ID NO: 1159066 - RNA, 22 nt, Human
auacacacacacacacagccac

SEQ ID NO: 1159067 - RNA, 23 nt, Human
auacacacacacacacagccaca

SEQ ID NO: 1159068 - RNA, 19 nt, Human
auacaccacuacauucugu

SEQ ID NO: 1159069 - RNA, 20 nt, Human
auacaccacuacauucuguu

SEQ ID NO: 1159070 - RNA, 21 nt, Human
auacaccacuacauucuguua

SEQ ID NO: 1159071 - RNA, 15 nt, Human
auagguuuaauaauu

SEQ ID NO: 1159072 - RNA, 17 nt, Human
auaguaugguggcuggg

SEQ ID NO: 1159073 - RNA, 18 nt, Human
auaguaugguggcugggu

SEQ ID NO: 1159074 - RNA, 15 nt, Human
auagccaaggccaaa

SEQ ID NO: 1159075 - RNA, 21 nt, Human
auagccaaggccaaaggaagc

SEQ ID NO: 1159076 - RNA, 14 nt, Human
auagucaaauugug

SEQ ID NO: 1159077 - RNA, 17 nt, Human
auagucaaauuguguga

SEQ ID NO: 1159078 - RNA, 10 nt, Human
auauacugua

SEQ ID NO: 1159079 - RNA, 11 nt, Human
auauacuguaa

SEQ ID NO: 1159080 - RNA, 12 nt, Human
auauacuguaaa

SEQ ID NO: 1159081 - RNA, 13 nt, Human
auauacuguaaag

SEQ ID NO: 1159082 - RNA, 14 nt, Human
auauacuguaaaga

SEQ ID NO: 1159083 - RNA, 15 nt, Human
auauacuguaaagaa

SEQ ID NO: 1159084 - RNA, 18 nt, Human
auauacuguaaagaaaga

SEQ ID NO: 1159085 - RNA, 19 nt, Human
auauacuguaaagaaagag

SEQ ID NO: 1159086 - RNA, 20 nt, Human
auauacuguaaagaaagaga

SEQ ID NO: 1159087 - RNA, 21 nt, Human
auauacuguaaagaaagagag

SEQ ID NO: 1159088 - RNA, 22 nt, Human
auauacuguaaagaaagagaga

SEQ ID NO: 1159089 - RNA, 23 nt, Human
auauacuguaaagaaagagagaa

SEQ ID NO: 1159090 - RNA, 24 nt, Human
auauacuguaaagaaagagagaaa

SEQ ID NO: 1159091 - RNA, 15 nt, Human
auaucaauuuaaaaa

SEQ ID NO: 1159092 - RNA, 16 nt, Human
auaugcucugcauguu

SEQ ID NO: 1159093 - RNA, 20 nt, Human
auaugcuucuguuuuauaau

SEQ ID NO: 1159094 - RNA, 22 nt, Human
auaugcuucuguuuuauaauuu

SEQ ID NO: 1159095 - RNA, 23 nt, Human
auaugcuucuguuuuauaauuuu

SEQ ID NO: 1159096 - RNA, 22 nt, Human
auauuaccacagacauacuaac

SEQ ID NO: 1159097 - RNA, 19 nt, Human
auauuuacuucuuauacau

SEQ ID NO: 1159098 - RNA, 13 nt, Human
auauuuauuuuaa

SEQ ID NO: 1159099 - RNA, 19 nt, Human
gucccaccuuggcugcagg

SEQ ID NO: 1159100 - RNA, 20 nt, Human
gucccaccuuggcugcaggg

SEQ ID NO: 1159101 - RNA, 18 nt, Human
gucccaccuuggcugcag

SEQ ID NO: 1159102 - RNA, 22 nt, Human
guagcucuaggagggcuggcaa

SEQ ID NO: 1159103 - RNA, 13 nt, Human
gucccccugacaa

SEQ ID NO: 1159104 - RNA, 18 nt, Human
gucccccugacaacacuc

SEQ ID NO: 1159105 - RNA, 15 nt, Human
guccccgcacugggc

SEQ ID NO: 1159106 - RNA, 16 nt, Human
guccccgcacugggcu

SEQ ID NO: 1159107 - RNA, 23 nt, Human
guccccuguuuguuucugaaagg

SEQ ID NO: 1159108 - RNA, 13 nt, Human
gucccuuuuccuu

SEQ ID NO: 1159109 - RNA, 21 nt, Human
guccgaaagggacuuggaagc

SEQ ID NO: 1159110 - RNA, 22 nt, Human
guccgaaagggacuuggaagcu

SEQ ID NO: 1159111 - RNA, 13 nt, Human
guccgagcuuuga

SEQ ID NO: 1159112 - RNA, 19 nt, Human
aacagguuuuccugaagaa

SEQ ID NO: 1159113 - RNA, 13 nt, Human
guccuacccaccc

SEQ ID NO: 1159114 - RNA, 15 nt, Human
guccuacccacccuc

SEQ ID NO: 1159115 - RNA, 16 nt, Human
aacagauaaauaguuu

SEQ ID NO: 1159116 - RNA, 15 nt, Human
aacagugauuaccag

SEQ ID NO: 1159117 - RNA, 18 nt, Human
aacauacucccaucugug

SEQ ID NO: 1159118 - RNA, 20 nt, Human
aacauacucccaucugugaa

SEQ ID NO: 1159119 - RNA, 14 nt, Human
aacaucaacaucuu

SEQ ID NO: 1159120 - RNA, 22 nt, Human
aacauguuuuucuucucccuca

SEQ ID NO: 1159121 - RNA, 16 nt, Human
gucgaggacagggagg

SEQ ID NO: 1159122 - RNA, 13 nt, Human
gucgcccagucug

SEQ ID NO: 1159123 - RNA, 14 nt, Human
gucgcccagucugg

SEQ ID NO: 1159124 - RNA, 14 nt, Human
gucgaggacaggga

SEQ ID NO: 1159125 - RNA, 23 nt, Human
gucgcccagucuggaaugcagug

SEQ ID NO: 1159126 - RNA, 13 nt, Human
guccugcugcagu

SEQ ID NO: 1159127 - RNA, 16 nt, Human
guccugcugcaguugc

SEQ ID NO: 1159128 - RNA, 17 nt, Human
guccugcugcaguugcc

SEQ ID NO: 1159129 - RNA, 14 nt, Human
gucuaugggacuca

SEQ ID NO: 1159130 - RNA, 15 nt, Human
gucuaugggacucaa

SEQ ID NO: 1159131 - RNA, 22 nt, Human
gucucaaacucuugaccucagg

SEQ ID NO: 1159132 - RNA, 23 nt, Human
gucucaguccaugaagauguaga

SEQ ID NO: 1159133 - RNA, 13 nt, Human
aaccacaucuugc

SEQ ID NO: 1159134 - RNA, 18 nt, Human
aaccacaucuugcucugc

SEQ ID NO: 1159135 - RNA, 13 nt, Human
gucuccauguuug

SEQ ID NO: 1159136 - RNA, 16 nt, Human
aacauuuugucauaua

SEQ ID NO: 1159137 - RNA, 19 nt, Human
gucugaaggcuggguucug

SEQ ID NO: 1159138 - RNA, 22 nt, Human
gucucuuuaaugucacaggcag

SEQ ID NO: 1159139 - RNA, 23 nt, Human
gucucuuuaaugucacaggcagg

SEQ ID NO: 1159140 - RNA, 18 nt, Human
gucucuuuaaugucacag

SEQ ID NO: 1159141 - RNA, 19 nt, Human
gucucuuuaaugucacagg

SEQ ID NO: 1159142 - RNA, 20 nt, Human
gucucuuuaaugucacaggc

SEQ ID NO: 1159143 - RNA, 17 nt, Human
gucucuugguccugcug

SEQ ID NO: 1159144 - RNA, 18 nt, Human
gucucuugguccugcugc

SEQ ID NO: 1159145 - RNA, 19 nt, Human
gucucuugguccugcugca

SEQ ID NO: 1159146 - RNA, 20 nt, Human
gucucuugguccugcugcag

SEQ ID NO: 1159147 - RNA, 21 nt, Human
gucugacaggcaaugcuggcu

SEQ ID NO: 1159148 - RNA, 22 nt, Human
gucugacaggcaaugcuggcug

SEQ ID NO: 1159149 - RNA, 23 nt, Human
gucugacaggcaaugcuggcugu

SEQ ID NO: 1159150 - RNA, 13 nt, Human
gucugacccacug

SEQ ID NO: 1159151 - RNA, 18 nt, Human
aaccugauugugucucuu

SEQ ID NO: 1159152 - RNA, 19 nt, Human
aaccugauugugucucuug

SEQ ID NO: 1159153 - RNA, 16 nt, Human
gucuucaguaagccgu

SEQ ID NO: 1159154 - RNA, 15 nt, Human
gucuuuguacagaca

SEQ ID NO: 1159155 - RNA, 16 nt, Human
gucuuuguacagacaa

SEQ ID NO: 1159156 - RNA, 23 nt, Human
aacguggcugcuucaaggauccu

SEQ ID NO: 1159157 - RNA, 20 nt, Human
aacuaucucauuuccaagca

SEQ ID NO: 1159158 - RNA, 23 nt, Human
aacuaucucauuuccaagcaagu

SEQ ID NO: 1159159 - RNA, 23 nt, Human
gugaagacaaugacuuacuguac

SEQ ID NO: 1159160 - RNA, 14 nt, Human
gugaagugaagaca

SEQ ID NO: 1159161 - RNA, 16 nt, Human
gugacagaggcagccc

SEQ ID NO: 1159162 - RNA, 18 nt, Human
gugacagaggcagcccca

SEQ ID NO: 1159163 - RNA, 19 nt, Human
gugacagaggcagccccau

SEQ ID NO: 1159164 - RNA, 23 nt, Human
gugacagaggcagccccauucug

SEQ ID NO: 1159165 - RNA, 14 nt, Human
gugacaugucuuuu

SEQ ID NO: 1159166 - RNA, 17 nt, Human
gugaccaaugaugguca

SEQ ID NO: 1159167 - RNA, 18 nt, Human
gugaccagcaccaucucu

SEQ ID NO: 1159168 - RNA, 21 nt, Human
gugaccagcaccaucucuccu

SEQ ID NO: 1159169 - RNA, 18 nt, Human
gugaccauguuuuguuua

SEQ ID NO: 1159170 - RNA, 17 nt, Human
gugaguacuacaguccu

SEQ ID NO: 1159171 - RNA, 21 nt, Human
gugagcacuaaggugugcucu

SEQ ID NO: 1159172 - RNA, 13 nt, Human
gugagagcugggu

SEQ ID NO: 1159173 - RNA, 16 nt, Human
gugagaggggaacaga

SEQ ID NO: 1159174 - RNA, 12 nt, Human
gugaccccaggu

SEQ ID NO: 1159175 - RNA, 12 nt, Human
gugagagcuggg

SEQ ID NO: 1159176 - RNA, 20 nt, Human
aacugaaaucauacuucuua

SEQ ID NO: 1159177 - RNA, 19 nt, Human
gugaguacuacaguccucc

SEQ ID NO: 1159178 - RNA, 21 nt, Human
gugaguacuacaguccuccca

SEQ ID NO: 1159179 - RNA, 17 nt, Human
gugaguccuggcauggg

SEQ ID NO: 1159180 - RNA, 20 nt, Human
gugaguccuggcaugggaau

SEQ ID NO: 1159181 - RNA, 15 nt, Human
gugagucgaggacag

SEQ ID NO: 1159182 - RNA, 15 nt, Human
gugccucugggacug

SEQ ID NO: 1159183 - RNA, 23 nt, Human
aacuugguucccauuugcuccuu

SEQ ID NO: 1159184 - RNA, 17 nt, Human
aacuuggcgcugccccu

SEQ ID NO: 1159185 - RNA, 14 nt, Human
aacuuggcgcugcc

SEQ ID NO: 1159186 - RNA, 12 nt, Human
gugcacacacca

SEQ ID NO: 1159187 - RNA, 14 nt, Human
gugcacacaccaga

SEQ ID NO: 1159188 - RNA, 17 nt, Human
gugcacacaccagagcc

SEQ ID NO: 1159189 - RNA, 18 nt, Human
gugcacguacacacacau

SEQ ID NO: 1159190 - RNA, 21 nt, Human
gugcauuugaggucuguucuu

SEQ ID NO: 1159191 - RNA, 22 nt, Human
gugcauuugaggucuguucuuu

SEQ ID NO: 1159192 - RNA, 15 nt, Human
gugcauuuggugguu

SEQ ID NO: 1159193 - RNA, 14 nt, Human
gugccaagcagagg

SEQ ID NO: 1159194 - RNA, 20 nt, Human
aagaaaaaggaugcacagag

SEQ ID NO: 1159195 - RNA, 22 nt, Human
aagaaaaaggaugcacagaguu

SEQ ID NO: 1159196 - RNA, 13 nt, Human
aagaaaauaucac

SEQ ID NO: 1159197 - RNA, 16 nt, Human
aagaagcccaggaaag

SEQ ID NO: 1159198 - RNA, 17 nt, Human
aagaagcccaggaaagg

SEQ ID NO: 1159199 - RNA, 14 nt, Human
aagaagcucucucc

SEQ ID NO: 1159200 - RNA, 15 nt, Human
aagaagcucucuccu

SEQ ID NO: 1159201 - RNA, 19 nt, Human
gugcugcccugcccaccug

SEQ ID NO: 1159202 - RNA, 20 nt, Human
gugcugcccugcccaccugg

SEQ ID NO: 1159203 - RNA, 21 nt, Human
gugcugcccugcccaccuggc

SEQ ID NO: 1159204 - RNA, 14 nt, Human
guggacacagcucu

SEQ ID NO: 1159205 - RNA, 15 nt, Human
guggacacagcucuu

SEQ ID NO: 1159206 - RNA, 17 nt, Human
guggacacagcucuucu

SEQ ID NO: 1159207 - RNA, 24 nt, Human
guggacacagcucuucuccaggcu

SEQ ID NO: 1159208 - RNA, 13 nt, Human
aagacccaaaagg

SEQ ID NO: 1159209 - RNA, 17 nt, Human
guggcagcugcggucca

SEQ ID NO: 1159210 - RNA, 19 nt, Human
guggcagcugcgguccacc

SEQ ID NO: 1159211 - RNA, 21 nt, Human
guggauuuaacagaaauguac

SEQ ID NO: 1159212 - RNA, 23 nt, Human
guggauuuaacagaaauguacag

SEQ ID NO: 1159213 - RNA, 13 nt, Human
guggcaccagcag

SEQ ID NO: 1159214 - RNA, 14 nt, Human
guggcaccagcagc

SEQ ID NO: 1159215 - RNA, 18 nt, Human
guggcaccagcagccugg

SEQ ID NO: 1159216 - RNA, 22 nt, Human
guggcagcucaccucucccuug

SEQ ID NO: 1159217 - RNA, 14 nt, Human
guggcagcugcggu

SEQ ID NO: 1159218 - RNA, 21 nt, Human
aagacgcugugcugcccugcc

SEQ ID NO: 1159219 - RNA, 22 nt, Human
aagacgcugugcugcccugccc

SEQ ID NO: 1159220 - RNA, 23 nt, Human
aagacgcugugcugcccugccca

SEQ ID NO: 1159221 - RNA, 17 nt, Human
aagacucauucuucugu

SEQ ID NO: 1159222 - RNA, 16 nt, Human
aagacuguacaaagua

SEQ ID NO: 1159223 - RNA, 16 nt, Human
aagagauugugguuuc

SEQ ID NO: 1159224 - RNA, 19 nt, Human
aagagauugugguuucauu

SEQ ID NO: 1159225 - RNA, 12 nt, Human
aagagcccaggc

SEQ ID NO: 1159226 - RNA, 14 nt, Human
aagagcccaggccu

SEQ ID NO: 1159227 - RNA, 16 nt, Human
aagagcccaggccucc

SEQ ID NO: 1159228 - RNA, 13 nt, Human
guggccucccaac

SEQ ID NO: 1159229 - RNA, 14 nt, Human
guggccucccaacu

SEQ ID NO: 1159230 - RNA, 15 nt, Human
guggccucccaacuc

SEQ ID NO: 1159231 - RNA, 12 nt, Human
gugggagcugag

SEQ ID NO: 1159232 - RNA, 15 nt, Human
gugggauccuccagg

SEQ ID NO: 1159233 - RNA, 18 nt, Human
gugggauccuccaggugc

SEQ ID NO: 1159234 - RNA, 14 nt, Human
gugggagcugccug

SEQ ID NO: 1159235 - RNA, 15 nt, Human
gugguguuuccuggc

SEQ ID NO: 1159236 - RNA, 16 nt, Human
gugguguuuccuggca

SEQ ID NO: 1159237 - RNA, 19 nt, Human
aagcaaaauuuuuucucua

SEQ ID NO: 1159238 - RNA, 22 nt, Human
aagauguagaggagaaacugga

SEQ ID NO: 1159239 - RNA, 17 nt, Human
aagauauuuugcuuugu

SEQ ID NO: 1159240 - RNA, 20 nt, Human
aagauauuuugcuuugugau

SEQ ID NO: 1159241 - RNA, 22 nt, Human
aagauauuuugcuuugugauuu

SEQ ID NO: 1159242 - RNA, 20 nt, Human
aagaguaggaagacuuugga

SEQ ID NO: 1159243 - RNA, 19 nt, Human
gugguguuuccuggcacug

SEQ ID NO: 1159244 - RNA, 18 nt, Human
gugguuauggagagggug

SEQ ID NO: 1159245 - RNA, 16 nt, Human
aagaguaggaagacuu

SEQ ID NO: 1159246 - RNA, 18 nt, Human
aagaguaggaagacuuug

SEQ ID NO: 1159247 - RNA, 19 nt, Human
aagaguaggaagacuuugg

SEQ ID NO: 1159248 - RNA, 19 nt, Human
gugugguguuuccuggcac

SEQ ID NO: 1159249 - RNA, 16 nt, Human
aagcaaguauuagaau

SEQ ID NO: 1159250 - RNA, 20 nt, Human
gugucccaaaaagaaaggag

SEQ ID NO: 1159251 - RNA, 21 nt, Human
gugucuugcaauggcagccuu

SEQ ID NO: 1159252 - RNA, 18 nt, Human
gugucuuuaaaugcugcu

SEQ ID NO: 1159253 - RNA, 19 nt, Human
gugucuuuaaaugcugcuu

SEQ ID NO: 1159254 - RNA, 13 nt, Human
gugugagucacca

SEQ ID NO: 1159255 - RNA, 18 nt, Human
gugugagucaccaagccc

SEQ ID NO: 1159256 - RNA, 20 nt, Human
gugugagucaccaagcccag

SEQ ID NO: 1159257 - RNA, 15 nt, Human
gugugguguuuccug

SEQ ID NO: 1159258 - RNA, 13 nt, Human
guguuuauuguca

SEQ ID NO: 1159259 - RNA, 11 nt, Human
aagcucccagg

SEQ ID NO: 1159260 - RNA, 12 nt, Human
aagcucccaggc

SEQ ID NO: 1159261 - RNA, 22 nt, Human
aagcucccaggcauuccccagg

SEQ ID NO: 1159262 - RNA, 23 nt, Human
aagcucccaggcauuccccagga

SEQ ID NO: 1159263 - RNA, 19 nt, Human
aaggaaaaaauaacaauga

SEQ ID NO: 1159264 - RNA, 16 nt, Human
aaggaaaaaauaacaa

SEQ ID NO: 1159265 - RNA, 13 nt, Human
aagcucugcuccu

SEQ ID NO: 1159266 - RNA, 18 nt, Human
aagcuguuacugucuuca

SEQ ID NO: 1159267 - RNA, 17 nt, Human
aagcucugcuccucucc

SEQ ID NO: 1159268 - RNA, 16 nt, Human
guucucugaggacacu

SEQ ID NO: 1159269 - RNA, 11 nt, Human
guucucugccc

SEQ ID NO: 1159270 - RNA, 12 nt, Human
guucucugcccu

SEQ ID NO: 1159271 - RNA, 13 nt, Human
guucucugcccuc

SEQ ID NO: 1159272 - RNA, 13 nt, Human
guugacaugggac

SEQ ID NO: 1159273 - RNA, 23 nt, Human
guugauagcacagacccugcccu

SEQ ID NO: 1159274 - RNA, 15 nt, Human
guugcccaggcuggc

SEQ ID NO: 1159275 - RNA, 16 nt, Human
guugcccaggcuggcg

SEQ ID NO: 1159276 - RNA, 17 nt, Human
guugcccaggcuggcgu

SEQ ID NO: 1159277 - RNA, 17 nt, Human
guugggcuggugucacc

SEQ ID NO: 1159278 - RNA, 13 nt, Human
guuggguggaugc

SEQ ID NO: 1159279 - RNA, 24 nt, Human
aaggaugcacagaguuguuacauu

SEQ ID NO: 1159280 - RNA, 14 nt, Human
aaggaugcccaaag

SEQ ID NO: 1159281 - RNA, 19 nt, Human
aaggaugcccaaagaugca

SEQ ID NO: 1159282 - RNA, 14 nt, Human
aaggccccgcccag

SEQ ID NO: 1159283 - RNA, 16 nt, Human
aaggccccgcccaggc

SEQ ID NO: 1159284 - RNA, 19 nt, Human
aaggccccgcccaggcuua

SEQ ID NO: 1159285 - RNA, 13 nt, Human
aaggcuaccuuug

SEQ ID NO: 1159286 - RNA, 15 nt, Human
aaggcuaccuuugua

SEQ ID NO: 1159287 - RNA, 13 nt, Human
aaggauaaugaau

SEQ ID NO: 1159288 - RNA, 20 nt, Human
aaggaggaagagaaaaaaua

SEQ ID NO: 1159289 - RNA, 11 nt, Human
aaggauccuga

SEQ ID NO: 1159290 - RNA, 12 nt, Human
aaggauccugag

SEQ ID NO: 1159291 - RNA, 13 nt, Human
aaggauccugagc

SEQ ID NO: 1159292 - RNA, 22 nt, Human
aaggauccugagccagauuuca

SEQ ID NO: 1159293 - RNA, 15 nt, Human
aaggaaacccagcuc

SEQ ID NO: 1159294 - RNA, 16 nt, Human
aaggaaacccagcucu

SEQ ID NO: 1159295 - RNA, 18 nt, Human
aaggagauuuacaacugg

SEQ ID NO: 1159296 - RNA, 15 nt, Human
aagggcccagagagg

SEQ ID NO: 1159297 - RNA, 14 nt, Human
aaggcugggggaag

SEQ ID NO: 1159298 - RNA, 13 nt, Human
aagggccuggccu

SEQ ID NO: 1159299 - RNA, 14 nt, Human
aaggggcaguggug

SEQ ID NO: 1159300 - RNA, 17 nt, Human
aaggggcaguggugguu

SEQ ID NO: 1159301 - RNA, 19 nt, Human
aaggguaucaggugcugcc

SEQ ID NO: 1159302 - RNA, 16 nt, Human
aaggguaucuggugac

SEQ ID NO: 1159303 - RNA, 22 nt, Human
guuucuaugacacaugcaaggu

SEQ ID NO: 1159304 - RNA, 22 nt, Human
guuucugccgcagcccugcaga

SEQ ID NO: 1159305 - RNA, 17 nt, Human
guuugccucugccucug

SEQ ID NO: 1159306 - RNA, 13 nt, Human
guuugcuaaguga

SEQ ID NO: 1159307 - RNA, 14 nt, Human
guuuuaagaggcag

SEQ ID NO: 1159308 - RNA, 16 nt, Human
guuuuaagaggcaggg

SEQ ID NO: 1159309 - RNA, 18 nt, Human
guuuuaaggaugcuugua

SEQ ID NO: 1159310 - RNA, 16 nt, Human
guuuuacugcagcuuu

SEQ ID NO: 1159311 - RNA, 18 nt, Human
guuuuacugcagcuuugu

SEQ ID NO: 1159312 - RNA, 15 nt, Human
guuuuauaauuuugu

SEQ ID NO: 1159313 - RNA, 22 nt, Human
guuuuauaauuuugugaagcaa

SEQ ID NO: 1159314 - RNA, 24 nt, Human
aagucacacaguauuacuucugcu

SEQ ID NO: 1159315 - RNA, 21 nt, Human
aagucaagugaaaaaggagga

SEQ ID NO: 1159316 - RNA, 18 nt, Human
aaguauucuuauuuaaug

SEQ ID NO: 1159317 - RNA, 19 nt, Human
aaguauucuuauuuaauga

SEQ ID NO: 1159318 - RNA, 13 nt, Human
aagucacacagug

SEQ ID NO: 1159319 - RNA, 16 nt, Human
aaguacuauguaucaa

SEQ ID NO: 1159320 - RNA, 15 nt, Human
aaguacuggagaaaa

SEQ ID NO: 1159321 - RNA, 21 nt, Human
aaguacuucuccacccugcuc

SEQ ID NO: 1159322 - RNA, 22 nt, Human
aaguacuucuccacccugcucu

SEQ ID NO: 1159323 - RNA, 23 nt, Human
aaguacuucuccacccugcucuc

SEQ ID NO: 1159324 - RNA, 23 nt, Human
aaguauguuagugcaaauuguca

SEQ ID NO: 1159325 - RNA, 22 nt, Human
aagucuuauauauuguagauaa

SEQ ID NO: 1159326 - RNA, 18 nt, Human
aagucuuagauguauaua

SEQ ID NO: 1159327 - RNA, 19 nt, Human
aagucuuagauguauauau

SEQ ID NO: 1159328 - RNA, 18 nt, Human
guuuuucuaggccugggg

SEQ ID NO: 1159329 - RNA, 16 nt, Human
guuuuugucuuaaaaa

SEQ ID NO: 1159330 - RNA, 23 nt, Human
guuuuuuuuuaaaaaagaaacau

SEQ ID NO: 1159331 - RNA, 12 nt, Human
aaguuaaauaaa

SEQ ID NO: 1159332 - RNA, 14 nt, Human
aaguuaaauaaauc

SEQ ID NO: 1159333 - RNA, 17 nt, Human
aaguucaugcuuuguuc

SEQ ID NO: 1159334 - RNA, 17 nt, Human
aaguucugcagauaaac

SEQ ID NO: 1159335 - RNA, 15 nt, Human
uaaagaaagagagaa

SEQ ID NO: 1159336 - RNA, 16 nt, Human
uaaagaaagagagaaa

SEQ ID NO: 1159337 - RNA, 17 nt, Human
uaaagaaagagagaaaa

SEQ ID NO: 1159338 - RNA, 18 nt, Human
uaaagaaagagagaaaau

SEQ ID NO: 1159339 - RNA, 19 nt, Human
uaaagaaagagagaaaaua

SEQ ID NO: 1159340 - RNA, 20 nt, Human
uaaagaaagagagaaaauaa

SEQ ID NO: 1159341 - RNA, 21 nt, Human
uaaagaaagagagaaaauaaa

SEQ ID NO: 1159342 - RNA, 22 nt, Human
uaaagaaagagagaaaauaaaa

SEQ ID NO: 1159343 - RNA, 23 nt, Human
uaaagaaagagagaaaauaaaaa

SEQ ID NO: 1159344 - RNA, 16 nt, Human
uaaaccgccaaggcug

SEQ ID NO: 1159345 - RNA, 18 nt, Human
uaaaccgccaaggcuggg

SEQ ID NO: 1159346 - RNA, 14 nt, Human
uaaagaguguggca

SEQ ID NO: 1159347 - RNA, 21 nt, Human
uaaaggcuaccuuuguauucu

SEQ ID NO: 1159348 - RNA, 22 nt, Human
aauaaaauccauacauuugugu

SEQ ID NO: 1159349 - RNA, 14 nt, Human
aauaaaguaauuau

SEQ ID NO: 1159350 - RNA, 12 nt, Human
aauaaaaauaau

SEQ ID NO: 1159351 - RNA, 13 nt, Human
uaaagucaggggu

SEQ ID NO: 1159352 - RNA, 14 nt, Human
uaaaguguauuuuu

SEQ ID NO: 1159353 - RNA, 15 nt, Human
uaaaguguauuuuuu

SEQ ID NO: 1159354 - RNA, 19 nt, Human
uaaaguguauuuuuuuacu

SEQ ID NO: 1159355 - RNA, 20 nt, Human
uaaaguguauuuuuuuacua

SEQ ID NO: 1159356 - RNA, 15 nt, Human
aauaacaauaaaaga

SEQ ID NO: 1159357 - RNA, 12 nt, Human
aauaacauguaa

SEQ ID NO: 1159358 - RNA, 19 nt, Human
aauaacauguaauuaagua

SEQ ID NO: 1159359 - RNA, 22 nt, Human
aauaacauguaauuaaguacua

SEQ ID NO: 1159360 - RNA, 12 nt, Human
aauaaauuauuu

SEQ ID NO: 1159361 - RNA, 15 nt, Human
aauaacuaaaaggua

SEQ ID NO: 1159362 - RNA, 19 nt, Human
uaaaucuccaaaauaaaac

SEQ ID NO: 1159363 - RNA, 15 nt, Human
aauacaccacuacau

SEQ ID NO: 1159364 - RNA, 16 nt, Human
aauacaccacuacauu

SEQ ID NO: 1159365 - RNA, 18 nt, Human
aauacaccacuacauucu

SEQ ID NO: 1159366 - RNA, 20 nt, Human
aauacaccacuacauucugu

SEQ ID NO: 1159367 - RNA, 21 nt, Human
aauacaccacuacauucuguu

SEQ ID NO: 1159368 - RNA, 13 nt, Human
uaacaagccaccc

SEQ ID NO: 1159369 - RNA, 15 nt, Human
uaacaaugcuguauu

SEQ ID NO: 1159370 - RNA, 17 nt, Human
uaacaaugcuguauuuu

SEQ ID NO: 1159371 - RNA, 20 nt, Human
uaaaucuccaaaauaaaacu

SEQ ID NO: 1159372 - RNA, 21 nt, Human
uaaaucuccaaaauaaaacuu

SEQ ID NO: 1159373 - RNA, 22 nt, Human
uaaaucuccaaaauaaaacuuu

SEQ ID NO: 1159374 - RNA, 17 nt, Human
uaaaugauuucauucaa

SEQ ID NO: 1159375 - RNA, 19 nt, Human
uaacaaugcuguauuuuaa

SEQ ID NO: 1159376 - RNA, 20 nt, Human
aauacaguaucucagggccu

SEQ ID NO: 1159377 - RNA, 23 nt, Human
aauacaucccuuaccugggaaag

SEQ ID NO: 1159378 - RNA, 22 nt, Human
uaauacaccacuacauucuguu

SEQ ID NO: 1159379 - RNA, 23 nt, Human
uaauacaccacuacauucuguua

SEQ ID NO: 1159380 - RNA, 14 nt, Human
uaauagacaauuua

SEQ ID NO: 1159381 - RNA, 21 nt, Human
uaauauugauaugcuuauaca

SEQ ID NO: 1159382 - RNA, 13 nt, Human
uaaucuuucacag

SEQ ID NO: 1159383 - RNA, 14 nt, Human
aaugaaugaaacau

SEQ ID NO: 1159384 - RNA, 15 nt, Human
aaugaaugaaugaau

SEQ ID NO: 1159385 - RNA, 15 nt, Human
aaugaaugucagugu

SEQ ID NO: 1159386 - RNA, 16 nt, Human
uaauguaagcucuacu

SEQ ID NO: 1159387 - RNA, 17 nt, Human
uaauguaagcucuacug

SEQ ID NO: 1159388 - RNA, 15 nt, Human
uaaugucacaggcag

SEQ ID NO: 1159389 - RNA, 16 nt, Human
uaaugucacaggcagg

SEQ ID NO: 1159390 - RNA, 17 nt, Human
uaaugucacaggcaggu

SEQ ID NO: 1159391 - RNA, 12 nt, Human
uaaugugaaacu

SEQ ID NO: 1159392 - RNA, 20 nt, Human
uaaugugaaacuggauuaaa

SEQ ID NO: 1159393 - RNA, 22 nt, Human
uaaugugaaacuggauuaaacu

SEQ ID NO: 1159394 - RNA, 23 nt, Human
uaaugugaaacuggauuaaacuu

SEQ ID NO: 1159395 - RNA, 23 nt, Human
uaauuaguuccucauuagcauuu

SEQ ID NO: 1159396 - RNA, 19 nt, Human
aaugcacuuuguucuggcu

SEQ ID NO: 1159397 - RNA, 20 nt, Human
aaugcacuuuguucuggcuc

SEQ ID NO: 1159398 - RNA, 19 nt, Human
aaugcacaaacagaggccg

SEQ ID NO: 1159399 - RNA, 20 nt, Human
aaugcacaaacagaggccgc

SEQ ID NO: 1159400 - RNA, 13 nt, Human
aaugcacuuuguu

SEQ ID NO: 1159401 - RNA, 16 nt, Human
aaugcacuuuguucug

SEQ ID NO: 1159402 - RNA, 20 nt, Human
aaugaaugucagugugacug

SEQ ID NO: 1159403 - RNA, 21 nt, Human
aaugaaugucagugugacuga

SEQ ID NO: 1159404 - RNA, 13 nt, Human
aaugaccuuucaa

SEQ ID NO: 1159405 - RNA, 14 nt, Human
aaugaccuuucaau

SEQ ID NO: 1159406 - RNA, 15 nt, Human
aaugaccuuucaaua

SEQ ID NO: 1159407 - RNA, 16 nt, Human
aaugcaaaccaucauu

SEQ ID NO: 1159408 - RNA, 22 nt, Human
aaugcaaaccaucauugaaauc

SEQ ID NO: 1159409 - RNA, 23 nt, Human
aaugcaaaccaucauugaaaucu

SEQ ID NO: 1159410 - RNA, 18 nt, Human
aaugcacaaacagaggcc

SEQ ID NO: 1159411 - RNA, 21 nt, Human
uacaagcgugagccacugcac

SEQ ID NO: 1159412 - RNA, 16 nt, Human
uacaagcgugagccac

SEQ ID NO: 1159413 - RNA, 18 nt, Human
uacaagcgugagccacug

SEQ ID NO: 1159414 - RNA, 19 nt, Human
uacaagcgugagccacugc

SEQ ID NO: 1159415 - RNA, 20 nt, Human
uacaagcgugagccacugca

SEQ ID NO: 1159416 - RNA, 15 nt, Human
uacaaaaagcauaaa

SEQ ID NO: 1159417 - RNA, 17 nt, Human
uaauuuaccugaagucu

SEQ ID NO: 1159418 - RNA, 18 nt, Human
uaauuuaccugaagucuu

SEQ ID NO: 1159419 - RNA, 13 nt, Human
aauuaaguacuau

SEQ ID NO: 1159420 - RNA, 15 nt, Human
aaugucacaggcagg

SEQ ID NO: 1159421 - RNA, 18 nt, Human
aauguugacaugggacau

SEQ ID NO: 1159422 - RNA, 18 nt, Human
aauuaacuuuuauaaacu

SEQ ID NO: 1159423 - RNA, 20 nt, Human
aauuaacuuuuauaaacuuu

SEQ ID NO: 1159424 - RNA, 22 nt, Human
aauuaacuuuuauaaacuuuac

SEQ ID NO: 1159425 - RNA, 17 nt, Human
uaccacuuuuguucuug

SEQ ID NO: 1159426 - RNA, 17 nt, Human
uaccauccccuguagag

SEQ ID NO: 1159427 - RNA, 20 nt, Human
uacccgggaagggggcuggg

SEQ ID NO: 1159428 - RNA, 16 nt, Human
uacccucauguucuua

SEQ ID NO: 1159429 - RNA, 23 nt, Human
uacccgggaagggggcugggaca

SEQ ID NO: 1159430 - RNA, 20 nt, Human
uacccuggcacuauaaugua

SEQ ID NO: 1159431 - RNA, 22 nt, Human
uacccuggcacuauaauguaag

SEQ ID NO: 1159432 - RNA, 17 nt, Human
uacaguccucccaucuc

SEQ ID NO: 1159433 - RNA, 18 nt, Human
uacaguccucccaucuca

SEQ ID NO: 1159434 - RNA, 24 nt, Human
uacagcaaggagauuuacaacugg

SEQ ID NO: 1159435 - RNA, 18 nt, Human
uacaguaucucagggccu

SEQ ID NO: 1159436 - RNA, 12 nt, Human
uacaguccuccc

SEQ ID NO: 1159437 - RNA, 15 nt, Human
uacaguccucccauc

SEQ ID NO: 1159438 - RNA, 15 nt, Human
uacauaaugcgugca

SEQ ID NO: 1159439 - RNA, 13 nt, Human
aaugucacaggca

SEQ ID NO: 1159440 - RNA, 14 nt, Human
aaugucacaggcag

SEQ ID NO: 1159441 - RNA, 22 nt, Human
uacagcaaggagauuuacaacu

SEQ ID NO: 1159442 - RNA, 21 nt, Human
aauguacagcaaggagauuua

SEQ ID NO: 1159443 - RNA, 23 nt, Human
aauguacagcaaggagauuuaca

SEQ ID NO: 1159444 - RNA, 16 nt, Human
aaugguuuaaaugguc

SEQ ID NO: 1159445 - RNA, 17 nt, Human
aaugguuuucuugugug

SEQ ID NO: 1159446 - RNA, 18 nt, Human
aaugguuuucuugugugu

SEQ ID NO: 1159447 - RNA, 22 nt, Human
aaugguuuucuuguguguuuau

SEQ ID NO: 1159448 - RNA, 13 nt, Human
aauguaagcucua

SEQ ID NO: 1159449 - RNA, 15 nt, Human
aauguaagcucuacu

SEQ ID NO: 1159450 - RNA, 14 nt, Human
uacgucugacaggc

SEQ ID NO: 1159451 - RNA, 13 nt, Human
uacguugugcauu

SEQ ID NO: 1159452 - RNA, 14 nt, Human
uacguugugcauuu

SEQ ID NO: 1159453 - RNA, 16 nt, Human
uacuauaauuuaccug

SEQ ID NO: 1159454 - RNA, 16 nt, Human
uacuauguaucaauga

SEQ ID NO: 1159455 - RNA, 12 nt, Human
uacuguaaagaa

SEQ ID NO: 1159456 - RNA, 13 nt, Human
uacuguaaagaaa

SEQ ID NO: 1159457 - RNA, 16 nt, Human
uacuguaaagaaagag

SEQ ID NO: 1159458 - RNA, 17 nt, Human
uacuguaaagaaagaga

SEQ ID NO: 1159459 - RNA, 18 nt, Human
uacuguaaagaaagagag

SEQ ID NO: 1159460 - RNA, 19 nt, Human
uacuguaaagaaagagaga

SEQ ID NO: 1159461 - RNA, 20 nt, Human
uacuguaaagaaagagagaa

SEQ ID NO: 1159462 - RNA, 21 nt, Human
aauucuugccaaauauaaaua

SEQ ID NO: 1159463 - RNA, 14 nt, Human
aauucuugcaaagu

SEQ ID NO: 1159464 - RNA, 20 nt, Human
aauucuugcaaaguaucccu

SEQ ID NO: 1159465 - RNA, 22 nt, Human
aauucuucuccacuuucuagcc

SEQ ID NO: 1159466 - RNA, 16 nt, Human
aauugacccacaagaa

SEQ ID NO: 1159467 - RNA, 19 nt, Human
aauugacccacaagaaaug

SEQ ID NO: 1159468 - RNA, 21 nt, Human
aauugacccacaagaaaugaa

SEQ ID NO: 1159469 - RNA, 15 nt, Human
uacguacacauuuua

SEQ ID NO: 1159470 - RNA, 21 nt, Human
uacuguaaagaaagagagaaa

SEQ ID NO: 1159471 - RNA, 23 nt, Human
uacuguaaagaaagagagaaaau

SEQ ID NO: 1159472 - RNA, 13 nt, Human
uacuguaagaaaa

SEQ ID NO: 1159473 - RNA, 22 nt, Human
aauuguuuggggaugagaaagg

SEQ ID NO: 1159474 - RNA, 13 nt, Human
aauuuaaaagucu

SEQ ID NO: 1159475 - RNA, 19 nt, Human
aauuuacauacucugcuua

SEQ ID NO: 1159476 - RNA, 14 nt, Human
uacuucaaauccuu

SEQ ID NO: 1159477 - RNA, 19 nt, Human
uacuucaaauccuugaaga

SEQ ID NO: 1159478 - RNA, 15 nt, Human
aauuuaccugaaguc

SEQ ID NO: 1159479 - RNA, 17 nt, Human
aauuuagaaauauaauu

SEQ ID NO: 1159480 - RNA, 13 nt, Human
aauuucuaaaucu

SEQ ID NO: 1159481 - RNA, 21 nt, Human
aauuucuaaaucuccaaaaua

SEQ ID NO: 1159482 - RNA, 19 nt, Human
aauuuuuucucuaggaaau

SEQ ID NO: 1159483 - RNA, 22 nt, Human
aauuuuuucucuaggaaauauu

SEQ ID NO: 1159484 - RNA, 17 nt, Human
aauuuuuuugagacaga

SEQ ID NO: 1159485 - RNA, 12 nt, Human
uagacagucccu

SEQ ID NO: 1159486 - RNA, 14 nt, Human
uagacagucccugc

SEQ ID NO: 1159487 - RNA, 16 nt, Human
uagacagucccugcca

SEQ ID NO: 1159488 - RNA, 19 nt, Human
aauuuuuauauuugaaaua

SEQ ID NO: 1159489 - RNA, 17 nt, Human
aauuuuuauuaaauuau

SEQ ID NO: 1159490 - RNA, 18 nt, Human
aauuuuuauuaaauuaug

SEQ ID NO: 1159491 - RNA, 21 nt, Human
uacuucaaauccuugaagauu

SEQ ID NO: 1159492 - RNA, 16 nt, Human
uacuucaugcugucua

SEQ ID NO: 1159493 - RNA, 15 nt, Human
uagaacucccuuuca

SEQ ID NO: 1159494 - RNA, 16 nt, Human
uagaagucacacagua

SEQ ID NO: 1159495 - RNA, 16 nt, Human
uagaagucuuagaugu

SEQ ID NO: 1159496 - RNA, 17 nt, Human
uagaagucuuagaugua

SEQ ID NO: 1159497 - RNA, 18 nt, Human
uagaagucuuagauguau

SEQ ID NO: 1159498 - RNA, 19 nt, Human
uagaagucuuagauguaua

SEQ ID NO: 1159499 - RNA, 20 nt, Human
uagaagucuuagauguauau

SEQ ID NO: 1159500 - RNA, 16 nt, Human
uagacaauuuauuaug

SEQ ID NO: 1159501 - RNA, 18 nt, Human
uagacaauuuauuauggc

SEQ ID NO: 1159502 - RNA, 16 nt, Human
acaaaaagcauaaaaa

SEQ ID NO: 1159503 - RNA, 19 nt, Human
uagaggagaaacuggaacu

SEQ ID NO: 1159504 - RNA, 17 nt, Human
uagaugcaguucugaag

SEQ ID NO: 1159505 - RNA, 19 nt, Human
uagaugcaguucugaagaa

SEQ ID NO: 1159506 - RNA, 21 nt, Human
uagcaugucgucaaagcugaa

SEQ ID NO: 1159507 - RNA, 22 nt, Human
uagauuuuagacccuauugcug

SEQ ID NO: 1159508 - RNA, 20 nt, Human
uagaugcaguucugaagaag

SEQ ID NO: 1159509 - RNA, 17 nt, Human
uagcacagacccugccc

SEQ ID NO: 1159510 - RNA, 18 nt, Human
uagcacagacccugcccu

SEQ ID NO: 1159511 - RNA, 19 nt, Human
uagcacagacccugcccug

SEQ ID NO: 1159512 - RNA, 15 nt, Human
acaacaacaaaauga

SEQ ID NO: 1159513 - RNA, 12 nt, Human
acaacacucaca

SEQ ID NO: 1159514 - RNA, 21 nt, Human
acaacacucauugaccugagg

SEQ ID NO: 1159515 - RNA, 17 nt, Human
acaagagcccaggccuc

SEQ ID NO: 1159516 - RNA, 18 nt, Human
acaagagcccaggccucc

SEQ ID NO: 1159517 - RNA, 18 nt, Human
acaagcacuaaacaaaga

SEQ ID NO: 1159518 - RNA, 12 nt, Human
acaagccacccc

SEQ ID NO: 1159519 - RNA, 20 nt, Human
acaagcgugagccacugcac

SEQ ID NO: 1159520 - RNA, 21 nt, Human
acaagcgugagccacugcacc

SEQ ID NO: 1159521 - RNA, 21 nt, Human
uagucaggugccucaagagaa

SEQ ID NO: 1159522 - RNA, 22 nt, Human
acaagcucacagaccuuugaac

SEQ ID NO: 1159523 - RNA, 19 nt, Human
acaagcugcacccucaggc

SEQ ID NO: 1159524 - RNA, 21 nt, Human
acaagcugcacccucaggcag

SEQ ID NO: 1159525 - RNA, 22 nt, Human
acaagcugcacccucaggcagg

SEQ ID NO: 1159526 - RNA, 23 nt, Human
acaagcugcacccucaggcaggu

SEQ ID NO: 1159527 - RNA, 22 nt, Human
uagugagcagucaggaaagaga

SEQ ID NO: 1159528 - RNA, 20 nt, Human
uaguuccucauuagcauuuu

SEQ ID NO: 1159529 - RNA, 16 nt, Human
uaguuuuauaugcuuc

SEQ ID NO: 1159530 - RNA, 21 nt, Human
uauaaaauaauuuuuauauuu

SEQ ID NO: 1159531 - RNA, 22 nt, Human
uauaaaauaauuuuuauauuug

SEQ ID NO: 1159532 - RNA, 23 nt, Human
uauaaaauaauuuuuauauuuga

SEQ ID NO: 1159533 - RNA, 15 nt, Human
acacaugaaguccaa

SEQ ID NO: 1159534 - RNA, 19 nt, Human
acacaugcaaggucauuuu

SEQ ID NO: 1159535 - RNA, 20 nt, Human
acacaugcaaggucauuuuu

SEQ ID NO: 1159536 - RNA, 21 nt, Human
acacaugcaaggucauuuuuu

SEQ ID NO: 1159537 - RNA, 20 nt, Human
acacccagcccacuucugcc

SEQ ID NO: 1159538 - RNA, 21 nt, Human
acacccagcccacuucugcca

SEQ ID NO: 1159539 - RNA, 11 nt, Human
acacccuguga

SEQ ID NO: 1159540 - RNA, 12 nt, Human
acacccugugau

SEQ ID NO: 1159541 - RNA, 18 nt, Human
acacccugugauggggcc

SEQ ID NO: 1159542 - RNA, 19 nt, Human
acacccugugauggggccc

SEQ ID NO: 1159543 - RNA, 13 nt, Human
uauaggaauugac

SEQ ID NO: 1159544 - RNA, 14 nt, Human
uauaggaauugacc

SEQ ID NO: 1159545 - RNA, 19 nt, Human
uauaggaauugacccacaa

SEQ ID NO: 1159546 - RNA, 20 nt, Human
uauagccuaggugacagagu

SEQ ID NO: 1159547 - RNA, 21 nt, Human
acacucauugaccugaggccc

SEQ ID NO: 1159548 - RNA, 23 nt, Human
acacucauugaccugaggcccuu

SEQ ID NO: 1159549 - RNA, 20 nt, Human
uauaaccaguguuguggauu

SEQ ID NO: 1159550 - RNA, 14 nt, Human
uauaauuuugugaa

SEQ ID NO: 1159551 - RNA, 19 nt, Human
uauaauuuugugaagcaaa

SEQ ID NO: 1159552 - RNA, 21 nt, Human
uauacacuuacacuuuaugca

SEQ ID NO: 1159553 - RNA, 13 nt, Human
uauacauaaacaa

SEQ ID NO: 1159554 - RNA, 14 nt, Human
uauacauaaacaag

SEQ ID NO: 1159555 - RNA, 14 nt, Human
uauacauuugauaa

SEQ ID NO: 1159556 - RNA, 17 nt, Human
acagacccugcccugug

SEQ ID NO: 1159557 - RNA, 11 nt, Human
acacuccuuca

SEQ ID NO: 1159558 - RNA, 13 nt, Human
acacuccuucaca

SEQ ID NO: 1159559 - RNA, 23 nt, Human
acagacacaggcccggcuccagg

SEQ ID NO: 1159560 - RNA, 18 nt, Human
acagacccugcccugugg

SEQ ID NO: 1159561 - RNA, 20 nt, Human
acagacccugcccugugggc

SEQ ID NO: 1159562 - RNA, 14 nt, Human
acagacuggaagca

SEQ ID NO: 1159563 - RNA, 17 nt, Human
acagacuggaagcacag

SEQ ID NO: 1159564 - RNA, 15 nt, Human
uauauuuacaaaugg

SEQ ID NO: 1159565 - RNA, 21 nt, Human
uaucaaguauuauaccuuuuu

SEQ ID NO: 1159566 - RNA, 14 nt, Human
uauauuuacaaaug

SEQ ID NO: 1159567 - RNA, 18 nt, Human
uaucacccagaagaaaau

SEQ ID NO: 1159568 - RNA, 16 nt, Human
acagagcuacacaggg

SEQ ID NO: 1159569 - RNA, 18 nt, Human
acagagcuacacagggga

SEQ ID NO: 1159570 - RNA, 17 nt, Human
uaucucccccagcccca

SEQ ID NO: 1159571 - RNA, 18 nt, Human
uaucucccccagccccau

SEQ ID NO: 1159572 - RNA, 19 nt, Human
uaucuagauacuguaucau

SEQ ID NO: 1159573 - RNA, 10 nt, Human
uaucagaauu

SEQ ID NO: 1159574 - RNA, 15 nt, Human
uaucuagauacugua

SEQ ID NO: 1159575 - RNA, 16 nt, Human
uaucuagauacuguau

SEQ ID NO: 1159576 - RNA, 15 nt, Human
acagaguuguuacau

SEQ ID NO: 1159577 - RNA, 18 nt, Human
acagaguuuucacucuua

SEQ ID NO: 1159578 - RNA, 20 nt, Human
acagaguuuucacucuuauu

SEQ ID NO: 1159579 - RNA, 15 nt, Human
uaucuugaagacuuu

SEQ ID NO: 1159580 - RNA, 13 nt, Human
uaugaggcauuug

SEQ ID NO: 1159581 - RNA, 21 nt, Human
uaugaucacggcucacugcag

SEQ ID NO: 1159582 - RNA, 23 nt, Human
uaugaucacggcucacugcagcc

SEQ ID NO: 1159583 - RNA, 16 nt, Human
uauggcuuuugugcau

SEQ ID NO: 1159584 - RNA, 17 nt, Human
acagcuaacauggaagu

SEQ ID NO: 1159585 - RNA, 14 nt, Human
acagccugugucuu

SEQ ID NO: 1159586 - RNA, 18 nt, Human
acagccugugucuuuaaa

SEQ ID NO: 1159587 - RNA, 23 nt, Human
acagccugugucuuuaaaugcug

SEQ ID NO: 1159588 - RNA, 15 nt, Human
acagcuaacauggaa

SEQ ID NO: 1159589 - RNA, 18 nt, Human
uaugcucugcauguuaca

SEQ ID NO: 1159590 - RNA, 19 nt, Human
uaugcucugcauguuacau

SEQ ID NO: 1159591 - RNA, 18 nt, Human
uauuuacuucuuauacau

SEQ ID NO: 1159592 - RNA, 23 nt, Human
uauuuaauuuuuuugagacagag

SEQ ID NO: 1159593 - RNA, 14 nt, Human
uauuuauuuaaauu

SEQ ID NO: 1159594 - RNA, 13 nt, Human
uauuuauuuaaau

SEQ ID NO: 1159595 - RNA, 14 nt, Human
uauuuauuuuaaua

SEQ ID NO: 1159596 - RNA, 16 nt, Human
uauuuauuuuaauaau

SEQ ID NO: 1159597 - RNA, 18 nt, Human
uauuuauuuuaauaaugu

SEQ ID NO: 1159598 - RNA, 13 nt, Human
uauugucaaagug

SEQ ID NO: 1159599 - RNA, 17 nt, Human
uauugucaaagugguga

SEQ ID NO: 1159600 - RNA, 17 nt, Human
uauugucuagugaaacu

SEQ ID NO: 1159601 - RNA, 15 nt, Human
uauuuaaugaaagac

SEQ ID NO: 1159602 - RNA, 21 nt, Human
uauuuaaugaaagacuguaca

SEQ ID NO: 1159603 - RNA, 23 nt, Human
acaguucggugagcuacaaaugc

SEQ ID NO: 1159604 - RNA, 16 nt, Human
acaguucucuccuucu

SEQ ID NO: 1159605 - RNA, 22 nt, Human
acaguucggugagcuacaaaug

SEQ ID NO: 1159606 - RNA, 19 nt, Human
acaguucggugagcuacaa

SEQ ID NO: 1159607 - RNA, 13 nt, Human
acaguuacucaga

SEQ ID NO: 1159608 - RNA, 20 nt, Human
acaguuacucagaauucucu

SEQ ID NO: 1159609 - RNA, 20 nt, Human
acaguucaauucucauuugu

SEQ ID NO: 1159610 - RNA, 17 nt, Human
acaguucucuccuucuu

SEQ ID NO: 1159611 - RNA, 20 nt, Human
uauucucuccuguaccucuu

SEQ ID NO: 1159612 - RNA, 24 nt, Human
uauucucuccuguaccucuugagc

SEQ ID NO: 1159613 - RNA, 16 nt, Human
uauucuguuggccagu

SEQ ID NO: 1159614 - RNA, 15 nt, Human
uauucuuauuuaaug

SEQ ID NO: 1159615 - RNA, 20 nt, Human
acagugaaagaaaauaacaa

SEQ ID NO: 1159616 - RNA, 21 nt, Human
acaguccuuaccagcagagca

SEQ ID NO: 1159617 - RNA, 22 nt, Human
acaguccuuaccagcagagcac

SEQ ID NO: 1159618 - RNA, 14 nt, Human
acagugagacucug

SEQ ID NO: 1159619 - RNA, 18 nt, Human
acagugagacucugucuc

SEQ ID NO: 1159620 - RNA, 15 nt, Human
acaguuaagagaaau

SEQ ID NO: 1159621 - RNA, 21 nt, Human
acaguuaccucugccucagaa

SEQ ID NO: 1159622 - RNA, 14 nt, Human
acaggcugggcuuc

SEQ ID NO: 1159623 - RNA, 17 nt, Human
acaggcugggcuucagu

SEQ ID NO: 1159624 - RNA, 21 nt, Human
acaggcugggcuucaguggca

SEQ ID NO: 1159625 - RNA, 22 nt, Human
acagggcacaccgggcacucag

SEQ ID NO: 1159626 - RNA, 21 nt, Human
acaguauggcagcuuuccuca

SEQ ID NO: 1159627 - RNA, 15 nt, Human
acaguauuacuucug

SEQ ID NO: 1159628 - RNA, 16 nt, Human
acaguauuacuucugc

SEQ ID NO: 1159629 - RNA, 17 nt, Human
acaguauuacuucugcu

SEQ ID NO: 1159630 - RNA, 19 nt, Human
acaguauuacuucugcuac

SEQ ID NO: 1159631 - RNA, 13 nt, Human
acagucccugcca

SEQ ID NO: 1159632 - RNA, 15 nt, Human
acagucccugccaau

SEQ ID NO: 1159633 - RNA, 13 nt, Human
acaguccucccau

SEQ ID NO: 1159634 - RNA, 14 nt, Human
acaguccucccauc

SEQ ID NO: 1159635 - RNA, 15 nt, Human
acaguccucccaucu

SEQ ID NO: 1159636 - RNA, 17 nt, Human
acaguccucccaucuca

SEQ ID NO: 1159637 - RNA, 18 nt, Human
acaguccuuaccagcaga

SEQ ID NO: 1159638 - RNA, 20 nt, Human
acaguccuuaccagcagagc

SEQ ID NO: 1159639 - RNA, 23 nt, Human
uauucauagcagcuuauucacaa

SEQ ID NO: 1159640 - RNA, 18 nt, Human
uauucaggaagcucaggg

SEQ ID NO: 1159641 - RNA, 22 nt, Human
uauucaggaagcucagggccug

SEQ ID NO: 1159642 - RNA, 16 nt, Human
uauuaccacagacaua

SEQ ID NO: 1159643 - RNA, 12 nt, Human
uauuagagaaga

SEQ ID NO: 1159644 - RNA, 17 nt, Human
uauguuuuaagaggcag

SEQ ID NO: 1159645 - RNA, 19 nt, Human
uauguuuuaagaggcaggg

SEQ ID NO: 1159646 - RNA, 21 nt, Human
uauguuuucaggcuagaugua

SEQ ID NO: 1159647 - RNA, 16 nt, Human
uauuaaaaaucucaaa

SEQ ID NO: 1159648 - RNA, 18 nt, Human
uauuaaaaaucucaaauu

SEQ ID NO: 1159649 - RNA, 20 nt, Human
uauuaaaaaucucaaauuuc

SEQ ID NO: 1159650 - RNA, 22 nt, Human
uauuaaaaaucucaaauuucua

SEQ ID NO: 1159651 - RNA, 23 nt, Human
uauuaaaaaucucaaauuucuaa

SEQ ID NO: 1159652 - RNA, 12 nt, Human
ucaccuccugcu

SEQ ID NO: 1159653 - RNA, 13 nt, Human
ucaccuccugcug

SEQ ID NO: 1159654 - RNA, 14 nt, Human
ucaccuccugcugg

SEQ ID NO: 1159655 - RNA, 15 nt, Human
ucaccuccugcuggg

SEQ ID NO: 1159656 - RNA, 17 nt, Human
ucaccuccugcugggca

SEQ ID NO: 1159657 - RNA, 19 nt, Human
ucaccugaagacucauucu

SEQ ID NO: 1159658 - RNA, 23 nt, Human
ucaccugaagacucauucuucug

SEQ ID NO: 1159659 - RNA, 19 nt, Human
accacuuguguuuugcaag

SEQ ID NO: 1159660 - RNA, 23 nt, Human
accacuuguguuuugcaagccag

SEQ ID NO: 1159661 - RNA, 12 nt, Human
accacuuuuguu

SEQ ID NO: 1159662 - RNA, 22 nt, Human
accagacaccuugacagggcac

SEQ ID NO: 1159663 - RNA, 23 nt, Human
accagacaccuugacagggcaca

SEQ ID NO: 1159664 - RNA, 11 nt, Human
accagacaggu

SEQ ID NO: 1159665 - RNA, 19 nt, Human
accagagcccaccuuggcu

SEQ ID NO: 1159666 - RNA, 22 nt, Human
accagagcccaccuuggcucaa

SEQ ID NO: 1159667 - RNA, 12 nt, Human
accagagcccac

SEQ ID NO: 1159668 - RNA, 12 nt, Human
accagagcugcc

SEQ ID NO: 1159669 - RNA, 15 nt, Human
accacuucagcugac

SEQ ID NO: 1159670 - RNA, 13 nt, Human
accacuucagcug

SEQ ID NO: 1159671 - RNA, 14 nt, Human
accacuucagcuga

SEQ ID NO: 1159672 - RNA, 17 nt, Human
accacugcacuccagcc

SEQ ID NO: 1159673 - RNA, 14 nt, Human
accacugcagaaga

SEQ ID NO: 1159674 - RNA, 19 nt, Human
accacugcagaagacagua

SEQ ID NO: 1159675 - RNA, 16 nt, Human
accacaucuugcucug

SEQ ID NO: 1159676 - RNA, 20 nt, Human
accacaucuugcucugcuga

SEQ ID NO: 1159677 - RNA, 21 nt, Human
accacaucuugcucugcugac

SEQ ID NO: 1159678 - RNA, 24 nt, Human
accacaucuugcucugcugacaga

SEQ ID NO: 1159679 - RNA, 20 nt, Human
accacucuaucaaguauuau

SEQ ID NO: 1159680 - RNA, 21 nt, Human
accacagacauacuaaccagc

SEQ ID NO: 1159681 - RNA, 22 nt, Human
accacagacauacuaaccagca

SEQ ID NO: 1159682 - RNA, 14 nt, Human
accacaucuugcuc

SEQ ID NO: 1159683 - RNA, 12 nt, Human
ucacugcagccu

SEQ ID NO: 1159684 - RNA, 13 nt, Human
ucacugcagccuc

SEQ ID NO: 1159685 - RNA, 16 nt, Human
ucacugagacagcccg

SEQ ID NO: 1159686 - RNA, 13 nt, Human
ucacugagacagc

SEQ ID NO: 1159687 - RNA, 14 nt, Human
ucacugagacagcc

SEQ ID NO: 1159688 - RNA, 15 nt, Human
ucacugagacagccc

SEQ ID NO: 1159689 - RNA, 21 nt, Human
accaguguuguggauuuaaca

SEQ ID NO: 1159690 - RNA, 17 nt, Human
ucacuguugcccaggcu

SEQ ID NO: 1159691 - RNA, 18 nt, Human
ucacuguugcccaggcug

SEQ ID NO: 1159692 - RNA, 19 nt, Human
ucacuguugcccaggcugg

SEQ ID NO: 1159693 - RNA, 23 nt, Human
accaugauuaaccacuucagcug

SEQ ID NO: 1159694 - RNA, 22 nt, Human
accaugauuaaccacuucagcu

SEQ ID NO: 1159695 - RNA, 18 nt, Human
accauucuccaccugcca

SEQ ID NO: 1159696 - RNA, 13 nt, Human
accauucuccacc

SEQ ID NO: 1159697 - RNA, 16 nt, Human
accauucuccaccugc

SEQ ID NO: 1159698 - RNA, 23 nt, Human
accauuuugggguacccacugcu

SEQ ID NO: 1159699 - RNA, 13 nt, Human
acccaaaaggcag

SEQ ID NO: 1159700 - RNA, 15 nt, Human
acccaaaaggcagaa

SEQ ID NO: 1159701 - RNA, 18 nt, Human
acccaaaaggcagaagca

SEQ ID NO: 1159702 - RNA, 21 nt, Human
acccaaauguucaucaaugaa

SEQ ID NO: 1159703 - RNA, 16 nt, Human
acccagaagaaaauag

SEQ ID NO: 1159704 - RNA, 16 nt, Human
acccagcccacuucug

SEQ ID NO: 1159705 - RNA, 17 nt, Human
acccagcccacuucugc

SEQ ID NO: 1159706 - RNA, 18 nt, Human
acccagcccacuucugcc

SEQ ID NO: 1159707 - RNA, 13 nt, Human
acccagcucuggu

SEQ ID NO: 1159708 - RNA, 15 nt, Human
acccagcucuggucc

SEQ ID NO: 1159709 - RNA, 13 nt, Human
ucagaagacacug

SEQ ID NO: 1159710 - RNA, 14 nt, Human
ucagaagacacuga

SEQ ID NO: 1159711 - RNA, 13 nt, Human
ucagaucuucugu

SEQ ID NO: 1159712 - RNA, 10 nt, Human
ucagccuggg

SEQ ID NO: 1159713 - RNA, 12 nt, Human
ucagccugggca

SEQ ID NO: 1159714 - RNA, 15 nt, Human
acccccagccugcua

SEQ ID NO: 1159715 - RNA, 18 nt, Human
ucagcggggacagcuccu

SEQ ID NO: 1159716 - RNA, 16 nt, Human
ucagcggggacagcuc

SEQ ID NO: 1159717 - RNA, 17 nt, Human
ucagcggggacagcucc

SEQ ID NO: 1159718 - RNA, 12 nt, Human
ucaggaagcuca

SEQ ID NO: 1159719 - RNA, 17 nt, Human
ucaggaagcucagggcc

SEQ ID NO: 1159720 - RNA, 19 nt, Human
ucaggaagcucagggccug

SEQ ID NO: 1159721 - RNA, 20 nt, Human
ucaggaagcucagggccugg

SEQ ID NO: 1159722 - RNA, 23 nt, Human
ucaggaagcucagggccuggcuc

SEQ ID NO: 1159723 - RNA, 20 nt, Human
ucaggccaaacucaccugcc

SEQ ID NO: 1159724 - RNA, 23 nt, Human
ucaggccaaacucaccugccccu

SEQ ID NO: 1159725 - RNA, 15 nt, Human
ucaggccagcugcuu

SEQ ID NO: 1159726 - RNA, 20 nt, Human
ucaggccagcugcuugggcu

SEQ ID NO: 1159727 - RNA, 11 nt, Human
ucaggccaggc

SEQ ID NO: 1159728 - RNA, 12 nt, Human
ucaggccaggcc

SEQ ID NO: 1159729 - RNA, 13 nt, Human
ucagggucccugg

SEQ ID NO: 1159730 - RNA, 14 nt, Human
ucagggucccuggu

SEQ ID NO: 1159731 - RNA, 18 nt, Human
ucagggucccugguggca

SEQ ID NO: 1159732 - RNA, 13 nt, Human
ucagguaacaggc

SEQ ID NO: 1159733 - RNA, 15 nt, Human
ucagguaacaggcag

SEQ ID NO: 1159734 - RNA, 16 nt, Human
ucagguaacaggcaga

SEQ ID NO: 1159735 - RNA, 19 nt, Human
accccuucgcuccuguguc

SEQ ID NO: 1159736 - RNA, 20 nt, Human
accccuucgcuccugugucu

SEQ ID NO: 1159737 - RNA, 14 nt, Human
acccucuuagaaaa

SEQ ID NO: 1159738 - RNA, 11 nt, Human
acccugcccug

SEQ ID NO: 1159739 - RNA, 12 nt, Human
acccugcccugu

SEQ ID NO: 1159740 - RNA, 13 nt, Human
acccugcccugug

SEQ ID NO: 1159741 - RNA, 14 nt, Human
acccugcccugugg

SEQ ID NO: 1159742 - RNA, 16 nt, Human
acccuuguggucccac

SEQ ID NO: 1159743 - RNA, 17 nt, Human
acccuuguggucccacc

SEQ ID NO: 1159744 - RNA, 19 nt, Human
acccuuguggucccacccc

SEQ ID NO: 1159745 - RNA, 20 nt, Human
acccuuguggucccacccca

SEQ ID NO: 1159746 - RNA, 20 nt, Human
accgcagacaggaccaggga

SEQ ID NO: 1159747 - RNA, 17 nt, Human
accgccaaggcuggggg

SEQ ID NO: 1159748 - RNA, 10 nt, Human
acccuuuucu

SEQ ID NO: 1159749 - RNA, 20 nt, Human
ucauauuuacuucuuauaca

SEQ ID NO: 1159750 - RNA, 21 nt, Human
ucauauuuacuucuuauacau

SEQ ID NO: 1159751 - RNA, 22 nt, Human
ucauauuuacuucuuauacauu

SEQ ID NO: 1159752 - RNA, 11 nt, Human
accucagccuc

SEQ ID NO: 1159753 - RNA, 20 nt, Human
accuccgccucuuggguuca

SEQ ID NO: 1159754 - RNA, 13 nt, Human
accuagccuuaga

SEQ ID NO: 1159755 - RNA, 13 nt, Human
accucucccuugg

SEQ ID NO: 1159756 - RNA, 14 nt, Human
accucucccuugga

SEQ ID NO: 1159757 - RNA, 15 nt, Human
accucucccuuggau

SEQ ID NO: 1159758 - RNA, 23 nt, Human
accucucccuuggauuguccccg

SEQ ID NO: 1159759 - RNA, 14 nt, Human
accucucucacucc

SEQ ID NO: 1159760 - RNA, 19 nt, Human
accucucucacuccuugaa

SEQ ID NO: 1159761 - RNA, 12 nt, Human
accucugcacaa

SEQ ID NO: 1159762 - RNA, 21 nt, Human
ucauucuccuuguguuacuaa

SEQ ID NO: 1159763 - RNA, 22 nt, Human
ucauugaccugaggcccuucuc

SEQ ID NO: 1159764 - RNA, 17 nt, Human
accucggugccuuccuc

SEQ ID NO: 1159765 - RNA, 13 nt, Human
ucaugucuggcua

SEQ ID NO: 1159766 - RNA, 11 nt, Human
ucauguucuua

SEQ ID NO: 1159767 - RNA, 17 nt, Human
ucauguucuuaauucuu

SEQ ID NO: 1159768 - RNA, 19 nt, Human
ucauccacugugccaugug

SEQ ID NO: 1159769 - RNA, 21 nt, Human
ucauccacugugccaugugcc

SEQ ID NO: 1159770 - RNA, 23 nt, Human
ucauccacugugccaugugccag

SEQ ID NO: 1159771 - RNA, 22 nt, Human
ucaugaauuaguuuuauaugcu

SEQ ID NO: 1159772 - RNA, 19 nt, Human
ucaugacaaagacugagua

SEQ ID NO: 1159773 - RNA, 23 nt, Human
accugcggugcuaucucccccag

SEQ ID NO: 1159774 - RNA, 19 nt, Human
accugcggugcuaucuccc

SEQ ID NO: 1159775 - RNA, 22 nt, Human
accugcggugcuaucuccccca

SEQ ID NO: 1159776 - RNA, 15 nt, Human
accugaagucuuugu

SEQ ID NO: 1159777 - RNA, 22 nt, Human
accugaagucuuuguacagaca

SEQ ID NO: 1159778 - RNA, 14 nt, Human
accuggaauauaua

SEQ ID NO: 1159779 - RNA, 17 nt, Human
accuggaauauauaacc

SEQ ID NO: 1159780 - RNA, 19 nt, Human
ucauuugagcagggcucag

SEQ ID NO: 1159781 - RNA, 21 nt, Human
ucauuugagcagggcucagcg

SEQ ID NO: 1159782 - RNA, 13 nt, Human
ucauuuuuuuuaa

SEQ ID NO: 1159783 - RNA, 17 nt, Human
ucauuuuuuuuaagaaa

SEQ ID NO: 1159784 - RNA, 16 nt, Human
uccaagcucccaggca

SEQ ID NO: 1159785 - RNA, 14 nt, Human
uccaagcucccagg

SEQ ID NO: 1159786 - RNA, 15 nt, Human
uccaagcucccaggc

SEQ ID NO: 1159787 - RNA, 21 nt, Human
uccaacuaucucauuuccaag

SEQ ID NO: 1159788 - RNA, 12 nt, Human
uccaagcuccca

SEQ ID NO: 1159789 - RNA, 13 nt, Human
uccaagcucccag

SEQ ID NO: 1159790 - RNA, 11 nt, Human
uccaagcuggu

SEQ ID NO: 1159791 - RNA, 16 nt, Human
uccaagcuggucccac

SEQ ID NO: 1159792 - RNA, 15 nt, Human
uccaccaucaagcca

SEQ ID NO: 1159793 - RNA, 18 nt, Human
uccaccaucaagccacca

SEQ ID NO: 1159794 - RNA, 17 nt, Human
accuuagacagucccug

SEQ ID NO: 1159795 - RNA, 14 nt, Human
accuucuccuucac

SEQ ID NO: 1159796 - RNA, 13 nt, Human
accuucuccuuca

SEQ ID NO: 1159797 - RNA, 14 nt, Human
accuugacagggca

SEQ ID NO: 1159798 - RNA, 15 nt, Human
accuugacagggcac

SEQ ID NO: 1159799 - RNA, 16 nt, Human
accuugacagggcaca

SEQ ID NO: 1159800 - RNA, 12 nt, Human
accuucuccuuc

SEQ ID NO: 1159801 - RNA, 14 nt, Human
uccagacccggcug

SEQ ID NO: 1159802 - RNA, 15 nt, Human
uccagccccuggaug

SEQ ID NO: 1159803 - RNA, 16 nt, Human
uccagccccuggaugc

SEQ ID NO: 1159804 - RNA, 17 nt, Human
uccagccccuggaugca

SEQ ID NO: 1159805 - RNA, 19 nt, Human
uccagccccuggaugcagc

SEQ ID NO: 1159806 - RNA, 21 nt, Human
uccagccccuggaugcagccu

SEQ ID NO: 1159807 - RNA, 22 nt, Human
uccagccccuggaugcagccuc

SEQ ID NO: 1159808 - RNA, 20 nt, Human
uccagccugagcgacaguga

SEQ ID NO: 1159809 - RNA, 21 nt, Human
uccagccugagcgacagugag

SEQ ID NO: 1159810 - RNA, 15 nt, Human
accuuuguauucucu

SEQ ID NO: 1159811 - RNA, 19 nt, Human
accuuuguauucucuccug

SEQ ID NO: 1159812 - RNA, 23 nt, Human
accuuuguauucucuccuguacc

SEQ ID NO: 1159813 - RNA, 13 nt, Human
accuuugucccca

SEQ ID NO: 1159814 - RNA, 22 nt, Human
uccagaaguuugagaucagccu

SEQ ID NO: 1159815 - RNA, 20 nt, Human
ucccaucucacacaugagca

SEQ ID NO: 1159816 - RNA, 15 nt, Human
ucccauaugccuggg

SEQ ID NO: 1159817 - RNA, 16 nt, Human
ucccauaugccugggc

SEQ ID NO: 1159818 - RNA, 13 nt, Human
ucccaucucacac

SEQ ID NO: 1159819 - RNA, 14 nt, Human
ucccaucucacaca

SEQ ID NO: 1159820 - RNA, 19 nt, Human
ucccaucucacacaugagc

SEQ ID NO: 1159821 - RNA, 16 nt, Human
acuacaguccucccau

SEQ ID NO: 1159822 - RNA, 17 nt, Human
acuacaguccucccauc

SEQ ID NO: 1159823 - RNA, 11 nt, Human
acuacauucug

SEQ ID NO: 1159824 - RNA, 19 nt, Human
ucccagugccgagaaggaa

SEQ ID NO: 1159825 - RNA, 22 nt, Human
ucccagugccgagaaggaagcc

SEQ ID NO: 1159826 - RNA, 13 nt, Human
acuaaccacgcug

SEQ ID NO: 1159827 - RNA, 16 nt, Human
acuaaccagcagaaau

SEQ ID NO: 1159828 - RNA, 17 nt, Human
acuaaccagcagaaaug

SEQ ID NO: 1159829 - RNA, 15 nt, Human
acuacaguccuccca

SEQ ID NO: 1159830 - RNA, 13 nt, Human
acuaaaaauacaa

SEQ ID NO: 1159831 - RNA, 15 nt, Human
acguuucuaaaggcu

SEQ ID NO: 1159832 - RNA, 14 nt, Human
acguuucuaaaggc

SEQ ID NO: 1159833 - RNA, 12 nt, Human
acguuucuaaag

SEQ ID NO: 1159834 - RNA, 14 nt, Human
uccagcucaccagc

SEQ ID NO: 1159835 - RNA, 15 nt, Human
uccagcucaccagcc

SEQ ID NO: 1159836 - RNA, 13 nt, Human
uccagccugggug

SEQ ID NO: 1159837 - RNA, 24 nt, Human
uccagccugggugacagagcaagu

SEQ ID NO: 1159838 - RNA, 16 nt, Human
acuaucuaaauguuga

SEQ ID NO: 1159839 - RNA, 18 nt, Human
acuauguugcccaggcag

SEQ ID NO: 1159840 - RNA, 19 nt, Human
acuauguugcccaggcagg

SEQ ID NO: 1159841 - RNA, 20 nt, Human
acuauguugcccaggcaggu

SEQ ID NO: 1159842 - RNA, 23 nt, Human
acuauguugcccaggcaggucuu

SEQ ID NO: 1159843 - RNA, 17 nt, Human
acuauauuguuugcuaa

SEQ ID NO: 1159844 - RNA, 23 nt, Human
acuauaauuuaccugaagucuuu

SEQ ID NO: 1159845 - RNA, 17 nt, Human
acuauagccuaggugac

SEQ ID NO: 1159846 - RNA, 18 nt, Human
acuauagccuaggugaca

SEQ ID NO: 1159847 - RNA, 24 nt, Human
uccccaccgcagacaggaccaggg

SEQ ID NO: 1159848 - RNA, 18 nt, Human
ucccgaauagcugggacu

SEQ ID NO: 1159849 - RNA, 18 nt, Human
ucccuauuagagaagaga

SEQ ID NO: 1159850 - RNA, 15 nt, Human
ucccgaauagcuggg

SEQ ID NO: 1159851 - RNA, 16 nt, Human
ucccgaauagcuggga

SEQ ID NO: 1159852 - RNA, 21 nt, Human
ucccucagucuggcccuuccu

SEQ ID NO: 1159853 - RNA, 22 nt, Human
ucccucauccucauacccaccc

SEQ ID NO: 1159854 - RNA, 19 nt, Human
acuccagugagacagcucu

SEQ ID NO: 1159855 - RNA, 12 nt, Human
acuccugcaggc

SEQ ID NO: 1159856 - RNA, 18 nt, Human
ucccuuacgugaguccug

SEQ ID NO: 1159857 - RNA, 22 nt, Human
ucccuuacgugaguccuggcau

SEQ ID NO: 1159858 - RNA, 22 nt, Human
ucccuuuccaaaugcccagcuu

SEQ ID NO: 1159859 - RNA, 22 nt, Human
ucccuuugacgccaucccagcc

SEQ ID NO: 1159860 - RNA, 23 nt, Human
ucccuuugacgccaucccagccc

SEQ ID NO: 1159861 - RNA, 18 nt, Human
ucccuuuuaauccuggcu

SEQ ID NO: 1159862 - RNA, 19 nt, Human
ucccuuuuaauccuggcug

SEQ ID NO: 1159863 - RNA, 20 nt, Human
uccuagcacuuugggaggcc

SEQ ID NO: 1159864 - RNA, 18 nt, Human
acucuccucugcugcugg

SEQ ID NO: 1159865 - RNA, 19 nt, Human
acucuccucugcugcuggc

SEQ ID NO: 1159866 - RNA, 21 nt, Human
acucuccucugcugcuggcug

SEQ ID NO: 1159867 - RNA, 19 nt, Human
uccuaggcauuugcugaau

SEQ ID NO: 1159868 - RNA, 18 nt, Human
acucgcgacaaugcaaac

SEQ ID NO: 1159869 - RNA, 20 nt, Human
acucgcgacaaugcaaacca

SEQ ID NO: 1159870 - RNA, 23 nt, Human
acucgcgacaaugcaaaccauca

SEQ ID NO: 1159871 - RNA, 17 nt, Human
acucuccucugcugcug

SEQ ID NO: 1159872 - RNA, 22 nt, Human
uccucauacccacccccaccca

SEQ ID NO: 1159873 - RNA, 14 nt, Human
uccucauacccacc

SEQ ID NO: 1159874 - RNA, 18 nt, Human
uccucauacccaccccca

SEQ ID NO: 1159875 - RNA, 12 nt, Human
uccucuccccag

SEQ ID NO: 1159876 - RNA, 17 nt, Human
uccucccucccucuuuc

SEQ ID NO: 1159877 - RNA, 19 nt, Human
uccucccucccucuuuccc

SEQ ID NO: 1159878 - RNA, 16 nt, Human
acucuuauugcccacg

SEQ ID NO: 1159879 - RNA, 19 nt, Human
acucuuauugcccacgcug

SEQ ID NO: 1159880 - RNA, 20 nt, Human
uccucagaucuucugugggu

SEQ ID NO: 1159881 - RNA, 17 nt, Human
acugaggggaggggagc

SEQ ID NO: 1159882 - RNA, 22 nt, Human
acugaggggaggggagcauggg

SEQ ID NO: 1159883 - RNA, 15 nt, Human
uccucuccccagcaa

SEQ ID NO: 1159884 - RNA, 22 nt, Human
acugaguacguugugcauuugg

SEQ ID NO: 1159885 - RNA, 23 nt, Human
acugaguacguugugcauuuggu

SEQ ID NO: 1159886 - RNA, 18 nt, Human
acugaguacguugugcau

SEQ ID NO: 1159887 - RNA, 19 nt, Human
acugaguacguugugcauu

SEQ ID NO: 1159888 - RNA, 21 nt, Human
acugaguacguugugcauuug

SEQ ID NO: 1159889 - RNA, 16 nt, Human
acugcaaccuccgccu

SEQ ID NO: 1159890 - RNA, 22 nt, Human
acugcaaccuccgccucuuggg

SEQ ID NO: 1159891 - RNA, 13 nt, Human
acugcaaccuccg

SEQ ID NO: 1159892 - RNA, 14 nt, Human
acugcaaccuccgc

SEQ ID NO: 1159893 - RNA, 20 nt, Human
uccugccucgaacuggcugc

SEQ ID NO: 1159894 - RNA, 21 nt, Human
uccugccucgaacuggcugca

SEQ ID NO: 1159895 - RNA, 16 nt, Human
uccugcaggcagccag

SEQ ID NO: 1159896 - RNA, 17 nt, Human
uccugcaggcagccagg

SEQ ID NO: 1159897 - RNA, 19 nt, Human
uccugcaggcagccaggcc

SEQ ID NO: 1159898 - RNA, 20 nt, Human
uccugcaggcagccaggcca

SEQ ID NO: 1159899 - RNA, 22 nt, Human
uccugcaggcagccaggccaca

SEQ ID NO: 1159900 - RNA, 19 nt, Human
uccugccucagccucccaa

SEQ ID NO: 1159901 - RNA, 13 nt, Human
uccugcugcaguu

SEQ ID NO: 1159902 - RNA, 21 nt, Human
uccugcugcaguugccaguca

SEQ ID NO: 1159903 - RNA, 23 nt, Human
acugcagccucaaccuccugggc

SEQ ID NO: 1159904 - RNA, 17 nt, Human
uccuuaaagaguguggc

SEQ ID NO: 1159905 - RNA, 23 nt, Human
uccuuaaagaguguggcaaaaua

SEQ ID NO: 1159906 - RNA, 18 nt, Human
uccuuaaagaguguggca

SEQ ID NO: 1159907 - RNA, 19 nt, Human
acugcagccucaaccuccu

SEQ ID NO: 1159908 - RNA, 21 nt, Human
acugcagccucaaccuccugg

SEQ ID NO: 1159909 - RNA, 22 nt, Human
acugcagccucaaccuccuggg

SEQ ID NO: 1159910 - RNA, 23 nt, Human
uccugugucuugcaauggcagcc

SEQ ID NO: 1159911 - RNA, 24 nt, Human
uccugugucuugcaauggcagccu

SEQ ID NO: 1159912 - RNA, 13 nt, Human
uccugugugugcg

SEQ ID NO: 1159913 - RNA, 14 nt, Human
uccugugugugcgc

SEQ ID NO: 1159914 - RNA, 18 nt, Human
uccugugugugcgccuac

SEQ ID NO: 1159915 - RNA, 19 nt, Human
uccuguucccaugagauga

SEQ ID NO: 1159916 - RNA, 22 nt, Human
acugccuucucaacuccaaacu

SEQ ID NO: 1159917 - RNA, 18 nt, Human
acugcuuccagugaggcu

SEQ ID NO: 1159918 - RNA, 21 nt, Human
acugcuuccagugaggcucug

SEQ ID NO: 1159919 - RNA, 22 nt, Human
acugcuuccagugaggcucugc

SEQ ID NO: 1159920 - RNA, 23 nt, Human
acugcuuccagugaggcucugcc

SEQ ID NO: 1159921 - RNA, 21 nt, Human
acugcuugugaaaggaaagag

SEQ ID NO: 1159922 - RNA, 22 nt, Human
acuggcugcaaaggguaucagg

SEQ ID NO: 1159923 - RNA, 13 nt, Human
uccuucagccuga

SEQ ID NO: 1159924 - RNA, 11 nt, Human
uccuucagugc

SEQ ID NO: 1159925 - RNA, 12 nt, Human
uccuucagugcc

SEQ ID NO: 1159926 - RNA, 13 nt, Human
uccuucagugccu

SEQ ID NO: 1159927 - RNA, 22 nt, Human
uccuucagugccuuauggaaca

SEQ ID NO: 1159928 - RNA, 14 nt, Human
uccuucagugccuu

SEQ ID NO: 1159929 - RNA, 15 nt, Human
uccuuucaccacaug

SEQ ID NO: 1159930 - RNA, 14 nt, Human
ucgaacuggcugca

SEQ ID NO: 1159931 - RNA, 15 nt, Human
ucgaacuggcugcaa

SEQ ID NO: 1159932 - RNA, 14 nt, Human
ucgagcaugccugg

SEQ ID NO: 1159933 - RNA, 15 nt, Human
ucgagcaugccugga

SEQ ID NO: 1159934 - RNA, 14 nt, Human
ucgaggacagggag

SEQ ID NO: 1159935 - RNA, 17 nt, Human
ucgaggacagggaggug

SEQ ID NO: 1159936 - RNA, 13 nt, Human
ucgcgacaaugca

SEQ ID NO: 1159937 - RNA, 14 nt, Human
ucgcgacaaugcaa

SEQ ID NO: 1159938 - RNA, 13 nt, Human
acuguacaugaaa

SEQ ID NO: 1159939 - RNA, 14 nt, Human
acuguacaugaaaa

SEQ ID NO: 1159940 - RNA, 16 nt, Human
acuguacaugaaaaca

SEQ ID NO: 1159941 - RNA, 23 nt, Human
acuguacaugaaaacacauuuuu

SEQ ID NO: 1159942 - RNA, 14 nt, Human
acuguacaaaguag

SEQ ID NO: 1159943 - RNA, 15 nt, Human
acuguacaaaguaga

SEQ ID NO: 1159944 - RNA, 19 nt, Human
acuguaauuugugauacaa

SEQ ID NO: 1159945 - RNA, 13 nt, Human
acuguacaaagua

SEQ ID NO: 1159946 - RNA, 12 nt, Human
ucgcuccugugu

SEQ ID NO: 1159947 - RNA, 13 nt, Human
ucgcuccuguguc

SEQ ID NO: 1159948 - RNA, 14 nt, Human
ucgcuccugugucu

SEQ ID NO: 1159949 - RNA, 19 nt, Human
acuggguacuuguggacac

SEQ ID NO: 1159950 - RNA, 20 nt, Human
acuggguacuuguggacaca

SEQ ID NO: 1159951 - RNA, 23 nt, Human
acuggguacuuguggacacagcu

SEQ ID NO: 1159952 - RNA, 11 nt, Human
ucucccuugga

SEQ ID NO: 1159953 - RNA, 18 nt, Human
ucucccuuggauuguccc

SEQ ID NO: 1159954 - RNA, 13 nt, Human
ucuccucugcugc

SEQ ID NO: 1159955 - RNA, 14 nt, Human
ucuccucugcugcu

SEQ ID NO: 1159956 - RNA, 15 nt, Human
ucuccucugcugcug

SEQ ID NO: 1159957 - RNA, 19 nt, Human
ucucccuuggauugucccc

SEQ ID NO: 1159958 - RNA, 21 nt, Human
ucucccuuggauuguccccga

SEQ ID NO: 1159959 - RNA, 12 nt, Human
ucuccucugcug

SEQ ID NO: 1159960 - RNA, 18 nt, Human
acuuuaccuuuuuuauac

SEQ ID NO: 1159961 - RNA, 19 nt, Human
acuuuaccuuuuuuauaca

SEQ ID NO: 1159962 - RNA, 22 nt, Human
acuuuaccuuuuuuauacauaa

SEQ ID NO: 1159963 - RNA, 23 nt, Human
acuuuaccuuuuuuauacauaaa

SEQ ID NO: 1159964 - RNA, 19 nt, Human
acuuugaccucugcagcaa

SEQ ID NO: 1159965 - RNA, 23 nt, Human
acuuugaccucugcagcaauaaa

SEQ ID NO: 1159966 - RNA, 13 nt, Human
acuuuggaaagac

SEQ ID NO: 1159967 - RNA, 14 nt, Human
acuuuggaaagacu

SEQ ID NO: 1159968 - RNA, 17 nt, Human
acuuuggaaagacuuuu

SEQ ID NO: 1159969 - RNA, 23 nt, Human
acuuuggaaagacuuuuccaacc

SEQ ID NO: 1159970 - RNA, 11 nt, Human
ucucugcccuc

SEQ ID NO: 1159971 - RNA, 16 nt, Human
ucucuggccuucggcc

SEQ ID NO: 1159972 - RNA, 17 nt, Human
ucucuggccuucggccu

SEQ ID NO: 1159973 - RNA, 21 nt, Human
ucucuggccuucggccuccau

SEQ ID NO: 1159974 - RNA, 14 nt, Human
ucucuugagagggu

SEQ ID NO: 1159975 - RNA, 20 nt, Human
ucuccuucaccuuugucccc

SEQ ID NO: 1159976 - RNA, 13 nt, Human
ucucuccagcccc

SEQ ID NO: 1159977 - RNA, 14 nt, Human
ucucuccagccccu

SEQ ID NO: 1159978 - RNA, 15 nt, Human
ucucuccagccccug

SEQ ID NO: 1159979 - RNA, 16 nt, Human
ucucuccagccccugg

SEQ ID NO: 1159980 - RNA, 20 nt, Human
ucucuccuguaccucuugag

SEQ ID NO: 1159981 - RNA, 22 nt, Human
ucucuccuguaccucuugagcc

SEQ ID NO: 1159982 - RNA, 17 nt, Human
agaaaaaugagccuggc

SEQ ID NO: 1159983 - RNA, 19 nt, Human
agaaaacaaggaugaauua

SEQ ID NO: 1159984 - RNA, 22 nt, Human
ucucuuuaaugucacaggcagg

SEQ ID NO: 1159985 - RNA, 17 nt, Human
ucucuugagccugggag

SEQ ID NO: 1159986 - RNA, 15 nt, Human
ucucuugagccuggg

SEQ ID NO: 1159987 - RNA, 13 nt, Human
ucucuugagccug

SEQ ID NO: 1159988 - RNA, 14 nt, Human
ucucuugagccugg

SEQ ID NO: 1159989 - RNA, 13 nt, Human
agaaacuggaacu

SEQ ID NO: 1159990 - RNA, 15 nt, Human
agaaacuggaacucu

SEQ ID NO: 1159991 - RNA, 15 nt, Human
ucugcagauaaacag

SEQ ID NO: 1159992 - RNA, 11 nt, Human
agaaauguguu

SEQ ID NO: 1159993 - RNA, 17 nt, Human
agaaauguacagcaagg

SEQ ID NO: 1159994 - RNA, 14 nt, Human
agaacucccuuuca

SEQ ID NO: 1159995 - RNA, 15 nt, Human
agaacucccuuucaa

SEQ ID NO: 1159996 - RNA, 19 nt, Human
ucugacccugcuucaaaua

SEQ ID NO: 1159997 - RNA, 19 nt, Human
ucugauucccaagcucugc

SEQ ID NO: 1159998 - RNA, 20 nt, Human
ucugauucccaagcucugcu

SEQ ID NO: 1159999 - RNA, 21 nt, Human
ucugauucccaagcucugcuc

SEQ ID NO: 1160000 - RNA, 14 nt, Human
agaagcuccaggua

SEQ ID NO: 1160001 - RNA, 15 nt, Human
agaagcggcuggcag

SEQ ID NO: 1160002 - RNA, 16 nt, Human
agaagcggcuggcagc

SEQ ID NO: 1160003 - RNA, 16 nt, Human
ucuggcagcucagaga

SEQ ID NO: 1160004 - RNA, 14 nt, Human
ucuggcagcucaga

SEQ ID NO: 1160005 - RNA, 15 nt, Human
ucuggcagcucagag

SEQ ID NO: 1160006 - RNA, 14 nt, Human
ucugcccuccaaga

SEQ ID NO: 1160007 - RNA, 18 nt, Human
ucugcccuccaagaccuu

SEQ ID NO: 1160008 - RNA, 16 nt, Human
ucugcucacauaucug

SEQ ID NO: 1160009 - RNA, 17 nt, Human
ucugcucacauaucugu

SEQ ID NO: 1160010 - RNA, 13 nt, Human
ucugcuucagccu

SEQ ID NO: 1160011 - RNA, 18 nt, Human
ucugguccauagagagca

SEQ ID NO: 1160012 - RNA, 11 nt, Human
ucuggggcugu

SEQ ID NO: 1160013 - RNA, 14 nt, Human
ucuggguucacugc

SEQ ID NO: 1160014 - RNA, 16 nt, Human
ucuggguucacugcaa

SEQ ID NO: 1160015 - RNA, 15 nt, Human
ucugucauuugagca

SEQ ID NO: 1160016 - RNA, 20 nt, Human
ucugucauuugagcagggcu

SEQ ID NO: 1160017 - RNA, 23 nt, Human
ucugucauuugagcagggcucag

SEQ ID NO: 1160018 - RNA, 15 nt, Human
ucugugaaaggaaag

SEQ ID NO: 1160019 - RNA, 21 nt, Human
ucugugaaaggaaagagggag

SEQ ID NO: 1160020 - RNA, 22 nt, Human
ucugugaaaggaaagagggagg

SEQ ID NO: 1160021 - RNA, 19 nt, Human
ucuguuggccagugugaca

SEQ ID NO: 1160022 - RNA, 20 nt, Human
ucuguuggccagugugacaa

SEQ ID NO: 1160023 - RNA, 20 nt, Human
ucuguuuuauaauuuuguga

SEQ ID NO: 1160024 - RNA, 18 nt, Human
ucuguuuuauaauuuugu

SEQ ID NO: 1160025 - RNA, 17 nt, Human
agaauuucccaaagcag

SEQ ID NO: 1160026 - RNA, 18 nt, Human
agaauuucccaaagcagu

SEQ ID NO: 1160027 - RNA, 23 nt, Human
agaauuucccaaagcagugcaug

SEQ ID NO: 1160028 - RNA, 15 nt, Human
agacaggaccaggga

SEQ ID NO: 1160029 - RNA, 16 nt, Human
agacaggaccagggau

SEQ ID NO: 1160030 - RNA, 23 nt, Human
agacaggcaagcaccuccugccu

SEQ ID NO: 1160031 - RNA, 21 nt, Human
agacaggguuuugccauguug

SEQ ID NO: 1160032 - RNA, 15 nt, Human
agacagucccugcca

SEQ ID NO: 1160033 - RNA, 16 nt, Human
agacagucccugccaa

SEQ ID NO: 1160034 - RNA, 17 nt, Human
agacagucccugccaau

SEQ ID NO: 1160035 - RNA, 19 nt, Human
agacagucccugccaaugg

SEQ ID NO: 1160036 - RNA, 17 nt, Human
ucuuauuuaaugaaaga

SEQ ID NO: 1160037 - RNA, 22 nt, Human
ucuuccaggcugggagagccuu

SEQ ID NO: 1160038 - RNA, 12 nt, Human
ucuucagagacu

SEQ ID NO: 1160039 - RNA, 22 nt, Human
ucuuagaugcaguucugaagaa

SEQ ID NO: 1160040 - RNA, 14 nt, Human
ucuuaugggcuggg

SEQ ID NO: 1160041 - RNA, 15 nt, Human
ucuuaugggcugggu

SEQ ID NO: 1160042 - RNA, 16 nt, Human
ucuuaugggcuggguu

SEQ ID NO: 1160043 - RNA, 18 nt, Human
ucuuaugggcuggguucu

SEQ ID NO: 1160044 - RNA, 18 nt, Human
ucuuauugcccacgcugg

SEQ ID NO: 1160045 - RNA, 22 nt, Human
ucuuauugcccacgcuggagug

SEQ ID NO: 1160046 - RNA, 19 nt, Human
agacuaucuaaauguugaa

SEQ ID NO: 1160047 - RNA, 17 nt, Human
agacuaucuaaauguug

SEQ ID NO: 1160048 - RNA, 18 nt, Human
agacuaucuaaauguuga

SEQ ID NO: 1160049 - RNA, 17 nt, Human
agacucauucuucugua

SEQ ID NO: 1160050 - RNA, 18 nt, Human
agacucauucuucuguac

SEQ ID NO: 1160051 - RNA, 13 nt, Human
ucuugcaauggca

SEQ ID NO: 1160052 - RNA, 16 nt, Human
ucuugcaauggcagcc

SEQ ID NO: 1160053 - RNA, 17 nt, Human
ucuugcaauggcagccu

SEQ ID NO: 1160054 - RNA, 18 nt, Human
ucuugcaauggcagccuu

SEQ ID NO: 1160055 - RNA, 12 nt, Human
agacccugcccu

SEQ ID NO: 1160056 - RNA, 13 nt, Human
agacccugcccug

SEQ ID NO: 1160057 - RNA, 14 nt, Human
agacccugcccugu

SEQ ID NO: 1160058 - RNA, 16 nt, Human
agacccugcccugugg

SEQ ID NO: 1160059 - RNA, 19 nt, Human
agacccugcccugugggcc

SEQ ID NO: 1160060 - RNA, 21 nt, Human
agacccugcccugugggcccc

SEQ ID NO: 1160061 - RNA, 23 nt, Human
agacccugcccugugggccccca

SEQ ID NO: 1160062 - RNA, 13 nt, Human
agacccuuguggu

SEQ ID NO: 1160063 - RNA, 15 nt, Human
agacccuuguggucc

SEQ ID NO: 1160064 - RNA, 19 nt, Human
agacccuuguggucccacc

SEQ ID NO: 1160065 - RNA, 20 nt, Human
agacccuuguggucccaccc

SEQ ID NO: 1160066 - RNA, 22 nt, Human
agacccuuguggucccacccca

SEQ ID NO: 1160067 - RNA, 23 nt, Human
agacccuuguggucccaccccac

SEQ ID NO: 1160068 - RNA, 15 nt, Human
ucuuuacuucaugga

SEQ ID NO: 1160069 - RNA, 13 nt, Human
ucuuuccugaggc

SEQ ID NO: 1160070 - RNA, 14 nt, Human
ucuuuccugaggcu

SEQ ID NO: 1160071 - RNA, 15 nt, Human
ucuuuccugaggcug

SEQ ID NO: 1160072 - RNA, 16 nt, Human
ucuuuccugaggcugg

SEQ ID NO: 1160073 - RNA, 15 nt, Human
agacuccugcaggca

SEQ ID NO: 1160074 - RNA, 16 nt, Human
agacuccugcaggcag

SEQ ID NO: 1160075 - RNA, 17 nt, Human
agacuccugcaggcagc

SEQ ID NO: 1160076 - RNA, 18 nt, Human
agacuccugcaggcagcc

SEQ ID NO: 1160077 - RNA, 19 nt, Human
agacuccugcaggcagcca

SEQ ID NO: 1160078 - RNA, 20 nt, Human
agacuccugcaggcagccag

SEQ ID NO: 1160079 - RNA, 23 nt, Human
agacuccugcaggcagccaggcc

SEQ ID NO: 1160080 - RNA, 17 nt, Human
agacucuacagaggcca

SEQ ID NO: 1160081 - RNA, 19 nt, Human
agacucuacagaggccaug

SEQ ID NO: 1160082 - RNA, 14 nt, Human
agacuucaucccuc

SEQ ID NO: 1160083 - RNA, 17 nt, Human
agacuucaucccucugg

SEQ ID NO: 1160084 - RNA, 12 nt, Human
agacuuuggaaa

SEQ ID NO: 1160085 - RNA, 14 nt, Human
agacuuuggaaaga

SEQ ID NO: 1160086 - RNA, 18 nt, Human
agagaaugaaagggccca

SEQ ID NO: 1160087 - RNA, 15 nt, Human
agacuuuggaaagac

SEQ ID NO: 1160088 - RNA, 15 nt, Human
agagaaugagagaca

SEQ ID NO: 1160089 - RNA, 17 nt, Human
agagacacacugaagaa

SEQ ID NO: 1160090 - RNA, 18 nt, Human
agagacacacugaagaag

SEQ ID NO: 1160091 - RNA, 20 nt, Human
agagacacacugaagaagca

SEQ ID NO: 1160092 - RNA, 13 nt, Human
agagaccaucccu

SEQ ID NO: 1160093 - RNA, 14 nt, Human
agagaccaucccug

SEQ ID NO: 1160094 - RNA, 15 nt, Human
agagaccaucccuga

SEQ ID NO: 1160095 - RNA, 18 nt, Human
agagaccaucccugaagg

SEQ ID NO: 1160096 - RNA, 21 nt, Human
ugaagacaaugacuuacugua

SEQ ID NO: 1160097 - RNA, 19 nt, Human
agagcugggugucaagagg

SEQ ID NO: 1160098 - RNA, 12 nt, Human
agaggaaagcaa

SEQ ID NO: 1160099 - RNA, 16 nt, Human
agaggaaagcaaagga

SEQ ID NO: 1160100 - RNA, 18 nt, Human
agaggaaagcaaaggaga

SEQ ID NO: 1160101 - RNA, 19 nt, Human
agaggaaagcaaaggagau

SEQ ID NO: 1160102 - RNA, 11 nt, Human
agaggaaauca

SEQ ID NO: 1160103 - RNA, 12 nt, Human
agaggaaaucac

SEQ ID NO: 1160104 - RNA, 21 nt, Human
agaggaaaucaccgaaaacgu

SEQ ID NO: 1160105 - RNA, 18 nt, Human
agaggcaacugcauuggc

SEQ ID NO: 1160106 - RNA, 14 nt, Human
ucuuuggucuacac

SEQ ID NO: 1160107 - RNA, 21 nt, Human
ucuuuggucuacacugugcug

SEQ ID NO: 1160108 - RNA, 11 nt, Human
ugaacuuugac

SEQ ID NO: 1160109 - RNA, 16 nt, Human
ugaacuuugaccucug

SEQ ID NO: 1160110 - RNA, 17 nt, Human
ugaacuuugaccucugc

SEQ ID NO: 1160111 - RNA, 14 nt, Human
ugaagaagauggua

SEQ ID NO: 1160112 - RNA, 20 nt, Human
ugaagaagcaccaaucauga

SEQ ID NO: 1160113 - RNA, 22 nt, Human
ugaagaagcaccaaucaugaau

SEQ ID NO: 1160114 - RNA, 11 nt, Human
ugaagacaaug

SEQ ID NO: 1160115 - RNA, 13 nt, Human
ugaagacaaugac

SEQ ID NO: 1160116 - RNA, 17 nt, Human
ugaagacaaugacuuac

SEQ ID NO: 1160117 - RNA, 17 nt, Human
agaggcuaugugagcac

SEQ ID NO: 1160118 - RNA, 21 nt, Human
agagggagggagggcuccaga

SEQ ID NO: 1160119 - RNA, 22 nt, Human
agagggagggagggcuccagac

SEQ ID NO: 1160120 - RNA, 15 nt, Human
agagggagguaagga

SEQ ID NO: 1160121 - RNA, 18 nt, Human
ugaagauguagaggagaa

SEQ ID NO: 1160122 - RNA, 14 nt, Human
ugaaugucagugug

SEQ ID NO: 1160123 - RNA, 15 nt, Human
ugaaugucaguguga

SEQ ID NO: 1160124 - RNA, 18 nt, Human
ugaaugucagugugacug

SEQ ID NO: 1160125 - RNA, 20 nt, Human
agagucucacuguugcccag

SEQ ID NO: 1160126 - RNA, 22 nt, Human
agagucucacuguugcccaggc

SEQ ID NO: 1160127 - RNA, 22 nt, Human
agagugaacaaauuuacagaga

SEQ ID NO: 1160128 - RNA, 15 nt, Human
agagugagacucugu

SEQ ID NO: 1160129 - RNA, 16 nt, Human
agagugagacucuguc

SEQ ID NO: 1160130 - RNA, 18 nt, Human
agauaauacaccacuaca

SEQ ID NO: 1160131 - RNA, 19 nt, Human
agauaaggguaucugguga

SEQ ID NO: 1160132 - RNA, 19 nt, Human
agagugagacucugucuca

SEQ ID NO: 1160133 - RNA, 19 nt, Human
agauacaggaaaagcugcu

SEQ ID NO: 1160134 - RNA, 19 nt, Human
agaucaaccccuucgcucc

SEQ ID NO: 1160135 - RNA, 21 nt, Human
agaucaaccccuucgcuccug

SEQ ID NO: 1160136 - RNA, 14 nt, Human
ugaccucugccuga

SEQ ID NO: 1160137 - RNA, 12 nt, Human
ugaccugaggcc

SEQ ID NO: 1160138 - RNA, 12 nt, Human
ugacccaugcug

SEQ ID NO: 1160139 - RNA, 23 nt, Human
agaugcuagaacucccuuucaac

SEQ ID NO: 1160140 - RNA, 18 nt, Human
agaugcuucucacugcca

SEQ ID NO: 1160141 - RNA, 14 nt, Human
ugaccugaggcccu

SEQ ID NO: 1160142 - RNA, 15 nt, Human
ugaccugaggcccuu

SEQ ID NO: 1160143 - RNA, 17 nt, Human
ugaccugaggcccuucu

SEQ ID NO: 1160144 - RNA, 17 nt, Human
ugacuccagaauuuccc

SEQ ID NO: 1160145 - RNA, 19 nt, Human
ugacuccagaauuucccaa

SEQ ID NO: 1160146 - RNA, 20 nt, Human
ugacuccagaauuucccaaa

SEQ ID NO: 1160147 - RNA, 23 nt, Human
ugacuccagaauuucccaaagca

SEQ ID NO: 1160148 - RNA, 15 nt, Human
ugacuguuuccauca

SEQ ID NO: 1160149 - RNA, 21 nt, Human
ugacuguuuucucuugagagg

SEQ ID NO: 1160150 - RNA, 16 nt, Human
agauugugccccugca

SEQ ID NO: 1160151 - RNA, 21 nt, Human
agauugugccccugcacucca

SEQ ID NO: 1160152 - RNA, 16 nt, Human
agauuuaccacuugug

SEQ ID NO: 1160153 - RNA, 13 nt, Human
agauuucacucuc

SEQ ID NO: 1160154 - RNA, 14 nt, Human
agauuucacucucc

SEQ ID NO: 1160155 - RNA, 17 nt, Human
agauuucacucuccuug

SEQ ID NO: 1160156 - RNA, 14 nt, Human
agauuuuccugaaa

SEQ ID NO: 1160157 - RNA, 15 nt, Human
ugagcaauccugcaa

SEQ ID NO: 1160158 - RNA, 20 nt, Human
ugagcacuaaggugugcucu

SEQ ID NO: 1160159 - RNA, 21 nt, Human
ugagcacuaaggugugcucug

SEQ ID NO: 1160160 - RNA, 22 nt, Human
ugagcacuaaggugugcucuga

SEQ ID NO: 1160161 - RNA, 23 nt, Human
ugagcacuaaggugugcucugau

SEQ ID NO: 1160162 - RNA, 22 nt, Human
ugagcaucaggccaggcccucu

SEQ ID NO: 1160163 - RNA, 24 nt, Human
ugagcaucaggccaggcccucugc

SEQ ID NO: 1160164 - RNA, 21 nt, Human
ugagccacugcaccgggccac

SEQ ID NO: 1160165 - RNA, 23 nt, Human
ugagccacugcaccgggccacag

SEQ ID NO: 1160166 - RNA, 13 nt, Human
ugagccagauuuc

SEQ ID NO: 1160167 - RNA, 14 nt, Human
ugagccagauuuca

SEQ ID NO: 1160168 - RNA, 16 nt, Human
ugagccagauuucacu

SEQ ID NO: 1160169 - RNA, 14 nt, Human
agcaagugagagcu

SEQ ID NO: 1160170 - RNA, 22 nt, Human
agcaagugagagcuggguguca

SEQ ID NO: 1160171 - RNA, 17 nt, Human
ugagccagauuucacuc

SEQ ID NO: 1160172 - RNA, 22 nt, Human
ugagccagauuucacucuccuu

SEQ ID NO: 1160173 - RNA, 18 nt, Human
ugagccagauuucacucu

SEQ ID NO: 1160174 - RNA, 20 nt, Human
agcaagugagacccugucuc

SEQ ID NO: 1160175 - RNA, 13 nt, Human
agcaagugagagc

SEQ ID NO: 1160176 - RNA, 22 nt, Human
agcacagccucuuagaugcagu

SEQ ID NO: 1160177 - RNA, 16 nt, Human
agcacagcuucauuuc

SEQ ID NO: 1160178 - RNA, 13 nt, Human
agcacaugccucu

SEQ ID NO: 1160179 - RNA, 14 nt, Human
agcacaugccucuc

SEQ ID NO: 1160180 - RNA, 16 nt, Human
agcacaugccucucuc

SEQ ID NO: 1160181 - RNA, 16 nt, Human
agcaccaaucaugaau

SEQ ID NO: 1160182 - RNA, 19 nt, Human
agcaccuuagacagucccu

SEQ ID NO: 1160183 - RNA, 20 nt, Human
agcaccuuagacagucccug

SEQ ID NO: 1160184 - RNA, 21 nt, Human
agcaccuuagacagucccugc

SEQ ID NO: 1160185 - RNA, 22 nt, Human
agcaccuuagacagucccugcc

SEQ ID NO: 1160186 - RNA, 23 nt, Human
agcaccuuagacagucccugcca

SEQ ID NO: 1160187 - RNA, 13 nt, Human
agcacgauuucug

SEQ ID NO: 1160188 - RNA, 14 nt, Human
agcacgauuucugu

SEQ ID NO: 1160189 - RNA, 15 nt, Human
agcacgauuucuguu

SEQ ID NO: 1160190 - RNA, 16 nt, Human
agcacgauuucuguuu

SEQ ID NO: 1160191 - RNA, 17 nt, Human
agcacgauuucuguuua

SEQ ID NO: 1160192 - RNA, 22 nt, Human
agcacuuugggaggccaaggug

SEQ ID NO: 1160193 - RNA, 23 nt, Human
agcacuuugggaggccaaggugg

SEQ ID NO: 1160194 - RNA, 12 nt, Human
agcagaaaugcc

SEQ ID NO: 1160195 - RNA, 13 nt, Human
agcagaaaugccu

SEQ ID NO: 1160196 - RNA, 19 nt, Human
agcagaaaugccuuacccu

SEQ ID NO: 1160197 - RNA, 14 nt, Human
agcagaacagugau

SEQ ID NO: 1160198 - RNA, 21 nt, Human
agcagagaaugaaagggccca

SEQ ID NO: 1160199 - RNA, 22 nt, Human
agcagagaaugaaagggcccag

SEQ ID NO: 1160200 - RNA, 23 nt, Human
agcagagaaugaaagggcccaga

SEQ ID NO: 1160201 - RNA, 14 nt, Human
agcagagaauucuc

SEQ ID NO: 1160202 - RNA, 21 nt, Human
agcagagaauucucuuaucca

SEQ ID NO: 1160203 - RNA, 15 nt, Human
agcagagaccauccc

SEQ ID NO: 1160204 - RNA, 16 nt, Human
agcagagaccaucccu

SEQ ID NO: 1160205 - RNA, 17 nt, Human
agcagagaccaucccug

SEQ ID NO: 1160206 - RNA, 11 nt, Human
ugagccuggca

SEQ ID NO: 1160207 - RNA, 16 nt, Human
ugagccuggcaagaau

SEQ ID NO: 1160208 - RNA, 14 nt, Human
ugagccugggaggu

SEQ ID NO: 1160209 - RNA, 19 nt, Human
ugagccugggaggucaagg

SEQ ID NO: 1160210 - RNA, 22 nt, Human
ugagccugggaggucaaggcug

SEQ ID NO: 1160211 - RNA, 14 nt, Human
ugagccuugaacuu

SEQ ID NO: 1160212 - RNA, 15 nt, Human
ugagccuugaacuuu

SEQ ID NO: 1160213 - RNA, 17 nt, Human
ugagccuugaacuuuga

SEQ ID NO: 1160214 - RNA, 18 nt, Human
ugagccuugaacuuugac

SEQ ID NO: 1160215 - RNA, 19 nt, Human
ugagccuugaacuuugacc

SEQ ID NO: 1160216 - RNA, 13 nt, Human
ugagcgacaguga

SEQ ID NO: 1160217 - RNA, 14 nt, Human
ugagcgacagugag

SEQ ID NO: 1160218 - RNA, 16 nt, Human
ugagcgacagugagac

SEQ ID NO: 1160219 - RNA, 20 nt, Human
ugagcgacagugagacucug

SEQ ID NO: 1160220 - RNA, 19 nt, Human
ugagggauacccaucccau

SEQ ID NO: 1160221 - RNA, 16 nt, Human
ugaggcccuucucucc

SEQ ID NO: 1160222 - RNA, 18 nt, Human
ugaggcccuucucuccag

SEQ ID NO: 1160223 - RNA, 19 nt, Human
ugaggcccuucucuccagc

SEQ ID NO: 1160224 - RNA, 20 nt, Human
ugaggcccuucucuccagcc

SEQ ID NO: 1160225 - RNA, 22 nt, Human
ugaggcccuucucuccagcccc

SEQ ID NO: 1160226 - RNA, 23 nt, Human
ugaggcccuucucuccagccccu

SEQ ID NO: 1160227 - RNA, 24 nt, Human
ugaggcccuucucuccagccccug

SEQ ID NO: 1160228 - RNA, 12 nt, Human
ugaggggccucu

SEQ ID NO: 1160229 - RNA, 13 nt, Human
ugaggggccucuu

SEQ ID NO: 1160230 - RNA, 20 nt, Human
agcagagaccaucccugaag

SEQ ID NO: 1160231 - RNA, 20 nt, Human
agcagagcaccuuagacagu

SEQ ID NO: 1160232 - RNA, 17 nt, Human
ugaggucagagccugca

SEQ ID NO: 1160233 - RNA, 18 nt, Human
agcagagaccaucccuga

SEQ ID NO: 1160234 - RNA, 19 nt, Human
agcagagaccaucccugaa

SEQ ID NO: 1160235 - RNA, 20 nt, Human
ugaggguugggcugguguca

SEQ ID NO: 1160236 - RNA, 17 nt, Human
ugagguacugagaguga

SEQ ID NO: 1160237 - RNA, 22 nt, Human
ugagguacugagagugaacaaa

SEQ ID NO: 1160238 - RNA, 13 nt, Human
ugaggucagagcc

SEQ ID NO: 1160239 - RNA, 14 nt, Human
ugaggucagagccu

SEQ ID NO: 1160240 - RNA, 16 nt, Human
ugaggucagagccugc

SEQ ID NO: 1160241 - RNA, 17 nt, Human
agcagaggaaggagagg

SEQ ID NO: 1160242 - RNA, 19 nt, Human
agcagauggagaccccuug

SEQ ID NO: 1160243 - RNA, 15 nt, Human
ugaggaagcaaaagc

SEQ ID NO: 1160244 - RNA, 22 nt, Human
ugaggaagcaaaagcaucuaug

SEQ ID NO: 1160245 - RNA, 14 nt, Human
ugaggaagccgcug

SEQ ID NO: 1160246 - RNA, 17 nt, Human
ugaggaagccgcugggg

SEQ ID NO: 1160247 - RNA, 18 nt, Human
ugaggaagccgcuggggc

SEQ ID NO: 1160248 - RNA, 19 nt, Human
ugaggaagccgcuggggcc

SEQ ID NO: 1160249 - RNA, 21 nt, Human
ugaggaagccgcuggggccag

SEQ ID NO: 1160250 - RNA, 16 nt, Human
ugagcuacaaaugcau

SEQ ID NO: 1160251 - RNA, 14 nt, Human
ugagcuacaaaugc

SEQ ID NO: 1160252 - RNA, 13 nt, Human
ugagcuacaaaug

SEQ ID NO: 1160253 - RNA, 21 nt, Human
ugaggaauccagacccggcug

SEQ ID NO: 1160254 - RNA, 22 nt, Human
ugaggaauccagacccggcugc

SEQ ID NO: 1160255 - RNA, 21 nt, Human
ugaggacacuaaccacgcugg

SEQ ID NO: 1160256 - RNA, 15 nt, Human
ugaggacacugauau

SEQ ID NO: 1160257 - RNA, 12 nt, Human
ugaggccagaga

SEQ ID NO: 1160258 - RNA, 14 nt, Human
ugaggccagagaca

SEQ ID NO: 1160259 - RNA, 16 nt, Human
ugaggccagagacaca

SEQ ID NO: 1160260 - RNA, 20 nt, Human
ugaggccagagacacaagcc

SEQ ID NO: 1160261 - RNA, 12 nt, Human
ugaggcccagag

SEQ ID NO: 1160262 - RNA, 13 nt, Human
ugaggcccagagg

SEQ ID NO: 1160263 - RNA, 15 nt, Human
ugaggcccagagggc

SEQ ID NO: 1160264 - RNA, 17 nt, Human
ugaggcccagagggccu

SEQ ID NO: 1160265 - RNA, 18 nt, Human
ugaggcccagagggccug

SEQ ID NO: 1160266 - RNA, 20 nt, Human
ugaggcccagagggccugca

SEQ ID NO: 1160267 - RNA, 21 nt, Human
ugaggcccagagggccugcaa

SEQ ID NO: 1160268 - RNA, 22 nt, Human
ugaggcccagagggccugcaag

SEQ ID NO: 1160269 - RNA, 23 nt, Human
ugaggcccagagggccugcaagg

SEQ ID NO: 1160270 - RNA, 22 nt, Human
ugcagacucuacagaggccaug

SEQ ID NO: 1160271 - RNA, 19 nt, Human
ugcagacucuacagaggcc

SEQ ID NO: 1160272 - RNA, 20 nt, Human
ugcagacucuacagaggcca

SEQ ID NO: 1160273 - RNA, 15 nt, Human
ugcacuccccugcug

SEQ ID NO: 1160274 - RNA, 18 nt, Human
agcccuucuuuccacaga

SEQ ID NO: 1160275 - RNA, 19 nt, Human
agcccuucuuuccacagaa

SEQ ID NO: 1160276 - RNA, 15 nt, Human
agccuaggugacaga

SEQ ID NO: 1160277 - RNA, 17 nt, Human
agccuaggugacagagu

SEQ ID NO: 1160278 - RNA, 15 nt, Human
agccucaaccuccug

SEQ ID NO: 1160279 - RNA, 15 nt, Human
ugcacaagcuccaag

SEQ ID NO: 1160280 - RNA, 16 nt, Human
ugcacaagcuccaagc

SEQ ID NO: 1160281 - RNA, 18 nt, Human
ugcacaagcuccaagcuc

SEQ ID NO: 1160282 - RNA, 20 nt, Human
ugcacaagcuccaagcuccc

SEQ ID NO: 1160283 - RNA, 22 nt, Human
ugcacaagcuccaagcucccag

SEQ ID NO: 1160284 - RNA, 23 nt, Human
ugcacaagcuccaagcucccagg

SEQ ID NO: 1160285 - RNA, 14 nt, Human
ugcacaagcugcac

SEQ ID NO: 1160286 - RNA, 15 nt, Human
ugcacacaccagagc

SEQ ID NO: 1160287 - RNA, 17 nt, Human
ugcacacaccagagccc

SEQ ID NO: 1160288 - RNA, 14 nt, Human
ugcaccacugcacu

SEQ ID NO: 1160289 - RNA, 15 nt, Human
ugcaccacugcacuc

SEQ ID NO: 1160290 - RNA, 22 nt, Human
ugcacuauagccuaggugacag

SEQ ID NO: 1160291 - RNA, 12 nt, Human
ugcacuccccug

SEQ ID NO: 1160292 - RNA, 13 nt, Human
ugcacuccccugc

SEQ ID NO: 1160293 - RNA, 19 nt, Human
ugcagugagccgagauugu

SEQ ID NO: 1160294 - RNA, 14 nt, Human
ugcagugagccgag

SEQ ID NO: 1160295 - RNA, 17 nt, Human
agccucaaccuccuggg

SEQ ID NO: 1160296 - RNA, 18 nt, Human
agccucaaccuccugggc

SEQ ID NO: 1160297 - RNA, 13 nt, Human
agccucagcaucc

SEQ ID NO: 1160298 - RNA, 14 nt, Human
agccucagcauccu

SEQ ID NO: 1160299 - RNA, 15 nt, Human
agccucagcauccug

SEQ ID NO: 1160300 - RNA, 16 nt, Human
agccucagcauccugg

SEQ ID NO: 1160301 - RNA, 19 nt, Human
agccucaaccuccugggcu

SEQ ID NO: 1160302 - RNA, 18 nt, Human
agccugagcgacagugag

SEQ ID NO: 1160303 - RNA, 19 nt, Human
agccugagcgacagugaga

SEQ ID NO: 1160304 - RNA, 18 nt, Human
ugcagccucaaccuccug

SEQ ID NO: 1160305 - RNA, 19 nt, Human
ugcagccucaaccuccugg

SEQ ID NO: 1160306 - RNA, 20 nt, Human
ugcagccucaaccuccuggg

SEQ ID NO: 1160307 - RNA, 16 nt, Human
ugcaugcugucccuua

SEQ ID NO: 1160308 - RNA, 16 nt, Human
agccugccucuucucu

SEQ ID NO: 1160309 - RNA, 19 nt, Human
agccugccucuucucuacu

SEQ ID NO: 1160310 - RNA, 23 nt, Human
agccugcaguuauuaacacuaac

SEQ ID NO: 1160311 - RNA, 13 nt, Human
ugcauacacacac

SEQ ID NO: 1160312 - RNA, 13 nt, Human
ugcauacucauua

SEQ ID NO: 1160313 - RNA, 9 nt, Human
ugcauacac

SEQ ID NO: 1160314 - RNA, 10 nt, Human
ugcauacaca

SEQ ID NO: 1160315 - RNA, 11 nt, Human
ugcauacacac

SEQ ID NO: 1160316 - RNA, 22 nt, Human
ugcauaccacuuuuguucuugg

SEQ ID NO: 1160317 - RNA, 12 nt, Human
ugcauacacaca

SEQ ID NO: 1160318 - RNA, 22 nt, Human
ugcaugaaguaauaugcacaca

SEQ ID NO: 1160319 - RNA, 21 nt, Human
ugcaugaggcuaguguggugu

SEQ ID NO: 1160320 - RNA, 13 nt, Human
ugcaugcuguccc

SEQ ID NO: 1160321 - RNA, 14 nt, Human
ugcaugcugucccu

SEQ ID NO: 1160322 - RNA, 15 nt, Human
ugcaugcugucccuu

SEQ ID NO: 1160323 - RNA, 14 nt, Human
agccugcuccagcu

SEQ ID NO: 1160324 - RNA, 14 nt, Human
agcgcccaguuggg

SEQ ID NO: 1160325 - RNA, 22 nt, Human
agcgcccaguuggguggaugcc

SEQ ID NO: 1160326 - RNA, 19 nt, Human
ugcauuugaaaauuuugau

SEQ ID NO: 1160327 - RNA, 23 nt, Human
ugcauuugaaaauuuugauguuu

SEQ ID NO: 1160328 - RNA, 18 nt, Human
ugcauuugaggucuguuc

SEQ ID NO: 1160329 - RNA, 16 nt, Human
ugccagucaccccggc

SEQ ID NO: 1160330 - RNA, 18 nt, Human
ugccagucaccccggcca

SEQ ID NO: 1160331 - RNA, 20 nt, Human
ugccagucaccccggccacc

SEQ ID NO: 1160332 - RNA, 22 nt, Human
ugccagucaccccggccaccug

SEQ ID NO: 1160333 - RNA, 23 nt, Human
ugccagucaccccggccaccugc

SEQ ID NO: 1160334 - RNA, 15 nt, Human
ugccauauucuguug

SEQ ID NO: 1160335 - RNA, 16 nt, Human
ugccauauucuguugg

SEQ ID NO: 1160336 - RNA, 17 nt, Human
ugccauauucuguuggc

SEQ ID NO: 1160337 - RNA, 20 nt, Human
ugccauauucuguuggccag

SEQ ID NO: 1160338 - RNA, 21 nt, Human
ugccauauucuguuggccagu

SEQ ID NO: 1160339 - RNA, 15 nt, Human
agcggggacagcucc

SEQ ID NO: 1160340 - RNA, 16 nt, Human
agcggggacagcuccu

SEQ ID NO: 1160341 - RNA, 17 nt, Human
agcggggacagcuccuu

SEQ ID NO: 1160342 - RNA, 15 nt, Human
agcgugagccacugc

SEQ ID NO: 1160343 - RNA, 16 nt, Human
agcgugagccacugca

SEQ ID NO: 1160344 - RNA, 17 nt, Human
agcgugagccacugcac

SEQ ID NO: 1160345 - RNA, 20 nt, Human
agcgugguggacaugcacag

SEQ ID NO: 1160346 - RNA, 23 nt, Human
agcgugguggacaugcacagcua

SEQ ID NO: 1160347 - RNA, 20 nt, Human
ugccauguuggccaggcugg

SEQ ID NO: 1160348 - RNA, 21 nt, Human
ugccauguuggccaggcuggu

SEQ ID NO: 1160349 - RNA, 18 nt, Human
agcucagggccuggcuca

SEQ ID NO: 1160350 - RNA, 15 nt, Human
agcucagggccuggc

SEQ ID NO: 1160351 - RNA, 16 nt, Human
agcucagggccuggcu

SEQ ID NO: 1160352 - RNA, 17 nt, Human
agcucagggccuggcuc

SEQ ID NO: 1160353 - RNA, 17 nt, Human
ugccauguuggccaggc

SEQ ID NO: 1160354 - RNA, 18 nt, Human
ugccauguuggccaggcu

SEQ ID NO: 1160355 - RNA, 19 nt, Human
ugccauguuggccaggcug

SEQ ID NO: 1160356 - RNA, 19 nt, Human
agcuauggugucauaggcu

SEQ ID NO: 1160357 - RNA, 12 nt, Human
ugcccaggcccc

SEQ ID NO: 1160358 - RNA, 16 nt, Human
ugcccacaggaucagu

SEQ ID NO: 1160359 - RNA, 14 nt, Human
ugcccaggccccug

SEQ ID NO: 1160360 - RNA, 20 nt, Human
ugcccaggccccugccaccc

SEQ ID NO: 1160361 - RNA, 22 nt, Human
ugcccaggccccugccacccug

SEQ ID NO: 1160362 - RNA, 14 nt, Human
ugcccacaggauca

SEQ ID NO: 1160363 - RNA, 15 nt, Human
ugcccaggcaggucu

SEQ ID NO: 1160364 - RNA, 16 nt, Human
ugcccaggcaggucuu

SEQ ID NO: 1160365 - RNA, 17 nt, Human
ugcccaggcaggucuug

SEQ ID NO: 1160366 - RNA, 20 nt, Human
ugcccaggcaggucuugaac

SEQ ID NO: 1160367 - RNA, 11 nt, Human
ugcccaggccc

SEQ ID NO: 1160368 - RNA, 19 nt, Human
ugccccucaacucuccucc

SEQ ID NO: 1160369 - RNA, 19 nt, Human
ugcccuccaagaccuucuc

SEQ ID NO: 1160370 - RNA, 20 nt, Human
ugcccuccaagaccuucucc

SEQ ID NO: 1160371 - RNA, 22 nt, Human
ugcccuccaagaccuucuccuu

SEQ ID NO: 1160372 - RNA, 16 nt, Human
agcucucuccucccuu

SEQ ID NO: 1160373 - RNA, 12 nt, Human
agcucugcuccu

SEQ ID NO: 1160374 - RNA, 22 nt, Human
agcucugcuccucuccccagca

SEQ ID NO: 1160375 - RNA, 12 nt, Human
agcucuguccug

SEQ ID NO: 1160376 - RNA, 14 nt, Human
agcucuguccuggg

SEQ ID NO: 1160377 - RNA, 18 nt, Human
agcucuucuccaggcugu

SEQ ID NO: 1160378 - RNA, 13 nt, Human
agcugcacccuca

SEQ ID NO: 1160379 - RNA, 17 nt, Human
agcugcacccucaggca

SEQ ID NO: 1160380 - RNA, 18 nt, Human
agcugcacccucaggcag

SEQ ID NO: 1160381 - RNA, 19 nt, Human
agcugcacccucaggcagg

SEQ ID NO: 1160382 - RNA, 20 nt, Human
agcugcacccucaggcaggu

SEQ ID NO: 1160383 - RNA, 22 nt, Human
agcugcacccucaggcaggugg

SEQ ID NO: 1160384 - RNA, 13 nt, Human
agcugccaccugc

SEQ ID NO: 1160385 - RNA, 14 nt, Human
agcugccagccgag

SEQ ID NO: 1160386 - RNA, 13 nt, Human
ugccucccaucac

SEQ ID NO: 1160387 - RNA, 14 nt, Human
ugccucccaucacc

SEQ ID NO: 1160388 - RNA, 19 nt, Human
ugccucccaucacccgcua

SEQ ID NO: 1160389 - RNA, 13 nt, Human
ugccucucucagg

SEQ ID NO: 1160390 - RNA, 14 nt, Human
ugccucucucaggc

SEQ ID NO: 1160391 - RNA, 15 nt, Human
ugccucucucaggcc

SEQ ID NO: 1160392 - RNA, 16 nt, Human
ugccucucucaggcca

SEQ ID NO: 1160393 - RNA, 20 nt, Human
ugccucugacacacagcucu

SEQ ID NO: 1160394 - RNA, 21 nt, Human
ugccucugacacacagcucug

SEQ ID NO: 1160395 - RNA, 23 nt, Human
agcugggaugauuggagggggga

SEQ ID NO: 1160396 - RNA, 19 nt, Human
agcugggacuacaggugug

SEQ ID NO: 1160397 - RNA, 14 nt, Human
agcugggcagguug

SEQ ID NO: 1160398 - RNA, 22 nt, Human
ugccucugacacacagcucugu

SEQ ID NO: 1160399 - RNA, 13 nt, Human
agcugccugggau

SEQ ID NO: 1160400 - RNA, 19 nt, Human
agcugccugggaucccuca

SEQ ID NO: 1160401 - RNA, 21 nt, Human
agcugccugggaucccucauc

SEQ ID NO: 1160402 - RNA, 10 nt, Human
agcugccugu

SEQ ID NO: 1160403 - RNA, 15 nt, Human
ugccuguucagcucc

SEQ ID NO: 1160404 - RNA, 16 nt, Human
ugccuguucagcucca

SEQ ID NO: 1160405 - RNA, 17 nt, Human
ugccuguucagcuccag

SEQ ID NO: 1160406 - RNA, 13 nt, Human
ugcgaaaggauga

SEQ ID NO: 1160407 - RNA, 19 nt, Human
ugcgaaaggaugaaaguga

SEQ ID NO: 1160408 - RNA, 18 nt, Human
ugcggacagccacggcca

SEQ ID NO: 1160409 - RNA, 16 nt, Human
ugcuaguaauuggaaa

SEQ ID NO: 1160410 - RNA, 16 nt, Human
aggaaagaggcucugg

SEQ ID NO: 1160411 - RNA, 17 nt, Human
aggaaagcaaaggagau

SEQ ID NO: 1160412 - RNA, 19 nt, Human
aggaaagcaaaggagauug

SEQ ID NO: 1160413 - RNA, 13 nt, Human
aggaaagagaacu

SEQ ID NO: 1160414 - RNA, 19 nt, Human
aggaaagagaacuuccaga

SEQ ID NO: 1160415 - RNA, 12 nt, Human
aggaaagaggcu

SEQ ID NO: 1160416 - RNA, 13 nt, Human
aggaaagaggcuc

SEQ ID NO: 1160417 - RNA, 12 nt, Human
agcuuugaaaau

SEQ ID NO: 1160418 - RNA, 16 nt, Human
agcuuugaaaauucag

SEQ ID NO: 1160419 - RNA, 18 nt, Human
agcuuugaaaauucagug

SEQ ID NO: 1160420 - RNA, 19 nt, Human
agcuuugaaaauucagugg

SEQ ID NO: 1160421 - RNA, 15 nt, Human
aggaaacccagcucu

SEQ ID NO: 1160422 - RNA, 16 nt, Human
aggaaacccagcucug

SEQ ID NO: 1160423 - RNA, 17 nt, Human
aggaaacccagcucugg

SEQ ID NO: 1160424 - RNA, 18 nt, Human
aggaaacccagcucuggu

SEQ ID NO: 1160425 - RNA, 20 nt, Human
aggaaacccagcucuggucc

SEQ ID NO: 1160426 - RNA, 21 nt, Human
aggaaacccagcucuggucca

SEQ ID NO: 1160427 - RNA, 21 nt, Human
agcuuauugucuagugaaacu

SEQ ID NO: 1160428 - RNA, 19 nt, Human
agcuuguaaauagcucagg

SEQ ID NO: 1160429 - RNA, 20 nt, Human
agcuuguaaauagcucaggu

SEQ ID NO: 1160430 - RNA, 21 nt, Human
agcuuguaaauagcucaggug

SEQ ID NO: 1160431 - RNA, 20 nt, Human
ugcggacagccacggccagg

SEQ ID NO: 1160432 - RNA, 21 nt, Human
ugcggacagccacggccaggc

SEQ ID NO: 1160433 - RNA, 20 nt, Human
agcuuaaaggggcuagagug

SEQ ID NO: 1160434 - RNA, 12 nt, Human
agcuuaucucag

SEQ ID NO: 1160435 - RNA, 14 nt, Human
agcuuaucucaggg

SEQ ID NO: 1160436 - RNA, 15 nt, Human
agcuuaucucagggg

SEQ ID NO: 1160437 - RNA, 22 nt, Human
ugcucugaucauccacugugcc

SEQ ID NO: 1160438 - RNA, 17 nt, Human
ugcugacuguuuucucu

SEQ ID NO: 1160439 - RNA, 15 nt, Human
ugcucugcauguuac

SEQ ID NO: 1160440 - RNA, 18 nt, Human
ugcucugcauguuacaua

SEQ ID NO: 1160441 - RNA, 14 nt, Human
ugcugagucugaag

SEQ ID NO: 1160442 - RNA, 21 nt, Human
ugcugacuguuuucucuugag

SEQ ID NO: 1160443 - RNA, 24 nt, Human
ugcugacuguuuucucuugagagg

SEQ ID NO: 1160444 - RNA, 18 nt, Human
aggaaaggcuccaggagc

SEQ ID NO: 1160445 - RNA, 20 nt, Human
aggaaaggcuccaggagcag

SEQ ID NO: 1160446 - RNA, 22 nt, Human
aggaaaggcuccaggagcagcc

SEQ ID NO: 1160447 - RNA, 23 nt, Human
aggaaaggcuccaggagcagcca

SEQ ID NO: 1160448 - RNA, 14 nt, Human
aggaaauauuuauu

SEQ ID NO: 1160449 - RNA, 18 nt, Human
aggaaauauuuauuuuaa

SEQ ID NO: 1160450 - RNA, 11 nt, Human
ugcugccaucc

SEQ ID NO: 1160451 - RNA, 21 nt, Human
ugcugccauccagguucagcu

SEQ ID NO: 1160452 - RNA, 22 nt, Human
ugcugccauccagguucagcuu

SEQ ID NO: 1160453 - RNA, 12 nt, Human
ugcugccaucca

SEQ ID NO: 1160454 - RNA, 13 nt, Human
ugcugccauccag

SEQ ID NO: 1160455 - RNA, 14 nt, Human
ugcugccauccagg

SEQ ID NO: 1160456 - RNA, 15 nt, Human
ugcugccauccaggu

SEQ ID NO: 1160457 - RNA, 15 nt, Human
aggaagacuuuggaa

SEQ ID NO: 1160458 - RNA, 14 nt, Human
aggaagagaaaaaa

SEQ ID NO: 1160459 - RNA, 17 nt, Human
aggaagcucagggccug

SEQ ID NO: 1160460 - RNA, 18 nt, Human
aggaagcucagggccugg

SEQ ID NO: 1160461 - RNA, 22 nt, Human
aggaagcucagggccuggcuca

SEQ ID NO: 1160462 - RNA, 23 nt, Human
aggaauccagacccggcugcgug

SEQ ID NO: 1160463 - RNA, 19 nt, Human
aggaauugacccacaagaa

SEQ ID NO: 1160464 - RNA, 23 nt, Human
aggaauugacccacaagaaauga

SEQ ID NO: 1160465 - RNA, 14 nt, Human
aggcaagcaccucc

SEQ ID NO: 1160466 - RNA, 17 nt, Human
aggcaagcaccuccugc

SEQ ID NO: 1160467 - RNA, 12 nt, Human
aggaucagucug

SEQ ID NO: 1160468 - RNA, 21 nt, Human
aggauccugagccagauuuca

SEQ ID NO: 1160469 - RNA, 12 nt, Human
aggaucucuuga

SEQ ID NO: 1160470 - RNA, 15 nt, Human
aggaugcuuguacau

SEQ ID NO: 1160471 - RNA, 16 nt, Human
aggaugcuuguacaua

SEQ ID NO: 1160472 - RNA, 18 nt, Human
aggaugcuuguacauaau

SEQ ID NO: 1160473 - RNA, 10 nt, Human
ugcugcccug

SEQ ID NO: 1160474 - RNA, 12 nt, Human
ugcugcccugcc

SEQ ID NO: 1160475 - RNA, 12 nt, Human
uggaacacucug

SEQ ID NO: 1160476 - RNA, 14 nt, Human
uggaacacucugag

SEQ ID NO: 1160477 - RNA, 13 nt, Human
uggaagcuccgcu

SEQ ID NO: 1160478 - RNA, 20 nt, Human
uggaaguacuauaauuuacc

SEQ ID NO: 1160479 - RNA, 15 nt, Human
aggaggccagccuug

SEQ ID NO: 1160480 - RNA, 21 nt, Human
aggaguuugagaccaaccugg

SEQ ID NO: 1160481 - RNA, 15 nt, Human
aggcaaugcuggcug

SEQ ID NO: 1160482 - RNA, 16 nt, Human
aggcaaugcuggcugu

SEQ ID NO: 1160483 - RNA, 22 nt, Human
uggacuuuguuaguuucuccaa

SEQ ID NO: 1160484 - RNA, 24 nt, Human
uggacuuuguuaguuucuccaagc

SEQ ID NO: 1160485 - RNA, 14 nt, Human
uggagaaaauggac

SEQ ID NO: 1160486 - RNA, 16 nt, Human
uggagaagaacugaaa

SEQ ID NO: 1160487 - RNA, 12 nt, Human
aggcaggauggc

SEQ ID NO: 1160488 - RNA, 15 nt, Human
aggcacccaccauca

SEQ ID NO: 1160489 - RNA, 20 nt, Human
aggcagccccauucugccug

SEQ ID NO: 1160490 - RNA, 21 nt, Human
aggcagccccauucugccugc

SEQ ID NO: 1160491 - RNA, 22 nt, Human
aggcagccccauucugccugcc

SEQ ID NO: 1160492 - RNA, 20 nt, Human
aggcagcucuaaaugucaau

SEQ ID NO: 1160493 - RNA, 19 nt, Human
aggcagggucucacucugu

SEQ ID NO: 1160494 - RNA, 20 nt, Human
aggcagggucucacucuguc

SEQ ID NO: 1160495 - RNA, 21 nt, Human
aggcagggucucacucugucg

SEQ ID NO: 1160496 - RNA, 22 nt, Human
aggcagggucucacucugucgc

SEQ ID NO: 1160497 - RNA, 14 nt, Human
aggcagguccaggg

SEQ ID NO: 1160498 - RNA, 21 nt, Human
aggcaggucuugaacuccugg

SEQ ID NO: 1160499 - RNA, 22 nt, Human
aggcaggucuugaacuccuggc

SEQ ID NO: 1160500 - RNA, 16 nt, Human
uggcaccagcagccug

SEQ ID NO: 1160501 - RNA, 17 nt, Human
uggcaccagcagccugg

SEQ ID NO: 1160502 - RNA, 18 nt, Human
uggcaccagcagccugga

SEQ ID NO: 1160503 - RNA, 14 nt, Human
uggcagcucagaga

SEQ ID NO: 1160504 - RNA, 15 nt, Human
uggcagcucagagag

SEQ ID NO: 1160505 - RNA, 16 nt, Human
uggcagcucagagagg

SEQ ID NO: 1160506 - RNA, 18 nt, Human
uggcagcucagagagggu

SEQ ID NO: 1160507 - RNA, 13 nt, Human
aggccagagacac

SEQ ID NO: 1160508 - RNA, 18 nt, Human
aggccagagacacaagcc

SEQ ID NO: 1160509 - RNA, 23 nt, Human
aggccagagacacaagccuucgg

SEQ ID NO: 1160510 - RNA, 18 nt, Human
aggccaugggccuccugu

SEQ ID NO: 1160511 - RNA, 16 nt, Human
aggcccagagggccug

SEQ ID NO: 1160512 - RNA, 19 nt, Human
aggcccagagggccugcaa

SEQ ID NO: 1160513 - RNA, 20 nt, Human
aggcccagagggccugcaag

SEQ ID NO: 1160514 - RNA, 13 nt, Human
aggccccugccac

SEQ ID NO: 1160515 - RNA, 15 nt, Human
aggccccugccaccc

SEQ ID NO: 1160516 - RNA, 17 nt, Human
aggccccugccacccug

SEQ ID NO: 1160517 - RNA, 18 nt, Human
aggccccugccacccugg

SEQ ID NO: 1160518 - RNA, 21 nt, Human
aggccccugccacccugggga

SEQ ID NO: 1160519 - RNA, 15 nt, Human
aggcccggcuccagg

SEQ ID NO: 1160520 - RNA, 16 nt, Human
aggcccggcuccaggc

SEQ ID NO: 1160521 - RNA, 17 nt, Human
aggcccggcuccaggcu

SEQ ID NO: 1160522 - RNA, 12 nt, Human
aggccuggccag

SEQ ID NO: 1160523 - RNA, 13 nt, Human
aggccuggccaga

SEQ ID NO: 1160524 - RNA, 15 nt, Human
aggccuggccagaug

SEQ ID NO: 1160525 - RNA, 19 nt, Human
uggcccacgcacuucggga

SEQ ID NO: 1160526 - RNA, 13 nt, Human
uggcccacugcau

SEQ ID NO: 1160527 - RNA, 14 nt, Human
uggcccacugcauc

SEQ ID NO: 1160528 - RNA, 20 nt, Human
uggccucugcacuccccugc

SEQ ID NO: 1160529 - RNA, 19 nt, Human
uggccucugcacuccccug

SEQ ID NO: 1160530 - RNA, 13 nt, Human
uggccucuucaga

SEQ ID NO: 1160531 - RNA, 18 nt, Human
aggccuucucugaaggac

SEQ ID NO: 1160532 - RNA, 11 nt, Human
aggcuccacuu

SEQ ID NO: 1160533 - RNA, 17 nt, Human
aggcuccacuuggucug

SEQ ID NO: 1160534 - RNA, 21 nt, Human
aggcuccacuuggucugugag

SEQ ID NO: 1160535 - RNA, 22 nt, Human
aggcuccacuuggucugugaga

SEQ ID NO: 1160536 - RNA, 13 nt, Human
aggcuccaggagc

SEQ ID NO: 1160537 - RNA, 14 nt, Human
aggcuccaggagca

SEQ ID NO: 1160538 - RNA, 16 nt, Human
aggcuccaggagcagc

SEQ ID NO: 1160539 - RNA, 18 nt, Human
uggcuaagcaaaauguga

SEQ ID NO: 1160540 - RNA, 17 nt, Human
aggcuccaggagcagcc

SEQ ID NO: 1160541 - RNA, 18 nt, Human
aggcuccaggagcagcca

SEQ ID NO: 1160542 - RNA, 19 nt, Human
aggcuccaggagcagccac

SEQ ID NO: 1160543 - RNA, 23 nt, Human
aggcuccaggagcagccacauuc

SEQ ID NO: 1160544 - RNA, 17 nt, Human
uggcuaauguacugcau

SEQ ID NO: 1160545 - RNA, 19 nt, Human
uggcuaauguacugcauau

SEQ ID NO: 1160546 - RNA, 22 nt, Human
uggcuagagguucaaagauauu

SEQ ID NO: 1160547 - RNA, 13 nt, Human
uggcucacgccug

SEQ ID NO: 1160548 - RNA, 16 nt, Human
uggcuguuggcugggg

SEQ ID NO: 1160549 - RNA, 18 nt, Human
uggcuguuggcugggggc

SEQ ID NO: 1160550 - RNA, 23 nt, Human
uggcuguuggcugggggccucag

SEQ ID NO: 1160551 - RNA, 14 nt, Human
uggcuucacggaag

SEQ ID NO: 1160552 - RNA, 18 nt, Human
ugggaaacaaaaggauaa

SEQ ID NO: 1160553 - RNA, 21 nt, Human
uggcuuuugugcauuaucuag

SEQ ID NO: 1160554 - RNA, 17 nt, Human
uggcuucacggaagagc

SEQ ID NO: 1160555 - RNA, 20 nt, Human
uggcuucacggaagagccuu

SEQ ID NO: 1160556 - RNA, 22 nt, Human
uggcuucacggaagagccuugc

SEQ ID NO: 1160557 - RNA, 16 nt, Human
uggcuuuugugcauua

SEQ ID NO: 1160558 - RNA, 22 nt, Human
aggcuuagucacugagacagcc

SEQ ID NO: 1160559 - RNA, 23 nt, Human
aggcuuagucacugagacagccc

SEQ ID NO: 1160560 - RNA, 19 nt, Human
aggcugggagagccuucca

SEQ ID NO: 1160561 - RNA, 20 nt, Human
aggcugggagagccuuccag

SEQ ID NO: 1160562 - RNA, 21 nt, Human
aggcugggagagccuuccagg

SEQ ID NO: 1160563 - RNA, 22 nt, Human
aggcugggagagccuuccaggg

SEQ ID NO: 1160564 - RNA, 13 nt, Human
aggcugggcuccc

SEQ ID NO: 1160565 - RNA, 14 nt, Human
aggcugggcucccu

SEQ ID NO: 1160566 - RNA, 18 nt, Human
aggcugggcucccuuccc

SEQ ID NO: 1160567 - RNA, 21 nt, Human
aggcugggcucccuucccacc

SEQ ID NO: 1160568 - RNA, 23 nt, Human
aggcugggcucccuucccaccuc

SEQ ID NO: 1160569 - RNA, 14 nt, Human
aggcugggcuucag

SEQ ID NO: 1160570 - RNA, 18 nt, Human
aggcugggcuucaguggc

SEQ ID NO: 1160571 - RNA, 19 nt, Human
aggcugggcuucaguggca

SEQ ID NO: 1160572 - RNA, 20 nt, Human
aggcugggcuucaguggcag

SEQ ID NO: 1160573 - RNA, 21 nt, Human
aggcugggcuucaguggcagc

SEQ ID NO: 1160574 - RNA, 22 nt, Human
aggcugggcuucaguggcagcu

SEQ ID NO: 1160575 - RNA, 23 nt, Human
aggcugggcuucaguggcagcug

SEQ ID NO: 1160576 - RNA, 17 nt, Human
aggcugggggaagaagc

SEQ ID NO: 1160577 - RNA, 22 nt, Human
aggcugggggaagaagcucucu

SEQ ID NO: 1160578 - RNA, 14 nt, Human
aggcuggguucuga

SEQ ID NO: 1160579 - RNA, 17 nt, Human
aggcuggguucugaucc

SEQ ID NO: 1160580 - RNA, 18 nt, Human
ugggacuacaggcaccca

SEQ ID NO: 1160581 - RNA, 16 nt, Human
ugggacuacaggugug

SEQ ID NO: 1160582 - RNA, 18 nt, Human
ugggacucaaugcacuga

SEQ ID NO: 1160583 - RNA, 13 nt, Human
agggaaauuucag

SEQ ID NO: 1160584 - RNA, 15 nt, Human
agggacuuggaagcu

SEQ ID NO: 1160585 - RNA, 18 nt, Human
agggacuuggaagcuccg

SEQ ID NO: 1160586 - RNA, 19 nt, Human
agggacuuggaagcuccgc

SEQ ID NO: 1160587 - RNA, 20 nt, Human
agggacuuggaagcuccgcu

SEQ ID NO: 1160588 - RNA, 21 nt, Human
ugggagaaccaaaaagaggcu

SEQ ID NO: 1160589 - RNA, 22 nt, Human
ugggagaaccaaaaagaggcua

SEQ ID NO: 1160590 - RNA, 18 nt, Human
ugggaggauugcuugagc

SEQ ID NO: 1160591 - RNA, 21 nt, Human
ugggaggauugcuugagcuca

SEQ ID NO: 1160592 - RNA, 22 nt, Human
ugggaggauugcuugagcucag

SEQ ID NO: 1160593 - RNA, 19 nt, Human
ugggaggcugagaugggag

SEQ ID NO: 1160594 - RNA, 17 nt, Human
ugggaggucaaggcugc

SEQ ID NO: 1160595 - RNA, 16 nt, Human
ugggcaacccccagcc

SEQ ID NO: 1160596 - RNA, 13 nt, Human
ugggcagaaggaa

SEQ ID NO: 1160597 - RNA, 16 nt, Human
ugggcagaaggaagac

SEQ ID NO: 1160598 - RNA, 20 nt, Human
ugggcagaaggaagacuuca

SEQ ID NO: 1160599 - RNA, 23 nt, Human
ugggcagaaggaagacuucaucc

SEQ ID NO: 1160600 - RNA, 16 nt, Human
agggauacccauccca

SEQ ID NO: 1160601 - RNA, 12 nt, Human
agggcccagaga

SEQ ID NO: 1160602 - RNA, 13 nt, Human
agggcccagagag

SEQ ID NO: 1160603 - RNA, 12 nt, Human
agggagggcucc

SEQ ID NO: 1160604 - RNA, 13 nt, Human
agggagggcucca

SEQ ID NO: 1160605 - RNA, 19 nt, Human
agggagggcuccagacaca

SEQ ID NO: 1160606 - RNA, 22 nt, Human
agggagggcuccagacacaugu

SEQ ID NO: 1160607 - RNA, 15 nt, Human
agggagggcuucugc

SEQ ID NO: 1160608 - RNA, 20 nt, Human
agggaguccgaaagggacuu

SEQ ID NO: 1160609 - RNA, 23 nt, Human
agggaguccgaaagggacuugga

SEQ ID NO: 1160610 - RNA, 20 nt, Human
agggagugaguugauagcac

SEQ ID NO: 1160611 - RNA, 14 nt, Human
agggcccagagagg

SEQ ID NO: 1160612 - RNA, 18 nt, Human
agggcccagagagggugg

SEQ ID NO: 1160613 - RNA, 20 nt, Human
agggcuccagacacaugucc

SEQ ID NO: 1160614 - RNA, 22 nt, Human
agggcuguuauaaucuuucaca

SEQ ID NO: 1160615 - RNA, 14 nt, Human
ugggcucccuuccc

SEQ ID NO: 1160616 - RNA, 15 nt, Human
ugggcucccuuccca

SEQ ID NO: 1160617 - RNA, 12 nt, Human
aggugggaggau

SEQ ID NO: 1160618 - RNA, 16 nt, Human
aggugucccugcacuu

SEQ ID NO: 1160619 - RNA, 20 nt, Human
aggugucccugcacuugcag

SEQ ID NO: 1160620 - RNA, 21 nt, Human
aggugugagucaccaagccca

SEQ ID NO: 1160621 - RNA, 22 nt, Human
aggugugagucaccaagcccag

SEQ ID NO: 1160622 - RNA, 12 nt, Human
aggugugcucug

SEQ ID NO: 1160623 - RNA, 14 nt, Human
agguugaagcacca

SEQ ID NO: 1160624 - RNA, 14 nt, Human
uguacaugaaaaca

SEQ ID NO: 1160625 - RNA, 16 nt, Human
uguacaugaaaacaca

SEQ ID NO: 1160626 - RNA, 20 nt, Human
uguaauuuuuuuaucgucac

SEQ ID NO: 1160627 - RNA, 19 nt, Human
uguacauaaugcgugcaua

SEQ ID NO: 1160628 - RNA, 20 nt, Human
uguacauaaugcgugcauac

SEQ ID NO: 1160629 - RNA, 20 nt, Human
agguuggcaaaaaggcagga

SEQ ID NO: 1160630 - RNA, 18 nt, Human
uguaauuaaguacuaugu

SEQ ID NO: 1160631 - RNA, 19 nt, Human
uguaauuaaguacuaugua

SEQ ID NO: 1160632 - RNA, 21 nt, Human
uguaauuaaguacuauguauc

SEQ ID NO: 1160633 - RNA, 23 nt, Human
uguaauuaaguacuauguaucaa

SEQ ID NO: 1160634 - RNA, 21 nt, Human
aguacacuguuucaaacuuua

SEQ ID NO: 1160635 - RNA, 23 nt, Human
aguacacuguuucaaacuuuacu

SEQ ID NO: 1160636 - RNA, 13 nt, Human
aguaaugauaacu

SEQ ID NO: 1160637 - RNA, 12 nt, Human
aguaauuggaaa

SEQ ID NO: 1160638 - RNA, 13 nt, Human
aguaauuggaaag

SEQ ID NO: 1160639 - RNA, 21 nt, Human
uguacauggaauaacauguaa

SEQ ID NO: 1160640 - RNA, 16 nt, Human
uguaggguuauaauaa

SEQ ID NO: 1160641 - RNA, 17 nt, Human
uguaggguuauaauaau

SEQ ID NO: 1160642 - RNA, 17 nt, Human
uguaguguuggagaaga

SEQ ID NO: 1160643 - RNA, 18 nt, Human
uguaguguuggagaagaa

SEQ ID NO: 1160644 - RNA, 19 nt, Human
uguaguguuggagaagaac

SEQ ID NO: 1160645 - RNA, 18 nt, Human
uguauauauuuccuauau

SEQ ID NO: 1160646 - RNA, 22 nt, Human
uguauauauuuccuauauuguu

SEQ ID NO: 1160647 - RNA, 19 nt, Human
ugucccuuacgugaguccu

SEQ ID NO: 1160648 - RNA, 23 nt, Human
ugucccuuacgugaguccuggca

SEQ ID NO: 1160649 - RNA, 22 nt, Human
agucagaaguuucugccgcagc

SEQ ID NO: 1160650 - RNA, 14 nt, Human
agucaggaaagaga

SEQ ID NO: 1160651 - RNA, 15 nt, Human
agucaggaaagagaa

SEQ ID NO: 1160652 - RNA, 18 nt, Human
agucccaccuuggcugca

SEQ ID NO: 1160653 - RNA, 19 nt, Human
agucccaccuuggcugcag

SEQ ID NO: 1160654 - RNA, 20 nt, Human
agucccaccuuggcugcagg

SEQ ID NO: 1160655 - RNA, 15 nt, Human
agucccaccuuggcu

SEQ ID NO: 1160656 - RNA, 16 nt, Human
agucccaccuuggcug

SEQ ID NO: 1160657 - RNA, 14 nt, Human
aguccucccaucuc

SEQ ID NO: 1160658 - RNA, 16 nt, Human
aguccucccaucucac

SEQ ID NO: 1160659 - RNA, 23 nt, Human
agucucacuguugcccaggcugg

SEQ ID NO: 1160660 - RNA, 15 nt, Human
aguauuacuucugcu

SEQ ID NO: 1160661 - RNA, 19 nt, Human
aguauucuuauuuaaugaa

SEQ ID NO: 1160662 - RNA, 15 nt, Human
agucaccaagcccag

SEQ ID NO: 1160663 - RNA, 17 nt, Human
agucaccccggccaccu

SEQ ID NO: 1160664 - RNA, 17 nt, Human
ugucagguggggcagcu

SEQ ID NO: 1160665 - RNA, 18 nt, Human
ugucagguggggcagcuu

SEQ ID NO: 1160666 - RNA, 20 nt, Human
ugucagguggggcagcuuga

SEQ ID NO: 1160667 - RNA, 20 nt, Human
ugucauuugagcagggcuca

SEQ ID NO: 1160668 - RNA, 21 nt, Human
ugucauuugagcagggcucag

SEQ ID NO: 1160669 - RNA, 22 nt, Human
ugucauuugagcagggcucagc

SEQ ID NO: 1160670 - RNA, 23 nt, Human
ugucauuugcuggagcucugccc

SEQ ID NO: 1160671 - RNA, 14 nt, Human
uguccaagaagccc

SEQ ID NO: 1160672 - RNA, 15 nt, Human
uguccaagaagccca

SEQ ID NO: 1160673 - RNA, 16 nt, Human
uguccaagaagcccag

SEQ ID NO: 1160674 - RNA, 17 nt, Human
uguccaagaagcccagg

SEQ ID NO: 1160675 - RNA, 18 nt, Human
uguccaagaagcccagga

SEQ ID NO: 1160676 - RNA, 22 nt, Human
uguccaagaagcccaggaaagg

SEQ ID NO: 1160677 - RNA, 20 nt, Human
ugucccugcacuugcagacu

SEQ ID NO: 1160678 - RNA, 22 nt, Human
ugucccugcacuugcagacucu

SEQ ID NO: 1160679 - RNA, 23 nt, Human
ugucccugcacuugcagacucua

SEQ ID NO: 1160680 - RNA, 11 nt, Human
ugugaggaagc

SEQ ID NO: 1160681 - RNA, 12 nt, Human
ugugaggaagcc

SEQ ID NO: 1160682 - RNA, 16 nt, Human
agucucuugauucaua

SEQ ID NO: 1160683 - RNA, 17 nt, Human
agucucuugauucauaa

SEQ ID NO: 1160684 - RNA, 12 nt, Human
agucugaaggcu

SEQ ID NO: 1160685 - RNA, 13 nt, Human
agucuuagaugua

SEQ ID NO: 1160686 - RNA, 14 nt, Human
agucuuagauguau

SEQ ID NO: 1160687 - RNA, 16 nt, Human
agucuuagauguauau

SEQ ID NO: 1160688 - RNA, 23 nt, Human
agucuuagauguauauauuuccu

SEQ ID NO: 1160689 - RNA, 18 nt, Human
agucuuucacauuuaaau

SEQ ID NO: 1160690 - RNA, 21 nt, Human
agugaacaaauuuacagagac

SEQ ID NO: 1160691 - RNA, 16 nt, Human
agucuuucacauuuaa

SEQ ID NO: 1160692 - RNA, 22 nt, Human
agugaacaaauuuacagagaca

SEQ ID NO: 1160693 - RNA, 23 nt, Human
agugaacaaauuuacagagacag

SEQ ID NO: 1160694 - RNA, 16 nt, Human
agugaacuugggccac

SEQ ID NO: 1160695 - RNA, 20 nt, Human
agugaacuugggccacugug

SEQ ID NO: 1160696 - RNA, 21 nt, Human
agugacugauggcuaauguac

SEQ ID NO: 1160697 - RNA, 14 nt, Human
agugagcacuaagg

SEQ ID NO: 1160698 - RNA, 22 nt, Human
agugagcacuaaggugugcucu

SEQ ID NO: 1160699 - RNA, 12 nt, Human
agugagcugguu

SEQ ID NO: 1160700 - RNA, 19 nt, Human
ugugaugagaggaaaucac

SEQ ID NO: 1160701 - RNA, 23 nt, Human
agugagcugguuuuuagcggaga

SEQ ID NO: 1160702 - RNA, 22 nt, Human
ugugaugaugaaaugaggucag

SEQ ID NO: 1160703 - RNA, 16 nt, Human
agugcaugcugucccu

SEQ ID NO: 1160704 - RNA, 14 nt, Human
agugccaaaaacaa

SEQ ID NO: 1160705 - RNA, 17 nt, Human
agugcagugagccgaga

SEQ ID NO: 1160706 - RNA, 16 nt, Human
agugaggaugaaaaaa

SEQ ID NO: 1160707 - RNA, 12 nt, Human
agugaggcucug

SEQ ID NO: 1160708 - RNA, 13 nt, Human
agugaggcucugc

SEQ ID NO: 1160709 - RNA, 14 nt, Human
agugaggcucugcc

SEQ ID NO: 1160710 - RNA, 14 nt, Human
agugcaaauuguca

SEQ ID NO: 1160711 - RNA, 12 nt, Human
ugugcucugauc

SEQ ID NO: 1160712 - RNA, 18 nt, Human
ugugcugagucugaaggc

SEQ ID NO: 1160713 - RNA, 19 nt, Human
ugugcugagucugaaggcu

SEQ ID NO: 1160714 - RNA, 12 nt, Human
ugugcugcccug

SEQ ID NO: 1160715 - RNA, 19 nt, Human
ugugcugcccugcccaccu

SEQ ID NO: 1160716 - RNA, 20 nt, Human
ugugcugcccugcccaccug

SEQ ID NO: 1160717 - RNA, 21 nt, Human
ugugcugcccugcccaccugg

SEQ ID NO: 1160718 - RNA, 14 nt, Human
uguggaugauaaaa

SEQ ID NO: 1160719 - RNA, 19 nt, Human
uguggauuuaacagaaaug

SEQ ID NO: 1160720 - RNA, 20 nt, Human
uguggauuuaacagaaaugu

SEQ ID NO: 1160721 - RNA, 22 nt, Human
uguggauuuaacagaaauguac

SEQ ID NO: 1160722 - RNA, 20 nt, Human
uguggucacaggaaguagag

SEQ ID NO: 1160723 - RNA, 20 nt, Human
ugugucuugcaauggcagcc

SEQ ID NO: 1160724 - RNA, 11 nt, Human
uguguguuuau

SEQ ID NO: 1160725 - RNA, 22 nt, Human
uguguuaucacccagaagaaaa

SEQ ID NO: 1160726 - RNA, 23 nt, Human
uguguuaucacccagaagaaaau

SEQ ID NO: 1160727 - RNA, 19 nt, Human
uguuacauaagauaaaugu

SEQ ID NO: 1160728 - RNA, 11 nt, Human
aguggcagcug

SEQ ID NO: 1160729 - RNA, 19 nt, Human
aguguuguggauuuaacag

SEQ ID NO: 1160730 - RNA, 20 nt, Human
aguguuguggauuuaacaga

SEQ ID NO: 1160731 - RNA, 13 nt, Human
aguuacucagaau

SEQ ID NO: 1160732 - RNA, 16 nt, Human
aguguuguggauuuaa

SEQ ID NO: 1160733 - RNA, 15 nt, Human
uguucuaagaaguga

SEQ ID NO: 1160734 - RNA, 22 nt, Human
uguugcccacagcuguaugauu

SEQ ID NO: 1160735 - RNA, 23 nt, Human
uguugcccaggcuggcgugcagu

SEQ ID NO: 1160736 - RNA, 12 nt, Human
uguugcccaggc

SEQ ID NO: 1160737 - RNA, 20 nt, Human
agugugacugaucucucgug

SEQ ID NO: 1160738 - RNA, 21 nt, Human
agugugccugaagucccagau

SEQ ID NO: 1160739 - RNA, 15 nt, Human
aguguggcaaaauaa

SEQ ID NO: 1160740 - RNA, 22 nt, Human
agugugguguuuccuggcacug

SEQ ID NO: 1160741 - RNA, 13 nt, Human
uguuaugacucca

SEQ ID NO: 1160742 - RNA, 17 nt, Human
uguuaugacuccagaau

SEQ ID NO: 1160743 - RNA, 19 nt, Human
uguuccacaaguuaaauaa

SEQ ID NO: 1160744 - RNA, 14 nt, Human
aguuucucuuuuca

SEQ ID NO: 1160745 - RNA, 15 nt, Human
aguuucugccgcagc

SEQ ID NO: 1160746 - RNA, 19 nt, Human
aguuucugccgcagcccug

SEQ ID NO: 1160747 - RNA, 22 nt, Human
aguuuguuaguaugaggcauuu

SEQ ID NO: 1160748 - RNA, 12 nt, Human
uuaacagaaaug

SEQ ID NO: 1160749 - RNA, 13 nt, Human
uuaacagaaaugu

SEQ ID NO: 1160750 - RNA, 14 nt, Human
uuaacagaaaugua

SEQ ID NO: 1160751 - RNA, 16 nt, Human
uuaacagaaauguaca

SEQ ID NO: 1160752 - RNA, 20 nt, Human
aguuuaaauuguaauaggcg

SEQ ID NO: 1160753 - RNA, 17 nt, Human
aguuuaaauuguaauag

SEQ ID NO: 1160754 - RNA, 15 nt, Human
aguuuagcuggaaaa

SEQ ID NO: 1160755 - RNA, 16 nt, Human
aguuuagcuggaaaag

SEQ ID NO: 1160756 - RNA, 19 nt, Human
uuaaaaaucucaaauuucu

SEQ ID NO: 1160757 - RNA, 20 nt, Human
uuaaaaaucucaaauuucua

SEQ ID NO: 1160758 - RNA, 20 nt, Human
uuaaaaaugguuuaaauggu

SEQ ID NO: 1160759 - RNA, 19 nt, Human
uuaagaaaaaggaugcaca

SEQ ID NO: 1160760 - RNA, 22 nt, Human
uuaacuuuuauaaacuuuaccu

SEQ ID NO: 1160761 - RNA, 23 nt, Human
uuaacuuuuauaaacuuuaccuu

SEQ ID NO: 1160762 - RNA, 16 nt, Human
aguuuuauaugcuucu

SEQ ID NO: 1160763 - RNA, 15 nt, Human
uuaaucuaaauggaa

SEQ ID NO: 1160764 - RNA, 14 nt, Human
uuacaggugugaac

SEQ ID NO: 1160765 - RNA, 20 nt, Human
uuacauaagauaaaugugcu

SEQ ID NO: 1160766 - RNA, 19 nt, Human
uuaccagcagagcaccuua

SEQ ID NO: 1160767 - RNA, 15 nt, Human
uuacugcagcuuugu

SEQ ID NO: 1160768 - RNA, 12 nt, Human
uuacuguacaug

SEQ ID NO: 1160769 - RNA, 13 nt, Human
uuacuguacauga

SEQ ID NO: 1160770 - RNA, 14 nt, Human
uuacuguacaugaa

SEQ ID NO: 1160771 - RNA, 22 nt, Human
uuacuguacaugaaaacacauu

SEQ ID NO: 1160772 - RNA, 23 nt, Human
uuacuguacaugaaaacacauuu

SEQ ID NO: 1160773 - RNA, 16 nt, Human
uuagaagucacacagu

SEQ ID NO: 1160774 - RNA, 14 nt, Human
auaagauucauauu

SEQ ID NO: 1160775 - RNA, 14 nt, Human
auaaucuuucacag

SEQ ID NO: 1160776 - RNA, 21 nt, Human
auaaucuuucacaggggacag

SEQ ID NO: 1160777 - RNA, 21 nt, Human
auaagauucauauuuacuucu

SEQ ID NO: 1160778 - RNA, 22 nt, Human
auaagccaaaaaaugcuugcuu

SEQ ID NO: 1160779 - RNA, 14 nt, Human
auaagccagacauc

SEQ ID NO: 1160780 - RNA, 17 nt, Human
uuaguagagacaggguu

SEQ ID NO: 1160781 - RNA, 14 nt, Human
uuaguagagacagg

SEQ ID NO: 1160782 - RNA, 13 nt, Human
uuaguagagacag

SEQ ID NO: 1160783 - RNA, 13 nt, Human
uuauaaacuuuac

SEQ ID NO: 1160784 - RNA, 14 nt, Human
uuaggguuaugauu

SEQ ID NO: 1160785 - RNA, 16 nt, Human
uuaggguuaugauuaa

SEQ ID NO: 1160786 - RNA, 19 nt, Human
uuaggugugggggaagcac

SEQ ID NO: 1160787 - RNA, 15 nt, Human
uuaggugaggaagca

SEQ ID NO: 1160788 - RNA, 18 nt, Human
uuagguuggcaaaaaggc

SEQ ID NO: 1160789 - RNA, 13 nt, Human
uuauuaugcauga

SEQ ID NO: 1160790 - RNA, 15 nt, Human
uuauuauauuuacaa

SEQ ID NO: 1160791 - RNA, 12 nt, Human
uuauuaugcaug

SEQ ID NO: 1160792 - RNA, 14 nt, Human
uuauuauauuuaca

SEQ ID NO: 1160793 - RNA, 19 nt, Human
uuauguuaaaacugggaca

SEQ ID NO: 1160794 - RNA, 16 nt, Human
auacucugcuuagaau

SEQ ID NO: 1160795 - RNA, 14 nt, Human
auacucccaucugu

SEQ ID NO: 1160796 - RNA, 16 nt, Human
auacucauuaggaugg

SEQ ID NO: 1160797 - RNA, 11 nt, Human
auacucccauc

SEQ ID NO: 1160798 - RNA, 12 nt, Human
auacuguaaaga

SEQ ID NO: 1160799 - RNA, 13 nt, Human
auacuguaaagaa

SEQ ID NO: 1160800 - RNA, 14 nt, Human
auacuguaaagaaa

SEQ ID NO: 1160801 - RNA, 15 nt, Human
auacuguaaagaaag

SEQ ID NO: 1160802 - RNA, 14 nt, Human
auagagagagacca

SEQ ID NO: 1160803 - RNA, 18 nt, Human
auagauaggucagugcaa

SEQ ID NO: 1160804 - RNA, 16 nt, Human
auagacaauuuauuau

SEQ ID NO: 1160805 - RNA, 22 nt, Human
auagacaauuuauuauggcaca

SEQ ID NO: 1160806 - RNA, 23 nt, Human
auagacaauuuauuauggcacau

SEQ ID NO: 1160807 - RNA, 17 nt, Human
auagaauuaacacauga

SEQ ID NO: 1160808 - RNA, 13 nt, Human
auagaaguaaaaa

SEQ ID NO: 1160809 - RNA, 16 nt, Human
auacuguaaagaaaga

SEQ ID NO: 1160810 - RNA, 18 nt, Human
auacuguaaagaaagaga

SEQ ID NO: 1160811 - RNA, 19 nt, Human
auacuguaaagaaagagag

SEQ ID NO: 1160812 - RNA, 20 nt, Human
auacuguaaagaaagagaga

SEQ ID NO: 1160813 - RNA, 21 nt, Human
auacuguaaagaaagagagaa

SEQ ID NO: 1160814 - RNA, 22 nt, Human
auacuguaaagaaagagagaaa

SEQ ID NO: 1160815 - RNA, 23 nt, Human
auacuguaaagaaagagagaaaa

SEQ ID NO: 1160816 - RNA, 19 nt, Human
uuaugauuaaguaaugaua

SEQ ID NO: 1160817 - RNA, 22 nt, Human
uuaugauuaaguaaugauaacu

SEQ ID NO: 1160818 - RNA, 19 nt, Human
uuauggcuuuugugcauua

SEQ ID NO: 1160819 - RNA, 13 nt, Human
uuaugggcugggu

SEQ ID NO: 1160820 - RNA, 22 nt, Human
uuaugggcuggguucuacccag

SEQ ID NO: 1160821 - RNA, 21 nt, Human
uuaugaauuacauuuguauaa

SEQ ID NO: 1160822 - RNA, 11 nt, Human
uuaugacucca

SEQ ID NO: 1160823 - RNA, 14 nt, Human
uuaugaauuacauu

SEQ ID NO: 1160824 - RNA, 16 nt, Human
uuaugaauuacauuug

SEQ ID NO: 1160825 - RNA, 17 nt, Human
uuaugaauuacauuugu

SEQ ID NO: 1160826 - RNA, 17 nt, Human
uuaucacccagaagaaa

SEQ ID NO: 1160827 - RNA, 18 nt, Human
uuaucacccagaagaaaa

SEQ ID NO: 1160828 - RNA, 19 nt, Human
uuaucacccagaagaaaau

SEQ ID NO: 1160829 - RNA, 21 nt, Human
uuaucacccagaagaaaauag

SEQ ID NO: 1160830 - RNA, 21 nt, Human
auacaguucggugagcuacaa

SEQ ID NO: 1160831 - RNA, 20 nt, Human
auacaguuacucagaauucu

SEQ ID NO: 1160832 - RNA, 23 nt, Human
auacagauagauauaugcucugc

SEQ ID NO: 1160833 - RNA, 23 nt, Human
auacaggaaaagcugcugacagu

SEQ ID NO: 1160834 - RNA, 18 nt, Human
auacaguuacucagaauu

SEQ ID NO: 1160835 - RNA, 16 nt, Human
auacagaggcaacugc

SEQ ID NO: 1160836 - RNA, 17 nt, Human
auacagaggcaacugca

SEQ ID NO: 1160837 - RNA, 17 nt, Human
uuauaaacuuuaccuuu

SEQ ID NO: 1160838 - RNA, 18 nt, Human
uuauaaacuuuaccuuuu

SEQ ID NO: 1160839 - RNA, 17 nt, Human
auaccacuuuuguucuu

SEQ ID NO: 1160840 - RNA, 18 nt, Human
auaccacuuuuguucuug

SEQ ID NO: 1160841 - RNA, 17 nt, Human
auaccagccaguaaaug

SEQ ID NO: 1160842 - RNA, 14 nt, Human
auaccuuuuuuaga

SEQ ID NO: 1160843 - RNA, 13 nt, Human
auacguacacauu

SEQ ID NO: 1160844 - RNA, 14 nt, Human
auacguacacauuu

SEQ ID NO: 1160845 - RNA, 15 nt, Human
auacguacacauuuu

SEQ ID NO: 1160846 - RNA, 16 nt, Human
auacguacacauuuua

SEQ ID NO: 1160847 - RNA, 13 nt, Human
auacuaaccagca

SEQ ID NO: 1160848 - RNA, 19 nt, Human
auacuaaccagcagaaaug

SEQ ID NO: 1160849 - RNA, 20 nt, Human
auacuaaccagcagaaaugc

SEQ ID NO: 1160850 - RNA, 19 nt, Human
uuauauuugaaauauugac

SEQ ID NO: 1160851 - RNA, 20 nt, Human
uucccucaccuuucccaucu

SEQ ID NO: 1160852 - RNA, 19 nt, Human
uuccguagguuauuuucag

SEQ ID NO: 1160853 - RNA, 14 nt, Human
uuccguuaaaauac

SEQ ID NO: 1160854 - RNA, 16 nt, Human
uuccguuaaaauacca

SEQ ID NO: 1160855 - RNA, 13 nt, Human
uuccucuuuccau

SEQ ID NO: 1160856 - RNA, 17 nt, Human
uuccucuuuccaucuac

SEQ ID NO: 1160857 - RNA, 22 nt, Human
uuccucuuuccaucuacccucc

SEQ ID NO: 1160858 - RNA, 14 nt, Human
uuccugaaccgaug

SEQ ID NO: 1160859 - RNA, 18 nt, Human
uuccugaagaauugaaaa

SEQ ID NO: 1160860 - RNA, 20 nt, Human
auauuuuuuguuaaaugauu

SEQ ID NO: 1160861 - RNA, 18 nt, Human
auauuuuuuguuaaauga

SEQ ID NO: 1160862 - RNA, 14 nt, Human
aucaacagauaaau

SEQ ID NO: 1160863 - RNA, 11 nt, Human
uuccugugucu

SEQ ID NO: 1160864 - RNA, 16 nt, Human
aucaaggguacacugc

SEQ ID NO: 1160865 - RNA, 14 nt, Human
aucaaugaguaaca

SEQ ID NO: 1160866 - RNA, 13 nt, Human
aucacgccacugc

SEQ ID NO: 1160867 - RNA, 14 nt, Human
aucacgccacugca

SEQ ID NO: 1160868 - RNA, 15 nt, Human
aucacggcucacugc

SEQ ID NO: 1160869 - RNA, 18 nt, Human
aucacggcucacugcagc

SEQ ID NO: 1160870 - RNA, 19 nt, Human
aucacggcucacugcagcc

SEQ ID NO: 1160871 - RNA, 21 nt, Human
uucucacugccaugccagcuu

SEQ ID NO: 1160872 - RNA, 11 nt, Human
aucagaauucu

SEQ ID NO: 1160873 - RNA, 22 nt, Human
aucacuugucaauaaaauccau

SEQ ID NO: 1160874 - RNA, 12 nt, Human
aucagaauucuc

SEQ ID NO: 1160875 - RNA, 13 nt, Human
aucagcacgauuu

SEQ ID NO: 1160876 - RNA, 15 nt, Human
aucaggccaggcccu

SEQ ID NO: 1160877 - RNA, 16 nt, Human
aucaggccaggcccuc

SEQ ID NO: 1160878 - RNA, 18 nt, Human
aucaggccaggcccucug

SEQ ID NO: 1160879 - RNA, 15 nt, Human
aucagcacgauuucu

SEQ ID NO: 1160880 - RNA, 20 nt, Human
aucaggccaggcccucugcc

SEQ ID NO: 1160881 - RNA, 17 nt, Human
aucaggguuaguauugu

SEQ ID NO: 1160882 - RNA, 15 nt, Human
uucgcuccugugucu

SEQ ID NO: 1160883 - RNA, 19 nt, Human
uucgcuccugugucuugca

SEQ ID NO: 1160884 - RNA, 14 nt, Human
uucggccuccaucc

SEQ ID NO: 1160885 - RNA, 15 nt, Human
uucggccuccauccu

SEQ ID NO: 1160886 - RNA, 20 nt, Human
uucuaaaggcuaccuuugua

SEQ ID NO: 1160887 - RNA, 21 nt, Human
uucuaaaggcuaccuuuguau

SEQ ID NO: 1160888 - RNA, 21 nt, Human
uucuaaaucuccaaaauaaaa

SEQ ID NO: 1160889 - RNA, 23 nt, Human
uucuaagaagugaaaaucuacac

SEQ ID NO: 1160890 - RNA, 16 nt, Human
uucuagcauggcugcc

SEQ ID NO: 1160891 - RNA, 15 nt, Human
uucucuaguuugauu

SEQ ID NO: 1160892 - RNA, 17 nt, Human
uucucuaguuugauuaa

SEQ ID NO: 1160893 - RNA, 20 nt, Human
uucucuaguuugauuaaauu

SEQ ID NO: 1160894 - RNA, 14 nt, Human
aucaggugcugcca

SEQ ID NO: 1160895 - RNA, 21 nt, Human
uucuccuuguguuacuaaguu

SEQ ID NO: 1160896 - RNA, 19 nt, Human
uucugaacuuggcgcugcc

SEQ ID NO: 1160897 - RNA, 22 nt, Human
uucugaacuuggcgcugccccu

SEQ ID NO: 1160898 - RNA, 23 nt, Human
uucugaacuuggcgcugccccug

SEQ ID NO: 1160899 - RNA, 15 nt, Human
uucugccauauucug

SEQ ID NO: 1160900 - RNA, 18 nt, Human
uucugccugcccaggccc

SEQ ID NO: 1160901 - RNA, 21 nt, Human
uucugccugcccaggccccug

SEQ ID NO: 1160902 - RNA, 16 nt, Human
uucuggcucuuccagg

SEQ ID NO: 1160903 - RNA, 17 nt, Human
uucuggcucuuccaggc

SEQ ID NO: 1160904 - RNA, 21 nt, Human
auccaguaucuugaagacuuu

SEQ ID NO: 1160905 - RNA, 19 nt, Human
aucccaaacccuucagugc

SEQ ID NO: 1160906 - RNA, 20 nt, Human
aucccaaacccuucagugcc

SEQ ID NO: 1160907 - RNA, 18 nt, Human
aucccauaugccugggca

SEQ ID NO: 1160908 - RNA, 18 nt, Human
auccaagcuggucccacu

SEQ ID NO: 1160909 - RNA, 21 nt, Human
auccaagcuggucccacucag

SEQ ID NO: 1160910 - RNA, 13 nt, Human
auccacccaccuc

SEQ ID NO: 1160911 - RNA, 15 nt, Human
auccacccaccucag

SEQ ID NO: 1160912 - RNA, 16 nt, Human
auccacccaccucagc

SEQ ID NO: 1160913 - RNA, 16 nt, Human
auccaguaucuugaag

SEQ ID NO: 1160914 - RNA, 20 nt, Human
uucuucugcuucagccuccc

SEQ ID NO: 1160915 - RNA, 24 nt, Human
aucccauaugccugggcagaagga

SEQ ID NO: 1160916 - RNA, 13 nt, Human
aucccaugagccu

SEQ ID NO: 1160917 - RNA, 14 nt, Human
aucccucauccuca

SEQ ID NO: 1160918 - RNA, 21 nt, Human
aucccucauccucauacccac

SEQ ID NO: 1160919 - RNA, 23 nt, Human
aucccucauccucauacccaccc

SEQ ID NO: 1160920 - RNA, 13 nt, Human
uucuucucccuca

SEQ ID NO: 1160921 - RNA, 14 nt, Human
uucuucucccucag

SEQ ID NO: 1160922 - RNA, 13 nt, Human
uucuucugcuuca

SEQ ID NO: 1160923 - RNA, 15 nt, Human
uucuucugcuucagc

SEQ ID NO: 1160924 - RNA, 21 nt, Human
auccuaagcuauucaguaaua

SEQ ID NO: 1160925 - RNA, 12 nt, Human
auccuaagcuau

SEQ ID NO: 1160926 - RNA, 16 nt, Human
auccuaggcauuugcu

SEQ ID NO: 1160927 - RNA, 16 nt, Human
auccuccucagaucuu

SEQ ID NO: 1160928 - RNA, 21 nt, Human
auccuaggcauuugcugaaua

SEQ ID NO: 1160929 - RNA, 17 nt, Human
uugaaauuguauuacaa

SEQ ID NO: 1160930 - RNA, 19 nt, Human
uugaacccgggaggcagag

SEQ ID NO: 1160931 - RNA, 17 nt, Human
uugaagggaaauuucag

SEQ ID NO: 1160932 - RNA, 16 nt, Human
auccucuguacagagc

SEQ ID NO: 1160933 - RNA, 17 nt, Human
auccucuguacagagcc

SEQ ID NO: 1160934 - RNA, 18 nt, Human
auccucuguacagagccc

SEQ ID NO: 1160935 - RNA, 13 nt, Human
aucuaaauggaac

SEQ ID NO: 1160936 - RNA, 17 nt, Human
aucuaaauggaaccacu

SEQ ID NO: 1160937 - RNA, 18 nt, Human
aucuaaauggaaccacuc

SEQ ID NO: 1160938 - RNA, 19 nt, Human
aucuaaauggaaccacucu

SEQ ID NO: 1160939 - RNA, 16 nt, Human
uugagaucagccuggg

SEQ ID NO: 1160940 - RNA, 20 nt, Human
uugagugaagcugggagaac

SEQ ID NO: 1160941 - RNA, 11 nt, Human
uugagugccuu

SEQ ID NO: 1160942 - RNA, 20 nt, Human
uugaguugauucagcucugc

SEQ ID NO: 1160943 - RNA, 15 nt, Human
uugauacuacaguuu

SEQ ID NO: 1160944 - RNA, 18 nt, Human
aucuaauauguaacaagc

SEQ ID NO: 1160945 - RNA, 20 nt, Human
aucuaauauguaacaagcca

SEQ ID NO: 1160946 - RNA, 18 nt, Human
aucuacacuccagugaga

SEQ ID NO: 1160947 - RNA, 19 nt, Human
aucuacacuccagugagac

SEQ ID NO: 1160948 - RNA, 21 nt, Human
aucucccccagccccauccuc

SEQ ID NO: 1160949 - RNA, 16 nt, Human
aucucccccagcccca

SEQ ID NO: 1160950 - RNA, 17 nt, Human
aucucccccagccccau

SEQ ID NO: 1160951 - RNA, 15 nt, Human
aucucccccagcccc

SEQ ID NO: 1160952 - RNA, 15 nt, Human
aucucuugagccugg

SEQ ID NO: 1160953 - RNA, 18 nt, Human
aucucuugagccugggag

SEQ ID NO: 1160954 - RNA, 14 nt, Human
aucugaaaauguau

SEQ ID NO: 1160955 - RNA, 16 nt, Human
aucugaaaauguaugu

SEQ ID NO: 1160956 - RNA, 19 nt, Human
aucugaaaauguaugugua

SEQ ID NO: 1160957 - RNA, 20 nt, Human
aucugaaaauguauguguaa

SEQ ID NO: 1160958 - RNA, 22 nt, Human
aucugaaaauguauguguaagu

SEQ ID NO: 1160959 - RNA, 16 nt, Human
aucucagggccugguc

SEQ ID NO: 1160960 - RNA, 14 nt, Human
aucucauuuccaag

SEQ ID NO: 1160961 - RNA, 14 nt, Human
aucuccaaaauaaa

SEQ ID NO: 1160962 - RNA, 17 nt, Human
aucuccaaaauaaaacu

SEQ ID NO: 1160963 - RNA, 20 nt, Human
aucuccaaaauaaaacuuuu

SEQ ID NO: 1160964 - RNA, 21 nt, Human
aucuccaaaauaaaacuuuuu

SEQ ID NO: 1160965 - RNA, 16 nt, Human
uugcaauggcagccuu

SEQ ID NO: 1160966 - RNA, 17 nt, Human
uugcaauggcagccuug

SEQ ID NO: 1160967 - RNA, 19 nt, Human
uugcaauggcagccuuggc

SEQ ID NO: 1160968 - RNA, 15 nt, Human
uugcaccacugcacu

SEQ ID NO: 1160969 - RNA, 16 nt, Human
uugcaccacugcacuc

SEQ ID NO: 1160970 - RNA, 18 nt, Human
uugcaccacugcacucca

SEQ ID NO: 1160971 - RNA, 23 nt, Human
aucugaaaauguauguguaagua

SEQ ID NO: 1160972 - RNA, 23 nt, Human
uugauguuuuaaggaugcuugua

SEQ ID NO: 1160973 - RNA, 13 nt, Human
uugauuaaauucu

SEQ ID NO: 1160974 - RNA, 14 nt, Human
uugauuaaauucuu

SEQ ID NO: 1160975 - RNA, 14 nt, Human
aucuuauaauuuaa

SEQ ID NO: 1160976 - RNA, 13 nt, Human
aucuugcucugcu

SEQ ID NO: 1160977 - RNA, 20 nt, Human
aucuuggucagauuugaacu

SEQ ID NO: 1160978 - RNA, 18 nt, Human
aucugugaaaggaaagag

SEQ ID NO: 1160979 - RNA, 23 nt, Human
aucugugaaaggaaagagggagg

SEQ ID NO: 1160980 - RNA, 10 nt, Human
aucuggugac

SEQ ID NO: 1160981 - RNA, 16 nt, Human
aucuggugacuuuccu

SEQ ID NO: 1160982 - RNA, 17 nt, Human
aucuggugacuuuccuc

SEQ ID NO: 1160983 - RNA, 17 nt, Human
aucugugaaaggaaaga

SEQ ID NO: 1160984 - RNA, 16 nt, Human
uuggagggugucccaa

SEQ ID NO: 1160985 - RNA, 18 nt, Human
uuggccccugcccggcug

SEQ ID NO: 1160986 - RNA, 17 nt, Human
aucuuugcagacaggca

SEQ ID NO: 1160987 - RNA, 18 nt, Human
aucuuugcagacaggcaa

SEQ ID NO: 1160988 - RNA, 22 nt, Human
aucuuuucauuuaggugaggaa

SEQ ID NO: 1160989 - RNA, 18 nt, Human
augaaagggcccagagag

SEQ ID NO: 1160990 - RNA, 18 nt, Human
augaacuuguaaaggaau

SEQ ID NO: 1160991 - RNA, 19 nt, Human
augaaagggcccagagagg

SEQ ID NO: 1160992 - RNA, 15 nt, Human
augaauuacauuugu

SEQ ID NO: 1160993 - RNA, 23 nt, Human
augaauggcuaagcaaaauguga

SEQ ID NO: 1160994 - RNA, 16 nt, Human
augaauuacauuugua

SEQ ID NO: 1160995 - RNA, 17 nt, Human
augaauuacauuuguau

SEQ ID NO: 1160996 - RNA, 18 nt, Human
uuggggaccagagcugcc

SEQ ID NO: 1160997 - RNA, 14 nt, Human
uuggggauauuuuu

SEQ ID NO: 1160998 - RNA, 18 nt, Human
augcagccucacaguccu

SEQ ID NO: 1160999 - RNA, 18 nt, Human
uuuaaauauaugcuaagu

SEQ ID NO: 1161000 - RNA, 12 nt, Human
uuuaauucaguu

SEQ ID NO: 1161001 - RNA, 12 nt, Human
augcccagcccc

SEQ ID NO: 1161002 - RNA, 13 nt, Human
augcccagccccu

SEQ ID NO: 1161003 - RNA, 14 nt, Human
augcccagccccuu

SEQ ID NO: 1161004 - RNA, 15 nt, Human
augcccagccccuuc

SEQ ID NO: 1161005 - RNA, 21 nt, Human
augcgggccagugcuccagcc

SEQ ID NO: 1161006 - RNA, 20 nt, Human
augcgugcauaccacuuuug

SEQ ID NO: 1161007 - RNA, 23 nt, Human
augcagugguaugaucacggcuc

SEQ ID NO: 1161008 - RNA, 13 nt, Human
augcaguucugaa

SEQ ID NO: 1161009 - RNA, 15 nt, Human
augcaguucugaaga

SEQ ID NO: 1161010 - RNA, 13 nt, Human
uuguguucaccuu

SEQ ID NO: 1161011 - RNA, 21 nt, Human
uuguuccacaaguuaaauaaa

SEQ ID NO: 1161012 - RNA, 13 nt, Human
uuguguuacuaag

SEQ ID NO: 1161013 - RNA, 15 nt, Human
uuguguuacuaaguu

SEQ ID NO: 1161014 - RNA, 20 nt, Human
uuguguuacuaaguuuuuau

SEQ ID NO: 1161015 - RNA, 15 nt, Human
augauaacuggaaac

SEQ ID NO: 1161016 - RNA, 17 nt, Human
augaucuaggaagacuu

SEQ ID NO: 1161017 - RNA, 20 nt, Human
augaucuaggaagacuuugg

SEQ ID NO: 1161018 - RNA, 18 nt, Human
augauuaaguaaugauaa

SEQ ID NO: 1161019 - RNA, 22 nt, Human
augcaccagcccuuagcaggga

SEQ ID NO: 1161020 - RNA, 13 nt, Human
augcaccuggaau

SEQ ID NO: 1161021 - RNA, 14 nt, Human
augcaccuggaaua

SEQ ID NO: 1161022 - RNA, 17 nt, Human
augcacuuuguucuggc

SEQ ID NO: 1161023 - RNA, 19 nt, Human
augcacuuuguucuggcuc

SEQ ID NO: 1161024 - RNA, 20 nt, Human
augcacuuuguucuggcucu

SEQ ID NO: 1161025 - RNA, 21 nt, Human
augcacuuuguucuggcucuu

SEQ ID NO: 1161026 - RNA, 13 nt, Human
uuuaaagaaugcu

SEQ ID NO: 1161027 - RNA, 13 nt, Human
augcuaagugaaa

SEQ ID NO: 1161028 - RNA, 20 nt, Human
augcuagaacucccuuucaa

SEQ ID NO: 1161029 - RNA, 21 nt, Human
augcuagaacucccuuucaac

SEQ ID NO: 1161030 - RNA, 22 nt, Human
augcuagaacucccuuucaaca

SEQ ID NO: 1161031 - RNA, 13 nt, Human
augcugcuuuuuc

SEQ ID NO: 1161032 - RNA, 13 nt, Human
augcuucucacug

SEQ ID NO: 1161033 - RNA, 16 nt, Human
uuucaaacauauauaa

SEQ ID NO: 1161034 - RNA, 17 nt, Human
uuucaaacauauauaac

SEQ ID NO: 1161035 - RNA, 16 nt, Human
uuucaaacuuuacuau

SEQ ID NO: 1161036 - RNA, 22 nt, Human
uuucaaacuuuacuauggcccu

SEQ ID NO: 1161037 - RNA, 14 nt, Human
auggcacuaguauu

SEQ ID NO: 1161038 - RNA, 16 nt, Human
auggcacuaguauuuc

SEQ ID NO: 1161039 - RNA, 19 nt, Human
auggcuaagcaaaauguga

SEQ ID NO: 1161040 - RNA, 18 nt, Human
auggcuaauguacugcau

SEQ ID NO: 1161041 - RNA, 15 nt, Human
augggagagaagaga

SEQ ID NO: 1161042 - RNA, 19 nt, Human
augggagagaagagaaugc

SEQ ID NO: 1161043 - RNA, 17 nt, Human
uuuccaugaguccccug

SEQ ID NO: 1161044 - RNA, 18 nt, Human
uuuccaugaguccccugu

SEQ ID NO: 1161045 - RNA, 11 nt, Human
auggacuuugu

SEQ ID NO: 1161046 - RNA, 12 nt, Human
auggacuuuguu

SEQ ID NO: 1161047 - RNA, 21 nt, Human
uuucugcagccacuauuguua

SEQ ID NO: 1161048 - RNA, 19 nt, Human
uuucugcagccacuauugu

SEQ ID NO: 1161049 - RNA, 15 nt, Human
uuucuggcuaugcau

SEQ ID NO: 1161050 - RNA, 16 nt, Human
uuucuggcuaugcauu

SEQ ID NO: 1161051 - RNA, 18 nt, Human
uuucuggcuaugcauuug

SEQ ID NO: 1161052 - RNA, 19 nt, Human
uuucuggcuaugcauuuga

SEQ ID NO: 1161053 - RNA, 15 nt, Human
augggauccuggagu

SEQ ID NO: 1161054 - RNA, 18 nt, Human
augggcaacccccagccu

SEQ ID NO: 1161055 - RNA, 14 nt, Human
augggggugcauuu

SEQ ID NO: 1161056 - RNA, 13 nt, Human
auggggcccugcc

SEQ ID NO: 1161057 - RNA, 24 nt, Human
auggggcugcaccggcuggccugg

SEQ ID NO: 1161058 - RNA, 15 nt, Human
augggggugcauuug

SEQ ID NO: 1161059 - RNA, 18 nt, Human
augggccuccugugugug

SEQ ID NO: 1161060 - RNA, 20 nt, Human
augggcuggguucuacccag

SEQ ID NO: 1161061 - RNA, 15 nt, Human
augggugcuuggagg

SEQ ID NO: 1161062 - RNA, 20 nt, Human
auggugagggauacccaucc

SEQ ID NO: 1161063 - RNA, 20 nt, Human
augggugcuuggaggaagga

SEQ ID NO: 1161064 - RNA, 12 nt, Human
auggugcaauga

SEQ ID NO: 1161065 - RNA, 13 nt, Human
auggugcaaugac

SEQ ID NO: 1161066 - RNA, 15 nt, Human
auggugcaaugaccu

SEQ ID NO: 1161067 - RNA, 16 nt, Human
auggugcaaugaccuu

SEQ ID NO: 1161068 - RNA, 17 nt, Human
auggugcaaugaccuuu

SEQ ID NO: 1161069 - RNA, 19 nt, Human
auggugcaaugaccuuuca

SEQ ID NO: 1161070 - RNA, 12 nt, Human
augguggcuggg

SEQ ID NO: 1161071 - RNA, 13 nt, Human
augguggcugggu

SEQ ID NO: 1161072 - RNA, 15 nt, Human
augguggcuggguug

SEQ ID NO: 1161073 - RNA, 17 nt, Human
augguggcuggguugga

SEQ ID NO: 1161074 - RNA, 21 nt, Human
augguucccuugaugaagaag

SEQ ID NO: 1161075 - RNA, 14 nt, Human
augguuuucaaaau

SEQ ID NO: 1161076 - RNA, 15 nt, Human
augguuuucaaaaua

SEQ ID NO: 1161077 - RNA, 16 nt, Human
augguuuucaaaauaa

SEQ ID NO: 1161078 - RNA, 14 nt, Human
augguuuucuugug

SEQ ID NO: 1161079 - RNA, 16 nt, Human
auguauguguaaguau

SEQ ID NO: 1161080 - RNA, 12 nt, Human
augucaguguga

SEQ ID NO: 1161081 - RNA, 13 nt, Human
augucagugugac

SEQ ID NO: 1161082 - RNA, 15 nt, Human
augucagugugacug

SEQ ID NO: 1161083 - RNA, 17 nt, Human
auguccacugguucuuc

SEQ ID NO: 1161084 - RNA, 17 nt, Human
uuugugaagcaaaauuu

SEQ ID NO: 1161085 - RNA, 19 nt, Human
uuuguaguguuggagaaga

SEQ ID NO: 1161086 - RNA, 21 nt, Human
uuuguaguguuggagaagaac

SEQ ID NO: 1161087 - RNA, 23 nt, Human
augucucuuuaaugucacaggca

SEQ ID NO: 1161088 - RNA, 16 nt, Human
augugaugagaggaaa

SEQ ID NO: 1161089 - RNA, 17 nt, Human
augugaugagaggaaau

SEQ ID NO: 1161090 - RNA, 19 nt, Human
augugaugagaggaaauca

SEQ ID NO: 1161091 - RNA, 23 nt, Human
augugcacaugcacgugugugca

SEQ ID NO: 1161092 - RNA, 16 nt, Human
auguacuucaugcugu

SEQ ID NO: 1161093 - RNA, 12 nt, Human
auguagaggaga

SEQ ID NO: 1161094 - RNA, 13 nt, Human
auguagaggagaa

SEQ ID NO: 1161095 - RNA, 17 nt, Human
auguagaggagaaacug

SEQ ID NO: 1161096 - RNA, 19 nt, Human
auguagaggagaaacugga

SEQ ID NO: 1161097 - RNA, 12 nt, Human
uuugaccucugc

SEQ ID NO: 1161098 - RNA, 18 nt, Human
uuugaccucugcagcaau

SEQ ID NO: 1161099 - RNA, 13 nt, Human
uuugacgccaucc

SEQ ID NO: 1161100 - RNA, 14 nt, Human
uuugacgccauccc

SEQ ID NO: 1161101 - RNA, 16 nt, Human
uuugacgccaucccag

SEQ ID NO: 1161102 - RNA, 19 nt, Human
uuugacgccaucccagccc

SEQ ID NO: 1161103 - RNA, 20 nt, Human
uuugacgccaucccagcccc

SEQ ID NO: 1161104 - RNA, 22 nt, Human
uuugauguucuuucacccuuuu

SEQ ID NO: 1161105 - RNA, 13 nt, Human
uuugauuaaauuc

SEQ ID NO: 1161106 - RNA, 18 nt, Human
uuugauuaaauucuugca

SEQ ID NO: 1161107 - RNA, 21 nt, Human
uuugauuaaauucuugcaaag

SEQ ID NO: 1161108 - RNA, 23 nt, Human
uuugauuaaauucuugcaaagua

SEQ ID NO: 1161109 - RNA, 21 nt, Human
uuugauucagacagcugccug

SEQ ID NO: 1161110 - RNA, 22 nt, Human
uuugauucagacagcugccugg

SEQ ID NO: 1161111 - RNA, 14 nt, Human
uuugcaagccagau

SEQ ID NO: 1161112 - RNA, 15 nt, Human
uuugccguuauuaaa

SEQ ID NO: 1161113 - RNA, 13 nt, Human
uuugccucugccu

SEQ ID NO: 1161114 - RNA, 15 nt, Human
auuauauuuacaaau

SEQ ID NO: 1161115 - RNA, 19 nt, Human
auucagacagcugccuggg

SEQ ID NO: 1161116 - RNA, 12 nt, Human
auucaggaagcu

SEQ ID NO: 1161117 - RNA, 18 nt, Human
auucagacagcugccugg

SEQ ID NO: 1161118 - RNA, 14 nt, Human
auucagacagcugc

SEQ ID NO: 1161119 - RNA, 15 nt, Human
auucagacagcugcc

SEQ ID NO: 1161120 - RNA, 16 nt, Human
auucagacagcugccu

SEQ ID NO: 1161121 - RNA, 17 nt, Human
auucagacagcugccug

SEQ ID NO: 1161122 - RNA, 11 nt, Human
auucagacagc

SEQ ID NO: 1161123 - RNA, 12 nt, Human
auucagacagcu

SEQ ID NO: 1161124 - RNA, 13 nt, Human
auucagacagcug

SEQ ID NO: 1161125 - RNA, 13 nt, Human
auucaggaagcuc

SEQ ID NO: 1161126 - RNA, 22 nt, Human
auuccccacccugaaagcccug

SEQ ID NO: 1161127 - RNA, 15 nt, Human
auuauauuuauuacu

SEQ ID NO: 1161128 - RNA, 18 nt, Human
auuauauuuauuacugua

SEQ ID NO: 1161129 - RNA, 14 nt, Human
auuaucuagauacu

SEQ ID NO: 1161130 - RNA, 18 nt, Human
auuaucuagauacuguau

SEQ ID NO: 1161131 - RNA, 17 nt, Human
auucucauuugucacac

SEQ ID NO: 1161132 - RNA, 11 nt, Human
auucugccugc

SEQ ID NO: 1161133 - RNA, 13 nt, Human
auucugccugccc

SEQ ID NO: 1161134 - RNA, 14 nt, Human
auucugccugccca

SEQ ID NO: 1161135 - RNA, 15 nt, Human
auucugccugcccag

SEQ ID NO: 1161136 - RNA, 16 nt, Human
auucugccugcccagg

SEQ ID NO: 1161137 - RNA, 17 nt, Human
auucugccugcccaggc

SEQ ID NO: 1161138 - RNA, 18 nt, Human
auucugccugcccaggcc

SEQ ID NO: 1161139 - RNA, 19 nt, Human
auucugccugcccaggccc

SEQ ID NO: 1161140 - RNA, 20 nt, Human
auucugccugcccaggcccc

SEQ ID NO: 1161141 - RNA, 21 nt, Human
auucugccugcccaggccccu

SEQ ID NO: 1161142 - RNA, 18 nt, Human
auucugcucacauaucug

SEQ ID NO: 1161143 - RNA, 19 nt, Human
auucugcucacauaucugu

SEQ ID NO: 1161144 - RNA, 20 nt, Human
auucugcucacauaucuguc

SEQ ID NO: 1161145 - RNA, 21 nt, Human
auucugcucacauaucuguca

SEQ ID NO: 1161146 - RNA, 22 nt, Human
auucugcucacauaucugucau

SEQ ID NO: 1161147 - RNA, 14 nt, Human
auucuguuggccag

SEQ ID NO: 1161148 - RNA, 19 nt, Human
auucuguuggccaguguga

SEQ ID NO: 1161149 - RNA, 21 nt, Human
auucuguuggccagugugaca

SEQ ID NO: 1161150 - RNA, 19 nt, Human
auugacacuuaaaaauggu

SEQ ID NO: 1161151 - RNA, 20 nt, Human
auugacacuuaaaaaugguu

SEQ ID NO: 1161152 - RNA, 15 nt, Human
auugacacuuaaaaa

SEQ ID NO: 1161153 - RNA, 17 nt, Human
auugacacuuaaaaaug

SEQ ID NO: 1161154 - RNA, 14 nt, Human
auucuuaaauaugu

SEQ ID NO: 1161155 - RNA, 13 nt, Human
auucuuccucccu

SEQ ID NO: 1161156 - RNA, 15 nt, Human
auugaaaaaccauuu

SEQ ID NO: 1161157 - RNA, 17 nt, Human
auugaaaucuuuuugcu

SEQ ID NO: 1161158 - RNA, 18 nt, Human
auugaaaucuuuuugcuu

SEQ ID NO: 1161159 - RNA, 20 nt, Human
auugaaaucuuuuugcuuug

SEQ ID NO: 1161160 - RNA, 19 nt, Human
auuggacaguaaaauccac

SEQ ID NO: 1161161 - RNA, 13 nt, Human
auugacuuuuuau

SEQ ID NO: 1161162 - RNA, 18 nt, Human
auugacuuuuuauggcac

SEQ ID NO: 1161163 - RNA, 21 nt, Human
auugauuuccguuaaaauacc

SEQ ID NO: 1161164 - RNA, 23 nt, Human
auugucaaaguggugagaggcau

SEQ ID NO: 1161165 - RNA, 13 nt, Human
auugucuagugaa

SEQ ID NO: 1161166 - RNA, 13 nt, Human
auugugggaaggg

SEQ ID NO: 1161167 - RNA, 14 nt, Human
auugugggaagggg

SEQ ID NO: 1161168 - RNA, 14 nt, Human
auuuaaaagauaca

SEQ ID NO: 1161169 - RNA, 16 nt, Human
auuuaaaagauacagu

SEQ ID NO: 1161170 - RNA, 17 nt, Human
auuuaaaagauacaguu

SEQ ID NO: 1161171 - RNA, 22 nt, Human
auuuuaaaaauacagauagaua

SEQ ID NO: 1161172 - RNA, 16 nt, Human
auuuuaaaagaaugau

SEQ ID NO: 1161173 - RNA, 17 nt, Human
auuuuaaaagaaugauu

SEQ ID NO: 1161174 - RNA, 23 nt, Human
auuuuaaaagaaugauuaugaau

SEQ ID NO: 1161175 - RNA, 22 nt, Human
auuuguaguguuggagaagaac

SEQ ID NO: 1161176 - RNA, 14 nt, Human
auuuguauaaaaua

SEQ ID NO: 1161177 - RNA, 15 nt, Human
auuuguauaaaauaa

SEQ ID NO: 1161178 - RNA, 20 nt, Human
auuucuugagguaaaagcau

SEQ ID NO: 1161179 - RNA, 16 nt, Human
auuugaaaauuuugau

SEQ ID NO: 1161180 - RNA, 20 nt, Human
auuucuuccacaagagccca

SEQ ID NO: 1161181 - RNA, 23 nt, Human
auuucuuccacaagagcccaggc

SEQ ID NO: 1161182 - RNA, 12 nt, Human
auuuauuuaaau

SEQ ID NO: 1161183 - RNA, 14 nt, Human
auuuauuuaaauuu

SEQ ID NO: 1161184 - RNA, 14 nt, Human
auuuauuuuaauaa

SEQ ID NO: 1161185 - RNA, 17 nt, Human
auuuauuuuaauaaugu

SEQ ID NO: 1161186 - RNA, 19 nt, Human
auuucccaaagcagugcau

SEQ ID NO: 1161187 - RNA, 20 nt, Human
auuuugcuaaaugugaauga

SEQ ID NO: 1161188 - RNA, 21 nt, Human
auuuugcugucccuuuuccuu

SEQ ID NO: 1161189 - RNA, 19 nt, Human
auuuugauccaagcugguc

SEQ ID NO: 1161190 - RNA, 15 nt, Human
auuuugauguuuuaa

SEQ ID NO: 1161191 - RNA, 17 nt, Human
auuuugauguuuuaagg

SEQ ID NO: 1161192 - RNA, 15 nt, Human
auuuucuauaauuua

SEQ ID NO: 1161193 - RNA, 14 nt, Human
auuuucuauaauuu

SEQ ID NO: 1161194 - RNA, 19 nt, Human
auuuucccuauuagagaag

SEQ ID NO: 1161195 - RNA, 16 nt, Human
auuuuccugccaggca

SEQ ID NO: 1161196 - RNA, 12 nt, Human
auuuuaauaaug

SEQ ID NO: 1161197 - RNA, 12 nt, Human
auuuugcuuugu

SEQ ID NO: 1161198 - RNA, 18 nt, Human
auuuugcuuugugauuuu

SEQ ID NO: 1161199 - RNA, 20 nt, Human
auuuugcuuugugauuuuug

SEQ ID NO: 1161200 - RNA, 14 nt, Human
auuuuggaaaauaa

SEQ ID NO: 1161201 - RNA, 19 nt, Human
auuuuggaaaauaaauuau

SEQ ID NO: 1161202 - RNA, 20 nt, Human
auuuuggaaaauaaauuauu

SEQ ID NO: 1161203 - RNA, 23 nt, Human
auuuugucauauaagauucauau

SEQ ID NO: 1161204 - RNA, 19 nt, Human
auuuugugcccccauguaa

SEQ ID NO: 1161205 - RNA, 13 nt, Human
auuuuuuaaaugc

SEQ ID NO: 1161206 - RNA, 14 nt, Human
auuuuuuaaaugca

SEQ ID NO: 1161207 - RNA, 22 nt, Human
auuuuugugauuuugugauuga

SEQ ID NO: 1161208 - RNA, 12 nt, Human
auuuuuguaauu

SEQ ID NO: 1161209 - RNA, 19 nt, Human
auuuuuguagagccagggu

SEQ ID NO: 1161210 - RNA, 20 nt, Human
auuuuuucucuaggaaauau

SEQ ID NO: 1161211 - RNA, 23 nt, Human
auuuuuucucuaggaaauauuua

SEQ ID NO: 1161212 - RNA, 18 nt, Human
auuuuuuguuaaaugauu

SEQ ID NO: 1161213 - RNA, 21 nt, Human
auuuuguuuuugucuuaaaaa

SEQ ID NO: 1161214 - RNA, 21 nt, Human
auuuuucuuagggaaggauac

SEQ ID NO: 1161215 - RNA, 22 nt, Human
auuuuucuuagggaaggauaca

SEQ ID NO: 1161216 - RNA, 18 nt, Human
ggggaauguuugccucug

SEQ ID NO: 1161217 - RNA, 22 nt, Human
ggggaauguuugccucugccuc

SEQ ID NO: 1161218 - RNA, 19 nt, Human
ggggaauugaggacacuga

SEQ ID NO: 1161219 - RNA, 16 nt, Human
ggggaccagagcugcc

SEQ ID NO: 1161220 - RNA, 14 nt, Human
aaacaguagugaua

SEQ ID NO: 1161221 - RNA, 13 nt, Human
ggggaccucaggc

SEQ ID NO: 1161222 - RNA, 11 nt, Human
ggggagaaagu

SEQ ID NO: 1161223 - RNA, 15 nt, Human
ggggccucagugcca

SEQ ID NO: 1161224 - RNA, 12 nt, Human
gggggccucagu

SEQ ID NO: 1161225 - RNA, 15 nt, Human
gggggccucagugcc

SEQ ID NO: 1161226 - RNA, 17 nt, Human
gggggccucagugccac

SEQ ID NO: 1161227 - RNA, 18 nt, Human
gggggccucagugccacu

SEQ ID NO: 1161228 - RNA, 12 nt, Human
aaacacauuuuu

SEQ ID NO: 1161229 - RNA, 11 nt, Human
aaacacauuuu

SEQ ID NO: 1161230 - RNA, 19 nt, Human
aaacacaaacgggcucagc

SEQ ID NO: 1161231 - RNA, 13 nt, Human
gggaugagaaagg

SEQ ID NO: 1161232 - RNA, 19 nt, Human
aaaauuuagaaauauaauu

SEQ ID NO: 1161233 - RNA, 20 nt, Human
aaaauuuugauguuuuaagg

SEQ ID NO: 1161234 - RNA, 23 nt, Human
aaaccaagucaagugaaaaagga

SEQ ID NO: 1161235 - RNA, 15 nt, Human
aaacgggcucagcaa

SEQ ID NO: 1161236 - RNA, 13 nt, Human
aaacucuccucug

SEQ ID NO: 1161237 - RNA, 19 nt, Human
aaacuguuaauaguucagg

SEQ ID NO: 1161238 - RNA, 16 nt, Human
aaacuuaaucuaaaug

SEQ ID NO: 1161239 - RNA, 17 nt, Human
aaacuuaaucuaaaugg

SEQ ID NO: 1161240 - RNA, 18 nt, Human
aaacuuaaucuaaaugga

SEQ ID NO: 1161241 - RNA, 19 nt, Human
aaacuuaaucuaaauggaa

SEQ ID NO: 1161242 - RNA, 15 nt, Human
aaacucguuaauuug

SEQ ID NO: 1161243 - RNA, 11 nt, Human
gguccugcugc

SEQ ID NO: 1161244 - RNA, 12 nt, Human
gguccugcugca

SEQ ID NO: 1161245 - RNA, 14 nt, Human
gguccugcugcagu

SEQ ID NO: 1161246 - RNA, 23 nt, Human
aaagacugaguacguugugcauu

SEQ ID NO: 1161247 - RNA, 13 nt, Human
aaagacuguacaa

SEQ ID NO: 1161248 - RNA, 14 nt, Human
aaagacuguacaaa

SEQ ID NO: 1161249 - RNA, 15 nt, Human
aaagaggaaugaagu

SEQ ID NO: 1161250 - RNA, 17 nt, Human
aaagaugcuucucacug

SEQ ID NO: 1161251 - RNA, 19 nt, Human
aaagaugcuucucacugcc

SEQ ID NO: 1161252 - RNA, 13 nt, Human
aaagacagugaaa

SEQ ID NO: 1161253 - RNA, 14 nt, Human
ggguggccucccaa

SEQ ID NO: 1161254 - RNA, 23 nt, Human
aaacuucagcgguuuauauaagc

SEQ ID NO: 1161255 - RNA, 13 nt, Human
aaagcugcugaca

SEQ ID NO: 1161256 - RNA, 21 nt, Human
aaaggagagcuagcagcaggg

SEQ ID NO: 1161257 - RNA, 17 nt, Human
aaaggagauuggaagga

SEQ ID NO: 1161258 - RNA, 22 nt, Human
aaagggacuuggaagcuccgcu

SEQ ID NO: 1161259 - RNA, 14 nt, Human
aaagguacuucaaa

SEQ ID NO: 1161260 - RNA, 13 nt, Human
ggucgaggcagga

SEQ ID NO: 1161261 - RNA, 13 nt, Human
ggugaacagaaca

SEQ ID NO: 1161262 - RNA, 18 nt, Human
ggugauccacccaccuca

SEQ ID NO: 1161263 - RNA, 23 nt, Human
ggugauccacccaccucagccuc

SEQ ID NO: 1161264 - RNA, 24 nt, Human
ggugauccacccaccucagccucc

SEQ ID NO: 1161265 - RNA, 12 nt, Human
ggugcaaugacc

SEQ ID NO: 1161266 - RNA, 13 nt, Human
ggugcaaugaccu

SEQ ID NO: 1161267 - RNA, 16 nt, Human
ggugcaaugaccuuuc

SEQ ID NO: 1161268 - RNA, 21 nt, Human
ggugcauuugaggucuguucu

SEQ ID NO: 1161269 - RNA, 13 nt, Human
gguggaugccugg

SEQ ID NO: 1161270 - RNA, 12 nt, Human
aaauauacugua

SEQ ID NO: 1161271 - RNA, 13 nt, Human
aaauauacuguaa

SEQ ID NO: 1161272 - RNA, 14 nt, Human
aaauauacuguaaa

SEQ ID NO: 1161273 - RNA, 15 nt, Human
aaauauacuguaaag

SEQ ID NO: 1161274 - RNA, 16 nt, Human
aaauauacuguaaaga

SEQ ID NO: 1161275 - RNA, 17 nt, Human
aaauauacuguaaagaa

SEQ ID NO: 1161276 - RNA, 19 nt, Human
aaauauacuguaaagaaag

SEQ ID NO: 1161277 - RNA, 21 nt, Human
aaauauacuguaaagaaagag

SEQ ID NO: 1161278 - RNA, 23 nt, Human
aaauauacuguaaagaaagagag

SEQ ID NO: 1161279 - RNA, 17 nt, Human
aaauauuauguuaaaac

SEQ ID NO: 1161280 - RNA, 19 nt, Human
aaaucagccguguaaccau

SEQ ID NO: 1161281 - RNA, 12 nt, Human
aaaucagccugc

SEQ ID NO: 1161282 - RNA, 18 nt, Human
aaaucagccugcuccagc

SEQ ID NO: 1161283 - RNA, 12 nt, Human
guacccacugcu

SEQ ID NO: 1161284 - RNA, 15 nt, Human
aaauccauacauuug

SEQ ID NO: 1161285 - RNA, 18 nt, Human
aaauccauacauuugugu

SEQ ID NO: 1161286 - RNA, 14 nt, Human
guacaugaaaacac

SEQ ID NO: 1161287 - RNA, 15 nt, Human
guacaugaaaacaca

SEQ ID NO: 1161288 - RNA, 16 nt, Human
guacaugaaaacacau

SEQ ID NO: 1161289 - RNA, 17 nt, Human
guacaugaaaacacauu

SEQ ID NO: 1161290 - RNA, 18 nt, Human
guacaugaaaacacauuu

SEQ ID NO: 1161291 - RNA, 19 nt, Human
guacaugaaaacacauuuu

SEQ ID NO: 1161292 - RNA, 20 nt, Human
guacaugaaaacacauuuuu

SEQ ID NO: 1161293 - RNA, 19 nt, Human
guacauggaauaacaugua

SEQ ID NO: 1161294 - RNA, 15 nt, Human
guacuauguaucaau

SEQ ID NO: 1161295 - RNA, 17 nt, Human
guacuauguaucaauga

SEQ ID NO: 1161296 - RNA, 13 nt, Human
guacccacugcuc

SEQ ID NO: 1161297 - RNA, 14 nt, Human
guacccacugcucu

SEQ ID NO: 1161298 - RNA, 18 nt, Human
guacuacaguccucccau

SEQ ID NO: 1161299 - RNA, 19 nt, Human
guacuacaguccucccauc

SEQ ID NO: 1161300 - RNA, 13 nt, Human
guacuauguauca

SEQ ID NO: 1161301 - RNA, 21 nt, Human
guacuucaaauccuugaagau

SEQ ID NO: 1161302 - RNA, 22 nt, Human
guacuucaaauccuugaagauu

SEQ ID NO: 1161303 - RNA, 15 nt, Human
guacuucaugcuguc

SEQ ID NO: 1161304 - RNA, 16 nt, Human
guacuggagaaaaugg

SEQ ID NO: 1161305 - RNA, 11 nt, Human
guagagacagg

SEQ ID NO: 1161306 - RNA, 12 nt, Human
guagagacaggg

SEQ ID NO: 1161307 - RNA, 13 nt, Human
guagagacagggu

SEQ ID NO: 1161308 - RNA, 10 nt, Human
guagagccag

SEQ ID NO: 1161309 - RNA, 11 nt, Human
guagagccagg

SEQ ID NO: 1161310 - RNA, 15 nt, Human
guagagccagggucu

SEQ ID NO: 1161311 - RNA, 18 nt, Human
guagagccagggucucac

SEQ ID NO: 1161312 - RNA, 20 nt, Human
guagaaauaucugaaaaugu

SEQ ID NO: 1161313 - RNA, 21 nt, Human
guagaaauaucugaaaaugua

SEQ ID NO: 1161314 - RNA, 23 nt, Human
guagaaauaucugaaaauguaug

SEQ ID NO: 1161315 - RNA, 18 nt, Human
guagaagcccuucuaccu

SEQ ID NO: 1161316 - RNA, 21 nt, Human
guagaagucuuagauguauau

SEQ ID NO: 1161317 - RNA, 14 nt, Human
guaauaugcacaca

SEQ ID NO: 1161318 - RNA, 16 nt, Human
guaauaugcacacauu

SEQ ID NO: 1161319 - RNA, 17 nt, Human
guaauaugcacacauuu

SEQ ID NO: 1161320 - RNA, 18 nt, Human
guaauaugcacacauuuu

SEQ ID NO: 1161321 - RNA, 20 nt, Human
guaauaggcguaacuaauuu

SEQ ID NO: 1161322 - RNA, 14 nt, Human
guaaagaaagagag

SEQ ID NO: 1161323 - RNA, 15 nt, Human
guaaagaaagagaga

SEQ ID NO: 1161324 - RNA, 16 nt, Human
guaaagaaagagagaa

SEQ ID NO: 1161325 - RNA, 17 nt, Human
guaaagaaagagagaaa

SEQ ID NO: 1161326 - RNA, 18 nt, Human
guaaagaaagagagaaaa

SEQ ID NO: 1161327 - RNA, 19 nt, Human
guaaagaaagagagaaaau

SEQ ID NO: 1161328 - RNA, 20 nt, Human
guaaagaaagagagaaaaua

SEQ ID NO: 1161329 - RNA, 21 nt, Human
guaaagaaagagagaaaauaa

SEQ ID NO: 1161330 - RNA, 22 nt, Human
guaaagaaagagagaaaauaaa

SEQ ID NO: 1161331 - RNA, 23 nt, Human
guaaagaaagagagaaaauaaaa

SEQ ID NO: 1161332 - RNA, 21 nt, Human
guaauuuuuuuaucgucacug

SEQ ID NO: 1161333 - RNA, 23 nt, Human
guacacugccuucucaacuccaa

SEQ ID NO: 1161334 - RNA, 22 nt, Human
aaauaauuuuuauauuugaaau

SEQ ID NO: 1161335 - RNA, 23 nt, Human
aaauaauuuuuauauuugaaaua

SEQ ID NO: 1161336 - RNA, 17 nt, Human
aaauacagauagauaua

SEQ ID NO: 1161337 - RNA, 18 nt, Human
aaauaccagccaguaaau

SEQ ID NO: 1161338 - RNA, 20 nt, Human
aaagguauuuuaaucaccaa

SEQ ID NO: 1161339 - RNA, 19 nt, Human
aaaguacuucuccacccug

SEQ ID NO: 1161340 - RNA, 20 nt, Human
aaaguacuucuccacccugc

SEQ ID NO: 1161341 - RNA, 21 nt, Human
aaaguacuucuccacccugcu

SEQ ID NO: 1161342 - RNA, 23 nt, Human
aaaguacuucuccacccugcucu

SEQ ID NO: 1161343 - RNA, 18 nt, Human
aaaguaucccuacuguaa

SEQ ID NO: 1161344 - RNA, 18 nt, Human
aaaguauguuagugcaaa

SEQ ID NO: 1161345 - RNA, 23 nt, Human
aaaguucugcagauaaacaguag

SEQ ID NO: 1161346 - RNA, 10 nt, Human
aaauaaaaag

SEQ ID NO: 1161347 - RNA, 12 nt, Human
aaauaaaaaguu

SEQ ID NO: 1161348 - RNA, 13 nt, Human
aaauaaaaaguua

SEQ ID NO: 1161349 - RNA, 14 nt, Human
aaauaaaaaguuaa

SEQ ID NO: 1161350 - RNA, 15 nt, Human
aaauaaaaaguuaaa

SEQ ID NO: 1161351 - RNA, 19 nt, Human
aaauaaaaaguuaaaaagu

SEQ ID NO: 1161352 - RNA, 15 nt, Human
aaauaauuuuuauau

SEQ ID NO: 1161353 - RNA, 22 nt, Human
ggcuucauccuccucagaucuu

SEQ ID NO: 1161354 - RNA, 18 nt, Human
ggcuucauccuccucaga

SEQ ID NO: 1161355 - RNA, 16 nt, Human
ggcuuccucauaguau

SEQ ID NO: 1161356 - RNA, 22 nt, Human
ggcuggguucuacccaggugcu

SEQ ID NO: 1161357 - RNA, 18 nt, Human
ggcuguaucccaugagcc

SEQ ID NO: 1161358 - RNA, 19 nt, Human
ggcuguaucccaugagccu

SEQ ID NO: 1161359 - RNA, 18 nt, Human
ggcuucaguggcagcugc

SEQ ID NO: 1161360 - RNA, 19 nt, Human
ggcuucaguggcagcugcu

SEQ ID NO: 1161361 - RNA, 20 nt, Human
ggcuucaguggcagcugcuu

SEQ ID NO: 1161362 - RNA, 14 nt, Human
aaaaauaacaauga

SEQ ID NO: 1161363 - RNA, 15 nt, Human
ggcugggggccucag

SEQ ID NO: 1161364 - RNA, 16 nt, Human
ggcugggggccucagu

SEQ ID NO: 1161365 - RNA, 17 nt, Human
ggcugggggccucagug

SEQ ID NO: 1161366 - RNA, 19 nt, Human
ggcugggggccucagugcc

SEQ ID NO: 1161367 - RNA, 19 nt, Human
ggcuggguggcaccagcag

SEQ ID NO: 1161368 - RNA, 19 nt, Human
ggcuggguucuacccaggu

SEQ ID NO: 1161369 - RNA, 21 nt, Human
ggcuggguucuacccaggugc

SEQ ID NO: 1161370 - RNA, 21 nt, Human
ggcuuccuccugguguggaag

SEQ ID NO: 1161371 - RNA, 18 nt, Human
gggaagaagcucucuccu

SEQ ID NO: 1161372 - RNA, 12 nt, Human
gggacagcuccu

SEQ ID NO: 1161373 - RNA, 13 nt, Human
gggacagcuccuu

SEQ ID NO: 1161374 - RNA, 13 nt, Human
gggaagagacuug

SEQ ID NO: 1161375 - RNA, 15 nt, Human
gggacagcuccuucu

SEQ ID NO: 1161376 - RNA, 16 nt, Human
gggacagcuccuucug

SEQ ID NO: 1161377 - RNA, 20 nt, Human
gggacagucaccucauggaa

SEQ ID NO: 1161378 - RNA, 21 nt, Human
gggacagucaccucauggaau

SEQ ID NO: 1161379 - RNA, 22 nt, Human
gggacagucaccucauggaauu

SEQ ID NO: 1161380 - RNA, 22 nt, Human
aaaacuugauguguuaucucuu

SEQ ID NO: 1161381 - RNA, 15 nt, Human
aaaacuucagacaua

SEQ ID NO: 1161382 - RNA, 18 nt, Human
aaaacugauuuuuuuuuc

SEQ ID NO: 1161383 - RNA, 18 nt, Human
aaaacucuccucugcugc

SEQ ID NO: 1161384 - RNA, 14 nt, Human
aaaacguggcugcu

SEQ ID NO: 1161385 - RNA, 15 nt, Human
aaaacaugcuacaca

SEQ ID NO: 1161386 - RNA, 12 nt, Human
aaaacccaagug

SEQ ID NO: 1161387 - RNA, 13 nt, Human
aaaacaugcuaca

SEQ ID NO: 1161388 - RNA, 14 nt, Human
aaaacaugcuacac

SEQ ID NO: 1161389 - RNA, 19 nt, Human
gggacauuugcucauggaa

SEQ ID NO: 1161390 - RNA, 14 nt, Human
gggaccagagcugc

SEQ ID NO: 1161391 - RNA, 20 nt, Human
gggaccagagcugccaccug

SEQ ID NO: 1161392 - RNA, 17 nt, Human
aaaaaugguuuaaaugg

SEQ ID NO: 1161393 - RNA, 15 nt, Human
gggacuuggaagcuc

SEQ ID NO: 1161394 - RNA, 17 nt, Human
gggacuuggaagcuccg

SEQ ID NO: 1161395 - RNA, 18 nt, Human
gggacuuggaagcuccgc

SEQ ID NO: 1161396 - RNA, 23 nt, Human
gggacuuggaagcuccgcuuucu

SEQ ID NO: 1161397 - RNA, 21 nt, Human
gggagaaccaaaaagaggcua

SEQ ID NO: 1161398 - RNA, 15 nt, Human
gggagagccuuccag

SEQ ID NO: 1161399 - RNA, 19 nt, Human
gggagagccuuccaggggu

SEQ ID NO: 1161400 - RNA, 23 nt, Human
gggagcaggcucgggcuccccag

SEQ ID NO: 1161401 - RNA, 15 nt, Human
gggagggagggcucc

SEQ ID NO: 1161402 - RNA, 16 nt, Human
gggagggagggcucca

SEQ ID NO: 1161403 - RNA, 18 nt, Human
gggaggucaaggcugcag

SEQ ID NO: 1161404 - RNA, 15 nt, Human
gggaggucgaggcag

SEQ ID NO: 1161405 - RNA, 19 nt, Human
ggcugccaaugggagcuca

SEQ ID NO: 1161406 - RNA, 20 nt, Human
ggcugccaaugggagcucau

SEQ ID NO: 1161407 - RNA, 21 nt, Human
ggcugccaaugggagcucaug

SEQ ID NO: 1161408 - RNA, 22 nt, Human
ggcugcggaaugaaccacaucu

SEQ ID NO: 1161409 - RNA, 14 nt, Human
ggcucuuccaggcu

SEQ ID NO: 1161410 - RNA, 12 nt, Human
ggcucuuccagg

SEQ ID NO: 1161411 - RNA, 13 nt, Human
ggcucucaggcca

SEQ ID NO: 1161412 - RNA, 14 nt, Human
ggcucucaggccag

SEQ ID NO: 1161413 - RNA, 11 nt, Human
ggcucucaggc

SEQ ID NO: 1161414 - RNA, 18 nt, Human
ggcugggagagccuucca

SEQ ID NO: 1161415 - RNA, 13 nt, Human
ggcugcugaaggc

SEQ ID NO: 1161416 - RNA, 14 nt, Human
ggcugggagagccu

SEQ ID NO: 1161417 - RNA, 15 nt, Human
ggcugggagagccuu

SEQ ID NO: 1161418 - RNA, 16 nt, Human
ggcugggagagccuuc

SEQ ID NO: 1161419 - RNA, 14 nt, Human
ggcuccacuugguc

SEQ ID NO: 1161420 - RNA, 16 nt, Human
ggcuccacuuggucug

SEQ ID NO: 1161421 - RNA, 19 nt, Human
ggcucagcaaaagaugcuu

SEQ ID NO: 1161422 - RNA, 18 nt, Human
ggcucagcggggacagcu

SEQ ID NO: 1161423 - RNA, 19 nt, Human
ggcucagcggggacagcuc

SEQ ID NO: 1161424 - RNA, 20 nt, Human
ggcucagcggggacagcucc

SEQ ID NO: 1161425 - RNA, 19 nt, Human
ggcucagguggggucacuc

SEQ ID NO: 1161426 - RNA, 20 nt, Human
ggcucagguggggucacucu

SEQ ID NO: 1161427 - RNA, 22 nt, Human
ggcccuucucuccagccccugg

SEQ ID NO: 1161428 - RNA, 23 nt, Human
ggcccuucucuccagccccugga

SEQ ID NO: 1161429 - RNA, 14 nt, Human
ggccuccauccuga

SEQ ID NO: 1161430 - RNA, 15 nt, Human
ggccuccauccugag

SEQ ID NO: 1161431 - RNA, 16 nt, Human
ggccuccauccugagg

SEQ ID NO: 1161432 - RNA, 23 nt, Human
ggccccugcugguucaggguugg

SEQ ID NO: 1161433 - RNA, 13 nt, Human
ggcccggcuccag

SEQ ID NO: 1161434 - RNA, 13 nt, Human
ggccccugcuggu

SEQ ID NO: 1161435 - RNA, 14 nt, Human
ggccccugcugguu

SEQ ID NO: 1161436 - RNA, 15 nt, Human
ggcccggcuccaggc

SEQ ID NO: 1161437 - RNA, 20 nt, Human
ggcccuucucuccagccccu

SEQ ID NO: 1161438 - RNA, 21 nt, Human
ggcccuucucuccagccccug

SEQ ID NO: 1161439 - RNA, 20 nt, Human
ggccagugugacaaggauug

SEQ ID NO: 1161440 - RNA, 14 nt, Human
ggccaguugguccc

SEQ ID NO: 1161441 - RNA, 17 nt, Human
ggccaguuggucccccu

SEQ ID NO: 1161442 - RNA, 11 nt, Human
ggcagccccug

SEQ ID NO: 1161443 - RNA, 20 nt, Human
ggcacagaaaauggaagaca

SEQ ID NO: 1161444 - RNA, 21 nt, Human
ggcacagaaaauggaagacag

SEQ ID NO: 1161445 - RNA, 23 nt, Human
ggcacagaaaauggaagacagcu

SEQ ID NO: 1161446 - RNA, 13 nt, Human
ggcacaucagcac

SEQ ID NO: 1161447 - RNA, 18 nt, Human
ggcacaucagcacgauuu

SEQ ID NO: 1161448 - RNA, 23 nt, Human
ggcacucagaagacacugauggg

SEQ ID NO: 1161449 - RNA, 16 nt, Human
ggagagaagagaaugc

SEQ ID NO: 1161450 - RNA, 20 nt, Human
ggcaguggugguuuucuguu

SEQ ID NO: 1161451 - RNA, 21 nt, Human
ggcaguggugguuuucuguuc

SEQ ID NO: 1161452 - RNA, 22 nt, Human
ggcagccccuguucuggcagag

SEQ ID NO: 1161453 - RNA, 14 nt, Human
ggacuuggaagcuc

SEQ ID NO: 1161454 - RNA, 15 nt, Human
ggacuuggaagcucc

SEQ ID NO: 1161455 - RNA, 9 nt, Human
ggacuuugu

SEQ ID NO: 1161456 - RNA, 13 nt, Human
ggagaaacuggaa

SEQ ID NO: 1161457 - RNA, 16 nt, Human
ggagaaaggaagggcu

SEQ ID NO: 1161458 - RNA, 20 nt, Human
ggacuaacuugucuuuggac

SEQ ID NO: 1161459 - RNA, 24 nt, Human
ggacuaacuugucuuuggacccug

SEQ ID NO: 1161460 - RNA, 14 nt, Human
ggacuacaggugug

SEQ ID NO: 1161461 - RNA, 15 nt, Human
ggacucaaugcacug

SEQ ID NO: 1161462 - RNA, 16 nt, Human
ggacucaaugcacuga

SEQ ID NO: 1161463 - RNA, 18 nt, Human
ggacucaaugcacugaca

SEQ ID NO: 1161464 - RNA, 11 nt, Human
ggacccugagg

SEQ ID NO: 1161465 - RNA, 12 nt, Human
ggacccccugaa

SEQ ID NO: 1161466 - RNA, 12 nt, Human
ggacccugaggc

SEQ ID NO: 1161467 - RNA, 13 nt, Human
ggacccugaggcc

SEQ ID NO: 1161468 - RNA, 13 nt, Human
ggaccucaggccu

SEQ ID NO: 1161469 - RNA, 14 nt, Human
ggaccucaggccug

SEQ ID NO: 1161470 - RNA, 15 nt, Human
ggaccucaggccugg

SEQ ID NO: 1161471 - RNA, 20 nt, Human
ggaccucaggccugggggcu

SEQ ID NO: 1161472 - RNA, 20 nt, Human
ggacguguuaugacuccaga

SEQ ID NO: 1161473 - RNA, 23 nt, Human
ggacaggcauguucucugaggac

SEQ ID NO: 1161474 - RNA, 15 nt, Human
ggacacagcucuucu

SEQ ID NO: 1161475 - RNA, 18 nt, Human
ggacacagcucuucucca

SEQ ID NO: 1161476 - RNA, 21 nt, Human
ggacacagcucuucuccaggc

SEQ ID NO: 1161477 - RNA, 17 nt, Human
ggacacuaaccacgcug

SEQ ID NO: 1161478 - RNA, 22 nt, Human
ggacacuaaccacgcuggaccu

SEQ ID NO: 1161479 - RNA, 19 nt, Human
ggacagcuccuucuguccu

SEQ ID NO: 1161480 - RNA, 20 nt, Human
ggacagcuccuucuguccua

SEQ ID NO: 1161481 - RNA, 18 nt, Human
ggaauaacauguaauuaa

SEQ ID NO: 1161482 - RNA, 16 nt, Human
ggaauccagacccggc

SEQ ID NO: 1161483 - RNA, 13 nt, Human
ggacaagagcagg

SEQ ID NO: 1161484 - RNA, 22 nt, Human
ggacaaggaugaucuaggaaga

SEQ ID NO: 1161485 - RNA, 23 nt, Human
ggacaaggaugaucuaggaagac

SEQ ID NO: 1161486 - RNA, 15 nt, Human
ggaagccgcuggggc

SEQ ID NO: 1161487 - RNA, 15 nt, Human
ggaagcucagggccu

SEQ ID NO: 1161488 - RNA, 23 nt, Human
ggaagcucagggccuggcucagg

SEQ ID NO: 1161489 - RNA, 11 nt, Human
ggaagcuccgc

SEQ ID NO: 1161490 - RNA, 16 nt, Human
ggaaggaaacccagcu

SEQ ID NO: 1161491 - RNA, 19 nt, Human
ggaaggaaacccagcucug

SEQ ID NO: 1161492 - RNA, 20 nt, Human
ggaaggaaacccagcucugg

SEQ ID NO: 1161493 - RNA, 12 nt, Human
ggaacacucuga

SEQ ID NO: 1161494 - RNA, 14 nt, Human
ggaacacucugaga

SEQ ID NO: 1161495 - RNA, 15 nt, Human
ggaacacucugagac

SEQ ID NO: 1161496 - RNA, 16 nt, Human
ggaacacucugagacu

SEQ ID NO: 1161497 - RNA, 17 nt, Human
ggaacagacuggaagca

SEQ ID NO: 1161498 - RNA, 13 nt, Human
ggaagacagcucu

SEQ ID NO: 1161499 - RNA, 14 nt, Human
ggaagacagcucuu

SEQ ID NO: 1161500 - RNA, 13 nt, Human
ggaagacuuugga

SEQ ID NO: 1161501 - RNA, 17 nt, Human
ggaagacuuuggaaaga

SEQ ID NO: 1161502 - RNA, 18 nt, Human
ggaagacuuuggaaagag

SEQ ID NO: 1161503 - RNA, 13 nt, Human
ggaagagaaaaaa

SEQ ID NO: 1161504 - RNA, 15 nt, Human
ggaagagaaaaaaua

SEQ ID NO: 1161505 - RNA, 21 nt, Human
gcuggguggcaccagcagccu

SEQ ID NO: 1161506 - RNA, 22 nt, Human
gcuggguggcaccagcagccug

SEQ ID NO: 1161507 - RNA, 23 nt, Human
gcuggguggcaccagcagccugg

SEQ ID NO: 1161508 - RNA, 15 nt, Human
gcuggcuguuggcug

SEQ ID NO: 1161509 - RNA, 16 nt, Human
gcuggcuguuggcugg

SEQ ID NO: 1161510 - RNA, 17 nt, Human
gcuggcuguuggcuggg

SEQ ID NO: 1161511 - RNA, 12 nt, Human
gcugggcucccu

SEQ ID NO: 1161512 - RNA, 18 nt, Human
gcuggagugcagugagcc

SEQ ID NO: 1161513 - RNA, 22 nt, Human
gcuggagugcagugagccgaga

SEQ ID NO: 1161514 - RNA, 20 nt, Human
gcuggccuggccccucaggg

SEQ ID NO: 1161515 - RNA, 13 nt, Human
gcucugcccuugg

SEQ ID NO: 1161516 - RNA, 15 nt, Human
gcucugguccauaga

SEQ ID NO: 1161517 - RNA, 16 nt, Human
gcucugguccauagag

SEQ ID NO: 1161518 - RNA, 23 nt, Human
gcucugguccauagagagcaaga

SEQ ID NO: 1161519 - RNA, 13 nt, Human
gcugcugaaggcu

SEQ ID NO: 1161520 - RNA, 14 nt, Human
gcugcugaaggcuc

SEQ ID NO: 1161521 - RNA, 15 nt, Human
gcugcugaaggcucg

SEQ ID NO: 1161522 - RNA, 18 nt, Human
gcugcugaaggcucgagc

SEQ ID NO: 1161523 - RNA, 13 nt, Human
gcugcuggcuggu

SEQ ID NO: 1161524 - RNA, 22 nt, Human
gcuuccucauaguaugguggcu

SEQ ID NO: 1161525 - RNA, 14 nt, Human
gcuugagcucagga

SEQ ID NO: 1161526 - RNA, 16 nt, Human
gcuugaggguugggcu

SEQ ID NO: 1161527 - RNA, 20 nt, Human
gcuuguaaauagcucaggug

SEQ ID NO: 1161528 - RNA, 12 nt, Human
gcuuguacauaa

SEQ ID NO: 1161529 - RNA, 18 nt, Human
gcuucacggaagagccuu

SEQ ID NO: 1161530 - RNA, 19 nt, Human
gcuucacggaagagccuug

SEQ ID NO: 1161531 - RNA, 12 nt, Human
gcuucagccucc

SEQ ID NO: 1161532 - RNA, 19 nt, Human
gcuucaaggauccugagcc

SEQ ID NO: 1161533 - RNA, 20 nt, Human
gcuucaaggauccugagcca

SEQ ID NO: 1161534 - RNA, 21 nt, Human
gcuucaaggauccugagccag

SEQ ID NO: 1161535 - RNA, 22 nt, Human
gcuucaaggauccugagccaga

SEQ ID NO: 1161536 - RNA, 17 nt, Human
gcuucacggaagagccu

SEQ ID NO: 1161537 - RNA, 20 nt, Human
gcuccagcucaccagcccca

SEQ ID NO: 1161538 - RNA, 21 nt, Human
gcuccagcucaccagccccag

SEQ ID NO: 1161539 - RNA, 18 nt, Human
gcuccacuuggucuguga

SEQ ID NO: 1161540 - RNA, 19 nt, Human
gcuccacuuggucugugag

SEQ ID NO: 1161541 - RNA, 18 nt, Human
gcuccagcucaccagccc

SEQ ID NO: 1161542 - RNA, 17 nt, Human
gcucccaggcauucccc

SEQ ID NO: 1161543 - RNA, 14 nt, Human
gcuccuggcccacu

SEQ ID NO: 1161544 - RNA, 15 nt, Human
gcuccuggcccacug

SEQ ID NO: 1161545 - RNA, 18 nt, Human
gcuccuggcccacugcau

SEQ ID NO: 1161546 - RNA, 19 nt, Human
gcuccuggcccacugcauc

SEQ ID NO: 1161547 - RNA, 20 nt, Human
gcuccuggcccacugcaucg

SEQ ID NO: 1161548 - RNA, 15 nt, Human
gcuccacuuggucug

SEQ ID NO: 1161549 - RNA, 17 nt, Human
gcucugaucauccacug

SEQ ID NO: 1161550 - RNA, 23 nt, Human
gcucugcaagaauugaagcagga

SEQ ID NO: 1161551 - RNA, 11 nt, Human
gcucugcccuu

SEQ ID NO: 1161552 - RNA, 17 nt, Human
gcucacugcagccucaa

SEQ ID NO: 1161553 - RNA, 15 nt, Human
gcucacugcagccuc

SEQ ID NO: 1161554 - RNA, 16 nt, Human
gcucacugcagccuca

SEQ ID NO: 1161555 - RNA, 11 nt, Human
gcucacugcag

SEQ ID NO: 1161556 - RNA, 12 nt, Human
gcucacugcagc

SEQ ID NO: 1161557 - RNA, 13 nt, Human
gcucacugcagcc

SEQ ID NO: 1161558 - RNA, 14 nt, Human
gcucacugcagccu

SEQ ID NO: 1161559 - RNA, 20 nt, Human
gcuauucaguaauaacucua

SEQ ID NO: 1161560 - RNA, 13 nt, Human
gcucagagagggu

SEQ ID NO: 1161561 - RNA, 14 nt, Human
gcucagagagggug

SEQ ID NO: 1161562 - RNA, 14 nt, Human
gcucaggugucccu

SEQ ID NO: 1161563 - RNA, 16 nt, Human
gcucaggugucccugc

SEQ ID NO: 1161564 - RNA, 17 nt, Human
gcucaggugucccugca

SEQ ID NO: 1161565 - RNA, 16 nt, Human
gcuaggccuggccaga

SEQ ID NO: 1161566 - RNA, 17 nt, Human
gcuaggccuggccagau

SEQ ID NO: 1161567 - RNA, 23 nt, Human
gcuaggccuggccagaugcacca

SEQ ID NO: 1161568 - RNA, 21 nt, Human
gcuagugugguguuuccuggc

SEQ ID NO: 1161569 - RNA, 22 nt, Human
gcuagugugguguuuccuggca

SEQ ID NO: 1161570 - RNA, 12 nt, Human
gcuaugcauuug

SEQ ID NO: 1161571 - RNA, 13 nt, Human
gcuaugcauuuga

SEQ ID NO: 1161572 - RNA, 19 nt, Human
gcuauucaguaauaacucu

SEQ ID NO: 1161573 - RNA, 13 nt, Human
gcuaaugggacac

SEQ ID NO: 1161574 - RNA, 15 nt, Human
gcuaaugggacacua

SEQ ID NO: 1161575 - RNA, 20 nt, Human
gcgugcacacaccagagccc

SEQ ID NO: 1161576 - RNA, 21 nt, Human
gcgggaggauguucugggaca

SEQ ID NO: 1161577 - RNA, 22 nt, Human
gcgggaggauguucugggacac

SEQ ID NO: 1161578 - RNA, 23 nt, Human
gcgugcacacaccagagcccacc

SEQ ID NO: 1161579 - RNA, 16 nt, Human
gcuagaacucccuuuc

SEQ ID NO: 1161580 - RNA, 18 nt, Human
gcuagaacucccuuucaa

SEQ ID NO: 1161581 - RNA, 12 nt, Human
gcuagaacuccc

SEQ ID NO: 1161582 - RNA, 13 nt, Human
gcuagaacucccu

SEQ ID NO: 1161583 - RNA, 14 nt, Human
gcuagaacucccuu

SEQ ID NO: 1161584 - RNA, 15 nt, Human
gcuagaacucccuuu

SEQ ID NO: 1161585 - RNA, 13 nt, Human
gccuggcucaggu

SEQ ID NO: 1161586 - RNA, 16 nt, Human
gccugugccucuggga

SEQ ID NO: 1161587 - RNA, 17 nt, Human
gccugugccucugggac

SEQ ID NO: 1161588 - RNA, 18 nt, Human
gccugugccucugggacu

SEQ ID NO: 1161589 - RNA, 19 nt, Human
gccugugccucugggacug

SEQ ID NO: 1161590 - RNA, 14 nt, Human
gccuguugggccag

SEQ ID NO: 1161591 - RNA, 15 nt, Human
gccuguugggccagg

SEQ ID NO: 1161592 - RNA, 16 nt, Human
gccuguugggccagga

SEQ ID NO: 1161593 - RNA, 18 nt, Human
gccuguugggccaggagc

SEQ ID NO: 1161594 - RNA, 20 nt, Human
gccuguugggccaggagccu

SEQ ID NO: 1161595 - RNA, 13 nt, Human
gccuggccugagc

SEQ ID NO: 1161596 - RNA, 14 nt, Human
gccuggccugagcu

SEQ ID NO: 1161597 - RNA, 18 nt, Human
gccuggccugagcuggga

SEQ ID NO: 1161598 - RNA, 20 nt, Human
gccuggccugagcugggaug

SEQ ID NO: 1161599 - RNA, 22 nt, Human
gcgaucuggguucacugcaacc

SEQ ID NO: 1161600 - RNA, 20 nt, Human
gcgcagcauauucaggaagc

SEQ ID NO: 1161601 - RNA, 21 nt, Human
gccuguugggccaggagccuc

SEQ ID NO: 1161602 - RNA, 20 nt, Human
gccuucggccuccauccuga

SEQ ID NO: 1161603 - RNA, 21 nt, Human
gccuucggccuccauccugag

SEQ ID NO: 1161604 - RNA, 23 nt, Human
gccuucggccuccauccugaggc

SEQ ID NO: 1161605 - RNA, 17 nt, Human
gccuugaccauucucca

SEQ ID NO: 1161606 - RNA, 19 nt, Human
gccuugaccauucuccacc

SEQ ID NO: 1161607 - RNA, 20 nt, Human
gccuugaccauucuccaccu

SEQ ID NO: 1161608 - RNA, 21 nt, Human
gccuugaccauucuccaccug

SEQ ID NO: 1161609 - RNA, 17 nt, Human
gcgagcccugguggcag

SEQ ID NO: 1161610 - RNA, 14 nt, Human
gccucuuggguuca

SEQ ID NO: 1161611 - RNA, 21 nt, Human
gccucuuaugggcuggguucu

SEQ ID NO: 1161612 - RNA, 13 nt, Human
gccugcccaggcc

SEQ ID NO: 1161613 - RNA, 14 nt, Human
gccugcccaggccc

SEQ ID NO: 1161614 - RNA, 20 nt, Human
gccucgaacuggcugcaaag

SEQ ID NO: 1161615 - RNA, 22 nt, Human
gccucgaacuggcugcaaaggg

SEQ ID NO: 1161616 - RNA, 15 nt, Human
gccucuuagaugcag

SEQ ID NO: 1161617 - RNA, 16 nt, Human
gccucuuaugggcugg

SEQ ID NO: 1161618 - RNA, 17 nt, Human
gccucuuaugggcuggg

SEQ ID NO: 1161619 - RNA, 18 nt, Human
gccucuuaugggcugggu

SEQ ID NO: 1161620 - RNA, 12 nt, Human
gccuccauccug

SEQ ID NO: 1161621 - RNA, 16 nt, Human
gccucccaaagugcug

SEQ ID NO: 1161622 - RNA, 17 nt, Human
gccucccaaagugcugg

SEQ ID NO: 1161623 - RNA, 18 nt, Human
gccucccaaagugcuggg

SEQ ID NO: 1161624 - RNA, 19 nt, Human
gccuccugugugugcgccu

SEQ ID NO: 1161625 - RNA, 23 nt, Human
gccuccugugugugcgccuacag

SEQ ID NO: 1161626 - RNA, 17 nt, Human
gccucgaacuggcugca

SEQ ID NO: 1161627 - RNA, 15 nt, Human
gccugcccaggcccc

SEQ ID NO: 1161628 - RNA, 17 nt, Human
gccugcccaggccccug

SEQ ID NO: 1161629 - RNA, 22 nt, Human
gccugcccaggccccugccacc

SEQ ID NO: 1161630 - RNA, 11 nt, Human
gcccugccucc

SEQ ID NO: 1161631 - RNA, 17 nt, Human
gcccugcccaccuggcc

SEQ ID NO: 1161632 - RNA, 20 nt, Human
gcccugcccaccuggccucu

SEQ ID NO: 1161633 - RNA, 21 nt, Human
gcccugcccaccuggccucug

SEQ ID NO: 1161634 - RNA, 22 nt, Human
gcccugcccaccuggccucugc

SEQ ID NO: 1161635 - RNA, 18 nt, Human
gcccugcagagggcacag

SEQ ID NO: 1161636 - RNA, 14 nt, Human
gcccugccuccuuu

SEQ ID NO: 1161637 - RNA, 12 nt, Human
gcccugccuccu

SEQ ID NO: 1161638 - RNA, 13 nt, Human
gcccugccuccuu

SEQ ID NO: 1161639 - RNA, 20 nt, Human
gcccuuagcagggaaacagc

SEQ ID NO: 1161640 - RNA, 22 nt, Human
gcccuuagcagggaaacagcua

SEQ ID NO: 1161641 - RNA, 20 nt, Human
gccgcagcccugcagagggc

SEQ ID NO: 1161642 - RNA, 20 nt, Human
gccuaggugacagagugaga

SEQ ID NO: 1161643 - RNA, 20 nt, Human
gccuagcauacguacacauu

SEQ ID NO: 1161644 - RNA, 21 nt, Human
gccuagcauacguacacauuu

SEQ ID NO: 1161645 - RNA, 22 nt, Human
gccuagcauacguacacauuuu

SEQ ID NO: 1161646 - RNA, 23 nt, Human
gccuagcauacguacacauuuua

SEQ ID NO: 1161647 - RNA, 13 nt, Human
gccuaggugacag

SEQ ID NO: 1161648 - RNA, 14 nt, Human
gccuaggugacaga

SEQ ID NO: 1161649 - RNA, 15 nt, Human
gccuaggugacagag

SEQ ID NO: 1161650 - RNA, 23 nt, Human
gcccgggcucugccucccaucac

SEQ ID NO: 1161651 - RNA, 12 nt, Human
gccccugcuggu

SEQ ID NO: 1161652 - RNA, 12 nt, Human
gcccccacuggu

SEQ ID NO: 1161653 - RNA, 17 nt, Human
gccccugccacccuggg

SEQ ID NO: 1161654 - RNA, 11 nt, Human
gccaaggccaa

SEQ ID NO: 1161655 - RNA, 17 nt, Human
gccaaggccaaaggaag

SEQ ID NO: 1161656 - RNA, 19 nt, Human
gccaaggccaaaggaagca

SEQ ID NO: 1161657 - RNA, 17 nt, Human
gcaugugaugagaggaa

SEQ ID NO: 1161658 - RNA, 18 nt, Human
gcaugugaugagaggaaa

SEQ ID NO: 1161659 - RNA, 16 nt, Human
gcaugggaaugaaugu

SEQ ID NO: 1161660 - RNA, 19 nt, Human
gcaugggaaugaaugucag

SEQ ID NO: 1161661 - RNA, 22 nt, Human
gcauccuggcacccggccccug

SEQ ID NO: 1161662 - RNA, 23 nt, Human
gcauccuggcacccggccccugc

SEQ ID NO: 1161663 - RNA, 17 nt, Human
gcauccuggcacccggc

SEQ ID NO: 1161664 - RNA, 21 nt, Human
gcauccuggcacccggccccu

SEQ ID NO: 1161665 - RNA, 12 nt, Human
gcauuuaaaaga

SEQ ID NO: 1161666 - RNA, 15 nt, Human
gcauuuaaaagauac

SEQ ID NO: 1161667 - RNA, 14 nt, Human
gcauuugaaaauuu

SEQ ID NO: 1161668 - RNA, 16 nt, Human
gcauuugaaaauuuug

SEQ ID NO: 1161669 - RNA, 14 nt, Human
gccaagaauucuua

SEQ ID NO: 1161670 - RNA, 18 nt, Human
gccaagaauucuuaaaua

SEQ ID NO: 1161671 - RNA, 22 nt, Human
gcagggaaacagcuaaugggac

SEQ ID NO: 1161672 - RNA, 17 nt, Human
gcaggcucucaggccag

SEQ ID NO: 1161673 - RNA, 18 nt, Human
gcaggcucucaggccagc

SEQ ID NO: 1161674 - RNA, 19 nt, Human
gcagcuugaggguugggcu

SEQ ID NO: 1161675 - RNA, 21 nt, Human
gcagcuugaggguugggcugg

SEQ ID NO: 1161676 - RNA, 22 nt, Human
gcaggcucgggcuccccagccc

SEQ ID NO: 1161677 - RNA, 12 nt, Human
gcaggcucucag

SEQ ID NO: 1161678 - RNA, 13 nt, Human
gcaggcucucagg

SEQ ID NO: 1161679 - RNA, 14 nt, Human
gcaggcucucaggc

SEQ ID NO: 1161680 - RNA, 15 nt, Human
gcaggcucucaggcc

SEQ ID NO: 1161681 - RNA, 16 nt, Human
gcaggcucucaggcca

SEQ ID NO: 1161682 - RNA, 22 nt, Human
gcagcugcgguccacccaggag

SEQ ID NO: 1161683 - RNA, 23 nt, Human
gcagcugcgguccacccaggagc

SEQ ID NO: 1161684 - RNA, 13 nt, Human
gcagcugcuuuug

SEQ ID NO: 1161685 - RNA, 20 nt, Human
gcagcugcuuuugucuaugg

SEQ ID NO: 1161686 - RNA, 15 nt, Human
gcagcuuauucacaa

SEQ ID NO: 1161687 - RNA, 16 nt, Human
gcagcuugaggguugg

SEQ ID NO: 1161688 - RNA, 16 nt, Human
gcacuuuguucuggcu

SEQ ID NO: 1161689 - RNA, 15 nt, Human
gcauaccacuuuugu

SEQ ID NO: 1161690 - RNA, 23 nt, Human
gcauacacacacacacacagcca

SEQ ID NO: 1161691 - RNA, 16 nt, Human
gcauaccacuuuuguu

SEQ ID NO: 1161692 - RNA, 19 nt, Human
gcagggacuugaacccaua

SEQ ID NO: 1161693 - RNA, 14 nt, Human
gcaguugccaguca

SEQ ID NO: 1161694 - RNA, 23 nt, Human
gcaguugccagucaccccggcca

SEQ ID NO: 1161695 - RNA, 15 nt, Human
gcauaaaaauuagcc

SEQ ID NO: 1161696 - RNA, 11 nt, Human
gcauacacaca

SEQ ID NO: 1161697 - RNA, 13 nt, Human
gcauacacacaca

SEQ ID NO: 1161698 - RNA, 14 nt, Human
gcauacacacacac

SEQ ID NO: 1161699 - RNA, 21 nt, Human
gcauacacacacacacacagc

SEQ ID NO: 1161700 - RNA, 22 nt, Human
gcauacacacacacacacagcc

SEQ ID NO: 1161701 - RNA, 20 nt, Human
gcacacaccagagcccaccu

SEQ ID NO: 1161702 - RNA, 11 nt, Human
gcacacauuuu

SEQ ID NO: 1161703 - RNA, 12 nt, Human
gcacacauuuuu

SEQ ID NO: 1161704 - RNA, 14 nt, Human
gcacacauuuuuua

SEQ ID NO: 1161705 - RNA, 15 nt, Human
gcaccggcuggccug

SEQ ID NO: 1161706 - RNA, 16 nt, Human
gcaccggcuggccugg

SEQ ID NO: 1161707 - RNA, 17 nt, Human
gcaccggcuggccuggc

SEQ ID NO: 1161708 - RNA, 18 nt, Human
gcaccggcuggccuggcc

SEQ ID NO: 1161709 - RNA, 12 nt, Human
gcaccuccugcc

SEQ ID NO: 1161710 - RNA, 17 nt, Human
gcacuccagccugggug

SEQ ID NO: 1161711 - RNA, 12 nt, Human
gcacuccccugc

SEQ ID NO: 1161712 - RNA, 22 nt, Human
gcacuauagccuaggugacaga

SEQ ID NO: 1161713 - RNA, 11 nt, Human
gcaauaaagca

SEQ ID NO: 1161714 - RNA, 21 nt, Human
gcaauaaagcagcguuucuau

SEQ ID NO: 1161715 - RNA, 18 nt, Human
gcaauagucaaauugugu

SEQ ID NO: 1161716 - RNA, 22 nt, Human
gcaauagucaaauugugugaaa

SEQ ID NO: 1161717 - RNA, 12 nt, Human
gcacacaccaga

SEQ ID NO: 1161718 - RNA, 14 nt, Human
gcacacaccagagc

SEQ ID NO: 1161719 - RNA, 15 nt, Human
gcacacaccagagcc

SEQ ID NO: 1161720 - RNA, 16 nt, Human
gcacacaccagagccc

SEQ ID NO: 1161721 - RNA, 17 nt, Human
gcacacaccagagccca

SEQ ID NO: 1161722 - RNA, 18 nt, Human
gcacacaccagagcccac

SEQ ID NO: 1161723 - RNA, 19 nt, Human
gcacacaccagagcccacc

SEQ ID NO: 1161724 - RNA, 15 nt, Human
gcaaaagaugcuucu

SEQ ID NO: 1161725 - RNA, 16 nt, Human
gcaaaagaugcuucuc

SEQ ID NO: 1161726 - RNA, 17 nt, Human
gcaaaagaugcuucuca

SEQ ID NO: 1161727 - RNA, 18 nt, Human
gcaacccccagccugcua

SEQ ID NO: 1161728 - RNA, 22 nt, Human
gcaacccuggugaccagcacca

SEQ ID NO: 1161729 - RNA, 18 nt, Human
gcaaccuccgccucuugg

SEQ ID NO: 1161730 - RNA, 19 nt, Human
gcaaccuccgccucuuggg

SEQ ID NO: 1161731 - RNA, 17 nt, Human
gauuucacucuccuugg

SEQ ID NO: 1161732 - RNA, 18 nt, Human
gauuucacucuccuuggu

SEQ ID NO: 1161733 - RNA, 12 nt, Human
gauucuuuccug

SEQ ID NO: 1161734 - RNA, 13 nt, Human
gauuucacucucc

SEQ ID NO: 1161735 - RNA, 16 nt, Human
gauuucacucuccuug

SEQ ID NO: 1161736 - RNA, 22 nt, Human
gauuuuuuuuuccuucagugcc

SEQ ID NO: 1161737 - RNA, 23 nt, Human
gauuuuuuuuuccuucagugccu

SEQ ID NO: 1161738 - RNA, 19 nt, Human
gauucuccugccucagccu

SEQ ID NO: 1161739 - RNA, 20 nt, Human
gauucuccugccucagccuc

SEQ ID NO: 1161740 - RNA, 21 nt, Human
gauucuccugccucagccucc

SEQ ID NO: 1161741 - RNA, 23 nt, Human
gauucuuauggacaaugacccag

SEQ ID NO: 1161742 - RNA, 21 nt, Human
gauucuucugcuucagccucc

SEQ ID NO: 1161743 - RNA, 20 nt, Human
gauuuaacagaaauguacag

SEQ ID NO: 1161744 - RNA, 23 nt, Human
gauuuaacagaaauguacagcaa

SEQ ID NO: 1161745 - RNA, 14 nt, Human
gaugcuuguacaua

SEQ ID NO: 1161746 - RNA, 16 nt, Human
gaugcuuguacauaau

SEQ ID NO: 1161747 - RNA, 17 nt, Human
gauguagaggagaaacu

SEQ ID NO: 1161748 - RNA, 23 nt, Human
gaugcuucucacugccaugccag

SEQ ID NO: 1161749 - RNA, 22 nt, Human
gaguugauagcacagacccugc

SEQ ID NO: 1161750 - RNA, 18 nt, Human
gaucuggguucacugcaa

SEQ ID NO: 1161751 - RNA, 20 nt, Human
gaucuggguucacugcaacc

SEQ ID NO: 1161752 - RNA, 22 nt, Human
gacuguacaaaguagaagucuu

SEQ ID NO: 1161753 - RNA, 14 nt, Human
gacucaaugcacug

SEQ ID NO: 1161754 - RNA, 17 nt, Human
gacucaaugcacugaca

SEQ ID NO: 1161755 - RNA, 16 nt, Human
gacuguuuucucuuga

SEQ ID NO: 1161756 - RNA, 18 nt, Human
gacuguuuucucuugaga

SEQ ID NO: 1161757 - RNA, 14 nt, Human
gacuuuggaaagac

SEQ ID NO: 1161758 - RNA, 14 nt, Human
gacuuuggaaagag

SEQ ID NO: 1161759 - RNA, 22 nt, Human
gacuuuguuaguuucuccaagc

SEQ ID NO: 1161760 - RNA, 21 nt, Human
gacuuuucuguccgagcuuug

SEQ ID NO: 1161761 - RNA, 23 nt, Human
gacuuuucuguccgagcuuugaa

SEQ ID NO: 1161762 - RNA, 17 nt, Human
gagaagcggcuggcagc

SEQ ID NO: 1161763 - RNA, 12 nt, Human
gacgcugugcug

SEQ ID NO: 1161764 - RNA, 13 nt, Human
gacgcugugcugc

SEQ ID NO: 1161765 - RNA, 15 nt, Human
gacgcugugcugccc

SEQ ID NO: 1161766 - RNA, 17 nt, Human
gaccauucuccaccugc

SEQ ID NO: 1161767 - RNA, 16 nt, Human
gaccauucuccaccug

SEQ ID NO: 1161768 - RNA, 16 nt, Human
gaccaucccugaaggc

SEQ ID NO: 1161769 - RNA, 17 nt, Human
gaccaucccugaaggcc

SEQ ID NO: 1161770 - RNA, 18 nt, Human
gaccaucccugaaggccc

SEQ ID NO: 1161771 - RNA, 12 nt, Human
gacccggcugcg

SEQ ID NO: 1161772 - RNA, 13 nt, Human
gacccggcugcgu

SEQ ID NO: 1161773 - RNA, 16 nt, Human
gacccuauugcugcuu

SEQ ID NO: 1161774 - RNA, 15 nt, Human
gaccaucccugaagg

SEQ ID NO: 1161775 - RNA, 20 nt, Human
gacaguauggcagcuuuccu

SEQ ID NO: 1161776 - RNA, 13 nt, Human
gacagcuccuucu

SEQ ID NO: 1161777 - RNA, 14 nt, Human
gacagcuccuucug

SEQ ID NO: 1161778 - RNA, 15 nt, Human
gacagcuccuucugu

SEQ ID NO: 1161779 - RNA, 16 nt, Human
gacagcuccuucuguc

SEQ ID NO: 1161780 - RNA, 14 nt, Human
gacagaaagcagaa

SEQ ID NO: 1161781 - RNA, 20 nt, Human
gacagaaagcagaacaguga

SEQ ID NO: 1161782 - RNA, 21 nt, Human
gacagaaagcagaacagugau

SEQ ID NO: 1161783 - RNA, 21 nt, Human
gacagcccuucuuuccacaga

SEQ ID NO: 1161784 - RNA, 15 nt, Human
gaggugggauccucc

SEQ ID NO: 1161785 - RNA, 16 nt, Human
gaggugggauccucca

SEQ ID NO: 1161786 - RNA, 17 nt, Human
gaggugggauccuccag

SEQ ID NO: 1161787 - RNA, 18 nt, Human
gaggugggauccuccagg

SEQ ID NO: 1161788 - RNA, 14 nt, Human
gagucacuggaaca

SEQ ID NO: 1161789 - RNA, 21 nt, Human
gagucacuggaacacuaauga

SEQ ID NO: 1161790 - RNA, 18 nt, Human
gagucagaaguuucugcc

SEQ ID NO: 1161791 - RNA, 14 nt, Human
gagugagacucugu

SEQ ID NO: 1161792 - RNA, 18 nt, Human
gagugagacucugucuca

SEQ ID NO: 1161793 - RNA, 24 nt, Human
gagugagcacuaaggugugcucug

SEQ ID NO: 1161794 - RNA, 18 nt, Human
gagugcagugagccgaga

SEQ ID NO: 1161795 - RNA, 18 nt, Human
gagugccuuacacaaugg

SEQ ID NO: 1161796 - RNA, 19 nt, Human
gaguugauacuacaguuug

SEQ ID NO: 1161797 - RNA, 22 nt, Human
gaguugauacuacaguuuguua

SEQ ID NO: 1161798 - RNA, 21 nt, Human
gaguugauagcacagacccug

SEQ ID NO: 1161799 - RNA, 20 nt, Human
gaggccagagacacaagccu

SEQ ID NO: 1161800 - RNA, 12 nt, Human
gaggcucugccc

SEQ ID NO: 1161801 - RNA, 13 nt, Human
gaggcucugcccu

SEQ ID NO: 1161802 - RNA, 14 nt, Human
gaggcucugcccuu

SEQ ID NO: 1161803 - RNA, 15 nt, Human
gaggcucugcccuug

SEQ ID NO: 1161804 - RNA, 17 nt, Human
gaggcucugcccuuggu

SEQ ID NO: 1161805 - RNA, 14 nt, Human
gaggcugccucucc

SEQ ID NO: 1161806 - RNA, 12 nt, Human
gagggcuccaga

SEQ ID NO: 1161807 - RNA, 13 nt, Human
gagggcuccagac

SEQ ID NO: 1161808 - RNA, 14 nt, Human
gagggcuccagaca

SEQ ID NO: 1161809 - RNA, 15 nt, Human
gagggcuccagacac

SEQ ID NO: 1161810 - RNA, 12 nt, Human
gaggggaacaga

SEQ ID NO: 1161811 - RNA, 12 nt, Human
gagccuuccagg

SEQ ID NO: 1161812 - RNA, 13 nt, Human
gagccuuccaggg

SEQ ID NO: 1161813 - RNA, 15 nt, Human
gagcgacagugagac

SEQ ID NO: 1161814 - RNA, 17 nt, Human
gagcggagaaaggaagg

SEQ ID NO: 1161815 - RNA, 16 nt, Human
gagcugccuguucagc

SEQ ID NO: 1161816 - RNA, 19 nt, Human
gagcugccuguucagcucc

SEQ ID NO: 1161817 - RNA, 20 nt, Human
gagcugccuguucagcucca

SEQ ID NO: 1161818 - RNA, 20 nt, Human
gagcaucaggccaggcccuc

SEQ ID NO: 1161819 - RNA, 22 nt, Human
gagcaucaggccaggcccucug

SEQ ID NO: 1161820 - RNA, 16 nt, Human
gaagcaccauaacuuu

SEQ ID NO: 1161821 - RNA, 16 nt, Human
gaagacucauucuucu

SEQ ID NO: 1161822 - RNA, 17 nt, Human
gaagacucauucuucug

SEQ ID NO: 1161823 - RNA, 18 nt, Human
gaagacucauucuucugu

SEQ ID NO: 1161824 - RNA, 13 nt, Human
gaagcacagcuuc

SEQ ID NO: 1161825 - RNA, 14 nt, Human
gaagcacagcuuca

SEQ ID NO: 1161826 - RNA, 14 nt, Human
gaagcacaugccuc

SEQ ID NO: 1161827 - RNA, 22 nt, Human
gaagcacaugccucucucaggc

SEQ ID NO: 1161828 - RNA, 14 nt, Human
gaagacagcucuua

SEQ ID NO: 1161829 - RNA, 15 nt, Human
gaagacagcucuuau

SEQ ID NO: 1161830 - RNA, 16 nt, Human
gaagacacugaugggc

SEQ ID NO: 1161831 - RNA, 21 nt, Human
gaagacacugaugggcaaccc

SEQ ID NO: 1161832 - RNA, 13 nt, Human
gaagacagagcua

SEQ ID NO: 1161833 - RNA, 15 nt, Human
gaagacagagcuaca

SEQ ID NO: 1161834 - RNA, 12 nt, Human
gaagacagcucu

SEQ ID NO: 1161835 - RNA, 13 nt, Human
gaagacagcucuu

SEQ ID NO: 1161836 - RNA, 23 nt, Human
gaaccaccacacccagcccacuu

SEQ ID NO: 1161837 - RNA, 22 nt, Human
gaaccauggucggaaaacaugc

SEQ ID NO: 1161838 - RNA, 17 nt, Human
gaacccgggaggcagag

SEQ ID NO: 1161839 - RNA, 19 nt, Human
gaacccgggaggcagaggu

SEQ ID NO: 1161840 - RNA, 13 nt, Human
gaacuccuggccu

SEQ ID NO: 1161841 - RNA, 14 nt, Human
gaacuccuggccuc

SEQ ID NO: 1161842 - RNA, 15 nt, Human
gaacuccuggccuca

SEQ ID NO: 1161843 - RNA, 13 nt, Human
gaacugaaaucau

SEQ ID NO: 1161844 - RNA, 18 nt, Human
gaaccaccacacccagcc

SEQ ID NO: 1161845 - RNA, 20 nt, Human
gaaccaccacacccagccca

SEQ ID NO: 1161846 - RNA, 21 nt, Human
gaaccaccacacccagcccac

SEQ ID NO: 1161847 - RNA, 22 nt, Human
gaaccaccacacccagcccacu

SEQ ID NO: 1161848 - RNA, 17 nt, Human
gaacaaauuuacagaga

SEQ ID NO: 1161849 - RNA, 15 nt, Human
gaaagggcccagaga

SEQ ID NO: 1161850 - RNA, 16 nt, Human
gaaagggcccagagag

SEQ ID NO: 1161851 - RNA, 17 nt, Human
gaaaugaaagcagggac

SEQ ID NO: 1161852 - RNA, 13 nt, Human
gaaacuggauuaa

SEQ ID NO: 1161853 - RNA, 17 nt, Human
gaaacuggauuaaacuu

SEQ ID NO: 1161854 - RNA, 18 nt, Human
gaaagaaaaucaggcugg

SEQ ID NO: 1161855 - RNA, 13 nt, Human
gaaaggcuccagg

SEQ ID NO: 1161856 - RNA, 14 nt, Human
gaaaggcuccagga

SEQ ID NO: 1161857 - RNA, 15 nt, Human
gaaaggcuccaggag

SEQ ID NO: 1161858 - RNA, 16 nt, Human
gaaaggcuccaggagc

SEQ ID NO: 1161859 - RNA, 13 nt, Human
gaaagggcccaga

SEQ ID NO: 1161860 - RNA, 21 nt, Human
gaaaacuuuaugcuaagugaa

SEQ ID NO: 1161861 - RNA, 23 nt, Human
gaaaagaaaaaugagccuggcaa

SEQ ID NO: 1161862 - RNA, 17 nt, Human
cuuuguauucucuccug

SEQ ID NO: 1161863 - RNA, 22 nt, Human
cuuuguauucucuccuguaccu

SEQ ID NO: 1161864 - RNA, 20 nt, Human
cuuuuauaaacuuuaccuuu

SEQ ID NO: 1161865 - RNA, 21 nt, Human
cuuuuauaaacuuuaccuuuu

SEQ ID NO: 1161866 - RNA, 15 nt, Human
cuuucuacccagcga

SEQ ID NO: 1161867 - RNA, 16 nt, Human
cuuucuacccagcgag

SEQ ID NO: 1161868 - RNA, 17 nt, Human
cuuucuacccagcgagc

SEQ ID NO: 1161869 - RNA, 16 nt, Human
cuuugacgccauccca

SEQ ID NO: 1161870 - RNA, 17 nt, Human
cuuugacgccaucccag

SEQ ID NO: 1161871 - RNA, 18 nt, Human
cuuugacgccaucccagc

SEQ ID NO: 1161872 - RNA, 22 nt, Human
cuugguagaagcccuucuaccu

SEQ ID NO: 1161873 - RNA, 14 nt, Human
cuugguccugcugc

SEQ ID NO: 1161874 - RNA, 16 nt, Human
cuuggucugugagaug

SEQ ID NO: 1161875 - RNA, 19 nt, Human
cuuggucugugagaugcua

SEQ ID NO: 1161876 - RNA, 15 nt, Human
cuugguccugcugca

SEQ ID NO: 1161877 - RNA, 19 nt, Human
cuuggugucgggcaugaca

SEQ ID NO: 1161878 - RNA, 20 nt, Human
cuuggugucgggcaugacac

SEQ ID NO: 1161879 - RNA, 13 nt, Human
cuugucuuuggac

SEQ ID NO: 1161880 - RNA, 15 nt, Human
cuugucuuuggaccc

SEQ ID NO: 1161881 - RNA, 18 nt, Human
cuugucuuuggacccuga

SEQ ID NO: 1161882 - RNA, 19 nt, Human
cuugucuuuggacccugag

SEQ ID NO: 1161883 - RNA, 13 nt, Human
cuuguggacacag

SEQ ID NO: 1161884 - RNA, 14 nt, Human
cuuucacccuuuuc

SEQ ID NO: 1161885 - RNA, 15 nt, Human
cuuucacccuuuucu

SEQ ID NO: 1161886 - RNA, 20 nt, Human
cuuucacccuuuucuguuug

SEQ ID NO: 1161887 - RNA, 20 nt, Human
cuuucagccaagaauucuua

SEQ ID NO: 1161888 - RNA, 22 nt, Human
cuuccucuuuccaucuacccuc

SEQ ID NO: 1161889 - RNA, 13 nt, Human
cuuccuccuggug

SEQ ID NO: 1161890 - RNA, 20 nt, Human
cuucucacauuuauauuuuu

SEQ ID NO: 1161891 - RNA, 13 nt, Human
cuucucacauuua

SEQ ID NO: 1161892 - RNA, 13 nt, Human
cuucuucagagac

SEQ ID NO: 1161893 - RNA, 14 nt, Human
cuucuucagagacu

SEQ ID NO: 1161894 - RNA, 18 nt, Human
cuucuucagagacuccug

SEQ ID NO: 1161895 - RNA, 15 nt, Human
cuucugacccaugcu

SEQ ID NO: 1161896 - RNA, 12 nt, Human
cuugauucauaa

SEQ ID NO: 1161897 - RNA, 12 nt, Human
cuugcaaaguau

SEQ ID NO: 1161898 - RNA, 23 nt, Human
cuuggauuguccccgacccuugc

SEQ ID NO: 1161899 - RNA, 24 nt, Human
cuuggauuguccccgacccuugcc

SEQ ID NO: 1161900 - RNA, 18 nt, Human
cuugaauuguaaggaaug

SEQ ID NO: 1161901 - RNA, 16 nt, Human
cuugacaucaacugca

SEQ ID NO: 1161902 - RNA, 22 nt, Human
cuugauauccucuuugagugaa

SEQ ID NO: 1161903 - RNA, 18 nt, Human
cuugauguguuaucucuu

SEQ ID NO: 1161904 - RNA, 23 nt, Human
cuuagcucauucuccuuguguua

SEQ ID NO: 1161905 - RNA, 22 nt, Human
cuuagcucauucuccuuguguu

SEQ ID NO: 1161906 - RNA, 16 nt, Human
cuuaccagcagagcac

SEQ ID NO: 1161907 - RNA, 19 nt, Human
cuuagggaaggauacaaaa

SEQ ID NO: 1161908 - RNA, 21 nt, Human
cuuagggaaggauacaaaagc

SEQ ID NO: 1161909 - RNA, 13 nt, Human
cuuacacaauggu

SEQ ID NO: 1161910 - RNA, 15 nt, Human
cuuaccagcagagca

SEQ ID NO: 1161911 - RNA, 14 nt, Human
cuuaaaacaacacu

SEQ ID NO: 1161912 - RNA, 13 nt, Human
cuuaaauaaugug

SEQ ID NO: 1161913 - RNA, 14 nt, Human
cuguuggcuggggg

SEQ ID NO: 1161914 - RNA, 19 nt, Human
cuguuggcugggggccuca

SEQ ID NO: 1161915 - RNA, 22 nt, Human
cuguuggcugggggccucagug

SEQ ID NO: 1161916 - RNA, 13 nt, Human
cuguaaagaaaga

SEQ ID NO: 1161917 - RNA, 14 nt, Human
cuguaaagaaagag

SEQ ID NO: 1161918 - RNA, 15 nt, Human
cuguaaagaaagaga

SEQ ID NO: 1161919 - RNA, 16 nt, Human
cuguaaagaaagagag

SEQ ID NO: 1161920 - RNA, 17 nt, Human
cuguaaagaaagagaga

SEQ ID NO: 1161921 - RNA, 18 nt, Human
cuguaaagaaagagagaa

SEQ ID NO: 1161922 - RNA, 19 nt, Human
cuguaaagaaagagagaaa

SEQ ID NO: 1161923 - RNA, 20 nt, Human
cuguaaagaaagagagaaaa

SEQ ID NO: 1161924 - RNA, 21 nt, Human
cuguaaagaaagagagaaaau

SEQ ID NO: 1161925 - RNA, 22 nt, Human
cuguaaagaaagagagaaaaua

SEQ ID NO: 1161926 - RNA, 23 nt, Human
cuguaaagaaagagagaaaauaa

SEQ ID NO: 1161927 - RNA, 22 nt, Human
cuggugacaugucuuuucuugc

SEQ ID NO: 1161928 - RNA, 13 nt, Human
cuguagaguggga

SEQ ID NO: 1161929 - RNA, 15 nt, Human
cuguagagugggagc

SEQ ID NO: 1161930 - RNA, 16 nt, Human
cugucgcccagucugg

SEQ ID NO: 1161931 - RNA, 20 nt, Human
cugucaauuacaggaaguac

SEQ ID NO: 1161932 - RNA, 23 nt, Human
cugucaauuacaggaaguacugg

SEQ ID NO: 1161933 - RNA, 12 nt, Human
cugugcugcccu

SEQ ID NO: 1161934 - RNA, 13 nt, Human
cugugcugcccug

SEQ ID NO: 1161935 - RNA, 14 nt, Human
cugugcugcccugc

SEQ ID NO: 1161936 - RNA, 15 nt, Human
cugugcugcccugcc

SEQ ID NO: 1161937 - RNA, 17 nt, Human
cugugcugcccugccca

SEQ ID NO: 1161938 - RNA, 18 nt, Human
cugugcugcccugcccac

SEQ ID NO: 1161939 - RNA, 19 nt, Human
cugugcugcccugcccacc

SEQ ID NO: 1161940 - RNA, 21 nt, Human
cugugcugcccugcccaccug

SEQ ID NO: 1161941 - RNA, 17 nt, Human
cugugucagcauagaag

SEQ ID NO: 1161942 - RNA, 19 nt, Human
cugugucagcauagaagua

SEQ ID NO: 1161943 - RNA, 13 nt, Human
cuguuauaaucuu

SEQ ID NO: 1161944 - RNA, 19 nt, Human
cuguuauaaucuuucacag

SEQ ID NO: 1161945 - RNA, 12 nt, Human
cugggcagaagg

SEQ ID NO: 1161946 - RNA, 15 nt, Human
cugggcagaaggaag

SEQ ID NO: 1161947 - RNA, 16 nt, Human
cugggcagaaggaaga

SEQ ID NO: 1161948 - RNA, 18 nt, Human
cuggguucacugcaaccu

SEQ ID NO: 1161949 - RNA, 20 nt, Human
cuggguucacugcaaccucc

SEQ ID NO: 1161950 - RNA, 22 nt, Human
cuggccccucagggucccuggu

SEQ ID NO: 1161951 - RNA, 14 nt, Human
cuggccuagcauac

SEQ ID NO: 1161952 - RNA, 11 nt, Human
cugggacacag

SEQ ID NO: 1161953 - RNA, 19 nt, Human
cuggcagaguugaagacag

SEQ ID NO: 1161954 - RNA, 11 nt, Human
cuggcagccca

SEQ ID NO: 1161955 - RNA, 12 nt, Human
cuggcagccccu

SEQ ID NO: 1161956 - RNA, 13 nt, Human
cuggcagccccug

SEQ ID NO: 1161957 - RNA, 17 nt, Human
cuggcagaguugaagac

SEQ ID NO: 1161958 - RNA, 18 nt, Human
cuggcagaguugaagaca

SEQ ID NO: 1161959 - RNA, 15 nt, Human
cugccucucccauca

SEQ ID NO: 1161960 - RNA, 22 nt, Human
cugccucucccaucacuucccu

SEQ ID NO: 1161961 - RNA, 23 nt, Human
cugccucucccaucacuucccua

SEQ ID NO: 1161962 - RNA, 17 nt, Human
cugccuguucagcucca

SEQ ID NO: 1161963 - RNA, 18 nt, Human
cugccuguucagcuccag

SEQ ID NO: 1161964 - RNA, 19 nt, Human
cugccuguucagcuccagc

SEQ ID NO: 1161965 - RNA, 21 nt, Human
cugccuguugggccaggagcc

SEQ ID NO: 1161966 - RNA, 22 nt, Human
cugccuguugggccaggagccu

SEQ ID NO: 1161967 - RNA, 23 nt, Human
cugccuguugggccaggagccuc

SEQ ID NO: 1161968 - RNA, 20 nt, Human
cugccuguucagcuccagcu

SEQ ID NO: 1161969 - RNA, 17 nt, Human
cugcuaucaaagagguu

SEQ ID NO: 1161970 - RNA, 18 nt, Human
cugcugacuguuuucucu

SEQ ID NO: 1161971 - RNA, 21 nt, Human
cugcugacuguuuucucuuga

SEQ ID NO: 1161972 - RNA, 21 nt, Human
cugcuuuugucuaugggacuc

SEQ ID NO: 1161973 - RNA, 19 nt, Human
cugcuuuuuaaagaaugcu

SEQ ID NO: 1161974 - RNA, 14 nt, Human
cuggaagcacagcu

SEQ ID NO: 1161975 - RNA, 14 nt, Human
cuggagaaaaugga

SEQ ID NO: 1161976 - RNA, 14 nt, Human
cugcuucaaauauu

SEQ ID NO: 1161977 - RNA, 19 nt, Human
cugcuucaaauauuucccu

SEQ ID NO: 1161978 - RNA, 12 nt, Human
cugcuucaagga

SEQ ID NO: 1161979 - RNA, 13 nt, Human
cugcuucaaggau

SEQ ID NO: 1161980 - RNA, 21 nt, Human
cugcuucaaggauccugagcc

SEQ ID NO: 1161981 - RNA, 22 nt, Human
cugcuucaaggauccugagcca

SEQ ID NO: 1161982 - RNA, 23 nt, Human
cugcuucaaggauccugagccag

SEQ ID NO: 1161983 - RNA, 20 nt, Human
cugcuuuugucuaugggacu

SEQ ID NO: 1161984 - RNA, 18 nt, Human
ccaccaucaugucuggcu

SEQ ID NO: 1161985 - RNA, 19 nt, Human
ccaccaucaugucuggcua

SEQ ID NO: 1161986 - RNA, 12 nt, Human
ccaccuuggcug

SEQ ID NO: 1161987 - RNA, 14 nt, Human
ccaccuuggcugca

SEQ ID NO: 1161988 - RNA, 15 nt, Human
ccaccuuggcugcag

SEQ ID NO: 1161989 - RNA, 16 nt, Human
ccaccuuggcugcagg

SEQ ID NO: 1161990 - RNA, 13 nt, Human
ccacgcuggagug

SEQ ID NO: 1161991 - RNA, 18 nt, Human
ccacgcuggaccuugaac

SEQ ID NO: 1161992 - RNA, 18 nt, Human
ccaccuuggcugcaggga

SEQ ID NO: 1161993 - RNA, 19 nt, Human
ccaccuuggcugcagggag

SEQ ID NO: 1161994 - RNA, 13 nt, Human
ccacgcccccacu

SEQ ID NO: 1161995 - RNA, 16 nt, Human
ccacagaagcuccagg

SEQ ID NO: 1161996 - RNA, 18 nt, Human
ccaccagucugacuguuu

SEQ ID NO: 1161997 - RNA, 18 nt, Human
ccacagaagcuccaggua

SEQ ID NO: 1161998 - RNA, 22 nt, Human
ccacagagaaaguacuucucca

SEQ ID NO: 1161999 - RNA, 17 nt, Human
cauuugucacacacuuu

SEQ ID NO: 1162000 - RNA, 15 nt, Human
cauuuggauuggaug

SEQ ID NO: 1162001 - RNA, 14 nt, Human
cauuuauucugcuc

SEQ ID NO: 1162002 - RNA, 15 nt, Human
cauuuauucugcuca

SEQ ID NO: 1162003 - RNA, 19 nt, Human
cauuuuuuaaaugcaccug

SEQ ID NO: 1162004 - RNA, 15 nt, Human
cauuuuuuaaaugca

SEQ ID NO: 1162005 - RNA, 16 nt, Human
cauuuuuuaaaugcac

SEQ ID NO: 1162006 - RNA, 20 nt, Human
ccaagcuggucccacucagu

SEQ ID NO: 1162007 - RNA, 15 nt, Human
ccaaggccaaaggaa

SEQ ID NO: 1162008 - RNA, 14 nt, Human
ccaagaagcccagg

SEQ ID NO: 1162009 - RNA, 15 nt, Human
ccaagaagcccagga

SEQ ID NO: 1162010 - RNA, 12 nt, Human
ccaagcuggucc

SEQ ID NO: 1162011 - RNA, 19 nt, Human
ccaagcuggucccacucag

SEQ ID NO: 1162012 - RNA, 22 nt, Human
ccaaauggaaaugggcagagca

SEQ ID NO: 1162013 - RNA, 23 nt, Human
ccaaauggaaaugggcagagcag

SEQ ID NO: 1162014 - RNA, 13 nt, Human
ccaacgucugugc

SEQ ID NO: 1162015 - RNA, 15 nt, Human
ccaacgucugugcca

SEQ ID NO: 1162016 - RNA, 16 nt, Human
ccaacgucugugccau

SEQ ID NO: 1162017 - RNA, 13 nt, Human
ccaagaagcccag

SEQ ID NO: 1162018 - RNA, 16 nt, Human
ccaaggccaaaggaag

SEQ ID NO: 1162019 - RNA, 22 nt, Human
cauuaggugugacugaauuucu

SEQ ID NO: 1162020 - RNA, 23 nt, Human
cauuaucuagauacuguaucaug

SEQ ID NO: 1162021 - RNA, 18 nt, Human
cauguccaagaagcccag

SEQ ID NO: 1162022 - RNA, 19 nt, Human
cauguccaagaagcccagg

SEQ ID NO: 1162023 - RNA, 20 nt, Human
cauguccaagaagcccagga

SEQ ID NO: 1162024 - RNA, 12 nt, Human
cauguuggccag

SEQ ID NO: 1162025 - RNA, 13 nt, Human
cauguuggccagg

SEQ ID NO: 1162026 - RNA, 14 nt, Human
caugcugcccugug

SEQ ID NO: 1162027 - RNA, 15 nt, Human
caugcugcccuguga

SEQ ID NO: 1162028 - RNA, 15 nt, Human
caugaaguaauaugc

SEQ ID NO: 1162029 - RNA, 19 nt, Human
caugaaguaauaugcacac

SEQ ID NO: 1162030 - RNA, 22 nt, Human
caugaaguaauaugcacacauu

SEQ ID NO: 1162031 - RNA, 23 nt, Human
caugaaguaauaugcacacauuu

SEQ ID NO: 1162032 - RNA, 23 nt, Human
caugacacgaauauugcugaugg

SEQ ID NO: 1162033 - RNA, 22 nt, Human
caugauuaaccacuucagcuga

SEQ ID NO: 1162034 - RNA, 23 nt, Human
caugauuaaccacuucagcugac

SEQ ID NO: 1162035 - RNA, 24 nt, Human
caugauuaaccacuucagcugacu

SEQ ID NO: 1162036 - RNA, 16 nt, Human
caugcacgugugugca

SEQ ID NO: 1162037 - RNA, 13 nt, Human
caugcuccuggcc

SEQ ID NO: 1162038 - RNA, 12 nt, Human
caugcugcccug

SEQ ID NO: 1162039 - RNA, 13 nt, Human
caugcugcccugu

SEQ ID NO: 1162040 - RNA, 15 nt, Human
cauaugccugggcag

SEQ ID NO: 1162041 - RNA, 20 nt, Human
cauaugccugggcagaagga

SEQ ID NO: 1162042 - RNA, 22 nt, Human
cauaugccugggcagaaggaag

SEQ ID NO: 1162043 - RNA, 14 nt, Human
cauauucaggaagc

SEQ ID NO: 1162044 - RNA, 15 nt, Human
cauauucaggaagcu

SEQ ID NO: 1162045 - RNA, 20 nt, Human
cauauucaggaagcucaggg

SEQ ID NO: 1162046 - RNA, 22 nt, Human
cauauucaggaagcucagggcc

SEQ ID NO: 1162047 - RNA, 15 nt, Human
cagugggagcugccu

SEQ ID NO: 1162048 - RNA, 21 nt, Human
cauacacacacacacacagcc

SEQ ID NO: 1162049 - RNA, 22 nt, Human
cauacacacacacacacagcca

SEQ ID NO: 1162050 - RNA, 23 nt, Human
cauacacacacacacacagccac

SEQ ID NO: 1162051 - RNA, 19 nt, Human
cauagcagagaaugaaagg

SEQ ID NO: 1162052 - RNA, 22 nt, Human
cauagcagagaaugaaagggcc

SEQ ID NO: 1162053 - RNA, 23 nt, Human
cauagcagagaaugaaagggccc

SEQ ID NO: 1162054 - RNA, 15 nt, Human
caucaggccaggccc

SEQ ID NO: 1162055 - RNA, 20 nt, Human
caucaggccaggcccucugc

SEQ ID NO: 1162056 - RNA, 16 nt, Human
caucaggccaggcccu

SEQ ID NO: 1162057 - RNA, 19 nt, Human
caucaggccaggcccucug

SEQ ID NO: 1162058 - RNA, 19 nt, Human
caucccauaugccugggca

SEQ ID NO: 1162059 - RNA, 14 nt, Human
cauccccuguagag

SEQ ID NO: 1162060 - RNA, 21 nt, Human
cauccccuguagagugggagc

SEQ ID NO: 1162061 - RNA, 18 nt, Human
cagggaggugaccccagg

SEQ ID NO: 1162062 - RNA, 22 nt, Human
cagggaguccgaaagggacuug

SEQ ID NO: 1162063 - RNA, 12 nt, Human
caggccuccuac

SEQ ID NO: 1162064 - RNA, 15 nt, Human
caggcuggcgugcag

SEQ ID NO: 1162065 - RNA, 16 nt, Human
caggcugggcuucagu

SEQ ID NO: 1162066 - RNA, 19 nt, Human
cagggaggacgcucucugg

SEQ ID NO: 1162067 - RNA, 17 nt, Human
caggcugggcuucagug

SEQ ID NO: 1162068 - RNA, 19 nt, Human
caggcugggcuucaguggc

SEQ ID NO: 1162069 - RNA, 17 nt, Human
cagggaggacgcucucu

SEQ ID NO: 1162070 - RNA, 18 nt, Human
cagggaggacgcucucug

SEQ ID NO: 1162071 - RNA, 17 nt, Human
caggaggccagccuuga

SEQ ID NO: 1162072 - RNA, 18 nt, Human
caggaggccagccuugac

SEQ ID NO: 1162073 - RNA, 22 nt, Human
caggcacccaccaucaugucug

SEQ ID NO: 1162074 - RNA, 23 nt, Human
caggcacccaccaucaugucugg

SEQ ID NO: 1162075 - RNA, 15 nt, Human
caggaggccagccuu

SEQ ID NO: 1162076 - RNA, 16 nt, Human
caggaggccagccuug

SEQ ID NO: 1162077 - RNA, 23 nt, Human
caggccagagggagugacagagg

SEQ ID NO: 1162078 - RNA, 19 nt, Human
caggccagagggagugaca

SEQ ID NO: 1162079 - RNA, 21 nt, Human
caggccagagggagugacaga

SEQ ID NO: 1162080 - RNA, 12 nt, Human
cagugcccacag

SEQ ID NO: 1162081 - RNA, 11 nt, Human
cagugggagcu

SEQ ID NO: 1162082 - RNA, 15 nt, Human
cagugccaaaaacaa

SEQ ID NO: 1162083 - RNA, 19 nt, Human
cagucugauucccaagcuc

SEQ ID NO: 1162084 - RNA, 20 nt, Human
cagucugauucccaagcucu

SEQ ID NO: 1162085 - RNA, 22 nt, Human
cagugcaugcugucccuuacgu

SEQ ID NO: 1162086 - RNA, 23 nt, Human
cagugcaugcugucccuuacgug

SEQ ID NO: 1162087 - RNA, 21 nt, Human
cagguuggugggggccucggu

SEQ ID NO: 1162088 - RNA, 16 nt, Human
cagguuuaagcuguua

SEQ ID NO: 1162089 - RNA, 18 nt, Human
cagguuuaagcuguuacu

SEQ ID NO: 1162090 - RNA, 20 nt, Human
cagucaccccggccaccugc

SEQ ID NO: 1162091 - RNA, 22 nt, Human
cagucaccccggccaccugcgg

SEQ ID NO: 1162092 - RNA, 15 nt, Human
cagucaccucaugga

SEQ ID NO: 1162093 - RNA, 22 nt, Human
cagggucucacucugucgccca

SEQ ID NO: 1162094 - RNA, 21 nt, Human
cagggucucacucugucgccc

SEQ ID NO: 1162095 - RNA, 18 nt, Human
cagggucucacucugucg

SEQ ID NO: 1162096 - RNA, 12 nt, Human
caggguuggccc

SEQ ID NO: 1162097 - RNA, 14 nt, Human
caggguuggccccu

SEQ ID NO: 1162098 - RNA, 16 nt, Human
caggugauccacccac

SEQ ID NO: 1162099 - RNA, 17 nt, Human
caggugauccacccacc

SEQ ID NO: 1162100 - RNA, 20 nt, Human
caggugauccacccaccuca

SEQ ID NO: 1162101 - RNA, 14 nt, Human
caggugcgaaagga

SEQ ID NO: 1162102 - RNA, 18 nt, Human
caggugcuaggaacacuc

SEQ ID NO: 1162103 - RNA, 20 nt, Human
caggugcuaggaacacuccu

SEQ ID NO: 1162104 - RNA, 14 nt, Human
cagguugguggggg

SEQ ID NO: 1162105 - RNA, 22 nt, Human
cagcuccagcucaccagcccca

SEQ ID NO: 1162106 - RNA, 16 nt, Human
cagcuccagcucacca

SEQ ID NO: 1162107 - RNA, 17 nt, Human
cagcuccagcucaccag

SEQ ID NO: 1162108 - RNA, 18 nt, Human
cagcuccagcucaccagc

SEQ ID NO: 1162109 - RNA, 20 nt, Human
cagcuccagcucaccagccc

SEQ ID NO: 1162110 - RNA, 13 nt, Human
cagcuccagcuca

SEQ ID NO: 1162111 - RNA, 14 nt, Human
cagcuccagcucac

SEQ ID NO: 1162112 - RNA, 15 nt, Human
cagcuccagcucacc

SEQ ID NO: 1162113 - RNA, 18 nt, Human
cagcugugcucuggacag

SEQ ID NO: 1162114 - RNA, 19 nt, Human
cagcugugcucuggacagg

SEQ ID NO: 1162115 - RNA, 15 nt, Human
cagcuucauuuccug

SEQ ID NO: 1162116 - RNA, 18 nt, Human
cagcuucauuuccugugu

SEQ ID NO: 1162117 - RNA, 19 nt, Human
cagcuucauuuccuguguc

SEQ ID NO: 1162118 - RNA, 14 nt, Human
caggaaaggcucca

SEQ ID NO: 1162119 - RNA, 15 nt, Human
caggaaaggcuccag

SEQ ID NO: 1162120 - RNA, 18 nt, Human
cagccugagcgacaguga

SEQ ID NO: 1162121 - RNA, 19 nt, Human
cagccugagcgacagugag

SEQ ID NO: 1162122 - RNA, 22 nt, Human
cagccugagcgacagugagacu

SEQ ID NO: 1162123 - RNA, 15 nt, Human
cagcggggacagcuc

SEQ ID NO: 1162124 - RNA, 16 nt, Human
cagcggggacagcucc

SEQ ID NO: 1162125 - RNA, 17 nt, Human
cagcggggacagcuccu

SEQ ID NO: 1162126 - RNA, 12 nt, Human
cagccccuggau

SEQ ID NO: 1162127 - RNA, 13 nt, Human
cagccccuggaug

SEQ ID NO: 1162128 - RNA, 14 nt, Human
cagccccuggaugc

SEQ ID NO: 1162129 - RNA, 22 nt, Human
cagccccuggaugcagccucac

SEQ ID NO: 1162130 - RNA, 16 nt, Human
cagcccuuagcaggga

SEQ ID NO: 1162131 - RNA, 21 nt, Human
cagcccuuagcagggaaacag

SEQ ID NO: 1162132 - RNA, 17 nt, Human
cagccccuggaugcagc

SEQ ID NO: 1162133 - RNA, 18 nt, Human
cagccccuggaugcagcc

SEQ ID NO: 1162134 - RNA, 19 nt, Human
cagccccuggaugcagccu

SEQ ID NO: 1162135 - RNA, 21 nt, Human
cagccccuggaugcagccuca

SEQ ID NO: 1162136 - RNA, 15 nt, Human
cagcccuucuuucca

SEQ ID NO: 1162137 - RNA, 19 nt, Human
cagcccuucuuuccacaga

SEQ ID NO: 1162138 - RNA, 20 nt, Human
cagcccuucuuuccacagaa

SEQ ID NO: 1162139 - RNA, 21 nt, Human
cagccgagauagccaaggcca

SEQ ID NO: 1162140 - RNA, 22 nt, Human
cagcacagccucuuagaugcag

SEQ ID NO: 1162141 - RNA, 22 nt, Human
cagccaggccacaagacccuug

SEQ ID NO: 1162142 - RNA, 12 nt, Human
cagccaggccac

SEQ ID NO: 1162143 - RNA, 13 nt, Human
cagccaggccaca

SEQ ID NO: 1162144 - RNA, 19 nt, Human
cagcauauucaggaagcuc

SEQ ID NO: 1162145 - RNA, 22 nt, Human
cagcauauucaggaagcucagg

SEQ ID NO: 1162146 - RNA, 23 nt, Human
cagcauauucaggaagcucaggg

SEQ ID NO: 1162147 - RNA, 18 nt, Human
cagaggggguggccuccc

SEQ ID NO: 1162148 - RNA, 19 nt, Human
cagaggggguggccuccca

SEQ ID NO: 1162149 - RNA, 20 nt, Human
cagaggggguggccucccaa

SEQ ID NO: 1162150 - RNA, 22 nt, Human
cagaggggguggccucccaacu

SEQ ID NO: 1162151 - RNA, 20 nt, Human
cagagucagaaguuucugcc

SEQ ID NO: 1162152 - RNA, 19 nt, Human
cagaaguuucugccgcagc

SEQ ID NO: 1162153 - RNA, 20 nt, Human
cagaaguuugagaucagccu

SEQ ID NO: 1162154 - RNA, 22 nt, Human
cagaaguuugagaucagccugg

SEQ ID NO: 1162155 - RNA, 23 nt, Human
cagaaguuugagaucagccuggg

SEQ ID NO: 1162156 - RNA, 18 nt, Human
cagagcugccaccugccu

SEQ ID NO: 1162157 - RNA, 22 nt, Human
cagagggccugcaagggaguga

SEQ ID NO: 1162158 - RNA, 13 nt, Human
caccagccccagu

SEQ ID NO: 1162159 - RNA, 16 nt, Human
caccagccccagugcc

SEQ ID NO: 1162160 - RNA, 18 nt, Human
cacccaccucagccuccc

SEQ ID NO: 1162161 - RNA, 16 nt, Human
cacccaggagccccga

SEQ ID NO: 1162162 - RNA, 14 nt, Human
caccaacgucugug

SEQ ID NO: 1162163 - RNA, 16 nt, Human
caccaacgucugugcc

SEQ ID NO: 1162164 - RNA, 17 nt, Human
caccaacauacucccau

SEQ ID NO: 1162165 - RNA, 19 nt, Human
cacauuuuauuuuauuaug

SEQ ID NO: 1162166 - RNA, 20 nt, Human
cacauuuuauuuuauuaugc

SEQ ID NO: 1162167 - RNA, 21 nt, Human
cacauuuuauuuuauuaugca

SEQ ID NO: 1162168 - RNA, 16 nt, Human
cacagaaaauauacug

SEQ ID NO: 1162169 - RNA, 17 nt, Human
cacagaaaauauacugu

SEQ ID NO: 1162170 - RNA, 18 nt, Human
cacagaaaauauacugua

SEQ ID NO: 1162171 - RNA, 19 nt, Human
cacagaaaauauacuguaa

SEQ ID NO: 1162172 - RNA, 20 nt, Human
cacagaaaauauacuguaaa

SEQ ID NO: 1162173 - RNA, 21 nt, Human
cacagaaaauauacuguaaag

SEQ ID NO: 1162174 - RNA, 23 nt, Human
cacagaaaagaaaguucaugcuu

SEQ ID NO: 1162175 - RNA, 12 nt, Human
cacagaaaauau

SEQ ID NO: 1162176 - RNA, 13 nt, Human
cacagaaaauaua

SEQ ID NO: 1162177 - RNA, 14 nt, Human
cacagaaaauauac

SEQ ID NO: 1162178 - RNA, 15 nt, Human
cacagaaaauauacu

SEQ ID NO: 1162179 - RNA, 10 nt, Human
cacacauuuu

SEQ ID NO: 1162180 - RNA, 11 nt, Human
cacacauuuuu

SEQ ID NO: 1162181 - RNA, 12 nt, Human
cacacauuuuuu

SEQ ID NO: 1162182 - RNA, 16 nt, Human
cacacauuuuuuaaau

SEQ ID NO: 1162183 - RNA, 19 nt, Human
cacacauuuuuuaaaugca

SEQ ID NO: 1162184 - RNA, 20 nt, Human
cacacauuuuuuaaaugcac

SEQ ID NO: 1162185 - RNA, 14 nt, Human
cacagacccugccc

SEQ ID NO: 1162186 - RNA, 16 nt, Human
cacagacccugcccug

SEQ ID NO: 1162187 - RNA, 17 nt, Human
cacagacccugcccugu

SEQ ID NO: 1162188 - RNA, 18 nt, Human
cacagacccugcccugug

SEQ ID NO: 1162189 - RNA, 11 nt, Human
cacagcucugu

SEQ ID NO: 1162190 - RNA, 14 nt, Human
cacagcucuguccu

SEQ ID NO: 1162191 - RNA, 15 nt, Human
cacagcucuguccug

SEQ ID NO: 1162192 - RNA, 16 nt, Human
cacagcucuguccugg

SEQ ID NO: 1162193 - RNA, 18 nt, Human
cacagcucuguccuggga

SEQ ID NO: 1162194 - RNA, 19 nt, Human
cacagcucuguccugggag

SEQ ID NO: 1162195 - RNA, 14 nt, Human
cacagcucuucucc

SEQ ID NO: 1162196 - RNA, 15 nt, Human
cacagcucuucucca

SEQ ID NO: 1162197 - RNA, 17 nt, Human
cacagcucuucuccagg

SEQ ID NO: 1162198 - RNA, 18 nt, Human
cacagcucuucuccaggc

SEQ ID NO: 1162199 - RNA, 13 nt, Human
caaugcuggcugu

SEQ ID NO: 1162200 - RNA, 20 nt, Human
caaugcuggcuguuggcugg

SEQ ID NO: 1162201 - RNA, 21 nt, Human
caaugcuggcuguuggcuggg

SEQ ID NO: 1162202 - RNA, 15 nt, Human
caaugggagcucaug

SEQ ID NO: 1162203 - RNA, 18 nt, Human
cacaagagcccaggccuc

SEQ ID NO: 1162204 - RNA, 19 nt, Human
cacaagagcccaggccucc

SEQ ID NO: 1162205 - RNA, 20 nt, Human
cacaagagcccaggccuccu

SEQ ID NO: 1162206 - RNA, 18 nt, Human
cacaagcuccaagcuccc

SEQ ID NO: 1162207 - RNA, 19 nt, Human
cacaagcuccaagcuccca

SEQ ID NO: 1162208 - RNA, 20 nt, Human
cacaagcuccaagcucccag

SEQ ID NO: 1162209 - RNA, 21 nt, Human
cacaagcuccaagcucccagg

SEQ ID NO: 1162210 - RNA, 20 nt, Human
caauaaaauccauacauuug

SEQ ID NO: 1162211 - RNA, 23 nt, Human
caauaaaauccauacauuugugu

SEQ ID NO: 1162212 - RNA, 17 nt, Human
caaggcaaggcugucaa

SEQ ID NO: 1162213 - RNA, 18 nt, Human
caaggcaaggcugucaau

SEQ ID NO: 1162214 - RNA, 20 nt, Human
caaggccaaaggaagcacau

SEQ ID NO: 1162215 - RNA, 21 nt, Human
caaggccaaaggaagcacaug

SEQ ID NO: 1162216 - RNA, 12 nt, Human
caccucagccuc

SEQ ID NO: 1162217 - RNA, 18 nt, Human
caccuuggcugcagggag

SEQ ID NO: 1162218 - RNA, 15 nt, Human
caccuuggcugcagg

SEQ ID NO: 1162219 - RNA, 16 nt, Human
caccuuggcugcaggg

SEQ ID NO: 1162220 - RNA, 14 nt, Human
caccuuucccaucu

SEQ ID NO: 1162221 - RNA, 14 nt, Human
caccuuugaagaag

SEQ ID NO: 1162222 - RNA, 20 nt, Human
cacucuuauugcccacgcug

SEQ ID NO: 1162223 - RNA, 21 nt, Human
cacucuuauugcccacgcugg

SEQ ID NO: 1162224 - RNA, 22 nt, Human
cacucuuauugcccacgcugga

SEQ ID NO: 1162225 - RNA, 12 nt, Human
cacggccaggcc

SEQ ID NO: 1162226 - RNA, 13 nt, Human
cacggccaggcca

SEQ ID NO: 1162227 - RNA, 14 nt, Human
cacggcucacugca

SEQ ID NO: 1162228 - RNA, 15 nt, Human
cacggcucacugcag

SEQ ID NO: 1162229 - RNA, 21 nt, Human
cacuacauuauaaaugucucu

SEQ ID NO: 1162230 - RNA, 17 nt, Human
cacuacauucuguuaau

SEQ ID NO: 1162231 - RNA, 21 nt, Human
cacuacauucuguuaaucauu

SEQ ID NO: 1162232 - RNA, 13 nt, Human
cacuccagccuga

SEQ ID NO: 1162233 - RNA, 23 nt, Human
cacuccagccugagcgacaguga

SEQ ID NO: 1162234 - RNA, 13 nt, Human
cacuccagccugg

SEQ ID NO: 1162235 - RNA, 14 nt, Human
cacuccagccuggg

SEQ ID NO: 1162236 - RNA, 18 nt, Human
cagaacagugauuaccag

SEQ ID NO: 1162237 - RNA, 14 nt, Human
cagaaguuucugcc

SEQ ID NO: 1162238 - RNA, 16 nt, Human
cagaaguuucugccgc

SEQ ID NO: 1162239 - RNA, 11 nt, Human
cagaacaguga

SEQ ID NO: 1162240 - RNA, 12 nt, Human
cagaacagugau

SEQ ID NO: 1162241 - RNA, 17 nt, Human
cagaacagugauuacca

SEQ ID NO: 1162242 - RNA, 16 nt, Human
cagaaauguacagcaa

SEQ ID NO: 1162243 - RNA, 17 nt, Human
cagaaauguguuaucac

SEQ ID NO: 1162244 - RNA, 20 nt, Human
cacugggcuuggggaccaga

SEQ ID NO: 1162245 - RNA, 15 nt, Human
cacuuaaaaaugguu

SEQ ID NO: 1162246 - RNA, 18 nt, Human
cacuguugcccaggcugg

SEQ ID NO: 1162247 - RNA, 19 nt, Human
cacuguugcccaggcuggc

SEQ ID NO: 1162248 - RNA, 23 nt, Human
cacuguugcccaggcuggcgugc

SEQ ID NO: 1162249 - RNA, 19 nt, Human
cacugcagccucaaccucc

SEQ ID NO: 1162250 - RNA, 20 nt, Human
cacugcagccucaaccuccu

SEQ ID NO: 1162251 - RNA, 21 nt, Human
cacugcagccucaaccuccug

SEQ ID NO: 1162252 - RNA, 22 nt, Human
cacugcagccucaaccuccugg

SEQ ID NO: 1162253 - RNA, 23 nt, Human
cacugcagccucaaccuccuggg

SEQ ID NO: 1162254 - RNA, 17 nt, Human
cacugccaugccagcuu

SEQ ID NO: 1162255 - RNA, 18 nt, Human
cacuuguguuaugaagca

SEQ ID NO: 1162256 - RNA, 17 nt, Human
cacuuguguuuugcaag

SEQ ID NO: 1162257 - RNA, 16 nt, Human
cacuuacacuuuaugc

SEQ ID NO: 1162258 - RNA, 18 nt, Human
cacuuucuagccagagga

SEQ ID NO: 1162259 - RNA, 16 nt, Human
cacuuucuagccagag

SEQ ID NO: 1162260 - RNA, 17 nt, Human
cacuuucuagccagagg

SEQ ID NO: 1162261 - RNA, 13 nt, Human
cacuuucuagcca

SEQ ID NO: 1162262 - RNA, 18 nt, Human
auucuccuuguguuacua

SEQ ID NO: 1162263 - RNA, 19 nt, Human
auucuccuuguguuacuaa

SEQ ID NO: 1162264 - RNA, 21 nt, Human
auucuccuuguguuacuaagu

SEQ ID NO: 1162265 - RNA, 22 nt, Human
auucuccuuguguuacuaaguu

SEQ ID NO: 1162266 - RNA, 17 nt, Human
auucucuaguuugauua

SEQ ID NO: 1162267 - RNA, 18 nt, Human
auucucuaguuugauuaa

SEQ ID NO: 1162268 - RNA, 19 nt, Human
auucucuaguuugauuaaa

SEQ ID NO: 1162269 - RNA, 19 nt, Human
auucuucugcuucagccuc

SEQ ID NO: 1162270 - RNA, 20 nt, Human
auucuucugcuucagccucc

SEQ ID NO: 1162271 - RNA, 22 nt, Human
auucuucuguacgucugacagg

SEQ ID NO: 1162272 - RNA, 17 nt, Human
auucuugccaaauauaa

SEQ ID NO: 1162273 - RNA, 14 nt, Human
auucuugcaaagua

SEQ ID NO: 1162274 - RNA, 15 nt, Human
auucuugcaaaguau

SEQ ID NO: 1162275 - RNA, 16 nt, Human
auucuugcaaaguauc

SEQ ID NO: 1162276 - RNA, 11 nt, Human
auuaaauuaug

SEQ ID NO: 1162277 - RNA, 19 nt, Human
auuaaaugcccagccccuu

SEQ ID NO: 1162278 - RNA, 19 nt, Human
auuaugaauuacauuugua

SEQ ID NO: 1162279 - RNA, 20 nt, Human
auuaugaauuacauuuguau

SEQ ID NO: 1162280 - RNA, 22 nt, Human
auuaugaauuacauuuguauaa

SEQ ID NO: 1162281 - RNA, 18 nt, Human
auucaacagguuuuccug

SEQ ID NO: 1162282 - RNA, 14 nt, Human
auuucuaugaaaua

SEQ ID NO: 1162283 - RNA, 16 nt, Human
auuuaaugaaagacug

SEQ ID NO: 1162284 - RNA, 20 nt, Human
auuuaaugaaagacuguaca

SEQ ID NO: 1162285 - RNA, 21 nt, Human
auuuaaugaaagacuguacaa

SEQ ID NO: 1162286 - RNA, 18 nt, Human
caacucaccccagcccca

SEQ ID NO: 1162287 - RNA, 14 nt, Human
caacucuccuccag

SEQ ID NO: 1162288 - RNA, 22 nt, Human
caagaauugaagcaggacuaaa

SEQ ID NO: 1162289 - RNA, 17 nt, Human
caagaccacguuucuaa

SEQ ID NO: 1162290 - RNA, 18 nt, Human
caagaccacguuucuaaa

SEQ ID NO: 1162291 - RNA, 19 nt, Human
caagacccaaaaggcagaa

SEQ ID NO: 1162292 - RNA, 19 nt, Human
caaaguaucccuacuguaa

SEQ ID NO: 1162293 - RNA, 21 nt, Human
caaaguaucccuacuguaauu

SEQ ID NO: 1162294 - RNA, 14 nt, Human
caaagauauuuugc

SEQ ID NO: 1162295 - RNA, 16 nt, Human
caaagauauuuugcuu

SEQ ID NO: 1162296 - RNA, 18 nt, Human
caaagcagugcaugcugu

SEQ ID NO: 1162297 - RNA, 21 nt, Human
caaagcagugcaugcuguccc

SEQ ID NO: 1162298 - RNA, 22 nt, Human
caaagcagugcaugcugucccu

SEQ ID NO: 1162299 - RNA, 18 nt, Human
caaagauauuuugcuuug

SEQ ID NO: 1162300 - RNA, 14 nt, Human
caaacccuucagug

SEQ ID NO: 1162301 - RNA, 21 nt, Human
caaaaggauaaugaauacuuu

SEQ ID NO: 1162302 - RNA, 17 nt, Human
caaacauauauaacaau

SEQ ID NO: 1162303 - RNA, 15 nt, Human
auuuuuauauuugaa

SEQ ID NO: 1162304 - RNA, 16 nt, Human
auuuuuauauuugaaa

SEQ ID NO: 1162305 - RNA, 16 nt, Human
auuuuuuugagacaga

SEQ ID NO: 1162306 - RNA, 18 nt, Human
auuuuuuuuuccuucagu

SEQ ID NO: 1162307 - RNA, 20 nt, Human
auuuuuuuuuccuucagugc

SEQ ID NO: 1162308 - RNA, 22 nt, Human
auuuuuuuuuccuucagugccu

SEQ ID NO: 1162309 - RNA, 23 nt, Human
auuuuuuuuuccuucagugccuu

SEQ ID NO: 1162310 - RNA, 21 nt, Human
auuuuauaucaauuuaaaaaa

SEQ ID NO: 1162311 - RNA, 19 nt, Human
auuuuuaagugcugcauuu

SEQ ID NO: 1162312 - RNA, 16 nt, Human
auuuuuaagugcugca

SEQ ID NO: 1162313 - RNA, 18 nt, Human
auuuuuaagugcugcauu

SEQ ID NO: 1162314 - RNA, 14 nt, Human
auuuuuagacagag

SEQ ID NO: 1162315 - RNA, 16 nt, Human
cccaggaaaggcucca

SEQ ID NO: 1162316 - RNA, 19 nt, Human
cccaggaaaggcuccagga

SEQ ID NO: 1162317 - RNA, 17 nt, Human
cccaggaaaggcuccag

SEQ ID NO: 1162318 - RNA, 18 nt, Human
cccaggaaaggcuccagg

SEQ ID NO: 1162319 - RNA, 22 nt, Human
cccaggcuuagucacugagaca

SEQ ID NO: 1162320 - RNA, 21 nt, Human
cccauccucuguacagagccc

SEQ ID NO: 1162321 - RNA, 22 nt, Human
cccauccucuguacagagccca

SEQ ID NO: 1162322 - RNA, 15 nt, Human
ccccagauugcaaca

SEQ ID NO: 1162323 - RNA, 20 nt, Human
ccccagauugcaacaggcug

SEQ ID NO: 1162324 - RNA, 21 nt, Human
ccccagauugcaacaggcugg

SEQ ID NO: 1162325 - RNA, 10 nt, Human
ccccagcccc

SEQ ID NO: 1162326 - RNA, 20 nt, Human
cccauucugccugcccaggc

SEQ ID NO: 1162327 - RNA, 19 nt, Human
cccauucugccugcccagg

SEQ ID NO: 1162328 - RNA, 14 nt, Human
cccauucugccugc

SEQ ID NO: 1162329 - RNA, 15 nt, Human
cccauucugccugcc

SEQ ID NO: 1162330 - RNA, 15 nt, Human
cccauuugcuccuuu

SEQ ID NO: 1162331 - RNA, 14 nt, Human
ccccgcacugggcu

SEQ ID NO: 1162332 - RNA, 23 nt, Human
ccccgacccuugccgucuaccug

SEQ ID NO: 1162333 - RNA, 20 nt, Human
cccucaacucuccuccagag

SEQ ID NO: 1162334 - RNA, 16 nt, Human
cccucaacucuccucc

SEQ ID NO: 1162335 - RNA, 18 nt, Human
cccgggaagggggcuggg

SEQ ID NO: 1162336 - RNA, 21 nt, Human
cccgggaagggggcugggaca

SEQ ID NO: 1162337 - RNA, 22 nt, Human
cccgggaagggggcugggacau

SEQ ID NO: 1162338 - RNA, 16 nt, Human
cccucaacaccucugc

SEQ ID NO: 1162339 - RNA, 11 nt, Human
cccggcuccag

SEQ ID NO: 1162340 - RNA, 15 nt, Human
cccgggaagggggcu

SEQ ID NO: 1162341 - RNA, 15 nt, Human
cccggccccugcugg

SEQ ID NO: 1162342 - RNA, 16 nt, Human
cccggccccugcuggu

SEQ ID NO: 1162343 - RNA, 13 nt, Human
ccccuucugaccc

SEQ ID NO: 1162344 - RNA, 14 nt, Human
ccccuucugaccca

SEQ ID NO: 1162345 - RNA, 16 nt, Human
ccccuucugacccaug

SEQ ID NO: 1162346 - RNA, 17 nt, Human
cccgaauagcugggacu

SEQ ID NO: 1162347 - RNA, 18 nt, Human
cccgaauagcugggacua

SEQ ID NO: 1162348 - RNA, 22 nt, Human
cccgaauagcugggacuacagg

SEQ ID NO: 1162349 - RNA, 15 nt, Human
ccccugacaacacuc

SEQ ID NO: 1162350 - RNA, 13 nt, Human
ccccugcacucca

SEQ ID NO: 1162351 - RNA, 14 nt, Human
ccccugccacccug

SEQ ID NO: 1162352 - RNA, 16 nt, Human
ccccugccacccuggg

SEQ ID NO: 1162353 - RNA, 20 nt, Human
ccaugaggaacaaggcaagg

SEQ ID NO: 1162354 - RNA, 23 nt, Human
ccaugaggaacaaggcaaggcug

SEQ ID NO: 1162355 - RNA, 13 nt, Human
ccaugaguccccu

SEQ ID NO: 1162356 - RNA, 19 nt, Human
ccauccagguucagcuugu

SEQ ID NO: 1162357 - RNA, 18 nt, Human
ccaguuggucccccuucc

SEQ ID NO: 1162358 - RNA, 20 nt, Human
ccaguuggucccccuuccau

SEQ ID NO: 1162359 - RNA, 20 nt, Human
ccaucccaaacccuucagug

SEQ ID NO: 1162360 - RNA, 20 nt, Human
ccaucccauaugccugggca

SEQ ID NO: 1162361 - RNA, 21 nt, Human
ccaucccauaugccugggcag

SEQ ID NO: 1162362 - RNA, 13 nt, Human
ccaguuggucccc

SEQ ID NO: 1162363 - RNA, 15 nt, Human
cccaacucaccccag

SEQ ID NO: 1162364 - RNA, 16 nt, Human
cccaacucaccccagc

SEQ ID NO: 1162365 - RNA, 17 nt, Human
cccaacucaccccagcc

SEQ ID NO: 1162366 - RNA, 20 nt, Human
cccaacucaccccagcccca

SEQ ID NO: 1162367 - RNA, 13 nt, Human
cccaacuccagaa

SEQ ID NO: 1162368 - RNA, 13 nt, Human
cccaagcucugcu

SEQ ID NO: 1162369 - RNA, 14 nt, Human
cccaagcucugcuc

SEQ ID NO: 1162370 - RNA, 15 nt, Human
cccaagcucugcucc

SEQ ID NO: 1162371 - RNA, 12 nt, Human
cccacccccacc

SEQ ID NO: 1162372 - RNA, 13 nt, Human
cccacucccugca

SEQ ID NO: 1162373 - RNA, 23 nt, Human
cccacugcuuuuggucuguguga

SEQ ID NO: 1162374 - RNA, 12 nt, Human
ccaggcaggucu

SEQ ID NO: 1162375 - RNA, 14 nt, Human
ccaggcaggucuug

SEQ ID NO: 1162376 - RNA, 23 nt, Human
ccaggcaggucuugaacuccugg

SEQ ID NO: 1162377 - RNA, 12 nt, Human
ccaggcuggcgu

SEQ ID NO: 1162378 - RNA, 16 nt, Human
ccaggcuggcgugcag

SEQ ID NO: 1162379 - RNA, 12 nt, Human
ccagcagaaaug

SEQ ID NO: 1162380 - RNA, 12 nt, Human
ccagcagagcac

SEQ ID NO: 1162381 - RNA, 13 nt, Human
ccagcagagcacc

SEQ ID NO: 1162382 - RNA, 14 nt, Human
ccagcagagcaccu

SEQ ID NO: 1162383 - RNA, 17 nt, Human
ccagccccagugcccac

SEQ ID NO: 1162384 - RNA, 15 nt, Human
ccagccccauccucu

SEQ ID NO: 1162385 - RNA, 17 nt, Human
ccagccccauccucugu

SEQ ID NO: 1162386 - RNA, 18 nt, Human
ccagccccauccucugua

SEQ ID NO: 1162387 - RNA, 23 nt, Human
ccagccccuucugacccaugcug

SEQ ID NO: 1162388 - RNA, 24 nt, Human
ccagccccuucugacccaugcugc

SEQ ID NO: 1162389 - RNA, 18 nt, Human
ccugcccaccuggccucu

SEQ ID NO: 1162390 - RNA, 19 nt, Human
ccugcccaccuggccucug

SEQ ID NO: 1162391 - RNA, 19 nt, Human
ccugcccaggccccugcca

SEQ ID NO: 1162392 - RNA, 21 nt, Human
ccugcccaggccccugccacc

SEQ ID NO: 1162393 - RNA, 22 nt, Human
ccugcccaggccccugccaccc

SEQ ID NO: 1162394 - RNA, 15 nt, Human
ccugccucagccucc

SEQ ID NO: 1162395 - RNA, 16 nt, Human
ccugccucagccuccc

SEQ ID NO: 1162396 - RNA, 17 nt, Human
ccugcccaccuggccuc

SEQ ID NO: 1162397 - RNA, 12 nt, Human
ccugcaggcagc

SEQ ID NO: 1162398 - RNA, 13 nt, Human
ccugcaggcagcc

SEQ ID NO: 1162399 - RNA, 14 nt, Human
ccugcaggcagcca

SEQ ID NO: 1162400 - RNA, 15 nt, Human
ccugcaggcagccag

SEQ ID NO: 1162401 - RNA, 19 nt, Human
ccucuuucccucccuuccu

SEQ ID NO: 1162402 - RNA, 15 nt, Human
ccucuuugagugaag

SEQ ID NO: 1162403 - RNA, 16 nt, Human
ccucuuugagugaagc

SEQ ID NO: 1162404 - RNA, 15 nt, Human
ccuggggagaaagua

SEQ ID NO: 1162405 - RNA, 13 nt, Human
ccugguguggaag

SEQ ID NO: 1162406 - RNA, 18 nt, Human
ccugguggcagugggagc

SEQ ID NO: 1162407 - RNA, 19 nt, Human
ccugguggcagugggagcu

SEQ ID NO: 1162408 - RNA, 20 nt, Human
ccugguggcagugggagcug

SEQ ID NO: 1162409 - RNA, 15 nt, Human
ccuggauggggcugc

SEQ ID NO: 1162410 - RNA, 17 nt, Human
ccuggauggggcugcac

SEQ ID NO: 1162411 - RNA, 18 nt, Human
ccuggauggggcugcacc

SEQ ID NO: 1162412 - RNA, 18 nt, Human
ccuggccccucagggucc

SEQ ID NO: 1162413 - RNA, 20 nt, Human
ccuggccccucagggucccu

SEQ ID NO: 1162414 - RNA, 21 nt, Human
ccuggccccucagggucccug

SEQ ID NO: 1162415 - RNA, 17 nt, Human
ccugucucuacuaaaaa

SEQ ID NO: 1162416 - RNA, 10 nt, Human
ccucaggccu

SEQ ID NO: 1162417 - RNA, 12 nt, Human
ccucaggcaggu

SEQ ID NO: 1162418 - RNA, 18 nt, Human
ccucaggcaggugggaug

SEQ ID NO: 1162419 - RNA, 16 nt, Human
ccucaaccuccugggc

SEQ ID NO: 1162420 - RNA, 20 nt, Human
ccucaagugauucuccugcc

SEQ ID NO: 1162421 - RNA, 23 nt, Human
ccucaagugauucuccugccuca

SEQ ID NO: 1162422 - RNA, 17 nt, Human
ccucccaucacccgcua

SEQ ID NO: 1162423 - RNA, 16 nt, Human
ccuccaagaccuucuc

SEQ ID NO: 1162424 - RNA, 17 nt, Human
ccuccaagaccuucucc

SEQ ID NO: 1162425 - RNA, 19 nt, Human
ccuccaagaccuucuccuu

SEQ ID NO: 1162426 - RNA, 20 nt, Human
ccuccaagaccuucuccuuc

SEQ ID NO: 1162427 - RNA, 12 nt, Human
ccucccaucacc

SEQ ID NO: 1162428 - RNA, 16 nt, Human
ccucaacaccucugca

SEQ ID NO: 1162429 - RNA, 15 nt, Human
ccucaaccuccuggg

SEQ ID NO: 1162430 - RNA, 21 nt, Human
ccucaacucuccuccagaguc

SEQ ID NO: 1162431 - RNA, 23 nt, Human
ccucaacucuccuccagagucag

SEQ ID NO: 1162432 - RNA, 16 nt, Human
ccucccuucucuucac

SEQ ID NO: 1162433 - RNA, 14 nt, Human
ccuccgccucuugg

SEQ ID NO: 1162434 - RNA, 23 nt, Human
ccuccuuugugaggaagccgcug

SEQ ID NO: 1162435 - RNA, 18 nt, Human
ccuccuuuucacaguucu

SEQ ID NO: 1162436 - RNA, 15 nt, Human
ccucgaacuggcugc

SEQ ID NO: 1162437 - RNA, 14 nt, Human
cccuucucuccagc

SEQ ID NO: 1162438 - RNA, 19 nt, Human
cccuucucuccagccccug

SEQ ID NO: 1162439 - RNA, 21 nt, Human
cccuuuuuuggcugcugaagg

SEQ ID NO: 1162440 - RNA, 22 nt, Human
cccuuuuuuggcugcugaaggc

SEQ ID NO: 1162441 - RNA, 23 nt, Human
cccuuuuuuggcugcugaaggcu

SEQ ID NO: 1162442 - RNA, 14 nt, Human
cccuccuuucacca

SEQ ID NO: 1162443 - RNA, 21 nt, Human
cccugugaguacuacaguccu

SEQ ID NO: 1162444 - RNA, 23 nt, Human
cccugugaguacuacaguccucc

SEQ ID NO: 1162445 - RNA, 15 nt, Human
cccugugauggggcc

SEQ ID NO: 1162446 - RNA, 17 nt, Human
cccugugauggggcccu

SEQ ID NO: 1162447 - RNA, 15 nt, Human
cccugugggccccca

SEQ ID NO: 1162448 - RNA, 14 nt, Human
ccgcagcccugcag

SEQ ID NO: 1162449 - RNA, 18 nt, Human
ccgcagcccugcagaggg

SEQ ID NO: 1162450 - RNA, 23 nt, Human
ccgcagcccugcagagggcacag

SEQ ID NO: 1162451 - RNA, 17 nt, Human
ccggccaccugcggugc

SEQ ID NO: 1162452 - RNA, 18 nt, Human
ccggccaccugcggugcu

SEQ ID NO: 1162453 - RNA, 18 nt, Human
ccggcaggguccuagaaa

SEQ ID NO: 1162454 - RNA, 22 nt, Human
ccuagccuuagaagucacacag

SEQ ID NO: 1162455 - RNA, 23 nt, Human
ccuagccugugccucugggacug

SEQ ID NO: 1162456 - RNA, 19 nt, Human
ccuagccuuagaagucaca

SEQ ID NO: 1162457 - RNA, 18 nt, Human
cuagcauacguacacauu

SEQ ID NO: 1162458 - RNA, 19 nt, Human
cuagcauacguacacauuu

SEQ ID NO: 1162459 - RNA, 20 nt, Human
cuagcauacguacacauuuu

SEQ ID NO: 1162460 - RNA, 19 nt, Human
cuagccagaggagagagga

SEQ ID NO: 1162461 - RNA, 13 nt, Human
cuaggccuggcca

SEQ ID NO: 1162462 - RNA, 14 nt, Human
cuaggccuggccag

SEQ ID NO: 1162463 - RNA, 15 nt, Human
cuaggccuggccaga

SEQ ID NO: 1162464 - RNA, 18 nt, Human
cuaggccuggccagaugc

SEQ ID NO: 1162465 - RNA, 19 nt, Human
cuaggccuggccagaugca

SEQ ID NO: 1162466 - RNA, 12 nt, Human
cuaggccugggg

SEQ ID NO: 1162467 - RNA, 13 nt, Human
cuaggccugggga

SEQ ID NO: 1162468 - RNA, 17 nt, Human
cuaguuugauuaaauuc

SEQ ID NO: 1162469 - RNA, 19 nt, Human
cuaguuugauuaaauucuu

SEQ ID NO: 1162470 - RNA, 14 nt, Human
cuagggaagauaau

SEQ ID NO: 1162471 - RNA, 20 nt, Human
cuaguuugauuaaauucuug

SEQ ID NO: 1162472 - RNA, 21 nt, Human
cuaguuugauuaaauucuugc

SEQ ID NO: 1162473 - RNA, 17 nt, Human
cuaccuuuguauucucu

SEQ ID NO: 1162474 - RNA, 16 nt, Human
cuaccugaggggccuc

SEQ ID NO: 1162475 - RNA, 19 nt, Human
cuaccugaggggccucuua

SEQ ID NO: 1162476 - RNA, 23 nt, Human
cuaccugaggggccucuuauggg

SEQ ID NO: 1162477 - RNA, 13 nt, Human
cucaccuccugcu

SEQ ID NO: 1162478 - RNA, 13 nt, Human
cucaccucucccu

SEQ ID NO: 1162479 - RNA, 14 nt, Human
cucaccucucccuu

SEQ ID NO: 1162480 - RNA, 15 nt, Human
cucaccucucccuug

SEQ ID NO: 1162481 - RNA, 16 nt, Human
cucaccucucccuugg

SEQ ID NO: 1162482 - RNA, 17 nt, Human
cucaccucucccuugga

SEQ ID NO: 1162483 - RNA, 14 nt, Human
cucaccuccugcug

SEQ ID NO: 1162484 - RNA, 13 nt, Human
cucaccugccccu

SEQ ID NO: 1162485 - RNA, 14 nt, Human
cucaccugccccuc

SEQ ID NO: 1162486 - RNA, 16 nt, Human
cucaccugccccucaa

SEQ ID NO: 1162487 - RNA, 18 nt, Human
cucaccugccccucaacu

SEQ ID NO: 1162488 - RNA, 19 nt, Human
cucagaaaacaaggaugaa

SEQ ID NO: 1162489 - RNA, 23 nt, Human
cucagaaaacaaggaugaauuaa

SEQ ID NO: 1162490 - RNA, 14 nt, Human
cucacacaugagca

SEQ ID NO: 1162491 - RNA, 21 nt, Human
cucacacaugagcaucaggcc

SEQ ID NO: 1162492 - RNA, 12 nt, Human
cucaaauaacua

SEQ ID NO: 1162493 - RNA, 14 nt, Human
cucacaaaggaugc

SEQ ID NO: 1162494 - RNA, 20 nt, Human
cuaucucccccagccccauc

SEQ ID NO: 1162495 - RNA, 19 nt, Human
cuauguaucaaugaguaac

SEQ ID NO: 1162496 - RNA, 23 nt, Human
cuaugucauuugcuggagcucug

SEQ ID NO: 1162497 - RNA, 22 nt, Human
cuauguguagggcgggaggaug

SEQ ID NO: 1162498 - RNA, 15 nt, Human
cuauguugcccaggc

SEQ ID NO: 1162499 - RNA, 16 nt, Human
cuauguugcccaggca

SEQ ID NO: 1162500 - RNA, 17 nt, Human
cuauguugcccaggcag

SEQ ID NO: 1162501 - RNA, 18 nt, Human
cucaaaaaaagaaaaaga

SEQ ID NO: 1162502 - RNA, 17 nt, Human
cgcuggggccaguuggu

SEQ ID NO: 1162503 - RNA, 20 nt, Human
cgcuggggccaguugguccc

SEQ ID NO: 1162504 - RNA, 16 nt, Human
cgccuuaaggauguuc

SEQ ID NO: 1162505 - RNA, 16 nt, Human
cgcugccccuggcagc

SEQ ID NO: 1162506 - RNA, 17 nt, Human
cgcugccccuggcagcc

SEQ ID NO: 1162507 - RNA, 18 nt, Human
cgcugccccuggcagccc

SEQ ID NO: 1162508 - RNA, 19 nt, Human
cgcugccccuggcagcccc

SEQ ID NO: 1162509 - RNA, 19 nt, Human
cgcuggaccuugaacuggg

SEQ ID NO: 1162510 - RNA, 23 nt, Human
cgcuggaccuugaacuggguacu

SEQ ID NO: 1162511 - RNA, 13 nt, Human
cgaguagcuggga

SEQ ID NO: 1162512 - RNA, 13 nt, Human
cguuaaaauacca

SEQ ID NO: 1162513 - RNA, 14 nt, Human
cuaaagcugccagc

SEQ ID NO: 1162514 - RNA, 15 nt, Human
cuaaagcugccagcc

SEQ ID NO: 1162515 - RNA, 15 nt, Human
cuaaaggcuaccuuu

SEQ ID NO: 1162516 - RNA, 16 nt, Human
cuaaaggcuaccuuug

SEQ ID NO: 1162517 - RNA, 17 nt, Human
cuaaaggcuaccuuugu

SEQ ID NO: 1162518 - RNA, 19 nt, Human
cuaaaggcuaccuuuguau

SEQ ID NO: 1162519 - RNA, 22 nt, Human
cuaaaguguauuuuuuuacuaa

SEQ ID NO: 1162520 - RNA, 13 nt, Human
cguacacauuuua

SEQ ID NO: 1162521 - RNA, 16 nt, Human
cguacacauuuuauuu

SEQ ID NO: 1162522 - RNA, 13 nt, Human
cgguguggagaag

SEQ ID NO: 1162523 - RNA, 15 nt, Human
cgguuuauauaagcu

SEQ ID NO: 1162524 - RNA, 15 nt, Human
cggagacggaguccc

SEQ ID NO: 1162525 - RNA, 24 nt, Human
cuccuuuucacaguucucuccuuc

SEQ ID NO: 1162526 - RNA, 22 nt, Human
cuccuagccugugccucuggga

SEQ ID NO: 1162527 - RNA, 16 nt, Human
cuccuuuagcgcccag

SEQ ID NO: 1162528 - RNA, 17 nt, Human
cuccuuuagcgcccagu

SEQ ID NO: 1162529 - RNA, 22 nt, Human
cuccuuuagcgcccaguugggu

SEQ ID NO: 1162530 - RNA, 11 nt, Human
cucggugccuu

SEQ ID NO: 1162531 - RNA, 13 nt, Human
cucucccuuggau

SEQ ID NO: 1162532 - RNA, 16 nt, Human
cucuccgaccagacac

SEQ ID NO: 1162533 - RNA, 21 nt, Human
cucuccgaccagacaccuuga

SEQ ID NO: 1162534 - RNA, 13 nt, Human
cucuccuccuuuu

SEQ ID NO: 1162535 - RNA, 20 nt, Human
cucuccuccuuuucacaguu

SEQ ID NO: 1162536 - RNA, 10 nt, Human
cucuccucug

SEQ ID NO: 1162537 - RNA, 12 nt, Human
cucuccucugcu

SEQ ID NO: 1162538 - RNA, 19 nt, Human
cucucuggccuucggccuc

SEQ ID NO: 1162539 - RNA, 22 nt, Human
cucucuggccuucggccuccau

SEQ ID NO: 1162540 - RNA, 14 nt, Human
cucccaccucagcc

SEQ ID NO: 1162541 - RNA, 16 nt, Human
cucccaccucagccuc

SEQ ID NO: 1162542 - RNA, 17 nt, Human
cucccaccucagccucc

SEQ ID NO: 1162543 - RNA, 18 nt, Human
cuccaggugcacaagcuc

SEQ ID NO: 1162544 - RNA, 19 nt, Human
cuccaggugcacaagcucc

SEQ ID NO: 1162545 - RNA, 20 nt, Human
cuccaggugcacaagcucca

SEQ ID NO: 1162546 - RNA, 22 nt, Human
cuccaggugcacaagcuccaag

SEQ ID NO: 1162547 - RNA, 23 nt, Human
cuccaggcuguaucccaugagcc

SEQ ID NO: 1162548 - RNA, 16 nt, Human
cuccagacacaugucc

SEQ ID NO: 1162549 - RNA, 22 nt, Human
cuccagaauuucccaaagcagu

SEQ ID NO: 1162550 - RNA, 11 nt, Human
cuccagacaca

SEQ ID NO: 1162551 - RNA, 16 nt, Human
cucagaaucucaaaua

SEQ ID NO: 1162552 - RNA, 17 nt, Human
cucagaaucucaaauaa

SEQ ID NO: 1162553 - RNA, 23 nt, Human
cuccgcuuucuacccagcgagcc

SEQ ID NO: 1162554 - RNA, 22 nt, Human
cuccgcuuucuacccagcgagc

SEQ ID NO: 1162555 - RNA, 21 nt, Human
cuccgcuuucuacccagcgag

SEQ ID NO: 1162556 - RNA, 19 nt, Human
cucccucuuucccucccuu

SEQ ID NO: 1162557 - RNA, 19 nt, Human
cuccccaugauguuuagaa

SEQ ID NO: 1162558 - RNA, 16 nt, Human
cucccucccucuuucc

SEQ ID NO: 1162559 - RNA, 15 nt, Human
cucccucuuucccuc

SEQ ID NO: 1162560 - RNA, 14 nt, Human
cugaaaauguaugu

SEQ ID NO: 1162561 - RNA, 13 nt, Human
cugacacacagcu

SEQ ID NO: 1162562 - RNA, 15 nt, Human
cugacacacagcucu

SEQ ID NO: 1162563 - RNA, 16 nt, Human
cugacacacagcucug

SEQ ID NO: 1162564 - RNA, 17 nt, Human
cugacacacagcucugu

SEQ ID NO: 1162565 - RNA, 18 nt, Human
cugacacacagcucuguc

SEQ ID NO: 1162566 - RNA, 19 nt, Human
cugacacacagcucugucc

SEQ ID NO: 1162567 - RNA, 20 nt, Human
cugacacacagcucuguccu

SEQ ID NO: 1162568 - RNA, 21 nt, Human
cugacacacagcucuguccug

SEQ ID NO: 1162569 - RNA, 22 nt, Human
cugacacacagcucuguccugg

SEQ ID NO: 1162570 - RNA, 23 nt, Human
cugacacacagcucuguccuggg

SEQ ID NO: 1162571 - RNA, 17 nt, Human
cucugcacaagcugcac

SEQ ID NO: 1162572 - RNA, 18 nt, Human
cucugcacaagcugcacc

SEQ ID NO: 1162573 - RNA, 19 nt, Human
cucugcacaagcugcaccc

SEQ ID NO: 1162574 - RNA, 14 nt, Human
cucuugagccuggg

SEQ ID NO: 1162575 - RNA, 15 nt, Human
cucuugagccuggga

SEQ ID NO: 1162576 - RNA, 16 nt, Human
cucuugagccugggag

SEQ ID NO: 1162577 - RNA, 24 nt, Human
cucuugauucauaaugacuuaagc

SEQ ID NO: 1162578 - RNA, 13 nt, Human
cugaaagaggaau

SEQ ID NO: 1162579 - RNA, 17 nt, Human
cugaaagaggaaugaag

SEQ ID NO: 1162580 - RNA, 14 nt, Human
cugaggaauccaga

SEQ ID NO: 1162581 - RNA, 19 nt, Human
cugacccugcuucaaauau

SEQ ID NO: 1162582 - RNA, 23 nt, Human
cugacccugcuucaaauauuucc

SEQ ID NO: 1162583 - RNA, 12 nt, Human
cugagcugggau

SEQ ID NO: 1162584 - RNA, 22 nt, Human
cugagcugggaugauuggaggg

SEQ ID NO: 1162585 - RNA, 23 nt, Human
cugaggaauccagacccggcugc

SEQ ID NO: 1162586 - RNA, 14 nt, Human
cugaggggccucuu

SEQ ID NO: 1162587 - RNA, 13 nt, Human
cugaggugggagg

SEQ ID NO: 1162588 - RNA, 22 nt, Human
cugaggugggaggaucucuuga

SEQ ID NO: 1162589 - RNA, 17 nt, Human
cugaguacguugugcau

SEQ ID NO: 1162590 - RNA, 17 nt, Human
cugaucucucgugauug

SEQ ID NO: 1162591 - RNA, 18 nt, Human
cugaucucucgugauuga

SEQ ID NO: 1162592 - RNA, 17 nt, Human
caaaucagcugcuacua

SEQ ID NO: 1162593 - RNA, 16 nt, Human
caaaucagcugcuacu

SEQ ID NO: 1162594 - RNA, 13 nt, Human
caaaucagcugcu

SEQ ID NO: 1162595 - RNA, 21 nt, Human
caaauguucaucaaugaauga

SEQ ID NO: 1162596 - RNA, 22 nt, Human
caaauucugcuugcuugcuuuu

SEQ ID NO: 1162597 - RNA, 21 nt, Human
caaaggaugcccaaagaugca

SEQ ID NO: 1162598 - RNA, 16 nt, Human
caaaaaaugcuugcuu

SEQ ID NO: 1162599 - RNA, 18 nt, Human
auuuuuuuacuaauagac

SEQ ID NO: 1162600 - RNA, 20 nt, Human
caaagccaaagcuaggccug

SEQ ID NO: 1162601 - RNA, 21 nt, Human
caaagccaaagcuaggccugg

SEQ ID NO: 1162602 - RNA, 22 nt, Human
caaagccaaagcuaggccuggc

SEQ ID NO: 1162603 - RNA, 16 nt, Human
caaagcuaggccuggc

SEQ ID NO: 1162604 - RNA, 17 nt, Human
caaagcuaggccuggcc

SEQ ID NO: 1162605 - RNA, 18 nt, Human
caaagcuaggccuggcca

SEQ ID NO: 1162606 - RNA, 16 nt, Human
caaagcuuguuaagau

SEQ ID NO: 1162607 - RNA, 12 nt, Human
caaaggaagcac

SEQ ID NO: 1162608 - RNA, 22 nt, Human
caaccccuucgcuccugugucu

SEQ ID NO: 1162609 - RNA, 21 nt, Human
caaccccuucgcuccuguguc

SEQ ID NO: 1162610 - RNA, 18 nt, Human
caaccccuucgcuccugu

SEQ ID NO: 1162611 - RNA, 19 nt, Human
caaccccuucgcuccugug

SEQ ID NO: 1162612 - RNA, 14 nt, Human
caaauuuacagaga

SEQ ID NO: 1162613 - RNA, 15 nt, Human
caaauuuacagagac

SEQ ID NO: 1162614 - RNA, 23 nt, Human
caacaggcugggcuucaguggca

SEQ ID NO: 1162615 - RNA, 24 nt, Human
caacaggcugggcuucaguggcag

SEQ ID NO: 1162616 - RNA, 16 nt, Human
caaauuuacagagaca

SEQ ID NO: 1162617 - RNA, 18 nt, Human
caacaggguuuuuuucca

SEQ ID NO: 1162618 - RNA, 15 nt, Human
caacagguuuuccug

SEQ ID NO: 1162619 - RNA, 19 nt, Human
caacagguuuuccugaaga

SEQ ID NO: 1162620 - RNA, 22 nt, Human
caacaucuuggucagauuugaa

SEQ ID NO: 1162621 - RNA, 19 nt, Human
caacucuccuccagaguca

SEQ ID NO: 1162622 - RNA, 16 nt, Human
caaccugauugugucu

SEQ ID NO: 1162623 - RNA, 12 nt, Human
caacccucauca

SEQ ID NO: 1162624 - RNA, 15 nt, Human
caacccucaucacca

SEQ ID NO: 1162625 - RNA, 20 nt, Human
caacucuccuccagagucag

SEQ ID NO: 1162626 - RNA, 22 nt, Human
caagccaccaacauacucccau

SEQ ID NO: 1162627 - RNA, 16 nt, Human
caagcgugagccacug

SEQ ID NO: 1162628 - RNA, 21 nt, Human
caagccaccaacauacuccca

SEQ ID NO: 1162629 - RNA, 17 nt, Human
caagcacuaaacaaaga

SEQ ID NO: 1162630 - RNA, 21 nt, Human
caaggaugaucuaggaagacu

SEQ ID NO: 1162631 - RNA, 13 nt, Human
caaggauccugag

SEQ ID NO: 1162632 - RNA, 17 nt, Human
caagcgugagccacugc

SEQ ID NO: 1162633 - RNA, 18 nt, Human
caagcgugagccacugca

SEQ ID NO: 1162634 - RNA, 19 nt, Human
caagugaaaaaggaggaag

SEQ ID NO: 1162635 - RNA, 16 nt, Human
caagugauucuccugc

SEQ ID NO: 1162636 - RNA, 17 nt, Human
caagugauucuccugcc

SEQ ID NO: 1162637 - RNA, 18 nt, Human
caagugauucuccugccu

SEQ ID NO: 1162638 - RNA, 22 nt, Human
caagugauucuccugccucagc

SEQ ID NO: 1162639 - RNA, 22 nt, Human
caagugugguagagugugccug

SEQ ID NO: 1162640 - RNA, 15 nt, Human
caaggauugcuacug

SEQ ID NO: 1162641 - RNA, 19 nt, Human
caaggauugcuacuguccu

SEQ ID NO: 1162642 - RNA, 19 nt, Human
caagggccuggccugagcu

SEQ ID NO: 1162643 - RNA, 12 nt, Human
caaggugggagg

SEQ ID NO: 1162644 - RNA, 23 nt, Human
caaggugggaggauugcuugagc

SEQ ID NO: 1162645 - RNA, 16 nt, Human
cacaaaaguuucucuu

SEQ ID NO: 1162646 - RNA, 18 nt, Human
cacaaaaguuucucuuuu

SEQ ID NO: 1162647 - RNA, 14 nt, Human
caaguuaaauaaau

SEQ ID NO: 1162648 - RNA, 20 nt, Human
caauaggaaaaacugauuuu

SEQ ID NO: 1162649 - RNA, 21 nt, Human
caauaggaaaaacugauuuuu

SEQ ID NO: 1162650 - RNA, 17 nt, Human
caauagucaaauugugu

SEQ ID NO: 1162651 - RNA, 22 nt, Human
caaugaaugaaugaauggcuaa

SEQ ID NO: 1162652 - RNA, 13 nt, Human
caaugaccuuuca

SEQ ID NO: 1162653 - RNA, 17 nt, Human
caaugcaaaccaucauu

SEQ ID NO: 1162654 - RNA, 18 nt, Human
caaugcaaaccaucauug

SEQ ID NO: 1162655 - RNA, 19 nt, Human
caaugcaaaccaucauuga

SEQ ID NO: 1162656 - RNA, 20 nt, Human
caaugcaaaccaucauugaa

SEQ ID NO: 1162657 - RNA, 23 nt, Human
caaugcacuuuguucuggcucuu

SEQ ID NO: 1162658 - RNA, 19 nt, Human
caaugugaaaagaaaaaug

SEQ ID NO: 1162659 - RNA, 17 nt, Human
cacaccgggcacucaga

SEQ ID NO: 1162660 - RNA, 12 nt, Human
cacaccagagcc

SEQ ID NO: 1162661 - RNA, 13 nt, Human
cacaccagagccc

SEQ ID NO: 1162662 - RNA, 15 nt, Human
cacaccagagcccac

SEQ ID NO: 1162663 - RNA, 13 nt, Human
cacacccagccca

SEQ ID NO: 1162664 - RNA, 13 nt, Human
cacaacuauauug

SEQ ID NO: 1162665 - RNA, 12 nt, Human
cacacacaugca

SEQ ID NO: 1162666 - RNA, 16 nt, Human
cacacacaugcauaca

SEQ ID NO: 1162667 - RNA, 17 nt, Human
cacacacaugcauacac

SEQ ID NO: 1162668 - RNA, 18 nt, Human
cacacacaugcauacaca

SEQ ID NO: 1162669 - RNA, 14 nt, Human
cacacaccagagcc

SEQ ID NO: 1162670 - RNA, 15 nt, Human
cacacaccagagccc

SEQ ID NO: 1162671 - RNA, 20 nt, Human
cacacagaaaauauacugua

SEQ ID NO: 1162672 - RNA, 21 nt, Human
cacacagaaaauauacuguaa

SEQ ID NO: 1162673 - RNA, 22 nt, Human
cacacagaaaauauacuguaaa

SEQ ID NO: 1162674 - RNA, 23 nt, Human
cacacagaaaauauacuguaaag

SEQ ID NO: 1162675 - RNA, 19 nt, Human
cacacagaggcugccucuc

SEQ ID NO: 1162676 - RNA, 21 nt, Human
cacacagaggcugccucuccc

SEQ ID NO: 1162677 - RNA, 11 nt, Human
cacacagccac

SEQ ID NO: 1162678 - RNA, 12 nt, Human
cacacagccaca

SEQ ID NO: 1162679 - RNA, 13 nt, Human
cacacagccacac

SEQ ID NO: 1162680 - RNA, 14 nt, Human
cacacagccacaca

SEQ ID NO: 1162681 - RNA, 15 nt, Human
cacacagccacacac

SEQ ID NO: 1162682 - RNA, 16 nt, Human
cacacagccacacaca

SEQ ID NO: 1162683 - RNA, 17 nt, Human
cacacagccacacacac

SEQ ID NO: 1162684 - RNA, 19 nt, Human
cacacagccacacacacag

SEQ ID NO: 1162685 - RNA, 20 nt, Human
cacacagccacacacacaga

SEQ ID NO: 1162686 - RNA, 21 nt, Human
cacacagccacacacacagaa

SEQ ID NO: 1162687 - RNA, 22 nt, Human
cacacagccacacacacagaaa

SEQ ID NO: 1162688 - RNA, 12 nt, Human
cacacagcucug

SEQ ID NO: 1162689 - RNA, 21 nt, Human
cacacuugacaucaacugcau

SEQ ID NO: 1162690 - RNA, 12 nt, Human
cacagagaaagu

SEQ ID NO: 1162691 - RNA, 16 nt, Human
cacagaguuguuacau

SEQ ID NO: 1162692 - RNA, 17 nt, Human
cacagaguuguuacauu

SEQ ID NO: 1162693 - RNA, 20 nt, Human
cacagaugggugcuuggagg

SEQ ID NO: 1162694 - RNA, 20 nt, Human
cacagaguuguuacauuuuu

SEQ ID NO: 1162695 - RNA, 21 nt, Human
cacagaguuguuacauuuuua

SEQ ID NO: 1162696 - RNA, 14 nt, Human
cacagaugggugcu

SEQ ID NO: 1162697 - RNA, 18 nt, Human
cacagaugggugcuugga

SEQ ID NO: 1162698 - RNA, 10 nt, Human
cacagccaca

SEQ ID NO: 1162699 - RNA, 11 nt, Human
cacagccacac

SEQ ID NO: 1162700 - RNA, 12 nt, Human
cacagccacaca

SEQ ID NO: 1162701 - RNA, 13 nt, Human
cacagccacacac

SEQ ID NO: 1162702 - RNA, 14 nt, Human
cacagccacacaca

SEQ ID NO: 1162703 - RNA, 15 nt, Human
cacagccacacacac

SEQ ID NO: 1162704 - RNA, 23 nt, Human
cacagaugggugcuuggaggaag

SEQ ID NO: 1162705 - RNA, 20 nt, Human
cacaggcccggcuccaggcu

SEQ ID NO: 1162706 - RNA, 23 nt, Human
cacaggcccggcuccaggcuccu

SEQ ID NO: 1162707 - RNA, 19 nt, Human
cacagugagucgaggacag

SEQ ID NO: 1162708 - RNA, 20 nt, Human
cacagugagucgaggacagg

SEQ ID NO: 1162709 - RNA, 17 nt, Human
cacauacacacacacgc

SEQ ID NO: 1162710 - RNA, 11 nt, Human
cacagccucug

SEQ ID NO: 1162711 - RNA, 20 nt, Human
cacaggaaccacaagacugc

SEQ ID NO: 1162712 - RNA, 15 nt, Human
cacaggaaguagagg

SEQ ID NO: 1162713 - RNA, 12 nt, Human
cacaggaucagu

SEQ ID NO: 1162714 - RNA, 15 nt, Human
cacaggaucagucug

SEQ ID NO: 1162715 - RNA, 16 nt, Human
cacaggaucagucuga

SEQ ID NO: 1162716 - RNA, 17 nt, Human
cacaggaucagucugau

SEQ ID NO: 1162717 - RNA, 10 nt, Human
cacaggcagg

SEQ ID NO: 1162718 - RNA, 16 nt, Human
cacaggcccggcucca

SEQ ID NO: 1162719 - RNA, 17 nt, Human
cacaggcccggcuccag

SEQ ID NO: 1162720 - RNA, 18 nt, Human
cacaggcccggcuccagg

SEQ ID NO: 1162721 - RNA, 19 nt, Human
cacaggcccggcuccaggc

SEQ ID NO: 1162722 - RNA, 21 nt, Human
cacagugagucgaggacaggg

SEQ ID NO: 1162723 - RNA, 17 nt, Human
cacaugugcacaugcac

SEQ ID NO: 1162724 - RNA, 14 nt, Human
cacaugugcacaug

SEQ ID NO: 1162725 - RNA, 15 nt, Human
cacaugugcacaugc

SEQ ID NO: 1162726 - RNA, 16 nt, Human
cacauuccugaugcuu

SEQ ID NO: 1162727 - RNA, 12 nt, Human
cacauaucuguc

SEQ ID NO: 1162728 - RNA, 14 nt, Human
cacauaucugucau

SEQ ID NO: 1162729 - RNA, 18 nt, Human
cacaucagcacgauuucu

SEQ ID NO: 1162730 - RNA, 19 nt, Human
cacaucagcacgauuucug

SEQ ID NO: 1162731 - RNA, 17 nt, Human
cacaugccucucucagg

SEQ ID NO: 1162732 - RNA, 18 nt, Human
cacaugccucucucaggc

SEQ ID NO: 1162733 - RNA, 19 nt, Human
cacaugccucucucaggcc

SEQ ID NO: 1162734 - RNA, 13 nt, Human
caccacacccagc

SEQ ID NO: 1162735 - RNA, 15 nt, Human
caccacacccagccc

SEQ ID NO: 1162736 - RNA, 17 nt, Human
caccacacccagcccac

SEQ ID NO: 1162737 - RNA, 15 nt, Human
caccacaugugcaca

SEQ ID NO: 1162738 - RNA, 18 nt, Human
caccacaugugcacaugc

SEQ ID NO: 1162739 - RNA, 19 nt, Human
caccacaugugcacaugca

SEQ ID NO: 1162740 - RNA, 14 nt, Human
caccaccucuuugg

SEQ ID NO: 1162741 - RNA, 16 nt, Human
caccacuacauucugu

SEQ ID NO: 1162742 - RNA, 17 nt, Human
caccacuacauucuguu

SEQ ID NO: 1162743 - RNA, 18 nt, Human
caccacuacauucuguua

SEQ ID NO: 1162744 - RNA, 19 nt, Human
caccacuacauucuguuaa

SEQ ID NO: 1162745 - RNA, 20 nt, Human
caccacuacauucuguuaau

SEQ ID NO: 1162746 - RNA, 14 nt, Human
caccccggccaccu

SEQ ID NO: 1162747 - RNA, 15 nt, Human
caccccggccaccug

SEQ ID NO: 1162748 - RNA, 16 nt, Human
caccccggccaccugc

SEQ ID NO: 1162749 - RNA, 17 nt, Human
caccccggccaccugcg

SEQ ID NO: 1162750 - RNA, 22 nt, Human
cacccccacccaagggccuggc

SEQ ID NO: 1162751 - RNA, 17 nt, Human
cacccaagggccuggcc

SEQ ID NO: 1162752 - RNA, 18 nt, Human
cacccaagggccuggccu

SEQ ID NO: 1162753 - RNA, 19 nt, Human
cacccaagggccuggccug

SEQ ID NO: 1162754 - RNA, 20 nt, Human
cacccaagggccuggccuga

SEQ ID NO: 1162755 - RNA, 21 nt, Human
cacccaagggccuggccugag

SEQ ID NO: 1162756 - RNA, 23 nt, Human
cacccaagggccuggccugagcu

SEQ ID NO: 1162757 - RNA, 20 nt, Human
cacccaccaucaugucuggc

SEQ ID NO: 1162758 - RNA, 22 nt, Human
cacccaccaucaugucuggcua

SEQ ID NO: 1162759 - RNA, 12 nt, Human
cacccaccucag

SEQ ID NO: 1162760 - RNA, 13 nt, Human
cacccaccucagc

SEQ ID NO: 1162761 - RNA, 14 nt, Human
cacccaccucagcc

SEQ ID NO: 1162762 - RNA, 16 nt, Human
cacccaccucagccuc

SEQ ID NO: 1162763 - RNA, 17 nt, Human
cacccaccucagccucc

SEQ ID NO: 1162764 - RNA, 13 nt, Human
caccccagcccca

SEQ ID NO: 1162765 - RNA, 21 nt, Human
ccacugcaucguuucaucuuc

SEQ ID NO: 1162766 - RNA, 23 nt, Human
ccacugcaucguuucaucuucca

SEQ ID NO: 1162767 - RNA, 20 nt, Human
ccacugcuuuuggucugugu

SEQ ID NO: 1162768 - RNA, 22 nt, Human
ccacugcuuuuggucuguguga

SEQ ID NO: 1162769 - RNA, 12 nt, Human
ccacugcucugg

SEQ ID NO: 1162770 - RNA, 13 nt, Human
ccacugcucuggu

SEQ ID NO: 1162771 - RNA, 15 nt, Human
ccacugcucugguua

SEQ ID NO: 1162772 - RNA, 23 nt, Human
ccacuggugacaugucuuuucuu

SEQ ID NO: 1162773 - RNA, 15 nt, Human
ccacugguucuucuu

SEQ ID NO: 1162774 - RNA, 14 nt, Human
ccacugugaagaga

SEQ ID NO: 1162775 - RNA, 15 nt, Human
ccacugugaagagaa

SEQ ID NO: 1162776 - RNA, 15 nt, Human
ccacugugccaugug

SEQ ID NO: 1162777 - RNA, 16 nt, Human
ccacugugccaugugc

SEQ ID NO: 1162778 - RNA, 19 nt, Human
ccacugugccaugugccag

SEQ ID NO: 1162779 - RNA, 22 nt, Human
ccagaagaaaauagugguguga

SEQ ID NO: 1162780 - RNA, 14 nt, Human
ccagacaucaacag

SEQ ID NO: 1162781 - RNA, 17 nt, Human
ccagacacauguccaag

SEQ ID NO: 1162782 - RNA, 20 nt, Human
ccagacacauguccaagaag

SEQ ID NO: 1162783 - RNA, 22 nt, Human
ccagacacauguccaagaagcc

SEQ ID NO: 1162784 - RNA, 16 nt, Human
ccagacccggcugcgu

SEQ ID NO: 1162785 - RNA, 14 nt, Human
ccagacccggcugc

SEQ ID NO: 1162786 - RNA, 15 nt, Human
ccagacccggcugcg

SEQ ID NO: 1162787 - RNA, 19 nt, Human
ccacccccacccaagggcc

SEQ ID NO: 1162788 - RNA, 14 nt, Human
ccacccuccuuuca

SEQ ID NO: 1162789 - RNA, 11 nt, Human
ccacccugcuc

SEQ ID NO: 1162790 - RNA, 12 nt, Human
ccacccugcucu

SEQ ID NO: 1162791 - RNA, 13 nt, Human
ccacccugcucuc

SEQ ID NO: 1162792 - RNA, 14 nt, Human
ccaccucucucacu

SEQ ID NO: 1162793 - RNA, 16 nt, Human
ccaccucucucacucc

SEQ ID NO: 1162794 - RNA, 19 nt, Human
ccaccucucucacuccuug

SEQ ID NO: 1162795 - RNA, 20 nt, Human
ccaccucucucacuccuuga

SEQ ID NO: 1162796 - RNA, 13 nt, Human
ccaccugccaggg

SEQ ID NO: 1162797 - RNA, 14 nt, Human
ccaccugccaggga

SEQ ID NO: 1162798 - RNA, 15 nt, Human
ccaccugccagggac

SEQ ID NO: 1162799 - RNA, 16 nt, Human
ccaccugccagggaca

SEQ ID NO: 1162800 - RNA, 13 nt, Human
ccaccuggccucu

SEQ ID NO: 1162801 - RNA, 20 nt, Human
ccaccuggccucugcacucc

SEQ ID NO: 1162802 - RNA, 14 nt, Human
ccaccuggccucug

SEQ ID NO: 1162803 - RNA, 13 nt, Human
ccaccuuggcuca

SEQ ID NO: 1162804 - RNA, 17 nt, Human
ccagcaccaucucuccu

SEQ ID NO: 1162805 - RNA, 18 nt, Human
ccagcaccaucucuccuc

SEQ ID NO: 1162806 - RNA, 16 nt, Human
ccagcaggcucucagg

SEQ ID NO: 1162807 - RNA, 17 nt, Human
ccagcaggcucucaggc

SEQ ID NO: 1162808 - RNA, 18 nt, Human
ccagcaggcucucaggcc

SEQ ID NO: 1162809 - RNA, 17 nt, Human
ccagcaagugagagcug

SEQ ID NO: 1162810 - RNA, 18 nt, Human
ccagcaagugagagcugg

SEQ ID NO: 1162811 - RNA, 19 nt, Human
ccagcaagugagagcuggg

SEQ ID NO: 1162812 - RNA, 20 nt, Human
ccagcaagugagagcugggu

SEQ ID NO: 1162813 - RNA, 14 nt, Human
ccagagcccaccuu

SEQ ID NO: 1162814 - RNA, 14 nt, Human
ccagauugcaacag

SEQ ID NO: 1162815 - RNA, 16 nt, Human
ccagauugcaacaggc

SEQ ID NO: 1162816 - RNA, 18 nt, Human
ccagauugcaacaggcug

SEQ ID NO: 1162817 - RNA, 22 nt, Human
ccagauugcaacaggcugggcu

SEQ ID NO: 1162818 - RNA, 23 nt, Human
ccagauugcaacaggcugggcuu

SEQ ID NO: 1162819 - RNA, 18 nt, Human
ccagauuucacucuccuu

SEQ ID NO: 1162820 - RNA, 19 nt, Human
ccagauuucacucuccuug

SEQ ID NO: 1162821 - RNA, 19 nt, Human
ccagcaggcucucaggcca

SEQ ID NO: 1162822 - RNA, 20 nt, Human
ccagcaggcucucaggccag

SEQ ID NO: 1162823 - RNA, 21 nt, Human
ccagcaggcucucaggccagc

SEQ ID NO: 1162824 - RNA, 23 nt, Human
ccagcaggcucucaggccagcug

SEQ ID NO: 1162825 - RNA, 16 nt, Human
ccagcccacuucugcc

SEQ ID NO: 1162826 - RNA, 17 nt, Human
ccagcccacuucugcca

SEQ ID NO: 1162827 - RNA, 19 nt, Human
ccagccccaaaacucuccu

SEQ ID NO: 1162828 - RNA, 17 nt, Human
ccagccgagauagccaa

SEQ ID NO: 1162829 - RNA, 20 nt, Human
ccagccgagauagccaaggc

SEQ ID NO: 1162830 - RNA, 22 nt, Human
ccagccgagauagccaaggcca

SEQ ID NO: 1162831 - RNA, 23 nt, Human
ccagccgagauagccaaggccaa

SEQ ID NO: 1162832 - RNA, 13 nt, Human
ccagccuggguga

SEQ ID NO: 1162833 - RNA, 23 nt, Human
ccagccuugaccauucuccaccu

SEQ ID NO: 1162834 - RNA, 13 nt, Human
ccagcgagcccug

SEQ ID NO: 1162835 - RNA, 13 nt, Human
ccagguuuaagcu

SEQ ID NO: 1162836 - RNA, 16 nt, Human
ccagguuucuaugugu

SEQ ID NO: 1162837 - RNA, 20 nt, Human
ccaguaaaugggggugcauu

SEQ ID NO: 1162838 - RNA, 21 nt, Human
ccaguaaaugggggugcauuu

SEQ ID NO: 1162839 - RNA, 22 nt, Human
ccaguaaaugggggugcauuug

SEQ ID NO: 1162840 - RNA, 23 nt, Human
ccaguaaaugggggugcauuuga

SEQ ID NO: 1162841 - RNA, 13 nt, Human
ccagugaggcucu

SEQ ID NO: 1162842 - RNA, 15 nt, Human
ccauaugccugggca

SEQ ID NO: 1162843 - RNA, 14 nt, Human
ccagugugacaagg

SEQ ID NO: 1162844 - RNA, 23 nt, Human
ccagugugacaaggauugcuacu

SEQ ID NO: 1162845 - RNA, 13 nt, Human
ccaucaagccacc

SEQ ID NO: 1162846 - RNA, 14 nt, Human
ccaucaagccacca

SEQ ID NO: 1162847 - RNA, 16 nt, Human
ccaucaagccaccaac

SEQ ID NO: 1162848 - RNA, 19 nt, Human
ccauauuaccacagacaua

SEQ ID NO: 1162849 - RNA, 18 nt, Human
ccaucaaggguacacugc

SEQ ID NO: 1162850 - RNA, 12 nt, Human
ccaucaugucug

SEQ ID NO: 1162851 - RNA, 13 nt, Human
ccaucaugucugg

SEQ ID NO: 1162852 - RNA, 12 nt, Human
ccaucauugaaa

SEQ ID NO: 1162853 - RNA, 14 nt, Human
ccaucauugaaauc

SEQ ID NO: 1162854 - RNA, 16 nt, Human
ccaucauugaaaucuu

SEQ ID NO: 1162855 - RNA, 17 nt, Human
ccaucauugaaaucuuu

SEQ ID NO: 1162856 - RNA, 18 nt, Human
ccauccugaggcuccacu

SEQ ID NO: 1162857 - RNA, 20 nt, Human
ccauccugaggcuccacuug

SEQ ID NO: 1162858 - RNA, 14 nt, Human
ccaucaugucuggc

SEQ ID NO: 1162859 - RNA, 14 nt, Human
ccaucucacacaug

SEQ ID NO: 1162860 - RNA, 15 nt, Human
ccaucucacacauga

SEQ ID NO: 1162861 - RNA, 17 nt, Human
ccaucucacacaugagc

SEQ ID NO: 1162862 - RNA, 18 nt, Human
ccaucucacacaugagca

SEQ ID NO: 1162863 - RNA, 20 nt, Human
ccaucucacacaugagcauc

SEQ ID NO: 1162864 - RNA, 21 nt, Human
ccaucucacacaugagcauca

SEQ ID NO: 1162865 - RNA, 17 nt, Human
ccaucucaccuccugcu

SEQ ID NO: 1162866 - RNA, 15 nt, Human
ccaucucuccuccuu

SEQ ID NO: 1162867 - RNA, 18 nt, Human
ccaucucaccuccugcug

SEQ ID NO: 1162868 - RNA, 15 nt, Human
ccaggaggccagccu

SEQ ID NO: 1162869 - RNA, 18 nt, Human
ccaggaggccagccuuga

SEQ ID NO: 1162870 - RNA, 20 nt, Human
ccaggaggccagccuugacc

SEQ ID NO: 1162871 - RNA, 12 nt, Human
ccaggccagagg

SEQ ID NO: 1162872 - RNA, 14 nt, Human
ccaggccccugcca

SEQ ID NO: 1162873 - RNA, 15 nt, Human
ccaggccccugccac

SEQ ID NO: 1162874 - RNA, 16 nt, Human
ccaggccccugccacc

SEQ ID NO: 1162875 - RNA, 19 nt, Human
ccaggccccugccacccug

SEQ ID NO: 1162876 - RNA, 13 nt, Human
ccaggcccucugc

SEQ ID NO: 1162877 - RNA, 14 nt, Human
ccaggcccucugcc

SEQ ID NO: 1162878 - RNA, 15 nt, Human
ccaggcccucugccc

SEQ ID NO: 1162879 - RNA, 16 nt, Human
ccaggcccucugccca

SEQ ID NO: 1162880 - RNA, 14 nt, Human
ccaggcuggucuca

SEQ ID NO: 1162881 - RNA, 21 nt, Human
ccaggcuuagucacugagaca

SEQ ID NO: 1162882 - RNA, 22 nt, Human
ccaggcuuagucacugagacag

SEQ ID NO: 1162883 - RNA, 23 nt, Human
ccaggcuuagucacugagacagc

SEQ ID NO: 1162884 - RNA, 20 nt, Human
ccagguagaggguguguaag

SEQ ID NO: 1162885 - RNA, 23 nt, Human
ccagugcccacaggaucagucug

SEQ ID NO: 1162886 - RNA, 17 nt, Human
cccacaggaucagucug

SEQ ID NO: 1162887 - RNA, 16 nt, Human
cccaagggccuggccu

SEQ ID NO: 1162888 - RNA, 17 nt, Human
cccaagggccuggccug

SEQ ID NO: 1162889 - RNA, 20 nt, Human
ccauuuugcugucccuuuuc

SEQ ID NO: 1162890 - RNA, 23 nt, Human
ccauuuuggauucuuauggacaa

SEQ ID NO: 1162891 - RNA, 12 nt, Human
cccaagggccug

SEQ ID NO: 1162892 - RNA, 14 nt, Human
cccaagggccuggc

SEQ ID NO: 1162893 - RNA, 12 nt, Human
cccaccucagcc

SEQ ID NO: 1162894 - RNA, 14 nt, Human
cccaccucagccuc

SEQ ID NO: 1162895 - RNA, 15 nt, Human
cccaccucagccucc

SEQ ID NO: 1162896 - RNA, 21 nt, Human
cccaccucagccucccaaagu

SEQ ID NO: 1162897 - RNA, 13 nt, Human
cccaccucucuca

SEQ ID NO: 1162898 - RNA, 14 nt, Human
cccaccucucucac

SEQ ID NO: 1162899 - RNA, 17 nt, Human
cccaccucucucacucc

SEQ ID NO: 1162900 - RNA, 19 nt, Human
cccaccucucucacuccuu

SEQ ID NO: 1162901 - RNA, 17 nt, Human
cccaccucagccucccg

SEQ ID NO: 1162902 - RNA, 12 nt, Human
cccaccuuggcu

SEQ ID NO: 1162903 - RNA, 15 nt, Human
cccaccuuggcucaa

SEQ ID NO: 1162904 - RNA, 22 nt, Human
cccaccuuggcucaaguccucu

SEQ ID NO: 1162905 - RNA, 14 nt, Human
cccaccuuggcugc

SEQ ID NO: 1162906 - RNA, 15 nt, Human
cccaccuuggcugca

SEQ ID NO: 1162907 - RNA, 17 nt, Human
cccacgcccccacuggu

SEQ ID NO: 1162908 - RNA, 19 nt, Human
cccacgcccccacugguga

SEQ ID NO: 1162909 - RNA, 16 nt, Human
cccaccuuggcugcag

SEQ ID NO: 1162910 - RNA, 14 nt, Human
cccacgcuggagug

SEQ ID NO: 1162911 - RNA, 13 nt, Human
ccauuugcuccuu

SEQ ID NO: 1162912 - RNA, 15 nt, Human
ccauucugccugccc

SEQ ID NO: 1162913 - RNA, 16 nt, Human
ccauucugccugccca

SEQ ID NO: 1162914 - RNA, 14 nt, Human
ccauucuccaccug

SEQ ID NO: 1162915 - RNA, 14 nt, Human
cccaguugggugga

SEQ ID NO: 1162916 - RNA, 19 nt, Human
cccaucucuacaaaaagca

SEQ ID NO: 1162917 - RNA, 12 nt, Human
cccaucugugaa

SEQ ID NO: 1162918 - RNA, 14 nt, Human
cccaugagccucag

SEQ ID NO: 1162919 - RNA, 15 nt, Human
cccaugagccucagc

SEQ ID NO: 1162920 - RNA, 15 nt, Human
ccccaccgcagacag

SEQ ID NO: 1162921 - RNA, 19 nt, Human
ccccaccgcagacaggacc

SEQ ID NO: 1162922 - RNA, 11 nt, Human
ccccacacaca

SEQ ID NO: 1162923 - RNA, 12 nt, Human
ccccacacacac

SEQ ID NO: 1162924 - RNA, 14 nt, Human
ccccacacacacac

SEQ ID NO: 1162925 - RNA, 14 nt, Human
ccccagugcccaca

SEQ ID NO: 1162926 - RNA, 15 nt, Human
ccccagugcccacag

SEQ ID NO: 1162927 - RNA, 16 nt, Human
ccccagugcccacagg

SEQ ID NO: 1162928 - RNA, 20 nt, Human
ccccagugcccacaggauca

SEQ ID NO: 1162929 - RNA, 14 nt, Human
ccccauccucugua

SEQ ID NO: 1162930 - RNA, 17 nt, Human
ccccauccucuguacag

SEQ ID NO: 1162931 - RNA, 13 nt, Human
cccccacccaagg

SEQ ID NO: 1162932 - RNA, 24 nt, Human
cccccacccaagggccuggccuga

SEQ ID NO: 1162933 - RNA, 11 nt, Human
cccccacuggu

SEQ ID NO: 1162934 - RNA, 13 nt, Human
cccccacugguga

SEQ ID NO: 1162935 - RNA, 15 nt, Human
cccccacuggugaca

SEQ ID NO: 1162936 - RNA, 17 nt, Human
cccccugacaacacuca

SEQ ID NO: 1162937 - RNA, 19 nt, Human
cccccugacaacacucauu

SEQ ID NO: 1162938 - RNA, 12 nt, Human
cccccagccugc

SEQ ID NO: 1162939 - RNA, 15 nt, Human
ccccucaacaccucu

SEQ ID NO: 1162940 - RNA, 16 nt, Human
ccccucaacaccucug

SEQ ID NO: 1162941 - RNA, 23 nt, Human
ccccucaacucuccuccagaguc

SEQ ID NO: 1162942 - RNA, 16 nt, Human
ccccucagggucccug

SEQ ID NO: 1162943 - RNA, 12 nt, Human
ccccuccaugug

SEQ ID NO: 1162944 - RNA, 17 nt, Human
ccccugcccggcugcgg

SEQ ID NO: 1162945 - RNA, 19 nt, Human
ccccugcccggcugcggaa

SEQ ID NO: 1162946 - RNA, 14 nt, Human
ccccugcugggugu

SEQ ID NO: 1162947 - RNA, 17 nt, Human
ccccugcuggguguggc

SEQ ID NO: 1162948 - RNA, 11 nt, Human
ccccugcuggu

SEQ ID NO: 1162949 - RNA, 13 nt, Human
ccccugcugguuc

SEQ ID NO: 1162950 - RNA, 15 nt, Human
ccccugcugguucag

SEQ ID NO: 1162951 - RNA, 20 nt, Human
ccccugcugguucaggguug

SEQ ID NO: 1162952 - RNA, 15 nt, Human
ccccuggaugcagcc

SEQ ID NO: 1162953 - RNA, 18 nt, Human
ccccuggaugcagccuca

SEQ ID NO: 1162954 - RNA, 19 nt, Human
ccccuggaugcagccucac

SEQ ID NO: 1162955 - RNA, 20 nt, Human
ccccuguucuggcagaguug

SEQ ID NO: 1162956 - RNA, 13 nt, Human
ccccuuccaugga

SEQ ID NO: 1162957 - RNA, 20 nt, Human
ccccuuccauggacuuuguu

SEQ ID NO: 1162958 - RNA, 20 nt, Human
cccgcccaggcuuagucacu

SEQ ID NO: 1162959 - RNA, 22 nt, Human
cccgcccaggcuuagucacuga

SEQ ID NO: 1162960 - RNA, 23 nt, Human
cccgcuaagagggagggagggcu

SEQ ID NO: 1162961 - RNA, 19 nt, Human
cccucugcccacucccugc

SEQ ID NO: 1162962 - RNA, 11 nt, Human
cccucugccca

SEQ ID NO: 1162963 - RNA, 15 nt, Human
cccucugcccacucc

SEQ ID NO: 1162964 - RNA, 18 nt, Human
cccucugcccacucccug

SEQ ID NO: 1162965 - RNA, 12 nt, Human
cccucuggggcu

SEQ ID NO: 1162966 - RNA, 12 nt, Human
cccucuuucccu

SEQ ID NO: 1162967 - RNA, 17 nt, Human
cccucuuucccucccuu

SEQ ID NO: 1162968 - RNA, 20 nt, Human
cccucuuucccucccuuccu

SEQ ID NO: 1162969 - RNA, 13 nt, Human
cccugaggcccag

SEQ ID NO: 1162970 - RNA, 22 nt, Human
cccugcucuccgaccagacacc

SEQ ID NO: 1162971 - RNA, 21 nt, Human
cccugcucuccgaccagacac

SEQ ID NO: 1162972 - RNA, 12 nt, Human
cccugaggccca

SEQ ID NO: 1162973 - RNA, 11 nt, Human
cccugccuccu

SEQ ID NO: 1162974 - RNA, 14 nt, Human
cccugccuccuuug

SEQ ID NO: 1162975 - RNA, 21 nt, Human
cccugguggcagcucaccucu

SEQ ID NO: 1162976 - RNA, 13 nt, Human
cccugguggcagu

SEQ ID NO: 1162977 - RNA, 14 nt, Human
cccugguggcagug

SEQ ID NO: 1162978 - RNA, 15 nt, Human
cccugguggcagugg

SEQ ID NO: 1162979 - RNA, 13 nt, Human
cccuguucuggca

SEQ ID NO: 1162980 - RNA, 14 nt, Human
cccuguucuggcag

SEQ ID NO: 1162981 - RNA, 19 nt, Human
cccuguuuguuucugaaag

SEQ ID NO: 1162982 - RNA, 17 nt, Human
cccuuaccugccaggaa

SEQ ID NO: 1162983 - RNA, 20 nt, Human
cccuuaccugccaggaagcc

SEQ ID NO: 1162984 - RNA, 23 nt, Human
cccuuaccugccaggaagccagc

SEQ ID NO: 1162985 - RNA, 14 nt, Human
cccuuagcagggaa

SEQ ID NO: 1162986 - RNA, 15 nt, Human
cccuuacgugagucc

SEQ ID NO: 1162987 - RNA, 17 nt, Human
cccuuacgugaguccug

SEQ ID NO: 1162988 - RNA, 23 nt, Human
cccuuagcagggaaacagcuaau

SEQ ID NO: 1162989 - RNA, 12 nt, Human
cccuuccaugga

SEQ ID NO: 1162990 - RNA, 15 nt, Human
cccuugaugaagaag

SEQ ID NO: 1162991 - RNA, 14 nt, Human
ccgaguagcuggga

SEQ ID NO: 1162992 - RNA, 16 nt, Human
ccgaguagcugggacu

SEQ ID NO: 1162993 - RNA, 19 nt, Human
ccgagcuuugaaaauucag

SEQ ID NO: 1162994 - RNA, 23 nt, Human
ccgcacugggcuuggggaccaga

SEQ ID NO: 1162995 - RNA, 15 nt, Human
ccgcagacaggacca

SEQ ID NO: 1162996 - RNA, 18 nt, Human
ccgagauagccaaggcca

SEQ ID NO: 1162997 - RNA, 15 nt, Human
ccgagauugcaccac

SEQ ID NO: 1162998 - RNA, 19 nt, Human
ccgagauugcaccacugca

SEQ ID NO: 1162999 - RNA, 21 nt, Human
ccgagauugcaccacugcacu

SEQ ID NO: 1163000 - RNA, 14 nt, Human
ccgcuggggccagu

SEQ ID NO: 1163001 - RNA, 11 nt, Human
ccgcuggggcc

SEQ ID NO: 1163002 - RNA, 16 nt, Human
ccggcuccaggcuccu

SEQ ID NO: 1163003 - RNA, 21 nt, Human
ccggcuccaggcuccuuuagc

SEQ ID NO: 1163004 - RNA, 22 nt, Human
ccgggcacucagaagacacuga

SEQ ID NO: 1163005 - RNA, 13 nt, Human
ccgggccacagag

SEQ ID NO: 1163006 - RNA, 14 nt, Human
ccgggcucugccuc

SEQ ID NO: 1163007 - RNA, 15 nt, Human
ccgggcucugccucc

SEQ ID NO: 1163008 - RNA, 18 nt, Human
ccgggcucugccucccau

SEQ ID NO: 1163009 - RNA, 22 nt, Human
ccgggcucugccucccaucacc

SEQ ID NO: 1163010 - RNA, 18 nt, Human
ccgugaggccagagacac

SEQ ID NO: 1163011 - RNA, 15 nt, Human
ccuaacgaaguaucc

SEQ ID NO: 1163012 - RNA, 21 nt, Human
ccuacaguugaaaaacagcug

SEQ ID NO: 1163013 - RNA, 13 nt, Human
ccugaaagaggaa

SEQ ID NO: 1163014 - RNA, 13 nt, Human
ccugaaagcccug

SEQ ID NO: 1163015 - RNA, 14 nt, Human
ccugaaagcccuga

SEQ ID NO: 1163016 - RNA, 18 nt, Human
ccugaaagcccugagcuu

SEQ ID NO: 1163017 - RNA, 18 nt, Human
ccugaaggccccgcccag

SEQ ID NO: 1163018 - RNA, 19 nt, Human
ccugaaggccccgcccagg

SEQ ID NO: 1163019 - RNA, 20 nt, Human
ccugaaggccccgcccaggc

SEQ ID NO: 1163020 - RNA, 21 nt, Human
ccugaaggccccgcccaggcu

SEQ ID NO: 1163021 - RNA, 22 nt, Human
ccugaaggccccgcccaggcuu

SEQ ID NO: 1163022 - RNA, 15 nt, Human
ccugagcugggauga

SEQ ID NO: 1163023 - RNA, 22 nt, Human
ccugaagucuuuguacagacaa

SEQ ID NO: 1163024 - RNA, 20 nt, Human
ccugaagucacacagugagu

SEQ ID NO: 1163025 - RNA, 15 nt, Human
ccugagccagauuuc

SEQ ID NO: 1163026 - RNA, 16 nt, Human
ccugagccagauuuca

SEQ ID NO: 1163027 - RNA, 18 nt, Human
ccugagccagauuucacu

SEQ ID NO: 1163028 - RNA, 20 nt, Human
ccugagccagauuucacucu

SEQ ID NO: 1163029 - RNA, 12 nt, Human
ccugagcuggga

SEQ ID NO: 1163030 - RNA, 15 nt, Human
ccugaggcccagagg

SEQ ID NO: 1163031 - RNA, 16 nt, Human
ccugaggcccagaggg

SEQ ID NO: 1163032 - RNA, 17 nt, Human
ccugaggcccagagggc

SEQ ID NO: 1163033 - RNA, 18 nt, Human
ccugaggcccagagggcc

SEQ ID NO: 1163034 - RNA, 13 nt, Human
ccugaggcuccac

SEQ ID NO: 1163035 - RNA, 14 nt, Human
ccugaggcuccacu

SEQ ID NO: 1163036 - RNA, 17 nt, Human
ccugaggcuccacuugg

SEQ ID NO: 1163037 - RNA, 13 nt, Human
ccugaggcugggc

SEQ ID NO: 1163038 - RNA, 14 nt, Human
ccugaggcugggcu

SEQ ID NO: 1163039 - RNA, 15 nt, Human
ccugaggcugggcuc

SEQ ID NO: 1163040 - RNA, 16 nt, Human
ccugaggcugggcucc

SEQ ID NO: 1163041 - RNA, 16 nt, Human
ccugcacuugcagacu

SEQ ID NO: 1163042 - RNA, 19 nt, Human
ccugccaauggacuaacuu

SEQ ID NO: 1163043 - RNA, 12 nt, Human
ccugccacccug

SEQ ID NO: 1163044 - RNA, 13 nt, Human
ccugccacccugg

SEQ ID NO: 1163045 - RNA, 14 nt, Human
ccugccacccuggg

SEQ ID NO: 1163046 - RNA, 16 nt, Human
ccugccacccugggga

SEQ ID NO: 1163047 - RNA, 22 nt, Human
ccugccacccuggggagaaagu

SEQ ID NO: 1163048 - RNA, 17 nt, Human
ccugccccugagcccau

SEQ ID NO: 1163049 - RNA, 14 nt, Human
ccugcccggcugcg

SEQ ID NO: 1163050 - RNA, 16 nt, Human
ccugcccggcugcgga

SEQ ID NO: 1163051 - RNA, 12 nt, Human
ccugccaggcau

SEQ ID NO: 1163052 - RNA, 15 nt, Human
ccugccaggcauggu

SEQ ID NO: 1163053 - RNA, 11 nt, Human
ccugcccugug

SEQ ID NO: 1163054 - RNA, 12 nt, Human
ccugcccugugg

SEQ ID NO: 1163055 - RNA, 14 nt, Human
ccugcccugugggc

SEQ ID NO: 1163056 - RNA, 12 nt, Human
ccugccucagcc

SEQ ID NO: 1163057 - RNA, 13 nt, Human
ccugccucagccu

SEQ ID NO: 1163058 - RNA, 14 nt, Human
ccugccucagccuc

SEQ ID NO: 1163059 - RNA, 14 nt, Human
ccugccuguugggc

SEQ ID NO: 1163060 - RNA, 15 nt, Human
ccugcccugugggcc

SEQ ID NO: 1163061 - RNA, 19 nt, Human
ccugcccuuaccugccagg

SEQ ID NO: 1163062 - RNA, 21 nt, Human
ccugcccuuaccugccaggaa

SEQ ID NO: 1163063 - RNA, 22 nt, Human
ccugcccuuaccugccaggaag

SEQ ID NO: 1163064 - RNA, 22 nt, Human
ccugccuguugggccaggagcc

SEQ ID NO: 1163065 - RNA, 19 nt, Human
ccuggcacccggccccugc

SEQ ID NO: 1163066 - RNA, 20 nt, Human
ccuggcacccggccccugcu

SEQ ID NO: 1163067 - RNA, 21 nt, Human
ccuggcacccggccccugcug

SEQ ID NO: 1163068 - RNA, 12 nt, Human
ccuggcacugcu

SEQ ID NO: 1163069 - RNA, 18 nt, Human
ccugccuguugggccagg

SEQ ID NO: 1163070 - RNA, 19 nt, Human
ccugccuguugggccagga

SEQ ID NO: 1163071 - RNA, 20 nt, Human
ccugccuguugggccaggag

SEQ ID NO: 1163072 - RNA, 21 nt, Human
ccugcuaauuccccagauugc

SEQ ID NO: 1163073 - RNA, 13 nt, Human
ccuggcccacugc

SEQ ID NO: 1163074 - RNA, 14 nt, Human
ccuggcccacugca

SEQ ID NO: 1163075 - RNA, 21 nt, Human
ccuggccagaugcaccagccc

SEQ ID NO: 1163076 - RNA, 23 nt, Human
ccuggccagaugcaccagcccuu

SEQ ID NO: 1163077 - RNA, 13 nt, Human
ccuggcacugcuu

SEQ ID NO: 1163078 - RNA, 16 nt, Human
ccuggcacugcuucca

SEQ ID NO: 1163079 - RNA, 17 nt, Human
ccuggcacugcuuccag

SEQ ID NO: 1163080 - RNA, 13 nt, Human
ccuggcaugggaa

SEQ ID NO: 1163081 - RNA, 16 nt, Human
ccuggcccacugcauc

SEQ ID NO: 1163082 - RNA, 18 nt, Human
ccugggagugagcugguu

SEQ ID NO: 1163083 - RNA, 16 nt, Human
ccugggcagaaggaag

SEQ ID NO: 1163084 - RNA, 22 nt, Human
ccugggaggucaaggcugcagu

SEQ ID NO: 1163085 - RNA, 16 nt, Human
ccugggagugagcugg

SEQ ID NO: 1163086 - RNA, 19 nt, Human
ccugggggcugggcagagg

SEQ ID NO: 1163087 - RNA, 20 nt, Human
ccugggggcugggcagagga

SEQ ID NO: 1163088 - RNA, 21 nt, Human
ccugggggcugggcagaggaa

SEQ ID NO: 1163089 - RNA, 14 nt, Human
ccuggcaugggaau

SEQ ID NO: 1163090 - RNA, 12 nt, Human
ccugucccccug

SEQ ID NO: 1163091 - RNA, 13 nt, Human
ccugucccccuga

SEQ ID NO: 1163092 - RNA, 14 nt, Human
ccugucccccugac

SEQ ID NO: 1163093 - RNA, 15 nt, Human
ccugucccccugaca

SEQ ID NO: 1163094 - RNA, 16 nt, Human
ccugucccccugacaa

SEQ ID NO: 1163095 - RNA, 13 nt, Human
ccuguagcccuaa

SEQ ID NO: 1163096 - RNA, 15 nt, Human
ccuguagagugggag

SEQ ID NO: 1163097 - RNA, 16 nt, Human
ccuguagagugggagc

SEQ ID NO: 1163098 - RNA, 19 nt, Human
ccuguagagugggagcuga

SEQ ID NO: 1163099 - RNA, 13 nt, Human
ccugguggcagug

SEQ ID NO: 1163100 - RNA, 14 nt, Human
ccugguggcagugg

SEQ ID NO: 1163101 - RNA, 15 nt, Human
ccugguggcaguggg

SEQ ID NO: 1163102 - RNA, 10 nt, Human
ccuguaccuc

SEQ ID NO: 1163103 - RNA, 12 nt, Human
ccuguaccucuu

SEQ ID NO: 1163104 - RNA, 21 nt, Human
ccugguggcagcucaccucuc

SEQ ID NO: 1163105 - RNA, 22 nt, Human
ccugguggcagcucaccucucc

SEQ ID NO: 1163106 - RNA, 14 nt, Human
ccugguggcagcug

SEQ ID NO: 1163107 - RNA, 15 nt, Human
ccugguggcagcugc

SEQ ID NO: 1163108 - RNA, 16 nt, Human
ccugguggcagcugcg

SEQ ID NO: 1163109 - RNA, 17 nt, Human
ccugguggcagcugcgg

SEQ ID NO: 1163110 - RNA, 18 nt, Human
ccugguggcagcugcggu

SEQ ID NO: 1163111 - RNA, 17 nt, Human
ccuuccauggacuuugu

SEQ ID NO: 1163112 - RNA, 13 nt, Human
ccuuccaggggug

SEQ ID NO: 1163113 - RNA, 17 nt, Human
ccuucggccuccauccu

SEQ ID NO: 1163114 - RNA, 18 nt, Human
ccuucggccuccauccug

SEQ ID NO: 1163115 - RNA, 19 nt, Human
ccuucggccuccauccuga

SEQ ID NO: 1163116 - RNA, 12 nt, Human
ccuucucuccag

SEQ ID NO: 1163117 - RNA, 13 nt, Human
ccuucucuccagc

SEQ ID NO: 1163118 - RNA, 15 nt, Human
ccuucucuccagccc

SEQ ID NO: 1163119 - RNA, 16 nt, Human
ccuucucuccagcccc

SEQ ID NO: 1163120 - RNA, 20 nt, Human
ccugugccucugggacugga

SEQ ID NO: 1163121 - RNA, 20 nt, Human
ccuguggaugauaaaacaca

SEQ ID NO: 1163122 - RNA, 20 nt, Human
ccugugggcccccaaaugga

SEQ ID NO: 1163123 - RNA, 19 nt, Human
ccuucauuuggcauucccc

SEQ ID NO: 1163124 - RNA, 17 nt, Human
ccuucucuccagccccu

SEQ ID NO: 1163125 - RNA, 18 nt, Human
ccuucucuccagccccug

SEQ ID NO: 1163126 - RNA, 18 nt, Human
ccuugacagggcacaccg

SEQ ID NO: 1163127 - RNA, 21 nt, Human
ccuugacagggcacaccgggc

SEQ ID NO: 1163128 - RNA, 15 nt, Human
ccuuggauugucccc

SEQ ID NO: 1163129 - RNA, 19 nt, Human
ccuuggauuguccccgacc

SEQ ID NO: 1163130 - RNA, 22 nt, Human
ccuuggcucaaguccucuuuuc

SEQ ID NO: 1163131 - RNA, 16 nt, Human
ccuuggcugcagggag

SEQ ID NO: 1163132 - RNA, 14 nt, Human
ccuuggggagcagg

SEQ ID NO: 1163133 - RNA, 19 nt, Human
ccuuggugucgggcaugac

SEQ ID NO: 1163134 - RNA, 20 nt, Human
ccuuggugucgggcaugaca

SEQ ID NO: 1163135 - RNA, 21 nt, Human
ccuuggugucgggcaugacac

SEQ ID NO: 1163136 - RNA, 19 nt, Human
ccuucucuccagccccugg

SEQ ID NO: 1163137 - RNA, 24 nt, Human
ccuuuguauucucuccuguaccuc

SEQ ID NO: 1163138 - RNA, 22 nt, Human
ccuuuguauucucuccuguacc

SEQ ID NO: 1163139 - RNA, 23 nt, Human
ccuuuguauucucuccuguaccu

SEQ ID NO: 1163140 - RNA, 14 nt, Human
ccuuuguccccacc

SEQ ID NO: 1163141 - RNA, 16 nt, Human
ccuuuguccccaccgc

SEQ ID NO: 1163142 - RNA, 18 nt, Human
ccuuuguccccaccgcag

SEQ ID NO: 1163143 - RNA, 14 nt, Human
ccuuugugaggaag

SEQ ID NO: 1163144 - RNA, 22 nt, Human
ccuuuguccccaccgcagacag

SEQ ID NO: 1163145 - RNA, 23 nt, Human
ccuuuguccccaccgcagacagg

SEQ ID NO: 1163146 - RNA, 15 nt, Human
ccuuugugaggaagc

SEQ ID NO: 1163147 - RNA, 16 nt, Human
ccuuugugaggaagcc

SEQ ID NO: 1163148 - RNA, 17 nt, Human
ccuuugugaggaagccg

SEQ ID NO: 1163149 - RNA, 23 nt, Human
ccuuugugaggaagccgcugggg

SEQ ID NO: 1163150 - RNA, 15 nt, Human
ccuuuuuuggcugcu

SEQ ID NO: 1163151 - RNA, 17 nt, Human
ccuuuuuuggcugcuga

SEQ ID NO: 1163152 - RNA, 18 nt, Human
ccuuuuuuggcugcugaa

SEQ ID NO: 1163153 - RNA, 20 nt, Human
ccuuuuuuggcugcugaagg

SEQ ID NO: 1163154 - RNA, 22 nt, Human
ccuuuuuuggcugcugaaggcu

SEQ ID NO: 1163155 - RNA, 21 nt, Human
cgaacauguuuuucuucuccc

SEQ ID NO: 1163156 - RNA, 23 nt, Human
cgaacauguuuuucuucucccuc

SEQ ID NO: 1163157 - RNA, 16 nt, Human
cgaauagcugggacua

SEQ ID NO: 1163158 - RNA, 11 nt, Human
cgaauauugcu

SEQ ID NO: 1163159 - RNA, 12 nt, Human
cgaauauugcug

SEQ ID NO: 1163160 - RNA, 14 nt, Human
cgaauauugcugau

SEQ ID NO: 1163161 - RNA, 15 nt, Human
cgaauauugcugaug

SEQ ID NO: 1163162 - RNA, 17 nt, Human
cgaauauugcugauggu

SEQ ID NO: 1163163 - RNA, 16 nt, Human
ccuuguggucccaccc

SEQ ID NO: 1163164 - RNA, 19 nt, Human
cgagcccugguggcagugg

SEQ ID NO: 1163165 - RNA, 16 nt, Human
cgaggacagggaggug

SEQ ID NO: 1163166 - RNA, 13 nt, Human
cgcacugggcuug

SEQ ID NO: 1163167 - RNA, 17 nt, Human
cgcacugggcuugggga

SEQ ID NO: 1163168 - RNA, 23 nt, Human
cgcacuucgggaggucgaggcag

SEQ ID NO: 1163169 - RNA, 19 nt, Human
cgcagcauauucaggaagc

SEQ ID NO: 1163170 - RNA, 20 nt, Human
cgcagcauauucaggaagcu

SEQ ID NO: 1163171 - RNA, 17 nt, Human
cgcagcccugcagaggg

SEQ ID NO: 1163172 - RNA, 18 nt, Human
cgcagcccugcagagggc

SEQ ID NO: 1163173 - RNA, 19 nt, Human
cgcagcccugcagagggca

SEQ ID NO: 1163174 - RNA, 13 nt, Human
cgcccagucugga

SEQ ID NO: 1163175 - RNA, 19 nt, Human
cgcccagucuggaaugcag

SEQ ID NO: 1163176 - RNA, 21 nt, Human
cgcccagucuggaaugcagug

SEQ ID NO: 1163177 - RNA, 14 nt, Human
cgcgacaaugcaaa

SEQ ID NO: 1163178 - RNA, 15 nt, Human
cgcgacaaugcaaac

SEQ ID NO: 1163179 - RNA, 19 nt, Human
cgcgguggcucacgccugu

SEQ ID NO: 1163180 - RNA, 18 nt, Human
cgcuacccgggaaggggg

SEQ ID NO: 1163181 - RNA, 21 nt, Human
cgcuacccgggaagggggcug

SEQ ID NO: 1163182 - RNA, 24 nt, Human
cgcuacccgggaagggggcuggga

SEQ ID NO: 1163183 - RNA, 21 nt, Human
cggacagccacggccaggcca

SEQ ID NO: 1163184 - RNA, 22 nt, Human
cggacagccacggccaggccag

SEQ ID NO: 1163185 - RNA, 15 nt, Human
cggagaaaggaaggg

SEQ ID NO: 1163186 - RNA, 17 nt, Human
cggagaaaggaagggcu

SEQ ID NO: 1163187 - RNA, 14 nt, Human
cgcuuucuacccag

SEQ ID NO: 1163188 - RNA, 16 nt, Human
cgcuuucuacccagcg

SEQ ID NO: 1163189 - RNA, 16 nt, Human
cggaauaguuggcuag

SEQ ID NO: 1163190 - RNA, 17 nt, Human
cggaauaguuggcuagg

SEQ ID NO: 1163191 - RNA, 11 nt, Human
cgcugugcugc

SEQ ID NO: 1163192 - RNA, 13 nt, Human
cgcugugcugccc

SEQ ID NO: 1163193 - RNA, 14 nt, Human
cgcugugcugcccu

SEQ ID NO: 1163194 - RNA, 19 nt, Human
cgcugugcugcccugccca

SEQ ID NO: 1163195 - RNA, 21 nt, Human
cgcugugcugcccugcccacc

SEQ ID NO: 1163196 - RNA, 23 nt, Human
cgcugugcugcccugcccaccug

SEQ ID NO: 1163197 - RNA, 11 nt, Human
cggccaggcca

SEQ ID NO: 1163198 - RNA, 12 nt, Human
cggccaggccag

SEQ ID NO: 1163199 - RNA, 20 nt, Human
cggccaggccagagggagug

SEQ ID NO: 1163200 - RNA, 24 nt, Human
cggccaggccagagggagugacag

SEQ ID NO: 1163201 - RNA, 23 nt, Human
cggcuggcagcccaccccucaac

SEQ ID NO: 1163202 - RNA, 13 nt, Human
cggcuggccuggc

SEQ ID NO: 1163203 - RNA, 14 nt, Human
cggcuggccuggcc

SEQ ID NO: 1163204 - RNA, 16 nt, Human
cgggaagggggcuggg

SEQ ID NO: 1163205 - RNA, 19 nt, Human
cgggaagggggcugggaca

SEQ ID NO: 1163206 - RNA, 20 nt, Human
cgggaagggggcugggacau

SEQ ID NO: 1163207 - RNA, 20 nt, Human
cgggaggcagagguugcagu

SEQ ID NO: 1163208 - RNA, 23 nt, Human
cgggaggauguucugggacacag

SEQ ID NO: 1163209 - RNA, 21 nt, Human
cuaaaucuccaaaauaaaacu

SEQ ID NO: 1163210 - RNA, 22 nt, Human
cuaaaugaaaaucgugacaaca

SEQ ID NO: 1163211 - RNA, 12 nt, Human
cuaaccacgcug

SEQ ID NO: 1163212 - RNA, 14 nt, Human
cuaaccacgcugga

SEQ ID NO: 1163213 - RNA, 19 nt, Human
cuaaauugacacuuaaaaa

SEQ ID NO: 1163214 - RNA, 23 nt, Human
cuaaauugacacuuaaaaauggu

SEQ ID NO: 1163215 - RNA, 14 nt, Human
cuaagagagaauga

SEQ ID NO: 1163216 - RNA, 15 nt, Human
cuaagagagaaugag

SEQ ID NO: 1163217 - RNA, 13 nt, Human
cuaagagggaggg

SEQ ID NO: 1163218 - RNA, 15 nt, Human
cuaagagggagggag

SEQ ID NO: 1163219 - RNA, 22 nt, Human
cuaagagggagggagggcucca

SEQ ID NO: 1163220 - RNA, 23 nt, Human
cuaagagggagggagggcuccag

SEQ ID NO: 1163221 - RNA, 18 nt, Human
cuaauauguaacaagcca

SEQ ID NO: 1163222 - RNA, 12 nt, Human
cuaaugggacac

SEQ ID NO: 1163223 - RNA, 13 nt, Human
cuaaugggacacu

SEQ ID NO: 1163224 - RNA, 21 nt, Human
cuacacaggggaaaagaggag

SEQ ID NO: 1163225 - RNA, 23 nt, Human
cuacacgagauacagaauuuuau

SEQ ID NO: 1163226 - RNA, 14 nt, Human
cuacacuaagagag

SEQ ID NO: 1163227 - RNA, 17 nt, Human
cuaauagacaauuuauu

SEQ ID NO: 1163228 - RNA, 19 nt, Human
cuaauagacaauuuauuau

SEQ ID NO: 1163229 - RNA, 23 nt, Human
cuaauagacaauuuauuauggca

SEQ ID NO: 1163230 - RNA, 21 nt, Human
cuaagcuucacuguaaaauaa

SEQ ID NO: 1163231 - RNA, 19 nt, Human
cuacagcuugaccgugagg

SEQ ID NO: 1163232 - RNA, 22 nt, Human
cuacagcuugaccgugaggcca

SEQ ID NO: 1163233 - RNA, 23 nt, Human
cuacagcuugaccgugaggccag

SEQ ID NO: 1163234 - RNA, 13 nt, Human
cuacacugugcug

SEQ ID NO: 1163235 - RNA, 14 nt, Human
cuacacugugcuga

SEQ ID NO: 1163236 - RNA, 17 nt, Human
cuacacugugcugaguc

SEQ ID NO: 1163237 - RNA, 18 nt, Human
cuacacugugcugagucu

SEQ ID NO: 1163238 - RNA, 18 nt, Human
cuacagaggccaugggcc

SEQ ID NO: 1163239 - RNA, 20 nt, Human
cuacagaggccaugggccuc

SEQ ID NO: 1163240 - RNA, 22 nt, Human
cuacagaggccaugggccuccu

SEQ ID NO: 1163241 - RNA, 14 nt, Human
cuacaggagugagc

SEQ ID NO: 1163242 - RNA, 15 nt, Human
cuacaggagugagca

SEQ ID NO: 1163243 - RNA, 16 nt, Human
cuacaggagugagcac

SEQ ID NO: 1163244 - RNA, 15 nt, Human
cuacaggcacccacc

SEQ ID NO: 1163245 - RNA, 17 nt, Human
cuacaggcacccaccau

SEQ ID NO: 1163246 - RNA, 14 nt, Human
cuacaggugugagu

SEQ ID NO: 1163247 - RNA, 16 nt, Human
cuacaggugugaguca

SEQ ID NO: 1163248 - RNA, 13 nt, Human
cuacaguccuccc

SEQ ID NO: 1163249 - RNA, 18 nt, Human
cuacauggaguauauguc

SEQ ID NO: 1163250 - RNA, 20 nt, Human
cuacauggaguauaugucaa

SEQ ID NO: 1163251 - RNA, 13 nt, Human
cuacauucuguua

SEQ ID NO: 1163252 - RNA, 14 nt, Human
cuacauucuguuaa

SEQ ID NO: 1163253 - RNA, 22 nt, Human
cuacauuauaaaugucucuuua

SEQ ID NO: 1163254 - RNA, 13 nt, Human
cuacccacccucc

SEQ ID NO: 1163255 - RNA, 15 nt, Human
cuacccagcgagccc

SEQ ID NO: 1163256 - RNA, 17 nt, Human
cuacccagcgagcccug

SEQ ID NO: 1163257 - RNA, 18 nt, Human
cuacccagcgagcccugg

SEQ ID NO: 1163258 - RNA, 13 nt, Human
cuacccaggugcu

SEQ ID NO: 1163259 - RNA, 19 nt, Human
cuacccagcgagcccuggu

SEQ ID NO: 1163260 - RNA, 17 nt, Human
cuacccucuuagaaaaa

SEQ ID NO: 1163261 - RNA, 22 nt, Human
cuaggaaauauuuauuuuaaua

SEQ ID NO: 1163262 - RNA, 15 nt, Human
cuacucgaguuacag

SEQ ID NO: 1163263 - RNA, 16 nt, Human
cuacucgaguuacaga

SEQ ID NO: 1163264 - RNA, 19 nt, Human
cuacucgaguuacagacaa

SEQ ID NO: 1163265 - RNA, 12 nt, Human
cuacucuguguc

SEQ ID NO: 1163266 - RNA, 13 nt, Human
cuacucuguguca

SEQ ID NO: 1163267 - RNA, 19 nt, Human
cuacuguccuacccacccu

SEQ ID NO: 1163268 - RNA, 20 nt, Human
cuacuguccuacccacccuc

SEQ ID NO: 1163269 - RNA, 17 nt, Human
cuagagguucaaagaua

SEQ ID NO: 1163270 - RNA, 18 nt, Human
cuagagguucaaagauau

SEQ ID NO: 1163271 - RNA, 21 nt, Human
cuagagguucaaagauauuuu

SEQ ID NO: 1163272 - RNA, 18 nt, Human
cuagaguuuagcuggaaa

SEQ ID NO: 1163273 - RNA, 19 nt, Human
cuagaguuuagcuggaaaa

SEQ ID NO: 1163274 - RNA, 13 nt, Human
cuagauacuguau

SEQ ID NO: 1163275 - RNA, 16 nt, Human
cuagauacuguaucau

SEQ ID NO: 1163276 - RNA, 24 nt, Human
cuagauacuguaucaugacaaaga

SEQ ID NO: 1163277 - RNA, 21 nt, Human
cuagccugugccucugggacu

SEQ ID NO: 1163278 - RNA, 22 nt, Human
cuagccugugccucugggacug

SEQ ID NO: 1163279 - RNA, 21 nt, Human
cuagccuuagaagucacacag

SEQ ID NO: 1163280 - RNA, 22 nt, Human
cuagccuuagaagucacacagu

SEQ ID NO: 1163281 - RNA, 23 nt, Human
cuagccuuagaagucacacagua

SEQ ID NO: 1163282 - RNA, 14 nt, Human
cuaggaaauauuua

SEQ ID NO: 1163283 - RNA, 15 nt, Human
cuaggaaauauuuau

SEQ ID NO: 1163284 - RNA, 19 nt, Human
cuaggaaauauuuauuuua

SEQ ID NO: 1163285 - RNA, 20 nt, Human
cuaggaaauauuuauuuuaa

SEQ ID NO: 1163286 - RNA, 19 nt, Human
cuaugaaauauuauguuaa

SEQ ID NO: 1163287 - RNA, 13 nt, Human
cuauaauuuaaau

SEQ ID NO: 1163288 - RNA, 12 nt, Human
cuauaauuuaaa

SEQ ID NO: 1163289 - RNA, 20 nt, Human
cuaggaacacuccuucacag

SEQ ID NO: 1163290 - RNA, 15 nt, Human
cuaggaagacuuugg

SEQ ID NO: 1163291 - RNA, 17 nt, Human
cuaggaagacuuuggaa

SEQ ID NO: 1163292 - RNA, 19 nt, Human
cuauagccuaggugacaga

SEQ ID NO: 1163293 - RNA, 20 nt, Human
cuauagccuaggugacagag

SEQ ID NO: 1163294 - RNA, 21 nt, Human
cuauagccuaggugacagagu

SEQ ID NO: 1163295 - RNA, 13 nt, Human
cuauguaucaaug

SEQ ID NO: 1163296 - RNA, 16 nt, Human
cuauguaucaaugagu

SEQ ID NO: 1163297 - RNA, 17 nt, Human
cuauucaguaauaacuc

SEQ ID NO: 1163298 - RNA, 23 nt, Human
cuauucaguaauaacucuacccu

SEQ ID NO: 1163299 - RNA, 16 nt, Human
cuauugcugcuugagg

SEQ ID NO: 1163300 - RNA, 14 nt, Human
cucaaguccucuuu

SEQ ID NO: 1163301 - RNA, 23 nt, Human
cucacacggacacucaaaagcug

SEQ ID NO: 1163302 - RNA, 16 nt, Human
cucaacucuccuccag

SEQ ID NO: 1163303 - RNA, 18 nt, Human
cucaacucuccuccagag

SEQ ID NO: 1163304 - RNA, 19 nt, Human
cucaacucuccuccagagu

SEQ ID NO: 1163305 - RNA, 14 nt, Human
cucaaauuucuaaa

SEQ ID NO: 1163306 - RNA, 15 nt, Human
cucaaauuucuaaau

SEQ ID NO: 1163307 - RNA, 17 nt, Human
cucaaauuucuaaaucu

SEQ ID NO: 1163308 - RNA, 14 nt, Human
cucaacucuccucc

SEQ ID NO: 1163309 - RNA, 15 nt, Human
cucacugcagccuca

SEQ ID NO: 1163310 - RNA, 16 nt, Human
cucacugcagccucaa

SEQ ID NO: 1163311 - RNA, 14 nt, Human
cucacuguugccca

SEQ ID NO: 1163312 - RNA, 15 nt, Human
cucacuguugcccag

SEQ ID NO: 1163313 - RNA, 23 nt, Human
cucagagagggugggagugggcc

SEQ ID NO: 1163314 - RNA, 19 nt, Human
cucagagagggugggagug

SEQ ID NO: 1163315 - RNA, 16 nt, Human
cucacuguugcccagg

SEQ ID NO: 1163316 - RNA, 17 nt, Human
cucacuguugcccaggc

SEQ ID NO: 1163317 - RNA, 18 nt, Human
cucacuguugcccaggcu

SEQ ID NO: 1163318 - RNA, 19 nt, Human
cucacuguugcccaggcug

SEQ ID NO: 1163319 - RNA, 15 nt, Human
cucagcauccuggca

SEQ ID NO: 1163320 - RNA, 19 nt, Human
cucagcaaaagaugcuucu

SEQ ID NO: 1163321 - RNA, 20 nt, Human
cucagcaaaagaugcuucuc

SEQ ID NO: 1163322 - RNA, 21 nt, Human
cucagcaaaagaugcuucuca

SEQ ID NO: 1163323 - RNA, 16 nt, Human
cucagcaggggagggu

SEQ ID NO: 1163324 - RNA, 13 nt, Human
cucagcauccugg

SEQ ID NO: 1163325 - RNA, 21 nt, Human
cucagcauccuggcacccggc

SEQ ID NO: 1163326 - RNA, 22 nt, Human
cucagcauccuggcacccggcc

SEQ ID NO: 1163327 - RNA, 23 nt, Human
cucagcggggacagcuccuucug

SEQ ID NO: 1163328 - RNA, 14 nt, Human
cucagcggggacag

SEQ ID NO: 1163329 - RNA, 15 nt, Human
cucagcggggacagc

SEQ ID NO: 1163330 - RNA, 16 nt, Human
cucagcggggacagcu

SEQ ID NO: 1163331 - RNA, 18 nt, Human
cucagcggggacagcucc

SEQ ID NO: 1163332 - RNA, 19 nt, Human
cucagcggggacagcuccu

SEQ ID NO: 1163333 - RNA, 20 nt, Human
cucagcggggacagcuccuu

SEQ ID NO: 1163334 - RNA, 21 nt, Human
cucagcggggacagcuccuuc

SEQ ID NO: 1163335 - RNA, 24 nt, Human
cucagggucccugguggcagcuca

SEQ ID NO: 1163336 - RNA, 14 nt, Human
cucagggccugguc

SEQ ID NO: 1163337 - RNA, 20 nt, Human
cucagggucccugguggcag

SEQ ID NO: 1163338 - RNA, 21 nt, Human
cucagggucccugguggcagc

SEQ ID NO: 1163339 - RNA, 22 nt, Human
cucagggucccugguggcagcu

SEQ ID NO: 1163340 - RNA, 23 nt, Human
cucaggugauccacccaccucag

SEQ ID NO: 1163341 - RNA, 19 nt, Human
cucagguggggucacucug

SEQ ID NO: 1163342 - RNA, 20 nt, Human
cucagguggggucacucugg

SEQ ID NO: 1163343 - RNA, 21 nt, Human
cucagguggggucacucuggc

SEQ ID NO: 1163344 - RNA, 22 nt, Human
cucagguggggucacucuggca

SEQ ID NO: 1163345 - RNA, 15 nt, Human
cucaggcagguggga

SEQ ID NO: 1163346 - RNA, 18 nt, Human
cucaggcaggugggaugg

SEQ ID NO: 1163347 - RNA, 13 nt, Human
cucagggccuggc

SEQ ID NO: 1163348 - RNA, 19 nt, Human
cucagggccuggcucaggu

SEQ ID NO: 1163349 - RNA, 20 nt, Human
cucagggccuggcucaggug

SEQ ID NO: 1163350 - RNA, 12 nt, Human
cucauuuccaag

SEQ ID NO: 1163351 - RNA, 13 nt, Human
cucauuuccaagc

SEQ ID NO: 1163352 - RNA, 14 nt, Human
cucauuuccaagca

SEQ ID NO: 1163353 - RNA, 17 nt, Human
cucauuuccaagcaagu

SEQ ID NO: 1163354 - RNA, 21 nt, Human
cucauuuccaagcaaguauua

SEQ ID NO: 1163355 - RNA, 21 nt, Human
cucauuugucacacacuuugg

SEQ ID NO: 1163356 - RNA, 18 nt, Human
cucauucuccuuguguua

SEQ ID NO: 1163357 - RNA, 22 nt, Human
cucauucuccuuguguuacuaa

SEQ ID NO: 1163358 - RNA, 12 nt, Human
cucauucuucug

SEQ ID NO: 1163359 - RNA, 19 nt, Human
cucauugaccugaggcccu

SEQ ID NO: 1163360 - RNA, 21 nt, Human
cucauugaccugaggcccuuc

SEQ ID NO: 1163361 - RNA, 16 nt, Human
cuccagagucagaagu

SEQ ID NO: 1163362 - RNA, 11 nt, Human
cuccagccccu

SEQ ID NO: 1163363 - RNA, 13 nt, Human
cuccagccccugg

SEQ ID NO: 1163364 - RNA, 14 nt, Human
cuccagccccugga

SEQ ID NO: 1163365 - RNA, 15 nt, Human
cuccagccccuggau

SEQ ID NO: 1163366 - RNA, 15 nt, Human
cuccagcucaccagc

SEQ ID NO: 1163367 - RNA, 16 nt, Human
cuccagcucaccagcc

SEQ ID NO: 1163368 - RNA, 18 nt, Human
cuccagcucaccagcccc

SEQ ID NO: 1163369 - RNA, 19 nt, Human
cuccagcucaccagcccca

SEQ ID NO: 1163370 - RNA, 16 nt, Human
cucccaaagugcuggg

SEQ ID NO: 1163371 - RNA, 14 nt, Human
cucccaacucaccc

SEQ ID NO: 1163372 - RNA, 15 nt, Human
cucccaacucacccc

SEQ ID NO: 1163373 - RNA, 16 nt, Human
cucccaacucacccca

SEQ ID NO: 1163374 - RNA, 15 nt, Human
cucccacaaaggaga

SEQ ID NO: 1163375 - RNA, 16 nt, Human
cucccaucacuucccu

SEQ ID NO: 1163376 - RNA, 15 nt, Human
cucccuucauccuuc

SEQ ID NO: 1163377 - RNA, 18 nt, Human
cucccucagucuggcccu

SEQ ID NO: 1163378 - RNA, 20 nt, Human
cucccgaauagcugggacua

SEQ ID NO: 1163379 - RNA, 23 nt, Human
cucccgaauagcugggacuacag

SEQ ID NO: 1163380 - RNA, 15 nt, Human
cucccgaguagcugg

SEQ ID NO: 1163381 - RNA, 20 nt, Human
cuccccagccccaucccaaa

SEQ ID NO: 1163382 - RNA, 21 nt, Human
cuccccugcuggguguggcgc

SEQ ID NO: 1163383 - RNA, 23 nt, Human
cuccccugcuggguguggcgcag

SEQ ID NO: 1163384 - RNA, 19 nt, Human
cugcccuccaagaccuucu

SEQ ID NO: 1163385 - RNA, 14 nt, Human
cucccuucccaccu

SEQ ID NO: 1163386 - RNA, 15 nt, Human
cucccuucccaccuc

SEQ ID NO: 1163387 - RNA, 16 nt, Human
cucccuucccaccucu

SEQ ID NO: 1163388 - RNA, 17 nt, Human
cucccuucccaccucuc

SEQ ID NO: 1163389 - RNA, 23 nt, Human
cucccuucccaccucucucacuc

SEQ ID NO: 1163390 - RNA, 12 nt, Human
cugcccuccaag

SEQ ID NO: 1163391 - RNA, 15 nt, Human
cugccgcagcccugc

SEQ ID NO: 1163392 - RNA, 17 nt, Human
cugccgcagcccugcag

SEQ ID NO: 1163393 - RNA, 18 nt, Human
cugccgcagcccugcaga

SEQ ID NO: 1163394 - RNA, 19 nt, Human
cugccgcagcccugcagag

SEQ ID NO: 1163395 - RNA, 15 nt, Human
cugccucuucucuac

SEQ ID NO: 1163396 - RNA, 15 nt, Human
cugccugaagucaca

SEQ ID NO: 1163397 - RNA, 16 nt, Human
cugccugaagucacac

SEQ ID NO: 1163398 - RNA, 16 nt, Human
cugccugcccaggccc

SEQ ID NO: 1163399 - RNA, 17 nt, Human
cugccugcccaggcccc

SEQ ID NO: 1163400 - RNA, 20 nt, Human
cugccugcccaggccccugc

SEQ ID NO: 1163401 - RNA, 21 nt, Human
cugccugcccaggccccugcc

SEQ ID NO: 1163402 - RNA, 21 nt, Human
cugccugggaucccucauccu

SEQ ID NO: 1163403 - RNA, 22 nt, Human
cugccugggaucccucauccuc

SEQ ID NO: 1163404 - RNA, 11 nt, Human
cugccucccau

SEQ ID NO: 1163405 - RNA, 12 nt, Human
cugccucccauc

SEQ ID NO: 1163406 - RNA, 14 nt, Human
cugccucccaucac

SEQ ID NO: 1163407 - RNA, 16 nt, Human
cugccucccaucaccc

SEQ ID NO: 1163408 - RNA, 19 nt, Human
cugccucccaucacccgcu

SEQ ID NO: 1163409 - RNA, 15 nt, Human
cugccucugacacac

SEQ ID NO: 1163410 - RNA, 22 nt, Human
cugccucugacacacagcucug

SEQ ID NO: 1163411 - RNA, 23 nt, Human
cugccucugacacacagcucugu

SEQ ID NO: 1163412 - RNA, 19 nt, Human
cugcgaccacaagaaggau

SEQ ID NO: 1163413 - RNA, 19 nt, Human
cugcuccagcuguucagcu

SEQ ID NO: 1163414 - RNA, 20 nt, Human
cugcuccagcuguucagcug

SEQ ID NO: 1163415 - RNA, 11 nt, Human
cugcugaaggc

SEQ ID NO: 1163416 - RNA, 12 nt, Human
cugcugaaggcu

SEQ ID NO: 1163417 - RNA, 13 nt, Human
cugcugguucagg

SEQ ID NO: 1163418 - RNA, 15 nt, Human
cugcugguucagggu

SEQ ID NO: 1163419 - RNA, 23 nt, Human
cugcugguucaggguuggccccu

SEQ ID NO: 1163420 - RNA, 16 nt, Human
cugcuuccagugaggc

SEQ ID NO: 1163421 - RNA, 18 nt, Human
cugcuuccagugaggcuc

SEQ ID NO: 1163422 - RNA, 19 nt, Human
cugcuuccagugaggcucu

SEQ ID NO: 1163423 - RNA, 20 nt, Human
cugcuuccagugaggcucug

SEQ ID NO: 1163424 - RNA, 21 nt, Human
cugcuuccagugaggcucugc

SEQ ID NO: 1163425 - RNA, 23 nt, Human
cugcuuccagugaggcucugccc

SEQ ID NO: 1163426 - RNA, 15 nt, Human
cugcugcuggcuggu

SEQ ID NO: 1163427 - RNA, 17 nt, Human
cuggaccuugaacuggg

SEQ ID NO: 1163428 - RNA, 20 nt, Human
cuggaccuugaacuggguac

SEQ ID NO: 1163429 - RNA, 21 nt, Human
cuggaccuugaacuggguacu

SEQ ID NO: 1163430 - RNA, 15 nt, Human
cuggacccuguggau

SEQ ID NO: 1163431 - RNA, 16 nt, Human
cuggaccuugaacugg

SEQ ID NO: 1163432 - RNA, 17 nt, Human
cuggacaggcauguucu

SEQ ID NO: 1163433 - RNA, 23 nt, Human
cuggacaggcauguucucugagg

SEQ ID NO: 1163434 - RNA, 13 nt, Human
cuggagcucugcc

SEQ ID NO: 1163435 - RNA, 16 nt, Human
cuggagcucugcccau

SEQ ID NO: 1163436 - RNA, 17 nt, Human
cuggagguacgaaaaga

SEQ ID NO: 1163437 - RNA, 22 nt, Human
cuggagguacgaaaagagggga

SEQ ID NO: 1163438 - RNA, 14 nt, Human
cuggagugcaguga

SEQ ID NO: 1163439 - RNA, 15 nt, Human
cuggagugcagugag

SEQ ID NO: 1163440 - RNA, 16 nt, Human
cuggagugcagugagc

SEQ ID NO: 1163441 - RNA, 17 nt, Human
cuggagugcagugagcc

SEQ ID NO: 1163442 - RNA, 22 nt, Human
cuggcacccggccccugcuggu

SEQ ID NO: 1163443 - RNA, 19 nt, Human
cuggcacugcuuccaguga

SEQ ID NO: 1163444 - RNA, 20 nt, Human
cuggcacugcuuccagugag

SEQ ID NO: 1163445 - RNA, 23 nt, Human
cuggcacugcuuccagugaggcu

SEQ ID NO: 1163446 - RNA, 20 nt, Human
cuggagugcagugagccgag

SEQ ID NO: 1163447 - RNA, 20 nt, Human
cuggcacccggccccugcug

SEQ ID NO: 1163448 - RNA, 21 nt, Human
cuggcacccggccccugcugg

SEQ ID NO: 1163449 - RNA, 14 nt, Human
cuggccagaugcac

SEQ ID NO: 1163450 - RNA, 15 nt, Human
cuggcccacugcauc

SEQ ID NO: 1163451 - RNA, 18 nt, Human
cuggccucugcacucccc

SEQ ID NO: 1163452 - RNA, 20 nt, Human
cuggccucugcacuccccug

SEQ ID NO: 1163453 - RNA, 21 nt, Human
cuggccucugcacuccccugc

SEQ ID NO: 1163454 - RNA, 13 nt, Human
cuggccuggcccc

SEQ ID NO: 1163455 - RNA, 24 nt, Human
cuggccuggccccucagggucccu

SEQ ID NO: 1163456 - RNA, 22 nt, Human
cuggccuucggccuccauccug

SEQ ID NO: 1163457 - RNA, 23 nt, Human
cuggccuucggccuccauccuga

SEQ ID NO: 1163458 - RNA, 14 nt, Human
cuggccugugucua

SEQ ID NO: 1163459 - RNA, 14 nt, Human
cuggcgugcagugg

SEQ ID NO: 1163460 - RNA, 15 nt, Human
cuggcgugcaguggu

SEQ ID NO: 1163461 - RNA, 21 nt, Human
cuggcucuuccaggcugggag

SEQ ID NO: 1163462 - RNA, 22 nt, Human
cuggcucuuccaggcugggaga

SEQ ID NO: 1163463 - RNA, 24 nt, Human
cuggcucuuccaggcugggagagc

SEQ ID NO: 1163464 - RNA, 23 nt, Human
cugguggcagcucaccucucccu

SEQ ID NO: 1163465 - RNA, 13 nt, Human
cugguggcagcug

SEQ ID NO: 1163466 - RNA, 14 nt, Human
cugguggcagcugc

SEQ ID NO: 1163467 - RNA, 23 nt, Human
cuguaaucacagcuacuugggag

SEQ ID NO: 1163468 - RNA, 15 nt, Human
cuguacaaaguagaa

SEQ ID NO: 1163469 - RNA, 13 nt, Human
cuguacaaaguag

SEQ ID NO: 1163470 - RNA, 20 nt, Human
cuguaauccuagcacuuugg

SEQ ID NO: 1163471 - RNA, 24 nt, Human
cugggcuucaguggcagcugcuuu

SEQ ID NO: 1163472 - RNA, 13 nt, Human
cugggcuugggga

SEQ ID NO: 1163473 - RNA, 13 nt, Human
cugggggaagaag

SEQ ID NO: 1163474 - RNA, 15 nt, Human
cugggggaagaagcu

SEQ ID NO: 1163475 - RNA, 19 nt, Human
cugggggcugggcagagga

SEQ ID NO: 1163476 - RNA, 22 nt, Human
cugggggggauuguaaaauggu

SEQ ID NO: 1163477 - RNA, 22 nt, Human
cuggguaacuagggaagauaau

SEQ ID NO: 1163478 - RNA, 14 nt, Human
cuggguacuugugg

SEQ ID NO: 1163479 - RNA, 15 nt, Human
cuggguucuacccag

SEQ ID NO: 1163480 - RNA, 16 nt, Human
cuggguucuacccagg

SEQ ID NO: 1163481 - RNA, 17 nt, Human
cuggguucuacccaggu

SEQ ID NO: 1163482 - RNA, 19 nt, Human
cuggguucuacccaggugc

SEQ ID NO: 1163483 - RNA, 13 nt, Human
cugucaauuacag

SEQ ID NO: 1163484 - RNA, 22 nt, Human
cuguauuuuaaaagaaugauua

SEQ ID NO: 1163485 - RNA, 20 nt, Human
cuguauuuuaaaagaaugau

SEQ ID NO: 1163486 - RNA, 23 nt, Human
cuguaucccaugagccucagcau

SEQ ID NO: 1163487 - RNA, 14 nt, Human
cuguaucccaugag

SEQ ID NO: 1163488 - RNA, 13 nt, Human
cuguacagagccc

SEQ ID NO: 1163489 - RNA, 14 nt, Human
cuguacagagccca

SEQ ID NO: 1163490 - RNA, 18 nt, Human
cugucucaaaaaaagaaa

SEQ ID NO: 1163491 - RNA, 23 nt, Human
cugucucaaaaaaacacaaaagu

SEQ ID NO: 1163492 - RNA, 16 nt, Human
cugucucaaaaaaaga

SEQ ID NO: 1163493 - RNA, 22 nt, Human
cugucccuuacgugaguccugg

SEQ ID NO: 1163494 - RNA, 15 nt, Human
cuguccgagcuuuga

SEQ ID NO: 1163495 - RNA, 14 nt, Human
cuguccuacccacc

SEQ ID NO: 1163496 - RNA, 18 nt, Human
cuguccccgcacugggcu

SEQ ID NO: 1163497 - RNA, 19 nt, Human
cuguccccgcacugggcuu

SEQ ID NO: 1163498 - RNA, 22 nt, Human
cuguccccgcacugggcuuggg

SEQ ID NO: 1163499 - RNA, 20 nt, Human
cugucccuuacgugaguccu

SEQ ID NO: 1163500 - RNA, 18 nt, Human
cugucuccauguuugaug

SEQ ID NO: 1163501 - RNA, 20 nt, Human
cugugaguacuacaguccuc

SEQ ID NO: 1163502 - RNA, 21 nt, Human
cugugaguacuacaguccucc

SEQ ID NO: 1163503 - RNA, 23 nt, Human
cugugaguacuacaguccuccca

SEQ ID NO: 1163504 - RNA, 18 nt, Human
cugugauggggcccugcc

SEQ ID NO: 1163505 - RNA, 19 nt, Human
cugugauggggcccugccu

SEQ ID NO: 1163506 - RNA, 20 nt, Human
cugugauggggcccugccuc

SEQ ID NO: 1163507 - RNA, 16 nt, Human
cugugccaugugccag

SEQ ID NO: 1163508 - RNA, 18 nt, Human
cugugccaugugccaggu

SEQ ID NO: 1163509 - RNA, 14 nt, Human
cugugccauuuugu

SEQ ID NO: 1163510 - RNA, 22 nt, Human
cugugccauuuuguauuuuacu

SEQ ID NO: 1163511 - RNA, 14 nt, Human
cugugccucuggga

SEQ ID NO: 1163512 - RNA, 16 nt, Human
cugugccucugggacu

SEQ ID NO: 1163513 - RNA, 17 nt, Human
cugugccucugggacug

SEQ ID NO: 1163514 - RNA, 18 nt, Human
cugugccucugggacugg

SEQ ID NO: 1163515 - RNA, 22 nt, Human
cugugcugcccugcccaccugg

SEQ ID NO: 1163516 - RNA, 17 nt, Human
cuguggaugauaaaaca

SEQ ID NO: 1163517 - RNA, 21 nt, Human
cugugucuugcaauggcagcc

SEQ ID NO: 1163518 - RNA, 22 nt, Human
cugugucuugcaauggcagccu

SEQ ID NO: 1163519 - RNA, 23 nt, Human
cugugucuugcaauggcagccuu

SEQ ID NO: 1163520 - RNA, 20 nt, Human
cugugugugcgccuacagga

SEQ ID NO: 1163521 - RNA, 13 nt, Human
cuguuacugucuu

SEQ ID NO: 1163522 - RNA, 19 nt, Human
cuguucagcugguugaggu

SEQ ID NO: 1163523 - RNA, 21 nt, Human
cuguucagcugguugagguuu

SEQ ID NO: 1163524 - RNA, 13 nt, Human
cuguucucugccc

SEQ ID NO: 1163525 - RNA, 14 nt, Human
cuguucucugcccu

SEQ ID NO: 1163526 - RNA, 15 nt, Human
cuguucucugcccuc

SEQ ID NO: 1163527 - RNA, 16 nt, Human
cuguucucugcccucc

SEQ ID NO: 1163528 - RNA, 17 nt, Human
cuguucucugcccucca

SEQ ID NO: 1163529 - RNA, 18 nt, Human
cuguucucugcccuccaa

SEQ ID NO: 1163530 - RNA, 19 nt, Human
cuguucucugcccuccaag

SEQ ID NO: 1163531 - RNA, 20 nt, Human
cuguucucugcccuccaaga

SEQ ID NO: 1163532 - RNA, 16 nt, Human
cuguucuggcagaguu

SEQ ID NO: 1163533 - RNA, 22 nt, Human
cuuagaugcaguucugaagaag

SEQ ID NO: 1163534 - RNA, 13 nt, Human
cuuagauguauau

SEQ ID NO: 1163535 - RNA, 19 nt, Human
cuuagauguauauauuucc

SEQ ID NO: 1163536 - RNA, 16 nt, Human
cuuagucacugagaca

SEQ ID NO: 1163537 - RNA, 18 nt, Human
cuuagucacugagacagc

SEQ ID NO: 1163538 - RNA, 19 nt, Human
cuuagucacugagacagcc

SEQ ID NO: 1163539 - RNA, 20 nt, Human
cuuagucacugagacagccc

SEQ ID NO: 1163540 - RNA, 19 nt, Human
cuuauaggaauugacccac

SEQ ID NO: 1163541 - RNA, 15 nt, Human
cuucaaauauuuccc

SEQ ID NO: 1163542 - RNA, 18 nt, Human
cuuauuuaaugaaagacu

SEQ ID NO: 1163543 - RNA, 17 nt, Human
cuuauuuaaugaaagac

SEQ ID NO: 1163544 - RNA, 10 nt, Human
cuucaaggau

SEQ ID NO: 1163545 - RNA, 13 nt, Human
cuucaaggauccu

SEQ ID NO: 1163546 - RNA, 15 nt, Human
cuucaaggauccuga

SEQ ID NO: 1163547 - RNA, 16 nt, Human
cuucaaggauccugag

SEQ ID NO: 1163548 - RNA, 23 nt, Human
cuucacagaugggugcuuggagg

SEQ ID NO: 1163549 - RNA, 16 nt, Human
cuucaguaagccguga

SEQ ID NO: 1163550 - RNA, 23 nt, Human
cuucaguaagccgugauuuucau

SEQ ID NO: 1163551 - RNA, 18 nt, Human
cuucagugccuuauggaa

SEQ ID NO: 1163552 - RNA, 22 nt, Human
cuucagugccuuauggaacacu

SEQ ID NO: 1163553 - RNA, 13 nt, Human
cuucaguggcagc

SEQ ID NO: 1163554 - RNA, 14 nt, Human
cuucaguggcagcu

SEQ ID NO: 1163555 - RNA, 15 nt, Human
cuucaguggcagcug

SEQ ID NO: 1163556 - RNA, 16 nt, Human
cuucaguggcagcugc

SEQ ID NO: 1163557 - RNA, 17 nt, Human
cuucaguggcagcugcu

SEQ ID NO: 1163558 - RNA, 17 nt, Human
cuuccacaagagcccag

SEQ ID NO: 1163559 - RNA, 19 nt, Human
cuuccacaagagcccaggc

SEQ ID NO: 1163560 - RNA, 21 nt, Human
cuuccacaagagcccaggccu

SEQ ID NO: 1163561 - RNA, 22 nt, Human
cuuccacaagagcccaggccuc

SEQ ID NO: 1163562 - RNA, 12 nt, Human
cuuccaggcugg

SEQ ID NO: 1163563 - RNA, 14 nt, Human
cuuccaggcuggga

SEQ ID NO: 1163564 - RNA, 17 nt, Human
cuucccuacaguugaaa

SEQ ID NO: 1163565 - RNA, 15 nt, Human
cuuccaggcugggag

SEQ ID NO: 1163566 - RNA, 16 nt, Human
cuuccaggcugggaga

SEQ ID NO: 1163567 - RNA, 19 nt, Human
cuuccaggcugggagagcc

SEQ ID NO: 1163568 - RNA, 14 nt, Human
cuuccagggguggg

SEQ ID NO: 1163569 - RNA, 15 nt, Human
cuuccagggguggga

SEQ ID NO: 1163570 - RNA, 17 nt, Human
cuuccaggggugggaca

SEQ ID NO: 1163571 - RNA, 21 nt, Human
cuuccaggggugggacacccu

SEQ ID NO: 1163572 - RNA, 11 nt, Human
cuucuccacuu

SEQ ID NO: 1163573 - RNA, 20 nt, Human
cuucuccacuuucuagccag

SEQ ID NO: 1163574 - RNA, 12 nt, Human
cuucuccaggcu

SEQ ID NO: 1163575 - RNA, 13 nt, Human
cuucuccaggcug

SEQ ID NO: 1163576 - RNA, 14 nt, Human
cuucuccaggcugu

SEQ ID NO: 1163577 - RNA, 19 nt, Human
cuucuccuucaccuuuguc

SEQ ID NO: 1163578 - RNA, 13 nt, Human
cuucucuccagcc

SEQ ID NO: 1163579 - RNA, 15 nt, Human
cuucucuccagcccc

SEQ ID NO: 1163580 - RNA, 17 nt, Human
cuucucuccagccccug

SEQ ID NO: 1163581 - RNA, 19 nt, Human
cuucucuccagccccugga

SEQ ID NO: 1163582 - RNA, 13 nt, Human
cuucucugaagga

SEQ ID NO: 1163583 - RNA, 13 nt, Human
cuucugcuucagc

SEQ ID NO: 1163584 - RNA, 14 nt, Human
cuucuguacgucug

SEQ ID NO: 1163585 - RNA, 15 nt, Human
cuucuguacgucuga

SEQ ID NO: 1163586 - RNA, 18 nt, Human
cuucuguacgucugacag

SEQ ID NO: 1163587 - RNA, 20 nt, Human
cuucuguacgucugacaggc

SEQ ID NO: 1163588 - RNA, 21 nt, Human
cuucuguacgucugacaggca

SEQ ID NO: 1163589 - RNA, 16 nt, Human
cuucuguccuacucug

SEQ ID NO: 1163590 - RNA, 17 nt, Human
cuucuguccuacucugu

SEQ ID NO: 1163591 - RNA, 18 nt, Human
cuucuguccuacucugug

SEQ ID NO: 1163592 - RNA, 19 nt, Human
cuucuguccuacucugugu

SEQ ID NO: 1163593 - RNA, 21 nt, Human
cuucuguccuacucuguguca

SEQ ID NO: 1163594 - RNA, 13 nt, Human
cuucuguggguuu

SEQ ID NO: 1163595 - RNA, 14 nt, Human
cuucuguggguuuc

SEQ ID NO: 1163596 - RNA, 21 nt, Human
cuucuguggguuucuaaagcu

SEQ ID NO: 1163597 - RNA, 22 nt, Human
cuucuuuauaauucuacuuuga

SEQ ID NO: 1163598 - RNA, 14 nt, Human
cuugaaaacacugu

SEQ ID NO: 1163599 - RNA, 23 nt, Human
cuugaaaacacuguucucugccc

SEQ ID NO: 1163600 - RNA, 13 nt, Human
cuugaacuccugg

SEQ ID NO: 1163601 - RNA, 14 nt, Human
cuugaacccgggag

SEQ ID NO: 1163602 - RNA, 17 nt, Human
cuugaacuuugaccucu

SEQ ID NO: 1163603 - RNA, 21 nt, Human
cuugaacuuugaccucugcag

SEQ ID NO: 1163604 - RNA, 22 nt, Human
cuugaccauucuccaccugcca

SEQ ID NO: 1163605 - RNA, 23 nt, Human
cuugaccauucuccaccugccag

SEQ ID NO: 1163606 - RNA, 16 nt, Human
cuugaagacuuuucuu

SEQ ID NO: 1163607 - RNA, 17 nt, Human
cuugaccgugaggccag

SEQ ID NO: 1163608 - RNA, 18 nt, Human
cuugaccgugaggccaga

SEQ ID NO: 1163609 - RNA, 20 nt, Human
cuugaccgugaggccagaga

SEQ ID NO: 1163610 - RNA, 21 nt, Human
cuugaccgugaggccagagac

SEQ ID NO: 1163611 - RNA, 13 nt, Human
cuugaccucaggu

SEQ ID NO: 1163612 - RNA, 15 nt, Human
cuugagccuugaacu

SEQ ID NO: 1163613 - RNA, 17 nt, Human
cuugagccuugaacuuu

SEQ ID NO: 1163614 - RNA, 18 nt, Human
cuugagccuugaacuuug

SEQ ID NO: 1163615 - RNA, 19 nt, Human
cuugaggguugggcuggug

SEQ ID NO: 1163616 - RNA, 20 nt, Human
cuugaggguugggcuggugu

SEQ ID NO: 1163617 - RNA, 21 nt, Human
cuugaggguugggcugguguc

SEQ ID NO: 1163618 - RNA, 17 nt, Human
cuuucuggcuaugcauu

SEQ ID NO: 1163619 - RNA, 18 nt, Human
cuuucuggcuaugcauuu

SEQ ID NO: 1163620 - RNA, 19 nt, Human
cuuucuggcuaugcauuug

SEQ ID NO: 1163621 - RNA, 20 nt, Human
cuuucuggcuaugcauuuga

SEQ ID NO: 1163622 - RNA, 13 nt, Human
cuuuccugaggcu

SEQ ID NO: 1163623 - RNA, 15 nt, Human
cuuuccugaggcugg

SEQ ID NO: 1163624 - RNA, 16 nt, Human
cuuuccugaggcuggg

SEQ ID NO: 1163625 - RNA, 15 nt, Human
cuuuccaucuacccu

SEQ ID NO: 1163626 - RNA, 11 nt, Human
cuuucccuccc

SEQ ID NO: 1163627 - RNA, 13 nt, Human
cuuucccucccuu

SEQ ID NO: 1163628 - RNA, 14 nt, Human
cuuucccucccuuc

SEQ ID NO: 1163629 - RNA, 16 nt, Human
cuuucccucccuuccu

SEQ ID NO: 1163630 - RNA, 12 nt, Human
cuuuccugaggc

SEQ ID NO: 1163631 - RNA, 14 nt, Human
cuuugaccucugca

SEQ ID NO: 1163632 - RNA, 15 nt, Human
cuuugaccucugcag

SEQ ID NO: 1163633 - RNA, 17 nt, Human
cuuugaccucugcagca

SEQ ID NO: 1163634 - RNA, 18 nt, Human
cuuugaccucugcagcaa

SEQ ID NO: 1163635 - RNA, 20 nt, Human
cuuugaccucugcagcaaua

SEQ ID NO: 1163636 - RNA, 24 nt, Human
cuuugaccucugcagcaauaaagc

SEQ ID NO: 1163637 - RNA, 20 nt, Human
cuuugcagacaggcaagcac

SEQ ID NO: 1163638 - RNA, 15 nt, Human
cuuuguccccaccgc

SEQ ID NO: 1163639 - RNA, 15 nt, Human
cuuugugaggaagcc

SEQ ID NO: 1163640 - RNA, 19 nt, Human
cuuugugaggaagccgcug

SEQ ID NO: 1163641 - RNA, 19 nt, Human
cuuuggcuauuagagauca

SEQ ID NO: 1163642 - RNA, 14 nt, Human
cuuuguccccaccg

SEQ ID NO: 1163643 - RNA, 17 nt, Human
cuuguacuuuauuuucu

SEQ ID NO: 1163644 - RNA, 23 nt, Human
cuugucaauaaaauccauacauu

SEQ ID NO: 1163645 - RNA, 19 nt, Human
cuugaguuuaaauuguaau

SEQ ID NO: 1163646 - RNA, 23 nt, Human
cuuggggggcugaggugggagga

SEQ ID NO: 1163647 - RNA, 17 nt, Human
cuuguaaauagcucagg

SEQ ID NO: 1163648 - RNA, 18 nt, Human
cuuguaaauagcucaggu

SEQ ID NO: 1163649 - RNA, 15 nt, Human
cuuguacauaaugcg

SEQ ID NO: 1163650 - RNA, 19 nt, Human
cuuguacauaaugcgugca

SEQ ID NO: 1163651 - RNA, 21 nt, Human
cuuguacauaaugcgugcaua

SEQ ID NO: 1163652 - RNA, 22 nt, Human
cuuguacauaaugcgugcauac

SEQ ID NO: 1163653 - RNA, 21 nt, Human
cuuguaaauagcucagguguc

SEQ ID NO: 1163654 - RNA, 13 nt, Human
cuuuacuauggcc

SEQ ID NO: 1163655 - RNA, 14 nt, Human
cuuuagcgcccagu

SEQ ID NO: 1163656 - RNA, 15 nt, Human
cuuuagcgcccaguu

SEQ ID NO: 1163657 - RNA, 19 nt, Human
cuuuauaauucuacuuuga

SEQ ID NO: 1163658 - RNA, 15 nt, Human
cuuuaugcacaaaau

SEQ ID NO: 1163659 - RNA, 18 nt, Human
gaaaaucuuauaauuuaa

SEQ ID NO: 1163660 - RNA, 20 nt, Human
gaaaaucagccugcuccagc

SEQ ID NO: 1163661 - RNA, 22 nt, Human
gaaaaucagccugcuccagcug

SEQ ID NO: 1163662 - RNA, 22 nt, Human
gaaaaucuacacuccagugaga

SEQ ID NO: 1163663 - RNA, 11 nt, Human
gaaaauaaaaa

SEQ ID NO: 1163664 - RNA, 12 nt, Human
gaaaauaaaaag

SEQ ID NO: 1163665 - RNA, 13 nt, Human
gaaaauaaaaagu

SEQ ID NO: 1163666 - RNA, 14 nt, Human
gaaaauaaaaaguu

SEQ ID NO: 1163667 - RNA, 24 nt, Human
gaaaacacuguucucugcccucca

SEQ ID NO: 1163668 - RNA, 20 nt, Human
gaaaacguggcugcuucaag

SEQ ID NO: 1163669 - RNA, 22 nt, Human
gaaaacguggcugcuucaagga

SEQ ID NO: 1163670 - RNA, 20 nt, Human
cuuuuguucuugguuuguaa

SEQ ID NO: 1163671 - RNA, 18 nt, Human
cuuuguuaguuucuccaa

SEQ ID NO: 1163672 - RNA, 15 nt, Human
cuuuguucagccugc

SEQ ID NO: 1163673 - RNA, 11 nt, Human
cuuuuguucuu

SEQ ID NO: 1163674 - RNA, 12 nt, Human
cuuuuguucuug

SEQ ID NO: 1163675 - RNA, 17 nt, Human
cuuuuuuggcugcugaa

SEQ ID NO: 1163676 - RNA, 20 nt, Human
cuuuuuuggcugcugaaggc

SEQ ID NO: 1163677 - RNA, 22 nt, Human
cuuuuuuggcugcugaaggcuc

SEQ ID NO: 1163678 - RNA, 23 nt, Human
cuuuuuuggcugcugaaggcucg

SEQ ID NO: 1163679 - RNA, 12 nt, Human
gaaaaaggagga

SEQ ID NO: 1163680 - RNA, 15 nt, Human
gaaaaaggaggaaga

SEQ ID NO: 1163681 - RNA, 17 nt, Human
gaaaaaggaugcacaga

SEQ ID NO: 1163682 - RNA, 18 nt, Human
gaaaacacauuuuucuua

SEQ ID NO: 1163683 - RNA, 19 nt, Human
gaaaacacauuuuucuuag

SEQ ID NO: 1163684 - RNA, 18 nt, Human
gaaaacacuguucucugc

SEQ ID NO: 1163685 - RNA, 16 nt, Human
gaaacacaacuauauu

SEQ ID NO: 1163686 - RNA, 13 nt, Human
gaaacccagcucu

SEQ ID NO: 1163687 - RNA, 14 nt, Human
gaaacccagcucug

SEQ ID NO: 1163688 - RNA, 15 nt, Human
gaaacccagcucugg

SEQ ID NO: 1163689 - RNA, 16 nt, Human
gaaacccagcucuggu

SEQ ID NO: 1163690 - RNA, 18 nt, Human
gaaacccagcucuggucc

SEQ ID NO: 1163691 - RNA, 19 nt, Human
gaaacccagcucuggucca

SEQ ID NO: 1163692 - RNA, 23 nt, Human
gaaacccagcucugguccauaga

SEQ ID NO: 1163693 - RNA, 15 nt, Human
gaaacccccacacac

SEQ ID NO: 1163694 - RNA, 16 nt, Human
gaaacccccacacaca

SEQ ID NO: 1163695 - RNA, 17 nt, Human
gaaacccccacacacac

SEQ ID NO: 1163696 - RNA, 23 nt, Human
gaaacccccacacacacacacau

SEQ ID NO: 1163697 - RNA, 14 nt, Human
gaaacccugucucu

SEQ ID NO: 1163698 - RNA, 23 nt, Human
gaaacucguuaauuuguaguguu

SEQ ID NO: 1163699 - RNA, 19 nt, Human
gaaagacuuuuccaacccu

SEQ ID NO: 1163700 - RNA, 17 nt, Human
gaaagagaacuuccaga

SEQ ID NO: 1163701 - RNA, 21 nt, Human
gaaagaggaaugaaguacuca

SEQ ID NO: 1163702 - RNA, 15 nt, Human
gaaagaguaggaaga

SEQ ID NO: 1163703 - RNA, 16 nt, Human
gaaagaguaggaagac

SEQ ID NO: 1163704 - RNA, 17 nt, Human
gaaagcagaacagugau

SEQ ID NO: 1163705 - RNA, 22 nt, Human
gaaagcagaacagugauuacca

SEQ ID NO: 1163706 - RNA, 14 nt, Human
gaaagcagggacuu

SEQ ID NO: 1163707 - RNA, 17 nt, Human
gaaagcccugagcuuuc

SEQ ID NO: 1163708 - RNA, 21 nt, Human
gaaagcccugagcuuucugcu

SEQ ID NO: 1163709 - RNA, 22 nt, Human
gaaagcccugagcuuucugcua

SEQ ID NO: 1163710 - RNA, 17 nt, Human
gaaagcccugugcucca

SEQ ID NO: 1163711 - RNA, 21 nt, Human
gaaagcuugcccuggugccuc

SEQ ID NO: 1163712 - RNA, 21 nt, Human
gaaugcacaaacagaggccgc

SEQ ID NO: 1163713 - RNA, 18 nt, Human
gaaugaaccacaucuugc

SEQ ID NO: 1163714 - RNA, 11 nt, Human
gaaugcagugg

SEQ ID NO: 1163715 - RNA, 20 nt, Human
gaaugcacaaacagaggccg

SEQ ID NO: 1163716 - RNA, 12 nt, Human
gaaaggcuccag

SEQ ID NO: 1163717 - RNA, 20 nt, Human
gaauccagacccggcugcgu

SEQ ID NO: 1163718 - RNA, 13 nt, Human
gaaugucagugug

SEQ ID NO: 1163719 - RNA, 15 nt, Human
gaauguuugccucug

SEQ ID NO: 1163720 - RNA, 16 nt, Human
gaauugacccacaaga

SEQ ID NO: 1163721 - RNA, 21 nt, Human
gaauugacccacaagaaauga

SEQ ID NO: 1163722 - RNA, 16 nt, Human
gaauuggagcucgugg

SEQ ID NO: 1163723 - RNA, 22 nt, Human
gaauuucuuuugccguuauuaa

SEQ ID NO: 1163724 - RNA, 15 nt, Human
gaauuguaaggaaug

SEQ ID NO: 1163725 - RNA, 22 nt, Human
gacaacacucauugaccugagg

SEQ ID NO: 1163726 - RNA, 23 nt, Human
gacaacacucauugaccugaggc

SEQ ID NO: 1163727 - RNA, 19 nt, Human
gacaaugugaaaagaaaaa

SEQ ID NO: 1163728 - RNA, 20 nt, Human
gacaaugugaaaagaaaaau

SEQ ID NO: 1163729 - RNA, 22 nt, Human
gacaaugcaaaccaucauugaa

SEQ ID NO: 1163730 - RNA, 12 nt, Human
gacaaugugaaa

SEQ ID NO: 1163731 - RNA, 18 nt, Human
gacaaugugaaaagaaaa

SEQ ID NO: 1163732 - RNA, 16 nt, Human
gacaaggaaaaaauaa

SEQ ID NO: 1163733 - RNA, 21 nt, Human
gacaaggaugaucuaggaaga

SEQ ID NO: 1163734 - RNA, 18 nt, Human
gacaaggauugcuacugu

SEQ ID NO: 1163735 - RNA, 19 nt, Human
gacaaggauugcuacuguc

SEQ ID NO: 1163736 - RNA, 21 nt, Human
gacaaggauugcuacuguccu

SEQ ID NO: 1163737 - RNA, 16 nt, Human
gacacaagccuucggc

SEQ ID NO: 1163738 - RNA, 22 nt, Human
gacacaagccuucggcgccuua

SEQ ID NO: 1163739 - RNA, 19 nt, Human
gacacaggcccggcuccag

SEQ ID NO: 1163740 - RNA, 20 nt, Human
gacacaggcccggcuccagg

SEQ ID NO: 1163741 - RNA, 21 nt, Human
gacacaggcccggcuccaggc

SEQ ID NO: 1163742 - RNA, 14 nt, Human
gacacaugcaaggu

SEQ ID NO: 1163743 - RNA, 19 nt, Human
gacacaugcaaggucauuu

SEQ ID NO: 1163744 - RNA, 15 nt, Human
gacacauguccaaga

SEQ ID NO: 1163745 - RNA, 20 nt, Human
gacacauguccaagaagccc

SEQ ID NO: 1163746 - RNA, 23 nt, Human
gacacauguccaagaagcccagg

SEQ ID NO: 1163747 - RNA, 18 nt, Human
gacaugggaaaggggaag

SEQ ID NO: 1163748 - RNA, 16 nt, Human
gacaugggacauuugc

SEQ ID NO: 1163749 - RNA, 17 nt, Human
gacaugggacauuugcu

SEQ ID NO: 1163750 - RNA, 14 nt, Human
gaccacguuucuaa

SEQ ID NO: 1163751 - RNA, 16 nt, Human
gaccacguuucuaaag

SEQ ID NO: 1163752 - RNA, 21 nt, Human
gaccacugcagaagacaguau

SEQ ID NO: 1163753 - RNA, 21 nt, Human
gaccagacaccuugacagggc

SEQ ID NO: 1163754 - RNA, 11 nt, Human
gaccagagcug

SEQ ID NO: 1163755 - RNA, 18 nt, Human
gaccagagcugccaccug

SEQ ID NO: 1163756 - RNA, 19 nt, Human
gaccagagcugccaccugc

SEQ ID NO: 1163757 - RNA, 13 nt, Human
gaccagagcugcc

SEQ ID NO: 1163758 - RNA, 14 nt, Human
gaccagagcugcca

SEQ ID NO: 1163759 - RNA, 15 nt, Human
gaccagagcugccac

SEQ ID NO: 1163760 - RNA, 17 nt, Human
gaccagagcugccaccu

SEQ ID NO: 1163761 - RNA, 19 nt, Human
gaccauucuccaccugcca

SEQ ID NO: 1163762 - RNA, 20 nt, Human
gaccauucuccaccugccag

SEQ ID NO: 1163763 - RNA, 21 nt, Human
gaccauucuccaccugccagg

SEQ ID NO: 1163764 - RNA, 22 nt, Human
gaccauucuccaccugccaggg

SEQ ID NO: 1163765 - RNA, 16 nt, Human
gacccaaaaggcagaa

SEQ ID NO: 1163766 - RNA, 18 nt, Human
gacccaaaaggcagaagc

SEQ ID NO: 1163767 - RNA, 15 nt, Human
gacccacaagaaaug

SEQ ID NO: 1163768 - RNA, 22 nt, Human
gacccacaagaaaugaaagcag

SEQ ID NO: 1163769 - RNA, 14 nt, Human
gaccccuccaugug

SEQ ID NO: 1163770 - RNA, 18 nt, Human
gaccccuccaugugggcu

SEQ ID NO: 1163771 - RNA, 21 nt, Human
gaccccuccaugugggcuagu

SEQ ID NO: 1163772 - RNA, 23 nt, Human
gacccugaggcccagagggccug

SEQ ID NO: 1163773 - RNA, 12 nt, Human
gacccugcccug

SEQ ID NO: 1163774 - RNA, 12 nt, Human
gacccugucuca

SEQ ID NO: 1163775 - RNA, 19 nt, Human
gacccuuguggucccaccc

SEQ ID NO: 1163776 - RNA, 20 nt, Human
gacccuuguggucccacccc

SEQ ID NO: 1163777 - RNA, 21 nt, Human
gacccuuguggucccacccca

SEQ ID NO: 1163778 - RNA, 23 nt, Human
gacccugucucaaaaaaagaaaa

SEQ ID NO: 1163779 - RNA, 16 nt, Human
gaccgugaggccagag

SEQ ID NO: 1163780 - RNA, 17 nt, Human
gaccgugaggccagaga

SEQ ID NO: 1163781 - RNA, 18 nt, Human
gaccgugaggccagagac

SEQ ID NO: 1163782 - RNA, 19 nt, Human
gaccgugaggccagagaca

SEQ ID NO: 1163783 - RNA, 21 nt, Human
gacagagcaagugagacccug

SEQ ID NO: 1163784 - RNA, 14 nt, Human
gacagaggcagccc

SEQ ID NO: 1163785 - RNA, 16 nt, Human
gacagaggcagcccca

SEQ ID NO: 1163786 - RNA, 17 nt, Human
gacagaggcagccccau

SEQ ID NO: 1163787 - RNA, 15 nt, Human
gacagaggggguggc

SEQ ID NO: 1163788 - RNA, 18 nt, Human
gacagaggggguggccuc

SEQ ID NO: 1163789 - RNA, 19 nt, Human
gacagaggggguggccucc

SEQ ID NO: 1163790 - RNA, 21 nt, Human
gacagaggggguggccuccca

SEQ ID NO: 1163791 - RNA, 22 nt, Human
gacagaggggguggccucccaa

SEQ ID NO: 1163792 - RNA, 23 nt, Human
gacagaggggguggccucccaac

SEQ ID NO: 1163793 - RNA, 14 nt, Human
gacagagucucacu

SEQ ID NO: 1163794 - RNA, 20 nt, Human
gacagagugagacucugucu

SEQ ID NO: 1163795 - RNA, 22 nt, Human
gacagagugagacucugucuca

SEQ ID NO: 1163796 - RNA, 23 nt, Human
gacagaggcagccccauucugcc

SEQ ID NO: 1163797 - RNA, 14 nt, Human
gacagccacggcca

SEQ ID NO: 1163798 - RNA, 17 nt, Human
gacagccacggccaggc

SEQ ID NO: 1163799 - RNA, 18 nt, Human
gacagccacggccaggcc

SEQ ID NO: 1163800 - RNA, 19 nt, Human
gacagccacggccaggcca

SEQ ID NO: 1163801 - RNA, 20 nt, Human
gacagccacggccaggccag

SEQ ID NO: 1163802 - RNA, 21 nt, Human
gacagccacggccaggccaga

SEQ ID NO: 1163803 - RNA, 16 nt, Human
gacagcugccugggau

SEQ ID NO: 1163804 - RNA, 17 nt, Human
gacagcugccugggauc

SEQ ID NO: 1163805 - RNA, 18 nt, Human
gacagcugccugggaucc

SEQ ID NO: 1163806 - RNA, 21 nt, Human
gacagcugccugggaucccuc

SEQ ID NO: 1163807 - RNA, 14 nt, Human
gacaggaccaggga

SEQ ID NO: 1163808 - RNA, 15 nt, Human
gacaggaccagggau

SEQ ID NO: 1163809 - RNA, 23 nt, Human
gacaggaccagggauuuccauga

SEQ ID NO: 1163810 - RNA, 17 nt, Human
gacagggaggacgcucu

SEQ ID NO: 1163811 - RNA, 18 nt, Human
gacagggaggacgcucuc

SEQ ID NO: 1163812 - RNA, 16 nt, Human
gacagggaggugaccc

SEQ ID NO: 1163813 - RNA, 23 nt, Human
gacagggcacaccgggcacucag

SEQ ID NO: 1163814 - RNA, 24 nt, Human
gacagggcacaccgggcacucaga

SEQ ID NO: 1163815 - RNA, 14 nt, Human
gacaguuaagagaa

SEQ ID NO: 1163816 - RNA, 22 nt, Human
gacaguuaagagaaaugagcuu

SEQ ID NO: 1163817 - RNA, 20 nt, Human
gacauagaauuaacacauga

SEQ ID NO: 1163818 - RNA, 14 nt, Human
gacaugaucuucuu

SEQ ID NO: 1163819 - RNA, 14 nt, Human
gacaugggaaaggg

SEQ ID NO: 1163820 - RNA, 12 nt, Human
gacuccugcagg

SEQ ID NO: 1163821 - RNA, 14 nt, Human
gacuccugcaggca

SEQ ID NO: 1163822 - RNA, 13 nt, Human
gacuccugcaggc

SEQ ID NO: 1163823 - RNA, 13 nt, Human
gacucgcgacaau

SEQ ID NO: 1163824 - RNA, 18 nt, Human
gacuacaggugugaguca

SEQ ID NO: 1163825 - RNA, 21 nt, Human
gacuacaggugugagucacca

SEQ ID NO: 1163826 - RNA, 15 nt, Human
gacucauucuucugu

SEQ ID NO: 1163827 - RNA, 17 nt, Human
gacucgcgacaaugcaa

SEQ ID NO: 1163828 - RNA, 18 nt, Human
gacucgcgacaaugcaaa

SEQ ID NO: 1163829 - RNA, 21 nt, Human
gacugaguacguugugcauuu

SEQ ID NO: 1163830 - RNA, 22 nt, Human
gacugaguacguugugcauuug

SEQ ID NO: 1163831 - RNA, 23 nt, Human
gacugaguacguugugcauuugg

SEQ ID NO: 1163832 - RNA, 14 nt, Human
gacugcauuauauu

SEQ ID NO: 1163833 - RNA, 16 nt, Human
gacugcauuauauuua

SEQ ID NO: 1163834 - RNA, 24 nt, Human
gacugcauuauauuuauuacugua

SEQ ID NO: 1163835 - RNA, 13 nt, Human
gacugcccggcag

SEQ ID NO: 1163836 - RNA, 15 nt, Human
gacugcccggcaggg

SEQ ID NO: 1163837 - RNA, 14 nt, Human
gacuggaagcacag

SEQ ID NO: 1163838 - RNA, 15 nt, Human
gacuggaagcacagc

SEQ ID NO: 1163839 - RNA, 16 nt, Human
gacuggaagcacagcu

SEQ ID NO: 1163840 - RNA, 18 nt, Human
gacuggaagcacagcuuc

SEQ ID NO: 1163841 - RNA, 19 nt, Human
gacuuaagcacacuugaca

SEQ ID NO: 1163842 - RNA, 13 nt, Human
gacuuggaagcuc

SEQ ID NO: 1163843 - RNA, 11 nt, Human
gagaaaauaaa

SEQ ID NO: 1163844 - RNA, 12 nt, Human
gagaaaauaaaa

SEQ ID NO: 1163845 - RNA, 13 nt, Human
gagaaaauaaaaa

SEQ ID NO: 1163846 - RNA, 14 nt, Human
gagaaaauaaaaag

SEQ ID NO: 1163847 - RNA, 15 nt, Human
gagaaaauaaaaagu

SEQ ID NO: 1163848 - RNA, 16 nt, Human
gagaaaauaaaaaguu

SEQ ID NO: 1163849 - RNA, 17 nt, Human
gagaaaauaaaaaguua

SEQ ID NO: 1163850 - RNA, 16 nt, Human
gagaaagguugaagca

SEQ ID NO: 1163851 - RNA, 22 nt, Human
gagaaaguacuucuccacccug

SEQ ID NO: 1163852 - RNA, 14 nt, Human
gagaaaugagcuug

SEQ ID NO: 1163853 - RNA, 21 nt, Human
gagaaccuagggugauauuaa

SEQ ID NO: 1163854 - RNA, 22 nt, Human
gagaaccuagggugauauuaac

SEQ ID NO: 1163855 - RNA, 22 nt, Human
gagaacuuccagauccuggaaa

SEQ ID NO: 1163856 - RNA, 23 nt, Human
gagaacuuccagauccuggaaau

SEQ ID NO: 1163857 - RNA, 13 nt, Human
gagaagaacugaa

SEQ ID NO: 1163858 - RNA, 14 nt, Human
gagaagagaaugca

SEQ ID NO: 1163859 - RNA, 16 nt, Human
gagaagagaaugcaca

SEQ ID NO: 1163860 - RNA, 16 nt, Human
gagaagcagaggaagg

SEQ ID NO: 1163861 - RNA, 17 nt, Human
gagaaugagagacacac

SEQ ID NO: 1163862 - RNA, 19 nt, Human
gagaggggaacagacugga

SEQ ID NO: 1163863 - RNA, 13 nt, Human
gagaggggcacag

SEQ ID NO: 1163864 - RNA, 14 nt, Human
gagagggugggagu

SEQ ID NO: 1163865 - RNA, 16 nt, Human
gagagggugggagugg

SEQ ID NO: 1163866 - RNA, 20 nt, Human
gagagggugggagugggccc

SEQ ID NO: 1163867 - RNA, 16 nt, Human
gagagaaaauaaaaag

SEQ ID NO: 1163868 - RNA, 17 nt, Human
gagagaaaauaaaaagu

SEQ ID NO: 1163869 - RNA, 18 nt, Human
gagagaaaauaaaaaguu

SEQ ID NO: 1163870 - RNA, 19 nt, Human
gagagaaaauaaaaaguua

SEQ ID NO: 1163871 - RNA, 20 nt, Human
gagagaaaauaaaaaguuaa

SEQ ID NO: 1163872 - RNA, 21 nt, Human
gagagaaaauaaaaaguuaaa

SEQ ID NO: 1163873 - RNA, 19 nt, Human
gagacuccugcaggcagcc

SEQ ID NO: 1163874 - RNA, 20 nt, Human
gagacuccugcaggcagcca

SEQ ID NO: 1163875 - RNA, 21 nt, Human
gagacuccugcaggcagccag

SEQ ID NO: 1163876 - RNA, 20 nt, Human
gagacucgcgacaaugcaaa

SEQ ID NO: 1163877 - RNA, 21 nt, Human
gagacucgcgacaaugcaaac

SEQ ID NO: 1163878 - RNA, 22 nt, Human
gagacuccugcaggcagccagg

SEQ ID NO: 1163879 - RNA, 13 nt, Human
gagacucugucuc

SEQ ID NO: 1163880 - RNA, 20 nt, Human
gagaaugagagacacacuga

SEQ ID NO: 1163881 - RNA, 21 nt, Human
gagaaugagagacacacugaa

SEQ ID NO: 1163882 - RNA, 23 nt, Human
gagaaugcacaaacagaggccgc

SEQ ID NO: 1163883 - RNA, 20 nt, Human
gagacagcucugcauacuca

SEQ ID NO: 1163884 - RNA, 22 nt, Human
gagacaggguuuugccauguug

SEQ ID NO: 1163885 - RNA, 14 nt, Human
gagaccaucccuga

SEQ ID NO: 1163886 - RNA, 18 nt, Human
gagaccaucccugaaggc

SEQ ID NO: 1163887 - RNA, 21 nt, Human
gagaccaucccugaaggcccc

SEQ ID NO: 1163888 - RNA, 14 nt, Human
gagauagccaaggc

SEQ ID NO: 1163889 - RNA, 16 nt, Human
gagauagccaaggcca

SEQ ID NO: 1163890 - RNA, 19 nt, Human
gagauagccaaggccaaag

SEQ ID NO: 1163891 - RNA, 18 nt, Human
gagaucacgccacugcac

SEQ ID NO: 1163892 - RNA, 19 nt, Human
gagaucacgccacugcacu

SEQ ID NO: 1163893 - RNA, 18 nt, Human
gagcaagacgcugugcug

SEQ ID NO: 1163894 - RNA, 20 nt, Human
gagcaccuuagacagucccu

SEQ ID NO: 1163895 - RNA, 21 nt, Human
gagcaccuuagacagucccug

SEQ ID NO: 1163896 - RNA, 22 nt, Human
gagcaccuuagacagucccugc

SEQ ID NO: 1163897 - RNA, 15 nt, Human
gagcacuaaggugug

SEQ ID NO: 1163898 - RNA, 21 nt, Human
gagcacuaaggugugcucuga

SEQ ID NO: 1163899 - RNA, 19 nt, Human
gagccaauuuaaagaaaac

SEQ ID NO: 1163900 - RNA, 16 nt, Human
gagcagagaauucucu

SEQ ID NO: 1163901 - RNA, 12 nt, Human
gagcagagacca

SEQ ID NO: 1163902 - RNA, 16 nt, Human
gagcagagaccauccc

SEQ ID NO: 1163903 - RNA, 23 nt, Human
gagccagauuucacucuccuugg

SEQ ID NO: 1163904 - RNA, 19 nt, Human
gagccagggucucacuaug

SEQ ID NO: 1163905 - RNA, 13 nt, Human
gaggaucucuuga

SEQ ID NO: 1163906 - RNA, 16 nt, Human
gaggaucucuugagcc

SEQ ID NO: 1163907 - RNA, 19 nt, Human
gaggaucucuugagccugg

SEQ ID NO: 1163908 - RNA, 22 nt, Human
gaggaucucuugagccugggag

SEQ ID NO: 1163909 - RNA, 20 nt, Human
gaggauugcuugagcucagg

SEQ ID NO: 1163910 - RNA, 19 nt, Human
gaggcagagguugcaguga

SEQ ID NO: 1163911 - RNA, 19 nt, Human
gaggcagccccauucugcc

SEQ ID NO: 1163912 - RNA, 20 nt, Human
gaggcagccccauucugccu

SEQ ID NO: 1163913 - RNA, 9 nt, Human
gaggcaggg

SEQ ID NO: 1163914 - RNA, 21 nt, Human
gaggcagccccauucugccug

SEQ ID NO: 1163915 - RNA, 14 nt, Human
gaggccaugggccu

SEQ ID NO: 1163916 - RNA, 17 nt, Human
gaggccaugggccuccu

SEQ ID NO: 1163917 - RNA, 18 nt, Human
gaggccaugggccuccug

SEQ ID NO: 1163918 - RNA, 20 nt, Human
gaggccaugggccuccugug

SEQ ID NO: 1163919 - RNA, 21 nt, Human
gaggccaugggccuccugugu

SEQ ID NO: 1163920 - RNA, 23 nt, Human
gaggccaugggccuccugugugu

SEQ ID NO: 1163921 - RNA, 11 nt, Human
gaggcccagag

SEQ ID NO: 1163922 - RNA, 13 nt, Human
gaggcccagaggg

SEQ ID NO: 1163923 - RNA, 14 nt, Human
gaggcccagagggc

SEQ ID NO: 1163924 - RNA, 15 nt, Human
gaggcccagagggcc

SEQ ID NO: 1163925 - RNA, 16 nt, Human
gaggcccagagggccu

SEQ ID NO: 1163926 - RNA, 19 nt, Human
gaggcccagagggccugca

SEQ ID NO: 1163927 - RNA, 15 nt, Human
gaggcccuucucucc

SEQ ID NO: 1163928 - RNA, 20 nt, Human
gaggcccuucucuccagccc

SEQ ID NO: 1163929 - RNA, 21 nt, Human
gaggcccuucucuccagcccc

SEQ ID NO: 1163930 - RNA, 22 nt, Human
gaggcccuucucuccagccccu

SEQ ID NO: 1163931 - RNA, 16 nt, Human
gaggccuucucugaag

SEQ ID NO: 1163932 - RNA, 18 nt, Human
gaggccuucucugaagga

SEQ ID NO: 1163933 - RNA, 19 nt, Human
gaggccuucucugaaggac

SEQ ID NO: 1163934 - RNA, 20 nt, Human
gagggagggcuccagacaca

SEQ ID NO: 1163935 - RNA, 14 nt, Human
gagggagguaagga

SEQ ID NO: 1163936 - RNA, 18 nt, Human
gagggagugacagaggca

SEQ ID NO: 1163937 - RNA, 21 nt, Human
gagggagugacagaggcagcc

SEQ ID NO: 1163938 - RNA, 22 nt, Human
gagggagugacagaggcagccc

SEQ ID NO: 1163939 - RNA, 20 nt, Human
gaggcugggcucccuuccca

SEQ ID NO: 1163940 - RNA, 19 nt, Human
gagggagggcuccagacac

SEQ ID NO: 1163941 - RNA, 14 nt, Human
gagggcacagaaaa

SEQ ID NO: 1163942 - RNA, 17 nt, Human
gaggggguggccuccca

SEQ ID NO: 1163943 - RNA, 13 nt, Human
gaggguaaggcug

SEQ ID NO: 1163944 - RNA, 13 nt, Human
gagggucugagga

SEQ ID NO: 1163945 - RNA, 14 nt, Human
gagggucugaggaa

SEQ ID NO: 1163946 - RNA, 21 nt, Human
gagggugaagugaagacaaug

SEQ ID NO: 1163947 - RNA, 12 nt, Human
gaggguggaaua

SEQ ID NO: 1163948 - RNA, 15 nt, Human
gagggugggaguggg

SEQ ID NO: 1163949 - RNA, 14 nt, Human
gaggguggugaccu

SEQ ID NO: 1163950 - RNA, 21 nt, Human
gaggguggugaccucugccug

SEQ ID NO: 1163951 - RNA, 22 nt, Human
gagggugucccaaaaagaaagg

SEQ ID NO: 1163952 - RNA, 14 nt, Human
gaggguugggcugg

SEQ ID NO: 1163953 - RNA, 15 nt, Human
gaggguugggcuggu

SEQ ID NO: 1163954 - RNA, 21 nt, Human
gagguaaggaauaccuguccc

SEQ ID NO: 1163955 - RNA, 24 nt, Human
gagguaaggaauaccugucccccu

SEQ ID NO: 1163956 - RNA, 17 nt, Human
gaggucaaggcugcagu

SEQ ID NO: 1163957 - RNA, 12 nt, Human
gaggucagagcc

SEQ ID NO: 1163958 - RNA, 13 nt, Human
gaggucagagccu

SEQ ID NO: 1163959 - RNA, 22 nt, Human
gauaaauggcuuccuggcaaua

SEQ ID NO: 1163960 - RNA, 15 nt, Human
gaguugaagacagag

SEQ ID NO: 1163961 - RNA, 17 nt, Human
gaguugaagacagagcu

SEQ ID NO: 1163962 - RNA, 21 nt, Human
gaguugaagacagagcuacac

SEQ ID NO: 1163963 - RNA, 13 nt, Human
gaguuacagacaa

SEQ ID NO: 1163964 - RNA, 15 nt, Human
gaguuacagacaaag

SEQ ID NO: 1163965 - RNA, 14 nt, Human
gaguucaucuugaa

SEQ ID NO: 1163966 - RNA, 19 nt, Human
gaguucaucuugaauugua

SEQ ID NO: 1163967 - RNA, 20 nt, Human
gaguucaucuugaauuguaa

SEQ ID NO: 1163968 - RNA, 17 nt, Human
gagugacagaggcagcc

SEQ ID NO: 1163969 - RNA, 13 nt, Human
gagugggugaaua

SEQ ID NO: 1163970 - RNA, 20 nt, Human
gagugugccugaagucccag

SEQ ID NO: 1163971 - RNA, 12 nt, Human
gaguuacagaca

SEQ ID NO: 1163972 - RNA, 22 nt, Human
gauaagaaccuuuugagugccu

SEQ ID NO: 1163973 - RNA, 20 nt, Human
gauacaggaaaagcugcuga

SEQ ID NO: 1163974 - RNA, 21 nt, Human
gauacaggaaaagcugcugac

SEQ ID NO: 1163975 - RNA, 23 nt, Human
gauacaggaaaagcugcugacag

SEQ ID NO: 1163976 - RNA, 15 nt, Human
gauagcacagacccu

SEQ ID NO: 1163977 - RNA, 16 nt, Human
gauagcacagacccug

SEQ ID NO: 1163978 - RNA, 22 nt, Human
gauagccaaggccaaaggaagc

SEQ ID NO: 1163979 - RNA, 15 nt, Human
gaucacggcucacug

SEQ ID NO: 1163980 - RNA, 16 nt, Human
gaucacggcucacugc

SEQ ID NO: 1163981 - RNA, 18 nt, Human
gaucacggcucacugcag

SEQ ID NO: 1163982 - RNA, 14 nt, Human
gaucacagccucug

SEQ ID NO: 1163983 - RNA, 20 nt, Human
gaucacggcucacugcagcc

SEQ ID NO: 1163984 - RNA, 17 nt, Human
gaggucagagccugcag

SEQ ID NO: 1163985 - RNA, 20 nt, Human
gaggucagagccugcaguua

SEQ ID NO: 1163986 - RNA, 15 nt, Human
gagguugggaggcca

SEQ ID NO: 1163987 - RNA, 17 nt, Human
gagguugggaggccauu

SEQ ID NO: 1163988 - RNA, 16 nt, Human
gagguuucaaaccucc

SEQ ID NO: 1163989 - RNA, 21 nt, Human
gaguacuacaguccucccauc

SEQ ID NO: 1163990 - RNA, 23 nt, Human
gaguacuacaguccucccaucuc

SEQ ID NO: 1163991 - RNA, 22 nt, Human
gaguagcugggacuacaggcac

SEQ ID NO: 1163992 - RNA, 12 nt, Human
gaguaggaagac

SEQ ID NO: 1163993 - RNA, 13 nt, Human
gaguaggaagacu

SEQ ID NO: 1163994 - RNA, 17 nt, Human
gaguaggaagacuuugg

SEQ ID NO: 1163995 - RNA, 18 nt, Human
gaguaggaagacuuugga

SEQ ID NO: 1163996 - RNA, 19 nt, Human
gaguaggaagacuuuggaa

SEQ ID NO: 1163997 - RNA, 11 nt, Human
gaguauauguc

SEQ ID NO: 1163998 - RNA, 19 nt, Human
gaguccgaaagggacuugg

SEQ ID NO: 1163999 - RNA, 14 nt, Human
gagucgaggacagg

SEQ ID NO: 1164000 - RNA, 15 nt, Human
gagucgaggacaggg

SEQ ID NO: 1164001 - RNA, 16 nt, Human
gagucgaggacaggga

SEQ ID NO: 1164002 - RNA, 19 nt, Human
gagucucacuguugcccag

SEQ ID NO: 1164003 - RNA, 12 nt, Human
gagucugaaggc

SEQ ID NO: 1164004 - RNA, 13 nt, Human
gagucugaaggcu

SEQ ID NO: 1164005 - RNA, 14 nt, Human
gagucugaaggcug

SEQ ID NO: 1164006 - RNA, 15 nt, Human
gagucugaaggcugg

SEQ ID NO: 1164007 - RNA, 17 nt, Human
gagugaagcugggagaa

SEQ ID NO: 1164008 - RNA, 14 nt, Human
gagugacagaggca

SEQ ID NO: 1164009 - RNA, 15 nt, Human
gagugacagaggcag

SEQ ID NO: 1164010 - RNA, 16 nt, Human
gagugacagaggcagc

SEQ ID NO: 1164011 - RNA, 20 nt, Human
gaugcuagaacucccuuuca

SEQ ID NO: 1164012 - RNA, 22 nt, Human
gaugcuagaacucccuuucaac

SEQ ID NO: 1164013 - RNA, 19 nt, Human
gaugcccaaagaugcagcc

SEQ ID NO: 1164014 - RNA, 20 nt, Human
gaugcccaaagaugcagccg

SEQ ID NO: 1164015 - RNA, 22 nt, Human
gauggccgggcgcgguggcuca

SEQ ID NO: 1164016 - RNA, 20 nt, Human
gaugggcaacccccagccug

SEQ ID NO: 1164017 - RNA, 21 nt, Human
gaugggcaacccccagccugc

SEQ ID NO: 1164018 - RNA, 22 nt, Human
gaugggcaacccccagccugcu

SEQ ID NO: 1164019 - RNA, 13 nt, Human
gauggggcugcac

SEQ ID NO: 1164020 - RNA, 15 nt, Human
gauggggcugcaccg

SEQ ID NO: 1164021 - RNA, 19 nt, Human
gauggggcugcaccggcug

SEQ ID NO: 1164022 - RNA, 19 nt, Human
gaugggugcuuggaggaag

SEQ ID NO: 1164023 - RNA, 22 nt, Human
gaugguucccuugaugaagaag

SEQ ID NO: 1164024 - RNA, 12 nt, Human
gauggugcaaug

SEQ ID NO: 1164025 - RNA, 14 nt, Human
gauggugcaaugac

SEQ ID NO: 1164026 - RNA, 15 nt, Human
gauggugcaaugacc

SEQ ID NO: 1164027 - RNA, 16 nt, Human
gauggugcaaugaccu

SEQ ID NO: 1164028 - RNA, 17 nt, Human
gauggugcaaugaccuu

SEQ ID NO: 1164029 - RNA, 23 nt, Human
gauuacaagcgugagccacugca

SEQ ID NO: 1164030 - RNA, 15 nt, Human
gauuaaacuuaaucu

SEQ ID NO: 1164031 - RNA, 22 nt, Human
gauuacaagcgugagccacugc

SEQ ID NO: 1164032 - RNA, 20 nt, Human
gauuacaggugugaaccacc

SEQ ID NO: 1164033 - RNA, 14 nt, Human
gauucuccugccuc

SEQ ID NO: 1164034 - RNA, 15 nt, Human
gauugcaacaggcug

SEQ ID NO: 1164035 - RNA, 15 nt, Human
gauuuaacagaaaug

SEQ ID NO: 1164036 - RNA, 22 nt, Human
gauuuccguuaaaauaccagcc

SEQ ID NO: 1164037 - RNA, 16 nt, Human
gauuuaacagaaaugu

SEQ ID NO: 1164038 - RNA, 13 nt, Human
gauuuaacagaaa

SEQ ID NO: 1164039 - RNA, 14 nt, Human
gauuuaacagaaau

SEQ ID NO: 1164040 - RNA, 16 nt, Human
gcaaauugucacagga

SEQ ID NO: 1164041 - RNA, 15 nt, Human
gcaaaccaucauuga

SEQ ID NO: 1164042 - RNA, 21 nt, Human
gauuuugaaauuuuuauuaaa

SEQ ID NO: 1164043 - RNA, 19 nt, Human
gauuuugauccaagcuggu

SEQ ID NO: 1164044 - RNA, 12 nt, Human
gcaaaccaucau

SEQ ID NO: 1164045 - RNA, 14 nt, Human
gcacaaacagaggc

SEQ ID NO: 1164046 - RNA, 15 nt, Human
gcacaaacagaggcc

SEQ ID NO: 1164047 - RNA, 16 nt, Human
gcacaaacagaggccg

SEQ ID NO: 1164048 - RNA, 14 nt, Human
gcaacucaucuuag

SEQ ID NO: 1164049 - RNA, 15 nt, Human
gcaauggcagccuug

SEQ ID NO: 1164050 - RNA, 14 nt, Human
gcaaugugauaaaa

SEQ ID NO: 1164051 - RNA, 15 nt, Human
gcacaagcuccaagc

SEQ ID NO: 1164052 - RNA, 17 nt, Human
gcacaagcuccaagcuc

SEQ ID NO: 1164053 - RNA, 18 nt, Human
gcacaagcuccaagcucc

SEQ ID NO: 1164054 - RNA, 21 nt, Human
gcacaagcuccaagcucccag

SEQ ID NO: 1164055 - RNA, 20 nt, Human
gcacagaaaauggaagacag

SEQ ID NO: 1164056 - RNA, 21 nt, Human
gcacagaaaauggaagacagc

SEQ ID NO: 1164057 - RNA, 22 nt, Human
gcacagaaaauggaagacagcu

SEQ ID NO: 1164058 - RNA, 23 nt, Human
gcacagaaaauggaagacagcuc

SEQ ID NO: 1164059 - RNA, 14 nt, Human
gcacagacccugcc

SEQ ID NO: 1164060 - RNA, 15 nt, Human
gcacagacccugccc

SEQ ID NO: 1164061 - RNA, 16 nt, Human
gcacagacccugcccu

SEQ ID NO: 1164062 - RNA, 17 nt, Human
gcacagacccugcccug

SEQ ID NO: 1164063 - RNA, 18 nt, Human
gcacagacccugcccugu

SEQ ID NO: 1164064 - RNA, 19 nt, Human
gcacagacccugcccugug

SEQ ID NO: 1164065 - RNA, 20 nt, Human
gcacagacccugcccugugg

SEQ ID NO: 1164066 - RNA, 21 nt, Human
gcacagacccugcccuguggg

SEQ ID NO: 1164067 - RNA, 22 nt, Human
gcacagacccugcccugugggc

SEQ ID NO: 1164068 - RNA, 15 nt, Human
gcacagaguuguuac

SEQ ID NO: 1164069 - RNA, 16 nt, Human
gcacagaguuguuaca

SEQ ID NO: 1164070 - RNA, 18 nt, Human
gcacagaguuguuacauu

SEQ ID NO: 1164071 - RNA, 19 nt, Human
gcacagaguuguuacauuu

SEQ ID NO: 1164072 - RNA, 21 nt, Human
gcacagaguuguuacauuuuu

SEQ ID NO: 1164073 - RNA, 22 nt, Human
gcacagaguuguuacauuuuua

SEQ ID NO: 1164074 - RNA, 12 nt, Human
gcaccauaacuu

SEQ ID NO: 1164075 - RNA, 20 nt, Human
gcaccuuagacagucccugc

SEQ ID NO: 1164076 - RNA, 21 nt, Human
gcaccuuagacagucccugcc

SEQ ID NO: 1164077 - RNA, 15 nt, Human
gcacgauuucuguuu

SEQ ID NO: 1164078 - RNA, 16 nt, Human
gcacgauuucuguuua

SEQ ID NO: 1164079 - RNA, 23 nt, Human
gcacugcuuccagugaggcucug

SEQ ID NO: 1164080 - RNA, 19 nt, Human
gcacuguggguagacacac

SEQ ID NO: 1164081 - RNA, 12 nt, Human
gcagacaggcaa

SEQ ID NO: 1164082 - RNA, 13 nt, Human
gcagacaggcaag

SEQ ID NO: 1164083 - RNA, 14 nt, Human
gcagacaggcaagc

SEQ ID NO: 1164084 - RNA, 15 nt, Human
gcagacucuacagag

SEQ ID NO: 1164085 - RNA, 17 nt, Human
gcagacucuacagaggc

SEQ ID NO: 1164086 - RNA, 13 nt, Human
gccccugccaccc

SEQ ID NO: 1164087 - RNA, 14 nt, Human
gccccugccacccu

SEQ ID NO: 1164088 - RNA, 15 nt, Human
gccccugccacccug

SEQ ID NO: 1164089 - RNA, 16 nt, Human
gccccugccacccugg

SEQ ID NO: 1164090 - RNA, 21 nt, Human
gccccuguucuggcagaguug

SEQ ID NO: 1164091 - RNA, 12 nt, Human
gcccggcuccag

SEQ ID NO: 1164092 - RNA, 16 nt, Human
gcccggcuccaggcuc

SEQ ID NO: 1164093 - RNA, 17 nt, Human
gcccggcuccaggcucc

SEQ ID NO: 1164094 - RNA, 18 nt, Human
gcccggcuccaggcuccu

SEQ ID NO: 1164095 - RNA, 12 nt, Human
gcccucugccca

SEQ ID NO: 1164096 - RNA, 16 nt, Human
gcccugagcuuucugc

SEQ ID NO: 1164097 - RNA, 14 nt, Human
gcccugguggcagu

SEQ ID NO: 1164098 - RNA, 17 nt, Human
gcccugguggcaguggg

SEQ ID NO: 1164099 - RNA, 18 nt, Human
gcccugguggcaguggga

SEQ ID NO: 1164100 - RNA, 19 nt, Human
gcccugguggcagugggag

SEQ ID NO: 1164101 - RNA, 20 nt, Human
gcccugguggcagugggagc

SEQ ID NO: 1164102 - RNA, 21 nt, Human
gcccugguggcagugggagcu

SEQ ID NO: 1164103 - RNA, 22 nt, Human
gcccugguggcagugggagcug

SEQ ID NO: 1164104 - RNA, 23 nt, Human
gcccugguggcagugggagcugc

SEQ ID NO: 1164105 - RNA, 19 nt, Human
gcccuucucuccagccccu

SEQ ID NO: 1164106 - RNA, 23 nt, Human
gcccuucucuccagccccuggau

SEQ ID NO: 1164107 - RNA, 21 nt, Human
gcccuucucuccagccccugg

SEQ ID NO: 1164108 - RNA, 22 nt, Human
gcccuucucuccagccccugga

SEQ ID NO: 1164109 - RNA, 16 nt, Human
gccgagaucacgccac

SEQ ID NO: 1164110 - RNA, 18 nt, Human
gccgagaucacgccacug

SEQ ID NO: 1164111 - RNA, 19 nt, Human
gccgagaucacgccacugc

SEQ ID NO: 1164112 - RNA, 18 nt, Human
gccgagauugcaccacug

SEQ ID NO: 1164113 - RNA, 17 nt, Human
gccuaagugcagccccg

SEQ ID NO: 1164114 - RNA, 22 nt, Human
gccuauauuuuuuguuaaauga

SEQ ID NO: 1164115 - RNA, 14 nt, Human
gccucaaccuccug

SEQ ID NO: 1164116 - RNA, 16 nt, Human
gccucaaccuccuggg

SEQ ID NO: 1164117 - RNA, 17 nt, Human
gccucaaccuccugggc

SEQ ID NO: 1164118 - RNA, 19 nt, Human
gccucaagugauucuccug

SEQ ID NO: 1164119 - RNA, 20 nt, Human
gccucaagugauucuccugc

SEQ ID NO: 1164120 - RNA, 21 nt, Human
gccucaagugauucuccugcc

SEQ ID NO: 1164121 - RNA, 23 nt, Human
gccucagccucccaaagugcugg

SEQ ID NO: 1164122 - RNA, 22 nt, Human
gccucaagugauucuccugccu

SEQ ID NO: 1164123 - RNA, 12 nt, Human
gccucagugcca

SEQ ID NO: 1164124 - RNA, 14 nt, Human
gccucagugccacu

SEQ ID NO: 1164125 - RNA, 17 nt, Human
gccucccgaguagcugg

SEQ ID NO: 1164126 - RNA, 23 nt, Human
gccucccgaauagcugggacuac

SEQ ID NO: 1164127 - RNA, 15 nt, Human
gccucccgaguagcu

SEQ ID NO: 1164128 - RNA, 15 nt, Human
gccucagugccacua

SEQ ID NO: 1164129 - RNA, 22 nt, Human
gccucccaacucaccccagccc

SEQ ID NO: 1164130 - RNA, 23 nt, Human
gccucccaacucaccccagcccc

SEQ ID NO: 1164131 - RNA, 14 nt, Human
gccucccacgacug

SEQ ID NO: 1164132 - RNA, 21 nt, Human
gccucccacgacugcccggca

SEQ ID NO: 1164133 - RNA, 22 nt, Human
gccugaagucacacagugaguc

SEQ ID NO: 1164134 - RNA, 15 nt, Human
gccugcuccagcugu

SEQ ID NO: 1164135 - RNA, 16 nt, Human
gccugcuccagcuguu

SEQ ID NO: 1164136 - RNA, 18 nt, Human
gccugcuccagcuguuca

SEQ ID NO: 1164137 - RNA, 16 nt, Human
gccuggauggggcugc

SEQ ID NO: 1164138 - RNA, 14 nt, Human
gccuggauggggcu

SEQ ID NO: 1164139 - RNA, 15 nt, Human
gccuggauggggcug

SEQ ID NO: 1164140 - RNA, 14 nt, Human
gccuggccagaugc

SEQ ID NO: 1164141 - RNA, 15 nt, Human
gccuggccagaugca

SEQ ID NO: 1164142 - RNA, 16 nt, Human
gccuggccagaugcac

SEQ ID NO: 1164143 - RNA, 15 nt, Human
gccugggcagaagga

SEQ ID NO: 1164144 - RNA, 16 nt, Human
gccugggcagaaggaa

SEQ ID NO: 1164145 - RNA, 17 nt, Human
gccugggcagaaggaag

SEQ ID NO: 1164146 - RNA, 18 nt, Human
gccugggcagaaggaaga

SEQ ID NO: 1164147 - RNA, 20 nt, Human
gccugggggcugggcagagg

SEQ ID NO: 1164148 - RNA, 21 nt, Human
gccugggggcugggcagagga

SEQ ID NO: 1164149 - RNA, 15 nt, Human
gcgggcuuccuccug

SEQ ID NO: 1164150 - RNA, 12 nt, Human
gcggggacagcu

SEQ ID NO: 1164151 - RNA, 13 nt, Human
gcggggacagcuc

SEQ ID NO: 1164152 - RNA, 16 nt, Human
gcgguccacccaggag

SEQ ID NO: 1164153 - RNA, 18 nt, Human
gcgguccacccaggagcc

SEQ ID NO: 1164154 - RNA, 19 nt, Human
gcgguccacccaggagccc

SEQ ID NO: 1164155 - RNA, 20 nt, Human
gcgguccacccaggagcccc

SEQ ID NO: 1164156 - RNA, 18 nt, Human
gcgugagccacugcaccg

SEQ ID NO: 1164157 - RNA, 23 nt, Human
gcgugagccacugcaccgggcca

SEQ ID NO: 1164158 - RNA, 13 nt, Human
gcuaaaugugaau

SEQ ID NO: 1164159 - RNA, 16 nt, Human
gcuaaaugugaaugau

SEQ ID NO: 1164160 - RNA, 14 nt, Human
gcuaacauggaagu

SEQ ID NO: 1164161 - RNA, 22 nt, Human
gcuaagagggagggagggcucc

SEQ ID NO: 1164162 - RNA, 14 nt, Human
gcuaagcauuccaa

SEQ ID NO: 1164163 - RNA, 23 nt, Human
gcuaagagggagggagggcucca

SEQ ID NO: 1164164 - RNA, 17 nt, Human
gcuaagcaaaaugugau

SEQ ID NO: 1164165 - RNA, 14 nt, Human
gcuacccgggaagg

SEQ ID NO: 1164166 - RNA, 15 nt, Human
gcuacccgggaaggg

SEQ ID NO: 1164167 - RNA, 21 nt, Human
gcuacccgggaagggggcugg

SEQ ID NO: 1164168 - RNA, 18 nt, Human
gcuagagguucaaagaua

SEQ ID NO: 1164169 - RNA, 19 nt, Human
gcuagagguucaaagauau

SEQ ID NO: 1164170 - RNA, 21 nt, Human
gcuagagguucaaagauauuu

SEQ ID NO: 1164171 - RNA, 16 nt, Human
gcuaucucccccagcc

SEQ ID NO: 1164172 - RNA, 17 nt, Human
gcuaucucccccagccc

SEQ ID NO: 1164173 - RNA, 18 nt, Human
gcuaucucccccagcccc

SEQ ID NO: 1164174 - RNA, 19 nt, Human
gcuaucucccccagcccca

SEQ ID NO: 1164175 - RNA, 20 nt, Human
gcuaucucccccagccccau

SEQ ID NO: 1164176 - RNA, 21 nt, Human
gcuaucucccccagccccauc

SEQ ID NO: 1164177 - RNA, 22 nt, Human
gcuaucucccccagccccaucc

SEQ ID NO: 1164178 - RNA, 23 nt, Human
gcuaucucccccagccccauccu

SEQ ID NO: 1164179 - RNA, 19 nt, Human
gcucaggugucccugcacu

SEQ ID NO: 1164180 - RNA, 15 nt, Human
gcucagcggggacag

SEQ ID NO: 1164181 - RNA, 16 nt, Human
gcucagcggggacagc

SEQ ID NO: 1164182 - RNA, 20 nt, Human
gcucagcggggacagcuccu

SEQ ID NO: 1164183 - RNA, 21 nt, Human
gcucagcggggacagcuccuu

SEQ ID NO: 1164184 - RNA, 22 nt, Human
gcucagcggggacagcuccuuc

SEQ ID NO: 1164185 - RNA, 18 nt, Human
gcucaggugucccugcac

SEQ ID NO: 1164186 - RNA, 19 nt, Human
gcucaccagccccagugcc

SEQ ID NO: 1164187 - RNA, 20 nt, Human
gcucaccagccccagugccc

SEQ ID NO: 1164188 - RNA, 23 nt, Human
gcucaccagccccagugcccaca

SEQ ID NO: 1164189 - RNA, 14 nt, Human
gcucaccucucccu

SEQ ID NO: 1164190 - RNA, 17 nt, Human
gcucagcaaaagaugcu

SEQ ID NO: 1164191 - RNA, 20 nt, Human
gcucagcaaaagaugcuucu

SEQ ID NO: 1164192 - RNA, 22 nt, Human
gcucagcaaaagaugcuucuca

SEQ ID NO: 1164193 - RNA, 23 nt, Human
gcucagcaaaagaugcuucucac

SEQ ID NO: 1164194 - RNA, 13 nt, Human
gcuccaagcuccc

SEQ ID NO: 1164195 - RNA, 14 nt, Human
gcuccaagcuccca

SEQ ID NO: 1164196 - RNA, 15 nt, Human
gcuccaagcucccag

SEQ ID NO: 1164197 - RNA, 21 nt, Human
gcuccaagcucccaggcauuc

SEQ ID NO: 1164198 - RNA, 16 nt, Human
gcuccaagcucccagg

SEQ ID NO: 1164199 - RNA, 17 nt, Human
gcuccaagcucccaggc

SEQ ID NO: 1164200 - RNA, 18 nt, Human
gcuccaagcucccaggca

SEQ ID NO: 1164201 - RNA, 19 nt, Human
gcuccaagcucccaggcau

SEQ ID NO: 1164202 - RNA, 15 nt, Human
gcuccauggcugcca

SEQ ID NO: 1164203 - RNA, 20 nt, Human
gcuccagcuguucagcuggu

SEQ ID NO: 1164204 - RNA, 24 nt, Human
gcuccaggcuccuuuagcgcccag

SEQ ID NO: 1164205 - RNA, 11 nt, Human
gcuccagcugu

SEQ ID NO: 1164206 - RNA, 16 nt, Human
gcuccaggcuccuuua

SEQ ID NO: 1164207 - RNA, 23 nt, Human
gcuccaggcuccuuuagcgccca

SEQ ID NO: 1164208 - RNA, 20 nt, Human
gcuccauuuuuagugaaaua

SEQ ID NO: 1164209 - RNA, 19 nt, Human
gcucuccgaccagacaccu

SEQ ID NO: 1164210 - RNA, 13 nt, Human
gcucuccgaccag

SEQ ID NO: 1164211 - RNA, 17 nt, Human
gcucuccgaccagacac

SEQ ID NO: 1164212 - RNA, 11 nt, Human
gcucucuggcc

SEQ ID NO: 1164213 - RNA, 12 nt, Human
gcucucuggccu

SEQ ID NO: 1164214 - RNA, 13 nt, Human
gcucucuggccuu

SEQ ID NO: 1164215 - RNA, 15 nt, Human
gcucccuucccaccu

SEQ ID NO: 1164216 - RNA, 16 nt, Human
gcucccuucccaccuc

SEQ ID NO: 1164217 - RNA, 18 nt, Human
gcucccuucccaccucuc

SEQ ID NO: 1164218 - RNA, 19 nt, Human
gcucccuucccaccucucu

SEQ ID NO: 1164219 - RNA, 21 nt, Human
gcuccuucuguccuacucugu

SEQ ID NO: 1164220 - RNA, 16 nt, Human
gcucgagcaugccugg

SEQ ID NO: 1164221 - RNA, 17 nt, Human
gcucgagcaugccugga

SEQ ID NO: 1164222 - RNA, 14 nt, Human
gcucucuggccuuc

SEQ ID NO: 1164223 - RNA, 15 nt, Human
gcucucuggccuucg

SEQ ID NO: 1164224 - RNA, 19 nt, Human
gcucucuggccuucggccu

SEQ ID NO: 1164225 - RNA, 20 nt, Human
gcucucuggccuucggccuc

SEQ ID NO: 1164226 - RNA, 14 nt, Human
gcucugcccuuggu

SEQ ID NO: 1164227 - RNA, 23 nt, Human
gcucugcccuugguuaggcauug

SEQ ID NO: 1164228 - RNA, 11 nt, Human
gcucugccucc

SEQ ID NO: 1164229 - RNA, 13 nt, Human
gcucugccuccca

SEQ ID NO: 1164230 - RNA, 14 nt, Human
gcucugccucccau

SEQ ID NO: 1164231 - RNA, 15 nt, Human
gcucugccucccauc

SEQ ID NO: 1164232 - RNA, 22 nt, Human
gcucugccucccaucacccgcu

SEQ ID NO: 1164233 - RNA, 13 nt, Human
gcucugcuccucu

SEQ ID NO: 1164234 - RNA, 14 nt, Human
gcucugcuccucuc

SEQ ID NO: 1164235 - RNA, 19 nt, Human
gcucugcuccucuccccag

SEQ ID NO: 1164236 - RNA, 21 nt, Human
gcucugcuccucuccccagca

SEQ ID NO: 1164237 - RNA, 13 nt, Human
gcucugcugacag

SEQ ID NO: 1164238 - RNA, 14 nt, Human
gcucugcugacaga

SEQ ID NO: 1164239 - RNA, 18 nt, Human
gcucugcugacagacaca

SEQ ID NO: 1164240 - RNA, 19 nt, Human
gcucugcugacagacacag

SEQ ID NO: 1164241 - RNA, 20 nt, Human
gcucugcugacagacacagg

SEQ ID NO: 1164242 - RNA, 23 nt, Human
gcucugcugacagacacaggccc

SEQ ID NO: 1164243 - RNA, 14 nt, Human
gcucuggacaggca

SEQ ID NO: 1164244 - RNA, 15 nt, Human
gcucuggacaggcau

SEQ ID NO: 1164245 - RNA, 16 nt, Human
gcucuggacaggcaug

SEQ ID NO: 1164246 - RNA, 21 nt, Human
gcucuggacaggcauguucuc

SEQ ID NO: 1164247 - RNA, 22 nt, Human
gcucuggacaggcauguucucu

SEQ ID NO: 1164248 - RNA, 14 nt, Human
gcucuucuccaggc

SEQ ID NO: 1164249 - RNA, 16 nt, Human
gcucuucuccaggcug

SEQ ID NO: 1164250 - RNA, 19 nt, Human
gcucuuccaggcugggaga

SEQ ID NO: 1164251 - RNA, 22 nt, Human
gcucuuccaggcugggagagcc

SEQ ID NO: 1164252 - RNA, 12 nt, Human
gcucuucuccag

SEQ ID NO: 1164253 - RNA, 21 nt, Human
gcugacagacacaggcccggc

SEQ ID NO: 1164254 - RNA, 15 nt, Human
gcugagucugaaggc

SEQ ID NO: 1164255 - RNA, 16 nt, Human
gcugagucugaaggcu

SEQ ID NO: 1164256 - RNA, 18 nt, Human
gcugagucugaaggcugg

SEQ ID NO: 1164257 - RNA, 19 nt, Human
gcugagucugaaggcuggg

SEQ ID NO: 1164258 - RNA, 22 nt, Human
gcugagugggggaucacagccu

SEQ ID NO: 1164259 - RNA, 23 nt, Human
gcugagugggggaucacagccuc

SEQ ID NO: 1164260 - RNA, 15 nt, Human
gcugauggugcaaug

SEQ ID NO: 1164261 - RNA, 16 nt, Human
gcugauggugcaauga

SEQ ID NO: 1164262 - RNA, 18 nt, Human
gcugauggugcaaugacc

SEQ ID NO: 1164263 - RNA, 21 nt, Human
gcugauggugcaaugaccuuu

SEQ ID NO: 1164264 - RNA, 18 nt, Human
gcugcaguugccagucac

SEQ ID NO: 1164265 - RNA, 20 nt, Human
gcugcaguugccagucaccc

SEQ ID NO: 1164266 - RNA, 21 nt, Human
gcugcaguugccagucacccc

SEQ ID NO: 1164267 - RNA, 17 nt, Human
gcugcauuuaaaagaua

SEQ ID NO: 1164268 - RNA, 17 nt, Human
gcugucuccauguuuga

SEQ ID NO: 1164269 - RNA, 14 nt, Human
gcuguucagcuggu

SEQ ID NO: 1164270 - RNA, 15 nt, Human
gcugccaaugggagc

SEQ ID NO: 1164271 - RNA, 16 nt, Human
gcugccaaugggagcu

SEQ ID NO: 1164272 - RNA, 19 nt, Human
gcugccaaugggagcucau

SEQ ID NO: 1164273 - RNA, 20 nt, Human
gcugccaaugggagcucaug

SEQ ID NO: 1164274 - RNA, 20 nt, Human
gcugucuacacuaagagaga

SEQ ID NO: 1164275 - RNA, 15 nt, Human
gcuuagucacugaga

SEQ ID NO: 1164276 - RNA, 17 nt, Human
gcuuagucacugagaca

SEQ ID NO: 1164277 - RNA, 19 nt, Human
gcuuagucacugagacagc

SEQ ID NO: 1164278 - RNA, 20 nt, Human
gcuuagucacugagacagcc

SEQ ID NO: 1164279 - RNA, 21 nt, Human
gcuuagucacugagacagccc

SEQ ID NO: 1164280 - RNA, 12 nt, Human
gcuuauacacuu

SEQ ID NO: 1164281 - RNA, 20 nt, Human
gcuuauacacuuacacuuua

SEQ ID NO: 1164282 - RNA, 19 nt, Human
gcuuaucucaggggugugc

SEQ ID NO: 1164283 - RNA, 16 nt, Human
gcuucaguggcagcug

SEQ ID NO: 1164284 - RNA, 17 nt, Human
gcuucaguggcagcugc

SEQ ID NO: 1164285 - RNA, 18 nt, Human
gcuucaguggcagcugcu

SEQ ID NO: 1164286 - RNA, 19 nt, Human
gcuucaguggcagcugcuu

SEQ ID NO: 1164287 - RNA, 12 nt, Human
gcuucauccucc

SEQ ID NO: 1164288 - RNA, 15 nt, Human
gcuucauccuccuca

SEQ ID NO: 1164289 - RNA, 13 nt, Human
gcuucauuuccug

SEQ ID NO: 1164290 - RNA, 16 nt, Human
gcuucauuuccugugu

SEQ ID NO: 1164291 - RNA, 17 nt, Human
gcuucauuuccuguguc

SEQ ID NO: 1164292 - RNA, 21 nt, Human
gcuucauccuccucagaucuu

SEQ ID NO: 1164293 - RNA, 18 nt, Human
gcuucauuuccugugucu

SEQ ID NO: 1164294 - RNA, 15 nt, Human
gcuuccagugaggcu

SEQ ID NO: 1164295 - RNA, 16 nt, Human
gcuuccagugaggcuc

SEQ ID NO: 1164296 - RNA, 18 nt, Human
gcuuccagugaggcucug

SEQ ID NO: 1164297 - RNA, 15 nt, Human
gcuuugugauuuuug

SEQ ID NO: 1164298 - RNA, 18 nt, Human
gcuugaggguugggcugg

SEQ ID NO: 1164299 - RNA, 20 nt, Human
gcuugaggguugggcuggug

SEQ ID NO: 1164300 - RNA, 22 nt, Human
gcuugaggguugggcugguguc

SEQ ID NO: 1164301 - RNA, 21 nt, Human
gcuuuguuuguugucagcuga

SEQ ID NO: 1164302 - RNA, 18 nt, Human
ggaaaacaugcuacacac

SEQ ID NO: 1164303 - RNA, 14 nt, Human
ggaaaagcugcuga

SEQ ID NO: 1164304 - RNA, 18 nt, Human
ggaaaagcugcugacagu

SEQ ID NO: 1164305 - RNA, 20 nt, Human
ggaaaagcugcugacagugu

SEQ ID NO: 1164306 - RNA, 19 nt, Human
ggaaaaucagccugcucca

SEQ ID NO: 1164307 - RNA, 23 nt, Human
ggaaaaucagccugcuccagcug

SEQ ID NO: 1164308 - RNA, 12 nt, Human
ggaaaggcucca

SEQ ID NO: 1164309 - RNA, 13 nt, Human
ggaaaggcuccag

SEQ ID NO: 1164310 - RNA, 14 nt, Human
ggaaaggcuccagg

SEQ ID NO: 1164311 - RNA, 17 nt, Human
ggaaaggcuccaggagc

SEQ ID NO: 1164312 - RNA, 19 nt, Human
ggaaaggcuccaggagcag

SEQ ID NO: 1164313 - RNA, 20 nt, Human
ggaaaggcuccaggagcagc

SEQ ID NO: 1164314 - RNA, 21 nt, Human
ggaaaggcuccaggagcagcc

SEQ ID NO: 1164315 - RNA, 22 nt, Human
ggaaaggcuccaggagcagcca

SEQ ID NO: 1164316 - RNA, 14 nt, Human
ggaaaucaccgaaa

SEQ ID NO: 1164317 - RNA, 21 nt, Human
ggaaaucaccgaaaacguggc

SEQ ID NO: 1164318 - RNA, 23 nt, Human
ggaaaucaccgaaaacguggcug

SEQ ID NO: 1164319 - RNA, 23 nt, Human
ggaaggggagauaaggguaucug

SEQ ID NO: 1164320 - RNA, 20 nt, Human
ggaagugacgguuuaauggg

SEQ ID NO: 1164321 - RNA, 12 nt, Human
ggaaguacugga

SEQ ID NO: 1164322 - RNA, 16 nt, Human
ggaaguacuggagaaa

SEQ ID NO: 1164323 - RNA, 18 nt, Human
ggaaguacuggagaaaau

SEQ ID NO: 1164324 - RNA, 16 nt, Human
ggaauuggagcucgug

SEQ ID NO: 1164325 - RNA, 22 nt, Human
ggaauuggagcucgugggacag

SEQ ID NO: 1164326 - RNA, 24 nt, Human
ggaaugauuaauuaaaacacaaca

SEQ ID NO: 1164327 - RNA, 12 nt, Human
ggaaugcagugg

SEQ ID NO: 1164328 - RNA, 19 nt, Human
ggaauguuugccucugccu

SEQ ID NO: 1164329 - RNA, 13 nt, Human
ggacgcucucugg

SEQ ID NO: 1164330 - RNA, 14 nt, Human
ggacgcucucuggc

SEQ ID NO: 1164331 - RNA, 15 nt, Human
ggacgcucucuggcc

SEQ ID NO: 1164332 - RNA, 17 nt, Human
ggagaagcggcuggcag

SEQ ID NO: 1164333 - RNA, 18 nt, Human
ggagaagcggcuggcagc

SEQ ID NO: 1164334 - RNA, 15 nt, Human
ggagaaucacuugaa

SEQ ID NO: 1164335 - RNA, 19 nt, Human
ggagaaucacuugaacccg

SEQ ID NO: 1164336 - RNA, 17 nt, Human
ggacacucaaaagcugg

SEQ ID NO: 1164337 - RNA, 22 nt, Human
ggacacucaaaagcugggcagg

SEQ ID NO: 1164338 - RNA, 15 nt, Human
ggacagccacggcca

SEQ ID NO: 1164339 - RNA, 19 nt, Human
ggacagccacggccaggcc

SEQ ID NO: 1164340 - RNA, 20 nt, Human
ggacagccacggccaggcca

SEQ ID NO: 1164341 - RNA, 21 nt, Human
ggacagccacggccaggccag

SEQ ID NO: 1164342 - RNA, 22 nt, Human
ggacagccacggccaggccaga

SEQ ID NO: 1164343 - RNA, 20 nt, Human
ggacauugcggacagccacg

SEQ ID NO: 1164344 - RNA, 16 nt, Human
ggacauuugcucaugg

SEQ ID NO: 1164345 - RNA, 13 nt, Human
ggaccagagcugc

SEQ ID NO: 1164346 - RNA, 14 nt, Human
ggaccagagcugcc

SEQ ID NO: 1164347 - RNA, 19 nt, Human
ggaccucaggugagaagca

SEQ ID NO: 1164348 - RNA, 23 nt, Human
ggaccucaggugagaagcagagg

SEQ ID NO: 1164349 - RNA, 15 nt, Human
ggaccuugaacuggg

SEQ ID NO: 1164350 - RNA, 17 nt, Human
ggaccuugaacugggua

SEQ ID NO: 1164351 - RNA, 18 nt, Human
ggaccuugaacuggguac

SEQ ID NO: 1164352 - RNA, 17 nt, Human
ggacgcuacccgggaag

SEQ ID NO: 1164353 - RNA, 19 nt, Human
ggacgcuacccgggaaggg

SEQ ID NO: 1164354 - RNA, 20 nt, Human
ggacgcuacccgggaagggg

SEQ ID NO: 1164355 - RNA, 13 nt, Human
ggaucccucaucc

SEQ ID NO: 1164356 - RNA, 17 nt, Human
ggaucccucauccucau

SEQ ID NO: 1164357 - RNA, 22 nt, Human
ggaucccucauccucauaccca

SEQ ID NO: 1164358 - RNA, 12 nt, Human
ggagugcaguga

SEQ ID NO: 1164359 - RNA, 14 nt, Human
ggagugcagugagc

SEQ ID NO: 1164360 - RNA, 15 nt, Human
ggagugcagugagcc

SEQ ID NO: 1164361 - RNA, 12 nt, Human
ggauccuccagg

SEQ ID NO: 1164362 - RNA, 13 nt, Human
ggauccuccaggu

SEQ ID NO: 1164363 - RNA, 14 nt, Human
ggauccuccaggug

SEQ ID NO: 1164364 - RNA, 21 nt, Human
ggaugauuggaggggggaggu

SEQ ID NO: 1164365 - RNA, 23 nt, Human
ggaugcacagaguuguuacauuu

SEQ ID NO: 1164366 - RNA, 16 nt, Human
ggaugcagccucacag

SEQ ID NO: 1164367 - RNA, 17 nt, Human
ggaugcagccucacagu

SEQ ID NO: 1164368 - RNA, 19 nt, Human
ggaugcagccucacagucc

SEQ ID NO: 1164369 - RNA, 15 nt, Human
ggaugcuuguacaua

SEQ ID NO: 1164370 - RNA, 19 nt, Human
ggauuacaagcgugagcca

SEQ ID NO: 1164371 - RNA, 23 nt, Human
ggauuacaagcgugagccacugc

SEQ ID NO: 1164372 - RNA, 16 nt, Human
ggauucuuauggacaa

SEQ ID NO: 1164373 - RNA, 16 nt, Human
ggauucuuccucccuc

SEQ ID NO: 1164374 - RNA, 17 nt, Human
ggauugcuacuguccua

SEQ ID NO: 1164375 - RNA, 15 nt, Human
ggauuguaaaauggu

SEQ ID NO: 1164376 - RNA, 16 nt, Human
ggcaacccccagccug

SEQ ID NO: 1164377 - RNA, 17 nt, Human
ggcaacccccagccugc

SEQ ID NO: 1164378 - RNA, 22 nt, Human
ggcacccggccccugcugguuc

SEQ ID NO: 1164379 - RNA, 23 nt, Human
ggcacccaccaucaugucuggcu

SEQ ID NO: 1164380 - RNA, 18 nt, Human
ggcaacccccagccugcu

SEQ ID NO: 1164381 - RNA, 19 nt, Human
ggcaacccccagccugcua

SEQ ID NO: 1164382 - RNA, 14 nt, Human
ggcaaugcuggcug

SEQ ID NO: 1164383 - RNA, 15 nt, Human
ggcaaugcuggcugu

SEQ ID NO: 1164384 - RNA, 23 nt, Human
ggcaaugcuggcuguuggcuggg

SEQ ID NO: 1164385 - RNA, 18 nt, Human
ggcaugacacgaauauug

SEQ ID NO: 1164386 - RNA, 22 nt, Human
ggcaugacacgaauauugcuga

SEQ ID NO: 1164387 - RNA, 19 nt, Human
ggcagggucucacucuguc

SEQ ID NO: 1164388 - RNA, 20 nt, Human
ggcagggucucacucugucg

SEQ ID NO: 1164389 - RNA, 13 nt, Human
ggcagugggagcu

SEQ ID NO: 1164390 - RNA, 14 nt, Human
ggcagugggagcug

SEQ ID NO: 1164391 - RNA, 16 nt, Human
ggcagugggagcugcc

SEQ ID NO: 1164392 - RNA, 12 nt, Human
ggcagcucaccu

SEQ ID NO: 1164393 - RNA, 14 nt, Human
ggcagcucaccucu

SEQ ID NO: 1164394 - RNA, 16 nt, Human
ggcagcucaccucucc

SEQ ID NO: 1164395 - RNA, 21 nt, Human
ggcagcucagagaggguggga

SEQ ID NO: 1164396 - RNA, 17 nt, Human
ggcagcuugaggguugg

SEQ ID NO: 1164397 - RNA, 18 nt, Human
ggcaugggaaugaauguc

SEQ ID NO: 1164398 - RNA, 22 nt, Human
ggcaugggaaugaaugucagug

SEQ ID NO: 1164399 - RNA, 17 nt, Human
ggcauuccccaggaggc

SEQ ID NO: 1164400 - RNA, 18 nt, Human
ggcauuccccaggaggcc

SEQ ID NO: 1164401 - RNA, 19 nt, Human
ggcauuccccaggaggcca

SEQ ID NO: 1164402 - RNA, 20 nt, Human
ggccagccuugaccauucuc

SEQ ID NO: 1164403 - RNA, 22 nt, Human
ggccagccuugaccauucucca

SEQ ID NO: 1164404 - RNA, 17 nt, Human
ggccagcugcuugggcu

SEQ ID NO: 1164405 - RNA, 23 nt, Human
ggccagcugcuugggcuucaucc

SEQ ID NO: 1164406 - RNA, 18 nt, Human
ggccaggcccucugccca

SEQ ID NO: 1164407 - RNA, 13 nt, Human
ggcccugccuccu

SEQ ID NO: 1164408 - RNA, 14 nt, Human
ggcccugccuccuu

SEQ ID NO: 1164409 - RNA, 15 nt, Human
ggcccugccuccuuu

SEQ ID NO: 1164410 - RNA, 11 nt, Human
ggcccagagag

SEQ ID NO: 1164411 - RNA, 12 nt, Human
ggcccagagagg

SEQ ID NO: 1164412 - RNA, 13 nt, Human
ggcccucugccca

SEQ ID NO: 1164413 - RNA, 15 nt, Human
ggcccucugcccacu

SEQ ID NO: 1164414 - RNA, 16 nt, Human
ggcccucugcccacuc

SEQ ID NO: 1164415 - RNA, 17 nt, Human
ggcccucugcccacucc

SEQ ID NO: 1164416 - RNA, 19 nt, Human
ggcccucugcccacucccu

SEQ ID NO: 1164417 - RNA, 20 nt, Human
ggcccucugcccacucccug

SEQ ID NO: 1164418 - RNA, 21 nt, Human
ggcccucugcccacucccugc

SEQ ID NO: 1164419 - RNA, 13 nt, Human
ggccucugcacuc

SEQ ID NO: 1164420 - RNA, 14 nt, Human
ggccucugcacucc

SEQ ID NO: 1164421 - RNA, 15 nt, Human
ggccucugcacuccc

SEQ ID NO: 1164422 - RNA, 16 nt, Human
ggccucugcacucccc

SEQ ID NO: 1164423 - RNA, 20 nt, Human
ggccucgguguggagaagcg

SEQ ID NO: 1164424 - RNA, 17 nt, Human
ggccucuuaugggcugg

SEQ ID NO: 1164425 - RNA, 18 nt, Human
ggccucuuaugggcuggg

SEQ ID NO: 1164426 - RNA, 15 nt, Human
ggcuaugcauuugaa

SEQ ID NO: 1164427 - RNA, 15 nt, Human
ggcuaguugggcuuc

SEQ ID NO: 1164428 - RNA, 16 nt, Human
ggcuaguugggcuucc

SEQ ID NO: 1164429 - RNA, 17 nt, Human
ggcuagagguucaaaga

SEQ ID NO: 1164430 - RNA, 22 nt, Human
ggcuagagguucaaagauauuu

SEQ ID NO: 1164431 - RNA, 16 nt, Human
ggcuaggaccccucca

SEQ ID NO: 1164432 - RNA, 22 nt, Human
ggcuaggaccccuccauguggg

SEQ ID NO: 1164433 - RNA, 12 nt, Human
ggcuccaggagc

SEQ ID NO: 1164434 - RNA, 13 nt, Human
ggcuccaggagca

SEQ ID NO: 1164435 - RNA, 19 nt, Human
ggcuccaggagcagccaca

SEQ ID NO: 1164436 - RNA, 15 nt, Human
ggcucaaguccucuu

SEQ ID NO: 1164437 - RNA, 21 nt, Human
ggcucaaguccucuuuucuga

SEQ ID NO: 1164438 - RNA, 16 nt, Human
ggcuccaggcuccuuu

SEQ ID NO: 1164439 - RNA, 11 nt, Human
ggcuccaggcu

SEQ ID NO: 1164440 - RNA, 14 nt, Human
ggccugggggcugg

SEQ ID NO: 1164441 - RNA, 20 nt, Human
ggccugggggcugggcagag

SEQ ID NO: 1164442 - RNA, 22 nt, Human
ggccugggggcugggcagagga

SEQ ID NO: 1164443 - RNA, 19 nt, Human
ggcgcugccccuggcagcc

SEQ ID NO: 1164444 - RNA, 21 nt, Human
ggcgcugccccuggcagcccc

SEQ ID NO: 1164445 - RNA, 23 nt, Human
ggcgcugccccuggcagccccug

SEQ ID NO: 1164446 - RNA, 15 nt, Human
ggcgcgguggcucac

SEQ ID NO: 1164447 - RNA, 12 nt, Human
gggccuggccug

SEQ ID NO: 1164448 - RNA, 12 nt, Human
gggccuggcuca

SEQ ID NO: 1164449 - RNA, 14 nt, Human
gggccuggcucagg

SEQ ID NO: 1164450 - RNA, 16 nt, Human
gggccuggcucaggug

SEQ ID NO: 1164451 - RNA, 18 nt, Human
gggccuggucguuuucaa

SEQ ID NO: 1164452 - RNA, 17 nt, Human
gggccuggcucaggugg

SEQ ID NO: 1164453 - RNA, 16 nt, Human
gggcgcgguggcucac

SEQ ID NO: 1164454 - RNA, 13 nt, Human
gggcucccuuccc

SEQ ID NO: 1164455 - RNA, 14 nt, Human
gggcucccuuccca

SEQ ID NO: 1164456 - RNA, 17 nt, Human
gggcucccuucccaccu

SEQ ID NO: 1164457 - RNA, 18 nt, Human
gggcucccuucccaccuc

SEQ ID NO: 1164458 - RNA, 23 nt, Human
gggcucccuucccaccucucuca

SEQ ID NO: 1164459 - RNA, 13 nt, Human
gggcucugccucc

SEQ ID NO: 1164460 - RNA, 15 nt, Human
gggcucugccuccca

SEQ ID NO: 1164461 - RNA, 16 nt, Human
gggcucugccucccau

SEQ ID NO: 1164462 - RNA, 17 nt, Human
gggcucugccucccauc

SEQ ID NO: 1164463 - RNA, 20 nt, Human
gggcucugccucccaucacc

SEQ ID NO: 1164464 - RNA, 16 nt, Human
gggcugaggugggagg

SEQ ID NO: 1164465 - RNA, 14 nt, Human
gggcugcaccggcu

SEQ ID NO: 1164466 - RNA, 17 nt, Human
gggcugcaccggcuggc

SEQ ID NO: 1164467 - RNA, 14 nt, Human
gggcuucaguggca

SEQ ID NO: 1164468 - RNA, 23 nt, Human
gggguucccuuuuuuggcugcug

SEQ ID NO: 1164469 - RNA, 13 nt, Human
ggguacccacugc

SEQ ID NO: 1164470 - RNA, 15 nt, Human
ggguacccacugcuc

SEQ ID NO: 1164471 - RNA, 18 nt, Human
ggguacccacugcucugg

SEQ ID NO: 1164472 - RNA, 19 nt, Human
ggguacuuguggacacagc

SEQ ID NO: 1164473 - RNA, 22 nt, Human
ggguacuuguggacacagcucu

SEQ ID NO: 1164474 - RNA, 23 nt, Human
ggguacuuguggacacagcucuu

SEQ ID NO: 1164475 - RNA, 23 nt, Human
ggguagagcggagaaaggaaggg

SEQ ID NO: 1164476 - RNA, 13 nt, Human
ggggcugggacau

SEQ ID NO: 1164477 - RNA, 16 nt, Human
ggggcugggcagagga

SEQ ID NO: 1164478 - RNA, 17 nt, Human
ggggcugggcagaggaa

SEQ ID NO: 1164479 - RNA, 17 nt, Human
ggggaucacagccucug

SEQ ID NO: 1164480 - RNA, 21 nt, Human
gggcuuggggaccagagcugc

SEQ ID NO: 1164481 - RNA, 22 nt, Human
gggcuuggggaccagagcugcc

SEQ ID NO: 1164482 - RNA, 13 nt, Human
ggggaguggccac

SEQ ID NO: 1164483 - RNA, 15 nt, Human
gggcuucaguggcag

SEQ ID NO: 1164484 - RNA, 16 nt, Human
gggcuucaguggcagc

SEQ ID NO: 1164485 - RNA, 17 nt, Human
gggcuucaguggcagcu

SEQ ID NO: 1164486 - RNA, 18 nt, Human
gggcuucaguggcagcug

SEQ ID NO: 1164487 - RNA, 19 nt, Human
gggcuucaguggcagcugc

SEQ ID NO: 1164488 - RNA, 20 nt, Human
gggcuucaguggcagcugcu

SEQ ID NO: 1164489 - RNA, 19 nt, Human
gggcuucauccuccucaga

SEQ ID NO: 1164490 - RNA, 20 nt, Human
gggcuucauccuccucagau

SEQ ID NO: 1164491 - RNA, 20 nt, Human
gggcuuggggaccagagcug

SEQ ID NO: 1164492 - RNA, 13 nt, Human
ggguggaugccug

SEQ ID NO: 1164493 - RNA, 19 nt, Human
ggguuggccccugcccggc

SEQ ID NO: 1164494 - RNA, 23 nt, Human
ggguucccuuuuuuggcugcuga

SEQ ID NO: 1164495 - RNA, 22 nt, Human
ggguucuacccaggugcuagga

SEQ ID NO: 1164496 - RNA, 17 nt, Human
gguacccacugcucugg

SEQ ID NO: 1164497 - RNA, 15 nt, Human
ggguugggcuggugu

SEQ ID NO: 1164498 - RNA, 22 nt, Human
gguacuucaaauccuugaagau

SEQ ID NO: 1164499 - RNA, 21 nt, Human
gguacuuguggacacagcucu

SEQ ID NO: 1164500 - RNA, 22 nt, Human
gguacuuguggacacagcucuu

SEQ ID NO: 1164501 - RNA, 15 nt, Human
gguagacacacauga

SEQ ID NO: 1164502 - RNA, 22 nt, Human
gguagacacacaugaaguccaa

SEQ ID NO: 1164503 - RNA, 22 nt, Human
gguagaaauaucugaaaaugua

SEQ ID NO: 1164504 - RNA, 16 nt, Human
ggucacucuggcagcu

SEQ ID NO: 1164505 - RNA, 20 nt, Human
ggucacucuggcagcucaga

SEQ ID NO: 1164506 - RNA, 22 nt, Human
ggucacucuggcagcucagaga

SEQ ID NO: 1164507 - RNA, 12 nt, Human
ggucagagccug

SEQ ID NO: 1164508 - RNA, 13 nt, Human
ggucagagccugc

SEQ ID NO: 1164509 - RNA, 14 nt, Human
ggucagagccugca

SEQ ID NO: 1164510 - RNA, 15 nt, Human
ggucagagccugcag

SEQ ID NO: 1164511 - RNA, 16 nt, Human
ggucagagccugcagu

SEQ ID NO: 1164512 - RNA, 12 nt, Human
ggucccacucag

SEQ ID NO: 1164513 - RNA, 14 nt, Human
ggucccacucaguc

SEQ ID NO: 1164514 - RNA, 22 nt, Human
ggucccacucaguccauagcag

SEQ ID NO: 1164515 - RNA, 13 nt, Human
ggucccccuucca

SEQ ID NO: 1164516 - RNA, 18 nt, Human
ggucccccuuccauggac

SEQ ID NO: 1164517 - RNA, 23 nt, Human
ggucccccuuccauggacuuugu

SEQ ID NO: 1164518 - RNA, 15 nt, Human
ggucugacccacugc

SEQ ID NO: 1164519 - RNA, 16 nt, Human
ggucugacccacugcu

SEQ ID NO: 1164520 - RNA, 12 nt, Human
ggucucacucug

SEQ ID NO: 1164521 - RNA, 16 nt, Human
ggucucacucugucgc

SEQ ID NO: 1164522 - RNA, 19 nt, Human
ggucugaggaauccagacc

SEQ ID NO: 1164523 - RNA, 16 nt, Human
ggugaacuugguuccc

SEQ ID NO: 1164524 - RNA, 18 nt, Human
ggugaagugaagacaaug

SEQ ID NO: 1164525 - RNA, 14 nt, Human
ggucccugguggca

SEQ ID NO: 1164526 - RNA, 22 nt, Human
ggucccugguggcagcucaccu

SEQ ID NO: 1164527 - RNA, 23 nt, Human
gguccuagaaauuccccacccug

SEQ ID NO: 1164528 - RNA, 22 nt, Human
ggucucacuauguugcccaggc

SEQ ID NO: 1164529 - RNA, 21 nt, Human
ggugacagagugagacucugu

SEQ ID NO: 1164530 - RNA, 14 nt, Human
ggugaccucugccu

SEQ ID NO: 1164531 - RNA, 16 nt, Human
ggugaccucugccuga

SEQ ID NO: 1164532 - RNA, 21 nt, Human
ggugaccucugccugaaguca

SEQ ID NO: 1164533 - RNA, 22 nt, Human
ggugcuaucucccccagcccca

SEQ ID NO: 1164534 - RNA, 23 nt, Human
ggugcuaucucccccagccccau

SEQ ID NO: 1164535 - RNA, 11 nt, Human
gguggcagcug

SEQ ID NO: 1164536 - RNA, 12 nt, Human
gguggcagcugc

SEQ ID NO: 1164537 - RNA, 13 nt, Human
gguggcagcugcg

SEQ ID NO: 1164538 - RNA, 15 nt, Human
gguggcagcugcggu

SEQ ID NO: 1164539 - RNA, 23 nt, Human
gguggcagcugcgguccacccag

SEQ ID NO: 1164540 - RNA, 16 nt, Human
gguggcagugggagcu

SEQ ID NO: 1164541 - RNA, 13 nt, Human
gguggccucccaa

SEQ ID NO: 1164542 - RNA, 17 nt, Human
gguggccucccaacuca

SEQ ID NO: 1164543 - RNA, 21 nt, Human
gguucaagcgauucuucugcu

SEQ ID NO: 1164544 - RNA, 14 nt, Human
gguugaagcaccaa

SEQ ID NO: 1164545 - RNA, 12 nt, Human
gguucagcuugu

SEQ ID NO: 1164546 - RNA, 22 nt, Human
gguucaagcgauucuucugcuu

SEQ ID NO: 1164547 - RNA, 23 nt, Human
gguucaagcgauucuucugcuuc

SEQ ID NO: 1164548 - RNA, 18 nt, Human
gguuggcaaaaaggcagg

SEQ ID NO: 1164549 - RNA, 14 nt, Human
gguugggcuggugu

SEQ ID NO: 1164550 - RNA, 13 nt, Human
gguuggugggggc

SEQ ID NO: 1164551 - RNA, 13 nt, Human
gguuuaagcuguu

SEQ ID NO: 1164552 - RNA, 23 nt, Human
gguuuugccauguuggccaggcu

SEQ ID NO: 1164553 - RNA, 16 nt, Human
gguuuagaaagcuugc

SEQ ID NO: 1164554 - RNA, 12 nt, Human
gguuuucuguuc

SEQ ID NO: 1164555 - RNA, 13 nt, Human
gguuuucuguucu

SEQ ID NO: 1164556 - RNA, 15 nt, Human
gguuuucuguucuuu

SEQ ID NO: 1164557 - RNA, 15 nt, Human
guaaauuaacuuuua

SEQ ID NO: 1164558 - RNA, 16 nt, Human
guaaauuaacuuuuau

SEQ ID NO: 1164559 - RNA, 17 nt, Human
guaaauuaacuuuuaua

SEQ ID NO: 1164560 - RNA, 21 nt, Human
guaaauuaacuuuuauaaacu

SEQ ID NO: 1164561 - RNA, 22 nt, Human
guaaauuaacuuuuauaaacuu

SEQ ID NO: 1164562 - RNA, 18 nt, Human
guaaaugggggugcauuu

SEQ ID NO: 1164563 - RNA, 19 nt, Human
guaaaugggggugcauuug

SEQ ID NO: 1164564 - RNA, 20 nt, Human
guaaaugggggugcauuuga

SEQ ID NO: 1164565 - RNA, 23 nt, Human
guaaauuaacuuuuauaaacuuu

SEQ ID NO: 1164566 - RNA, 18 nt, Human
guaaggaauaccuguccc

SEQ ID NO: 1164567 - RNA, 20 nt, Human
guaaggaauaccuguccccc

SEQ ID NO: 1164568 - RNA, 21 nt, Human
guaaggaauaccugucccccu

SEQ ID NO: 1164569 - RNA, 23 nt, Human
guaaggaauaccugucccccuga

SEQ ID NO: 1164570 - RNA, 13 nt, Human
guaaggaaugauu

SEQ ID NO: 1164571 - RNA, 22 nt, Human
guaaguauucuuauuuaaugaa

SEQ ID NO: 1164572 - RNA, 19 nt, Human
guaaugauaacuggaaacu

SEQ ID NO: 1164573 - RNA, 14 nt, Human
guaauuaaguacua

SEQ ID NO: 1164574 - RNA, 17 nt, Human
guaauuaaguacuaugu

SEQ ID NO: 1164575 - RNA, 20 nt, Human
guaauuaaguacuauguauc

SEQ ID NO: 1164576 - RNA, 21 nt, Human
guaauuaaguacuauguauca

SEQ ID NO: 1164577 - RNA, 15 nt, Human
guaauuggaaaggca

SEQ ID NO: 1164578 - RNA, 18 nt, Human
guacacuguuucaaacuu

SEQ ID NO: 1164579 - RNA, 15 nt, Human
guacccacugcucug

SEQ ID NO: 1164580 - RNA, 20 nt, Human
guacauaaugcgugcauacc

SEQ ID NO: 1164581 - RNA, 19 nt, Human
guacacuguuucaaacuuu

SEQ ID NO: 1164582 - RNA, 20 nt, Human
guacacuguuucaaacuuua

SEQ ID NO: 1164583 - RNA, 21 nt, Human
guacacuguuucaaacuuuac

SEQ ID NO: 1164584 - RNA, 16 nt, Human
guacagacaacaaacc

SEQ ID NO: 1164585 - RNA, 12 nt, Human
guacagagccca

SEQ ID NO: 1164586 - RNA, 18 nt, Human
guacagagcccacgcccc

SEQ ID NO: 1164587 - RNA, 22 nt, Human
guacagagcccacgcccccacu

SEQ ID NO: 1164588 - RNA, 20 nt, Human
guacagcaaggagauuuaca

SEQ ID NO: 1164589 - RNA, 23 nt, Human
guacuuuauuuucuauaauuuaa

SEQ ID NO: 1164590 - RNA, 21 nt, Human
guacuuguggacacagcucuu

SEQ ID NO: 1164591 - RNA, 16 nt, Human
guagagcggagaaagg

SEQ ID NO: 1164592 - RNA, 15 nt, Human
guagaggagaaacug

SEQ ID NO: 1164593 - RNA, 16 nt, Human
guacuucuccacccug

SEQ ID NO: 1164594 - RNA, 17 nt, Human
guacuucuccacccugc

SEQ ID NO: 1164595 - RNA, 18 nt, Human
guacuucuccacccugcu

SEQ ID NO: 1164596 - RNA, 19 nt, Human
guacuucuccacccugcuc

SEQ ID NO: 1164597 - RNA, 20 nt, Human
guacuucuccacccugcucu

SEQ ID NO: 1164598 - RNA, 21 nt, Human
guacuucuccacccugcucuc

SEQ ID NO: 1164599 - RNA, 16 nt, Human
guacuuguggacacag

SEQ ID NO: 1164600 - RNA, 20 nt, Human
guacuuguggacacagcucu

SEQ ID NO: 1164601 - RNA, 16 nt, Human
guacccacugcucugg

SEQ ID NO: 1164602 - RNA, 15 nt, Human
guaccgcaaugugac

SEQ ID NO: 1164603 - RNA, 13 nt, Human
guaccucuugagc

SEQ ID NO: 1164604 - RNA, 21 nt, Human
guaccucuugagccuugaacu

SEQ ID NO: 1164605 - RNA, 22 nt, Human
guaccucuugagccuugaacuu

SEQ ID NO: 1164606 - RNA, 14 nt, Human
guacgucugacagg

SEQ ID NO: 1164607 - RNA, 15 nt, Human
guacgucugacaggc

SEQ ID NO: 1164608 - RNA, 17 nt, Human
guacgucugacaggcaa

SEQ ID NO: 1164609 - RNA, 14 nt, Human
guacguugugcauu

SEQ ID NO: 1164610 - RNA, 15 nt, Human
guacguugugcauuu

SEQ ID NO: 1164611 - RNA, 16 nt, Human
guacguugugcauuug

SEQ ID NO: 1164612 - RNA, 17 nt, Human
guacguugugcauuugg

SEQ ID NO: 1164613 - RNA, 15 nt, Human
guacuaaggaaucuu

SEQ ID NO: 1164614 - RNA, 23 nt, Human
guacuaaggaaucuuucugcuuu

SEQ ID NO: 1164615 - RNA, 17 nt, Human
guacuacaguccuccca

SEQ ID NO: 1164616 - RNA, 14 nt, Human
guacuucuccaccc

SEQ ID NO: 1164617 - RNA, 15 nt, Human
guacuucuccacccu

SEQ ID NO: 1164618 - RNA, 17 nt, Human
guauuucuaugaaauau

SEQ ID NO: 1164619 - RNA, 22 nt, Human
guauuucuaugaaauauuaugu

SEQ ID NO: 1164620 - RNA, 13 nt, Human
guagagugggagc

SEQ ID NO: 1164621 - RNA, 15 nt, Human
guagagugggagcug

SEQ ID NO: 1164622 - RNA, 15 nt, Human
guagagugugccuga

SEQ ID NO: 1164623 - RNA, 13 nt, Human
guauuacuucugc

SEQ ID NO: 1164624 - RNA, 14 nt, Human
guauuacuucugcu

SEQ ID NO: 1164625 - RNA, 15 nt, Human
guauuacuucugcua

SEQ ID NO: 1164626 - RNA, 14 nt, Human
guauuauaccuuuu

SEQ ID NO: 1164627 - RNA, 16 nt, Human
gucaagugaaaaagga

SEQ ID NO: 1164628 - RNA, 18 nt, Human
gucaagugaaaaaggagg

SEQ ID NO: 1164629 - RNA, 19 nt, Human
gucaagugaaaaaggagga

SEQ ID NO: 1164630 - RNA, 16 nt, Human
guauuuuaaaagaaug

SEQ ID NO: 1164631 - RNA, 17 nt, Human
guauuuuaaaagaauga

SEQ ID NO: 1164632 - RNA, 18 nt, Human
guauuuuaaaagaaugau

SEQ ID NO: 1164633 - RNA, 18 nt, Human
gucaagagggucugagga

SEQ ID NO: 1164634 - RNA, 19 nt, Human
gucaagagggucugaggaa

SEQ ID NO: 1164635 - RNA, 15 nt, Human
gucaauaaaauccau

SEQ ID NO: 1164636 - RNA, 21 nt, Human
gucaauaaaauccauacauuu

SEQ ID NO: 1164637 - RNA, 22 nt, Human
gucaauaaaauccauacauuug

SEQ ID NO: 1164638 - RNA, 13 nt, Human
gucaauuacagga

SEQ ID NO: 1164639 - RNA, 15 nt, Human
gucaauuacaggaag

SEQ ID NO: 1164640 - RNA, 16 nt, Human
gucaauuacaggaagu

SEQ ID NO: 1164641 - RNA, 13 nt, Human
gucaccccggcca

SEQ ID NO: 1164642 - RNA, 15 nt, Human
gucaccccggccacc

SEQ ID NO: 1164643 - RNA, 14 nt, Human
gucaccucauggaa

SEQ ID NO: 1164644 - RNA, 20 nt, Human
gucaccugaagacucauucu

SEQ ID NO: 1164645 - RNA, 21 nt, Human
gucauauaagauucauauuua

SEQ ID NO: 1164646 - RNA, 14 nt, Human
guccacccaggagc

SEQ ID NO: 1164647 - RNA, 15 nt, Human
guccacccaggagcc

SEQ ID NO: 1164648 - RNA, 16 nt, Human
guccacccaggagccc

SEQ ID NO: 1164649 - RNA, 14 nt, Human
gucccacucagucc

SEQ ID NO: 1164650 - RNA, 15 nt, Human
gucccacucagucca

SEQ ID NO: 1164651 - RNA, 17 nt, Human
gucccagauacuugggg

SEQ ID NO: 1164652 - RNA, 17 nt, Human
guccugggagugagcug

SEQ ID NO: 1164653 - RNA, 18 nt, Human
guccugggagugagcugg

SEQ ID NO: 1164654 - RNA, 19 nt, Human
guccugggagugagcuggu

SEQ ID NO: 1164655 - RNA, 12 nt, Human
guccucccaucu

SEQ ID NO: 1164656 - RNA, 13 nt, Human
guccucccaucuc

SEQ ID NO: 1164657 - RNA, 14 nt, Human
guccucccaucuca

SEQ ID NO: 1164658 - RNA, 23 nt, Human
guccucccaucucacacaugagc

SEQ ID NO: 1164659 - RNA, 15 nt, Human
guccugggagugagc

SEQ ID NO: 1164660 - RNA, 16 nt, Human
guccugggagugagcu

SEQ ID NO: 1164661 - RNA, 12 nt, Human
gucccagugccg

SEQ ID NO: 1164662 - RNA, 16 nt, Human
gucccugguggcagcu

SEQ ID NO: 1164663 - RNA, 17 nt, Human
gucccugguggcagcuc

SEQ ID NO: 1164664 - RNA, 18 nt, Human
gucccugguggcagcuca

SEQ ID NO: 1164665 - RNA, 15 nt, Human
guccuacucuguguc

SEQ ID NO: 1164666 - RNA, 23 nt, Human
guccuacucugugucaggugggg

SEQ ID NO: 1164667 - RNA, 23 nt, Human
guccuagaaauuccccacccuga

SEQ ID NO: 1164668 - RNA, 14 nt, Human
gucugacccacugc

SEQ ID NO: 1164669 - RNA, 15 nt, Human
gucugacccacugcu

SEQ ID NO: 1164670 - RNA, 18 nt, Human
gucugaggaauccagacc

SEQ ID NO: 1164671 - RNA, 19 nt, Human
gucugaggaauccagaccc

SEQ ID NO: 1164672 - RNA, 21 nt, Human
gucugaggaauccagacccgg

SEQ ID NO: 1164673 - RNA, 13 nt, Human
gucugacuguuuc

SEQ ID NO: 1164674 - RNA, 17 nt, Human
gucugauucccaagcuc

SEQ ID NO: 1164675 - RNA, 18 nt, Human
gucugauucccaagcucu

SEQ ID NO: 1164676 - RNA, 19 nt, Human
gucugauucccaagcucug

SEQ ID NO: 1164677 - RNA, 20 nt, Human
gucugauucccaagcucugc

SEQ ID NO: 1164678 - RNA, 21 nt, Human
gucugauucccaagcucugcu

SEQ ID NO: 1164679 - RNA, 23 nt, Human
gucuacacuaagagagaaugaga

SEQ ID NO: 1164680 - RNA, 15 nt, Human
gucuacacugugcug

SEQ ID NO: 1164681 - RNA, 17 nt, Human
gucuacacuaagagaga

SEQ ID NO: 1164682 - RNA, 15 nt, Human
guccuuaccagcaga

SEQ ID NO: 1164683 - RNA, 16 nt, Human
guccuuaccagcagag

SEQ ID NO: 1164684 - RNA, 17 nt, Human
guccuuaccagcagagc

SEQ ID NO: 1164685 - RNA, 18 nt, Human
guccuuaccagcagagca

SEQ ID NO: 1164686 - RNA, 20 nt, Human
gucucacuauguugcccagg

SEQ ID NO: 1164687 - RNA, 21 nt, Human
gucucacuauguugcccaggc

SEQ ID NO: 1164688 - RNA, 23 nt, Human
gucucacuauguugcccaggcag

SEQ ID NO: 1164689 - RNA, 16 nt, Human
gucucacuguugccca

SEQ ID NO: 1164690 - RNA, 17 nt, Human
gucucacuguugcccag

SEQ ID NO: 1164691 - RNA, 18 nt, Human
gucucacuguugcccagg

SEQ ID NO: 1164692 - RNA, 19 nt, Human
gucucacuguugcccaggc

SEQ ID NO: 1164693 - RNA, 20 nt, Human
gucucacuguugcccaggcu

SEQ ID NO: 1164694 - RNA, 21 nt, Human
gucucacuguugcccaggcug

SEQ ID NO: 1164695 - RNA, 22 nt, Human
gucucacuguugcccaggcugg

SEQ ID NO: 1164696 - RNA, 23 nt, Human
gucucacuguugcccaggcuggc

SEQ ID NO: 1164697 - RNA, 13 nt, Human
gucuaccugaggg

SEQ ID NO: 1164698 - RNA, 11 nt, Human
gucucacucug

SEQ ID NO: 1164699 - RNA, 14 nt, Human
gugaaaagaaaaau

SEQ ID NO: 1164700 - RNA, 23 nt, Human
gugaaaagaaaaaugagccuggc

SEQ ID NO: 1164701 - RNA, 19 nt, Human
gugaaagaaaauaacaaua

SEQ ID NO: 1164702 - RNA, 20 nt, Human
gugaaacucguuaauuugua

SEQ ID NO: 1164703 - RNA, 12 nt, Human
gugaaacuggau

SEQ ID NO: 1164704 - RNA, 19 nt, Human
gugaaaggaaagagggagg

SEQ ID NO: 1164705 - RNA, 12 nt, Human
gugaccucugcc

SEQ ID NO: 1164706 - RNA, 16 nt, Human
gugacaacacuugugu

SEQ ID NO: 1164707 - RNA, 16 nt, Human
gugacaagcucacaga

SEQ ID NO: 1164708 - RNA, 15 nt, Human
gugacugaauuucuu

SEQ ID NO: 1164709 - RNA, 16 nt, Human
gugacugaauuucuuu

SEQ ID NO: 1164710 - RNA, 18 nt, Human
gugacugaauuucuuuug

SEQ ID NO: 1164711 - RNA, 13 nt, Human
gugagccacugca

SEQ ID NO: 1164712 - RNA, 17 nt, Human
gugacugaucucucgug

SEQ ID NO: 1164713 - RNA, 16 nt, Human
gugagcagucaggaaa

SEQ ID NO: 1164714 - RNA, 14 nt, Human
gugagccacugcac

SEQ ID NO: 1164715 - RNA, 11 nt, Human
gugaggaagcc

SEQ ID NO: 1164716 - RNA, 16 nt, Human
gugaggaagccgcugg

SEQ ID NO: 1164717 - RNA, 19 nt, Human
gugaggaagccgcuggggc

SEQ ID NO: 1164718 - RNA, 11 nt, Human
gugaggccaga

SEQ ID NO: 1164719 - RNA, 13 nt, Human
gugaggccagaga

SEQ ID NO: 1164720 - RNA, 15 nt, Human
gugauccacccaccu

SEQ ID NO: 1164721 - RNA, 18 nt, Human
gugauccacccaccucag

SEQ ID NO: 1164722 - RNA, 20 nt, Human
gugauccacccaccucagcc

SEQ ID NO: 1164723 - RNA, 22 nt, Human
gugauccacccaccucagccuc

SEQ ID NO: 1164724 - RNA, 14 nt, Human
gugauccucccacc

SEQ ID NO: 1164725 - RNA, 15 nt, Human
gugauccucccaccu

SEQ ID NO: 1164726 - RNA, 18 nt, Human
gugauccucccaccucag

SEQ ID NO: 1164727 - RNA, 20 nt, Human
gugauccucccaccucagcc

SEQ ID NO: 1164728 - RNA, 22 nt, Human
gugauccucccaccucagccuc

SEQ ID NO: 1164729 - RNA, 23 nt, Human
gugauccucccaccucagccucc

SEQ ID NO: 1164730 - RNA, 14 nt, Human
gugauucuccugcc

SEQ ID NO: 1164731 - RNA, 16 nt, Human
gugauucuccugccuc

SEQ ID NO: 1164732 - RNA, 17 nt, Human
gugauucuccugccuca

SEQ ID NO: 1164733 - RNA, 18 nt, Human
gugauucuccugccucag

SEQ ID NO: 1164734 - RNA, 19 nt, Human
gugauucuccugccucagc

SEQ ID NO: 1164735 - RNA, 20 nt, Human
gugauucuccugccucagcc

SEQ ID NO: 1164736 - RNA, 22 nt, Human
gugauucuccugccucagccuc

SEQ ID NO: 1164737 - RNA, 23 nt, Human
gugauucuccugccucagccucc

SEQ ID NO: 1164738 - RNA, 18 nt, Human
gugcaaauugucacagga

SEQ ID NO: 1164739 - RNA, 19 nt, Human
gugcauaaguuaacuucca

SEQ ID NO: 1164740 - RNA, 21 nt, Human
gugcauaccacuuuuguucuu

SEQ ID NO: 1164741 - RNA, 13 nt, Human
gugcauaccacuu

SEQ ID NO: 1164742 - RNA, 14 nt, Human
gugcauaccacuuu

SEQ ID NO: 1164743 - RNA, 22 nt, Human
gugcaugcugucccuuacguga

SEQ ID NO: 1164744 - RNA, 22 nt, Human
gugccagguuuuuggucugacc

SEQ ID NO: 1164745 - RNA, 20 nt, Human
gugcccacaggaucagucug

SEQ ID NO: 1164746 - RNA, 15 nt, Human
gugcugccauccagg

SEQ ID NO: 1164747 - RNA, 18 nt, Human
gugcugccauccagguuc

SEQ ID NO: 1164748 - RNA, 19 nt, Human
gugcugccauccagguuca

SEQ ID NO: 1164749 - RNA, 12 nt, Human
gugcugcauuua

SEQ ID NO: 1164750 - RNA, 19 nt, Human
gugcugcauuuaaaagaua

SEQ ID NO: 1164751 - RNA, 20 nt, Human
gugcugcauuuaaaagauac

SEQ ID NO: 1164752 - RNA, 12 nt, Human
gugcugagucug

SEQ ID NO: 1164753 - RNA, 16 nt, Human
gugcugagucugaagg

SEQ ID NO: 1164754 - RNA, 17 nt, Human
gugcugagucugaaggc

SEQ ID NO: 1164755 - RNA, 18 nt, Human
gugcugagucugaaggcu

SEQ ID NO: 1164756 - RNA, 19 nt, Human
gugcugagucugaaggcug

SEQ ID NO: 1164757 - RNA, 22 nt, Human
gugccgagaaggaagccuccca

SEQ ID NO: 1164758 - RNA, 21 nt, Human
gugccuuggggacaagagcag

SEQ ID NO: 1164759 - RNA, 15 nt, Human
gugcucuggacaggc

SEQ ID NO: 1164760 - RNA, 16 nt, Human
gugcucuggacaggca

SEQ ID NO: 1164761 - RNA, 17 nt, Human
gugcucuggacaggcau

SEQ ID NO: 1164762 - RNA, 18 nt, Human
gugcucuggacaggcaug

SEQ ID NO: 1164763 - RNA, 19 nt, Human
gugcugaaugguuuucaaa

SEQ ID NO: 1164764 - RNA, 20 nt, Human
gugcugaaugguuuucaaaa

SEQ ID NO: 1164765 - RNA, 23 nt, Human
gugcugaaugguuuucaaaauaa

SEQ ID NO: 1164766 - RNA, 22 nt, Human
gugcugccauccagguucagcu

SEQ ID NO: 1164767 - RNA, 11 nt, Human
gugcugcccug

SEQ ID NO: 1164768 - RNA, 12 nt, Human
gugcugcccugc

SEQ ID NO: 1164769 - RNA, 12 nt, Human
gugcuuggagga

SEQ ID NO: 1164770 - RNA, 13 nt, Human
gugcuuggaggaa

SEQ ID NO: 1164771 - RNA, 15 nt, Human
gugcuuggaggaagg

SEQ ID NO: 1164772 - RNA, 18 nt, Human
guggaaaaauagccugcc

SEQ ID NO: 1164773 - RNA, 20 nt, Human
guggagaagcggcuggcagc

SEQ ID NO: 1164774 - RNA, 17 nt, Human
guggaguucaucuugaa

SEQ ID NO: 1164775 - RNA, 16 nt, Human
guggaugccugguggc

SEQ ID NO: 1164776 - RNA, 18 nt, Human
guggaugccugguggcag

SEQ ID NO: 1164777 - RNA, 19 nt, Human
guggcagugggagcugccu

SEQ ID NO: 1164778 - RNA, 21 nt, Human
guggcagugggagcugccugu

SEQ ID NO: 1164779 - RNA, 20 nt, Human
guggaugccugguggcagcu

SEQ ID NO: 1164780 - RNA, 21 nt, Human
guggcagcugcgguccaccca

SEQ ID NO: 1164781 - RNA, 22 nt, Human
guggcagcugcgguccacccag

SEQ ID NO: 1164782 - RNA, 23 nt, Human
guggcagcugcgguccacccagg

SEQ ID NO: 1164783 - RNA, 12 nt, Human
guggcagcugcu

SEQ ID NO: 1164784 - RNA, 13 nt, Human
guggcagcugcuu

SEQ ID NO: 1164785 - RNA, 19 nt, Human
guggcagcugcuuuugucu

SEQ ID NO: 1164786 - RNA, 15 nt, Human
guggcagugggagcu

SEQ ID NO: 1164787 - RNA, 16 nt, Human
guggcagugggagcug

SEQ ID NO: 1164788 - RNA, 17 nt, Human
guggcagugggagcugc

SEQ ID NO: 1164789 - RNA, 18 nt, Human
uaggccuggccagaugca

SEQ ID NO: 1164790 - RNA, 15 nt, Human
uaggccuggccagau

SEQ ID NO: 1164791 - RNA, 18 nt, Human
uaggccaugggacaggga

SEQ ID NO: 1164792 - RNA, 12 nt, Human
uaggaauugacc

SEQ ID NO: 1164793 - RNA, 20 nt, Human
uaggaauugacccacaagaa

SEQ ID NO: 1164794 - RNA, 16 nt, Human
uaggucagugcaaaua

SEQ ID NO: 1164795 - RNA, 19 nt, Human
uagggaaaaaccagcgugu

SEQ ID NO: 1164796 - RNA, 20 nt, Human
uagggaaaaaccagcgugug

SEQ ID NO: 1164797 - RNA, 21 nt, Human
uagggaaaaaccagcguguga

SEQ ID NO: 1164798 - RNA, 23 nt, Human
uaggugacagagugagacucugu

SEQ ID NO: 1164799 - RNA, 13 nt, Human
uaguaucaaaaga

SEQ ID NO: 1164800 - RNA, 18 nt, Human
uaguauuucuaugaaaua

SEQ ID NO: 1164801 - RNA, 19 nt, Human
uaguauuucuaugaaauau

SEQ ID NO: 1164802 - RNA, 15 nt, Human
uaguaugaggcauuu

SEQ ID NO: 1164803 - RNA, 13 nt, Human
uagucaaauugug

SEQ ID NO: 1164804 - RNA, 14 nt, Human
uagucaaauugugu

SEQ ID NO: 1164805 - RNA, 14 nt, Human
uagugcaaauuguc

SEQ ID NO: 1164806 - RNA, 15 nt, Human
uagugcaaauuguca

SEQ ID NO: 1164807 - RNA, 10 nt, Human
uauacuguaa

SEQ ID NO: 1164808 - RNA, 11 nt, Human
uauacuguaaa

SEQ ID NO: 1164809 - RNA, 12 nt, Human
uauacuguaaag

SEQ ID NO: 1164810 - RNA, 13 nt, Human
uauacuguaaaga

SEQ ID NO: 1164811 - RNA, 14 nt, Human
uauacuguaaagaa

SEQ ID NO: 1164812 - RNA, 15 nt, Human
uauacuguaaagaaa

SEQ ID NO: 1164813 - RNA, 16 nt, Human
uauacuguaaagaaag

SEQ ID NO: 1164814 - RNA, 17 nt, Human
uauacuguaaagaaaga

SEQ ID NO: 1164815 - RNA, 19 nt, Human
uauacuguaaagaaagaga

SEQ ID NO: 1164816 - RNA, 20 nt, Human
uauacuguaaagaaagagag

SEQ ID NO: 1164817 - RNA, 22 nt, Human
uauacuguaaagaaagagagaa

SEQ ID NO: 1164818 - RNA, 13 nt, Human
uauauaacaaugc

SEQ ID NO: 1164819 - RNA, 21 nt, Human
uauaugcucugcauguuacau

SEQ ID NO: 1164820 - RNA, 13 nt, Human
uauaugcuucugu

SEQ ID NO: 1164821 - RNA, 14 nt, Human
uauaugcuucuguu

SEQ ID NO: 1164822 - RNA, 14 nt, Human
uaucuugaagacuu

SEQ ID NO: 1164823 - RNA, 20 nt, Human
uaucugucauuugagcaggg

SEQ ID NO: 1164824 - RNA, 21 nt, Human
uaucugucauuugagcagggc

SEQ ID NO: 1164825 - RNA, 23 nt, Human
uaucugucauuugagcagggcuc

SEQ ID NO: 1164826 - RNA, 22 nt, Human
uaugacacaugcaaggucauuu

SEQ ID NO: 1164827 - RNA, 12 nt, Human
uaugacacaugc

SEQ ID NO: 1164828 - RNA, 17 nt, Human
uaugaauuacauuugua

SEQ ID NO: 1164829 - RNA, 23 nt, Human
uaugaauuacauuuguauaaaau

SEQ ID NO: 1164830 - RNA, 16 nt, Human
uaucgucacugcuuaa

SEQ ID NO: 1164831 - RNA, 21 nt, Human
uaucuaauauguaacaagcca

SEQ ID NO: 1164832 - RNA, 19 nt, Human
uauauguuuuaagaggcag

SEQ ID NO: 1164833 - RNA, 15 nt, Human
uauccuucagccuga

SEQ ID NO: 1164834 - RNA, 18 nt, Human
uaugcaaucaaaucugcu

SEQ ID NO: 1164835 - RNA, 13 nt, Human
uaugcacacauuu

SEQ ID NO: 1164836 - RNA, 14 nt, Human
uaugcacacauuuu

SEQ ID NO: 1164837 - RNA, 16 nt, Human
uaugauucccagccag

SEQ ID NO: 1164838 - RNA, 16 nt, Human
uaugacuccagaauuu

SEQ ID NO: 1164839 - RNA, 17 nt, Human
uaugacuccagaauuuc

SEQ ID NO: 1164840 - RNA, 23 nt, Human
uaugacuccagaauuucccaaag

SEQ ID NO: 1164841 - RNA, 13 nt, Human
uaugcaugaagua

SEQ ID NO: 1164842 - RNA, 18 nt, Human
uaugcaugaaguaauaug

SEQ ID NO: 1164843 - RNA, 15 nt, Human
uaugcuucuguuuua

SEQ ID NO: 1164844 - RNA, 16 nt, Human
uaugcuucuguuuuau

SEQ ID NO: 1164845 - RNA, 13 nt, Human
uauggaacacucu

SEQ ID NO: 1164846 - RNA, 16 nt, Human
uauggaacacucugag

SEQ ID NO: 1164847 - RNA, 17 nt, Human
uauggaacacucugaga

SEQ ID NO: 1164848 - RNA, 18 nt, Human
uauggaacacucugagac

SEQ ID NO: 1164849 - RNA, 19 nt, Human
uauggaacacucugagacu

SEQ ID NO: 1164850 - RNA, 17 nt, Human
uauggacaaugacccag

SEQ ID NO: 1164851 - RNA, 21 nt, Human
uauguugcccaggcaggucuu

SEQ ID NO: 1164852 - RNA, 17 nt, Human
uauguucuaagaaguga

SEQ ID NO: 1164853 - RNA, 22 nt, Human
uauguucuuaguggauguucug

SEQ ID NO: 1164854 - RNA, 15 nt, Human
uauuaaaugcccagc

SEQ ID NO: 1164855 - RNA, 17 nt, Human
uauuaaaugcccagccc

SEQ ID NO: 1164856 - RNA, 19 nt, Human
uauuaaaugcccagccccu

SEQ ID NO: 1164857 - RNA, 16 nt, Human
uauuaagaaagacuau

SEQ ID NO: 1164858 - RNA, 12 nt, Human
uauguuaaaacu

SEQ ID NO: 1164859 - RNA, 19 nt, Human
uauguuagugcaaauuguc

SEQ ID NO: 1164860 - RNA, 16 nt, Human
uauuauguuaaaacug

SEQ ID NO: 1164861 - RNA, 17 nt, Human
uauuauauuuacaaaug

SEQ ID NO: 1164862 - RNA, 14 nt, Human
uauuauaccuuuuu

SEQ ID NO: 1164863 - RNA, 24 nt, Human
uauuaagaaagacuaucuaaaugu

SEQ ID NO: 1164864 - RNA, 14 nt, Human
uauuaaggaagaca

SEQ ID NO: 1164865 - RNA, 12 nt, Human
uauuauaccuuu

SEQ ID NO: 1164866 - RNA, 13 nt, Human
uauuauaccuuuu

SEQ ID NO: 1164867 - RNA, 20 nt, Human
uauugauaugcuuauacacu

SEQ ID NO: 1164868 - RNA, 21 nt, Human
uauugauaugcuuauacacuu

SEQ ID NO: 1164869 - RNA, 13 nt, Human
uauugcccacgcu

SEQ ID NO: 1164870 - RNA, 14 nt, Human
uauugcccacgcug

SEQ ID NO: 1164871 - RNA, 15 nt, Human
uauugcccacgcugg

SEQ ID NO: 1164872 - RNA, 23 nt, Human
uauugcugauggugcaaugaccu

SEQ ID NO: 1164873 - RNA, 17 nt, Human
uauuuaugggauccugg

SEQ ID NO: 1164874 - RNA, 22 nt, Human
uauuuauuaaaugcccagcccc

SEQ ID NO: 1164875 - RNA, 14 nt, Human
uauuuauuacugua

SEQ ID NO: 1164876 - RNA, 13 nt, Human
uauuucuaugaaa

SEQ ID NO: 1164877 - RNA, 14 nt, Human
uauuucuaugaaau

SEQ ID NO: 1164878 - RNA, 15 nt, Human
uauuucuaugaaaua

SEQ ID NO: 1164879 - RNA, 21 nt, Human
uauuucuaugaaauauuaugu

SEQ ID NO: 1164880 - RNA, 17 nt, Human
ucaaacauauauaacaa

SEQ ID NO: 1164881 - RNA, 13 nt, Human
ucaaacuuuacua

SEQ ID NO: 1164882 - RNA, 12 nt, Human
ucaaagagguuu

SEQ ID NO: 1164883 - RNA, 23 nt, Human
ucaaagagguuuuaaaaaaaucc

SEQ ID NO: 1164884 - RNA, 16 nt, Human
ucaaauccuugaagau

SEQ ID NO: 1164885 - RNA, 22 nt, Human
ucaacuccaaacugacucuuaa

SEQ ID NO: 1164886 - RNA, 20 nt, Human
ucaacucuccuccagaguca

SEQ ID NO: 1164887 - RNA, 18 nt, Human
ucaaccccuucgcuccug

SEQ ID NO: 1164888 - RNA, 19 nt, Human
ucaaccccuucgcuccugu

SEQ ID NO: 1164889 - RNA, 20 nt, Human
ucaaccccuucgcuccugug

SEQ ID NO: 1164890 - RNA, 15 nt, Human
ucaaccuccugggcu

SEQ ID NO: 1164891 - RNA, 16 nt, Human
ucaaccuccugggcua

SEQ ID NO: 1164892 - RNA, 12 nt, Human
ucaagccaccaa

SEQ ID NO: 1164893 - RNA, 20 nt, Human
ucaagccaccaacauacucc

SEQ ID NO: 1164894 - RNA, 18 nt, Human
ucaagcgauucuucugcu

SEQ ID NO: 1164895 - RNA, 19 nt, Human
ucaagcgauucuucugcuu

SEQ ID NO: 1164896 - RNA, 21 nt, Human
ucaagcgauucuucugcuuca

SEQ ID NO: 1164897 - RNA, 13 nt, Human
ucaaggauccuga

SEQ ID NO: 1164898 - RNA, 14 nt, Human
ucaaggauccugag

SEQ ID NO: 1164899 - RNA, 15 nt, Human
ucaaggauccugagc

SEQ ID NO: 1164900 - RNA, 16 nt, Human
ucaaggauccugagcc

SEQ ID NO: 1164901 - RNA, 17 nt, Human
ucaaggauccugagcca

SEQ ID NO: 1164902 - RNA, 15 nt, Human
ucacacacuuuggcu

SEQ ID NO: 1164903 - RNA, 23 nt, Human
ucacacaugagcaucaggccagg

SEQ ID NO: 1164904 - RNA, 16 nt, Human
ucacagucacauucca

SEQ ID NO: 1164905 - RNA, 14 nt, Human
ucaauaaaauccau

SEQ ID NO: 1164906 - RNA, 22 nt, Human
ucacaagacccaaaaggcagaa

SEQ ID NO: 1164907 - RNA, 12 nt, Human
ucacccuuuucu

SEQ ID NO: 1164908 - RNA, 14 nt, Human
ucaccgaaaacgug

SEQ ID NO: 1164909 - RNA, 19 nt, Human
ucacccgcuaagagggagg

SEQ ID NO: 1164910 - RNA, 15 nt, Human
ucaccgaaaacgugg

SEQ ID NO: 1164911 - RNA, 19 nt, Human
ucaccgaaaacguggcugc

SEQ ID NO: 1164912 - RNA, 20 nt, Human
ucaccgaaaacguggcugcu

SEQ ID NO: 1164913 - RNA, 21 nt, Human
ucaccgaaaacguggcugcuu

SEQ ID NO: 1164914 - RNA, 22 nt, Human
ucaccgaaaacguggcugcuuc

SEQ ID NO: 1164915 - RNA, 23 nt, Human
ucaccgaaaacguggcugcuuca

SEQ ID NO: 1164916 - RNA, 12 nt, Human
ucacauuuaaau

SEQ ID NO: 1164917 - RNA, 14 nt, Human
ucacauuuauucug

SEQ ID NO: 1164918 - RNA, 17 nt, Human
ucaccaacgucugugcc

SEQ ID NO: 1164919 - RNA, 18 nt, Human
ucaccaacgucugugcca

SEQ ID NO: 1164920 - RNA, 13 nt, Human
ucaccaagcccag

SEQ ID NO: 1164921 - RNA, 18 nt, Human
ucacccgcuaagagggag

SEQ ID NO: 1164922 - RNA, 21 nt, Human
ucaggccugggggcugggcag

SEQ ID NO: 1164923 - RNA, 23 nt, Human
ucagcuccagcucaccagcccca

SEQ ID NO: 1164924 - RNA, 24 nt, Human
ucagcuccagcucaccagccccag

SEQ ID NO: 1164925 - RNA, 23 nt, Human
ucagcucugcaagaauugaagca

SEQ ID NO: 1164926 - RNA, 13 nt, Human
ucaggcuagaugu

SEQ ID NO: 1164927 - RNA, 16 nt, Human
ucaggugauccaccca

SEQ ID NO: 1164928 - RNA, 23 nt, Human
ucaggugauccacccaccucagc

SEQ ID NO: 1164929 - RNA, 23 nt, Human
ucaggugccucaagagaaggcaa

SEQ ID NO: 1164930 - RNA, 18 nt, Human
ucagguggggcagcuuga

SEQ ID NO: 1164931 - RNA, 19 nt, Human
ucagguggggcagcuugag

SEQ ID NO: 1164932 - RNA, 20 nt, Human
ucagguggggcagcuugagg

SEQ ID NO: 1164933 - RNA, 21 nt, Human
ucagguggggcagcuugaggg

SEQ ID NO: 1164934 - RNA, 21 nt, Human
ucagucugauucccaagcucu

SEQ ID NO: 1164935 - RNA, 22 nt, Human
ucagucugauucccaagcucug

SEQ ID NO: 1164936 - RNA, 23 nt, Human
ucagucugauucccaagcucugc

SEQ ID NO: 1164937 - RNA, 13 nt, Human
uccaaaguacacu

SEQ ID NO: 1164938 - RNA, 16 nt, Human
ucauuaggauggcuag

SEQ ID NO: 1164939 - RNA, 17 nt, Human
ucaucaaugaaugaaug

SEQ ID NO: 1164940 - RNA, 20 nt, Human
ucaguguacauggaauaaca

SEQ ID NO: 1164941 - RNA, 16 nt, Human
ucagugccaaaaacaa

SEQ ID NO: 1164942 - RNA, 11 nt, Human
ucauagcagcu

SEQ ID NO: 1164943 - RNA, 12 nt, Human
ucauagcagcuu

SEQ ID NO: 1164944 - RNA, 14 nt, Human
ucauccacugugcc

SEQ ID NO: 1164945 - RNA, 17 nt, Human
ucauccacugugccaug

SEQ ID NO: 1164946 - RNA, 18 nt, Human
ucauccacugugccaugu

SEQ ID NO: 1164947 - RNA, 19 nt, Human
ucauggaauuggagcucgu

SEQ ID NO: 1164948 - RNA, 14 nt, Human
uccagauccuggaa

SEQ ID NO: 1164949 - RNA, 12 nt, Human
uccaggagcagc

SEQ ID NO: 1164950 - RNA, 13 nt, Human
uccaggagcagcc

SEQ ID NO: 1164951 - RNA, 14 nt, Human
uccaggagcagcca

SEQ ID NO: 1164952 - RNA, 15 nt, Human
uccaggagcagccac

SEQ ID NO: 1164953 - RNA, 19 nt, Human
uccaggggugggacacccu

SEQ ID NO: 1164954 - RNA, 20 nt, Human
uccaggggugggacacccug

SEQ ID NO: 1164955 - RNA, 14 nt, Human
uccaaaguacacug

SEQ ID NO: 1164956 - RNA, 16 nt, Human
uccaaaguacacuguu

SEQ ID NO: 1164957 - RNA, 21 nt, Human
uccacuuggucugugagaugc

SEQ ID NO: 1164958 - RNA, 23 nt, Human
uccacuuggucugugagaugcua

SEQ ID NO: 1164959 - RNA, 20 nt, Human
uccacuuucuagccagagga

SEQ ID NO: 1164960 - RNA, 21 nt, Human
uccacuuucuagccagaggag

SEQ ID NO: 1164961 - RNA, 22 nt, Human
uccaggggugggacacccugug

SEQ ID NO: 1164962 - RNA, 19 nt, Human
uccagguagagggugugua

SEQ ID NO: 1164963 - RNA, 20 nt, Human
uccagguuuaagcuguuacu

SEQ ID NO: 1164964 - RNA, 15 nt, Human
uccauacauuugugu

SEQ ID NO: 1164965 - RNA, 14 nt, Human
uccauagagagcaa

SEQ ID NO: 1164966 - RNA, 15 nt, Human
uccauagagagcaag

SEQ ID NO: 1164967 - RNA, 13 nt, Human
uccauggacuuug

SEQ ID NO: 1164968 - RNA, 20 nt, Human
uccaugggccauaugaaaag

SEQ ID NO: 1164969 - RNA, 15 nt, Human
ucccaucuuccaagg

SEQ ID NO: 1164970 - RNA, 18 nt, Human
ucccaugagccucagcau

SEQ ID NO: 1164971 - RNA, 19 nt, Human
ucccaugagccucagcauc

SEQ ID NO: 1164972 - RNA, 21 nt, Human
ucccagcugugcucuggacag

SEQ ID NO: 1164973 - RNA, 22 nt, Human
ucccagcugugcucuggacagg

SEQ ID NO: 1164974 - RNA, 23 nt, Human
ucccagcugugcucuggacaggc

SEQ ID NO: 1164975 - RNA, 24 nt, Human
ucccaggcauuccccaggaggcca

SEQ ID NO: 1164976 - RNA, 20 nt, Human
uccaugugggcuaguugggc

SEQ ID NO: 1164977 - RNA, 22 nt, Human
ucccaccucucucacuccuuga

SEQ ID NO: 1164978 - RNA, 13 nt, Human
ucccaccuuggcu

SEQ ID NO: 1164979 - RNA, 16 nt, Human
ucccaccuuggcugca

SEQ ID NO: 1164980 - RNA, 17 nt, Human
ucccaccuuggcugcag

SEQ ID NO: 1164981 - RNA, 18 nt, Human
ucccaccuuggcugcagg

SEQ ID NO: 1164982 - RNA, 20 nt, Human
ucccaugagccucagcaucc

SEQ ID NO: 1164983 - RNA, 13 nt, Human
uccccagauugca

SEQ ID NO: 1164984 - RNA, 18 nt, Human
uccccagauugcaacagg

SEQ ID NO: 1164985 - RNA, 19 nt, Human
uccccagauugcaacaggc

SEQ ID NO: 1164986 - RNA, 20 nt, Human
uccccagauugcaacaggcu

SEQ ID NO: 1164987 - RNA, 22 nt, Human
uccccagauugcaacaggcugg

SEQ ID NO: 1164988 - RNA, 23 nt, Human
uccccagauugcaacaggcuggg

SEQ ID NO: 1164989 - RNA, 20 nt, Human
uccccagcaagugagagcug

SEQ ID NO: 1164990 - RNA, 21 nt, Human
uccccagcaagugagagcugg

SEQ ID NO: 1164991 - RNA, 22 nt, Human
uccccagcaagugagagcuggg

SEQ ID NO: 1164992 - RNA, 14 nt, Human
uccccaggaggcca

SEQ ID NO: 1164993 - RNA, 15 nt, Human
uccccaggaggccag

SEQ ID NO: 1164994 - RNA, 16 nt, Human
uccccaggaggccagc

SEQ ID NO: 1164995 - RNA, 17 nt, Human
uccccaggaggccagcc

SEQ ID NO: 1164996 - RNA, 20 nt, Human
ucccccagccccauccucug

SEQ ID NO: 1164997 - RNA, 21 nt, Human
ucccccagccccauccucugu

SEQ ID NO: 1164998 - RNA, 22 nt, Human
ucccccagccccauccucugua

SEQ ID NO: 1164999 - RNA, 18 nt, Human
uccucauuagcauuuugc

SEQ ID NO: 1165000 - RNA, 10 nt, Human
uccuccaggu

SEQ ID NO: 1165001 - RNA, 12 nt, Human
uccucccaccuc

SEQ ID NO: 1165002 - RNA, 13 nt, Human
uccucccaccuca

SEQ ID NO: 1165003 - RNA, 12 nt, Human
uccuaguuccac

SEQ ID NO: 1165004 - RNA, 23 nt, Human
uccuauauuguuuucaguguaca

SEQ ID NO: 1165005 - RNA, 15 nt, Human
ucccccuuccaugga

SEQ ID NO: 1165006 - RNA, 21 nt, Human
ucccccuuccauggacuuugu

SEQ ID NO: 1165007 - RNA, 15 nt, Human
ucccuuccucuuucc

SEQ ID NO: 1165008 - RNA, 16 nt, Human
ucccuuccucuuucca

SEQ ID NO: 1165009 - RNA, 14 nt, Human
uccgccucuugggu

SEQ ID NO: 1165010 - RNA, 16 nt, Human
uccgcuuucuacccag

SEQ ID NO: 1165011 - RNA, 18 nt, Human
uccgcuuucuacccagcg

SEQ ID NO: 1165012 - RNA, 20 nt, Human
uccgcuuucuacccagcgag

SEQ ID NO: 1165013 - RNA, 20 nt, Human
uccuaagcuauucaguaaua

SEQ ID NO: 1165014 - RNA, 21 nt, Human
uccuaagcuauucaguaauaa

SEQ ID NO: 1165015 - RNA, 21 nt, Human
uccugaggcuccacuuggucu

SEQ ID NO: 1165016 - RNA, 19 nt, Human
uccugaggcuccacuuggu

SEQ ID NO: 1165017 - RNA, 20 nt, Human
uccugaggcuccacuugguc

SEQ ID NO: 1165018 - RNA, 13 nt, Human
uccugccaggcau

SEQ ID NO: 1165019 - RNA, 14 nt, Human
uccugccaggcaug

SEQ ID NO: 1165020 - RNA, 18 nt, Human
uccugccccugagcccau

SEQ ID NO: 1165021 - RNA, 17 nt, Human
uccugccccugagccca

SEQ ID NO: 1165022 - RNA, 17 nt, Human
uccugcccuuaccugcc

SEQ ID NO: 1165023 - RNA, 20 nt, Human
uccugcccuuaccugccagg

SEQ ID NO: 1165024 - RNA, 20 nt, Human
uccugccuaagugcagcccc

SEQ ID NO: 1165025 - RNA, 14 nt, Human
uccuggaguucugg

SEQ ID NO: 1165026 - RNA, 17 nt, Human
uccuggcaauagucaaa

SEQ ID NO: 1165027 - RNA, 23 nt, Human
uccuggcacccggccccugcugg

SEQ ID NO: 1165028 - RNA, 13 nt, Human
uccuggcacugcu

SEQ ID NO: 1165029 - RNA, 16 nt, Human
uccuggcacugcuucc

SEQ ID NO: 1165030 - RNA, 17 nt, Human
uccuggcacugcuucca

SEQ ID NO: 1165031 - RNA, 12 nt, Human
uccuggccucaa

SEQ ID NO: 1165032 - RNA, 11 nt, Human
uccuguagccc

SEQ ID NO: 1165033 - RNA, 13 nt, Human
uccuguagcccua

SEQ ID NO: 1165034 - RNA, 18 nt, Human
ucuaaaggcuaccuuugu

SEQ ID NO: 1165035 - RNA, 19 nt, Human
ucuaaaggcuaccuuugua

SEQ ID NO: 1165036 - RNA, 20 nt, Human
ucuaaaggcuaccuuuguau

SEQ ID NO: 1165037 - RNA, 13 nt, Human
ucgugacaacacu

SEQ ID NO: 1165038 - RNA, 14 nt, Human
ucuaugacacaugc

SEQ ID NO: 1165039 - RNA, 17 nt, Human
ucuaugacacaugcaag

SEQ ID NO: 1165040 - RNA, 15 nt, Human
ucuaggaagacuuug

SEQ ID NO: 1165041 - RNA, 16 nt, Human
ucuaggaagacuuugg

SEQ ID NO: 1165042 - RNA, 19 nt, Human
ucuaggaagacuuuggaaa

SEQ ID NO: 1165043 - RNA, 21 nt, Human
ucuaggaagacuuuggaaaga

SEQ ID NO: 1165044 - RNA, 17 nt, Human
ucuacacuaagagagaa

SEQ ID NO: 1165045 - RNA, 15 nt, Human
ucuacagaggccaug

SEQ ID NO: 1165046 - RNA, 16 nt, Human
ucuacagaggccaugg

SEQ ID NO: 1165047 - RNA, 14 nt, Human
ucuaccuuccugca

SEQ ID NO: 1165048 - RNA, 12 nt, Human
ucuacuaaaaau

SEQ ID NO: 1165049 - RNA, 13 nt, Human
ucuccacccugcu

SEQ ID NO: 1165050 - RNA, 17 nt, Human
ucuccacccugcucucc

SEQ ID NO: 1165051 - RNA, 14 nt, Human
ucuccacccugcuc

SEQ ID NO: 1165052 - RNA, 16 nt, Human
ucuccacccugcucuc

SEQ ID NO: 1165053 - RNA, 22 nt, Human
ucuccaccugccagggacagag

SEQ ID NO: 1165054 - RNA, 17 nt, Human
ucuccaccugccaggga

SEQ ID NO: 1165055 - RNA, 19 nt, Human
ucuccaccugccagggaca

SEQ ID NO: 1165056 - RNA, 14 nt, Human
ucuccaccugccag

SEQ ID NO: 1165057 - RNA, 15 nt, Human
ucuccaccugccagg

SEQ ID NO: 1165058 - RNA, 16 nt, Human
ucuccaccugccaggg

SEQ ID NO: 1165059 - RNA, 12 nt, Human
ucuaugggacuc

SEQ ID NO: 1165060 - RNA, 13 nt, Human
ucuaugggacuca

SEQ ID NO: 1165061 - RNA, 19 nt, Human
ucuaugggacucaaugcac

SEQ ID NO: 1165062 - RNA, 23 nt, Human
ucuaugggacucaaugcacugac

SEQ ID NO: 1165063 - RNA, 23 nt, Human
ucucaguccaugaagauguagag

SEQ ID NO: 1165064 - RNA, 16 nt, Human
ucucauacucaccuca

SEQ ID NO: 1165065 - RNA, 18 nt, Human
ucucauacucaccucacc

SEQ ID NO: 1165066 - RNA, 12 nt, Human
ucuccagccccu

SEQ ID NO: 1165067 - RNA, 13 nt, Human
ucuccagccccug

SEQ ID NO: 1165068 - RNA, 14 nt, Human
ucuccagccccugg

SEQ ID NO: 1165069 - RNA, 15 nt, Human
ucuccagccccugga

SEQ ID NO: 1165070 - RNA, 16 nt, Human
ucuccagccccuggau

SEQ ID NO: 1165071 - RNA, 18 nt, Human
ucuccagccccuggaugc

SEQ ID NO: 1165072 - RNA, 22 nt, Human
ucuccagccccuggaugcagcc

SEQ ID NO: 1165073 - RNA, 18 nt, Human
ucucccucagucuggccc

SEQ ID NO: 1165074 - RNA, 23 nt, Human
ucucccucagucuggcccuuccu

SEQ ID NO: 1165075 - RNA, 11 nt, Human
ucuccaggcug

SEQ ID NO: 1165076 - RNA, 12 nt, Human
ucucccccagcc

SEQ ID NO: 1165077 - RNA, 13 nt, Human
ucucccccagccc

SEQ ID NO: 1165078 - RNA, 16 nt, Human
ucucccuucauccuuc

SEQ ID NO: 1165079 - RNA, 15 nt, Human
ucuugcaugaggcua

SEQ ID NO: 1165080 - RNA, 16 nt, Human
ucuuguguguuuauug

SEQ ID NO: 1165081 - RNA, 21 nt, Human
ucuuguguguuuauugucaaa

SEQ ID NO: 1165082 - RNA, 23 nt, Human
ucuuucacccuuuucuguuugcu

SEQ ID NO: 1165083 - RNA, 17 nt, Human
ucuuuggacacucacac

SEQ ID NO: 1165084 - RNA, 12 nt, Human
ucuuugccaagu

SEQ ID NO: 1165085 - RNA, 16 nt, Human
ucuuucagccaagaau

SEQ ID NO: 1165086 - RNA, 19 nt, Human
ucuuucagccaagaauucu

SEQ ID NO: 1165087 - RNA, 20 nt, Human
ucuuucagccaagaauucuu

SEQ ID NO: 1165088 - RNA, 21 nt, Human
ucuuucagccaagaauucuua

SEQ ID NO: 1165089 - RNA, 13 nt, Human
ucuuuccaaagua

SEQ ID NO: 1165090 - RNA, 14 nt, Human
ucuuuccaaaguac

SEQ ID NO: 1165091 - RNA, 17 nt, Human
ucuuuccaaaguacacu

SEQ ID NO: 1165092 - RNA, 18 nt, Human
ugaaagcccugagcuuuc

SEQ ID NO: 1165093 - RNA, 18 nt, Human
ugaaacccugucucuacu

SEQ ID NO: 1165094 - RNA, 13 nt, Human
ugaaagggcccag

SEQ ID NO: 1165095 - RNA, 15 nt, Human
ugaaagggcccagag

SEQ ID NO: 1165096 - RNA, 15 nt, Human
ugaaagguacuucaa

SEQ ID NO: 1165097 - RNA, 16 nt, Human
ugaaagguacuucaaa

SEQ ID NO: 1165098 - RNA, 20 nt, Human
ugaaaagcuccauuuuuagu

SEQ ID NO: 1165099 - RNA, 13 nt, Human
ugaaaauuuugau

SEQ ID NO: 1165100 - RNA, 19 nt, Human
ugaaaauuuugauguuuua

SEQ ID NO: 1165101 - RNA, 21 nt, Human
ugaaaauuuugauguuuuaag

SEQ ID NO: 1165102 - RNA, 14 nt, Human
ugaaacauuuuguc

SEQ ID NO: 1165103 - RNA, 16 nt, Human
ugaaacccccacacac

SEQ ID NO: 1165104 - RNA, 17 nt, Human
ugaaacccccacacaca

SEQ ID NO: 1165105 - RNA, 18 nt, Human
ugaaacccccacacacac

SEQ ID NO: 1165106 - RNA, 16 nt, Human
ugaaauauugacuuuu

SEQ ID NO: 1165107 - RNA, 22 nt, Human
ugaaccaagaacuuuccaggaa

SEQ ID NO: 1165108 - RNA, 19 nt, Human
ugaaccacaucuugcucug

SEQ ID NO: 1165109 - RNA, 23 nt, Human
ugaaccacaucuugcucugcuga

SEQ ID NO: 1165110 - RNA, 17 nt, Human
ugaaccaccacacccag

SEQ ID NO: 1165111 - RNA, 20 nt, Human
ugaaccaccacacccagccc

SEQ ID NO: 1165112 - RNA, 21 nt, Human
ugaaccaccacacccagccca

SEQ ID NO: 1165113 - RNA, 17 nt, Human
ugaacuccuggccucaa

SEQ ID NO: 1165114 - RNA, 15 nt, Human
ugaaggccccgccca

SEQ ID NO: 1165115 - RNA, 16 nt, Human
ugaaggccccgcccag

SEQ ID NO: 1165116 - RNA, 19 nt, Human
ugaaggacauugcggacag

SEQ ID NO: 1165117 - RNA, 20 nt, Human
ugaaggacauugcggacagc

SEQ ID NO: 1165118 - RNA, 22 nt, Human
ugaaggacauugcggacagcca

SEQ ID NO: 1165119 - RNA, 17 nt, Human
ugaaggccccgcccagg

SEQ ID NO: 1165120 - RNA, 11 nt, Human
ugaaguccaag

SEQ ID NO: 1165121 - RNA, 13 nt, Human
ugaaguccaagca

SEQ ID NO: 1165122 - RNA, 16 nt, Human
ugaaugaaacccccac

SEQ ID NO: 1165123 - RNA, 18 nt, Human
ugaaugaaacccccacac

SEQ ID NO: 1165124 - RNA, 19 nt, Human
ugaaugaaacccccacaca

SEQ ID NO: 1165125 - RNA, 20 nt, Human
ugaaugaaacccccacacac

SEQ ID NO: 1165126 - RNA, 21 nt, Human
ugaaugaaacccccacacaca

SEQ ID NO: 1165127 - RNA, 22 nt, Human
ugaaugaaacccccacacacac

SEQ ID NO: 1165128 - RNA, 23 nt, Human
ugaaugaugauccuaggcauuug

SEQ ID NO: 1165129 - RNA, 15 nt, Human
ugaauuacauuugua

SEQ ID NO: 1165130 - RNA, 16 nt, Human
ugaauuacauuuguau

SEQ ID NO: 1165131 - RNA, 18 nt, Human
ugaauuacauuuguauaa

SEQ ID NO: 1165132 - RNA, 23 nt, Human
ugacagacacaggcccggcucca

SEQ ID NO: 1165133 - RNA, 14 nt, Human
ugacagaggcagcc

SEQ ID NO: 1165134 - RNA, 15 nt, Human
ugacagaggcagccc

SEQ ID NO: 1165135 - RNA, 16 nt, Human
ugacagaggcagcccc

SEQ ID NO: 1165136 - RNA, 17 nt, Human
ugacagaggcagcccca

SEQ ID NO: 1165137 - RNA, 18 nt, Human
ugacagaggcagccccau

SEQ ID NO: 1165138 - RNA, 23 nt, Human
ugacagaggcagccccauucugc

SEQ ID NO: 1165139 - RNA, 14 nt, Human
ugacagagugagac

SEQ ID NO: 1165140 - RNA, 17 nt, Human
ugacagagugagacucu

SEQ ID NO: 1165141 - RNA, 19 nt, Human
ugacagagugagacucugu

SEQ ID NO: 1165142 - RNA, 22 nt, Human
ugacagagugagacucugucuc

SEQ ID NO: 1165143 - RNA, 18 nt, Human
ugacaaggauugcuacug

SEQ ID NO: 1165144 - RNA, 15 nt, Human
ugacaagcucacaga

SEQ ID NO: 1165145 - RNA, 20 nt, Human
ugacaagcucacagaccuuu

SEQ ID NO: 1165146 - RNA, 12 nt, Human
ugacaagcucac

SEQ ID NO: 1165147 - RNA, 17 nt, Human
ugacaugggacauuugc

SEQ ID NO: 1165148 - RNA, 18 nt, Human
ugacaugggacauuugcu

SEQ ID NO: 1165149 - RNA, 13 nt, Human
ugacaugucuuuu

SEQ ID NO: 1165150 - RNA, 15 nt, Human
ugacaugucuuuucu

SEQ ID NO: 1165151 - RNA, 20 nt, Human
ugaccacugcagaagacagu

SEQ ID NO: 1165152 - RNA, 19 nt, Human
ugaccagcaccaucucucc

SEQ ID NO: 1165153 - RNA, 20 nt, Human
ugaccagcaccaucucuccu

SEQ ID NO: 1165154 - RNA, 16 nt, Human
ugaccauucuccaccu

SEQ ID NO: 1165155 - RNA, 17 nt, Human
ugaccauucuccaccug

SEQ ID NO: 1165156 - RNA, 18 nt, Human
ugaccauucuccaccugc

SEQ ID NO: 1165157 - RNA, 19 nt, Human
ugaccauucuccaccugcc

SEQ ID NO: 1165158 - RNA, 13 nt, Human
ugaccgugaggcc

SEQ ID NO: 1165159 - RNA, 14 nt, Human
ugaccgugaggcca

SEQ ID NO: 1165160 - RNA, 16 nt, Human
ugaccgugaggccaga

SEQ ID NO: 1165161 - RNA, 20 nt, Human
ugaccgugaggccagagaca

SEQ ID NO: 1165162 - RNA, 20 nt, Human
ugaccucaggugauccaccc

SEQ ID NO: 1165163 - RNA, 21 nt, Human
ugaccucaggugauccaccca

SEQ ID NO: 1165164 - RNA, 19 nt, Human
ugagacucgcgacaaugca

SEQ ID NO: 1165165 - RNA, 20 nt, Human
ugagacucgcgacaaugcaa

SEQ ID NO: 1165166 - RNA, 21 nt, Human
ugagacucgcgacaaugcaaa

SEQ ID NO: 1165167 - RNA, 22 nt, Human
ugagacucgcgacaaugcaaac

SEQ ID NO: 1165168 - RNA, 23 nt, Human
ugagacucgcgacaaugcaaacc

SEQ ID NO: 1165169 - RNA, 16 nt, Human
ugagagugaacaaauu

SEQ ID NO: 1165170 - RNA, 15 nt, Human
ugagaucaaaacggu

SEQ ID NO: 1165171 - RNA, 14 nt, Human
ugagaucagccugg

SEQ ID NO: 1165172 - RNA, 15 nt, Human
ugagaucagccuggg

SEQ ID NO: 1165173 - RNA, 13 nt, Human
ugagcagggcuca

SEQ ID NO: 1165174 - RNA, 14 nt, Human
ugagcagggcucag

SEQ ID NO: 1165175 - RNA, 15 nt, Human
ugagcagggcucagc

SEQ ID NO: 1165176 - RNA, 19 nt, Human
ugagccgagaucacgccac

SEQ ID NO: 1165177 - RNA, 21 nt, Human
ugagccgagaucacgccacug

SEQ ID NO: 1165178 - RNA, 17 nt, Human
ugagccucagcauccug

SEQ ID NO: 1165179 - RNA, 22 nt, Human
ugagccucagcauccuggcacc

SEQ ID NO: 1165180 - RNA, 18 nt, Human
ugagccucagcauccugg

SEQ ID NO: 1165181 - RNA, 21 nt, Human
ugagccucagcauccuggcac

SEQ ID NO: 1165182 - RNA, 10 nt, Human
ugagccuggc

SEQ ID NO: 1165183 - RNA, 16 nt, Human
ugagcagggcucagcg

SEQ ID NO: 1165184 - RNA, 17 nt, Human
ugagcagggcucagcgg

SEQ ID NO: 1165185 - RNA, 19 nt, Human
ugagcagggcucagcgggg

SEQ ID NO: 1165186 - RNA, 18 nt, Human
ugagcaucaggccaggcc

SEQ ID NO: 1165187 - RNA, 19 nt, Human
ugagcaucaggccaggccc

SEQ ID NO: 1165188 - RNA, 20 nt, Human
ugagcaucaggccaggcccu

SEQ ID NO: 1165189 - RNA, 21 nt, Human
ugagcaucaggccaggcccuc

SEQ ID NO: 1165190 - RNA, 12 nt, Human
ugaggcauuugu

SEQ ID NO: 1165191 - RNA, 19 nt, Human
ugaggcauuuguuugaacu

SEQ ID NO: 1165192 - RNA, 20 nt, Human
ugaggcauuuguuugaacug

SEQ ID NO: 1165193 - RNA, 21 nt, Human
ugaggcauuuguuugaacuga

SEQ ID NO: 1165194 - RNA, 17 nt, Human
ugaggcuaguguggugu

SEQ ID NO: 1165195 - RNA, 23 nt, Human
ugaggcuagugugguguuuccug

SEQ ID NO: 1165196 - RNA, 23 nt, Human
ugaggcauuuguuugaacugaua

SEQ ID NO: 1165197 - RNA, 13 nt, Human
ugagcugggauga

SEQ ID NO: 1165198 - RNA, 18 nt, Human
ugaggcuccacuuggucu

SEQ ID NO: 1165199 - RNA, 20 nt, Human
ugaggcuccacuuggucugu

SEQ ID NO: 1165200 - RNA, 13 nt, Human
ugaggcucugccc

SEQ ID NO: 1165201 - RNA, 14 nt, Human
ugaggcucugcccu

SEQ ID NO: 1165202 - RNA, 15 nt, Human
ugaggcucugcccuu

SEQ ID NO: 1165203 - RNA, 17 nt, Human
ugagggaacagagaggu

SEQ ID NO: 1165204 - RNA, 12 nt, Human
ugaggugggagg

SEQ ID NO: 1165205 - RNA, 13 nt, Human
ugaggugggagga

SEQ ID NO: 1165206 - RNA, 21 nt, Human
ugaggugggaggaucucuuga

SEQ ID NO: 1165207 - RNA, 19 nt, Human
ugaguccagaaguuugaga

SEQ ID NO: 1165208 - RNA, 19 nt, Human
ugagucgaggacagggagg

SEQ ID NO: 1165209 - RNA, 13 nt, Human
ugagucugaaggc

SEQ ID NO: 1165210 - RNA, 15 nt, Human
ugagucugaaggcug

SEQ ID NO: 1165211 - RNA, 17 nt, Human
ugagucugaaggcuggg

SEQ ID NO: 1165212 - RNA, 18 nt, Human
ugagucugaaggcugggu

SEQ ID NO: 1165213 - RNA, 21 nt, Human
ugaguugauagcacagacccu

SEQ ID NO: 1165214 - RNA, 14 nt, Human
ugagugagcaugcc

SEQ ID NO: 1165215 - RNA, 16 nt, Human
ugaguugauagcacag

SEQ ID NO: 1165216 - RNA, 20 nt, Human
ugaguugauagcacagaccc

SEQ ID NO: 1165217 - RNA, 16 nt, Human
ugauaacuggaaacuu

SEQ ID NO: 1165218 - RNA, 20 nt, Human
ugaucuucuuuauaauucua

SEQ ID NO: 1165219 - RNA, 17 nt, Human
ugauccacccaccucag

SEQ ID NO: 1165220 - RNA, 18 nt, Human
ugauccacccaccucagc

SEQ ID NO: 1165221 - RNA, 19 nt, Human
ugauccacccaccucagcc

SEQ ID NO: 1165222 - RNA, 17 nt, Human
ugaucucucgugauuga

SEQ ID NO: 1165223 - RNA, 20 nt, Human
ugauaagaaccuuuugagug

SEQ ID NO: 1165224 - RNA, 13 nt, Human
ugauagcacagac

SEQ ID NO: 1165225 - RNA, 14 nt, Human
ugauagcacagacc

SEQ ID NO: 1165226 - RNA, 17 nt, Human
ugaucagcuuauugucu

SEQ ID NO: 1165227 - RNA, 24 nt, Human
ugaucagcuuauugucuagugaaa

SEQ ID NO: 1165228 - RNA, 13 nt, Human
ugauccaagcugg

SEQ ID NO: 1165229 - RNA, 14 nt, Human
ugauccaagcuggu

SEQ ID NO: 1165230 - RNA, 15 nt, Human
ugauccaagcugguc

SEQ ID NO: 1165231 - RNA, 17 nt, Human
ugauccaagcugguccc

SEQ ID NO: 1165232 - RNA, 20 nt, Human
ugaugcuacaggauuugaaa

SEQ ID NO: 1165233 - RNA, 23 nt, Human
ugaugcgggccagugcuccagcc

SEQ ID NO: 1165234 - RNA, 23 nt, Human
ugaugcuacaggauuugaaauug

SEQ ID NO: 1165235 - RNA, 16 nt, Human
ugaucuuugcagacag

SEQ ID NO: 1165236 - RNA, 18 nt, Human
ugaucuuugcagacaggc

SEQ ID NO: 1165237 - RNA, 16 nt, Human
ugaugcuucuucagag

SEQ ID NO: 1165238 - RNA, 17 nt, Human
ugaugcuucuucagaga

SEQ ID NO: 1165239 - RNA, 18 nt, Human
ugaugcuucuucagagac

SEQ ID NO: 1165240 - RNA, 16 nt, Human
ugauguguuaucucuu

SEQ ID NO: 1165241 - RNA, 13 nt, Human
ugauucagacagc

SEQ ID NO: 1165242 - RNA, 14 nt, Human
ugauucagacagcu

SEQ ID NO: 1165243 - RNA, 15 nt, Human
ugauucagacagcug

SEQ ID NO: 1165244 - RNA, 16 nt, Human
ugauucagacagcugc

SEQ ID NO: 1165245 - RNA, 21 nt, Human
ugauuaugaauuacauuugua

SEQ ID NO: 1165246 - RNA, 22 nt, Human
ugauuaugaauuacauuuguau

SEQ ID NO: 1165247 - RNA, 20 nt, Human
ugauucaacagguuuuccug

SEQ ID NO: 1165248 - RNA, 13 nt, Human
ugauuauauguca

SEQ ID NO: 1165249 - RNA, 17 nt, Human
ugauuaugaauuacauu

SEQ ID NO: 1165250 - RNA, 19 nt, Human
ugauuaugaauuacauuug

SEQ ID NO: 1165251 - RNA, 20 nt, Human
ugauguucuuucacccuuuu

SEQ ID NO: 1165252 - RNA, 22 nt, Human
ugauguuuagaaacacaacuau

SEQ ID NO: 1165253 - RNA, 13 nt, Human
ugauuggaggggg

SEQ ID NO: 1165254 - RNA, 21 nt, Human
ugauuggaggggggagguggg

SEQ ID NO: 1165255 - RNA, 16 nt, Human
ugauugugucucuugg

SEQ ID NO: 1165256 - RNA, 18 nt, Human
ugauucagacagcugccu

SEQ ID NO: 1165257 - RNA, 19 nt, Human
ugauucagacagcugccug

SEQ ID NO: 1165258 - RNA, 20 nt, Human
ugauucagacagcugccugg

SEQ ID NO: 1165259 - RNA, 21 nt, Human
ugauucagacagcugccuggg

SEQ ID NO: 1165260 - RNA, 23 nt, Human
ugauucagacagcugccugggau

SEQ ID NO: 1165261 - RNA, 21 nt, Human
ugauucuccugccucagccuc

SEQ ID NO: 1165262 - RNA, 13 nt, Human
ugauucagcucug

SEQ ID NO: 1165263 - RNA, 16 nt, Human
ugccccuggcagcccc

SEQ ID NO: 1165264 - RNA, 17 nt, Human
ugccccuggcagccccu

SEQ ID NO: 1165265 - RNA, 12 nt, Human
ugcccggcugcg

SEQ ID NO: 1165266 - RNA, 14 nt, Human
ugcccggcugcgga

SEQ ID NO: 1165267 - RNA, 18 nt, Human
ugcccaggcuggcgugca

SEQ ID NO: 1165268 - RNA, 19 nt, Human
ugcccaggcuggcgugcag

SEQ ID NO: 1165269 - RNA, 20 nt, Human
ugcccaggcuggcgugcagu

SEQ ID NO: 1165270 - RNA, 21 nt, Human
ugcccugcccaccuggccucu

SEQ ID NO: 1165271 - RNA, 15 nt, Human
ugcccugcccaccug

SEQ ID NO: 1165272 - RNA, 16 nt, Human
ugcccugcccaccugg

SEQ ID NO: 1165273 - RNA, 20 nt, Human
ugcccugcccaccuggccuc

SEQ ID NO: 1165274 - RNA, 23 nt, Human
ugcccugugaguacuacaguccu

SEQ ID NO: 1165275 - RNA, 14 nt, Human
ugccucaagagaag

SEQ ID NO: 1165276 - RNA, 15 nt, Human
ugccucaagagaagg

SEQ ID NO: 1165277 - RNA, 21 nt, Human
ugcaguuacacuaaaagguga

SEQ ID NO: 1165278 - RNA, 21 nt, Human
ugcaguggugcgaucuggguu

SEQ ID NO: 1165279 - RNA, 13 nt, Human
ugcagggaguccg

SEQ ID NO: 1165280 - RNA, 12 nt, Human
ugcaguucugaa

SEQ ID NO: 1165281 - RNA, 14 nt, Human
ugcaguucugaaga

SEQ ID NO: 1165282 - RNA, 16 nt, Human
ugcaguugccagucac

SEQ ID NO: 1165283 - RNA, 17 nt, Human
ugcaugguuuagaaagc

SEQ ID NO: 1165284 - RNA, 21 nt, Human
ugcauuuggugguuucagaaa

SEQ ID NO: 1165285 - RNA, 23 nt, Human
ugcauuuggugguuucagaaaug

SEQ ID NO: 1165286 - RNA, 16 nt, Human
ugccacuaaauugaca

SEQ ID NO: 1165287 - RNA, 20 nt, Human
ugccaggaagccagcaggcu

SEQ ID NO: 1165288 - RNA, 22 nt, Human
ugccaggaagccagcaggcucu

SEQ ID NO: 1165289 - RNA, 20 nt, Human
ugccacuaaauugacacuua

SEQ ID NO: 1165290 - RNA, 14 nt, Human
ugccaggcauggug

SEQ ID NO: 1165291 - RNA, 21 nt, Human
ugcuacuguccuacccacccu

SEQ ID NO: 1165292 - RNA, 22 nt, Human
ugcuacuguccuacccacccuc

SEQ ID NO: 1165293 - RNA, 17 nt, Human
ugcggacagccacggcc

SEQ ID NO: 1165294 - RNA, 23 nt, Human
ugcucuccgaccagacaccuuga

SEQ ID NO: 1165295 - RNA, 13 nt, Human
ugcuagaacuccc

SEQ ID NO: 1165296 - RNA, 14 nt, Human
ugcuagaacucccu

SEQ ID NO: 1165297 - RNA, 15 nt, Human
ugcuagaacucccuu

SEQ ID NO: 1165298 - RNA, 17 nt, Human
ugcuagaacucccuuuc

SEQ ID NO: 1165299 - RNA, 18 nt, Human
ugcuagaacucccuuuca

SEQ ID NO: 1165300 - RNA, 21 nt, Human
ugcuaggaacacuccuucaca

SEQ ID NO: 1165301 - RNA, 22 nt, Human
ugcuaggaacacuccuucacag

SEQ ID NO: 1165302 - RNA, 12 nt, Human
ugcugcuugagg

SEQ ID NO: 1165303 - RNA, 19 nt, Human
ugcugcuugaggcaacuca

SEQ ID NO: 1165304 - RNA, 17 nt, Human
ugcugcauuuaaaagau

SEQ ID NO: 1165305 - RNA, 18 nt, Human
ugcugcauuuaaaagaua

SEQ ID NO: 1165306 - RNA, 19 nt, Human
ugcugcauuuaaaagauac

SEQ ID NO: 1165307 - RNA, 23 nt, Human
ugcugcauuuaaaagauacaguu

SEQ ID NO: 1165308 - RNA, 17 nt, Human
ugcugggcuugucugua

SEQ ID NO: 1165309 - RNA, 20 nt, Human
ugcugggggggauuguaaaa

SEQ ID NO: 1165310 - RNA, 13 nt, Human
ugcuggguguggc

SEQ ID NO: 1165311 - RNA, 21 nt, Human
uggaggaaggaaacccagcuc

SEQ ID NO: 1165312 - RNA, 23 nt, Human
uggaggaaggaaacccagcucug

SEQ ID NO: 1165313 - RNA, 12 nt, Human
uggcaaaaaggc

SEQ ID NO: 1165314 - RNA, 16 nt, Human
uggcaaaaaggcagga

SEQ ID NO: 1165315 - RNA, 20 nt, Human
uggcaauagucaaauugugu

SEQ ID NO: 1165316 - RNA, 15 nt, Human
uggcacuaguauuuc

SEQ ID NO: 1165317 - RNA, 15 nt, Human
uggcacuauaaugua

SEQ ID NO: 1165318 - RNA, 16 nt, Human
uggcacuauaauguaa

SEQ ID NO: 1165319 - RNA, 21 nt, Human
uggcacuauaauguaagcucu

SEQ ID NO: 1165320 - RNA, 15 nt, Human
uggcagaguugaaga

SEQ ID NO: 1165321 - RNA, 21 nt, Human
uggcagaguggauucuugaac

SEQ ID NO: 1165322 - RNA, 17 nt, Human
uggcagaguugaagaca

SEQ ID NO: 1165323 - RNA, 19 nt, Human
uggcagaguugaagacaga

SEQ ID NO: 1165324 - RNA, 17 nt, Human
uggccagaugcaccagc

SEQ ID NO: 1165325 - RNA, 18 nt, Human
uggccagaugcaccagcc

SEQ ID NO: 1165326 - RNA, 19 nt, Human
uggccagaugcaccagccc

SEQ ID NO: 1165327 - RNA, 20 nt, Human
uggccagaugcaccagcccu

SEQ ID NO: 1165328 - RNA, 15 nt, Human
uggccaggcuggucu

SEQ ID NO: 1165329 - RNA, 13 nt, Human
uggccaggcuggu

SEQ ID NO: 1165330 - RNA, 15 nt, Human
uggccccugcccggc

SEQ ID NO: 1165331 - RNA, 16 nt, Human
uggccccugcccggcu

SEQ ID NO: 1165332 - RNA, 20 nt, Human
uggccccugcccggcugcgg

SEQ ID NO: 1165333 - RNA, 11 nt, Human
uggcugcuuca

SEQ ID NO: 1165334 - RNA, 15 nt, Human
uggcugcuucaagga

SEQ ID NO: 1165335 - RNA, 16 nt, Human
uggcugcuucaaggau

SEQ ID NO: 1165336 - RNA, 22 nt, Human
uggcgcagcauauucaggaagc

SEQ ID NO: 1165337 - RNA, 23 nt, Human
uggcgcagcauauucaggaagcu

SEQ ID NO: 1165338 - RNA, 16 nt, Human
uggcgcugccccuggc

SEQ ID NO: 1165339 - RNA, 23 nt, Human
uggcgcugccccuggcagccccu

SEQ ID NO: 1165340 - RNA, 22 nt, Human
ugggcagagcagagaccauccc

SEQ ID NO: 1165341 - RNA, 22 nt, Human
ugggauuacaagcgugagccac

SEQ ID NO: 1165342 - RNA, 12 nt, Human
ugggauccucca

SEQ ID NO: 1165343 - RNA, 13 nt, Human
ugggauccuccag

SEQ ID NO: 1165344 - RNA, 14 nt, Human
ugggauccuccagg

SEQ ID NO: 1165345 - RNA, 16 nt, Human
uggcugggggccucag

SEQ ID NO: 1165346 - RNA, 17 nt, Human
uggcugggggccucagu

SEQ ID NO: 1165347 - RNA, 20 nt, Human
uggcugggggccucagugcc

SEQ ID NO: 1165348 - RNA, 14 nt, Human
ugggagugggccca

SEQ ID NO: 1165349 - RNA, 16 nt, Human
ugggagugggcccaau

SEQ ID NO: 1165350 - RNA, 23 nt, Human
ugggcagagcagagaccaucccu

SEQ ID NO: 1165351 - RNA, 15 nt, Human
uggggaugagaaagg

SEQ ID NO: 1165352 - RNA, 23 nt, Human
uggggaugagaaagguugaagca

SEQ ID NO: 1165353 - RNA, 20 nt, Human
uggggccaguuggucccccu

SEQ ID NO: 1165354 - RNA, 21 nt, Human
uggggccaguuggucccccuu

SEQ ID NO: 1165355 - RNA, 17 nt, Human
uggguacuuguggacac

SEQ ID NO: 1165356 - RNA, 18 nt, Human
uggguacuuguggacaca

SEQ ID NO: 1165357 - RNA, 20 nt, Human
uggguacuuguggacacagc

SEQ ID NO: 1165358 - RNA, 16 nt, Human
ugggggaguggccaca

SEQ ID NO: 1165359 - RNA, 20 nt, Human
ugggggaucacagccucuga

SEQ ID NO: 1165360 - RNA, 22 nt, Human
uggucacaggaaguagaggagg

SEQ ID NO: 1165361 - RNA, 14 nt, Human
uggucccccuucca

SEQ ID NO: 1165362 - RNA, 13 nt, Human
ugguauguuuuca

SEQ ID NO: 1165363 - RNA, 21 nt, Human
ugguauguuuucaggcuagau

SEQ ID NO: 1165364 - RNA, 15 nt, Human
uggucccccuuccau

SEQ ID NO: 1165365 - RNA, 16 nt, Human
uggucccccuuccaug

SEQ ID NO: 1165366 - RNA, 18 nt, Human
uggucccccuuccaugga

SEQ ID NO: 1165367 - RNA, 23 nt, Human
uggucccccuuccauggacuuug

SEQ ID NO: 1165368 - RNA, 17 nt, Human
ugguccuaaucuucuga

SEQ ID NO: 1165369 - RNA, 19 nt, Human
ugguccuaaucuucugaac

SEQ ID NO: 1165370 - RNA, 13 nt, Human
ugguccugcugca

SEQ ID NO: 1165371 - RNA, 15 nt, Human
ugguccugcugcagu

SEQ ID NO: 1165372 - RNA, 23 nt, Human
ugguccugcugcaguugccaguc

SEQ ID NO: 1165373 - RNA, 14 nt, Human
uggucggaaaacau

SEQ ID NO: 1165374 - RNA, 17 nt, Human
uggucggaaaacaugcu

SEQ ID NO: 1165375 - RNA, 15 nt, Human
uggucuacacugugc

SEQ ID NO: 1165376 - RNA, 16 nt, Human
uggucuacacugugcu

SEQ ID NO: 1165377 - RNA, 17 nt, Human
uggucuacacugugcug

SEQ ID NO: 1165378 - RNA, 18 nt, Human
uggucuacacugugcuga

SEQ ID NO: 1165379 - RNA, 19 nt, Human
uggucuacacugugcugag

SEQ ID NO: 1165380 - RNA, 13 nt, Human
uggugaccucugc

SEQ ID NO: 1165381 - RNA, 14 nt, Human
uggugaccucugcc

SEQ ID NO: 1165382 - RNA, 15 nt, Human
uggugaccucugccu

SEQ ID NO: 1165383 - RNA, 16 nt, Human
uggugaccucugccug

SEQ ID NO: 1165384 - RNA, 17 nt, Human
uggugaccucugccuga

SEQ ID NO: 1165385 - RNA, 22 nt, Human
uggugaccucugccugaaguca

SEQ ID NO: 1165386 - RNA, 19 nt, Human
uggugacuuuccucuuugg

SEQ ID NO: 1165387 - RNA, 21 nt, Human
uggugcaaugaccuuucaaua

SEQ ID NO: 1165388 - RNA, 22 nt, Human
uguuuuaagaggcagggucuca

SEQ ID NO: 1165389 - RNA, 18 nt, Human
uguuuuaaggaugcuugu

SEQ ID NO: 1165390 - RNA, 19 nt, Human
uguuuuaaggaugcuugua

SEQ ID NO: 1165391 - RNA, 14 nt, Human
uuaaaagauacagu

SEQ ID NO: 1165392 - RNA, 17 nt, Human
uuaaaagauacaguuac

SEQ ID NO: 1165393 - RNA, 13 nt, Human
uuaaaagaaugau

SEQ ID NO: 1165394 - RNA, 21 nt, Human
uuaaaauaccagccaguaaau

SEQ ID NO: 1165395 - RNA, 21 nt, Human
uguuucaaacauauauaacaa

SEQ ID NO: 1165396 - RNA, 22 nt, Human
uguuucaaacauauauaacaau

SEQ ID NO: 1165397 - RNA, 15 nt, Human
uguuucaaacuuuac

SEQ ID NO: 1165398 - RNA, 20 nt, Human
uguuuagauaauacaccacu

SEQ ID NO: 1165399 - RNA, 16 nt, Human
uguuuagauaauacac

SEQ ID NO: 1165400 - RNA, 13 nt, Human
uguuugugauuga

SEQ ID NO: 1165401 - RNA, 17 nt, Human
uuaagcuguuacugucu

SEQ ID NO: 1165402 - RNA, 18 nt, Human
uuaauauugauaugcuua

SEQ ID NO: 1165403 - RNA, 22 nt, Human
uuaauauugauaugcuuauaca

SEQ ID NO: 1165404 - RNA, 22 nt, Human
uuaaugucaauucuugccaaau

SEQ ID NO: 1165405 - RNA, 20 nt, Human
uuacaagcgugagccacugc

SEQ ID NO: 1165406 - RNA, 21 nt, Human
uuacaagcgugagccacugca

SEQ ID NO: 1165407 - RNA, 22 nt, Human
uuaauuaaaacacaacaucuuu

SEQ ID NO: 1165408 - RNA, 16 nt, Human
uuaacuucacauauug

SEQ ID NO: 1165409 - RNA, 15 nt, Human
uuaacuuuuauaaac

SEQ ID NO: 1165410 - RNA, 16 nt, Human
uuaacuuuuauaaacu

SEQ ID NO: 1165411 - RNA, 17 nt, Human
uuaacuuuuauaaacuu

SEQ ID NO: 1165412 - RNA, 18 nt, Human
uuaacuuuuauaaacuuu

SEQ ID NO: 1165413 - RNA, 17 nt, Human
uuaaccacuucagcuga

SEQ ID NO: 1165414 - RNA, 17 nt, Human
uuacuaguuucccuugc

SEQ ID NO: 1165415 - RNA, 13 nt, Human
uuacuaaguuuuu

SEQ ID NO: 1165416 - RNA, 14 nt, Human
uuacuaaguuuuua

SEQ ID NO: 1165417 - RNA, 16 nt, Human
uuacuaauagacaauu

SEQ ID NO: 1165418 - RNA, 18 nt, Human
uuacuuagguguggggga

SEQ ID NO: 1165419 - RNA, 11 nt, Human
uuacuucugcu

SEQ ID NO: 1165420 - RNA, 12 nt, Human
uuacuucugcua

SEQ ID NO: 1165421 - RNA, 23 nt, Human
uuacuucuuauacauuugauaaa

SEQ ID NO: 1165422 - RNA, 19 nt, Human
uuacuauggcccuggccua

SEQ ID NO: 1165423 - RNA, 21 nt, Human
uuacuuaaaccgccaaggcug

SEQ ID NO: 1165424 - RNA, 17 nt, Human
uuacuuuaaaaggagcc

SEQ ID NO: 1165425 - RNA, 18 nt, Human
uuacuuuaaaaggagcca

SEQ ID NO: 1165426 - RNA, 14 nt, Human
uuacuuuguguuca

SEQ ID NO: 1165427 - RNA, 19 nt, Human
uuagaaacacaacuauauu

SEQ ID NO: 1165428 - RNA, 15 nt, Human
uuagacagucccugc

SEQ ID NO: 1165429 - RNA, 16 nt, Human
uuagacagucccugcc

SEQ ID NO: 1165430 - RNA, 17 nt, Human
uuagacagucccugcca

SEQ ID NO: 1165431 - RNA, 18 nt, Human
uuagacagucccugccaa

SEQ ID NO: 1165432 - RNA, 12 nt, Human
uuagcuggaaaa

SEQ ID NO: 1165433 - RNA, 13 nt, Human
uuagcuggaaaag

SEQ ID NO: 1165434 - RNA, 14 nt, Human
uuagaguugauacu

SEQ ID NO: 1165435 - RNA, 22 nt, Human
uuagauaauacaccacuacauu

SEQ ID NO: 1165436 - RNA, 20 nt, Human
uuagaugcaguucugaagaa

SEQ ID NO: 1165437 - RNA, 21 nt, Human
uuagaugcaguucugaagaag

SEQ ID NO: 1165438 - RNA, 22 nt, Human
uuagaugcaguucugaagaaga

SEQ ID NO: 1165439 - RNA, 18 nt, Human
uuaguaugaggcauuugu

SEQ ID NO: 1165440 - RNA, 16 nt, Human
uuaguaugaggcauuu

SEQ ID NO: 1165441 - RNA, 18 nt, Human
uuaggauguugaaaaagu

SEQ ID NO: 1165442 - RNA, 17 nt, Human
uucaaauccuugaagau

SEQ ID NO: 1165443 - RNA, 17 nt, Human
uuauuuuaauaauguuu

SEQ ID NO: 1165444 - RNA, 17 nt, Human
uuauugucaaaguggug

SEQ ID NO: 1165445 - RNA, 18 nt, Human
uuauugucaaagugguga

SEQ ID NO: 1165446 - RNA, 15 nt, Human
uuauugucuagugaa

SEQ ID NO: 1165447 - RNA, 15 nt, Human
uuauuuuaauaaugu

SEQ ID NO: 1165448 - RNA, 16 nt, Human
uuauuuuaauaauguu

SEQ ID NO: 1165449 - RNA, 13 nt, Human
uucacucuccuug

SEQ ID NO: 1165450 - RNA, 16 nt, Human
uucagacauagaauua

SEQ ID NO: 1165451 - RNA, 20 nt, Human
uucagacauagaauuaacac

SEQ ID NO: 1165452 - RNA, 20 nt, Human
uucagauaaucacaauacau

SEQ ID NO: 1165453 - RNA, 15 nt, Human
uucacgugguccuaa

SEQ ID NO: 1165454 - RNA, 13 nt, Human
uucaauaggaaaa

SEQ ID NO: 1165455 - RNA, 15 nt, Human
uucaauaggaaaaac

SEQ ID NO: 1165456 - RNA, 18 nt, Human
uucaauaggaaaaacuga

SEQ ID NO: 1165457 - RNA, 20 nt, Human
uucaauaggaaaaacugauu

SEQ ID NO: 1165458 - RNA, 17 nt, Human
uuaucuagauacuguau

SEQ ID NO: 1165459 - RNA, 16 nt, Human
uuaguuccucauuagc

SEQ ID NO: 1165460 - RNA, 14 nt, Human
uuaguuccuugagu

SEQ ID NO: 1165461 - RNA, 16 nt, Human
uuaucuagauacugua

SEQ ID NO: 1165462 - RNA, 16 nt, Human
uuaugcaugaaguaau

SEQ ID NO: 1165463 - RNA, 22 nt, Human
uuaugcaugaaguaauaugcac

SEQ ID NO: 1165464 - RNA, 16 nt, Human
uuauggaacacucuga

SEQ ID NO: 1165465 - RNA, 21 nt, Human
uuauggcacuaguauuucuau

SEQ ID NO: 1165466 - RNA, 17 nt, Human
uuauuacuguaagaaaa

SEQ ID NO: 1165467 - RNA, 18 nt, Human
uuauuacuguaagaaaau

SEQ ID NO: 1165468 - RNA, 11 nt, Human
uuauucugcuc

SEQ ID NO: 1165469 - RNA, 15 nt, Human
uuauugcccacgcug

SEQ ID NO: 1165470 - RNA, 15 nt, Human
uuccaaauucugcuu

SEQ ID NO: 1165471 - RNA, 11 nt, Human
uucaggaagcu

SEQ ID NO: 1165472 - RNA, 13 nt, Human
uucaggaagcuca

SEQ ID NO: 1165473 - RNA, 15 nt, Human
uucaggaagcucagg

SEQ ID NO: 1165474 - RNA, 21 nt, Human
uucaucuugaauuguaaggaa

SEQ ID NO: 1165475 - RNA, 15 nt, Human
uucauuuccuguguc

SEQ ID NO: 1165476 - RNA, 16 nt, Human
uucauuuccugugucu

SEQ ID NO: 1165477 - RNA, 16 nt, Human
uucccauuugcuccuu

SEQ ID NO: 1165478 - RNA, 15 nt, Human
uuccccaggaggcca

SEQ ID NO: 1165479 - RNA, 16 nt, Human
uuccccaggaggccag

SEQ ID NO: 1165480 - RNA, 21 nt, Human
uuccccaggaggccagccuug

SEQ ID NO: 1165481 - RNA, 17 nt, Human
uuccccaggaggccagc

SEQ ID NO: 1165482 - RNA, 18 nt, Human
uuccccaggaggccagcc

SEQ ID NO: 1165483 - RNA, 19 nt, Human
uuccccaggaggccagccu

SEQ ID NO: 1165484 - RNA, 20 nt, Human
uuccccaggaggccagccuu

SEQ ID NO: 1165485 - RNA, 11 nt, Human
uucccucccuu

SEQ ID NO: 1165486 - RNA, 17 nt, Human
uucccucccuuccucuu

SEQ ID NO: 1165487 - RNA, 20 nt, Human
uucccucccuuccucuuucc

SEQ ID NO: 1165488 - RNA, 17 nt, Human
uucccuugaugaagaag

SEQ ID NO: 1165489 - RNA, 18 nt, Human
uucccuugaugaagaagu

SEQ ID NO: 1165490 - RNA, 20 nt, Human
uucccuuugacgccauccca

SEQ ID NO: 1165491 - RNA, 21 nt, Human
uucccuuugacgccaucccag

SEQ ID NO: 1165492 - RNA, 22 nt, Human
uucccuuugacgccaucccagc

SEQ ID NO: 1165493 - RNA, 13 nt, Human
uuccucauuagca

SEQ ID NO: 1165494 - RNA, 23 nt, Human
uuccugaugcuucuucagagacu

SEQ ID NO: 1165495 - RNA, 17 nt, Human
uuccugccaggcauggu

SEQ ID NO: 1165496 - RNA, 15 nt, Human
uuccugaugcuucuu

SEQ ID NO: 1165497 - RNA, 18 nt, Human
uuccugaugcuucuucag

SEQ ID NO: 1165498 - RNA, 19 nt, Human
uuccugaugcuucuucaga

SEQ ID NO: 1165499 - RNA, 14 nt, Human
uuccuggcacugcu

SEQ ID NO: 1165500 - RNA, 19 nt, Human
uuccuggcacugcuuccag

SEQ ID NO: 1165501 - RNA, 20 nt, Human
uuccuugaguugauucagcu

SEQ ID NO: 1165502 - RNA, 13 nt, Human
uucuaaagcugcc

SEQ ID NO: 1165503 - RNA, 17 nt, Human
uucuaaagcugccagcc

SEQ ID NO: 1165504 - RNA, 20 nt, Human
uucgggaggucgaggcagga

SEQ ID NO: 1165505 - RNA, 13 nt, Human
uucuucagagacu

SEQ ID NO: 1165506 - RNA, 17 nt, Human
uucuuagggaaggauac

SEQ ID NO: 1165507 - RNA, 19 nt, Human
uucuuaggguuaugauuaa

SEQ ID NO: 1165508 - RNA, 14 nt, Human
uucuuguguguuua

SEQ ID NO: 1165509 - RNA, 20 nt, Human
uucuggcagaguugaagaca

SEQ ID NO: 1165510 - RNA, 16 nt, Human
uucuggcuaugcauuu

SEQ ID NO: 1165511 - RNA, 21 nt, Human
uugaaaaucuuauaauuuaaa

SEQ ID NO: 1165512 - RNA, 21 nt, Human
uucuuuccugaggcugggcuc

SEQ ID NO: 1165513 - RNA, 15 nt, Human
uugaacuuugaccuc

SEQ ID NO: 1165514 - RNA, 17 nt, Human
uugaacuuugaccucug

SEQ ID NO: 1165515 - RNA, 18 nt, Human
uugaacuuugaccucugc

SEQ ID NO: 1165516 - RNA, 20 nt, Human
uugaacuuugaccucugcag

SEQ ID NO: 1165517 - RNA, 12 nt, Human
uugaaugaugcc

SEQ ID NO: 1165518 - RNA, 16 nt, Human
uugaaugaugccauga

SEQ ID NO: 1165519 - RNA, 19 nt, Human
uugagccuugaacuuugac

SEQ ID NO: 1165520 - RNA, 14 nt, Human
uugaauuguaagga

SEQ ID NO: 1165521 - RNA, 14 nt, Human
uugagccuugaacu

SEQ ID NO: 1165522 - RNA, 15 nt, Human
uugagccuugaacuu

SEQ ID NO: 1165523 - RNA, 16 nt, Human
uugagccuugaacuuu

SEQ ID NO: 1165524 - RNA, 20 nt, Human
uugauaugccuuuucccaac

SEQ ID NO: 1165525 - RNA, 16 nt, Human
uugauaugcuuauaca

SEQ ID NO: 1165526 - RNA, 17 nt, Human
uugauucagacagcugc

SEQ ID NO: 1165527 - RNA, 21 nt, Human
uugauucagacagcugccugg

SEQ ID NO: 1165528 - RNA, 23 nt, Human
uugauucagacagcugccuggga

SEQ ID NO: 1165529 - RNA, 16 nt, Human
uugauucagcucugca

SEQ ID NO: 1165530 - RNA, 13 nt, Human
uugauucauaaug

SEQ ID NO: 1165531 - RNA, 17 nt, Human
uugauucauaaugacuu

SEQ ID NO: 1165532 - RNA, 23 nt, Human
uugcagacaggcaagcaccuccu

SEQ ID NO: 1165533 - RNA, 13 nt, Human
uugccagucaccc

SEQ ID NO: 1165534 - RNA, 16 nt, Human
uugccauguuggccag

SEQ ID NO: 1165535 - RNA, 17 nt, Human
uugccauguuggccagg

SEQ ID NO: 1165536 - RNA, 18 nt, Human
uugccauguuggccaggc

SEQ ID NO: 1165537 - RNA, 19 nt, Human
uugccauguuggccaggcu

SEQ ID NO: 1165538 - RNA, 11 nt, Human
uuggaaggaac

SEQ ID NO: 1165539 - RNA, 19 nt, Human
uuggaagcuccgcuuucua

SEQ ID NO: 1165540 - RNA, 18 nt, Human
uuggacccugaggcccag

SEQ ID NO: 1165541 - RNA, 19 nt, Human
uuggacccugaggcccaga

SEQ ID NO: 1165542 - RNA, 21 nt, Human
uuggacccugaggcccagagg

SEQ ID NO: 1165543 - RNA, 15 nt, Human
uuggauuguccccga

SEQ ID NO: 1165544 - RNA, 20 nt, Human
uugccauguuggccaggcug

SEQ ID NO: 1165545 - RNA, 21 nt, Human
uugccauguuggccaggcugg

SEQ ID NO: 1165546 - RNA, 23 nt, Human
uugcccacgcuggagugcaguga

SEQ ID NO: 1165547 - RNA, 16 nt, Human
uugcuaagcauuccaa

SEQ ID NO: 1165548 - RNA, 18 nt, Human
uugcuaagcauuccaacu

SEQ ID NO: 1165549 - RNA, 14 nt, Human
uugcugcuugaggc

SEQ ID NO: 1165550 - RNA, 16 nt, Human
uugcugcuugaggcaa

SEQ ID NO: 1165551 - RNA, 16 nt, Human
uugcugucccuuuucc

SEQ ID NO: 1165552 - RNA, 18 nt, Human
uugcugucccuuuuccuu

SEQ ID NO: 1165553 - RNA, 22 nt, Human
uugucaaaguggugagaggcau

SEQ ID NO: 1165554 - RNA, 14 nt, Human
uugucuaugggacu

SEQ ID NO: 1165555 - RNA, 20 nt, Human
uugucuaugggacucaaugc

SEQ ID NO: 1165556 - RNA, 20 nt, Human
uuguaaaauggugugaccac

SEQ ID NO: 1165557 - RNA, 16 nt, Human
uuguaccgcaauguga

SEQ ID NO: 1165558 - RNA, 15 nt, Human
uuggucugugagaug

SEQ ID NO: 1165559 - RNA, 12 nt, Human
uuguaaaauggu

SEQ ID NO: 1165560 - RNA, 13 nt, Human
uuguaaaauggug

SEQ ID NO: 1165561 - RNA, 20 nt, Human
uuggucugacccacugcuuu

SEQ ID NO: 1165562 - RNA, 20 nt, Human
uugguaaggggaauugagga

SEQ ID NO: 1165563 - RNA, 23 nt, Human
uuggcuucacggaagagccuugc

SEQ ID NO: 1165564 - RNA, 20 nt, Human
uuguuuggggaugagaaagg

SEQ ID NO: 1165565 - RNA, 15 nt, Human
uugucuuuggacccu

SEQ ID NO: 1165566 - RNA, 20 nt, Human
uugucuuuggacccugaggc

SEQ ID NO: 1165567 - RNA, 24 nt, Human
uugucuuuggacccugaggcccag

SEQ ID NO: 1165568 - RNA, 13 nt, Human
uuuaacagaaaug

SEQ ID NO: 1165569 - RNA, 12 nt, Human
uuuaaaaugucu

SEQ ID NO: 1165570 - RNA, 14 nt, Human
uuuaaaagaaugau

SEQ ID NO: 1165571 - RNA, 17 nt, Human
uuuaaaagaaugauuau

SEQ ID NO: 1165572 - RNA, 13 nt, Human
uuuaaaagauaca

SEQ ID NO: 1165573 - RNA, 14 nt, Human
uuuaacagaaaugu

SEQ ID NO: 1165574 - RNA, 15 nt, Human
uuuaacagaaaugua

SEQ ID NO: 1165575 - RNA, 18 nt, Human
uuuaacagaaauguacag

SEQ ID NO: 1165576 - RNA, 13 nt, Human
uuuaauaaaccau

SEQ ID NO: 1165577 - RNA, 15 nt, Human
uuuaauaauguuuca

SEQ ID NO: 1165578 - RNA, 19 nt, Human
uuuaauaauguuucaaaca

SEQ ID NO: 1165579 - RNA, 16 nt, Human
uuuaucgucacugcuu

SEQ ID NO: 1165580 - RNA, 12 nt, Human
uuuauacauaaa

SEQ ID NO: 1165581 - RNA, 20 nt, Human
uuuauacauaaacaagacca

SEQ ID NO: 1165582 - RNA, 22 nt, Human
uuuagacccuauugcugcuuga

SEQ ID NO: 1165583 - RNA, 19 nt, Human
uuuagacccuauugcugcu

SEQ ID NO: 1165584 - RNA, 23 nt, Human
uuuccuggcacugcuuccaguga

SEQ ID NO: 1165585 - RNA, 19 nt, Human
uuuccuggcacugcuucca

SEQ ID NO: 1165586 - RNA, 19 nt, Human
uuucuaaaucuccaaaaua

SEQ ID NO: 1165587 - RNA, 15 nt, Human
uuucuacccagcgag

SEQ ID NO: 1165588 - RNA, 18 nt, Human
uuucuacccagcgagccc

SEQ ID NO: 1165589 - RNA, 22 nt, Human
uuucuacccagcgagcccuggu

SEQ ID NO: 1165590 - RNA, 23 nt, Human
uuucuacucgaguuacagacaaa

SEQ ID NO: 1165591 - RNA, 12 nt, Human
uuucucuaggaa

SEQ ID NO: 1165592 - RNA, 17 nt, Human
uuuauggcacuaguauu

SEQ ID NO: 1165593 - RNA, 17 nt, Human
uuucagccaagaauucu

SEQ ID NO: 1165594 - RNA, 19 nt, Human
uuucuuguguguuuauugu

SEQ ID NO: 1165595 - RNA, 21 nt, Human
uuugaaauuguauuacaaauc

SEQ ID NO: 1165596 - RNA, 16 nt, Human
uuugagaucagccugg

SEQ ID NO: 1165597 - RNA, 17 nt, Human
uuugagaucagccuggg

SEQ ID NO: 1165598 - RNA, 17 nt, Human
uuugaggucuguucuuu

SEQ ID NO: 1165599 - RNA, 15 nt, Human
uuuguauucucuccu

SEQ ID NO: 1165600 - RNA, 18 nt, Human
uuugguaaggggaauuga

SEQ ID NO: 1165601 - RNA, 15 nt, Human
uuuggacccugaggc

SEQ ID NO: 1165602 - RNA, 19 nt, Human
uuuggacccugaggcccag

SEQ ID NO: 1165603 - RNA, 14 nt, Human
uuugauccaagcug

SEQ ID NO: 1165604 - RNA, 14 nt, Human
aaaaacacaaaagu

SEQ ID NO: 1165605 - RNA, 13 nt, Human
aaaaacugauuuu

SEQ ID NO: 1165606 - RNA, 15 nt, Human
aaaaacugauuuuuu

SEQ ID NO: 1165607 - RNA, 12 nt, Human
aaaaagaggcua

SEQ ID NO: 1165608 - RNA, 14 nt, Human
aaaacaaggaugaa

SEQ ID NO: 1165609 - RNA, 17 nt, Human
aaaacaaggaugaauua

SEQ ID NO: 1165610 - RNA, 12 nt, Human
aaaacacauuuu

SEQ ID NO: 1165611 - RNA, 15 nt, Human
accacguuucuaaag

SEQ ID NO: 1165612 - RNA, 19 nt, Human
accacguuucuaaaggcua

SEQ ID NO: 1165613 - RNA, 14 nt, Human
accacgcuggaccu

SEQ ID NO: 1165614 - RNA, 14 nt, Human
accacuacauucug

SEQ ID NO: 1165615 - RNA, 15 nt, Human
accacuacauucugu

SEQ ID NO: 1165616 - RNA, 14 nt, Human
accagcagccugga

SEQ ID NO: 1165617 - RNA, 17 nt, Human
accagcagccuggaccc

SEQ ID NO: 1165618 - RNA, 18 nt, Human
acauuugcucauggaauu

SEQ ID NO: 1165619 - RNA, 14 nt, Human
acauuuguauaaaa

SEQ ID NO: 1165620 - RNA, 19 nt, Human
acaugcaaggucauuuuuu

SEQ ID NO: 1165621 - RNA, 20 nt, Human
acaugcacagcuaacaugga

SEQ ID NO: 1165622 - RNA, 23 nt, Human
acaugcacagcuaacauggaagu

SEQ ID NO: 1165623 - RNA, 13 nt, Human
acauguuacaaca

SEQ ID NO: 1165624 - RNA, 21 nt, Human
acauguuuuucuucucccuca

SEQ ID NO: 1165625 - RNA, 22 nt, Human
acagguuuuccugaagaauuga

SEQ ID NO: 1165626 - RNA, 23 nt, Human
acauaaacaagaccacguuucua

SEQ ID NO: 1165627 - RNA, 20 nt, Human
acaucagcacgauuucuguu

SEQ ID NO: 1165628 - RNA, 21 nt, Human
acaucagcacgauuucuguuu

SEQ ID NO: 1165629 - RNA, 22 nt, Human
acaucagcacgauuucuguuua

SEQ ID NO: 1165630 - RNA, 15 nt, Human
accccggccaccugc

SEQ ID NO: 1165631 - RNA, 19 nt, Human
acccaugcugcccugugag

SEQ ID NO: 1165632 - RNA, 17 nt, Human
acccaugcugcccugug

SEQ ID NO: 1165633 - RNA, 18 nt, Human
acccaugcugcccuguga

SEQ ID NO: 1165634 - RNA, 15 nt, Human
acccacaagaaauga

SEQ ID NO: 1165635 - RNA, 13 nt, Human
acccaagggccug

SEQ ID NO: 1165636 - RNA, 16 nt, Human
acccaagggccuggcc

SEQ ID NO: 1165637 - RNA, 18 nt, Human
acccaagggccuggccug

SEQ ID NO: 1165638 - RNA, 14 nt, Human
accaucaugucugg

SEQ ID NO: 1165639 - RNA, 21 nt, Human
accaucccugaaggccccgcc

SEQ ID NO: 1165640 - RNA, 22 nt, Human
accaucccugaaggccccgccc

SEQ ID NO: 1165641 - RNA, 16 nt, Human
accaucaugucuggcu

SEQ ID NO: 1165642 - RNA, 17 nt, Human
accaucaugucuggcua

SEQ ID NO: 1165643 - RNA, 12 nt, Human
accaucauugaa

SEQ ID NO: 1165644 - RNA, 18 nt, Human
accaucccugaaggcccc

SEQ ID NO: 1165645 - RNA, 20 nt, Human
accccucaacaccucugcac

SEQ ID NO: 1165646 - RNA, 13 nt, Human
acaacuauauugu

SEQ ID NO: 1165647 - RNA, 13 nt, Human
acaaagacugagu

SEQ ID NO: 1165648 - RNA, 21 nt, Human
acaaaccuguuucugcagcca

SEQ ID NO: 1165649 - RNA, 15 nt, Human
acaaacgggcucagc

SEQ ID NO: 1165650 - RNA, 20 nt, Human
acaaaauguaggguuauaau

SEQ ID NO: 1165651 - RNA, 12 nt, Human
acaccagagccc

SEQ ID NO: 1165652 - RNA, 13 nt, Human
acaccagagccca

SEQ ID NO: 1165653 - RNA, 14 nt, Human
acaccacuacauuc

SEQ ID NO: 1165654 - RNA, 11 nt, Human
acacagcucug

SEQ ID NO: 1165655 - RNA, 12 nt, Human
acacagcucugu

SEQ ID NO: 1165656 - RNA, 14 nt, Human
acacagcucugucc

SEQ ID NO: 1165657 - RNA, 14 nt, Human
acacuaaccacgcu

SEQ ID NO: 1165658 - RNA, 15 nt, Human
acacuaaccacgcug

SEQ ID NO: 1165659 - RNA, 15 nt, Human
acacggacacucaaa

SEQ ID NO: 1165660 - RNA, 16 nt, Human
acaauuuauuauggca

SEQ ID NO: 1165661 - RNA, 15 nt, Human
acaauuuauuauggc

SEQ ID NO: 1165662 - RNA, 18 nt, Human
acacaaacgggcucagca

SEQ ID NO: 1165663 - RNA, 17 nt, Human
acacugugcugagucug

SEQ ID NO: 1165664 - RNA, 17 nt, Human
acagagucucacuguug

SEQ ID NO: 1165665 - RNA, 19 nt, Human
acagagucucacuguugcc

SEQ ID NO: 1165666 - RNA, 23 nt, Human
acagagucucacuguugcccagg

SEQ ID NO: 1165667 - RNA, 22 nt, Human
acagaggggguggccucccaac

SEQ ID NO: 1165668 - RNA, 12 nt, Human
acagagucucac

SEQ ID NO: 1165669 - RNA, 14 nt, Human
acagagucucacug

SEQ ID NO: 1165670 - RNA, 15 nt, Human
acagccaugauucuu

SEQ ID NO: 1165671 - RNA, 19 nt, Human
acaggcaagcaccuccugc

SEQ ID NO: 1165672 - RNA, 18 nt, Human
acaggcaagcaccuccug

SEQ ID NO: 1165673 - RNA, 16 nt, Human
acaggcaagcaccucc

SEQ ID NO: 1165674 - RNA, 22 nt, Human
acaggugugagucaccaagccc

SEQ ID NO: 1165675 - RNA, 20 nt, Human
acaggugugaaccaccacac

SEQ ID NO: 1165676 - RNA, 23 nt, Human
acaggugugaaccaccacaccca

SEQ ID NO: 1165677 - RNA, 12 nt, Human
acagcuccuucu

SEQ ID NO: 1165678 - RNA, 13 nt, Human
acagcuccuucug

SEQ ID NO: 1165679 - RNA, 14 nt, Human
acagcuccuucugu

SEQ ID NO: 1165680 - RNA, 15 nt, Human
acagcuccuucuguc

SEQ ID NO: 1165681 - RNA, 20 nt, Human
acagcucugcauacucauua

SEQ ID NO: 1165682 - RNA, 13 nt, Human
acagcucuguccu

SEQ ID NO: 1165683 - RNA, 14 nt, Human
acagcugccuggga

SEQ ID NO: 1165684 - RNA, 23 nt, Human
acagcugccugggaucccucauc

SEQ ID NO: 1165685 - RNA, 14 nt, Human
acuagcuauggugu

SEQ ID NO: 1165686 - RNA, 14 nt, Human
acucccccaggugg

SEQ ID NO: 1165687 - RNA, 13 nt, Human
acuccccugcugg

SEQ ID NO: 1165688 - RNA, 17 nt, Human
acuccccugcugggugu

SEQ ID NO: 1165689 - RNA, 11 nt, Human
acuauaaugua

SEQ ID NO: 1165690 - RNA, 16 nt, Human
acucaaacucuuaaaa

SEQ ID NO: 1165691 - RNA, 17 nt, Human
acucaaacucuuaaaac

SEQ ID NO: 1165692 - RNA, 18 nt, Human
acucuacccucuuagaaa

SEQ ID NO: 1165693 - RNA, 21 nt, Human
acucuacccucuuagaaaaac

SEQ ID NO: 1165694 - RNA, 14 nt, Human
acucuaucaaguau

SEQ ID NO: 1165695 - RNA, 16 nt, Human
acucuaucaaguauua

SEQ ID NO: 1165696 - RNA, 21 nt, Human
acucuaucaaguauuauaccu

SEQ ID NO: 1165697 - RNA, 16 nt, Human
acucugugucaggugg

SEQ ID NO: 1165698 - RNA, 19 nt, Human
acucugugucagguggggc

SEQ ID NO: 1165699 - RNA, 11 nt, Human
acucuuaaaac

SEQ ID NO: 1165700 - RNA, 18 nt, Human
acucuuaaaacccaagug

SEQ ID NO: 1165701 - RNA, 12 nt, Human
acucccuuucaa

SEQ ID NO: 1165702 - RNA, 13 nt, Human
acucccuuucaac

SEQ ID NO: 1165703 - RNA, 14 nt, Human
accuuggcucaagu

SEQ ID NO: 1165704 - RNA, 12 nt, Human
accuuggcugca

SEQ ID NO: 1165705 - RNA, 16 nt, Human
accuuucaauaggaaa

SEQ ID NO: 1165706 - RNA, 14 nt, Human
accuuggcugcagg

SEQ ID NO: 1165707 - RNA, 17 nt, Human
accuuucaauaggaaaa

SEQ ID NO: 1165708 - RNA, 21 nt, Human
accuuucaauaggaaaaacug

SEQ ID NO: 1165709 - RNA, 23 nt, Human
accuuucaauaggaaaaacugau

SEQ ID NO: 1165710 - RNA, 17 nt, Human
accucuugagccuugaa

SEQ ID NO: 1165711 - RNA, 23 nt, Human
accugccccucaacucuccucca

SEQ ID NO: 1165712 - RNA, 16 nt, Human
accucugcacaagcug

SEQ ID NO: 1165713 - RNA, 18 nt, Human
accucugcacaagcugca

SEQ ID NO: 1165714 - RNA, 15 nt, Human
accucugcagcaaua

SEQ ID NO: 1165715 - RNA, 21 nt, Human
accucugcacaagcugcaccc

SEQ ID NO: 1165716 - RNA, 18 nt, Human
acgcugugcugcccugcc

SEQ ID NO: 1165717 - RNA, 19 nt, Human
acgcugugcugcccugccc

SEQ ID NO: 1165718 - RNA, 17 nt, Human
acgccagauucuuuccu

SEQ ID NO: 1165719 - RNA, 16 nt, Human
acgcugugcugcccug

SEQ ID NO: 1165720 - RNA, 17 nt, Human
acgcugugcugcccugc

SEQ ID NO: 1165721 - RNA, 13 nt, Human
acguggcugcuuc

SEQ ID NO: 1165722 - RNA, 14 nt, Human
acguggcugcuuca

SEQ ID NO: 1165723 - RNA, 15 nt, Human
acguggcugcuucaa

SEQ ID NO: 1165724 - RNA, 17 nt, Human
acguggcugcuucaagg

SEQ ID NO: 1165725 - RNA, 16 nt, Human
acuaagagagaaugag

SEQ ID NO: 1165726 - RNA, 22 nt, Human
acuaaguuuuuauggcuuuugu

SEQ ID NO: 1165727 - RNA, 12 nt, Human
acgauuucuguu

SEQ ID NO: 1165728 - RNA, 13 nt, Human
acgauuucuguuu

SEQ ID NO: 1165729 - RNA, 14 nt, Human
acgauuucuguuua

SEQ ID NO: 1165730 - RNA, 17 nt, Human
acgauuucuguuuagau

SEQ ID NO: 1165731 - RNA, 18 nt, Human
acgccacugcacuauagc

SEQ ID NO: 1165732 - RNA, 19 nt, Human
acgauuucuguuuagauaa

SEQ ID NO: 1165733 - RNA, 16 nt, Human
acugugccaugugcca

SEQ ID NO: 1165734 - RNA, 12 nt, Human
acugucuucagu

SEQ ID NO: 1165735 - RNA, 14 nt, Human
acuggaagcacagc

SEQ ID NO: 1165736 - RNA, 15 nt, Human
acuggaagcacagcu

SEQ ID NO: 1165737 - RNA, 16 nt, Human
acuggaagcacagcuu

SEQ ID NO: 1165738 - RNA, 14 nt, Human
acuggagaaaaugg

SEQ ID NO: 1165739 - RNA, 21 nt, Human
acuuggucugugagaugcuag

SEQ ID NO: 1165740 - RNA, 20 nt, Human
acuuguaaaggaauuuaaaa

SEQ ID NO: 1165741 - RNA, 19 nt, Human
acuuguaaaggaauuuaaa

SEQ ID NO: 1165742 - RNA, 14 nt, Human
acuuggucugugag

SEQ ID NO: 1165743 - RNA, 15 nt, Human
acuuggucugugaga

SEQ ID NO: 1165744 - RNA, 23 nt, Human
acuucacauauugauuuccguua

SEQ ID NO: 1165745 - RNA, 18 nt, Human
acuucugccauauucugu

SEQ ID NO: 1165746 - RNA, 19 nt, Human
acuucugccauauucuguu

SEQ ID NO: 1165747 - RNA, 19 nt, Human
acuucacauauugauuucc

SEQ ID NO: 1165748 - RNA, 13 nt, Human
acuguuucaaacu

SEQ ID NO: 1165749 - RNA, 14 nt, Human
agaaaauaacaaua

SEQ ID NO: 1165750 - RNA, 12 nt, Human
agaaaauauacu

SEQ ID NO: 1165751 - RNA, 13 nt, Human
agaaaauauacug

SEQ ID NO: 1165752 - RNA, 14 nt, Human
agaaaauauacugu

SEQ ID NO: 1165753 - RNA, 15 nt, Human
agaaaauauacugua

SEQ ID NO: 1165754 - RNA, 16 nt, Human
agaaaauauacuguaa

SEQ ID NO: 1165755 - RNA, 17 nt, Human
agaaaauauacuguaaa

SEQ ID NO: 1165756 - RNA, 18 nt, Human
agaaaauauacuguaaag

SEQ ID NO: 1165757 - RNA, 19 nt, Human
agaaaauauacuguaaaga

SEQ ID NO: 1165758 - RNA, 20 nt, Human
agaaaauauacuguaaagaa

SEQ ID NO: 1165759 - RNA, 21 nt, Human
agaaaauauacuguaaagaaa

SEQ ID NO: 1165760 - RNA, 22 nt, Human
agaaaauauacuguaaagaaag

SEQ ID NO: 1165761 - RNA, 23 nt, Human
agaaaauauacuguaaagaaaga

SEQ ID NO: 1165762 - RNA, 23 nt, Human
agaaaauggaagacagcucuuau

SEQ ID NO: 1165763 - RNA, 15 nt, Human
agaaaauggacgugu

SEQ ID NO: 1165764 - RNA, 20 nt, Human
agaaaauggacguguuauga

SEQ ID NO: 1165765 - RNA, 22 nt, Human
agaaaauggacguguuaugacu

SEQ ID NO: 1165766 - RNA, 23 nt, Human
agaaaauggacguguuaugacuc

SEQ ID NO: 1165767 - RNA, 19 nt, Human
acuuuuauaaacuuuaccu

SEQ ID NO: 1165768 - RNA, 22 nt, Human
acuuuuauaaacuuuaccuuuu

SEQ ID NO: 1165769 - RNA, 12 nt, Human
agaaaauaaaaa

SEQ ID NO: 1165770 - RNA, 13 nt, Human
agaaaauaaaaag

SEQ ID NO: 1165771 - RNA, 14 nt, Human
agaaaauaaaaagu

SEQ ID NO: 1165772 - RNA, 15 nt, Human
agaaaauaaaaaguu

SEQ ID NO: 1165773 - RNA, 16 nt, Human
agaaaauaaaaaguua

SEQ ID NO: 1165774 - RNA, 17 nt, Human
agaaaauaaaaaguuaa

SEQ ID NO: 1165775 - RNA, 18 nt, Human
agaaaauaaaaaguuaaa

SEQ ID NO: 1165776 - RNA, 23 nt, Human
acuuuccuucauucaacccaccu

SEQ ID NO: 1165777 - RNA, 16 nt, Human
acuuucuagccagagg

SEQ ID NO: 1165778 - RNA, 23 nt, Human
acuuuguucuggcucuuccaggc

SEQ ID NO: 1165779 - RNA, 20 nt, Human
agaaaggaggggauagagag

SEQ ID NO: 1165780 - RNA, 23 nt, Human
agaaaggaggggauagagagaga

SEQ ID NO: 1165781 - RNA, 15 nt, Human
agaaauaaaguuucu

SEQ ID NO: 1165782 - RNA, 18 nt, Human
agaaauaaaguuucuguu

SEQ ID NO: 1165783 - RNA, 13 nt, Human
aauccauacauuu

SEQ ID NO: 1165784 - RNA, 14 nt, Human
aauccauacauuug

SEQ ID NO: 1165785 - RNA, 13 nt, Human
aaucuccaaaaua

SEQ ID NO: 1165786 - RNA, 14 nt, Human
aaucuccaaaauaa

SEQ ID NO: 1165787 - RNA, 18 nt, Human
aaucuccaaaauaaaacu

SEQ ID NO: 1165788 - RNA, 21 nt, Human
aaugaugauccuaggcauuug

SEQ ID NO: 1165789 - RNA, 20 nt, Human
aaugauaacuggaaacuuca

SEQ ID NO: 1165790 - RNA, 22 nt, Human
aaucugcuuuuuaaagaaugcu

SEQ ID NO: 1165791 - RNA, 16 nt, Human
aaugaaccacaucuug

SEQ ID NO: 1165792 - RNA, 17 nt, Human
aaugaaccacaucuugc

SEQ ID NO: 1165793 - RNA, 23 nt, Human
aaugaaccacaucuugcucugcu

SEQ ID NO: 1165794 - RNA, 19 nt, Human
aaugaugccaugaggaaca

SEQ ID NO: 1165795 - RNA, 13 nt, Human
aaucacaauacau

SEQ ID NO: 1165796 - RNA, 16 nt, Human
aauauuauguuaaaac

SEQ ID NO: 1165797 - RNA, 20 nt, Human
aauauaggaacuuaaauaau

SEQ ID NO: 1165798 - RNA, 21 nt, Human
aauauaggaacuuaaauaaug

SEQ ID NO: 1165799 - RNA, 18 nt, Human
aauauaggaacuuaaaua

SEQ ID NO: 1165800 - RNA, 13 nt, Human
aaugucaguguga

SEQ ID NO: 1165801 - RNA, 15 nt, Human
aaugucagugugacu

SEQ ID NO: 1165802 - RNA, 16 nt, Human
aaugucagugugacug

SEQ ID NO: 1165803 - RNA, 20 nt, Human
aaugucucuuuaaugucaca

SEQ ID NO: 1165804 - RNA, 17 nt, Human
aaugucagugugacuga

SEQ ID NO: 1165805 - RNA, 21 nt, Human
aaugucagugugacugaucuc

SEQ ID NO: 1165806 - RNA, 22 nt, Human
aaugucuaguuguaacaccaug

SEQ ID NO: 1165807 - RNA, 15 nt, Human
aaugggcagagcaga

SEQ ID NO: 1165808 - RNA, 18 nt, Human
aauguuugccucugccuc

SEQ ID NO: 1165809 - RNA, 19 nt, Human
aauguuugccucugccucu

SEQ ID NO: 1165810 - RNA, 18 nt, Human
aauuaaaacacaacaucu

SEQ ID NO: 1165811 - RNA, 14 nt, Human
aauuaguuuuauau

SEQ ID NO: 1165812 - RNA, 17 nt, Human
aauuaguuuuauaugcu

SEQ ID NO: 1165813 - RNA, 20 nt, Human
aauuaguuuuauaugcuucu

SEQ ID NO: 1165814 - RNA, 21 nt, Human
aauaauccuaaacauaugaau

SEQ ID NO: 1165815 - RNA, 16 nt, Human
aauaaugugaaacugg

SEQ ID NO: 1165816 - RNA, 17 nt, Human
aagucuuagauguauau

SEQ ID NO: 1165817 - RNA, 16 nt, Human
aagucuuagauguaua

SEQ ID NO: 1165818 - RNA, 11 nt, Human
aaggugggagg

SEQ ID NO: 1165819 - RNA, 15 nt, Human
aagguuaauaaagua

SEQ ID NO: 1165820 - RNA, 16 nt, Human
aagguuaauaaaguaa

SEQ ID NO: 1165821 - RNA, 20 nt, Human
aagguuaauguucaucaucc

SEQ ID NO: 1165822 - RNA, 11 nt, Human
aaguacuucuu

SEQ ID NO: 1165823 - RNA, 16 nt, Human
aaguaucccuacugua

SEQ ID NO: 1165824 - RNA, 17 nt, Human
aaguaucccuacuguaa

SEQ ID NO: 1165825 - RNA, 21 nt, Human
aagcagaggaaggagaggaga

SEQ ID NO: 1165826 - RNA, 14 nt, Human
aagcagaggaagga

SEQ ID NO: 1165827 - RNA, 15 nt, Human
aagcagggacuugaa

SEQ ID NO: 1165828 - RNA, 13 nt, Human
aagccagauuuuc

SEQ ID NO: 1165829 - RNA, 19 nt, Human
aagccagauuuuccugaaa

SEQ ID NO: 1165830 - RNA, 16 nt, Human
aagauuuaccacuugu

SEQ ID NO: 1165831 - RNA, 14 nt, Human
aagcugcugacagu

SEQ ID NO: 1165832 - RNA, 11 nt, Human
aagcugggcag

SEQ ID NO: 1165833 - RNA, 13 nt, Human
aagcugggcaggu

SEQ ID NO: 1165834 - RNA, 15 nt, Human
aagcugggcagguug

SEQ ID NO: 1165835 - RNA, 18 nt, Human
aaggacauugcggacagc

SEQ ID NO: 1165836 - RNA, 12 nt, Human
aagcguggugga

SEQ ID NO: 1165837 - RNA, 21 nt, Human
aagcugcacccucaggcaggu

SEQ ID NO: 1165838 - RNA, 22 nt, Human
aagcugcacccucaggcaggug

SEQ ID NO: 1165839 - RNA, 17 nt, Human
aaggcaaggcugucaau

SEQ ID NO: 1165840 - RNA, 18 nt, Human
aaggcaaggcugucaauu

SEQ ID NO: 1165841 - RNA, 12 nt, Human
aaagaaagagag

SEQ ID NO: 1165842 - RNA, 13 nt, Human
aaagaaagagaga

SEQ ID NO: 1165843 - RNA, 14 nt, Human
aaagaaagagagaa

SEQ ID NO: 1165844 - RNA, 15 nt, Human
aaagaaagagagaaa

SEQ ID NO: 1165845 - RNA, 16 nt, Human
aaagaaagagagaaaa

SEQ ID NO: 1165846 - RNA, 16 nt, Human
aaacugacucuuaaga

SEQ ID NO: 1165847 - RNA, 16 nt, Human
aaacugaaugaaaccc

SEQ ID NO: 1165848 - RNA, 17 nt, Human
aaacugacucuuaagaa

SEQ ID NO: 1165849 - RNA, 17 nt, Human
aaagaaagagagaaaau

SEQ ID NO: 1165850 - RNA, 18 nt, Human
aaagaaagagagaaaaua

SEQ ID NO: 1165851 - RNA, 14 nt, Human
aaagaguaggaaga

SEQ ID NO: 1165852 - RNA, 19 nt, Human
aaacacuguucucugcccu

SEQ ID NO: 1165853 - RNA, 22 nt, Human
aaacacuguucucugcccucca

SEQ ID NO: 1165854 - RNA, 13 nt, Human
aaaacacauuuuu

SEQ ID NO: 1165855 - RNA, 15 nt, Human
aaaacacauuuuucu

SEQ ID NO: 1165856 - RNA, 13 nt, Human
aaaauucagugga

SEQ ID NO: 1165857 - RNA, 18 nt, Human
aaacacuguucucugccc

SEQ ID NO: 1165858 - RNA, 12 nt, Human
aaauaacaauga

SEQ ID NO: 1165859 - RNA, 11 nt, Human
aaagugcuggg

SEQ ID NO: 1165860 - RNA, 14 nt, Human
aaagugcugggauu

SEQ ID NO: 1165861 - RNA, 19 nt, Human
aaauaguggugugauuugg

SEQ ID NO: 1165862 - RNA, 14 nt, Human
aaauauaauugaca

SEQ ID NO: 1165863 - RNA, 16 nt, Human
aaauggaaaugggcag

SEQ ID NO: 1165864 - RNA, 18 nt, Human
aaauggaagacagcucuu

SEQ ID NO: 1165865 - RNA, 20 nt, Human
aaauggacguguuaugacuc

SEQ ID NO: 1165866 - RNA, 21 nt, Human
aaauggacguguuaugacucc

SEQ ID NO: 1165867 - RNA, 22 nt, Human
aaauggacguguuaugacucca

SEQ ID NO: 1165868 - RNA, 18 nt, Human
aaauggcuuccuggcaau

SEQ ID NO: 1165869 - RNA, 19 nt, Human
aacacauuuuucuuaggga

SEQ ID NO: 1165870 - RNA, 22 nt, Human
aacaugcuacacacugcauguu

SEQ ID NO: 1165871 - RNA, 22 nt, Human
aaccacuggaaaguuuaugguu

SEQ ID NO: 1165872 - RNA, 14 nt, Human
aacauguaauuaag

SEQ ID NO: 1165873 - RNA, 21 nt, Human
aacauguaauuaaguacuaug

SEQ ID NO: 1165874 - RNA, 23 nt, Human
aacauguaauuaaguacuaugua

SEQ ID NO: 1165875 - RNA, 22 nt, Human
aaccacucuaucaaguauuaua

SEQ ID NO: 1165876 - RNA, 17 nt, Human
aaccaguguuguggauu

SEQ ID NO: 1165877 - RNA, 14 nt, Human
aacccuggugacca

SEQ ID NO: 1165878 - RNA, 12 nt, Human
aacucaccccag

SEQ ID NO: 1165879 - RNA, 15 nt, Human
aacucaccccagccc

SEQ ID NO: 1165880 - RNA, 15 nt, Human
aacucaccugccccu

SEQ ID NO: 1165881 - RNA, 16 nt, Human
aacucaccugccccuc

SEQ ID NO: 1165882 - RNA, 17 nt, Human
aacugauuuuuuuuucc

SEQ ID NO: 1165883 - RNA, 19 nt, Human
aacugauuuuuuuuuccuu

SEQ ID NO: 1165884 - RNA, 20 nt, Human
aacugauuuuuuuuuccuuc

SEQ ID NO: 1165885 - RNA, 19 nt, Human
aacuuaaauaaugugaaac

SEQ ID NO: 1165886 - RNA, 17 nt, Human
aacuuaaauaaugugaa

SEQ ID NO: 1165887 - RNA, 13 nt, Human
aacuucacauauu

SEQ ID NO: 1165888 - RNA, 16 nt, Human
aacuuuuauaaacuuu

SEQ ID NO: 1165889 - RNA, 19 nt, Human
aacuuuuauaaacuuuacc

SEQ ID NO: 1165890 - RNA, 13 nt, Human
aacuuugaccucu

SEQ ID NO: 1165891 - RNA, 14 nt, Human
aacuuugaccucug

SEQ ID NO: 1165892 - RNA, 17 nt, Human
aacuuugaccucugcag

SEQ ID NO: 1165893 - RNA, 19 nt, Human
aacuuugaccucugcagca

SEQ ID NO: 1165894 - RNA, 20 nt, Human
aacuuugaccucugcagcaa

SEQ ID NO: 1165895 - RNA, 12 nt, Human
aacuuuuauaaa

SEQ ID NO: 1165896 - RNA, 15 nt, Human
aacuuuuauaaacuu

SEQ ID NO: 1165897 - RNA, 20 nt, Human
auacacacacacacacagcc

SEQ ID NO: 1165898 - RNA, 21 nt, Human
auacacacacacacacagcca

SEQ ID NO: 1165899 - RNA, 11 nt, Human
auacacacaca

SEQ ID NO: 1165900 - RNA, 13 nt, Human
auacacacacaca

SEQ ID NO: 1165901 - RNA, 14 nt, Human
auacacacacacac

SEQ ID NO: 1165902 - RNA, 15 nt, Human
auacacacacacaca

SEQ ID NO: 1165903 - RNA, 18 nt, Human
auacacacacacacacag

SEQ ID NO: 1165904 - RNA, 19 nt, Human
auacacacacacacacagc

SEQ ID NO: 1165905 - RNA, 14 nt, Human
auaauuacuauguc

SEQ ID NO: 1165906 - RNA, 12 nt, Human
auaccugucccc

SEQ ID NO: 1165907 - RNA, 13 nt, Human
auaccuguccccc

SEQ ID NO: 1165908 - RNA, 18 nt, Human
auaaugugaaacuggauu

SEQ ID NO: 1165909 - RNA, 19 nt, Human
auaaugugaaacuggauua

SEQ ID NO: 1165910 - RNA, 21 nt, Human
auaaugugaaacuggauuaaa

SEQ ID NO: 1165911 - RNA, 15 nt, Human
auaguaugguggcug

SEQ ID NO: 1165912 - RNA, 16 nt, Human
auaguaugguggcugg

SEQ ID NO: 1165913 - RNA, 16 nt, Human
auauaggaacuuaaau

SEQ ID NO: 1165914 - RNA, 23 nt, Human
auauuucagauaaucacaauaca

SEQ ID NO: 1165915 - RNA, 13 nt, Human
auauucaggaagc

SEQ ID NO: 1165916 - RNA, 14 nt, Human
auauucaggaagcu

SEQ ID NO: 1165917 - RNA, 16 nt, Human
auauucaggaagcuca

SEQ ID NO: 1165918 - RNA, 17 nt, Human
auauucaggaagcucag

SEQ ID NO: 1165919 - RNA, 14 nt, Human
auauuuauuacugu

SEQ ID NO: 1165920 - RNA, 19 nt, Human
auauuuauuacuguaagaa

SEQ ID NO: 1165921 - RNA, 18 nt, Human
auauuuauuuuaauaaug

SEQ ID NO: 1165922 - RNA, 22 nt, Human
auauuuauuacuguaagaaaau

SEQ ID NO: 1165923 - RNA, 18 nt, Human
auaucacuugucaauaaa

SEQ ID NO: 1165924 - RNA, 22 nt, Human
auaugccugggcagaaggaaga

SEQ ID NO: 1165925 - RNA, 14 nt, Human
auaugcuuauacac

SEQ ID NO: 1165926 - RNA, 16 nt, Human
auaugcuuauacacuu

SEQ ID NO: 1165927 - RNA, 19 nt, Human
auaugcuuauacacuuaca

SEQ ID NO: 1165928 - RNA, 21 nt, Human
auaugcuuauacacuuacacu

SEQ ID NO: 1165929 - RNA, 18 nt, Human
agugauuaccagggacug

SEQ ID NO: 1165930 - RNA, 23 nt, Human
agugugacaaggauugcuacugu

SEQ ID NO: 1165931 - RNA, 13 nt, Human
aguuguuacauuu

SEQ ID NO: 1165932 - RNA, 15 nt, Human
aguuguuacauuuuu

SEQ ID NO: 1165933 - RNA, 16 nt, Human
aguuguuacauuuuua

SEQ ID NO: 1165934 - RNA, 19 nt, Human
aguuguuacauuuuuaagu

SEQ ID NO: 1165935 - RNA, 18 nt, Human
aguuacagacaaagcgug

SEQ ID NO: 1165936 - RNA, 19 nt, Human
aguuguaccgcaaugugac

SEQ ID NO: 1165937 - RNA, 16 nt, Human
agucaagugaaaaagg

SEQ ID NO: 1165938 - RNA, 19 nt, Human
agucaaauugugugaaagg

SEQ ID NO: 1165939 - RNA, 15 nt, Human
agucaaauuguguga

SEQ ID NO: 1165940 - RNA, 17 nt, Human
agucaaauugugugaaa

SEQ ID NO: 1165941 - RNA, 20 nt, Human
agucaagugaaaaaggagga

SEQ ID NO: 1165942 - RNA, 16 nt, Human
aguccaagcauuuaga

SEQ ID NO: 1165943 - RNA, 21 nt, Human
aguccaagcauuuagauguau

SEQ ID NO: 1165944 - RNA, 14 nt, Human
agugacagaggcag

SEQ ID NO: 1165945 - RNA, 13 nt, Human
agugauccuccca

SEQ ID NO: 1165946 - RNA, 17 nt, Human
augcacacauuuuuuaa

SEQ ID NO: 1165947 - RNA, 19 nt, Human
augcacacauuuuuuaaau

SEQ ID NO: 1165948 - RNA, 22 nt, Human
augcacacauuuuuuaaaugca

SEQ ID NO: 1165949 - RNA, 23 nt, Human
augcacacauuuuuuaaaugcac

SEQ ID NO: 1165950 - RNA, 14 nt, Human
augcacagcuaaca

SEQ ID NO: 1165951 - RNA, 21 nt, Human
augcacagcuaacauggaagu

SEQ ID NO: 1165952 - RNA, 23 nt, Human
augcaugaaguaauaugcacaca

SEQ ID NO: 1165953 - RNA, 10 nt, Human
augcauuuga

SEQ ID NO: 1165954 - RNA, 12 nt, Human
augcauuugaaa

SEQ ID NO: 1165955 - RNA, 18 nt, Human
augcauuugaaaauuuug

SEQ ID NO: 1165956 - RNA, 23 nt, Human
augccuggauggggcugcaccgg

SEQ ID NO: 1165957 - RNA, 17 nt, Human
augccugggcagaagga

SEQ ID NO: 1165958 - RNA, 11 nt, Human
augccuggugg

SEQ ID NO: 1165959 - RNA, 15 nt, Human
augccugguggcagc

SEQ ID NO: 1165960 - RNA, 16 nt, Human
augccugguggcagcu

SEQ ID NO: 1165961 - RNA, 17 nt, Human
augccugguggcagcug

SEQ ID NO: 1165962 - RNA, 18 nt, Human
augccugguggcagcugc

SEQ ID NO: 1165963 - RNA, 14 nt, Human
augccuuuucccaa

SEQ ID NO: 1165964 - RNA, 19 nt, Human
auggaaaugggcagagcag

SEQ ID NO: 1165965 - RNA, 20 nt, Human
auggaaaugggcagagcaga

SEQ ID NO: 1165966 - RNA, 11 nt, Human
auggaacacuc

SEQ ID NO: 1165967 - RNA, 21 nt, Human
augggaaugaaugucagugug

SEQ ID NO: 1165968 - RNA, 15 nt, Human
augggaaugaauguc

SEQ ID NO: 1165969 - RNA, 23 nt, Human
auggcugccaaugggagcucaug

SEQ ID NO: 1165970 - RNA, 14 nt, Human
auguuugccucugc

SEQ ID NO: 1165971 - RNA, 16 nt, Human
auguuuuaagaggcag

SEQ ID NO: 1165972 - RNA, 18 nt, Human
auguuuuaagaggcaggg

SEQ ID NO: 1165973 - RNA, 14 nt, Human
auuaaaugcccagc

SEQ ID NO: 1165974 - RNA, 15 nt, Human
auuaaaugcccagcc

SEQ ID NO: 1165975 - RNA, 16 nt, Human
auuaaaugcccagccc

SEQ ID NO: 1165976 - RNA, 17 nt, Human
auuaaaugcccagcccc

SEQ ID NO: 1165977 - RNA, 13 nt, Human
auuaaauucuugc

SEQ ID NO: 1165978 - RNA, 18 nt, Human
auguucucugaggacacu

SEQ ID NO: 1165979 - RNA, 22 nt, Human
auguucugacccugcuucaaau

SEQ ID NO: 1165980 - RNA, 15 nt, Human
auguucuuaauucuu

SEQ ID NO: 1165981 - RNA, 20 nt, Human
auguucuuaguggauguucu

SEQ ID NO: 1165982 - RNA, 20 nt, Human
auguucuuucacccuuuucu

SEQ ID NO: 1165983 - RNA, 16 nt, Human
augucaaucagccuag

SEQ ID NO: 1165984 - RNA, 15 nt, Human
augucacaggcaggu

SEQ ID NO: 1165985 - RNA, 16 nt, Human
augucacaggcagguc

SEQ ID NO: 1165986 - RNA, 17 nt, Human
augucacaggcaggucc

SEQ ID NO: 1165987 - RNA, 17 nt, Human
auguaagcucuacugag

SEQ ID NO: 1165988 - RNA, 13 nt, Human
aucccucauccuc

SEQ ID NO: 1165989 - RNA, 18 nt, Human
auccucauacccaccccc

SEQ ID NO: 1165990 - RNA, 19 nt, Human
auccucauacccaccccca

SEQ ID NO: 1165991 - RNA, 22 nt, Human
auccucauacccacccccaccc

SEQ ID NO: 1165992 - RNA, 18 nt, Human
auccacccaccucagccu

SEQ ID NO: 1165993 - RNA, 20 nt, Human
auccacccaccucagccucc

SEQ ID NO: 1165994 - RNA, 14 nt, Human
auccuccucagauc

SEQ ID NO: 1165995 - RNA, 13 nt, Human
aucgaugcagugc

SEQ ID NO: 1165996 - RNA, 14 nt, Human
auccuccaggugca

SEQ ID NO: 1165997 - RNA, 19 nt, Human
auccuccaggugcacaagc

SEQ ID NO: 1165998 - RNA, 22 nt, Human
auccuccaggugcacaagcucc

SEQ ID NO: 1165999 - RNA, 23 nt, Human
auccucauacccacccccaccca

SEQ ID NO: 1166000 - RNA, 23 nt, Human
auccuccaggugcacaagcucca

SEQ ID NO: 1166001 - RNA, 11 nt, Human
auccuccucag

SEQ ID NO: 1166002 - RNA, 11 nt, Human
aucagccuggg

SEQ ID NO: 1166003 - RNA, 20 nt, Human
aucagccugggcaaugugau

SEQ ID NO: 1166004 - RNA, 21 nt, Human
aucagccugggcaaugugaua

SEQ ID NO: 1166005 - RNA, 17 nt, Human
aucagccugcuccagcu

SEQ ID NO: 1166006 - RNA, 13 nt, Human
aucagcugcuacu

SEQ ID NO: 1166007 - RNA, 23 nt, Human
aucagcugcuacuacuccuguag

SEQ ID NO: 1166008 - RNA, 22 nt, Human
aucuuauaauuuaaaauaugcu

SEQ ID NO: 1166009 - RNA, 19 nt, Human
aucuuccaacucaaacucu

SEQ ID NO: 1166010 - RNA, 22 nt, Human
aucucucgugauugauaagaac

SEQ ID NO: 1166011 - RNA, 17 nt, Human
aucuugaagacuuuucu

SEQ ID NO: 1166012 - RNA, 18 nt, Human
aucuugaagacuuuucuu

SEQ ID NO: 1166013 - RNA, 17 nt, Human
aucuucuuuauaauucu

SEQ ID NO: 1166014 - RNA, 22 nt, Human
aucuucugaacuuggcgcugcc

SEQ ID NO: 1166015 - RNA, 13 nt, Human
augagccuggcaa

SEQ ID NO: 1166016 - RNA, 14 nt, Human
augagccuggcaag

SEQ ID NO: 1166017 - RNA, 15 nt, Human
augaaacccccacac

SEQ ID NO: 1166018 - RNA, 16 nt, Human
augaaacccccacaca

SEQ ID NO: 1166019 - RNA, 17 nt, Human
augaaacccccacacac

SEQ ID NO: 1166020 - RNA, 18 nt, Human
augaaacccccacacaca

SEQ ID NO: 1166021 - RNA, 19 nt, Human
augaaacccccacacacac

SEQ ID NO: 1166022 - RNA, 12 nt, Human
augacccagugg

SEQ ID NO: 1166023 - RNA, 12 nt, Human
augacuccagaa

SEQ ID NO: 1166024 - RNA, 16 nt, Human
augacuccagaauuuc

SEQ ID NO: 1166025 - RNA, 17 nt, Human
augacuccagaauuucc

SEQ ID NO: 1166026 - RNA, 16 nt, Human
agccccagugcccaca

SEQ ID NO: 1166027 - RNA, 20 nt, Human
agccccaucccaaacccuuc

SEQ ID NO: 1166028 - RNA, 11 nt, Human
agccccauccu

SEQ ID NO: 1166029 - RNA, 15 nt, Human
agcccugagcuuucu

SEQ ID NO: 1166030 - RNA, 19 nt, Human
agccgagaucacgccacug

SEQ ID NO: 1166031 - RNA, 20 nt, Human
agccgagaucacgccacugc

SEQ ID NO: 1166032 - RNA, 21 nt, Human
agccgagaucacgccacugca

SEQ ID NO: 1166033 - RNA, 19 nt, Human
agccgagauugcaccacug

SEQ ID NO: 1166034 - RNA, 20 nt, Human
agccgagauugcaccacugc

SEQ ID NO: 1166035 - RNA, 14 nt, Human
agccgcuggggcca

SEQ ID NO: 1166036 - RNA, 22 nt, Human
agccgcuggggccaguuggucc

SEQ ID NO: 1166037 - RNA, 18 nt, Human
agccucccaaagugcugg

SEQ ID NO: 1166038 - RNA, 19 nt, Human
agccucccaaagugcuggg

SEQ ID NO: 1166039 - RNA, 20 nt, Human
agccucccaaagugcuggga

SEQ ID NO: 1166040 - RNA, 18 nt, Human
agccucccgaauagcugg

SEQ ID NO: 1166041 - RNA, 19 nt, Human
agccucccgaauagcuggg

SEQ ID NO: 1166042 - RNA, 20 nt, Human
agccucccgaauagcuggga

SEQ ID NO: 1166043 - RNA, 22 nt, Human
agccucccgaauagcugggacu

SEQ ID NO: 1166044 - RNA, 17 nt, Human
agccucccgaguagcug

SEQ ID NO: 1166045 - RNA, 21 nt, Human
agaugggagaaucacuugaac

SEQ ID NO: 1166046 - RNA, 14 nt, Human
agauguagaggaga

SEQ ID NO: 1166047 - RNA, 16 nt, Human
agauguagaggagaaa

SEQ ID NO: 1166048 - RNA, 19 nt, Human
agcacuaaggugugcucug

SEQ ID NO: 1166049 - RNA, 20 nt, Human
agcacuaaggugugcucuga

SEQ ID NO: 1166050 - RNA, 21 nt, Human
agcagccacauuccugaugcu

SEQ ID NO: 1166051 - RNA, 12 nt, Human
agcaugccugga

SEQ ID NO: 1166052 - RNA, 20 nt, Human
agcaugccuggauggggcug

SEQ ID NO: 1166053 - RNA, 19 nt, Human
agccaaagcuaggccuggc

SEQ ID NO: 1166054 - RNA, 20 nt, Human
agccaaagcuaggccuggcc

SEQ ID NO: 1166055 - RNA, 23 nt, Human
agccaaagcuaggccuggccaga

SEQ ID NO: 1166056 - RNA, 22 nt, Human
agccaaggccaaaggaagcaca

SEQ ID NO: 1166057 - RNA, 23 nt, Human
agccaaggccaaaggaagcacau

SEQ ID NO: 1166058 - RNA, 20 nt, Human
agccagaggagagaggaccc

SEQ ID NO: 1166059 - RNA, 15 nt, Human
agccagauuuuccug

SEQ ID NO: 1166060 - RNA, 19 nt, Human
agccagauuuuccugaaaa

SEQ ID NO: 1166061 - RNA, 14 nt, Human
agaucuucuguggg

SEQ ID NO: 1166062 - RNA, 21 nt, Human
agauaggucagugcaaauacu

SEQ ID NO: 1166063 - RNA, 15 nt, Human
agauagccaaggcca

SEQ ID NO: 1166064 - RNA, 16 nt, Human
agauagccaaggccaa

SEQ ID NO: 1166065 - RNA, 20 nt, Human
agauagccaaggccaaagga

SEQ ID NO: 1166066 - RNA, 13 nt, Human
agaggagaggggc

SEQ ID NO: 1166067 - RNA, 22 nt, Human
agaggggaacagacuggaagca

SEQ ID NO: 1166068 - RNA, 16 nt, Human
agaggggaagagacuu

SEQ ID NO: 1166069 - RNA, 22 nt, Human
agauacuuggggggcugaggug

SEQ ID NO: 1166070 - RNA, 13 nt, Human
agauagccaaggc

SEQ ID NO: 1166071 - RNA, 17 nt, Human
agacugcauuauauuua

SEQ ID NO: 1166072 - RNA, 21 nt, Human
agacugcauuauauuuauuac

SEQ ID NO: 1166073 - RNA, 21 nt, Human
agagaagagauugugguuuca

SEQ ID NO: 1166074 - RNA, 18 nt, Human
agagaaaguacuucucca

SEQ ID NO: 1166075 - RNA, 13 nt, Human
agacaaugacuua

SEQ ID NO: 1166076 - RNA, 17 nt, Human
agacaaugacuuacugu

SEQ ID NO: 1166077 - RNA, 19 nt, Human
agacaaugacuuacuguac

SEQ ID NO: 1166078 - RNA, 15 nt, Human
agacaauuuauuaug

SEQ ID NO: 1166079 - RNA, 21 nt, Human
agacaauuuauuauggcacau

SEQ ID NO: 1166080 - RNA, 19 nt, Human
agacggagucccaccuugg

SEQ ID NO: 1166081 - RNA, 18 nt, Human
agacgggggcagagaggg

SEQ ID NO: 1166082 - RNA, 17 nt, Human
agacagcccgggcucug

SEQ ID NO: 1166083 - RNA, 18 nt, Human
agacagcccgggcucugc

SEQ ID NO: 1166084 - RNA, 20 nt, Human
agacagcccgggcucugccu

SEQ ID NO: 1166085 - RNA, 21 nt, Human
agacagcccgggcucugccuc

SEQ ID NO: 1166086 - RNA, 13 nt, Human
agaccaucccuga

SEQ ID NO: 1166087 - RNA, 14 nt, Human
agaccaucccugaa

SEQ ID NO: 1166088 - RNA, 17 nt, Human
agaccaucccugaaggc

SEQ ID NO: 1166089 - RNA, 18 nt, Human
agaccaucccugaaggcc

SEQ ID NO: 1166090 - RNA, 21 nt, Human
agaccaucccugaaggccccg

SEQ ID NO: 1166091 - RNA, 17 nt, Human
agguaaggaauaccugu

SEQ ID NO: 1166092 - RNA, 22 nt, Human
agguacgaaaagaggggaagag

SEQ ID NO: 1166093 - RNA, 14 nt, Human
aggucgaggcagga

SEQ ID NO: 1166094 - RNA, 16 nt, Human
aggugcugccauccag

SEQ ID NO: 1166095 - RNA, 17 nt, Human
aggugcugccauccagg

SEQ ID NO: 1166096 - RNA, 14 nt, Human
agguuaauguucau

SEQ ID NO: 1166097 - RNA, 17 nt, Human
agguucaaagauauuuu

SEQ ID NO: 1166098 - RNA, 13 nt, Human
agguucagcuugu

SEQ ID NO: 1166099 - RNA, 13 nt, Human
agguucccuuuga

SEQ ID NO: 1166100 - RNA, 21 nt, Human
agggacgcuacccgggaaggg

SEQ ID NO: 1166101 - RNA, 12 nt, Human
agggacagaggg

SEQ ID NO: 1166102 - RNA, 13 nt, Human
agggacagagggg

SEQ ID NO: 1166103 - RNA, 20 nt, Human
agggacagaggggguggccu

SEQ ID NO: 1166104 - RNA, 18 nt, Human
aggcugccucucccauca

SEQ ID NO: 1166105 - RNA, 17 nt, Human
agggcacaccgggcacu

SEQ ID NO: 1166106 - RNA, 20 nt, Human
agggcacaccgggcacucag

SEQ ID NO: 1166107 - RNA, 21 nt, Human
agggcacaccgggcacucaga

SEQ ID NO: 1166108 - RNA, 22 nt, Human
agggcacagaaaauggaagaca

SEQ ID NO: 1166109 - RNA, 15 nt, Human
agggccuggccugag

SEQ ID NO: 1166110 - RNA, 16 nt, Human
agggccuggccugagc

SEQ ID NO: 1166111 - RNA, 17 nt, Human
agggccuggccugagcu

SEQ ID NO: 1166112 - RNA, 18 nt, Human
agggccuggccugagcug

SEQ ID NO: 1166113 - RNA, 19 nt, Human
agggcgggaggauguucug

SEQ ID NO: 1166114 - RNA, 21 nt, Human
aggggauagagagagaccacu

SEQ ID NO: 1166115 - RNA, 15 nt, Human
aggggcacagggucu

SEQ ID NO: 1166116 - RNA, 14 nt, Human
aggaccucagguga

SEQ ID NO: 1166117 - RNA, 20 nt, Human
aggaccucaggugagaagca

SEQ ID NO: 1166118 - RNA, 15 nt, Human
aggagagcuagcagc

SEQ ID NO: 1166119 - RNA, 15 nt, Human
aggagaggagagggg

SEQ ID NO: 1166120 - RNA, 16 nt, Human
aggagaggggcacagg

SEQ ID NO: 1166121 - RNA, 18 nt, Human
aggagaggggcacagggu

SEQ ID NO: 1166122 - RNA, 20 nt, Human
aggaccccuccaugugggcu

SEQ ID NO: 1166123 - RNA, 16 nt, Human
aggauucuuccucccu

SEQ ID NO: 1166124 - RNA, 12 nt, Human
aggauucuuccu

SEQ ID NO: 1166125 - RNA, 17 nt, Human
aggaggggauagagaga

SEQ ID NO: 1166126 - RNA, 20 nt, Human
aggauguucugggacacagu

SEQ ID NO: 1166127 - RNA, 14 nt, Human
aggauguugaaaaa

SEQ ID NO: 1166128 - RNA, 17 nt, Human
aggauguugaaaaaguu

SEQ ID NO: 1166129 - RNA, 21 nt, Human
agcuggucccacucaguccau

SEQ ID NO: 1166130 - RNA, 17 nt, Human
agcugggugucaagagg

SEQ ID NO: 1166131 - RNA, 22 nt, Human
agcugggugucaagagggucug

SEQ ID NO: 1166132 - RNA, 13 nt, Human
aggaaaaacugau

SEQ ID NO: 1166133 - RNA, 15 nt, Human
aggaaaaacugauuu

SEQ ID NO: 1166134 - RNA, 14 nt, Human
agcuguaugauucc

SEQ ID NO: 1166135 - RNA, 21 nt, Human
aaaugucucuuuaaugucaca

SEQ ID NO: 1166136 - RNA, 18 nt, Human
guauucucuccuguaccu

SEQ ID NO: 1166137 - RNA, 21 nt, Human
guauucucuccuguaccucuu

SEQ ID NO: 1166138 - RNA, 17 nt, Human
aaauuguauuacaaauc

SEQ ID NO: 1166139 - RNA, 17 nt, Human
aaauuccaagugauuga

SEQ ID NO: 1166140 - RNA, 16 nt, Human
aaauuccccacccuga

SEQ ID NO: 1166141 - RNA, 20 nt, Human
gucacaggaaguagaggagg

SEQ ID NO: 1166142 - RNA, 12 nt, Human
gucacaggcagg

SEQ ID NO: 1166143 - RNA, 22 nt, Human
gucaccaaaucagcugcuacua

SEQ ID NO: 1166144 - RNA, 22 nt, Human
gucaauuacaggaaguacugga

SEQ ID NO: 1166145 - RNA, 21 nt, Human
gucaauuuuguuauguauauu

SEQ ID NO: 1166146 - RNA, 13 nt, Human
gucacaggaagua

SEQ ID NO: 1166147 - RNA, 15 nt, Human
gucacaggaaguaga

SEQ ID NO: 1166148 - RNA, 10 nt, Human
gucacugcuu

SEQ ID NO: 1166149 - RNA, 17 nt, Human
gucacugagacagcccg

SEQ ID NO: 1166150 - RNA, 18 nt, Human
gucacugagacagcccgg

SEQ ID NO: 1166151 - RNA, 21 nt, Human
gucacugagacagcccgggcu

SEQ ID NO: 1166152 - RNA, 23 nt, Human
gucacugagacagcccgggcucu

SEQ ID NO: 1166153 - RNA, 12 nt, Human
gucaccaagccc

SEQ ID NO: 1166154 - RNA, 15 nt, Human
gucaccaagcccagu

SEQ ID NO: 1166155 - RNA, 23 nt, Human
gucacucuggcagcucagagagg

SEQ ID NO: 1166156 - RNA, 14 nt, Human
gucacugagacagc

SEQ ID NO: 1166157 - RNA, 15 nt, Human
gucacugagacagcc

SEQ ID NO: 1166158 - RNA, 16 nt, Human
gucacugagacagccc

SEQ ID NO: 1166159 - RNA, 21 nt, Human
gucagaaguuucugccgcagc

SEQ ID NO: 1166160 - RNA, 23 nt, Human
gucagaaguuucugccgcagccc

SEQ ID NO: 1166161 - RNA, 14 nt, Human
gucaggaaagagaa

SEQ ID NO: 1166162 - RNA, 15 nt, Human
gucacugcuuaacuu

SEQ ID NO: 1166163 - RNA, 21 nt, Human
gucacugcuuaacuucacaua

SEQ ID NO: 1166164 - RNA, 16 nt, Human
gucagguggggcagcu

SEQ ID NO: 1166165 - RNA, 17 nt, Human
gucagguggggcagcuu

SEQ ID NO: 1166166 - RNA, 18 nt, Human
gucagguggggcagcuug

SEQ ID NO: 1166167 - RNA, 22 nt, Human
gucagguggggcagcuugaggg

SEQ ID NO: 1166168 - RNA, 15 nt, Human
gucagugugacugau

SEQ ID NO: 1166169 - RNA, 13 nt, Human
aaauuucuaaauc

SEQ ID NO: 1166170 - RNA, 15 nt, Human
aaauuucuaaaucuc

SEQ ID NO: 1166171 - RNA, 14 nt, Human
gucuaccugagggg

SEQ ID NO: 1166172 - RNA, 15 nt, Human
gucuaccugaggggc

SEQ ID NO: 1166173 - RNA, 16 nt, Human
gucuaccugaggggcc

SEQ ID NO: 1166174 - RNA, 20 nt, Human
gucuaccugaggggccucuu

SEQ ID NO: 1166175 - RNA, 22 nt, Human
gucuaugggacucaaugcacug

SEQ ID NO: 1166176 - RNA, 17 nt, Human
guccuggcaugggaaug

SEQ ID NO: 1166177 - RNA, 12 nt, Human
gucgaggcagga

SEQ ID NO: 1166178 - RNA, 14 nt, Human
guccucuuuucuga

SEQ ID NO: 1166179 - RNA, 19 nt, Human
guccugcugcaguugccag

SEQ ID NO: 1166180 - RNA, 16 nt, Human
guccuggcaugggaau

SEQ ID NO: 1166181 - RNA, 12 nt, Human
aacauauauaac

SEQ ID NO: 1166182 - RNA, 16 nt, Human
aacauauauaacaaug

SEQ ID NO: 1166183 - RNA, 19 nt, Human
aaauuucuaaaucuccaaa

SEQ ID NO: 1166184 - RNA, 19 nt, Human
aacacaaacgggcucagca

SEQ ID NO: 1166185 - RNA, 21 nt, Human
aacacucacauuuauucugcu

SEQ ID NO: 1166186 - RNA, 17 nt, Human
aacacucauugaccuga

SEQ ID NO: 1166187 - RNA, 17 nt, Human
aacacuguucucugccc

SEQ ID NO: 1166188 - RNA, 18 nt, Human
aacacuguucucugcccu

SEQ ID NO: 1166189 - RNA, 19 nt, Human
aacacuguucucugcccuc

SEQ ID NO: 1166190 - RNA, 17 nt, Human
gucauuugagcagggcu

SEQ ID NO: 1166191 - RNA, 19 nt, Human
gucauuugagcagggcuca

SEQ ID NO: 1166192 - RNA, 22 nt, Human
guccaugaagauguagaggaga

SEQ ID NO: 1166193 - RNA, 23 nt, Human
guccaugaagauguagaggagaa

SEQ ID NO: 1166194 - RNA, 15 nt, Human
gucccaccccacaca

SEQ ID NO: 1166195 - RNA, 20 nt, Human
gucccaccccacacacgcca

SEQ ID NO: 1166196 - RNA, 18 nt, Human
guccccaccgcagacagg

SEQ ID NO: 1166197 - RNA, 22 nt, Human
guccccaccgcagacaggacca

SEQ ID NO: 1166198 - RNA, 18 nt, Human
guccccuguuuguuucug

SEQ ID NO: 1166199 - RNA, 22 nt, Human
guccccuguuuguuucugaaag

SEQ ID NO: 1166200 - RNA, 19 nt, Human
gucccugguggcagcucac

SEQ ID NO: 1166201 - RNA, 18 nt, Human
gucccuuacgugaguccu

SEQ ID NO: 1166202 - RNA, 19 nt, Human
gucccuuacgugaguccug

SEQ ID NO: 1166203 - RNA, 15 nt, Human
gucuuuaaaugcugc

SEQ ID NO: 1166204 - RNA, 15 nt, Human
gucuggaaugcagug

SEQ ID NO: 1166205 - RNA, 16 nt, Human
gucuggaaugcagugg

SEQ ID NO: 1166206 - RNA, 18 nt, Human
gucuggaaugcaguggua

SEQ ID NO: 1166207 - RNA, 14 nt, Human
gucucaaaaaaaca

SEQ ID NO: 1166208 - RNA, 17 nt, Human
gucucaaaaaaagaaaa

SEQ ID NO: 1166209 - RNA, 19 nt, Human
gucucaaaaaaagaaaaag

SEQ ID NO: 1166210 - RNA, 14 nt, Human
gucugaaggcuggg

SEQ ID NO: 1166211 - RNA, 12 nt, Human
gucugacaggca

SEQ ID NO: 1166212 - RNA, 13 nt, Human
gucugacaggcaa

SEQ ID NO: 1166213 - RNA, 14 nt, Human
gucugacaggcaau

SEQ ID NO: 1166214 - RNA, 15 nt, Human
gucugacaggcaaug

SEQ ID NO: 1166215 - RNA, 18 nt, Human
gucugacaggcaaugcug

SEQ ID NO: 1166216 - RNA, 20 nt, Human
gucugacaggcaaugcuggc

SEQ ID NO: 1166217 - RNA, 13 nt, Human
aacuauauuguuu

SEQ ID NO: 1166218 - RNA, 17 nt, Human
aacuagggaagauaaua

SEQ ID NO: 1166219 - RNA, 12 nt, Human
aacguggcugcu

SEQ ID NO: 1166220 - RNA, 13 nt, Human
aacguggcugcuu

SEQ ID NO: 1166221 - RNA, 15 nt, Human
aacguggcugcuuca

SEQ ID NO: 1166222 - RNA, 14 nt, Human
aacuccagaaagug

SEQ ID NO: 1166223 - RNA, 12 nt, Human
aacuccuggccu

SEQ ID NO: 1166224 - RNA, 23 nt, Human
gugaauaauacaguaucucaggg

SEQ ID NO: 1166225 - RNA, 20 nt, Human
gugacagagugagacucugu

SEQ ID NO: 1166226 - RNA, 22 nt, Human
gugacagagugagacucugucu

SEQ ID NO: 1166227 - RNA, 19 nt, Human
gugacaugucuuuucuugc

SEQ ID NO: 1166228 - RNA, 22 nt, Human
gugagacccugucucaaaaaaa

SEQ ID NO: 1166229 - RNA, 14 nt, Human
gugagacucugucu

SEQ ID NO: 1166230 - RNA, 16 nt, Human
gugagacucugucuca

SEQ ID NO: 1166231 - RNA, 22 nt, Human
aacucuccucugcugcuggcug

SEQ ID NO: 1166232 - RNA, 23 nt, Human
aacucuccucugcugcuggcugg

SEQ ID NO: 1166233 - RNA, 21 nt, Human
aacugauuuuuuuuuccuuca

SEQ ID NO: 1166234 - RNA, 22 nt, Human
aacugauuuuuuuuuccuucag

SEQ ID NO: 1166235 - RNA, 23 nt, Human
aacugauuuuuuuuuccuucagu

SEQ ID NO: 1166236 - RNA, 16 nt, Human
aacugcauuggcuuug

SEQ ID NO: 1166237 - RNA, 18 nt, Human
gugagacucugucucaaa

SEQ ID NO: 1166238 - RNA, 12 nt, Human
gugaggcucugc

SEQ ID NO: 1166239 - RNA, 13 nt, Human
gugaggcucugcc

SEQ ID NO: 1166240 - RNA, 14 nt, Human
gugaggcucugccc

SEQ ID NO: 1166241 - RNA, 15 nt, Human
gugaggcucugcccu

SEQ ID NO: 1166242 - RNA, 16 nt, Human
gugaggcucugcccuu

SEQ ID NO: 1166243 - RNA, 17 nt, Human
gugaggcucugcccuug

SEQ ID NO: 1166244 - RNA, 18 nt, Human
gugaggcucugcccuugg

SEQ ID NO: 1166245 - RNA, 23 nt, Human
gugaguacuacaguccucccauc

SEQ ID NO: 1166246 - RNA, 17 nt, Human
gugagucaccaagccca

SEQ ID NO: 1166247 - RNA, 19 nt, Human
gugagucaccaagcccagu

SEQ ID NO: 1166248 - RNA, 19 nt, Human
aacucuccucugcugcugg

SEQ ID NO: 1166249 - RNA, 21 nt, Human
aacucuccucugcugcuggcu

SEQ ID NO: 1166250 - RNA, 14 nt, Human
aacuucacauauug

SEQ ID NO: 1166251 - RNA, 22 nt, Human
aacuucacauauugauuuccgu

SEQ ID NO: 1166252 - RNA, 22 nt, Human
aacuucaccauauuaccacaga

SEQ ID NO: 1166253 - RNA, 13 nt, Human
aacuucagacaua

SEQ ID NO: 1166254 - RNA, 18 nt, Human
aacuucagcgguuuauau

SEQ ID NO: 1166255 - RNA, 21 nt, Human
aacuucagcgguuuauauaag

SEQ ID NO: 1166256 - RNA, 11 nt, Human
gugauuaccag

SEQ ID NO: 1166257 - RNA, 16 nt, Human
gugauuaccagggacu

SEQ ID NO: 1166258 - RNA, 17 nt, Human
gugauuaccagggacug

SEQ ID NO: 1166259 - RNA, 18 nt, Human
gugcaaugaccuuucaau

SEQ ID NO: 1166260 - RNA, 13 nt, Human
gugcacaagcucc

SEQ ID NO: 1166261 - RNA, 16 nt, Human
gugcacaagcuccaag

SEQ ID NO: 1166262 - RNA, 21 nt, Human
gugcacaagcuccaagcuccc

SEQ ID NO: 1166263 - RNA, 23 nt, Human
gugcacaagcuccaagcucccag

SEQ ID NO: 1166264 - RNA, 21 nt, Human
gugcacaugcacgugugugca

SEQ ID NO: 1166265 - RNA, 22 nt, Human
gugcaaugaccuuucaauagga

SEQ ID NO: 1166266 - RNA, 17 nt, Human
gugcauuugaggucugu

SEQ ID NO: 1166267 - RNA, 19 nt, Human
gugcauuugaggucuguuc

SEQ ID NO: 1166268 - RNA, 20 nt, Human
gugcauuugaggucuguucu

SEQ ID NO: 1166269 - RNA, 21 nt, Human
gugcauuuggugguuucagaa

SEQ ID NO: 1166270 - RNA, 23 nt, Human
gugccaaaaacaacaacaaaaug

SEQ ID NO: 1166271 - RNA, 22 nt, Human
aacuuuaccuuuuuuauacaua

SEQ ID NO: 1166272 - RNA, 23 nt, Human
aacuuuaccuuuuuuauacauaa

SEQ ID NO: 1166273 - RNA, 19 nt, Human
aagaaaaaauauuuucccu

SEQ ID NO: 1166274 - RNA, 13 nt, Human
aagaaaaagaaaa

SEQ ID NO: 1166275 - RNA, 18 nt, Human
aagaaaaagaaaaagaaa

SEQ ID NO: 1166276 - RNA, 17 nt, Human
aagaaaaaugagccugg

SEQ ID NO: 1166277 - RNA, 18 nt, Human
aagaaaaaugagccuggc

SEQ ID NO: 1166278 - RNA, 15 nt, Human
aagaaaauaguggug

SEQ ID NO: 1166279 - RNA, 21 nt, Human
aagaaaauaguggugugauuu

SEQ ID NO: 1166280 - RNA, 22 nt, Human
aagaaaauaguggugugauuug

SEQ ID NO: 1166281 - RNA, 11 nt, Human
aagaaacauuu

SEQ ID NO: 1166282 - RNA, 14 nt, Human
aagaaagaaaauca

SEQ ID NO: 1166283 - RNA, 16 nt, Human
aagaaagaaaaucagg

SEQ ID NO: 1166284 - RNA, 12 nt, Human
aagaaagagaga

SEQ ID NO: 1166285 - RNA, 13 nt, Human
aagaaagagagaa

SEQ ID NO: 1166286 - RNA, 14 nt, Human
aagaaagagagaaa

SEQ ID NO: 1166287 - RNA, 15 nt, Human
aagaaagagagaaaa

SEQ ID NO: 1166288 - RNA, 16 nt, Human
aagaaagagagaaaau

SEQ ID NO: 1166289 - RNA, 18 nt, Human
aagaaagagagaaaauaa

SEQ ID NO: 1166290 - RNA, 20 nt, Human
aagaaagagagaaaauaaaa

SEQ ID NO: 1166291 - RNA, 22 nt, Human
aagaagcaccaaucaugaauua

SEQ ID NO: 1166292 - RNA, 17 nt, Human
gugcuaggaacacuccu

SEQ ID NO: 1166293 - RNA, 15 nt, Human
gugcuaucuccccca

SEQ ID NO: 1166294 - RNA, 18 nt, Human
gugcuaucucccccagcc

SEQ ID NO: 1166295 - RNA, 19 nt, Human
gugcuaucucccccagccc

SEQ ID NO: 1166296 - RNA, 18 nt, Human
gugcuccauggcugccau

SEQ ID NO: 1166297 - RNA, 22 nt, Human
gugcuccauggcugccaucuca

SEQ ID NO: 1166298 - RNA, 16 nt, Human
gugcucugaucaucca

SEQ ID NO: 1166299 - RNA, 13 nt, Human
gugcucuggacag

SEQ ID NO: 1166300 - RNA, 14 nt, Human
gugcucuggacagg

SEQ ID NO: 1166301 - RNA, 13 nt, Human
gugcugcccugcc

SEQ ID NO: 1166302 - RNA, 14 nt, Human
gugcugcccugccc

SEQ ID NO: 1166303 - RNA, 15 nt, Human
gugcugcccugccca

SEQ ID NO: 1166304 - RNA, 20 nt, Human
aagaucaaaagguuaauaaa

SEQ ID NO: 1166305 - RNA, 23 nt, Human
aagaucaaaagguuaauaaagua

SEQ ID NO: 1166306 - RNA, 13 nt, Human
aagcaaaauguga

SEQ ID NO: 1166307 - RNA, 17 nt, Human
aagcaacccaaauguuc

SEQ ID NO: 1166308 - RNA, 14 nt, Human
gugucaccugaaga

SEQ ID NO: 1166309 - RNA, 22 nt, Human
gugucaccugaagacucauucu

SEQ ID NO: 1166310 - RNA, 14 nt, Human
gugucagguggggc

SEQ ID NO: 1166311 - RNA, 18 nt, Human
gugucagguggggcagcu

SEQ ID NO: 1166312 - RNA, 19 nt, Human
gugucagguggggcagcuu

SEQ ID NO: 1166313 - RNA, 20 nt, Human
gugucagguggggcagcuug

SEQ ID NO: 1166314 - RNA, 23 nt, Human
gugugaaccaccacacccagccc

SEQ ID NO: 1166315 - RNA, 23 nt, Human
gugcugcccugcccaccuggccu

SEQ ID NO: 1166316 - RNA, 18 nt, Human
gugcugcccugcccaccu

SEQ ID NO: 1166317 - RNA, 15 nt, Human
gugguuucagaaaug

SEQ ID NO: 1166318 - RNA, 16 nt, Human
gugguuucagaaaugu

SEQ ID NO: 1166319 - RNA, 11 nt, Human
aagaggcaggg

SEQ ID NO: 1166320 - RNA, 14 nt, Human
aagaggcagggucu

SEQ ID NO: 1166321 - RNA, 21 nt, Human
aagagggagggagggcuccag

SEQ ID NO: 1166322 - RNA, 22 nt, Human
aagagggagggagggcuccaga

SEQ ID NO: 1166323 - RNA, 16 nt, Human
aagcacuaaacaaaga

SEQ ID NO: 1166324 - RNA, 17 nt, Human
aagcaccuccugccucg

SEQ ID NO: 1166325 - RNA, 21 nt, Human
aagcacaugccucucucaggc

SEQ ID NO: 1166326 - RNA, 13 nt, Human
aagcaccuccugc

SEQ ID NO: 1166327 - RNA, 14 nt, Human
aagcaccuccugcc

SEQ ID NO: 1166328 - RNA, 15 nt, Human
aagcaccuccugccu

SEQ ID NO: 1166329 - RNA, 16 nt, Human
aagcaccuccugccuc

SEQ ID NO: 1166330 - RNA, 16 nt, Human
aagcacacuugacauc

SEQ ID NO: 1166331 - RNA, 14 nt, Human
aagcacaugccucu

SEQ ID NO: 1166332 - RNA, 15 nt, Human
aagcacaugccucuc

SEQ ID NO: 1166333 - RNA, 16 nt, Human
aagcacaugccucucu

SEQ ID NO: 1166334 - RNA, 19 nt, Human
aagcacaugccucucucag

SEQ ID NO: 1166335 - RNA, 20 nt, Human
aagcacaugccucucucagg

SEQ ID NO: 1166336 - RNA, 12 nt, Human
aagcaugugaga

SEQ ID NO: 1166337 - RNA, 16 nt, Human
aagcauuuacuuugug

SEQ ID NO: 1166338 - RNA, 17 nt, Human
aagccaaagcuaggccu

SEQ ID NO: 1166339 - RNA, 18 nt, Human
aagccaaagcuaggccug

SEQ ID NO: 1166340 - RNA, 20 nt, Human
aagccaaagcuaggccuggc

SEQ ID NO: 1166341 - RNA, 14 nt, Human
aagcccaggaaagg

SEQ ID NO: 1166342 - RNA, 18 nt, Human
guuaaucauuagguguga

SEQ ID NO: 1166343 - RNA, 20 nt, Human
guuauuauauuuacaaaugg

SEQ ID NO: 1166344 - RNA, 19 nt, Human
guuauuauauuuacaaaug

SEQ ID NO: 1166345 - RNA, 19 nt, Human
guuagagguucccuuugac

SEQ ID NO: 1166346 - RNA, 21 nt, Human
aagccgugauuuucauugcug

SEQ ID NO: 1166347 - RNA, 17 nt, Human
guucagguaacaggcag

SEQ ID NO: 1166348 - RNA, 18 nt, Human
guucagguaacaggcaga

SEQ ID NO: 1166349 - RNA, 23 nt, Human
guucagcuuguaaauagcucagg

SEQ ID NO: 1166350 - RNA, 21 nt, Human
guucaggguuggccccugccc

SEQ ID NO: 1166351 - RNA, 22 nt, Human
guucaggguuggccccugcccg

SEQ ID NO: 1166352 - RNA, 16 nt, Human
aagccucccacgacug

SEQ ID NO: 1166353 - RNA, 15 nt, Human
aagccuccuccagcc

SEQ ID NO: 1166354 - RNA, 19 nt, Human
aagccuccuccagccgcca

SEQ ID NO: 1166355 - RNA, 21 nt, Human
aagccuuggggcugaugcagu

SEQ ID NO: 1166356 - RNA, 14 nt, Human
guucuugguuugua

SEQ ID NO: 1166357 - RNA, 15 nt, Human
guucuugguuuguaa

SEQ ID NO: 1166358 - RNA, 18 nt, Human
guucuugguuuguaaauu

SEQ ID NO: 1166359 - RNA, 14 nt, Human
guugauagcacaga

SEQ ID NO: 1166360 - RNA, 19 nt, Human
guugauagcacagacccug

SEQ ID NO: 1166361 - RNA, 22 nt, Human
guugauagcacagacccugccc

SEQ ID NO: 1166362 - RNA, 19 nt, Human
guucuagcauggcugccaa

SEQ ID NO: 1166363 - RNA, 15 nt, Human
guucucucuucucca

SEQ ID NO: 1166364 - RNA, 12 nt, Human
guucucugagga

SEQ ID NO: 1166365 - RNA, 14 nt, Human
guucucugaggaca

SEQ ID NO: 1166366 - RNA, 15 nt, Human
guucucugcccucca

SEQ ID NO: 1166367 - RNA, 17 nt, Human
guucucugcccuccaag

SEQ ID NO: 1166368 - RNA, 18 nt, Human
guucucugcccuccaaga

SEQ ID NO: 1166369 - RNA, 13 nt, Human
guucuuaauucuu

SEQ ID NO: 1166370 - RNA, 14 nt, Human
guucuuaauucuua

SEQ ID NO: 1166371 - RNA, 17 nt, Human
guucuuaauucuuagcu

SEQ ID NO: 1166372 - RNA, 23 nt, Human
aagcuuguauuccuuuuucucuc

SEQ ID NO: 1166373 - RNA, 18 nt, Human
guucccuugaugaagaag

SEQ ID NO: 1166374 - RNA, 21 nt, Human
guucccuuuuuuggcugcuga

SEQ ID NO: 1166375 - RNA, 22 nt, Human
guucccuuuuuuggcugcugaa

SEQ ID NO: 1166376 - RNA, 13 nt, Human
aaggggagaguaa

SEQ ID NO: 1166377 - RNA, 12 nt, Human
aagggggcuggg

SEQ ID NO: 1166378 - RNA, 23 nt, Human
aagggggcugggacaugggaaag

SEQ ID NO: 1166379 - RNA, 11 nt, Human
guuucagaaau

SEQ ID NO: 1166380 - RNA, 13 nt, Human
guuucagaaaugu

SEQ ID NO: 1166381 - RNA, 14 nt, Human
guuucagaaaugug

SEQ ID NO: 1166382 - RNA, 16 nt, Human
aaggcugggggaagaa

SEQ ID NO: 1166383 - RNA, 19 nt, Human
aaggcugggggaagaagcu

SEQ ID NO: 1166384 - RNA, 22 nt, Human
aaggcugggggaagaagcucuc

SEQ ID NO: 1166385 - RNA, 20 nt, Human
aaggcugucaauuacaggaa

SEQ ID NO: 1166386 - RNA, 15 nt, Human
aagggcuguuauaau

SEQ ID NO: 1166387 - RNA, 17 nt, Human
aagggcuguuauaaucu

SEQ ID NO: 1166388 - RNA, 14 nt, Human
guuuaugauuccac

SEQ ID NO: 1166389 - RNA, 17 nt, Human
aaggaaacccagcucug

SEQ ID NO: 1166390 - RNA, 22 nt, Human
aaggaaacccagcucuggucca

SEQ ID NO: 1166391 - RNA, 23 nt, Human
guuguuugauucagacagcugcc

SEQ ID NO: 1166392 - RNA, 21 nt, Human
guuuaagugacugauggcuaa

SEQ ID NO: 1166393 - RNA, 18 nt, Human
aaguaauaugcacacauu

SEQ ID NO: 1166394 - RNA, 20 nt, Human
aaguaauaugcacacauuuu

SEQ ID NO: 1166395 - RNA, 21 nt, Human
aaguaauaugcacacauuuuu

SEQ ID NO: 1166396 - RNA, 22 nt, Human
guuuuaaggaugcuuguacaua

SEQ ID NO: 1166397 - RNA, 14 nt, Human
guuuucuguucuuu

SEQ ID NO: 1166398 - RNA, 15 nt, Human
guuuucuguucuuuc

SEQ ID NO: 1166399 - RNA, 16 nt, Human
guuuucuguucuuucu

SEQ ID NO: 1166400 - RNA, 19 nt, Human
guuuucuguucuuucuggc

SEQ ID NO: 1166401 - RNA, 16 nt, Human
aaguauuauaccuuuu

SEQ ID NO: 1166402 - RNA, 19 nt, Human
aaguauuauaccuuuuuua

SEQ ID NO: 1166403 - RNA, 21 nt, Human
aaguauucuuauuuaaugaaa

SEQ ID NO: 1166404 - RNA, 23 nt, Human
aaguauucuuauuuaaugaaaga

SEQ ID NO: 1166405 - RNA, 14 nt, Human
aaguacuauaauuu

SEQ ID NO: 1166406 - RNA, 17 nt, Human
aaguacuauaauuuacc

SEQ ID NO: 1166407 - RNA, 13 nt, Human
aaguacuauguau

SEQ ID NO: 1166408 - RNA, 15 nt, Human
aaguacuauguauca

SEQ ID NO: 1166409 - RNA, 18 nt, Human
aaguacuucuccacccug

SEQ ID NO: 1166410 - RNA, 19 nt, Human
aaguacuucuccacccugc

SEQ ID NO: 1166411 - RNA, 20 nt, Human
aaguacuucuccacccugcu

SEQ ID NO: 1166412 - RNA, 18 nt, Human
aaguauguuagugcaaau

SEQ ID NO: 1166413 - RNA, 19 nt, Human
aaguauguuagugcaaauu

SEQ ID NO: 1166414 - RNA, 21 nt, Human
aaguauguuagugcaaauugu

SEQ ID NO: 1166415 - RNA, 15 nt, Human
aaguauuauaccuuu

SEQ ID NO: 1166416 - RNA, 21 nt, Human
uaaaaaaaaaccugagcccca

SEQ ID NO: 1166417 - RNA, 15 nt, Human
uaaaaaugagguacu

SEQ ID NO: 1166418 - RNA, 22 nt, Human
uaaaaaugagguacucuccugg

SEQ ID NO: 1166419 - RNA, 13 nt, Human
uaaaacccaagug

SEQ ID NO: 1166420 - RNA, 12 nt, Human
uaaaacuuuuua

SEQ ID NO: 1166421 - RNA, 15 nt, Human
uaaaacuuuuuaaaa

SEQ ID NO: 1166422 - RNA, 23 nt, Human
aagugauccucccaccucagccu

SEQ ID NO: 1166423 - RNA, 21 nt, Human
uaaaauaccagccaguaaaug

SEQ ID NO: 1166424 - RNA, 13 nt, Human
aagugauccuccc

SEQ ID NO: 1166425 - RNA, 19 nt, Human
aagugauccucccaccuca

SEQ ID NO: 1166426 - RNA, 20 nt, Human
aagugauccucccaccucag

SEQ ID NO: 1166427 - RNA, 13 nt, Human
uaaaagucuugug

SEQ ID NO: 1166428 - RNA, 22 nt, Human
uaaaauaauuuuuauauuugaa

SEQ ID NO: 1166429 - RNA, 13 nt, Human
aagugugguagag

SEQ ID NO: 1166430 - RNA, 19 nt, Human
aaguuucugccgcagcccu

SEQ ID NO: 1166431 - RNA, 21 nt, Human
aaguuucugccgcagcccugc

SEQ ID NO: 1166432 - RNA, 20 nt, Human
aaguuugagaucagccuggg

SEQ ID NO: 1166433 - RNA, 9 nt, Human
uaaaauggu

SEQ ID NO: 1166434 - RNA, 13 nt, Human
aauaguuggcuag

SEQ ID NO: 1166435 - RNA, 16 nt, Human
aauagucaaauugugu

SEQ ID NO: 1166436 - RNA, 19 nt, Human
aauagucaaauugugugaa

SEQ ID NO: 1166437 - RNA, 22 nt, Human
aauaguggugugauuuggggau

SEQ ID NO: 1166438 - RNA, 18 nt, Human
uaacauggacaugaucuu

SEQ ID NO: 1166439 - RNA, 23 nt, Human
uaacauggacaugaucuucuuua

SEQ ID NO: 1166440 - RNA, 17 nt, Human
uaacauguaauuaagua

SEQ ID NO: 1166441 - RNA, 22 nt, Human
aauaucacuugucaauaaaauc

SEQ ID NO: 1166442 - RNA, 20 nt, Human
uaacgauaaaagacagugaa

SEQ ID NO: 1166443 - RNA, 21 nt, Human
uaacuucacauauugauuucc

SEQ ID NO: 1166444 - RNA, 14 nt, Human
uaacuucaccauau

SEQ ID NO: 1166445 - RNA, 17 nt, Human
uaacuuccaauuuacau

SEQ ID NO: 1166446 - RNA, 21 nt, Human
aauaugccccauucaacaucu

SEQ ID NO: 1166447 - RNA, 24 nt, Human
aauaugccccauucaacaucuagu

SEQ ID NO: 1166448 - RNA, 15 nt, Human
uaagagaaaugagcu

SEQ ID NO: 1166449 - RNA, 16 nt, Human
aauaugcacacauuuu

SEQ ID NO: 1166450 - RNA, 17 nt, Human
aauaugcacacauuuuu

SEQ ID NO: 1166451 - RNA, 22 nt, Human
aauaugcacacauuuuuuaaau

SEQ ID NO: 1166452 - RNA, 17 nt, Human
aauauugauaugcuuau

SEQ ID NO: 1166453 - RNA, 18 nt, Human
aauauuuauuuuaauaau

SEQ ID NO: 1166454 - RNA, 19 nt, Human
aauauuuauuuuaauaaug

SEQ ID NO: 1166455 - RNA, 14 nt, Human
aauauuucagauaa

SEQ ID NO: 1166456 - RNA, 22 nt, Human
aaucaggguuaguauuguccag

SEQ ID NO: 1166457 - RNA, 21 nt, Human
aaucaggguuaguauugucca

SEQ ID NO: 1166458 - RNA, 18 nt, Human
uaagcacacuugacauca

SEQ ID NO: 1166459 - RNA, 22 nt, Human
uaagcuguuacugucuucagua

SEQ ID NO: 1166460 - RNA, 11 nt, Human
aauccuggcug

SEQ ID NO: 1166461 - RNA, 17 nt, Human
aaucaugaauuaguuuu

SEQ ID NO: 1166462 - RNA, 15 nt, Human
aaucauuagguguga

SEQ ID NO: 1166463 - RNA, 17 nt, Human
aaucauuaggugugacu

SEQ ID NO: 1166464 - RNA, 23 nt, Human
aaucauuaggugugacugaauuu

SEQ ID NO: 1166465 - RNA, 19 nt, Human
aaucuacacuccagugaga

SEQ ID NO: 1166466 - RNA, 19 nt, Human
aaucuuauaauuuaaaaua

SEQ ID NO: 1166467 - RNA, 12 nt, Human
aaucaugaauua

SEQ ID NO: 1166468 - RNA, 15 nt, Human
aaucaugaauuaguu

SEQ ID NO: 1166469 - RNA, 16 nt, Human
uaagcuuguauuccuu

SEQ ID NO: 1166470 - RNA, 19 nt, Human
uaaguaaugauaacuggaa

SEQ ID NO: 1166471 - RNA, 13 nt, Human
uaaguacuaugua

SEQ ID NO: 1166472 - RNA, 16 nt, Human
uaaguacuauguauca

SEQ ID NO: 1166473 - RNA, 17 nt, Human
uaaguacuauguaucaa

SEQ ID NO: 1166474 - RNA, 19 nt, Human
uaaguacuauguaucaaug

SEQ ID NO: 1166475 - RNA, 19 nt, Human
uaaguauucuuauuuaaug

SEQ ID NO: 1166476 - RNA, 20 nt, Human
uaaguauucuuauuuaauga

SEQ ID NO: 1166477 - RNA, 21 nt, Human
uaaguauucuuauuuaaugaa

SEQ ID NO: 1166478 - RNA, 13 nt, Human
uaauguacugcau

SEQ ID NO: 1166479 - RNA, 18 nt, Human
uaaugucacaggcagguc

SEQ ID NO: 1166480 - RNA, 20 nt, Human
aaugaaacccccacacacac

SEQ ID NO: 1166481 - RNA, 22 nt, Human
aaugaauggcuaagcaaaaugu

SEQ ID NO: 1166482 - RNA, 18 nt, Human
aaugaaagacuguacaaa

SEQ ID NO: 1166483 - RNA, 14 nt, Human
aaugaaugucagug

SEQ ID NO: 1166484 - RNA, 13 nt, Human
aaugaaugucagu

SEQ ID NO: 1166485 - RNA, 22 nt, Human
aaugaaugucagugugacugau

SEQ ID NO: 1166486 - RNA, 17 nt, Human
aaugaaacauuuuguca

SEQ ID NO: 1166487 - RNA, 14 nt, Human
aaugaaacccccac

SEQ ID NO: 1166488 - RNA, 17 nt, Human
aaugaaaccugugucuc

SEQ ID NO: 1166489 - RNA, 18 nt, Human
aaugaaacccccacacac

SEQ ID NO: 1166490 - RNA, 19 nt, Human
aaugaaacccccacacaca

SEQ ID NO: 1166491 - RNA, 16 nt, Human
aaugaaagacuguaca

SEQ ID NO: 1166492 - RNA, 17 nt, Human
aaugaaagacuguacaa

SEQ ID NO: 1166493 - RNA, 17 nt, Human
uaaugaaugaaacauuu

SEQ ID NO: 1166494 - RNA, 16 nt, Human
uaauacaccacuacau

SEQ ID NO: 1166495 - RNA, 18 nt, Human
uaauacaccacuacauuc

SEQ ID NO: 1166496 - RNA, 19 nt, Human
uaauacaccacuacauucu

SEQ ID NO: 1166497 - RNA, 21 nt, Human
uaauacaccacuacauucugu

SEQ ID NO: 1166498 - RNA, 16 nt, Human
uaauagacaauuuauu

SEQ ID NO: 1166499 - RNA, 18 nt, Human
uaauagacaauuuauuau

SEQ ID NO: 1166500 - RNA, 22 nt, Human
uaauagacaauuuauuauggca

SEQ ID NO: 1166501 - RNA, 20 nt, Human
aaugcuguauuuuaaaagaa

SEQ ID NO: 1166502 - RNA, 16 nt, Human
aaugcuguauuuuaaa

SEQ ID NO: 1166503 - RNA, 11 nt, Human
aaugcccagcc

SEQ ID NO: 1166504 - RNA, 12 nt, Human
aaugcccagccc

SEQ ID NO: 1166505 - RNA, 13 nt, Human
aaugcccagcccc

SEQ ID NO: 1166506 - RNA, 20 nt, Human
aauggaaaugggcagagcag

SEQ ID NO: 1166507 - RNA, 21 nt, Human
aauggaaaugggcagagcaga

SEQ ID NO: 1166508 - RNA, 14 nt, Human
aauggaaccacucu

SEQ ID NO: 1166509 - RNA, 23 nt, Human
aauggacguguuaugacuccaga

SEQ ID NO: 1166510 - RNA, 20 nt, Human
aauggacuaacuugucuuug

SEQ ID NO: 1166511 - RNA, 16 nt, Human
aaugaccuuucaauag

SEQ ID NO: 1166512 - RNA, 17 nt, Human
aaugaccuuucaauagg

SEQ ID NO: 1166513 - RNA, 18 nt, Human
aaugaccuuucaauagga

SEQ ID NO: 1166514 - RNA, 21 nt, Human
uacaaugcugugcccuaaagu

SEQ ID NO: 1166515 - RNA, 20 nt, Human
aaugaccuuucaauaggaaa

SEQ ID NO: 1166516 - RNA, 21 nt, Human
aaugcacuuuguucuggcucu

SEQ ID NO: 1166517 - RNA, 22 nt, Human
aaugcacuuuguucuggcucuu

SEQ ID NO: 1166518 - RNA, 12 nt, Human
aauggcagccuu

SEQ ID NO: 1166519 - RNA, 16 nt, Human
aauggcagccuuggca

SEQ ID NO: 1166520 - RNA, 22 nt, Human
uacagacaacaaaccuguuucu

SEQ ID NO: 1166521 - RNA, 21 nt, Human
uacacauuuuauuuuauuaug

SEQ ID NO: 1166522 - RNA, 22 nt, Human
uacacauuuuauuuuauuaugc

SEQ ID NO: 1166523 - RNA, 23 nt, Human
uacacauuuuauuuuauuaugca

SEQ ID NO: 1166524 - RNA, 15 nt, Human
uacacuaaaagguga

SEQ ID NO: 1166525 - RNA, 14 nt, Human
uacacuaagagaga

SEQ ID NO: 1166526 - RNA, 18 nt, Human
uacacuaagagagaauga

SEQ ID NO: 1166527 - RNA, 21 nt, Human
aaugugcugaaugguuuucaa

SEQ ID NO: 1166528 - RNA, 19 nt, Human
aaugugaaaagaaaaauga

SEQ ID NO: 1166529 - RNA, 14 nt, Human
aaugugaaacugga

SEQ ID NO: 1166530 - RNA, 15 nt, Human
aaugugaaacuggau

SEQ ID NO: 1166531 - RNA, 22 nt, Human
aaugugaaacuggauuaaacuu

SEQ ID NO: 1166532 - RNA, 20 nt, Human
aauguauguguaaguauucu

SEQ ID NO: 1166533 - RNA, 16 nt, Human
uacaggugugagucac

SEQ ID NO: 1166534 - RNA, 23 nt, Human
uacauaaugcgugcauaccacuu

SEQ ID NO: 1166535 - RNA, 24 nt, Human
uacauaaugcgugcauaccacuuu

SEQ ID NO: 1166536 - RNA, 20 nt, Human
uacaucccuuaccugggaaa

SEQ ID NO: 1166537 - RNA, 13 nt, Human
uacauucuguuaa

SEQ ID NO: 1166538 - RNA, 11 nt, Human
aauuaacuuuu

SEQ ID NO: 1166539 - RNA, 12 nt, Human
uacguacacauu

SEQ ID NO: 1166540 - RNA, 13 nt, Human
uacguacacauuu

SEQ ID NO: 1166541 - RNA, 14 nt, Human
uacguacacauuuu

SEQ ID NO: 1166542 - RNA, 15 nt, Human
uacguugugcauuug

SEQ ID NO: 1166543 - RNA, 16 nt, Human
uacguugugcauuugg

SEQ ID NO: 1166544 - RNA, 22 nt, Human
uacgccaggggaaaaucagccu

SEQ ID NO: 1166545 - RNA, 17 nt, Human
uacuacuccuguaggaa

SEQ ID NO: 1166546 - RNA, 23 nt, Human
uacuauggcccuggccuagcaua

SEQ ID NO: 1166547 - RNA, 12 nt, Human
uacuauguauca

SEQ ID NO: 1166548 - RNA, 13 nt, Human
uacuauguaucaa

SEQ ID NO: 1166549 - RNA, 14 nt, Human
uacuauguaucaau

SEQ ID NO: 1166550 - RNA, 22 nt, Human
uacucuccuggaaauauuaaga

SEQ ID NO: 1166551 - RNA, 23 nt, Human
uacucuccuggaaauauuaagaa

SEQ ID NO: 1166552 - RNA, 12 nt, Human
uacucuguguca

SEQ ID NO: 1166553 - RNA, 21 nt, Human
uacucugugucagguggggca

SEQ ID NO: 1166554 - RNA, 16 nt, Human
uacuggagaaaaugga

SEQ ID NO: 1166555 - RNA, 14 nt, Human
uacuguaagaaaau

SEQ ID NO: 1166556 - RNA, 18 nt, Human
uacuguaauuugugauac

SEQ ID NO: 1166557 - RNA, 19 nt, Human
uacuguaauuugugauaca

SEQ ID NO: 1166558 - RNA, 20 nt, Human
uacuguaauuugugauacaa

SEQ ID NO: 1166559 - RNA, 23 nt, Human
uacuguaauuugugauacaaugc

SEQ ID NO: 1166560 - RNA, 21 nt, Human
uacuguacaugaaaacacauu

SEQ ID NO: 1166561 - RNA, 22 nt, Human
uacuguacaugaaaacacauuu

SEQ ID NO: 1166562 - RNA, 22 nt, Human
aauugacccacaagaaaugaaa

SEQ ID NO: 1166563 - RNA, 18 nt, Human
aauuccaagugauugaaa

SEQ ID NO: 1166564 - RNA, 22 nt, Human
aauuccacuuauaggaauugac

SEQ ID NO: 1166565 - RNA, 14 nt, Human
aauuccccacccug

SEQ ID NO: 1166566 - RNA, 12 nt, Human
aauuccccagau

SEQ ID NO: 1166567 - RNA, 15 nt, Human
aauuagccaagugug

SEQ ID NO: 1166568 - RNA, 11 nt, Human
aauuacaggaa

SEQ ID NO: 1166569 - RNA, 18 nt, Human
uaccugccaggaagccag

SEQ ID NO: 1166570 - RNA, 20 nt, Human
uaccugccaggaagccagca

SEQ ID NO: 1166571 - RNA, 23 nt, Human
uaccugccaggaagccagcaggc

SEQ ID NO: 1166572 - RNA, 10 nt, Human
uaccuguccc

SEQ ID NO: 1166573 - RNA, 13 nt, Human
uaccugucccccu

SEQ ID NO: 1166574 - RNA, 14 nt, Human
uaccugucccccug

SEQ ID NO: 1166575 - RNA, 16 nt, Human
uaccugucccccugac

SEQ ID NO: 1166576 - RNA, 17 nt, Human
uaccugucccccugaca

SEQ ID NO: 1166577 - RNA, 16 nt, Human
uagaugcaguucugaa

SEQ ID NO: 1166578 - RNA, 15 nt, Human
uagaugcaguucuga

SEQ ID NO: 1166579 - RNA, 19 nt, Human
uagcauggcugccaauggg

SEQ ID NO: 1166580 - RNA, 16 nt, Human
uagcauuuugcuaaau

SEQ ID NO: 1166581 - RNA, 18 nt, Human
uagcaugucgucaaagcu

SEQ ID NO: 1166582 - RNA, 22 nt, Human
uagcauuuugcuaaaugugaau

SEQ ID NO: 1166583 - RNA, 21 nt, Human
uagccaaggccaaaggaagca

SEQ ID NO: 1166584 - RNA, 11 nt, Human
uagccagagga

SEQ ID NO: 1166585 - RNA, 15 nt, Human
uagccagaggagaga

SEQ ID NO: 1166586 - RNA, 18 nt, Human
acaaauuuacagagacag

SEQ ID NO: 1166587 - RNA, 19 nt, Human
acaaauuuacagagacaga

SEQ ID NO: 1166588 - RNA, 23 nt, Human
acaacacucauugaccugaggcc

SEQ ID NO: 1166589 - RNA, 19 nt, Human
acaagaccacguuucuaaa

SEQ ID NO: 1166590 - RNA, 20 nt, Human
acaagacccaaaaggcagaa

SEQ ID NO: 1166591 - RNA, 19 nt, Human
acaagacccuugugguccc

SEQ ID NO: 1166592 - RNA, 18 nt, Human
acaaaaggauaaugaaua

SEQ ID NO: 1166593 - RNA, 11 nt, Human
acaaaagcaug

SEQ ID NO: 1166594 - RNA, 22 nt, Human
acaaaagcaugugagacugguu

SEQ ID NO: 1166595 - RNA, 22 nt, Human
acaaaggaugcccaaagaugca

SEQ ID NO: 1166596 - RNA, 22 nt, Human
uagaggagaaacuggaacucuc

SEQ ID NO: 1166597 - RNA, 15 nt, Human
uagauauaugcucug

SEQ ID NO: 1166598 - RNA, 19 nt, Human
uagauauaugcucugcaug

SEQ ID NO: 1166599 - RNA, 13 nt, Human
acaagacugcaca

SEQ ID NO: 1166600 - RNA, 14 nt, Human
acaagacugcacau

SEQ ID NO: 1166601 - RNA, 23 nt, Human
acaauacaucccuuaccugggaa

SEQ ID NO: 1166602 - RNA, 12 nt, Human
acaaugacuuac

SEQ ID NO: 1166603 - RNA, 17 nt, Human
acaaugacuuacuguac

SEQ ID NO: 1166604 - RNA, 18 nt, Human
acaaugacuuacuguaca

SEQ ID NO: 1166605 - RNA, 19 nt, Human
acaaugacuuacuguacau

SEQ ID NO: 1166606 - RNA, 19 nt, Human
uaggaaauauuuauuuuaa

SEQ ID NO: 1166607 - RNA, 18 nt, Human
uaggaaauauuuauuuua

SEQ ID NO: 1166608 - RNA, 16 nt, Human
uaggcauuugcugaau

SEQ ID NO: 1166609 - RNA, 20 nt, Human
uaggcauuugcugaauacag

SEQ ID NO: 1166610 - RNA, 16 nt, Human
acaccgggcacucaga

SEQ ID NO: 1166611 - RNA, 21 nt, Human
acaccucugcacaagcugcac

SEQ ID NO: 1166612 - RNA, 12 nt, Human
acacgaauauug

SEQ ID NO: 1166613 - RNA, 13 nt, Human
acacuaagagaga

SEQ ID NO: 1166614 - RNA, 14 nt, Human
acacuaagagagaa

SEQ ID NO: 1166615 - RNA, 15 nt, Human
acacucaaaagcugg

SEQ ID NO: 1166616 - RNA, 20 nt, Human
acacucacauuuauucugcu

SEQ ID NO: 1166617 - RNA, 22 nt, Human
acacucacauuuauucugcuca

SEQ ID NO: 1166618 - RNA, 20 nt, Human
uaguuccaccaucaagccac

SEQ ID NO: 1166619 - RNA, 21 nt, Human
acacaugagcaucaggccagg

SEQ ID NO: 1166620 - RNA, 18 nt, Human
acacaugauccugcaauu

SEQ ID NO: 1166621 - RNA, 18 nt, Human
acacaugcaaggucauuu

SEQ ID NO: 1166622 - RNA, 14 nt, Human
acacauuuuauuuu

SEQ ID NO: 1166623 - RNA, 19 nt, Human
acacauuuuauuuuauuau

SEQ ID NO: 1166624 - RNA, 20 nt, Human
acacauuuuauuuuauuaug

SEQ ID NO: 1166625 - RNA, 21 nt, Human
acacauuuuauuuuauuaugc

SEQ ID NO: 1166626 - RNA, 22 nt, Human
uagugaaacucguuaauuugua

SEQ ID NO: 1166627 - RNA, 23 nt, Human
uaguguuggagaagaacugaaau

SEQ ID NO: 1166628 - RNA, 18 nt, Human
acacaguauuacuucugc

SEQ ID NO: 1166629 - RNA, 19 nt, Human
acacaguauuacuucugcu

SEQ ID NO: 1166630 - RNA, 22 nt, Human
acacaguauuacuucugcuaca

SEQ ID NO: 1166631 - RNA, 22 nt, Human
acaaugcuguauuuuaaaagaa

SEQ ID NO: 1166632 - RNA, 21 nt, Human
acaaugcugugcccuaaagug

SEQ ID NO: 1166633 - RNA, 22 nt, Human
acaaugcugugcccuaaagugu

SEQ ID NO: 1166634 - RNA, 23 nt, Human
acaaugcugugcccuaaagugua

SEQ ID NO: 1166635 - RNA, 24 nt, Human
acaaugcugugcccuaaaguguau

SEQ ID NO: 1166636 - RNA, 17 nt, Human
acaaugugaaaagaaaa

SEQ ID NO: 1166637 - RNA, 19 nt, Human
acaaugugaaaagaaaaau

SEQ ID NO: 1166638 - RNA, 12 nt, Human
acacacacacac

SEQ ID NO: 1166639 - RNA, 13 nt, Human
acacacacacaca

SEQ ID NO: 1166640 - RNA, 14 nt, Human
acacacacacacac

SEQ ID NO: 1166641 - RNA, 16 nt, Human
acacacacacacacag

SEQ ID NO: 1166642 - RNA, 15 nt, Human
acacacacacacaca

SEQ ID NO: 1166643 - RNA, 11 nt, Human
acacacacaug

SEQ ID NO: 1166644 - RNA, 12 nt, Human
acacacacaugc

SEQ ID NO: 1166645 - RNA, 13 nt, Human
acacacacaugca

SEQ ID NO: 1166646 - RNA, 14 nt, Human
acacacacaugcau

SEQ ID NO: 1166647 - RNA, 15 nt, Human
acacacacaugcaua

SEQ ID NO: 1166648 - RNA, 16 nt, Human
acacacacaugcauac

SEQ ID NO: 1166649 - RNA, 22 nt, Human
acacacacgcgugcacacacca

SEQ ID NO: 1166650 - RNA, 14 nt, Human
acacacagcucugu

SEQ ID NO: 1166651 - RNA, 17 nt, Human
acacacagcucuguccu

SEQ ID NO: 1166652 - RNA, 19 nt, Human
acacacagcucuguccugg

SEQ ID NO: 1166653 - RNA, 14 nt, Human
acacaccagagccc

SEQ ID NO: 1166654 - RNA, 15 nt, Human
acacaccagagccca

SEQ ID NO: 1166655 - RNA, 20 nt, Human
acacaccagagcccaccuug

SEQ ID NO: 1166656 - RNA, 21 nt, Human
acacacgcgugcacacaccag

SEQ ID NO: 1166657 - RNA, 21 nt, Human
acacacugcauguuugugauu

SEQ ID NO: 1166658 - RNA, 20 nt, Human
acagagcccacgcccccacu

SEQ ID NO: 1166659 - RNA, 15 nt, Human
acagagcccacgccc

SEQ ID NO: 1166660 - RNA, 18 nt, Human
acagagcccacgccccca

SEQ ID NO: 1166661 - RNA, 19 nt, Human
acagagcccacgcccccac

SEQ ID NO: 1166662 - RNA, 17 nt, Human
acagcaaggagauuuac

SEQ ID NO: 1166663 - RNA, 21 nt, Human
acagcaaggagauuuacaacu

SEQ ID NO: 1166664 - RNA, 17 nt, Human
acagcccgggcucugcc

SEQ ID NO: 1166665 - RNA, 18 nt, Human
acagcccgggcucugccu

SEQ ID NO: 1166666 - RNA, 19 nt, Human
acagcccgggcucugccuc

SEQ ID NO: 1166667 - RNA, 20 nt, Human
acagcccgggcucugccucc

SEQ ID NO: 1166668 - RNA, 16 nt, Human
acagccucuuagaugc

SEQ ID NO: 1166669 - RNA, 23 nt, Human
uauggcuuuugugcauuaucuag

SEQ ID NO: 1166670 - RNA, 15 nt, Human
uaugcuuauacacuu

SEQ ID NO: 1166671 - RNA, 22 nt, Human
uaugcuuauacacuuacacuuu

SEQ ID NO: 1166672 - RNA, 17 nt, Human
uauggcuuuugugcauu

SEQ ID NO: 1166673 - RNA, 18 nt, Human
uauggcuuuugugcauua

SEQ ID NO: 1166674 - RNA, 21 nt, Human
uauggcuuuugugcauuaucu

SEQ ID NO: 1166675 - RNA, 16 nt, Human
uaugauuaaguaauga

SEQ ID NO: 1166676 - RNA, 20 nt, Human
uaugauuaaguaaugauaac

SEQ ID NO: 1166677 - RNA, 21 nt, Human
uaugauuaaguaaugauaacu

SEQ ID NO: 1166678 - RNA, 11 nt, Human
uaugcauuuga

SEQ ID NO: 1166679 - RNA, 23 nt, Human
uaugcauuugaaaauuuugaugu

SEQ ID NO: 1166680 - RNA, 24 nt, Human
uaugcauuugaaaauuuugauguu

SEQ ID NO: 1166681 - RNA, 19 nt, Human
uaugccccauucaacaucu

SEQ ID NO: 1166682 - RNA, 17 nt, Human
uaugccugggcagaagg

SEQ ID NO: 1166683 - RNA, 15 nt, Human
uauauuguuugcuaa

SEQ ID NO: 1166684 - RNA, 13 nt, Human
acagacccugccc

SEQ ID NO: 1166685 - RNA, 14 nt, Human
acagacccugcccu

SEQ ID NO: 1166686 - RNA, 15 nt, Human
acagacccugcccug

SEQ ID NO: 1166687 - RNA, 16 nt, Human
acagacccugcccugu

SEQ ID NO: 1166688 - RNA, 17 nt, Human
acagaaaauauacugua

SEQ ID NO: 1166689 - RNA, 18 nt, Human
acagaaaauauacuguaa

SEQ ID NO: 1166690 - RNA, 19 nt, Human
acagaaaauauacuguaaa

SEQ ID NO: 1166691 - RNA, 20 nt, Human
acagaaaauauacuguaaag

SEQ ID NO: 1166692 - RNA, 21 nt, Human
acagaaaauauacuguaaaga

SEQ ID NO: 1166693 - RNA, 20 nt, Human
acagaaaauggaagacagcu

SEQ ID NO: 1166694 - RNA, 17 nt, Human
acagaaaauucuucucc

SEQ ID NO: 1166695 - RNA, 18 nt, Human
acagaaaauucuucucca

SEQ ID NO: 1166696 - RNA, 14 nt, Human
acagaaauguacag

SEQ ID NO: 1166697 - RNA, 16 nt, Human
acagaaauguacagca

SEQ ID NO: 1166698 - RNA, 17 nt, Human
acagaaauguacagcaa

SEQ ID NO: 1166699 - RNA, 18 nt, Human
uaucaaguauuauaccuu

SEQ ID NO: 1166700 - RNA, 13 nt, Human
uaucucccccagc

SEQ ID NO: 1166701 - RNA, 14 nt, Human
uaucucccccagcc

SEQ ID NO: 1166702 - RNA, 16 nt, Human
uaucucccccagcccc

SEQ ID NO: 1166703 - RNA, 11 nt, Human
acagagaaagu

SEQ ID NO: 1166704 - RNA, 18 nt, Human
acagagaaaguacuucuc

SEQ ID NO: 1166705 - RNA, 13 nt, Human
acagcuaacaugg

SEQ ID NO: 1166706 - RNA, 14 nt, Human
acagcuaacaugga

SEQ ID NO: 1166707 - RNA, 15 nt, Human
acaggaaaagcugcu

SEQ ID NO: 1166708 - RNA, 16 nt, Human
acaggaaaagcugcug

SEQ ID NO: 1166709 - RNA, 17 nt, Human
acaggaaaagcugcuga

SEQ ID NO: 1166710 - RNA, 18 nt, Human
acaggaaaagcugcugac

SEQ ID NO: 1166711 - RNA, 13 nt, Human
acaggaaguacug

SEQ ID NO: 1166712 - RNA, 17 nt, Human
acaggaaguagaggagg

SEQ ID NO: 1166713 - RNA, 23 nt, Human
acaggaccagggauuuccaugau

SEQ ID NO: 1166714 - RNA, 16 nt, Human
acaggagugagcacua

SEQ ID NO: 1166715 - RNA, 14 nt, Human
acaggaucagucug

SEQ ID NO: 1166716 - RNA, 15 nt, Human
acaggaucagucuga

SEQ ID NO: 1166717 - RNA, 14 nt, Human
acaggcagguccag

SEQ ID NO: 1166718 - RNA, 16 nt, Human
acaggcagguccaggg

SEQ ID NO: 1166719 - RNA, 14 nt, Human
acaggcauguucuc

SEQ ID NO: 1166720 - RNA, 15 nt, Human
acaggcauguucucu

SEQ ID NO: 1166721 - RNA, 18 nt, Human
acaggcauguucucugag

SEQ ID NO: 1166722 - RNA, 19 nt, Human
acaggcauguucucugagg

SEQ ID NO: 1166723 - RNA, 20 nt, Human
acaggcauguucucugagga

SEQ ID NO: 1166724 - RNA, 22 nt, Human
acaggcauguucucugaggaca

SEQ ID NO: 1166725 - RNA, 20 nt, Human
uauguggaguucaucuugaa

SEQ ID NO: 1166726 - RNA, 15 nt, Human
uauuagaauaccaca

SEQ ID NO: 1166727 - RNA, 14 nt, Human
uauuacuguaagaa

SEQ ID NO: 1166728 - RNA, 13 nt, Human
uauuacuucugcu

SEQ ID NO: 1166729 - RNA, 14 nt, Human
uauuacuucugcua

SEQ ID NO: 1166730 - RNA, 14 nt, Human
uauucaggaagcuc

SEQ ID NO: 1166731 - RNA, 16 nt, Human
uauucaggaagcucag

SEQ ID NO: 1166732 - RNA, 20 nt, Human
uauucaguaauaacucuacc

SEQ ID NO: 1166733 - RNA, 23 nt, Human
acaggcugggcuucaguggcagc

SEQ ID NO: 1166734 - RNA, 12 nt, Human
acaggcugggcu

SEQ ID NO: 1166735 - RNA, 22 nt, Human
acaggcugggcuucaguggcag

SEQ ID NO: 1166736 - RNA, 20 nt, Human
acagggaggacgcucucugg

SEQ ID NO: 1166737 - RNA, 21 nt, Human
acagggaggacgcucucuggc

SEQ ID NO: 1166738 - RNA, 12 nt, Human
acagggcacacc

SEQ ID NO: 1166739 - RNA, 20 nt, Human
acagggcacaccgggcacuc

SEQ ID NO: 1166740 - RNA, 16 nt, Human
acagucaccucaugga

SEQ ID NO: 1166741 - RNA, 17 nt, Human
acagucaccucauggaa

SEQ ID NO: 1166742 - RNA, 18 nt, Human
acagucaccucauggaau

SEQ ID NO: 1166743 - RNA, 14 nt, Human
ucaaccagcagaug

SEQ ID NO: 1166744 - RNA, 20 nt, Human
ucaacugcaucaagauguga

SEQ ID NO: 1166745 - RNA, 14 nt, Human
ucaaauuucuaaau

SEQ ID NO: 1166746 - RNA, 13 nt, Human
ucaaauuucuaaa

SEQ ID NO: 1166747 - RNA, 14 nt, Human
acauuccugaugcu

SEQ ID NO: 1166748 - RNA, 18 nt, Human
ucaaauugugugaaaggu

SEQ ID NO: 1166749 - RNA, 23 nt, Human
acauguaauuaaguacuauguau

SEQ ID NO: 1166750 - RNA, 15 nt, Human
acauguccaagaagc

SEQ ID NO: 1166751 - RNA, 19 nt, Human
acauguccaagaagcccag

SEQ ID NO: 1166752 - RNA, 12 nt, Human
acagucccugcc

SEQ ID NO: 1166753 - RNA, 20 nt, Human
acaugagguacugagaguga

SEQ ID NO: 1166754 - RNA, 23 nt, Human
acaugagguacugagagugaaca

SEQ ID NO: 1166755 - RNA, 15 nt, Human
acaugcuacacacug

SEQ ID NO: 1166756 - RNA, 21 nt, Human
acaugcuacacacugcauguu

SEQ ID NO: 1166757 - RNA, 22 nt, Human
acaugcuacacacugcauguuu

SEQ ID NO: 1166758 - RNA, 14 nt, Human
acauggaaguacua

SEQ ID NO: 1166759 - RNA, 11 nt, Human
acaugggacau

SEQ ID NO: 1166760 - RNA, 14 nt, Human
acaugggacauuug

SEQ ID NO: 1166761 - RNA, 15 nt, Human
acaugggacauuugc

SEQ ID NO: 1166762 - RNA, 20 nt, Human
acaugggacauuugcucaug

SEQ ID NO: 1166763 - RNA, 21 nt, Human
acaugggacauuugcucaugg

SEQ ID NO: 1166764 - RNA, 15 nt, Human
acauguaauuaagua

SEQ ID NO: 1166765 - RNA, 17 nt, Human
acauguaauuaaguacu

SEQ ID NO: 1166766 - RNA, 19 nt, Human
acauguaauuaaguacuau

SEQ ID NO: 1166767 - RNA, 21 nt, Human
acauguaauuaaguacuaugu

SEQ ID NO: 1166768 - RNA, 22 nt, Human
acauguaauuaaguacuaugua

SEQ ID NO: 1166769 - RNA, 23 nt, Human
ucaaugaaugaaugaauggcuaa

SEQ ID NO: 1166770 - RNA, 15 nt, Human
ucaauauuucagaua

SEQ ID NO: 1166771 - RNA, 19 nt, Human
ucaauauuucagauaauca

SEQ ID NO: 1166772 - RNA, 23 nt, Human
ucaauauuucagauaaucacaau

SEQ ID NO: 1166773 - RNA, 22 nt, Human
ucaauaucuuuuuuuuaauaaa

SEQ ID NO: 1166774 - RNA, 18 nt, Human
acauuuuauuuuauuaug

SEQ ID NO: 1166775 - RNA, 19 nt, Human
acauuuuauuuuauuaugc

SEQ ID NO: 1166776 - RNA, 20 nt, Human
acauuuuauuuuauuaugca

SEQ ID NO: 1166777 - RNA, 21 nt, Human
acauuuuuaagugcugcauuu

SEQ ID NO: 1166778 - RNA, 22 nt, Human
acauuuuuaagugcugcauuua

SEQ ID NO: 1166779 - RNA, 23 nt, Human
acauuuuuaagugcugcauuuaa

SEQ ID NO: 1166780 - RNA, 14 nt, Human
acauuuuuuaaaug

SEQ ID NO: 1166781 - RNA, 16 nt, Human
acauuuuuuaaaugca

SEQ ID NO: 1166782 - RNA, 17 nt, Human
acauuuuuuaaaugcac

SEQ ID NO: 1166783 - RNA, 21 nt, Human
acauuuuuuaaaugcaccugg

SEQ ID NO: 1166784 - RNA, 20 nt, Human
ucacagaugggugcuuggag

SEQ ID NO: 1166785 - RNA, 13 nt, Human
ucacagccucuga

SEQ ID NO: 1166786 - RNA, 20 nt, Human
ucacaguucucuccuucuuc

SEQ ID NO: 1166787 - RNA, 17 nt, Human
ucacaaaggaugcccaa

SEQ ID NO: 1166788 - RNA, 16 nt, Human
ucaauucuugccaaau

SEQ ID NO: 1166789 - RNA, 17 nt, Human
accacaucuugcucugc

SEQ ID NO: 1166790 - RNA, 18 nt, Human
accacaucuugcucugcu

SEQ ID NO: 1166791 - RNA, 19 nt, Human
accacaucuugcucugcug

SEQ ID NO: 1166792 - RNA, 18 nt, Human
accacaugugcacaugca

SEQ ID NO: 1166793 - RNA, 15 nt, Human
accaccacacccagc

SEQ ID NO: 1166794 - RNA, 20 nt, Human
accaccacacccagcccacu

SEQ ID NO: 1166795 - RNA, 12 nt, Human
ucaccucaugga

SEQ ID NO: 1166796 - RNA, 13 nt, Human
ucaccucauggaa

SEQ ID NO: 1166797 - RNA, 14 nt, Human
ucaccucauggaau

SEQ ID NO: 1166798 - RNA, 16 nt, Human
accacuacauucuguu

SEQ ID NO: 1166799 - RNA, 17 nt, Human
accacuacauucuguua

SEQ ID NO: 1166800 - RNA, 22 nt, Human
accagcgugugacuacuccccc

SEQ ID NO: 1166801 - RNA, 17 nt, Human
ucacuauguugcccagg

SEQ ID NO: 1166802 - RNA, 17 nt, Human
ucacugagacagcccgg

SEQ ID NO: 1166803 - RNA, 21 nt, Human
ucacugagacagcccgggcuc

SEQ ID NO: 1166804 - RNA, 22 nt, Human
ucacugagacagcccgggcucu

SEQ ID NO: 1166805 - RNA, 14 nt, Human
ucacugcagccuca

SEQ ID NO: 1166806 - RNA, 15 nt, Human
ucacugcagccucaa

SEQ ID NO: 1166807 - RNA, 23 nt, Human
ucacuguugcccaggcuggcgug

SEQ ID NO: 1166808 - RNA, 23 nt, Human
ucacuugaacccgggaggcagag

SEQ ID NO: 1166809 - RNA, 10 nt, Human
ucacuugagu

SEQ ID NO: 1166810 - RNA, 14 nt, Human
accagucugacugu

SEQ ID NO: 1166811 - RNA, 15 nt, Human
accaguguuguggau

SEQ ID NO: 1166812 - RNA, 17 nt, Human
accaguguuguggauuu

SEQ ID NO: 1166813 - RNA, 23 nt, Human
acccaggagccccgaggccuucu

SEQ ID NO: 1166814 - RNA, 13 nt, Human
accccagccccaa

SEQ ID NO: 1166815 - RNA, 22 nt, Human
accccagccccaaaacucuccu

SEQ ID NO: 1166816 - RNA, 21 nt, Human
ucagauuugaacucuucaauc

SEQ ID NO: 1166817 - RNA, 12 nt, Human
ucagauuugaac

SEQ ID NO: 1166818 - RNA, 18 nt, Human
accaguguuguggauuua

SEQ ID NO: 1166819 - RNA, 15 nt, Human
ucagcaaaagaugcu

SEQ ID NO: 1166820 - RNA, 18 nt, Human
accccaucucuacaaaaa

SEQ ID NO: 1166821 - RNA, 19 nt, Human
ucagcggggacagcuccuu

SEQ ID NO: 1166822 - RNA, 20 nt, Human
ucagcggggacagcuccuuc

SEQ ID NO: 1166823 - RNA, 21 nt, Human
ucagcggggacagcuccuucu

SEQ ID NO: 1166824 - RNA, 23 nt, Human
ucagcggggacagcuccuucugu

SEQ ID NO: 1166825 - RNA, 12 nt, Human
ucagcuccagcu

SEQ ID NO: 1166826 - RNA, 16 nt, Human
acccugaaagcccuga

SEQ ID NO: 1166827 - RNA, 18 nt, Human
acccugaaagcccugagc

SEQ ID NO: 1166828 - RNA, 14 nt, Human
acccugaggcccag

SEQ ID NO: 1166829 - RNA, 15 nt, Human
acccugaggcccaga

SEQ ID NO: 1166830 - RNA, 16 nt, Human
acccugaggcccagag

SEQ ID NO: 1166831 - RNA, 17 nt, Human
acccugaggcccagagg

SEQ ID NO: 1166832 - RNA, 15 nt, Human
acccugcccuguggg

SEQ ID NO: 1166833 - RNA, 17 nt, Human
acccugcccugugggcc

SEQ ID NO: 1166834 - RNA, 22 nt, Human
acccugcccugugggcccccaa

SEQ ID NO: 1166835 - RNA, 17 nt, Human
acccuugccgucuaccu

SEQ ID NO: 1166836 - RNA, 23 nt, Human
acccuuguggucccaccccacac

SEQ ID NO: 1166837 - RNA, 15 nt, Human
accgaaaacguggcu

SEQ ID NO: 1166838 - RNA, 14 nt, Human
acccggccccugcu

SEQ ID NO: 1166839 - RNA, 15 nt, Human
acccggccccugcug

SEQ ID NO: 1166840 - RNA, 16 nt, Human
acccggccccugcugg

SEQ ID NO: 1166841 - RNA, 21 nt, Human
ucagguaacaggcagauacag

SEQ ID NO: 1166842 - RNA, 22 nt, Human
ucagguaacaggcagauacagg

SEQ ID NO: 1166843 - RNA, 23 nt, Human
ucagguaacaggcagauacagga

SEQ ID NO: 1166844 - RNA, 17 nt, Human
ucaggguuggccccugc

SEQ ID NO: 1166845 - RNA, 17 nt, Human
acccggccccugcuggu

SEQ ID NO: 1166846 - RNA, 20 nt, Human
acccggccccugcugguuca

SEQ ID NO: 1166847 - RNA, 22 nt, Human
acccggccccugcugguucagg

SEQ ID NO: 1166848 - RNA, 12 nt, Human
acccgggaaggg

SEQ ID NO: 1166849 - RNA, 13 nt, Human
acccgggaagggg

SEQ ID NO: 1166850 - RNA, 17 nt, Human
acccgggaggcagaggu

SEQ ID NO: 1166851 - RNA, 14 nt, Human
ucagcuccagcuca

SEQ ID NO: 1166852 - RNA, 15 nt, Human
ucagcuccagcucac

SEQ ID NO: 1166853 - RNA, 21 nt, Human
ucagcuuguaaauagcucagg

SEQ ID NO: 1166854 - RNA, 22 nt, Human
ucagcuuguaaauagcucaggu

SEQ ID NO: 1166855 - RNA, 21 nt, Human
ucaggccaggcccucugccca

SEQ ID NO: 1166856 - RNA, 22 nt, Human
ucaggccaggcccucugcccac

SEQ ID NO: 1166857 - RNA, 23 nt, Human
ucaggccaggcccucugcccacu

SEQ ID NO: 1166858 - RNA, 19 nt, Human
ucagggucccugguggcag

SEQ ID NO: 1166859 - RNA, 16 nt, Human
ucaggguuggccccug

SEQ ID NO: 1166860 - RNA, 9 nt, Human
ucagugccu

SEQ ID NO: 1166861 - RNA, 10 nt, Human
ucagugccuu

SEQ ID NO: 1166862 - RNA, 11 nt, Human
ucagugccuua

SEQ ID NO: 1166863 - RNA, 12 nt, Human
ucagugccuuau

SEQ ID NO: 1166864 - RNA, 14 nt, Human
ucagugccuuaugg

SEQ ID NO: 1166865 - RNA, 15 nt, Human
ucagugccuuaugga

SEQ ID NO: 1166866 - RNA, 17 nt, Human
accgaaaacguggcugc

SEQ ID NO: 1166867 - RNA, 19 nt, Human
accgaaaacguggcugcuu

SEQ ID NO: 1166868 - RNA, 20 nt, Human
accgaaaacguggcugcuuc

SEQ ID NO: 1166869 - RNA, 12 nt, Human
ucagugccacua

SEQ ID NO: 1166870 - RNA, 12 nt, Human
ucaguggcagcu

SEQ ID NO: 1166871 - RNA, 13 nt, Human
ucaguggcagcug

SEQ ID NO: 1166872 - RNA, 16 nt, Human
ucagugccuuauggaa

SEQ ID NO: 1166873 - RNA, 18 nt, Human
ucagugccuuauggaaca

SEQ ID NO: 1166874 - RNA, 11 nt, Human
ucaguggcagc

SEQ ID NO: 1166875 - RNA, 15 nt, Human
ucaguuuuugugaaa

SEQ ID NO: 1166876 - RNA, 17 nt, Human
ucaguuuuugugaaaag

SEQ ID NO: 1166877 - RNA, 16 nt, Human
ucauauuuacuucuua

SEQ ID NO: 1166878 - RNA, 15 nt, Human
ucauauuuacuucuu

SEQ ID NO: 1166879 - RNA, 23 nt, Human
ucauauuuacuucuuauacauuu

SEQ ID NO: 1166880 - RNA, 18 nt, Human
ucauauaagauucauauu

SEQ ID NO: 1166881 - RNA, 21 nt, Human
ucauaguaugguggcuggguu

SEQ ID NO: 1166882 - RNA, 14 nt, Human
ucauaaccuagccu

SEQ ID NO: 1166883 - RNA, 15 nt, Human
ucauaguaugguggc

SEQ ID NO: 1166884 - RNA, 18 nt, Human
ucauaguaugguggcugg

SEQ ID NO: 1166885 - RNA, 19 nt, Human
ucauaguaugguggcuggg

SEQ ID NO: 1166886 - RNA, 12 nt, Human
accuccugccuc

SEQ ID NO: 1166887 - RNA, 12 nt, Human
accgcagacagg

SEQ ID NO: 1166888 - RNA, 16 nt, Human
accgcagacaggacca

SEQ ID NO: 1166889 - RNA, 17 nt, Human
accgcagacaggaccag

SEQ ID NO: 1166890 - RNA, 16 nt, Human
accuagggugauauua

SEQ ID NO: 1166891 - RNA, 20 nt, Human
accucccacaaaggagagcu

SEQ ID NO: 1166892 - RNA, 21 nt, Human
uccacugugccaugugccagg

SEQ ID NO: 1166893 - RNA, 22 nt, Human
uccacugguucuucuuggucuc

SEQ ID NO: 1166894 - RNA, 13 nt, Human
accuuuuuuauac

SEQ ID NO: 1166895 - RNA, 14 nt, Human
accuuuuuuauaca

SEQ ID NO: 1166896 - RNA, 19 nt, Human
accuugaaaacuuuaugcu

SEQ ID NO: 1166897 - RNA, 20 nt, Human
accuugaacuggguacuugu

SEQ ID NO: 1166898 - RNA, 15 nt, Human
accuugaaugaugcc

SEQ ID NO: 1166899 - RNA, 18 nt, Human
accuuuguccccaccgca

SEQ ID NO: 1166900 - RNA, 14 nt, Human
uccagaauuuccca

SEQ ID NO: 1166901 - RNA, 15 nt, Human
uccagaauuucccaa

SEQ ID NO: 1166902 - RNA, 16 nt, Human
uccagaauuucccaaa

SEQ ID NO: 1166903 - RNA, 11 nt, Human
uccagccuggg

SEQ ID NO: 1166904 - RNA, 10 nt, Human
uccaggcucc

SEQ ID NO: 1166905 - RNA, 12 nt, Human
uccaggcuccuu

SEQ ID NO: 1166906 - RNA, 22 nt, Human
uccaggcuccuuuagcgcccag

SEQ ID NO: 1166907 - RNA, 20 nt, Human
uccaggcugggagagccuuc

SEQ ID NO: 1166908 - RNA, 21 nt, Human
uccaggcugggagagccuucc

SEQ ID NO: 1166909 - RNA, 23 nt, Human
uccaggcugggagagccuuccag

SEQ ID NO: 1166910 - RNA, 14 nt, Human
uccaggcuguaucc

SEQ ID NO: 1166911 - RNA, 15 nt, Human
acgaauauugcugau

SEQ ID NO: 1166912 - RNA, 18 nt, Human
acgaauauugcugauggu

SEQ ID NO: 1166913 - RNA, 11 nt, Human
acgcucucugg

SEQ ID NO: 1166914 - RNA, 14 nt, Human
acgcucucuggccu

SEQ ID NO: 1166915 - RNA, 13 nt, Human
acgcuggaccuug

SEQ ID NO: 1166916 - RNA, 20 nt, Human
acgcuggaccuugaacuggg

SEQ ID NO: 1166917 - RNA, 23 nt, Human
acgcuggaccuugaacuggguac

SEQ ID NO: 1166918 - RNA, 15 nt, Human
acgcuggagugcagu

SEQ ID NO: 1166919 - RNA, 16 nt, Human
acgcuggagugcagug

SEQ ID NO: 1166920 - RNA, 17 nt, Human
acgcuggagugcaguga

SEQ ID NO: 1166921 - RNA, 18 nt, Human
acgcuggagugcagugag

SEQ ID NO: 1166922 - RNA, 23 nt, Human
acggagucccaccuuggcugcag

SEQ ID NO: 1166923 - RNA, 21 nt, Human
acgaauauugcugauggugca

SEQ ID NO: 1166924 - RNA, 21 nt, Human
acgcuacccgggaagggggcu

SEQ ID NO: 1166925 - RNA, 20 nt, Human
acgcgugcacacaccagagc

SEQ ID NO: 1166926 - RNA, 12 nt, Human
acggccaggcca

SEQ ID NO: 1166927 - RNA, 13 nt, Human
acggccaggccag

SEQ ID NO: 1166928 - RNA, 16 nt, Human
acggcucacugcagcc

SEQ ID NO: 1166929 - RNA, 17 nt, Human
acggcucacugcagccu

SEQ ID NO: 1166930 - RNA, 18 nt, Human
acggcucacugcagccuc

SEQ ID NO: 1166931 - RNA, 18 nt, Human
acggcuuuuacuuaaacc

SEQ ID NO: 1166932 - RNA, 14 nt, Human
uccaguaucuugaa

SEQ ID NO: 1166933 - RNA, 15 nt, Human
uccaguaucuugaag

SEQ ID NO: 1166934 - RNA, 16 nt, Human
uccaguaucuugaaga

SEQ ID NO: 1166935 - RNA, 18 nt, Human
uccaguaucuugaagacu

SEQ ID NO: 1166936 - RNA, 18 nt, Human
uccagugagacagcucug

SEQ ID NO: 1166937 - RNA, 15 nt, Human
uccagugaggcucug

SEQ ID NO: 1166938 - RNA, 16 nt, Human
uccagugaggcucugc

SEQ ID NO: 1166939 - RNA, 17 nt, Human
uccagugaggcucugcc

SEQ ID NO: 1166940 - RNA, 22 nt, Human
uccagugaggcucugcccuugg

SEQ ID NO: 1166941 - RNA, 23 nt, Human
uccagugaggcucugcccuuggu

SEQ ID NO: 1166942 - RNA, 13 nt, Human
acguugugcauuu

SEQ ID NO: 1166943 - RNA, 14 nt, Human
acguugugcauuug

SEQ ID NO: 1166944 - RNA, 15 nt, Human
acguugugcauuugg

SEQ ID NO: 1166945 - RNA, 16 nt, Human
acguuucuaaaggcua

SEQ ID NO: 1166946 - RNA, 18 nt, Human
acguggcugcuucaagga

SEQ ID NO: 1166947 - RNA, 19 nt, Human
acguggcugcuucaaggau

SEQ ID NO: 1166948 - RNA, 21 nt, Human
acguggcugcuucaaggaucc

SEQ ID NO: 1166949 - RNA, 23 nt, Human
acguggcugcuucaaggauccug

SEQ ID NO: 1166950 - RNA, 12 nt, Human
uccauccugagg

SEQ ID NO: 1166951 - RNA, 15 nt, Human
uccauccugaggcuc

SEQ ID NO: 1166952 - RNA, 19 nt, Human
uccauccugaggcuccacu

SEQ ID NO: 1166953 - RNA, 15 nt, Human
acuaauuuuaaaaug

SEQ ID NO: 1166954 - RNA, 22 nt, Human
acguuucuaaaggcuaccuuug

SEQ ID NO: 1166955 - RNA, 16 nt, Human
ucccagauacuugggg

SEQ ID NO: 1166956 - RNA, 18 nt, Human
ucccagauacuugggggg

SEQ ID NO: 1166957 - RNA, 13 nt, Human
ucccccagcccca

SEQ ID NO: 1166958 - RNA, 15 nt, Human
ucccccagccccauc

SEQ ID NO: 1166959 - RNA, 16 nt, Human
ucccccagccccaucc

SEQ ID NO: 1166960 - RNA, 17 nt, Human
ucccccagccccauccu

SEQ ID NO: 1166961 - RNA, 20 nt, Human
uccccaggaggccagccuug

SEQ ID NO: 1166962 - RNA, 21 nt, Human
uccccaggaggccagccuuga

SEQ ID NO: 1166963 - RNA, 23 nt, Human
uccccaggaggccagccuugacc

SEQ ID NO: 1166964 - RNA, 23 nt, Human
uccccacccugaaagcccugagc

SEQ ID NO: 1166965 - RNA, 15 nt, Human
uccccaccgcagaca

SEQ ID NO: 1166966 - RNA, 16 nt, Human
uccccaccgcagacag

SEQ ID NO: 1166967 - RNA, 18 nt, Human
uccccaggaggccagccu

SEQ ID NO: 1166968 - RNA, 20 nt, Human
acuauagccuaggugacaga

SEQ ID NO: 1166969 - RNA, 22 nt, Human
acuauagccuaggugacagagu

SEQ ID NO: 1166970 - RNA, 22 nt, Human
acuauauuguuugcuaagcauu

SEQ ID NO: 1166971 - RNA, 21 nt, Human
acuaucuaaauguugaaagau

SEQ ID NO: 1166972 - RNA, 15 nt, Human
acuaucucauuucca

SEQ ID NO: 1166973 - RNA, 16 nt, Human
acuaucucauuuccaa

SEQ ID NO: 1166974 - RNA, 17 nt, Human
acuaucucauuuccaag

SEQ ID NO: 1166975 - RNA, 22 nt, Human
acuauggcccuggccuagcaua

SEQ ID NO: 1166976 - RNA, 15 nt, Human
acuauguugcccagg

SEQ ID NO: 1166977 - RNA, 16 nt, Human
acuauguugcccaggc

SEQ ID NO: 1166978 - RNA, 17 nt, Human
acuauguugcccaggca

SEQ ID NO: 1166979 - RNA, 16 nt, Human
acucaaugcacugaca

SEQ ID NO: 1166980 - RNA, 16 nt, Human
acucaccccagcccca

SEQ ID NO: 1166981 - RNA, 14 nt, Human
acucaccccagccc

SEQ ID NO: 1166982 - RNA, 15 nt, Human
acucaccccagcccc

SEQ ID NO: 1166983 - RNA, 13 nt, Human
acucaccccagcc

SEQ ID NO: 1166984 - RNA, 14 nt, Human
acuccugcaggcag

SEQ ID NO: 1166985 - RNA, 15 nt, Human
acuccugcaggcagc

SEQ ID NO: 1166986 - RNA, 16 nt, Human
acuccugcaggcagcc

SEQ ID NO: 1166987 - RNA, 22 nt, Human
acuccugcaggcagccaggcca

SEQ ID NO: 1166988 - RNA, 17 nt, Human
acuccugcaggcagcca

SEQ ID NO: 1166989 - RNA, 11 nt, Human
acuccuggccu

SEQ ID NO: 1166990 - RNA, 17 nt, Human
ucccugguggcagcuca

SEQ ID NO: 1166991 - RNA, 18 nt, Human
ucccugguggcagcucac

SEQ ID NO: 1166992 - RNA, 19 nt, Human
ucccugguggcagcucacc

SEQ ID NO: 1166993 - RNA, 20 nt, Human
ucccugguggcagcucaccu

SEQ ID NO: 1166994 - RNA, 21 nt, Human
ucccugguggcagcucaccuc

SEQ ID NO: 1166995 - RNA, 13 nt, Human
uccuacucugugu

SEQ ID NO: 1166996 - RNA, 14 nt, Human
uccuacucuguguc

SEQ ID NO: 1166997 - RNA, 15 nt, Human
uccuacucuguguca

SEQ ID NO: 1166998 - RNA, 13 nt, Human
uccuaggcauuug

SEQ ID NO: 1166999 - RNA, 14 nt, Human
uccuaggcauuugc

SEQ ID NO: 1167000 - RNA, 13 nt, Human
acuccuggccuca

SEQ ID NO: 1167001 - RNA, 14 nt, Human
acuccuggccucaa

SEQ ID NO: 1167002 - RNA, 22 nt, Human
ucccugguggcagcucaccucu

SEQ ID NO: 1167003 - RNA, 23 nt, Human
ucccugguggcagcucaccucuc

SEQ ID NO: 1167004 - RNA, 19 nt, Human
ucccuuggauuguccccga

SEQ ID NO: 1167005 - RNA, 20 nt, Human
ucccuuggauuguccccgac

SEQ ID NO: 1167006 - RNA, 12 nt, Human
acuccuggccuc

SEQ ID NO: 1167007 - RNA, 16 nt, Human
ucccuuugacgccauc

SEQ ID NO: 1167008 - RNA, 18 nt, Human
ucccuuugacgccauccc

SEQ ID NO: 1167009 - RNA, 19 nt, Human
ucccuuugacgccauccca

SEQ ID NO: 1167010 - RNA, 21 nt, Human
ucccuuugacgccaucccagc

SEQ ID NO: 1167011 - RNA, 19 nt, Human
ucccuuuuuuggcugcuga

SEQ ID NO: 1167012 - RNA, 20 nt, Human
ucccuuuuuuggcugcugaa

SEQ ID NO: 1167013 - RNA, 22 nt, Human
ucccuuuuuuggcugcugaagg

SEQ ID NO: 1167014 - RNA, 23 nt, Human
ucccuuuuuuggcugcugaaggc

SEQ ID NO: 1167015 - RNA, 13 nt, Human
acucuggcagcuc

SEQ ID NO: 1167016 - RNA, 15 nt, Human
acucuggcagcucag

SEQ ID NO: 1167017 - RNA, 16 nt, Human
acucuccuuggugucg

SEQ ID NO: 1167018 - RNA, 23 nt, Human
acucuccuuggugucgggcauga

SEQ ID NO: 1167019 - RNA, 22 nt, Human
acucugagacucgcgacaaugc

SEQ ID NO: 1167020 - RNA, 23 nt, Human
acuccuugaaaacacuguucucu

SEQ ID NO: 1167021 - RNA, 24 nt, Human
acuccuugaaaacacuguucucug

SEQ ID NO: 1167022 - RNA, 14 nt, Human
acucuccuccagag

SEQ ID NO: 1167023 - RNA, 17 nt, Human
acucuccuccagaguca

SEQ ID NO: 1167024 - RNA, 12 nt, Human
acucuccucugc

SEQ ID NO: 1167025 - RNA, 13 nt, Human
acucuccucugcu

SEQ ID NO: 1167026 - RNA, 14 nt, Human
acucuccucugcug

SEQ ID NO: 1167027 - RNA, 16 nt, Human
acucuccucugcugcu

SEQ ID NO: 1167028 - RNA, 18 nt, Human
acucuccuggaaauauua

SEQ ID NO: 1167029 - RNA, 15 nt, Human
acucuccuugguguc

SEQ ID NO: 1167030 - RNA, 22 nt, Human
uccucauaguaugguggcuggg

SEQ ID NO: 1167031 - RNA, 23 nt, Human
uccucauacccacccccacccaa

SEQ ID NO: 1167032 - RNA, 21 nt, Human
acucuuaagaagacugcauua

SEQ ID NO: 1167033 - RNA, 16 nt, Human
acucuggcagcucaga

SEQ ID NO: 1167034 - RNA, 14 nt, Human
acucuugaccucag

SEQ ID NO: 1167035 - RNA, 15 nt, Human
acucuugaccucagg

SEQ ID NO: 1167036 - RNA, 16 nt, Human
acucuugaccucaggu

SEQ ID NO: 1167037 - RNA, 22 nt, Human
uccucuuuggucuacacugugc

SEQ ID NO: 1167038 - RNA, 23 nt, Human
uccucuuuggucuacacugugcu

SEQ ID NO: 1167039 - RNA, 11 nt, Human
uccucccuccc

SEQ ID NO: 1167040 - RNA, 14 nt, Human
uccucccucccucu

SEQ ID NO: 1167041 - RNA, 11 nt, Human
uccucuuucca

SEQ ID NO: 1167042 - RNA, 12 nt, Human
uccucuuuccau

SEQ ID NO: 1167043 - RNA, 19 nt, Human
uccucuuuccaucuacccu

SEQ ID NO: 1167044 - RNA, 15 nt, Human
uccucccucccucuu

SEQ ID NO: 1167045 - RNA, 19 nt, Human
uccucuuuggucuacacug

SEQ ID NO: 1167046 - RNA, 21 nt, Human
uccucuuuggucuacacugug

SEQ ID NO: 1167047 - RNA, 19 nt, Human
acucuuucuauuguuucuu

SEQ ID NO: 1167048 - RNA, 22 nt, Human
acugagacagcccgggcucugc

SEQ ID NO: 1167049 - RNA, 23 nt, Human
acugagacagcccgggcucugcc

SEQ ID NO: 1167050 - RNA, 18 nt, Human
acugagagugaacaaauu

SEQ ID NO: 1167051 - RNA, 15 nt, Human
acugagacagcccgg

SEQ ID NO: 1167052 - RNA, 18 nt, Human
acugagacagcccgggcu

SEQ ID NO: 1167053 - RNA, 21 nt, Human
acugagacagcccgggcucug

SEQ ID NO: 1167054 - RNA, 12 nt, Human
acugaagaagca

SEQ ID NO: 1167055 - RNA, 13 nt, Human
acugacucuuaag

SEQ ID NO: 1167056 - RNA, 14 nt, Human
acugacucuuaaga

SEQ ID NO: 1167057 - RNA, 15 nt, Human
acugacucuuaagaa

SEQ ID NO: 1167058 - RNA, 16 nt, Human
acugacucuuaagaag

SEQ ID NO: 1167059 - RNA, 17 nt, Human
acugacucuuaagaaga

SEQ ID NO: 1167060 - RNA, 18 nt, Human
acugacucuuaagaagac

SEQ ID NO: 1167061 - RNA, 20 nt, Human
acugacucuuaagaagacug

SEQ ID NO: 1167062 - RNA, 13 nt, Human
acugauaaagaug

SEQ ID NO: 1167063 - RNA, 21 nt, Human
acugauaaagaugagugagca

SEQ ID NO: 1167064 - RNA, 14 nt, Human
acugcaccgggcca

SEQ ID NO: 1167065 - RNA, 16 nt, Human
acugcaccgggccaca

SEQ ID NO: 1167066 - RNA, 20 nt, Human
acugcacuauagccuaggug

SEQ ID NO: 1167067 - RNA, 13 nt, Human
acugcacuguuuu

SEQ ID NO: 1167068 - RNA, 19 nt, Human
uccugaugcuucuucagag

SEQ ID NO: 1167069 - RNA, 20 nt, Human
uccugaugcuucuucagaga

SEQ ID NO: 1167070 - RNA, 21 nt, Human
uccugaugcuucuucagagac

SEQ ID NO: 1167071 - RNA, 21 nt, Human
acugcacuauagccuagguga

SEQ ID NO: 1167072 - RNA, 14 nt, Human
acugcacuccagcc

SEQ ID NO: 1167073 - RNA, 17 nt, Human
acugcacuccagccugg

SEQ ID NO: 1167074 - RNA, 18 nt, Human
acugcacuccagccuggg

SEQ ID NO: 1167075 - RNA, 19 nt, Human
acugcacuccagccugggu

SEQ ID NO: 1167076 - RNA, 20 nt, Human
acugcacuccagccugggug

SEQ ID NO: 1167077 - RNA, 12 nt, Human
uccugcaggcag

SEQ ID NO: 1167078 - RNA, 13 nt, Human
uccugcaggcagc

SEQ ID NO: 1167079 - RNA, 14 nt, Human
uccugcaggcagcc

SEQ ID NO: 1167080 - RNA, 15 nt, Human
uccugcaggcagcca

SEQ ID NO: 1167081 - RNA, 13 nt, Human
uccugcugggcag

SEQ ID NO: 1167082 - RNA, 15 nt, Human
uccuggaaauauuaa

SEQ ID NO: 1167083 - RNA, 16 nt, Human
uccuggaaaucagggu

SEQ ID NO: 1167084 - RNA, 12 nt, Human
uccugggaguga

SEQ ID NO: 1167085 - RNA, 14 nt, Human
uccugggagugagc

SEQ ID NO: 1167086 - RNA, 17 nt, Human
uccugggagugagcugg

SEQ ID NO: 1167087 - RNA, 19 nt, Human
ucuacccagcgagcccugg

SEQ ID NO: 1167088 - RNA, 21 nt, Human
ucuacagaggccaugggccuc

SEQ ID NO: 1167089 - RNA, 18 nt, Human
uccugggagugagcuggu

SEQ ID NO: 1167090 - RNA, 20 nt, Human
ucuacccagcgagcccuggu

SEQ ID NO: 1167091 - RNA, 14 nt, Human
ucuacccaggugcu

SEQ ID NO: 1167092 - RNA, 19 nt, Human
ucuacccuggcacuauaau

SEQ ID NO: 1167093 - RNA, 21 nt, Human
ucuacccuggcacuauaaugu

SEQ ID NO: 1167094 - RNA, 16 nt, Human
acuguucucugcccuc

SEQ ID NO: 1167095 - RNA, 17 nt, Human
acuguucucugcccucc

SEQ ID NO: 1167096 - RNA, 18 nt, Human
acuguucucugcccucca

SEQ ID NO: 1167097 - RNA, 19 nt, Human
acuguucucugcccuccaa

SEQ ID NO: 1167098 - RNA, 22 nt, Human
acuuacuguacaugaaaacaca

SEQ ID NO: 1167099 - RNA, 17 nt, Human
acuuacacuuuaugcac

SEQ ID NO: 1167100 - RNA, 21 nt, Human
acuuacuguacaugaaaacac

SEQ ID NO: 1167101 - RNA, 15 nt, Human
acuuagguguggggg

SEQ ID NO: 1167102 - RNA, 12 nt, Human
acuguugcccag

SEQ ID NO: 1167103 - RNA, 13 nt, Human
acuuaagcacacu

SEQ ID NO: 1167104 - RNA, 19 nt, Human
acuuaaucuaaauggaacc

SEQ ID NO: 1167105 - RNA, 22 nt, Human
acuuaaucuaaauggaaccacu

SEQ ID NO: 1167106 - RNA, 16 nt, Human
acuuacacuuuaugca

SEQ ID NO: 1167107 - RNA, 16 nt, Human
acuucaucccucuggg

SEQ ID NO: 1167108 - RNA, 13 nt, Human
ucuagauacugua

SEQ ID NO: 1167109 - RNA, 18 nt, Human
ucuagcauggcugccaau

SEQ ID NO: 1167110 - RNA, 13 nt, Human
ucuagccagagga

SEQ ID NO: 1167111 - RNA, 17 nt, Human
ucuaggaaauauuuauu

SEQ ID NO: 1167112 - RNA, 12 nt, Human
ucuaggaagacu

SEQ ID NO: 1167113 - RNA, 22 nt, Human
ucuaguuguuugauucagacag

SEQ ID NO: 1167114 - RNA, 23 nt, Human
ucuaguuguuugauucagacagc

SEQ ID NO: 1167115 - RNA, 21 nt, Human
ucuaguuugauuaaauucuug

SEQ ID NO: 1167116 - RNA, 22 nt, Human
ucuaguuugauuaaauucuugc

SEQ ID NO: 1167117 - RNA, 14 nt, Human
ucucaccuccugcu

SEQ ID NO: 1167118 - RNA, 15 nt, Human
ucucaccuccugcug

SEQ ID NO: 1167119 - RNA, 16 nt, Human
ucucaccuccugcugg

SEQ ID NO: 1167120 - RNA, 17 nt, Human
ucucaccuccugcuggg

SEQ ID NO: 1167121 - RNA, 19 nt, Human
ucucaccuccugcugggca

SEQ ID NO: 1167122 - RNA, 17 nt, Human
ucucacuauguugccca

SEQ ID NO: 1167123 - RNA, 19 nt, Human
ucucacuauguugcccagg

SEQ ID NO: 1167124 - RNA, 17 nt, Human
ucucaggccagcugcuu

SEQ ID NO: 1167125 - RNA, 18 nt, Human
ucucaggccagcugcuug

SEQ ID NO: 1167126 - RNA, 21 nt, Human
ucucaggccagcugcuugggc

SEQ ID NO: 1167127 - RNA, 14 nt, Human
ucucauuugucaca

SEQ ID NO: 1167128 - RNA, 15 nt, Human
ucucauuuccaagca

SEQ ID NO: 1167129 - RNA, 16 nt, Human
ucucauuugucacaca

SEQ ID NO: 1167130 - RNA, 13 nt, Human
ucuccaaaauaaa

SEQ ID NO: 1167131 - RNA, 16 nt, Human
ucuccaagcaggacau

SEQ ID NO: 1167132 - RNA, 10 nt, Human
ucucaggcca

SEQ ID NO: 1167133 - RNA, 12 nt, Human
ucucaggccaaa

SEQ ID NO: 1167134 - RNA, 12 nt, Human
ucucaggccagc

SEQ ID NO: 1167135 - RNA, 13 nt, Human
ucucaggccagcu

SEQ ID NO: 1167136 - RNA, 18 nt, Human
ucucaccuccugcugggc

SEQ ID NO: 1167137 - RNA, 20 nt, Human
ucucacuauguugcccaggc

SEQ ID NO: 1167138 - RNA, 21 nt, Human
ucucacuauguugcccaggca

SEQ ID NO: 1167139 - RNA, 22 nt, Human
ucucacuauguugcccaggcag

SEQ ID NO: 1167140 - RNA, 23 nt, Human
ucucacuauguugcccaggcagg

SEQ ID NO: 1167141 - RNA, 19 nt, Human
acuugcagacucuacagag

SEQ ID NO: 1167142 - RNA, 22 nt, Human
acuugcagacucuacagaggcc

SEQ ID NO: 1167143 - RNA, 23 nt, Human
acuugcagacucuacagaggcca

SEQ ID NO: 1167144 - RNA, 15 nt, Human
acuugucaauaaaau

SEQ ID NO: 1167145 - RNA, 16 nt, Human
acuugucaauaaaauc

SEQ ID NO: 1167146 - RNA, 20 nt, Human
acuugucuuuggacccugag

SEQ ID NO: 1167147 - RNA, 21 nt, Human
acuugucuuuggacccugagg

SEQ ID NO: 1167148 - RNA, 19 nt, Human
acuuguggacacagcucuu

SEQ ID NO: 1167149 - RNA, 22 nt, Human
acuuguggacacagcucuucuc

SEQ ID NO: 1167150 - RNA, 18 nt, Human
ucuccaagcaggacaugg

SEQ ID NO: 1167151 - RNA, 19 nt, Human
ucuccaagcaggacaugga

SEQ ID NO: 1167152 - RNA, 12 nt, Human
ucuccacccugc

SEQ ID NO: 1167153 - RNA, 23 nt, Human
ucuccccagcaagugagagcugg

SEQ ID NO: 1167154 - RNA, 17 nt, Human
ucuccgaccagacaccu

SEQ ID NO: 1167155 - RNA, 23 nt, Human
ucuccgaccagacaccuugacag

SEQ ID NO: 1167156 - RNA, 15 nt, Human
ucuccuccagaguca

SEQ ID NO: 1167157 - RNA, 16 nt, Human
ucuccucugcugcugg

SEQ ID NO: 1167158 - RNA, 17 nt, Human
ucuccucugcugcuggc

SEQ ID NO: 1167159 - RNA, 18 nt, Human
ucuccucugcugcuggcu

SEQ ID NO: 1167160 - RNA, 20 nt, Human
ucuccucugcugcuggcugg

SEQ ID NO: 1167161 - RNA, 12 nt, Human
acuuuaccuuuu

SEQ ID NO: 1167162 - RNA, 12 nt, Human
acuuugaccucu

SEQ ID NO: 1167163 - RNA, 13 nt, Human
acuuugaccucug

SEQ ID NO: 1167164 - RNA, 14 nt, Human
acuuugaccucugc

SEQ ID NO: 1167165 - RNA, 20 nt, Human
acuuuguuaguuucuccaag

SEQ ID NO: 1167166 - RNA, 21 nt, Human
acuuuguuaguuucuccaagc

SEQ ID NO: 1167167 - RNA, 14 nt, Human
acuuuguucuggcu

SEQ ID NO: 1167168 - RNA, 12 nt, Human
acuuuuguucuu

SEQ ID NO: 1167169 - RNA, 13 nt, Human
acuuuuguucuug

SEQ ID NO: 1167170 - RNA, 15 nt, Human
acuuuuguucuuggu

SEQ ID NO: 1167171 - RNA, 23 nt, Human
acuuuuguucuugguuuguaaau

SEQ ID NO: 1167172 - RNA, 22 nt, Human
acuuuuuauggcacuaguauuu

SEQ ID NO: 1167173 - RNA, 17 nt, Human
agaaaaaauauuuuccc

SEQ ID NO: 1167174 - RNA, 14 nt, Human
ucuccuucaccuuu

SEQ ID NO: 1167175 - RNA, 15 nt, Human
ucuccuucaccuuug

SEQ ID NO: 1167176 - RNA, 16 nt, Human
ucuccuucaccuuugu

SEQ ID NO: 1167177 - RNA, 19 nt, Human
agaaaaaauauuuucccua

SEQ ID NO: 1167178 - RNA, 18 nt, Human
ucuccuucaccuuugucc

SEQ ID NO: 1167179 - RNA, 13 nt, Human
ucuccuuguguua

SEQ ID NO: 1167180 - RNA, 21 nt, Human
ucuccuuguguuacuaaguuu

SEQ ID NO: 1167181 - RNA, 15 nt, Human
agaaaugccuuaccc

SEQ ID NO: 1167182 - RNA, 21 nt, Human
ucugaaggacauugcggacag

SEQ ID NO: 1167183 - RNA, 22 nt, Human
ucugaaggacauugcggacagc

SEQ ID NO: 1167184 - RNA, 13 nt, Human
ucugacacacagc

SEQ ID NO: 1167185 - RNA, 14 nt, Human
ucugacacacagcu

SEQ ID NO: 1167186 - RNA, 15 nt, Human
ucugacacacagcuc

SEQ ID NO: 1167187 - RNA, 16 nt, Human
ucugacacacagcucu

SEQ ID NO: 1167188 - RNA, 17 nt, Human
ucugaucauccacugug

SEQ ID NO: 1167189 - RNA, 21 nt, Human
ucugaucauccacugugccau

SEQ ID NO: 1167190 - RNA, 21 nt, Human
ucugacuguuuccaucaaggg

SEQ ID NO: 1167191 - RNA, 21 nt, Human
ucugagacucgcgacaaugca

SEQ ID NO: 1167192 - RNA, 22 nt, Human
ucugagacucgcgacaaugcaa

SEQ ID NO: 1167193 - RNA, 17 nt, Human
ucugcacuccccugcug

SEQ ID NO: 1167194 - RNA, 16 nt, Human
ucugcacuccccugcu

SEQ ID NO: 1167195 - RNA, 14 nt, Human
ucugcacuccccug

SEQ ID NO: 1167196 - RNA, 15 nt, Human
ucugcacuccccugc

SEQ ID NO: 1167197 - RNA, 18 nt, Human
ucugcagcaauaaagcag

SEQ ID NO: 1167198 - RNA, 17 nt, Human
ucugcagcaauaaagca

SEQ ID NO: 1167199 - RNA, 18 nt, Human
ucugcagauaaacaguag

SEQ ID NO: 1167200 - RNA, 14 nt, Human
agaaauguacagca

SEQ ID NO: 1167201 - RNA, 15 nt, Human
agaaauguacagcaa

SEQ ID NO: 1167202 - RNA, 16 nt, Human
agaaauguacagcaag

SEQ ID NO: 1167203 - RNA, 13 nt, Human
agaagaacugaaa

SEQ ID NO: 1167204 - RNA, 14 nt, Human
agaagaacugaaau

SEQ ID NO: 1167205 - RNA, 21 nt, Human
agaagaacugaaaucauacuu

SEQ ID NO: 1167206 - RNA, 18 nt, Human
agaagaugguaccaccag

SEQ ID NO: 1167207 - RNA, 18 nt, Human
agaagauuuugaaauuuu

SEQ ID NO: 1167208 - RNA, 19 nt, Human
agaagcaacccaaauguuc

SEQ ID NO: 1167209 - RNA, 12 nt, Human
agaagcccagga

SEQ ID NO: 1167210 - RNA, 16 nt, Human
agaagcccaggaaagg

SEQ ID NO: 1167211 - RNA, 18 nt, Human
agaagcccaggaaaggcu

SEQ ID NO: 1167212 - RNA, 20 nt, Human
agaagcccaggaaaggcucc

SEQ ID NO: 1167213 - RNA, 21 nt, Human
agaagcccaggaaaggcucca

SEQ ID NO: 1167214 - RNA, 22 nt, Human
agaagcccaggaaaggcuccag

SEQ ID NO: 1167215 - RNA, 23 nt, Human
agaagcccaggaaaggcuccagg

SEQ ID NO: 1167216 - RNA, 17 nt, Human
ucugcccacucccugca

SEQ ID NO: 1167217 - RNA, 14 nt, Human
ucugccgcagcccu

SEQ ID NO: 1167218 - RNA, 15 nt, Human
ucugccgcagcccug

SEQ ID NO: 1167219 - RNA, 18 nt, Human
ucugcccacucccugcaa

SEQ ID NO: 1167220 - RNA, 21 nt, Human
ucugcccacucccugcaaccu

SEQ ID NO: 1167221 - RNA, 23 nt, Human
ucugcccacucccugcaaccuga

SEQ ID NO: 1167222 - RNA, 19 nt, Human
ucugcccuccaagaccuuc

SEQ ID NO: 1167223 - RNA, 23 nt, Human
ucugccgcagcccugcagagggc

SEQ ID NO: 1167224 - RNA, 22 nt, Human
ucugccgcagcccugcagaggg

SEQ ID NO: 1167225 - RNA, 22 nt, Human
ucugccugcccaggccccugcc

SEQ ID NO: 1167226 - RNA, 19 nt, Human
ucugcucacauaucuguca

SEQ ID NO: 1167227 - RNA, 20 nt, Human
ucugcucacauaucugucau

SEQ ID NO: 1167228 - RNA, 14 nt, Human
ucugcuucagccuc

SEQ ID NO: 1167229 - RNA, 15 nt, Human
ucugcuucagccucc

SEQ ID NO: 1167230 - RNA, 21 nt, Human
agaaguuucugccgcagcccu

SEQ ID NO: 1167231 - RNA, 22 nt, Human
agaaguuucugccgcagcccug

SEQ ID NO: 1167232 - RNA, 23 nt, Human
agaaguuucugccgcagcccugc

SEQ ID NO: 1167233 - RNA, 15 nt, Human
agaauuaacacauga

SEQ ID NO: 1167234 - RNA, 23 nt, Human
agaauuaacacaugauccugcaa

SEQ ID NO: 1167235 - RNA, 14 nt, Human
ucugugagaugcua

SEQ ID NO: 1167236 - RNA, 17 nt, Human
ucugugagaugcuagaa

SEQ ID NO: 1167237 - RNA, 22 nt, Human
ucugugagaugcuagaacuccc

SEQ ID NO: 1167238 - RNA, 23 nt, Human
ucugugagaugcuagaacucccu

SEQ ID NO: 1167239 - RNA, 12 nt, Human
ucuguuggccag

SEQ ID NO: 1167240 - RNA, 17 nt, Human
ucuguuggccaguguga

SEQ ID NO: 1167241 - RNA, 13 nt, Human
ucuguucuuucca

SEQ ID NO: 1167242 - RNA, 22 nt, Human
ucuguucuuuccaaaguacacu

SEQ ID NO: 1167243 - RNA, 18 nt, Human
ucuguuggccagugugac

SEQ ID NO: 1167244 - RNA, 13 nt, Human
ucuguuuagauaa

SEQ ID NO: 1167245 - RNA, 12 nt, Human
agacacacauga

SEQ ID NO: 1167246 - RNA, 15 nt, Human
agacacacaugaagu

SEQ ID NO: 1167247 - RNA, 12 nt, Human
agacacaggccc

SEQ ID NO: 1167248 - RNA, 13 nt, Human
agacacaggcccg

SEQ ID NO: 1167249 - RNA, 16 nt, Human
agacacaggcccggcu

SEQ ID NO: 1167250 - RNA, 16 nt, Human
agacacauguccaaga

SEQ ID NO: 1167251 - RNA, 20 nt, Human
agacacauguccaagaagcc

SEQ ID NO: 1167252 - RNA, 17 nt, Human
agacaccuugacagggc

SEQ ID NO: 1167253 - RNA, 18 nt, Human
agacaccuugacagggca

SEQ ID NO: 1167254 - RNA, 19 nt, Human
agacaccuugacagggcac

SEQ ID NO: 1167255 - RNA, 13 nt, Human
agacagagcuaca

SEQ ID NO: 1167256 - RNA, 13 nt, Human
agacuccugcagg

SEQ ID NO: 1167257 - RNA, 14 nt, Human
agacuccugcaggc

SEQ ID NO: 1167258 - RNA, 13 nt, Human
agacucugucuca

SEQ ID NO: 1167259 - RNA, 20 nt, Human
agacaggcaagcaccuccug

SEQ ID NO: 1167260 - RNA, 22 nt, Human
agacaggcaagcaccuccugcc

SEQ ID NO: 1167261 - RNA, 15 nt, Human
ucuuuaaugucacag

SEQ ID NO: 1167262 - RNA, 18 nt, Human
ucuuuaaugucacaggca

SEQ ID NO: 1167263 - RNA, 19 nt, Human
ucuuuaaugucacaggcag

SEQ ID NO: 1167264 - RNA, 12 nt, Human
ucuuuccugagg

SEQ ID NO: 1167265 - RNA, 20 nt, Human
agacugguuccauggccucu

SEQ ID NO: 1167266 - RNA, 14 nt, Human
agacuguacaaagu

SEQ ID NO: 1167267 - RNA, 17 nt, Human
agacuuuggaaagacuu

SEQ ID NO: 1167268 - RNA, 15 nt, Human
agacuuuggaaagag

SEQ ID NO: 1167269 - RNA, 19 nt, Human
agacuuuggaaagaguagg

SEQ ID NO: 1167270 - RNA, 15 nt, Human
agacuuuuccaaccc

SEQ ID NO: 1167271 - RNA, 19 nt, Human
agacuuuucuuucagccaa

SEQ ID NO: 1167272 - RNA, 16 nt, Human
agagacacaagccuuc

SEQ ID NO: 1167273 - RNA, 19 nt, Human
agagacacaagccuucggc

SEQ ID NO: 1167274 - RNA, 16 nt, Human
agagacacacugaaga

SEQ ID NO: 1167275 - RNA, 14 nt, Human
agagacagaaagca

SEQ ID NO: 1167276 - RNA, 15 nt, Human
agagacagaaagcag

SEQ ID NO: 1167277 - RNA, 14 nt, Human
ucuuuguacagaca

SEQ ID NO: 1167278 - RNA, 15 nt, Human
ucuuuguacagacaa

SEQ ID NO: 1167279 - RNA, 20 nt, Human
ucuuuguacagacaacaaac

SEQ ID NO: 1167280 - RNA, 14 nt, Human
ucuuuguggcuucc

SEQ ID NO: 1167281 - RNA, 11 nt, Human
agagagaaaau

SEQ ID NO: 1167282 - RNA, 12 nt, Human
agagagaaaaua

SEQ ID NO: 1167283 - RNA, 12 nt, Human
agagacuccugc

SEQ ID NO: 1167284 - RNA, 13 nt, Human
agagacuccugca

SEQ ID NO: 1167285 - RNA, 14 nt, Human
agagacuccugcag

SEQ ID NO: 1167286 - RNA, 15 nt, Human
agagacuccugcagg

SEQ ID NO: 1167287 - RNA, 16 nt, Human
ugaaagacuguacaaa

SEQ ID NO: 1167288 - RNA, 18 nt, Human
ugaaagacuguacaaagu

SEQ ID NO: 1167289 - RNA, 19 nt, Human
ugaaagacuguacaaagua

SEQ ID NO: 1167290 - RNA, 22 nt, Human
ugaaagacuguacaaaguagaa

SEQ ID NO: 1167291 - RNA, 17 nt, Human
ugaaagaggaaugaagu

SEQ ID NO: 1167292 - RNA, 18 nt, Human
ugaaagaggaaugaagua

SEQ ID NO: 1167293 - RNA, 19 nt, Human
agagaccaucccugaaggc

SEQ ID NO: 1167294 - RNA, 21 nt, Human
agagaccaucccugaaggccc

SEQ ID NO: 1167295 - RNA, 22 nt, Human
agagaccaucccugaaggcccc

SEQ ID NO: 1167296 - RNA, 23 nt, Human
agagaccaucccugaaggccccg

SEQ ID NO: 1167297 - RNA, 12 nt, Human
ugaaaacacauu

SEQ ID NO: 1167298 - RNA, 13 nt, Human
ugaaaacacauuu

SEQ ID NO: 1167299 - RNA, 14 nt, Human
ugaaaacacauuuu

SEQ ID NO: 1167300 - RNA, 15 nt, Human
ugaaaacacauuuuu

SEQ ID NO: 1167301 - RNA, 17 nt, Human
ugaaaacacauuuuucu

SEQ ID NO: 1167302 - RNA, 19 nt, Human
ugaaaacacauuuuucuua

SEQ ID NO: 1167303 - RNA, 20 nt, Human
ugaaaacacauuuuucuuag

SEQ ID NO: 1167304 - RNA, 13 nt, Human
ugaaagaaaauaa

SEQ ID NO: 1167305 - RNA, 17 nt, Human
ugaaacuggauuaaacu

SEQ ID NO: 1167306 - RNA, 18 nt, Human
ugaaacuggauuaaacuu

SEQ ID NO: 1167307 - RNA, 16 nt, Human
ugaaaaucgugacaac

SEQ ID NO: 1167308 - RNA, 20 nt, Human
ugaaauuuuuauuaaauuau

SEQ ID NO: 1167309 - RNA, 16 nt, Human
agagauugugguuuca

SEQ ID NO: 1167310 - RNA, 14 nt, Human
ugaaauaagccaga

SEQ ID NO: 1167311 - RNA, 11 nt, Human
ugaacuccugg

SEQ ID NO: 1167312 - RNA, 22 nt, Human
ugaagacaaugacuuacuguac

SEQ ID NO: 1167313 - RNA, 23 nt, Human
ugaagacaaugacuuacuguaca

SEQ ID NO: 1167314 - RNA, 13 nt, Human
ugaagacagagcu

SEQ ID NO: 1167315 - RNA, 13 nt, Human
ugaacaaauuuac

SEQ ID NO: 1167316 - RNA, 22 nt, Human
ugaaccaccacacccagcccac

SEQ ID NO: 1167317 - RNA, 18 nt, Human
ugaacaaauuuacagaga

SEQ ID NO: 1167318 - RNA, 22 nt, Human
ugaacccauauuuguacaccaa

SEQ ID NO: 1167319 - RNA, 18 nt, Human
ugaacccgggaggcagag

SEQ ID NO: 1167320 - RNA, 22 nt, Human
ugaaccgaugagaaauaaaguu

SEQ ID NO: 1167321 - RNA, 23 nt, Human
ugaacuagaguuuagcuggaaaa

SEQ ID NO: 1167322 - RNA, 15 nt, Human
ugaaguaauaugcac

SEQ ID NO: 1167323 - RNA, 16 nt, Human
ugaaguaauaugcaca

SEQ ID NO: 1167324 - RNA, 20 nt, Human
ugaaguaauaugcacacauu

SEQ ID NO: 1167325 - RNA, 21 nt, Human
ugaaguaauaugcacacauuu

SEQ ID NO: 1167326 - RNA, 22 nt, Human
ugaaguaauaugcacacauuuu

SEQ ID NO: 1167327 - RNA, 17 nt, Human
ugaagauuuaccacuug

SEQ ID NO: 1167328 - RNA, 20 nt, Human
ugaagauuuaccacuugugu

SEQ ID NO: 1167329 - RNA, 17 nt, Human
ugaaguacucauacaug

SEQ ID NO: 1167330 - RNA, 13 nt, Human
ugaagucacacag

SEQ ID NO: 1167331 - RNA, 14 nt, Human
ugaagucacacagu

SEQ ID NO: 1167332 - RNA, 12 nt, Human
ugaauaauacag

SEQ ID NO: 1167333 - RNA, 13 nt, Human
ugaauaauacagu

SEQ ID NO: 1167334 - RNA, 22 nt, Human
agaggcagccccauucugccug

SEQ ID NO: 1167335 - RNA, 23 nt, Human
agaggcagccccauucugccugc

SEQ ID NO: 1167336 - RNA, 24 nt, Human
agaggcagccccauucugccugcc

SEQ ID NO: 1167337 - RNA, 22 nt, Human
agaggcugccucucccaucacu

SEQ ID NO: 1167338 - RNA, 15 nt, Human
agagggagugacaga

SEQ ID NO: 1167339 - RNA, 20 nt, Human
agagggagugacagaggcag

SEQ ID NO: 1167340 - RNA, 16 nt, Human
agagguucaaagauau

SEQ ID NO: 1167341 - RNA, 19 nt, Human
agagguucaaagauauuuu

SEQ ID NO: 1167342 - RNA, 20 nt, Human
agagguucaaagauauuuug

SEQ ID NO: 1167343 - RNA, 13 nt, Human
agauccuggaaau

SEQ ID NO: 1167344 - RNA, 14 nt, Human
agauccuggaaauc

SEQ ID NO: 1167345 - RNA, 18 nt, Human
agaucucuaacuucacca

SEQ ID NO: 1167346 - RNA, 21 nt, Human
agaugcaguucugaagaagau

SEQ ID NO: 1167347 - RNA, 19 nt, Human
agaugcuagaacucccuuu

SEQ ID NO: 1167348 - RNA, 21 nt, Human
agaugcuagaacucccuuuca

SEQ ID NO: 1167349 - RNA, 22 nt, Human
agaugcuagaacucccuuucaa

SEQ ID NO: 1167350 - RNA, 17 nt, Human
ugacaggcaaugcuggc

SEQ ID NO: 1167351 - RNA, 19 nt, Human
ugacaggcaaugcuggcug

SEQ ID NO: 1167352 - RNA, 22 nt, Human
ugacagggcacaccgggcacuc

SEQ ID NO: 1167353 - RNA, 16 nt, Human
ugacacgaauauugcu

SEQ ID NO: 1167354 - RNA, 19 nt, Human
ugacacgaauauugcugau

SEQ ID NO: 1167355 - RNA, 15 nt, Human
ugacacuuaaaaaug

SEQ ID NO: 1167356 - RNA, 16 nt, Human
ugacacuuaaaaaugg

SEQ ID NO: 1167357 - RNA, 12 nt, Human
ugaccuuucaau

SEQ ID NO: 1167358 - RNA, 13 nt, Human
ugaccuuucaaua

SEQ ID NO: 1167359 - RNA, 22 nt, Human
agauguauguacuucaugcugu

SEQ ID NO: 1167360 - RNA, 15 nt, Human
ugaccuuuaagagaa

SEQ ID NO: 1167361 - RNA, 19 nt, Human
agauucauauuuacuucuu

SEQ ID NO: 1167362 - RNA, 19 nt, Human
agauuucacucuccuuggu

SEQ ID NO: 1167363 - RNA, 13 nt, Human
agauucauauuua

SEQ ID NO: 1167364 - RNA, 16 nt, Human
agauucauauuuacuu

SEQ ID NO: 1167365 - RNA, 12 nt, Human
ugacuuacugua

SEQ ID NO: 1167366 - RNA, 20 nt, Human
ugacuuacuguacaugaaaa

SEQ ID NO: 1167367 - RNA, 11 nt, Human
ugagacagagu

SEQ ID NO: 1167368 - RNA, 21 nt, Human
ugagacagaguuuucacucuu

SEQ ID NO: 1167369 - RNA, 13 nt, Human
ugagacagcccgg

SEQ ID NO: 1167370 - RNA, 12 nt, Human
ugagaauuaccc

SEQ ID NO: 1167371 - RNA, 15 nt, Human
agauuuuccugaaaa

SEQ ID NO: 1167372 - RNA, 16 nt, Human
agauuuuccugaaaac

SEQ ID NO: 1167373 - RNA, 17 nt, Human
ugagacagcccgggcuc

SEQ ID NO: 1167374 - RNA, 18 nt, Human
ugagacagcccgggcucu

SEQ ID NO: 1167375 - RNA, 19 nt, Human
ugagacagcccgggcucug

SEQ ID NO: 1167376 - RNA, 20 nt, Human
ugagacagcccgggcucugc

SEQ ID NO: 1167377 - RNA, 22 nt, Human
ugagacagcccgggcucugccu

SEQ ID NO: 1167378 - RNA, 12 nt, Human
ugagacagcucu

SEQ ID NO: 1167379 - RNA, 20 nt, Human
ugagacucugucucagucca

SEQ ID NO: 1167380 - RNA, 16 nt, Human
ugagagacacacugaa

SEQ ID NO: 1167381 - RNA, 17 nt, Human
ugagagacacacugaag

SEQ ID NO: 1167382 - RNA, 19 nt, Human
ugagagacacacugaagaa

SEQ ID NO: 1167383 - RNA, 20 nt, Human
ugagagacacacugaagaag

SEQ ID NO: 1167384 - RNA, 21 nt, Human
ugagagacacacugaagaagc

SEQ ID NO: 1167385 - RNA, 22 nt, Human
ugagagacacacugaagaagca

SEQ ID NO: 1167386 - RNA, 14 nt, Human
ugagagcugggugu

SEQ ID NO: 1167387 - RNA, 10 nt, Human
ugagaggaaa

SEQ ID NO: 1167388 - RNA, 11 nt, Human
ugagaggaaau

SEQ ID NO: 1167389 - RNA, 12 nt, Human
ugagaggaaauc

SEQ ID NO: 1167390 - RNA, 13 nt, Human
ugagaggaaauca

SEQ ID NO: 1167391 - RNA, 14 nt, Human
ugagaggaaaucac

SEQ ID NO: 1167392 - RNA, 17 nt, Human
ugagaggaaaucaccga

SEQ ID NO: 1167393 - RNA, 23 nt, Human
ugagaggacuuuucuuuguggcu

SEQ ID NO: 1167394 - RNA, 12 nt, Human
ugagccacugca

SEQ ID NO: 1167395 - RNA, 13 nt, Human
ugagccacugcac

SEQ ID NO: 1167396 - RNA, 14 nt, Human
ugagccacugcacc

SEQ ID NO: 1167397 - RNA, 18 nt, Human
ugagccacugcaccgggc

SEQ ID NO: 1167398 - RNA, 19 nt, Human
ugagccagauuucacucuc

SEQ ID NO: 1167399 - RNA, 20 nt, Human
ugagccagauuucacucucc

SEQ ID NO: 1167400 - RNA, 21 nt, Human
ugagccagauuucacucuccu

SEQ ID NO: 1167401 - RNA, 14 nt, Human
agcaaggagauuua

SEQ ID NO: 1167402 - RNA, 17 nt, Human
agcaaggagauuuacaa

SEQ ID NO: 1167403 - RNA, 19 nt, Human
agcaaggagauuuacaacu

SEQ ID NO: 1167404 - RNA, 16 nt, Human
agcaagugagacccug

SEQ ID NO: 1167405 - RNA, 15 nt, Human
agcaagugagagcug

SEQ ID NO: 1167406 - RNA, 16 nt, Human
agcaagugagagcugg

SEQ ID NO: 1167407 - RNA, 13 nt, Human
agcaccuccugcc

SEQ ID NO: 1167408 - RNA, 14 nt, Human
agcaccuccugccu

SEQ ID NO: 1167409 - RNA, 16 nt, Human
agcaccuccugccucg

SEQ ID NO: 1167410 - RNA, 23 nt, Human
agcacaugccucucucaggccaa

SEQ ID NO: 1167411 - RNA, 22 nt, Human
agcaccaaaagcuuaccaaggg

SEQ ID NO: 1167412 - RNA, 16 nt, Human
agcaccaucucuccuc

SEQ ID NO: 1167413 - RNA, 17 nt, Human
agcaagugagagcuggg

SEQ ID NO: 1167414 - RNA, 18 nt, Human
agcaagugagagcugggu

SEQ ID NO: 1167415 - RNA, 21 nt, Human
agcacagcuucauuuccugug

SEQ ID NO: 1167416 - RNA, 18 nt, Human
agcacaugccucucucag

SEQ ID NO: 1167417 - RNA, 19 nt, Human
agcacaugccucucucagg

SEQ ID NO: 1167418 - RNA, 20 nt, Human
agcacaugccucucucaggc

SEQ ID NO: 1167419 - RNA, 21 nt, Human
agcacaugccucucucaggcc

SEQ ID NO: 1167420 - RNA, 22 nt, Human
agcacaugccucucucaggcca

SEQ ID NO: 1167421 - RNA, 13 nt, Human
ugauggugcaaug

SEQ ID NO: 1167422 - RNA, 15 nt, Human
ugauggugcaaugac

SEQ ID NO: 1167423 - RNA, 19 nt, Human
ugauuaaauucuugcaaag

SEQ ID NO: 1167424 - RNA, 20 nt, Human
ugauuaaauucuugcaaagu

SEQ ID NO: 1167425 - RNA, 19 nt, Human
ugauuaaccacuucagcug

SEQ ID NO: 1167426 - RNA, 18 nt, Human
ugauuaaguaaugauaac

SEQ ID NO: 1167427 - RNA, 15 nt, Human
ugauuaauuaaaaca

SEQ ID NO: 1167428 - RNA, 23 nt, Human
ugauuaaguaaugauaacuggaa

SEQ ID NO: 1167429 - RNA, 20 nt, Human
ugauuaaccacuucagcuga

SEQ ID NO: 1167430 - RNA, 18 nt, Human
agccacugcaccgggcca

SEQ ID NO: 1167431 - RNA, 19 nt, Human
agccacugcaccgggccac

SEQ ID NO: 1167432 - RNA, 20 nt, Human
agccacugcaccgggccaca

SEQ ID NO: 1167433 - RNA, 10 nt, Human
agccagagga

SEQ ID NO: 1167434 - RNA, 11 nt, Human
agccagaggag

SEQ ID NO: 1167435 - RNA, 16 nt, Human
ugauccuaguuccacc

SEQ ID NO: 1167436 - RNA, 15 nt, Human
ugauccucccaccuc

SEQ ID NO: 1167437 - RNA, 16 nt, Human
ugauccucccaccuca

SEQ ID NO: 1167438 - RNA, 21 nt, Human
ugauccucccaccucagccuc

SEQ ID NO: 1167439 - RNA, 22 nt, Human
ugauccucccaccucagccucc

SEQ ID NO: 1167440 - RNA, 11 nt, Human
ugaugaagaag

SEQ ID NO: 1167441 - RNA, 12 nt, Human
ugaugaagaagu

SEQ ID NO: 1167442 - RNA, 13 nt, Human
ugaugagaggaaa

SEQ ID NO: 1167443 - RNA, 14 nt, Human
ugaugagaggaaau

SEQ ID NO: 1167444 - RNA, 15 nt, Human
ugaugagaggaaauc

SEQ ID NO: 1167445 - RNA, 16 nt, Human
ugaugagaggaaauca

SEQ ID NO: 1167446 - RNA, 21 nt, Human
ugaugggcaacccccagccug

SEQ ID NO: 1167447 - RNA, 15 nt, Human
ugauggggcccugcc

SEQ ID NO: 1167448 - RNA, 16 nt, Human
ugauggggcccugccu

SEQ ID NO: 1167449 - RNA, 19 nt, Human
ugauggggcccugccuccu

SEQ ID NO: 1167450 - RNA, 14 nt, Human
agcccaggaaaggc

SEQ ID NO: 1167451 - RNA, 18 nt, Human
agcccaggaaaggcucca

SEQ ID NO: 1167452 - RNA, 16 nt, Human
ugauucauaaugacuu

SEQ ID NO: 1167453 - RNA, 21 nt, Human
ugauucauaaugacuuaagca

SEQ ID NO: 1167454 - RNA, 13 nt, Human
ugauucuccugcc

SEQ ID NO: 1167455 - RNA, 22 nt, Human
ugauucccaagcucugcuccuc

SEQ ID NO: 1167456 - RNA, 23 nt, Human
ugauucccaagcucugcuccucu

SEQ ID NO: 1167457 - RNA, 22 nt, Human
ugauuuccguuaaaauaccagc

SEQ ID NO: 1167458 - RNA, 13 nt, Human
ugauuucauucaa

SEQ ID NO: 1167459 - RNA, 17 nt, Human
ugauuuggggauauuuu

SEQ ID NO: 1167460 - RNA, 13 nt, Human
agccaguaaaugg

SEQ ID NO: 1167461 - RNA, 21 nt, Human
agccaguaaaugggggugcau

SEQ ID NO: 1167462 - RNA, 22 nt, Human
agccaguaaaugggggugcauu

SEQ ID NO: 1167463 - RNA, 13 nt, Human
agcccacuucugc

SEQ ID NO: 1167464 - RNA, 14 nt, Human
agcccacuucugcc

SEQ ID NO: 1167465 - RNA, 15 nt, Human
agcccacuucugcca

SEQ ID NO: 1167466 - RNA, 22 nt, Human
agcccacuucugccauauucug

SEQ ID NO: 1167467 - RNA, 13 nt, Human
agcccgggcucug

SEQ ID NO: 1167468 - RNA, 14 nt, Human
agcccugguggcag

SEQ ID NO: 1167469 - RNA, 15 nt, Human
agcccugguggcagu

SEQ ID NO: 1167470 - RNA, 16 nt, Human
agcccugguggcagug

SEQ ID NO: 1167471 - RNA, 18 nt, Human
ugcacacaccagagccca

SEQ ID NO: 1167472 - RNA, 21 nt, Human
ugcacacaccagagcccaccu

SEQ ID NO: 1167473 - RNA, 22 nt, Human
ugcacacaccagagcccaccuu

SEQ ID NO: 1167474 - RNA, 23 nt, Human
agccccauucugccugcccaggc

SEQ ID NO: 1167475 - RNA, 21 nt, Human
ugcaaaccaucauugaaaucu

SEQ ID NO: 1167476 - RNA, 16 nt, Human
agccccaaaacucucc

SEQ ID NO: 1167477 - RNA, 17 nt, Human
agccccaaaacucuccu

SEQ ID NO: 1167478 - RNA, 18 nt, Human
agccccaaaacucuccuc

SEQ ID NO: 1167479 - RNA, 20 nt, Human
agccccaaaacucuccucug

SEQ ID NO: 1167480 - RNA, 21 nt, Human
agccccauucugccugcccag

SEQ ID NO: 1167481 - RNA, 22 nt, Human
agccccauucugccugcccagg

SEQ ID NO: 1167482 - RNA, 18 nt, Human
agccgagaucacgccacu

SEQ ID NO: 1167483 - RNA, 20 nt, Human
agccucaaccuccugggcua

SEQ ID NO: 1167484 - RNA, 17 nt, Human
agccucacaguccuuac

SEQ ID NO: 1167485 - RNA, 18 nt, Human
agccucacaguccuuacc

SEQ ID NO: 1167486 - RNA, 23 nt, Human
agccucugaaaaccaauguucuc

SEQ ID NO: 1167487 - RNA, 21 nt, Human
ugcagccucaaccuccugggc

SEQ ID NO: 1167488 - RNA, 22 nt, Human
ugcagccucaaccuccugggcu

SEQ ID NO: 1167489 - RNA, 23 nt, Human
ugcagccucaaccuccugggcua

SEQ ID NO: 1167490 - RNA, 12 nt, Human
ugcacacauuuu

SEQ ID NO: 1167491 - RNA, 13 nt, Human
ugcacacauuuuu

SEQ ID NO: 1167492 - RNA, 15 nt, Human
ugcacacauuuuuua

SEQ ID NO: 1167493 - RNA, 16 nt, Human
ugcacuccccugcugg

SEQ ID NO: 1167494 - RNA, 17 nt, Human
ugcacuccccugcuggg

SEQ ID NO: 1167495 - RNA, 19 nt, Human
ugcacuccccugcugggug

SEQ ID NO: 1167496 - RNA, 21 nt, Human
agcccugguggcagugggagc

SEQ ID NO: 1167497 - RNA, 20 nt, Human
ugcacacauuuuuuaaaugc

SEQ ID NO: 1167498 - RNA, 14 nt, Human
ugcagaagacagua

SEQ ID NO: 1167499 - RNA, 15 nt, Human
ugcagaagacaguau

SEQ ID NO: 1167500 - RNA, 22 nt, Human
ugcagacaggcaagcaccuccu

SEQ ID NO: 1167501 - RNA, 22 nt, Human
ugcagaagacaguauggcagcu

SEQ ID NO: 1167502 - RNA, 16 nt, Human
ugcagacucuacagag

SEQ ID NO: 1167503 - RNA, 17 nt, Human
ugcagacucuacagagg

SEQ ID NO: 1167504 - RNA, 18 nt, Human
ugcagacucuacagaggc

SEQ ID NO: 1167505 - RNA, 16 nt, Human
agcccuuagcagggaa

SEQ ID NO: 1167506 - RNA, 21 nt, Human
agcccuuagcagggaaacagc

SEQ ID NO: 1167507 - RNA, 21 nt, Human
agccgagauagccaaggccaa

SEQ ID NO: 1167508 - RNA, 17 nt, Human
agccgagaucacgccac

SEQ ID NO: 1167509 - RNA, 19 nt, Human
ugcauuugaggucuguucu

SEQ ID NO: 1167510 - RNA, 20 nt, Human
ugcauuuaaaagauacaguu

SEQ ID NO: 1167511 - RNA, 18 nt, Human
agccuuccagggguggga

SEQ ID NO: 1167512 - RNA, 15 nt, Human
agccuugaacuuuga

SEQ ID NO: 1167513 - RNA, 16 nt, Human
agccuugaacuuugac

SEQ ID NO: 1167514 - RNA, 22 nt, Human
agccuugaacuuugaccucugc

SEQ ID NO: 1167515 - RNA, 23 nt, Human
agccuugaacuuugaccucugca

SEQ ID NO: 1167516 - RNA, 23 nt, Human
agccuugaccauucuccaccugc

SEQ ID NO: 1167517 - RNA, 22 nt, Human
agcgauucuucugcuucagccu

SEQ ID NO: 1167518 - RNA, 20 nt, Human
ugcauuugaggucuguucuu

SEQ ID NO: 1167519 - RNA, 21 nt, Human
ugcauuugaggucuguucuuu

SEQ ID NO: 1167520 - RNA, 18 nt, Human
ugccagcuuaucucaggg

SEQ ID NO: 1167521 - RNA, 12 nt, Human
ugccaggaagcc

SEQ ID NO: 1167522 - RNA, 13 nt, Human
agcggcuggcagc

SEQ ID NO: 1167523 - RNA, 23 nt, Human
agcggcuggcagcccaccccuca

SEQ ID NO: 1167524 - RNA, 19 nt, Human
agcggggacagcuccuucu

SEQ ID NO: 1167525 - RNA, 20 nt, Human
agcggggacagcuccuucug

SEQ ID NO: 1167526 - RNA, 22 nt, Human
agcggggacagcuccuucuguc

SEQ ID NO: 1167527 - RNA, 23 nt, Human
ugccccgaacauguuuuucuucu

SEQ ID NO: 1167528 - RNA, 20 nt, Human
ugcccuaaaguguauuuuuu

SEQ ID NO: 1167529 - RNA, 16 nt, Human
ugccccauucaacauc

SEQ ID NO: 1167530 - RNA, 17 nt, Human
ugcccaaagaugcagcc

SEQ ID NO: 1167531 - RNA, 20 nt, Human
ugcccaaagaugcagccggu

SEQ ID NO: 1167532 - RNA, 13 nt, Human
ugcccagccccuu

SEQ ID NO: 1167533 - RNA, 16 nt, Human
ugcccagccccuucug

SEQ ID NO: 1167534 - RNA, 17 nt, Human
ugcccagccccuucuga

SEQ ID NO: 1167535 - RNA, 20 nt, Human
ugcccagccccuucugaccc

SEQ ID NO: 1167536 - RNA, 15 nt, Human
ugcccaggccccugc

SEQ ID NO: 1167537 - RNA, 17 nt, Human
ugcccaggccccugcca

SEQ ID NO: 1167538 - RNA, 18 nt, Human
ugcccaggccccugccac

SEQ ID NO: 1167539 - RNA, 13 nt, Human
agcgugagccacu

SEQ ID NO: 1167540 - RNA, 21 nt, Human
agcuaggccuggccagaugca

SEQ ID NO: 1167541 - RNA, 19 nt, Human
agcuauucaguaauaacuc

SEQ ID NO: 1167542 - RNA, 12 nt, Human
agcucagggccu

SEQ ID NO: 1167543 - RNA, 13 nt, Human
agcucagggccug

SEQ ID NO: 1167544 - RNA, 14 nt, Human
agcucagggccugg

SEQ ID NO: 1167545 - RNA, 19 nt, Human
agcucagggccuggcucag

SEQ ID NO: 1167546 - RNA, 20 nt, Human
agcucagggccuggcucagg

SEQ ID NO: 1167547 - RNA, 17 nt, Human
agcucaggugucccugc

SEQ ID NO: 1167548 - RNA, 15 nt, Human
agcuccaagcuccca

SEQ ID NO: 1167549 - RNA, 16 nt, Human
agcuccaagcucccag

SEQ ID NO: 1167550 - RNA, 14 nt, Human
ugcccugcccaccu

SEQ ID NO: 1167551 - RNA, 17 nt, Human
agcuccaagcucccagg

SEQ ID NO: 1167552 - RNA, 18 nt, Human
agcuccaagcucccaggc

SEQ ID NO: 1167553 - RNA, 19 nt, Human
agcuccaagcucccaggca

SEQ ID NO: 1167554 - RNA, 13 nt, Human
agcuccagcucac

SEQ ID NO: 1167555 - RNA, 17 nt, Human
agcuccagcucaccagc

SEQ ID NO: 1167556 - RNA, 23 nt, Human
agcucugcccauccugccccuga

SEQ ID NO: 1167557 - RNA, 18 nt, Human
agcuccagcucaccagcc

SEQ ID NO: 1167558 - RNA, 19 nt, Human
agcuccagcucaccagccc

SEQ ID NO: 1167559 - RNA, 21 nt, Human
agcuccagcucaccagcccca

SEQ ID NO: 1167560 - RNA, 23 nt, Human
agcuccuucuguccuacucugug

SEQ ID NO: 1167561 - RNA, 18 nt, Human
ugccucagaaaacaagga

SEQ ID NO: 1167562 - RNA, 22 nt, Human
ugccucccaucacccgcuaaga

SEQ ID NO: 1167563 - RNA, 17 nt, Human
ugccucucucaggccaa

SEQ ID NO: 1167564 - RNA, 15 nt, Human
agcucuucuccaggc

SEQ ID NO: 1167565 - RNA, 16 nt, Human
agcucuucuccaggcu

SEQ ID NO: 1167566 - RNA, 17 nt, Human
agcucuucuccaggcug

SEQ ID NO: 1167567 - RNA, 15 nt, Human
ugcccugugggcccc

SEQ ID NO: 1167568 - RNA, 18 nt, Human
ugcccugugggcccccaa

SEQ ID NO: 1167569 - RNA, 22 nt, Human
ugcccuuaccugccaggaagcc

SEQ ID NO: 1167570 - RNA, 20 nt, Human
ugccgcagcccugcagaggg

SEQ ID NO: 1167571 - RNA, 15 nt, Human
ugccucaccccuugc

SEQ ID NO: 1167572 - RNA, 11 nt, Human
ugccucugccu

SEQ ID NO: 1167573 - RNA, 14 nt, Human
ugccucugacacac

SEQ ID NO: 1167574 - RNA, 16 nt, Human
ugccucugacacacag

SEQ ID NO: 1167575 - RNA, 12 nt, Human
ugccucugccuc

SEQ ID NO: 1167576 - RNA, 17 nt, Human
ugccugcccaggccccu

SEQ ID NO: 1167577 - RNA, 18 nt, Human
ugccugcccaggccccug

SEQ ID NO: 1167578 - RNA, 19 nt, Human
ugccugcccaggccccugc

SEQ ID NO: 1167579 - RNA, 20 nt, Human
ugccugcccaggccccugcc

SEQ ID NO: 1167580 - RNA, 23 nt, Human
agcugcuuuugucuaugggacuc

SEQ ID NO: 1167581 - RNA, 24 nt, Human
agcugcuuuugucuaugggacuca

SEQ ID NO: 1167582 - RNA, 13 nt, Human
agcuggaaaagua

SEQ ID NO: 1167583 - RNA, 13 nt, Human
agcugccuguuca

SEQ ID NO: 1167584 - RNA, 15 nt, Human
ugcugagucugaagg

SEQ ID NO: 1167585 - RNA, 21 nt, Human
ugcucugcugacagacacagg

SEQ ID NO: 1167586 - RNA, 22 nt, Human
ugcucugcugacagacacaggc

SEQ ID NO: 1167587 - RNA, 16 nt, Human
agcugggacuacaggc

SEQ ID NO: 1167588 - RNA, 18 nt, Human
agcugggacuacaggcac

SEQ ID NO: 1167589 - RNA, 19 nt, Human
agcugggacuacaggcacc

SEQ ID NO: 1167590 - RNA, 16 nt, Human
ugcuccagcuguucag

SEQ ID NO: 1167591 - RNA, 19 nt, Human
ugcuccagcuguucagcug

SEQ ID NO: 1167592 - RNA, 20 nt, Human
ugcuccagcuguucagcugg

SEQ ID NO: 1167593 - RNA, 11 nt, Human
aggaauuuaaa

SEQ ID NO: 1167594 - RNA, 17 nt, Human
aggaagccagcaggcuc

SEQ ID NO: 1167595 - RNA, 18 nt, Human
aggaagccagcaggcucu

SEQ ID NO: 1167596 - RNA, 18 nt, Human
aggaaggaaacccagcuc

SEQ ID NO: 1167597 - RNA, 19 nt, Human
aggaaggaaacccagcucu

SEQ ID NO: 1167598 - RNA, 20 nt, Human
aggaaggaaacccagcucug

SEQ ID NO: 1167599 - RNA, 15 nt, Human
aggaaggagaggaga

SEQ ID NO: 1167600 - RNA, 16 nt, Human
ugcugagucugaaggc

SEQ ID NO: 1167601 - RNA, 17 nt, Human
ugcugagucugaaggcu

SEQ ID NO: 1167602 - RNA, 18 nt, Human
ugcugagucugaaggcug

SEQ ID NO: 1167603 - RNA, 21 nt, Human
ugcugagucugaaggcugggu

SEQ ID NO: 1167604 - RNA, 22 nt, Human
ugcugagucugaaggcuggguu

SEQ ID NO: 1167605 - RNA, 23 nt, Human
ugcugagucugaaggcuggguuc

SEQ ID NO: 1167606 - RNA, 13 nt, Human
aggaagacuucau

SEQ ID NO: 1167607 - RNA, 19 nt, Human
aggaagacuucaucccucu

SEQ ID NO: 1167608 - RNA, 13 nt, Human
aggaagacuuugg

SEQ ID NO: 1167609 - RNA, 14 nt, Human
aggaagacuuugga

SEQ ID NO: 1167610 - RNA, 23 nt, Human
aggaagcacaugccucucucagg

SEQ ID NO: 1167611 - RNA, 24 nt, Human
aggaagcacaugccucucucaggc

SEQ ID NO: 1167612 - RNA, 14 nt, Human
aggaagccagcagg

SEQ ID NO: 1167613 - RNA, 15 nt, Human
aggaagccagcaggc

SEQ ID NO: 1167614 - RNA, 16 nt, Human
ugcuggcugguuagag

SEQ ID NO: 1167615 - RNA, 18 nt, Human
ugcuggcuguuggcuggg

SEQ ID NO: 1167616 - RNA, 13 nt, Human
ugcugcccuguga

SEQ ID NO: 1167617 - RNA, 14 nt, Human
ugcugcccugugag

SEQ ID NO: 1167618 - RNA, 15 nt, Human
ugcugcccugugagu

SEQ ID NO: 1167619 - RNA, 13 nt, Human
ugcuggagcucug

SEQ ID NO: 1167620 - RNA, 14 nt, Human
ugcuggagcucugc

SEQ ID NO: 1167621 - RNA, 17 nt, Human
ugcugucccuuacguga

SEQ ID NO: 1167622 - RNA, 22 nt, Human
aggacagggaggugaccccagg

SEQ ID NO: 1167623 - RNA, 17 nt, Human
aggacacugauaugggu

SEQ ID NO: 1167624 - RNA, 23 nt, Human
aggacacuaaccacgcuggaccu

SEQ ID NO: 1167625 - RNA, 14 nt, Human
aggacacugauaug

SEQ ID NO: 1167626 - RNA, 13 nt, Human
ugcuuauacacuu

SEQ ID NO: 1167627 - RNA, 16 nt, Human
ugcuucaaggauccug

SEQ ID NO: 1167628 - RNA, 18 nt, Human
ugcuucaaggauccugag

SEQ ID NO: 1167629 - RNA, 19 nt, Human
ugcuucaaggauccugagc

SEQ ID NO: 1167630 - RNA, 20 nt, Human
ugcuucaaggauccugagcc

SEQ ID NO: 1167631 - RNA, 13 nt, Human
ugcuucagccucc

SEQ ID NO: 1167632 - RNA, 14 nt, Human
ugcuucagccuccc

SEQ ID NO: 1167633 - RNA, 19 nt, Human
ugcuugggcuucauccucc

SEQ ID NO: 1167634 - RNA, 13 nt, Human
uggaaaggcagcu

SEQ ID NO: 1167635 - RNA, 15 nt, Human
uggaaauauuaagaa

SEQ ID NO: 1167636 - RNA, 21 nt, Human
ugcuuggaggaaggaaaccca

SEQ ID NO: 1167637 - RNA, 12 nt, Human
ugcuugggcuuc

SEQ ID NO: 1167638 - RNA, 16 nt, Human
ugcuugggcuucaucc

SEQ ID NO: 1167639 - RNA, 15 nt, Human
aggacauugcggaca

SEQ ID NO: 1167640 - RNA, 17 nt, Human
aggacauugcggacagc

SEQ ID NO: 1167641 - RNA, 18 nt, Human
aggacauugcggacagcc

SEQ ID NO: 1167642 - RNA, 19 nt, Human
aggacauugcggacagcca

SEQ ID NO: 1167643 - RNA, 23 nt, Human
aggacauugcggacagccacggc

SEQ ID NO: 1167644 - RNA, 11 nt, Human
aggagaaacug

SEQ ID NO: 1167645 - RNA, 17 nt, Human
aggagaaacuggaacuc

SEQ ID NO: 1167646 - RNA, 17 nt, Human
aggagauuggaaggaac

SEQ ID NO: 1167647 - RNA, 22 nt, Human
aggagccccgaggccuucucug

SEQ ID NO: 1167648 - RNA, 21 nt, Human
aggauacaaaagcaugugaga

SEQ ID NO: 1167649 - RNA, 15 nt, Human
aggauccugagccag

SEQ ID NO: 1167650 - RNA, 16 nt, Human
aggauccugagccaga

SEQ ID NO: 1167651 - RNA, 17 nt, Human
aggauccugagccagau

SEQ ID NO: 1167652 - RNA, 18 nt, Human
aggauccugagccagauu

SEQ ID NO: 1167653 - RNA, 21 nt, Human
aggaucucuugagccugggag

SEQ ID NO: 1167654 - RNA, 22 nt, Human
aggaucucuugagccugggagg

SEQ ID NO: 1167655 - RNA, 16 nt, Human
aggaugaucuaggaag

SEQ ID NO: 1167656 - RNA, 17 nt, Human
aggaugaucuaggaaga

SEQ ID NO: 1167657 - RNA, 20 nt, Human
uggaaauauuaagaaagacu

SEQ ID NO: 1167658 - RNA, 23 nt, Human
uggaaaugggcagagcagagacc

SEQ ID NO: 1167659 - RNA, 19 nt, Human
aggauuuugauccaagcug

SEQ ID NO: 1167660 - RNA, 20 nt, Human
aggaugaucuaggaagacuu

SEQ ID NO: 1167661 - RNA, 14 nt, Human
aggaugcccaaaga

SEQ ID NO: 1167662 - RNA, 19 nt, Human
aggaugcccaaagaugcag

SEQ ID NO: 1167663 - RNA, 17 nt, Human
aggcaacucaucuuagg

SEQ ID NO: 1167664 - RNA, 19 nt, Human
aggcaacugcauuggcuuu

SEQ ID NO: 1167665 - RNA, 18 nt, Human
uggaauuggagcucgugg

SEQ ID NO: 1167666 - RNA, 15 nt, Human
uggacacagcucuuc

SEQ ID NO: 1167667 - RNA, 16 nt, Human
uggacacagcucuucu

SEQ ID NO: 1167668 - RNA, 18 nt, Human
uggacacagcucuucucc

SEQ ID NO: 1167669 - RNA, 21 nt, Human
uggacacagcucuucuccagg

SEQ ID NO: 1167670 - RNA, 12 nt, Human
uggacccugagg

SEQ ID NO: 1167671 - RNA, 13 nt, Human
uggacccugaggc

SEQ ID NO: 1167672 - RNA, 14 nt, Human
uggacccugaggcc

SEQ ID NO: 1167673 - RNA, 15 nt, Human
uggacccugaggccc

SEQ ID NO: 1167674 - RNA, 15 nt, Human
aggccacaagacccu

SEQ ID NO: 1167675 - RNA, 16 nt, Human
aggccacaagacccuu

SEQ ID NO: 1167676 - RNA, 16 nt, Human
uggaguucaucuugaa

SEQ ID NO: 1167677 - RNA, 17 nt, Human
uggaguucaucuugaau

SEQ ID NO: 1167678 - RNA, 20 nt, Human
uggaguucaucuugaauugu

SEQ ID NO: 1167679 - RNA, 18 nt, Human
uggaugccugguggcagc

SEQ ID NO: 1167680 - RNA, 19 nt, Human
uggaugccugguggcagcu

SEQ ID NO: 1167681 - RNA, 20 nt, Human
uggaugccugguggcagcug

SEQ ID NO: 1167682 - RNA, 18 nt, Human
uggacgagaaaacaauaa

SEQ ID NO: 1167683 - RNA, 18 nt, Human
aggcauuuguuugaacug

SEQ ID NO: 1167684 - RNA, 16 nt, Human
aggccaaacucaccug

SEQ ID NO: 1167685 - RNA, 20 nt, Human
aggccaaacucaccugcccc

SEQ ID NO: 1167686 - RNA, 14 nt, Human
aggccaaaggaagc

SEQ ID NO: 1167687 - RNA, 15 nt, Human
aggccaaaggaagca

SEQ ID NO: 1167688 - RNA, 23 nt, Human
aggccaaaggaagcacaugccuc

SEQ ID NO: 1167689 - RNA, 12 nt, Human
uggcagccccug

SEQ ID NO: 1167690 - RNA, 13 nt, Human
uggcagccuuggc

SEQ ID NO: 1167691 - RNA, 12 nt, Human
aggccagagaca

SEQ ID NO: 1167692 - RNA, 12 nt, Human
uggauguucuga

SEQ ID NO: 1167693 - RNA, 22 nt, Human
uggauuaaacuuaaucuaaaug

SEQ ID NO: 1167694 - RNA, 20 nt, Human
uggcacaucagcacgauuuc

SEQ ID NO: 1167695 - RNA, 21 nt, Human
uggcacaucagcacgauuucu

SEQ ID NO: 1167696 - RNA, 15 nt, Human
uggcacccggccccu

SEQ ID NO: 1167697 - RNA, 16 nt, Human
uggcacccggccccug

SEQ ID NO: 1167698 - RNA, 21 nt, Human
uggcagaguugaagacagagc

SEQ ID NO: 1167699 - RNA, 22 nt, Human
uggcagaguugaagacagagcu

SEQ ID NO: 1167700 - RNA, 12 nt, Human
uggcaugggaau

SEQ ID NO: 1167701 - RNA, 15 nt, Human
uggcaugggaaugaa

SEQ ID NO: 1167702 - RNA, 22 nt, Human
uggcaugggaaugaaugucagu

SEQ ID NO: 1167703 - RNA, 17 nt, Human
uggccaggcuggucuca

SEQ ID NO: 1167704 - RNA, 13 nt, Human
aggcccucugccc

SEQ ID NO: 1167705 - RNA, 14 nt, Human
aggcccucugccca

SEQ ID NO: 1167706 - RNA, 15 nt, Human
aggcccucugcccac

SEQ ID NO: 1167707 - RNA, 21 nt, Human
uggccccugcccggcugcgga

SEQ ID NO: 1167708 - RNA, 14 nt, Human
uggccucugcacuc

SEQ ID NO: 1167709 - RNA, 15 nt, Human
uggccucugcacucc

SEQ ID NO: 1167710 - RNA, 17 nt, Human
uggccucugcacucccc

SEQ ID NO: 1167711 - RNA, 23 nt, Human
uggccgggcgcgguggcucacgc

SEQ ID NO: 1167712 - RNA, 18 nt, Human
uggccucugcacuccccu

SEQ ID NO: 1167713 - RNA, 16 nt, Human
aggccuggccagaugc

SEQ ID NO: 1167714 - RNA, 17 nt, Human
aggccuggccagaugca

SEQ ID NO: 1167715 - RNA, 21 nt, Human
aggccuggccagaugcaccag

SEQ ID NO: 1167716 - RNA, 22 nt, Human
aggccuggccagaugcaccagc

SEQ ID NO: 1167717 - RNA, 23 nt, Human
aggccuggccagaugcaccagcc

SEQ ID NO: 1167718 - RNA, 12 nt, Human
uggccuggcccc

SEQ ID NO: 1167719 - RNA, 23 nt, Human
aggccugggggcugggcagagga

SEQ ID NO: 1167720 - RNA, 19 nt, Human
aggcuccuuuagcgcccag

SEQ ID NO: 1167721 - RNA, 12 nt, Human
aggcucgagcau

SEQ ID NO: 1167722 - RNA, 15 nt, Human
aggcucgagcaugcc

SEQ ID NO: 1167723 - RNA, 17 nt, Human
aggcucgagcaugccug

SEQ ID NO: 1167724 - RNA, 18 nt, Human
aggcucgagcaugccugg

SEQ ID NO: 1167725 - RNA, 19 nt, Human
aggcucgagcaugccugga

SEQ ID NO: 1167726 - RNA, 21 nt, Human
aggcucgagcaugccuggaug

SEQ ID NO: 1167727 - RNA, 11 nt, Human
aggcucucagg

SEQ ID NO: 1167728 - RNA, 12 nt, Human
aggcucucaggc

SEQ ID NO: 1167729 - RNA, 14 nt, Human
aggcucucaggcca

SEQ ID NO: 1167730 - RNA, 15 nt, Human
aggcucucaggccag

SEQ ID NO: 1167731 - RNA, 16 nt, Human
aggcucucaggccagc

SEQ ID NO: 1167732 - RNA, 18 nt, Human
aggcucucaggccagcug

SEQ ID NO: 1167733 - RNA, 19 nt, Human
aggcucucaggccagcugc

SEQ ID NO: 1167734 - RNA, 20 nt, Human
aggcucucaggccagcugcu

SEQ ID NO: 1167735 - RNA, 21 nt, Human
aggcucucaggccagcugcuu

SEQ ID NO: 1167736 - RNA, 11 nt, Human
aggcucugccc

SEQ ID NO: 1167737 - RNA, 12 nt, Human
aggcucugcccu

SEQ ID NO: 1167738 - RNA, 13 nt, Human
aggcucugcccuu

SEQ ID NO: 1167739 - RNA, 14 nt, Human
aggcucugcccuug

SEQ ID NO: 1167740 - RNA, 15 nt, Human
aggcucugcccuugg

SEQ ID NO: 1167741 - RNA, 16 nt, Human
aggcucugcccuuggu

SEQ ID NO: 1167742 - RNA, 13 nt, Human
aggcuggcgugca

SEQ ID NO: 1167743 - RNA, 17 nt, Human
aggcuggcgugcagugg

SEQ ID NO: 1167744 - RNA, 16 nt, Human
ugggaaaggggaaguu

SEQ ID NO: 1167745 - RNA, 11 nt, Human
uggcugcugaa

SEQ ID NO: 1167746 - RNA, 14 nt, Human
uggcugugucuccc

SEQ ID NO: 1167747 - RNA, 13 nt, Human
uggcuguuggcug

SEQ ID NO: 1167748 - RNA, 15 nt, Human
uggcuguuggcuggg

SEQ ID NO: 1167749 - RNA, 17 nt, Human
uggcuuaaaacaacacu

SEQ ID NO: 1167750 - RNA, 23 nt, Human
uggcuucacggaagagccuugcg

SEQ ID NO: 1167751 - RNA, 14 nt, Human
aggcugggagagcc

SEQ ID NO: 1167752 - RNA, 16 nt, Human
aggcugggagagccuu

SEQ ID NO: 1167753 - RNA, 18 nt, Human
aggcuggcgugcaguggu

SEQ ID NO: 1167754 - RNA, 20 nt, Human
aggcuggcgugcaguggugc

SEQ ID NO: 1167755 - RNA, 14 nt, Human
uggcuaugcauuug

SEQ ID NO: 1167756 - RNA, 15 nt, Human
uggcuaugcauuuga

SEQ ID NO: 1167757 - RNA, 17 nt, Human
uggcuaugcauuugaaa

SEQ ID NO: 1167758 - RNA, 19 nt, Human
uggcuaugcauuugaaaau

SEQ ID NO: 1167759 - RNA, 22 nt, Human
uggcuauuagagaucaaccccu

SEQ ID NO: 1167760 - RNA, 18 nt, Human
uggcucaaguccucuuuu

SEQ ID NO: 1167761 - RNA, 20 nt, Human
uggcucuuccaggcugggag

SEQ ID NO: 1167762 - RNA, 21 nt, Human
uggcucuuccaggcugggaga

SEQ ID NO: 1167763 - RNA, 12 nt, Human
uggcugcaaagg

SEQ ID NO: 1167764 - RNA, 13 nt, Human
uggcugcagggag

SEQ ID NO: 1167765 - RNA, 14 nt, Human
uggcugcagggagu

SEQ ID NO: 1167766 - RNA, 15 nt, Human
uggcugcagggaguc

SEQ ID NO: 1167767 - RNA, 18 nt, Human
uggcugccaaugggagcu

SEQ ID NO: 1167768 - RNA, 20 nt, Human
uggcugccaaugggagcuca

SEQ ID NO: 1167769 - RNA, 23 nt, Human
uggcugcaaaggguaucaggugc

SEQ ID NO: 1167770 - RNA, 16 nt, Human
aggggauagagagaga

SEQ ID NO: 1167771 - RNA, 16 nt, Human
aggguaucaggugcug

SEQ ID NO: 1167772 - RNA, 18 nt, Human
aggguaucaggugcugcc

SEQ ID NO: 1167773 - RNA, 19 nt, Human
aggguacuaaggaaucuuu

SEQ ID NO: 1167774 - RNA, 14 nt, Human
uggguggaugccug

SEQ ID NO: 1167775 - RNA, 23 nt, Human
uggguggaugccugguggcagcu

SEQ ID NO: 1167776 - RNA, 21 nt, Human
uggucaccaaaucagcugcua

SEQ ID NO: 1167777 - RNA, 23 nt, Human
uggucaccaaaucagcugcuacu

SEQ ID NO: 1167778 - RNA, 15 nt, Human
ugguccauagagagc

SEQ ID NO: 1167779 - RNA, 16 nt, Human
ugguccauagagagca

SEQ ID NO: 1167780 - RNA, 13 nt, Human
uggucccacccca

SEQ ID NO: 1167781 - RNA, 22 nt, Human
ugguccaugggccauaugaaaa

SEQ ID NO: 1167782 - RNA, 19 nt, Human
ugguccauagagagcaaga

SEQ ID NO: 1167783 - RNA, 22 nt, Human
uggucugugagaugcuagaacu

SEQ ID NO: 1167784 - RNA, 12 nt, Human
uggucuguguga

SEQ ID NO: 1167785 - RNA, 19 nt, Human
uggugaacagaacaaaagg

SEQ ID NO: 1167786 - RNA, 18 nt, Human
aggguggugaccucugcc

SEQ ID NO: 1167787 - RNA, 19 nt, Human
aggguggugaccucugccu

SEQ ID NO: 1167788 - RNA, 21 nt, Human
aggguggugaccucugccuga

SEQ ID NO: 1167789 - RNA, 13 nt, Human
aggguuggccccu

SEQ ID NO: 1167790 - RNA, 14 nt, Human
aggguuggccccug

SEQ ID NO: 1167791 - RNA, 17 nt, Human
aggguuggccccugccc

SEQ ID NO: 1167792 - RNA, 15 nt, Human
aggguugggcuggug

SEQ ID NO: 1167793 - RNA, 20 nt, Human
aggucuugaacuccuggccu

SEQ ID NO: 1167794 - RNA, 21 nt, Human
aggucuugaacuccuggccuc

SEQ ID NO: 1167795 - RNA, 22 nt, Human
aggucuugaacuccuggccuca

SEQ ID NO: 1167796 - RNA, 15 nt, Human
aggucagugcaaaua

SEQ ID NO: 1167797 - RNA, 21 nt, Human
aggucaaggcugcagugagcc

SEQ ID NO: 1167798 - RNA, 22 nt, Human
aggucauuuuuuuuaagaaaaa

SEQ ID NO: 1167799 - RNA, 23 nt, Human
aggucauuuuuuuuaagaaaaag

SEQ ID NO: 1167800 - RNA, 17 nt, Human
agguaugcaaucaaauc

SEQ ID NO: 1167801 - RNA, 17 nt, Human
aggguugggcugguguc

SEQ ID NO: 1167802 - RNA, 20 nt, Human
aggguuuauguuuaggaugu

SEQ ID NO: 1167803 - RNA, 12 nt, Human
ugguggcagcug

SEQ ID NO: 1167804 - RNA, 13 nt, Human
ugguggcagcugc

SEQ ID NO: 1167805 - RNA, 15 nt, Human
ugguggcagagugga

SEQ ID NO: 1167806 - RNA, 12 nt, Human
ugguggcagcuc

SEQ ID NO: 1167807 - RNA, 16 nt, Human
ugguggcagcucaccu

SEQ ID NO: 1167808 - RNA, 19 nt, Human
ugguggcagcucaccucuc

SEQ ID NO: 1167809 - RNA, 20 nt, Human
ugguggcagcucaccucucc

SEQ ID NO: 1167810 - RNA, 23 nt, Human
ugguggcagcucaccucucccuu

SEQ ID NO: 1167811 - RNA, 15 nt, Human
ugguguuuccuggca

SEQ ID NO: 1167812 - RNA, 17 nt, Human
ugguguuuccuggcacu

SEQ ID NO: 1167813 - RNA, 20 nt, Human
ugguucaggguuggccccug

SEQ ID NO: 1167814 - RNA, 22 nt, Human
ugguucaggguuggccccugcc

SEQ ID NO: 1167815 - RNA, 23 nt, Human
ugguucaggguuggccccugccc

SEQ ID NO: 1167816 - RNA, 23 nt, Human
aggugauccacccaccucagccu

SEQ ID NO: 1167817 - RNA, 16 nt, Human
uguaaaggaauuuaaa

SEQ ID NO: 1167818 - RNA, 13 nt, Human
ugguuuucuguuc

SEQ ID NO: 1167819 - RNA, 15 nt, Human
ugguuuucuguucuu

SEQ ID NO: 1167820 - RNA, 23 nt, Human
uguaaagaaagagagaaaauaaa

SEQ ID NO: 1167821 - RNA, 14 nt, Human
ugguuucagaaaug

SEQ ID NO: 1167822 - RNA, 15 nt, Human
ugguuucagaaaugu

SEQ ID NO: 1167823 - RNA, 12 nt, Human
ugguuuucuguu

SEQ ID NO: 1167824 - RNA, 13 nt, Human
agguggggcagcu

SEQ ID NO: 1167825 - RNA, 14 nt, Human
agguggggcagcuu

SEQ ID NO: 1167826 - RNA, 16 nt, Human
agguggggcagcuuga

SEQ ID NO: 1167827 - RNA, 20 nt, Human
aggugugacugaauuucuuu

SEQ ID NO: 1167828 - RNA, 14 nt, Human
aggugugagucacc

SEQ ID NO: 1167829 - RNA, 20 nt, Human
aggugugagucaccaagccc

SEQ ID NO: 1167830 - RNA, 22 nt, Human
aggugugaaccaccacacccag

SEQ ID NO: 1167831 - RNA, 23 nt, Human
aggugugaaccaccacacccagc

SEQ ID NO: 1167832 - RNA, 18 nt, Human
aggugugacugaauuucu

SEQ ID NO: 1167833 - RNA, 18 nt, Human
uguaagaaaauaucacuu

SEQ ID NO: 1167834 - RNA, 13 nt, Human
uguaaggaaugau

SEQ ID NO: 1167835 - RNA, 14 nt, Human
uguaaggaaugauu

SEQ ID NO: 1167836 - RNA, 15 nt, Human
uguaaggaaugauua

SEQ ID NO: 1167837 - RNA, 17 nt, Human
uguacaugaaaacacau

SEQ ID NO: 1167838 - RNA, 18 nt, Human
uguacaugaaaacacauu

SEQ ID NO: 1167839 - RNA, 19 nt, Human
uguacaugaaaacacauuu

SEQ ID NO: 1167840 - RNA, 20 nt, Human
uguacaugaaaacacauuuu

SEQ ID NO: 1167841 - RNA, 18 nt, Human
uguaaggaaugauuaauu

SEQ ID NO: 1167842 - RNA, 16 nt, Human
uguaauuugugauaca

SEQ ID NO: 1167843 - RNA, 17 nt, Human
uguaauuugugauacaa

SEQ ID NO: 1167844 - RNA, 21 nt, Human
uguaauuugugauacaaugcu

SEQ ID NO: 1167845 - RNA, 19 nt, Human
uguacaaaguagaagucuu

SEQ ID NO: 1167846 - RNA, 23 nt, Human
uguacaaaguagaagucuuagau

SEQ ID NO: 1167847 - RNA, 14 nt, Human
ugucaaagugguga

SEQ ID NO: 1167848 - RNA, 15 nt, Human
ugucaaaguggugag

SEQ ID NO: 1167849 - RNA, 16 nt, Human
ugucaaaguggugaga

SEQ ID NO: 1167850 - RNA, 19 nt, Human
ugucaaaguggugagaggc

SEQ ID NO: 1167851 - RNA, 13 nt, Human
aguagcugggacu

SEQ ID NO: 1167852 - RNA, 14 nt, Human
aguagcugggacua

SEQ ID NO: 1167853 - RNA, 12 nt, Human
uguagagccagg

SEQ ID NO: 1167854 - RNA, 15 nt, Human
uguagagccaggguc

SEQ ID NO: 1167855 - RNA, 15 nt, Human
uguaucccaugagcc

SEQ ID NO: 1167856 - RNA, 16 nt, Human
uguaucccaugagccu

SEQ ID NO: 1167857 - RNA, 14 nt, Human
uguauguguaagua

SEQ ID NO: 1167858 - RNA, 15 nt, Human
aguauuguccagguc

SEQ ID NO: 1167859 - RNA, 16 nt, Human
aguauuguccaggucu

SEQ ID NO: 1167860 - RNA, 20 nt, Human
agucacauuccaagccucau

SEQ ID NO: 1167861 - RNA, 15 nt, Human
agucacugagacagc

SEQ ID NO: 1167862 - RNA, 16 nt, Human
agucacugagacagcc

SEQ ID NO: 1167863 - RNA, 17 nt, Human
agucacugagacagccc

SEQ ID NO: 1167864 - RNA, 15 nt, Human
ugucagcauagaagu

SEQ ID NO: 1167865 - RNA, 15 nt, Human
aguauuauaccuuuu

SEQ ID NO: 1167866 - RNA, 14 nt, Human
aguauuauaccuuu

SEQ ID NO: 1167867 - RNA, 19 nt, Human
aguagcugggacuacaggc

SEQ ID NO: 1167868 - RNA, 21 nt, Human
aguagcugggacuacaggcac

SEQ ID NO: 1167869 - RNA, 22 nt, Human
aguagcugggacuacaggcacc

SEQ ID NO: 1167870 - RNA, 18 nt, Human
aguauguuagugcaaauu

SEQ ID NO: 1167871 - RNA, 21 nt, Human
aguauguuagugcaaauuguc

SEQ ID NO: 1167872 - RNA, 16 nt, Human
ugucagccauuccugu

SEQ ID NO: 1167873 - RNA, 18 nt, Human
agucacugagacagcccg

SEQ ID NO: 1167874 - RNA, 14 nt, Human
ugucccugcacuug

SEQ ID NO: 1167875 - RNA, 12 nt, Human
ugucccuuuucc

SEQ ID NO: 1167876 - RNA, 17 nt, Human
ugucccuuuuccuuuuu

SEQ ID NO: 1167877 - RNA, 21 nt, Human
agucccaccuuggcugcaggg

SEQ ID NO: 1167878 - RNA, 23 nt, Human
agucccaccuuggcugcagggag

SEQ ID NO: 1167879 - RNA, 14 nt, Human
aguccccuguuugu

SEQ ID NO: 1167880 - RNA, 19 nt, Human
aguccccuguuuguuucug

SEQ ID NO: 1167881 - RNA, 14 nt, Human
ugugaagcaaaauu

SEQ ID NO: 1167882 - RNA, 19 nt, Human
ugugagcacaaagguagcu

SEQ ID NO: 1167883 - RNA, 11 nt, Human
agugaaaaagg

SEQ ID NO: 1167884 - RNA, 17 nt, Human
agugaaaaaggaggaag

SEQ ID NO: 1167885 - RNA, 20 nt, Human
agugaaaaaggaggaagaga

SEQ ID NO: 1167886 - RNA, 23 nt, Human
agugaaaaaggaggaagagaaaa

SEQ ID NO: 1167887 - RNA, 21 nt, Human
agugagcagucaggaaagaga

SEQ ID NO: 1167888 - RNA, 14 nt, Human
agugagagcugggu

SEQ ID NO: 1167889 - RNA, 16 nt, Human
agugagccgagauugu

SEQ ID NO: 1167890 - RNA, 15 nt, Human
ugugauggggcccug

SEQ ID NO: 1167891 - RNA, 16 nt, Human
ugugauggggcccugc

SEQ ID NO: 1167892 - RNA, 17 nt, Human
ugugauggggcccugcc

SEQ ID NO: 1167893 - RNA, 18 nt, Human
ugugauggggcccugccu

SEQ ID NO: 1167894 - RNA, 20 nt, Human
agugaaacucguuaauuugu

SEQ ID NO: 1167895 - RNA, 14 nt, Human
agugagacagcucu

SEQ ID NO: 1167896 - RNA, 17 nt, Human
agugagacccugucuca

SEQ ID NO: 1167897 - RNA, 21 nt, Human
agugagacccugucucaaaaa

SEQ ID NO: 1167898 - RNA, 13 nt, Human
agugagacucugu

SEQ ID NO: 1167899 - RNA, 16 nt, Human
agugagacucugucuc

SEQ ID NO: 1167900 - RNA, 17 nt, Human
agugagacucugucuca

SEQ ID NO: 1167901 - RNA, 22 nt, Human
agugagacucugucucaaaaaa

SEQ ID NO: 1167902 - RNA, 23 nt, Human
aguccccuguuuguuucugaaag

SEQ ID NO: 1167903 - RNA, 13 nt, Human
agucccugccaau

SEQ ID NO: 1167904 - RNA, 14 nt, Human
agucccugccaaug

SEQ ID NO: 1167905 - RNA, 16 nt, Human
agucccugccaaugga

SEQ ID NO: 1167906 - RNA, 17 nt, Human
ugucucuacuaaaaaua

SEQ ID NO: 1167907 - RNA, 13 nt, Human
ugucucugagagu

SEQ ID NO: 1167908 - RNA, 18 nt, Human
ugucucuugguccugcug

SEQ ID NO: 1167909 - RNA, 19 nt, Human
ugucucuugguccugcugc

SEQ ID NO: 1167910 - RNA, 20 nt, Human
ugucucuugguccugcugca

SEQ ID NO: 1167911 - RNA, 21 nt, Human
ugucucuugguccugcugcag

SEQ ID NO: 1167912 - RNA, 22 nt, Human
ugucucuugguccugcugcagu

SEQ ID NO: 1167913 - RNA, 21 nt, Human
ugucucuuuaaugucacaggc

SEQ ID NO: 1167914 - RNA, 22 nt, Human
ugucucuuuaaugucacaggca

SEQ ID NO: 1167915 - RNA, 15 nt, Human
ugucuugcaauggca

SEQ ID NO: 1167916 - RNA, 17 nt, Human
ugucuugcaauggcagc

SEQ ID NO: 1167917 - RNA, 18 nt, Human
ugucuugcaauggcagcc

SEQ ID NO: 1167918 - RNA, 20 nt, Human
ugucuugcaauggcagccuu

SEQ ID NO: 1167919 - RNA, 21 nt, Human
ugucuugcaauggcagccuug

SEQ ID NO: 1167920 - RNA, 17 nt, Human
ugucuuuaaaugcugcu

SEQ ID NO: 1167921 - RNA, 15 nt, Human
ugugaaccaccacac

SEQ ID NO: 1167922 - RNA, 16 nt, Human
ugugaaccaccacacc

SEQ ID NO: 1167923 - RNA, 17 nt, Human
ugugaaccaccacaccc

SEQ ID NO: 1167924 - RNA, 22 nt, Human
ugugaaccaccacacccagccc

SEQ ID NO: 1167925 - RNA, 23 nt, Human
ugugaaccaccacacccagccca

SEQ ID NO: 1167926 - RNA, 23 nt, Human
aguguacauggaauaacauguaa

SEQ ID NO: 1167927 - RNA, 13 nt, Human
uguucugggacac

SEQ ID NO: 1167928 - RNA, 14 nt, Human
uguucugggacaca

SEQ ID NO: 1167929 - RNA, 15 nt, Human
uguucugggacacag

SEQ ID NO: 1167930 - RNA, 14 nt, Human
uguucuuaauucuu

SEQ ID NO: 1167931 - RNA, 16 nt, Human
uguucuuaauucuuag

SEQ ID NO: 1167932 - RNA, 17 nt, Human
uguucuugguuuguaaa

SEQ ID NO: 1167933 - RNA, 18 nt, Human
uguucuugguuuguaaau

SEQ ID NO: 1167934 - RNA, 19 nt, Human
uguucuugguuuguaaauu

SEQ ID NO: 1167935 - RNA, 13 nt, Human
uguucuuuccaaa

SEQ ID NO: 1167936 - RNA, 14 nt, Human
uguucuuuccaaag

SEQ ID NO: 1167937 - RNA, 21 nt, Human
aguguacauggaauaacaugu

SEQ ID NO: 1167938 - RNA, 22 nt, Human
aguguacauggaauaacaugua

SEQ ID NO: 1167939 - RNA, 19 nt, Human
agugggugaauaauacagu

SEQ ID NO: 1167940 - RNA, 16 nt, Human
aguggugcgaucuggg

SEQ ID NO: 1167941 - RNA, 21 nt, Human
agugguuccuaauccucuagg

SEQ ID NO: 1167942 - RNA, 12 nt, Human
aguggcagcugc

SEQ ID NO: 1167943 - RNA, 13 nt, Human
aguggcagcugcu

SEQ ID NO: 1167944 - RNA, 14 nt, Human
aguggcagcugcuu

SEQ ID NO: 1167945 - RNA, 20 nt, Human
aguggcagcugcuuuugucu

SEQ ID NO: 1167946 - RNA, 19 nt, Human
agugggggaguggccacag

SEQ ID NO: 1167947 - RNA, 20 nt, Human
agugggggaguggccacaga

SEQ ID NO: 1167948 - RNA, 18 nt, Human
agugggggaucacagccu

SEQ ID NO: 1167949 - RNA, 13 nt, Human
agugggugaauaa

SEQ ID NO: 1167950 - RNA, 18 nt, Human
agugggugaauaauacag

SEQ ID NO: 1167951 - RNA, 21 nt, Human
aguuauuuuuauuuauuuaaa

SEQ ID NO: 1167952 - RNA, 13 nt, Human
uguugucagcuga

SEQ ID NO: 1167953 - RNA, 13 nt, Human
uguugggccagga

SEQ ID NO: 1167954 - RNA, 16 nt, Human
uguugggccaggagcc

SEQ ID NO: 1167955 - RNA, 20 nt, Human
aguuauuauauuuacaaaug

SEQ ID NO: 1167956 - RNA, 18 nt, Human
uguucuuuccaaaguaca

SEQ ID NO: 1167957 - RNA, 20 nt, Human
uguucuuuccaaaguacacu

SEQ ID NO: 1167958 - RNA, 17 nt, Human
uuaaaccgccaaggcug

SEQ ID NO: 1167959 - RNA, 13 nt, Human
uuaaauaaaucau

SEQ ID NO: 1167960 - RNA, 15 nt, Human
uuaaauaaaucauaa

SEQ ID NO: 1167961 - RNA, 20 nt, Human
uuaaauaaugugaaacugga

SEQ ID NO: 1167962 - RNA, 21 nt, Human
uuaaauaaugugaaacuggau

SEQ ID NO: 1167963 - RNA, 22 nt, Human
uuaaauaaugugaaacuggauu

SEQ ID NO: 1167964 - RNA, 20 nt, Human
aguugccagucaccccggcc

SEQ ID NO: 1167965 - RNA, 15 nt, Human
uuaaaaaagaaacau

SEQ ID NO: 1167966 - RNA, 18 nt, Human
uuaaaaaagaaacauuug

SEQ ID NO: 1167967 - RNA, 19 nt, Human
uuaaaaaagaaacauuugg

SEQ ID NO: 1167968 - RNA, 18 nt, Human
uuaaaaaguggaaaaaua

SEQ ID NO: 1167969 - RNA, 17 nt, Human
uuaaaacaacacucaca

SEQ ID NO: 1167970 - RNA, 21 nt, Human
aguuucuccaagcaggacaug

SEQ ID NO: 1167971 - RNA, 13 nt, Human
aguuucuccaagc

SEQ ID NO: 1167972 - RNA, 15 nt, Human
aguuucuccaagcag

SEQ ID NO: 1167973 - RNA, 13 nt, Human
uuaaauucuugca

SEQ ID NO: 1167974 - RNA, 16 nt, Human
uuaaauucuugcaaag

SEQ ID NO: 1167975 - RNA, 20 nt, Human
uuaaauucuugcaaaguauc

SEQ ID NO: 1167976 - RNA, 22 nt, Human
aguuuucacucuuauugcccac

SEQ ID NO: 1167977 - RNA, 13 nt, Human
aguucucuccuuc

SEQ ID NO: 1167978 - RNA, 16 nt, Human
aguucucuccuucuuc

SEQ ID NO: 1167979 - RNA, 15 nt, Human
uguuuucucuugaga

SEQ ID NO: 1167980 - RNA, 17 nt, Human
uguuuucaguguacaug

SEQ ID NO: 1167981 - RNA, 13 nt, Human
uguuuuauaauuu

SEQ ID NO: 1167982 - RNA, 20 nt, Human
uguuuuauaauuuugugaag

SEQ ID NO: 1167983 - RNA, 15 nt, Human
uguuuucaguguaca

SEQ ID NO: 1167984 - RNA, 14 nt, Human
uguugucagcugaa

SEQ ID NO: 1167985 - RNA, 14 nt, Human
uguuugccucugcc

SEQ ID NO: 1167986 - RNA, 16 nt, Human
uguuugccucugccuc

SEQ ID NO: 1167987 - RNA, 15 nt, Human
uguuugcuaagcauu

SEQ ID NO: 1167988 - RNA, 19 nt, Human
uguuugcuaagcauuccaa

SEQ ID NO: 1167989 - RNA, 15 nt, Human
uguuuggggaugaga

SEQ ID NO: 1167990 - RNA, 19 nt, Human
uguuuggggaugagaaagg

SEQ ID NO: 1167991 - RNA, 13 nt, Human
aguucugaagaag

SEQ ID NO: 1167992 - RNA, 14 nt, Human
aguucugaagaaga

SEQ ID NO: 1167993 - RNA, 15 nt, Human
aguucugaagaagau

SEQ ID NO: 1167994 - RNA, 16 nt, Human
aguucugaagaagaug

SEQ ID NO: 1167995 - RNA, 15 nt, Human
aguugauagcacaga

SEQ ID NO: 1167996 - RNA, 19 nt, Human
aguugauagcacagacccu

SEQ ID NO: 1167997 - RNA, 20 nt, Human
aguugauagcacagacccug

SEQ ID NO: 1167998 - RNA, 21 nt, Human
aguugauagcacagacccugc

SEQ ID NO: 1167999 - RNA, 22 nt, Human
aguugauagcacagacccugcc

SEQ ID NO: 1168000 - RNA, 23 nt, Human
aguugauagcacagacccugccc

SEQ ID NO: 1168001 - RNA, 21 nt, Human
aguugauaugccuuuucccaa

SEQ ID NO: 1168002 - RNA, 13 nt, Human
aguugauucagcu

SEQ ID NO: 1168003 - RNA, 14 nt, Human
aguugauucagcuc

SEQ ID NO: 1168004 - RNA, 15 nt, Human
aguugauucagcucu

SEQ ID NO: 1168005 - RNA, 17 nt, Human
aguugauucagcucugc

SEQ ID NO: 1168006 - RNA, 18 nt, Human
aguugauucagcucugca

SEQ ID NO: 1168007 - RNA, 23 nt, Human
aguugauucagcucugcaagaau

SEQ ID NO: 1168008 - RNA, 18 nt, Human
uuauauaagcuuguauuc

SEQ ID NO: 1168009 - RNA, 13 nt, Human
auaauuuugugaa

SEQ ID NO: 1168010 - RNA, 14 nt, Human
auaauuuugugaag

SEQ ID NO: 1168011 - RNA, 15 nt, Human
auaauuuugugaagc

SEQ ID NO: 1168012 - RNA, 20 nt, Human
auaauuuugugaagcaaaau

SEQ ID NO: 1168013 - RNA, 14 nt, Human
auaauuuuuauauu

SEQ ID NO: 1168014 - RNA, 16 nt, Human
auaauuuuuauauuug

SEQ ID NO: 1168015 - RNA, 19 nt, Human
auaauuuuuauauuugaaa

SEQ ID NO: 1168016 - RNA, 21 nt, Human
auaauuuuuauauuugaaaua

SEQ ID NO: 1168017 - RNA, 22 nt, Human
auaauuuuuauauuugaaauau

SEQ ID NO: 1168018 - RNA, 22 nt, Human
auacaaaaaaaaaaaaaaauua

SEQ ID NO: 1168019 - RNA, 12 nt, Human
auacaaaagcau

SEQ ID NO: 1168020 - RNA, 13 nt, Human
auacaaaagcaug

SEQ ID NO: 1168021 - RNA, 15 nt, Human
auacaaaagcaugug

SEQ ID NO: 1168022 - RNA, 22 nt, Human
auaccacaggaaccacaagacu

SEQ ID NO: 1168023 - RNA, 19 nt, Human
auaccagccaguaaauggg

SEQ ID NO: 1168024 - RNA, 21 nt, Human
auacuaaccagcagaaaugcc

SEQ ID NO: 1168025 - RNA, 13 nt, Human
auacuacaguuug

SEQ ID NO: 1168026 - RNA, 15 nt, Human
auacuacaguuuguu

SEQ ID NO: 1168027 - RNA, 16 nt, Human
auacuacaguuuguua

SEQ ID NO: 1168028 - RNA, 20 nt, Human
auacuacaguuuguuaguau

SEQ ID NO: 1168029 - RNA, 16 nt, Human
auacauuugauaaagu

SEQ ID NO: 1168030 - RNA, 20 nt, Human
auacaucccuuaccugggaa

SEQ ID NO: 1168031 - RNA, 20 nt, Human
auacauaaacaagaccacgu

SEQ ID NO: 1168032 - RNA, 14 nt, Human
auacaggaaaagcu

SEQ ID NO: 1168033 - RNA, 19 nt, Human
auacaggaaaagcugcuga

SEQ ID NO: 1168034 - RNA, 20 nt, Human
auacaggaaaagcugcugac

SEQ ID NO: 1168035 - RNA, 22 nt, Human
auacaggaaaagcugcugacag

SEQ ID NO: 1168036 - RNA, 14 nt, Human
auaaugaauacuuu

SEQ ID NO: 1168037 - RNA, 15 nt, Human
auaaugaaugaaaca

SEQ ID NO: 1168038 - RNA, 14 nt, Human
auaauucuacuuug

SEQ ID NO: 1168039 - RNA, 19 nt, Human
auaauacaguaucucaggg

SEQ ID NO: 1168040 - RNA, 23 nt, Human
uuagaugcaguucugaagaagau

SEQ ID NO: 1168041 - RNA, 12 nt, Human
uuaccugggaaa

SEQ ID NO: 1168042 - RNA, 22 nt, Human
auaagaaccuuuugagugccuu

SEQ ID NO: 1168043 - RNA, 23 nt, Human
auaagaaccuuuugagugccuua

SEQ ID NO: 1168044 - RNA, 17 nt, Human
auaaguuaacuuccaau

SEQ ID NO: 1168045 - RNA, 22 nt, Human
auaaguuaacuuccaauuuaca

SEQ ID NO: 1168046 - RNA, 23 nt, Human
auaauacaccacuacauucuguu

SEQ ID NO: 1168047 - RNA, 13 nt, Human
auaaacuuuaccu

SEQ ID NO: 1168048 - RNA, 15 nt, Human
auaaacuuuaccuuu

SEQ ID NO: 1168049 - RNA, 16 nt, Human
auaaacuuuaccuuuu

SEQ ID NO: 1168050 - RNA, 20 nt, Human
auaaccaguguuguggauuu

SEQ ID NO: 1168051 - RNA, 12 nt, Human
auaacuggaaac

SEQ ID NO: 1168052 - RNA, 16 nt, Human
uuacaggaaguacugg

SEQ ID NO: 1168053 - RNA, 18 nt, Human
uuacaggaaguacuggag

SEQ ID NO: 1168054 - RNA, 22 nt, Human
uuacaggaaguacuggagaaaa

SEQ ID NO: 1168055 - RNA, 23 nt, Human
uuaccauuuugggguacccacug

SEQ ID NO: 1168056 - RNA, 14 nt, Human
uucaggguuggccc

SEQ ID NO: 1168057 - RNA, 16 nt, Human
uucaggguuggccccu

SEQ ID NO: 1168058 - RNA, 17 nt, Human
uucaggguuggccccug

SEQ ID NO: 1168059 - RNA, 19 nt, Human
uucaggguuggccccugcc

SEQ ID NO: 1168060 - RNA, 22 nt, Human
uucaggguuggccccugcccgg

SEQ ID NO: 1168061 - RNA, 15 nt, Human
uucagguaacaggca

SEQ ID NO: 1168062 - RNA, 16 nt, Human
uucagguaacaggcag

SEQ ID NO: 1168063 - RNA, 14 nt, Human
uucagccaagaauu

SEQ ID NO: 1168064 - RNA, 20 nt, Human
uucagccugccuucuuuucu

SEQ ID NO: 1168065 - RNA, 17 nt, Human
uucagcgguuuauauaa

SEQ ID NO: 1168066 - RNA, 16 nt, Human
uucagaaauguguuau

SEQ ID NO: 1168067 - RNA, 13 nt, Human
auauaugcuaagu

SEQ ID NO: 1168068 - RNA, 15 nt, Human
uucaucaaugaauga

SEQ ID NO: 1168069 - RNA, 18 nt, Human
uucaucauccuaagcuau

SEQ ID NO: 1168070 - RNA, 21 nt, Human
auauauguuuuaagaggcagg

SEQ ID NO: 1168071 - RNA, 22 nt, Human
auauauguuuuaagaggcaggg

SEQ ID NO: 1168072 - RNA, 16 nt, Human
uucagugccaaaaaca

SEQ ID NO: 1168073 - RNA, 17 nt, Human
uucagguaacaggcaga

SEQ ID NO: 1168074 - RNA, 14 nt, Human
uucaguaagccgug

SEQ ID NO: 1168075 - RNA, 18 nt, Human
uuccaccaucaagccacc

SEQ ID NO: 1168076 - RNA, 21 nt, Human
uuccacaagagcccaggccuc

SEQ ID NO: 1168077 - RNA, 22 nt, Human
uuccacaagagcccaggccucc

SEQ ID NO: 1168078 - RNA, 15 nt, Human
uuccaggcugggaga

SEQ ID NO: 1168079 - RNA, 17 nt, Human
uuccaggcugggagagc

SEQ ID NO: 1168080 - RNA, 17 nt, Human
uuccaggggugggacac

SEQ ID NO: 1168081 - RNA, 18 nt, Human
uuccagguuuaagcuguu

SEQ ID NO: 1168082 - RNA, 22 nt, Human
uuccaauuuacauacucugcuu

SEQ ID NO: 1168083 - RNA, 23 nt, Human
auauguaccuaacgaaguauccu

SEQ ID NO: 1168084 - RNA, 20 nt, Human
auauguggaguucaucuuga

SEQ ID NO: 1168085 - RNA, 21 nt, Human
auauguggaguucaucuugaa

SEQ ID NO: 1168086 - RNA, 15 nt, Human
uuccagugaggcucu

SEQ ID NO: 1168087 - RNA, 16 nt, Human
uuccagugaggcucug

SEQ ID NO: 1168088 - RNA, 17 nt, Human
uuccagugaggcucugc

SEQ ID NO: 1168089 - RNA, 16 nt, Human
auauuaagaaagacua

SEQ ID NO: 1168090 - RNA, 17 nt, Human
auauuaagaaagacuau

SEQ ID NO: 1168091 - RNA, 22 nt, Human
auauuaagaaagacuaucuaaa

SEQ ID NO: 1168092 - RNA, 17 nt, Human
auauuaccacagacaua

SEQ ID NO: 1168093 - RNA, 19 nt, Human
auauuaccacagacauacu

SEQ ID NO: 1168094 - RNA, 15 nt, Human
auauugauaugcuua

SEQ ID NO: 1168095 - RNA, 22 nt, Human
auauugcugauggugcaaugac

SEQ ID NO: 1168096 - RNA, 13 nt, Human
auauuuacaaaug

SEQ ID NO: 1168097 - RNA, 14 nt, Human
auauuguuugcuaa

SEQ ID NO: 1168098 - RNA, 13 nt, Human
auauuguuuucag

SEQ ID NO: 1168099 - RNA, 17 nt, Human
auauuguuuucagugua

SEQ ID NO: 1168100 - RNA, 22 nt, Human
uuccucuuuuuauuuaguuccu

SEQ ID NO: 1168101 - RNA, 20 nt, Human
uuccuggcacugcuuccagu

SEQ ID NO: 1168102 - RNA, 22 nt, Human
uuccuggcacugcuuccaguga

SEQ ID NO: 1168103 - RNA, 21 nt, Human
aucaacugcaucaagauguga

SEQ ID NO: 1168104 - RNA, 21 nt, Human
aucaaggguacacugccuucu

SEQ ID NO: 1168105 - RNA, 13 nt, Human
aucaauuuaaaaa

SEQ ID NO: 1168106 - RNA, 15 nt, Human
aucacgccacugcac

SEQ ID NO: 1168107 - RNA, 17 nt, Human
aucacgccacugcacua

SEQ ID NO: 1168108 - RNA, 19 nt, Human
aucagucugauucccaagc

SEQ ID NO: 1168109 - RNA, 23 nt, Human
aucacuugaacccgggaggcaga

SEQ ID NO: 1168110 - RNA, 15 nt, Human
aucaggugcugccau

SEQ ID NO: 1168111 - RNA, 17 nt, Human
aucaggugcugccaucc

SEQ ID NO: 1168112 - RNA, 19 nt, Human
aucaggugcugccauccag

SEQ ID NO: 1168113 - RNA, 15 nt, Human
aucauaaaacuugau

SEQ ID NO: 1168114 - RNA, 21 nt, Human
aucauccacugugccaugugc

SEQ ID NO: 1168115 - RNA, 23 nt, Human
aucauccacugugccaugugcca

SEQ ID NO: 1168116 - RNA, 16 nt, Human
aucauuaggugugacu

SEQ ID NO: 1168117 - RNA, 21 nt, Human
uucucuaguuugauuaaauuc

SEQ ID NO: 1168118 - RNA, 12 nt, Human
aucauugaaauc

SEQ ID NO: 1168119 - RNA, 13 nt, Human
aucauugaaaucu

SEQ ID NO: 1168120 - RNA, 17 nt, Human
auccagguucagcuugu

SEQ ID NO: 1168121 - RNA, 14 nt, Human
auccaguaucuuga

SEQ ID NO: 1168122 - RNA, 15 nt, Human
auccaguaucuugaa

SEQ ID NO: 1168123 - RNA, 15 nt, Human
uucugccugcccagg

SEQ ID NO: 1168124 - RNA, 16 nt, Human
uucugccugcccaggc

SEQ ID NO: 1168125 - RNA, 17 nt, Human
uucugccugcccaggcc

SEQ ID NO: 1168126 - RNA, 11 nt, Human
aucccagcccc

SEQ ID NO: 1168127 - RNA, 12 nt, Human
aucccagcccca

SEQ ID NO: 1168128 - RNA, 16 nt, Human
aucccaugagccucag

SEQ ID NO: 1168129 - RNA, 17 nt, Human
aucccaugagccucagc

SEQ ID NO: 1168130 - RNA, 18 nt, Human
aucccaugagccucagca

SEQ ID NO: 1168131 - RNA, 17 nt, Human
aucccugaaggccccgc

SEQ ID NO: 1168132 - RNA, 22 nt, Human
aucccugaaggccccgcccagg

SEQ ID NO: 1168133 - RNA, 13 nt, Human
uucuguuuagaua

SEQ ID NO: 1168134 - RNA, 18 nt, Human
uucuguuuagauaauaca

SEQ ID NO: 1168135 - RNA, 16 nt, Human
uucuguuuuauaauuu

SEQ ID NO: 1168136 - RNA, 17 nt, Human
uucuguuuuauaauuuu

SEQ ID NO: 1168137 - RNA, 22 nt, Human
uucuucuccacuuucuagccag

SEQ ID NO: 1168138 - RNA, 11 nt, Human
uucuucucccu

SEQ ID NO: 1168139 - RNA, 12 nt, Human
uucuuucuggcu

SEQ ID NO: 1168140 - RNA, 17 nt, Human
uucuuucuggcuaugca

SEQ ID NO: 1168141 - RNA, 20 nt, Human
uucuuucuggcuaugcauuu

SEQ ID NO: 1168142 - RNA, 22 nt, Human
uucuuucuggcuaugcauuuga

SEQ ID NO: 1168143 - RNA, 15 nt, Human
aucuaaauguugaaa

SEQ ID NO: 1168144 - RNA, 14 nt, Human
aucgucacugcuua

SEQ ID NO: 1168145 - RNA, 18 nt, Human
aucgucacugcuuaacuu

SEQ ID NO: 1168146 - RNA, 14 nt, Human
aucgugacaacacu

SEQ ID NO: 1168147 - RNA, 15 nt, Human
aucgugacaacacuu

SEQ ID NO: 1168148 - RNA, 17 nt, Human
uugacacuuaaaaaugg

SEQ ID NO: 1168149 - RNA, 15 nt, Human
uugagaucagccugg

SEQ ID NO: 1168150 - RNA, 16 nt, Human
uugaggucuguucuuu

SEQ ID NO: 1168151 - RNA, 12 nt, Human
uugauaaaguaa

SEQ ID NO: 1168152 - RNA, 24 nt, Human
uugaccauucuccaccugccaggg

SEQ ID NO: 1168153 - RNA, 14 nt, Human
uugacccacaagaa

SEQ ID NO: 1168154 - RNA, 19 nt, Human
uugacacuuaaaaaugguu

SEQ ID NO: 1168155 - RNA, 13 nt, Human
uugacaucaacug

SEQ ID NO: 1168156 - RNA, 18 nt, Human
uugaccauucuccaccug

SEQ ID NO: 1168157 - RNA, 19 nt, Human
uugaccauucuccaccugc

SEQ ID NO: 1168158 - RNA, 15 nt, Human
auccuggaguucugg

SEQ ID NO: 1168159 - RNA, 17 nt, Human
auccuggcacccggccc

SEQ ID NO: 1168160 - RNA, 19 nt, Human
auccuggcacccggccccu

SEQ ID NO: 1168161 - RNA, 20 nt, Human
auccuggcacccggccccug

SEQ ID NO: 1168162 - RNA, 21 nt, Human
auccuggcacccggccccugc

SEQ ID NO: 1168163 - RNA, 22 nt, Human
auccuggcacccggccccugcu

SEQ ID NO: 1168164 - RNA, 23 nt, Human
auccuggcacccggccccugcug

SEQ ID NO: 1168165 - RNA, 20 nt, Human
auccuggcugucgagaaaca

SEQ ID NO: 1168166 - RNA, 20 nt, Human
auccucuguacagagcccac

SEQ ID NO: 1168167 - RNA, 20 nt, Human
uucuuuugccguuauuaaaa

SEQ ID NO: 1168168 - RNA, 17 nt, Human
auccucuuugagugaag

SEQ ID NO: 1168169 - RNA, 11 nt, Human
auccugagcca

SEQ ID NO: 1168170 - RNA, 12 nt, Human
auccugagccag

SEQ ID NO: 1168171 - RNA, 13 nt, Human
auccugagccaga

SEQ ID NO: 1168172 - RNA, 14 nt, Human
auccugagccagau

SEQ ID NO: 1168173 - RNA, 15 nt, Human
auccugagccagauu

SEQ ID NO: 1168174 - RNA, 17 nt, Human
auccugagccagauuuc

SEQ ID NO: 1168175 - RNA, 21 nt, Human
auccugagccagauuucacuc

SEQ ID NO: 1168176 - RNA, 11 nt, Human
auccugaggcu

SEQ ID NO: 1168177 - RNA, 13 nt, Human
auccugaggcucc

SEQ ID NO: 1168178 - RNA, 16 nt, Human
auccugaggcuccacu

SEQ ID NO: 1168179 - RNA, 18 nt, Human
auccugaggcuccacuug

SEQ ID NO: 1168180 - RNA, 22 nt, Human
auccugaggcuccacuuggucu

SEQ ID NO: 1168181 - RNA, 16 nt, Human
auccugcaauuccacu

SEQ ID NO: 1168182 - RNA, 13 nt, Human
auccugccccuga

SEQ ID NO: 1168183 - RNA, 20 nt, Human
augaaagacuguacaaagua

SEQ ID NO: 1168184 - RNA, 21 nt, Human
augaaauauuauguuaaaacu

SEQ ID NO: 1168185 - RNA, 14 nt, Human
augaaaugagguca

SEQ ID NO: 1168186 - RNA, 22 nt, Human
uuggcgcugccccuggcagccc

SEQ ID NO: 1168187 - RNA, 16 nt, Human
uuggcugcugaaggcu

SEQ ID NO: 1168188 - RNA, 18 nt, Human
uuggaaagaguaggaaga

SEQ ID NO: 1168189 - RNA, 23 nt, Human
uuggaaagaguaggaagacuuug

SEQ ID NO: 1168190 - RNA, 21 nt, Human
uuggcuagagguucaaagaua

SEQ ID NO: 1168191 - RNA, 22 nt, Human
uuggcuagagguucaaagauau

SEQ ID NO: 1168192 - RNA, 22 nt, Human
uuggcuaggaccccuccaugug

SEQ ID NO: 1168193 - RNA, 23 nt, Human
uuggcuauuagagaucaaccccu

SEQ ID NO: 1168194 - RNA, 14 nt, Human
uuggcugcagggag

SEQ ID NO: 1168195 - RNA, 11 nt, Human
uuggcugcuga

SEQ ID NO: 1168196 - RNA, 15 nt, Human
uuggcugcugaaggc

SEQ ID NO: 1168197 - RNA, 17 nt, Human
uugcugauggugcaaug

SEQ ID NO: 1168198 - RNA, 18 nt, Human
uugcugauggugcaauga

SEQ ID NO: 1168199 - RNA, 19 nt, Human
uugcugauggugcaaugac

SEQ ID NO: 1168200 - RNA, 17 nt, Human
uuggaaagaguaggaag

SEQ ID NO: 1168201 - RNA, 20 nt, Human
uugcuaagugaggaugaaaa

SEQ ID NO: 1168202 - RNA, 11 nt, Human
uugcucaugga

SEQ ID NO: 1168203 - RNA, 12 nt, Human
uugcucauggaa

SEQ ID NO: 1168204 - RNA, 19 nt, Human
uugcugaauacagaggcaa

SEQ ID NO: 1168205 - RNA, 14 nt, Human
uuguaaggaaugau

SEQ ID NO: 1168206 - RNA, 22 nt, Human
uugggguacccacugcucuggu

SEQ ID NO: 1168207 - RNA, 19 nt, Human
uugguuaggcauuguggga

SEQ ID NO: 1168208 - RNA, 13 nt, Human
augaaccacaucu

SEQ ID NO: 1168209 - RNA, 20 nt, Human
augaaccacaucuugcucug

SEQ ID NO: 1168210 - RNA, 22 nt, Human
augaaccacaucuugcucugcu

SEQ ID NO: 1168211 - RNA, 18 nt, Human
augaauuacauuuguaua

SEQ ID NO: 1168212 - RNA, 19 nt, Human
augaauuacauuuguauaa

SEQ ID NO: 1168213 - RNA, 22 nt, Human
augaauuacauuuguauaaaau

SEQ ID NO: 1168214 - RNA, 19 nt, Human
uuggggaagaacgaagcca

SEQ ID NO: 1168215 - RNA, 17 nt, Human
uugggguacccacugcu

SEQ ID NO: 1168216 - RNA, 19 nt, Human
augacacgaauauugcuga

SEQ ID NO: 1168217 - RNA, 20 nt, Human
augacacgaauauugcugau

SEQ ID NO: 1168218 - RNA, 21 nt, Human
augaauuaguuuuauaugcuu

SEQ ID NO: 1168219 - RNA, 23 nt, Human
augaauuaguuuuauaugcuucu

SEQ ID NO: 1168220 - RNA, 20 nt, Human
uuguaaggaaugauuaauua

SEQ ID NO: 1168221 - RNA, 13 nt, Human
uuguauaaaauaa

SEQ ID NO: 1168222 - RNA, 15 nt, Human
uuguauaaaauaauu

SEQ ID NO: 1168223 - RNA, 15 nt, Human
augaucuaggaagac

SEQ ID NO: 1168224 - RNA, 14 nt, Human
augaucuucuuuau

SEQ ID NO: 1168225 - RNA, 23 nt, Human
augaucacggcucacugcagccu

SEQ ID NO: 1168226 - RNA, 16 nt, Human
augauccuaggcauuu

SEQ ID NO: 1168227 - RNA, 15 nt, Human
augaucacggcucac

SEQ ID NO: 1168228 - RNA, 18 nt, Human
augaucacggcucacugc

SEQ ID NO: 1168229 - RNA, 19 nt, Human
augaucacggcucacugca

SEQ ID NO: 1168230 - RNA, 18 nt, Human
uugugaagcaaaauuuuu

SEQ ID NO: 1168231 - RNA, 19 nt, Human
augcaccuggaauauauaa

SEQ ID NO: 1168232 - RNA, 15 nt, Human
augaucuucuuuaua

SEQ ID NO: 1168233 - RNA, 18 nt, Human
augaucuucuuuauaauu

SEQ ID NO: 1168234 - RNA, 16 nt, Human
augcaaaccaucauug

SEQ ID NO: 1168235 - RNA, 18 nt, Human
augcaaaccaucauugaa

SEQ ID NO: 1168236 - RNA, 19 nt, Human
augcaaaccaucauugaaa

SEQ ID NO: 1168237 - RNA, 20 nt, Human
augcaaaccaucauugaaau

SEQ ID NO: 1168238 - RNA, 21 nt, Human
augcaaaccaucauugaaauc

SEQ ID NO: 1168239 - RNA, 22 nt, Human
augcaaaccaucauugaaaucu

SEQ ID NO: 1168240 - RNA, 14 nt, Human
augcaaggucauuu

SEQ ID NO: 1168241 - RNA, 16 nt, Human
augcaaggucauuuuu

SEQ ID NO: 1168242 - RNA, 22 nt, Human
augcaaggucauuuuuuuuaag

SEQ ID NO: 1168243 - RNA, 16 nt, Human
augcaccuggaauaua

SEQ ID NO: 1168244 - RNA, 12 nt, Human
augagaggaaau

SEQ ID NO: 1168245 - RNA, 13 nt, Human
augagaggaaauc

SEQ ID NO: 1168246 - RNA, 14 nt, Human
augagaggaaauca

SEQ ID NO: 1168247 - RNA, 15 nt, Human
augagaggaaaucac

SEQ ID NO: 1168248 - RNA, 16 nt, Human
augagaggaaaucacc

SEQ ID NO: 1168249 - RNA, 15 nt, Human
augagcaucaggcca

SEQ ID NO: 1168250 - RNA, 16 nt, Human
augagcaucaggccag

SEQ ID NO: 1168251 - RNA, 17 nt, Human
augagcaucaggccagg

SEQ ID NO: 1168252 - RNA, 18 nt, Human
augagcaucaggccaggc

SEQ ID NO: 1168253 - RNA, 19 nt, Human
augagcaucaggccaggcc

SEQ ID NO: 1168254 - RNA, 20 nt, Human
augagcaucaggccaggccc

SEQ ID NO: 1168255 - RNA, 21 nt, Human
augagcaucaggccaggcccu

SEQ ID NO: 1168256 - RNA, 22 nt, Human
augagcaucaggccaggcccuc

SEQ ID NO: 1168257 - RNA, 12 nt, Human
augagccucagc

SEQ ID NO: 1168258 - RNA, 15 nt, Human
augagccucagcauc

SEQ ID NO: 1168259 - RNA, 16 nt, Human
augagccucagcaucc

SEQ ID NO: 1168260 - RNA, 17 nt, Human
augagccucagcauccu

SEQ ID NO: 1168261 - RNA, 18 nt, Human
augagccucagcauccug

SEQ ID NO: 1168262 - RNA, 19 nt, Human
augagccucagcauccugg

SEQ ID NO: 1168263 - RNA, 15 nt, Human
augauaaaacacaaa

SEQ ID NO: 1168264 - RNA, 14 nt, Human
augauaacuggaaa

SEQ ID NO: 1168265 - RNA, 16 nt, Human
augcgggccagugcuc

SEQ ID NO: 1168266 - RNA, 18 nt, Human
augcuacaggauuugaaa

SEQ ID NO: 1168267 - RNA, 18 nt, Human
augcuacacacugcaugu

SEQ ID NO: 1168268 - RNA, 17 nt, Human
augcuacacacugcaug

SEQ ID NO: 1168269 - RNA, 14 nt, Human
uuuaccuuuuuuau

SEQ ID NO: 1168270 - RNA, 19 nt, Human
uuuaccuuuuuuauacaua

SEQ ID NO: 1168271 - RNA, 20 nt, Human
uuuaccuuuuuuauacauaa

SEQ ID NO: 1168272 - RNA, 21 nt, Human
uuuaccuuuuuuauacauaaa

SEQ ID NO: 1168273 - RNA, 14 nt, Human
uuuacuaauagaca

SEQ ID NO: 1168274 - RNA, 17 nt, Human
uuuacuaauagacaauu

SEQ ID NO: 1168275 - RNA, 18 nt, Human
uuuacuaauagacaauuu

SEQ ID NO: 1168276 - RNA, 20 nt, Human
uuuagcuggaaaaguauguu

SEQ ID NO: 1168277 - RNA, 15 nt, Human
uuuaguagagacagg

SEQ ID NO: 1168278 - RNA, 13 nt, Human
uuuagauaauaca

SEQ ID NO: 1168279 - RNA, 15 nt, Human
uuuagauaauacacc

SEQ ID NO: 1168280 - RNA, 17 nt, Human
uuuauaugcuucuguuu

SEQ ID NO: 1168281 - RNA, 19 nt, Human
uuuauaugcuucuguuuua

SEQ ID NO: 1168282 - RNA, 19 nt, Human
uuuauuaaaugcccagccc

SEQ ID NO: 1168283 - RNA, 14 nt, Human
augcuguauuuuaa

SEQ ID NO: 1168284 - RNA, 19 nt, Human
augcuguauuuuaaaagaa

SEQ ID NO: 1168285 - RNA, 19 nt, Human
augcugugcccuaaagugu

SEQ ID NO: 1168286 - RNA, 22 nt, Human
augcugugcccuaaaguguauu

SEQ ID NO: 1168287 - RNA, 19 nt, Human
uuuauuacuguaagaaaau

SEQ ID NO: 1168288 - RNA, 13 nt, Human
uuuauuaugcaug

SEQ ID NO: 1168289 - RNA, 14 nt, Human
auggaauaacaugu

SEQ ID NO: 1168290 - RNA, 15 nt, Human
auggaauaacaugua

SEQ ID NO: 1168291 - RNA, 16 nt, Human
uuuauuuuaauaaugu

SEQ ID NO: 1168292 - RNA, 18 nt, Human
auggaacacucugagacu

SEQ ID NO: 1168293 - RNA, 21 nt, Human
auggaaguacuauaauuuacc

SEQ ID NO: 1168294 - RNA, 14 nt, Human
uuucacucuccuug

SEQ ID NO: 1168295 - RNA, 15 nt, Human
uuucacucuccuugg

SEQ ID NO: 1168296 - RNA, 24 nt, Human
uuucacucuuauugcccacgcugg

SEQ ID NO: 1168297 - RNA, 23 nt, Human
auggaauuggagcucgugggaca

SEQ ID NO: 1168298 - RNA, 19 nt, Human
uuuccagguuuaagcuguu

SEQ ID NO: 1168299 - RNA, 13 nt, Human
augggagcucaug

SEQ ID NO: 1168300 - RNA, 19 nt, Human
augggcaacccccagccug

SEQ ID NO: 1168301 - RNA, 21 nt, Human
augggcaacccccagccugcu

SEQ ID NO: 1168302 - RNA, 13 nt, Human
augggcagagcag

SEQ ID NO: 1168303 - RNA, 14 nt, Human
augggcagagcaga

SEQ ID NO: 1168304 - RNA, 15 nt, Human
augggcagagcagag

SEQ ID NO: 1168305 - RNA, 15 nt, Human
augggccuccugugu

SEQ ID NO: 1168306 - RNA, 21 nt, Human
auggacccaauauuuaccaga

SEQ ID NO: 1168307 - RNA, 18 nt, Human
auggccucuucagaucuc

SEQ ID NO: 1168308 - RNA, 22 nt, Human
augggacauuugcucauggaau

SEQ ID NO: 1168309 - RNA, 18 nt, Human
uuucgcaggauucuuccu

SEQ ID NO: 1168310 - RNA, 22 nt, Human
uuucgcaggauucuuccucccu

SEQ ID NO: 1168311 - RNA, 17 nt, Human
augggccuccugugugu

SEQ ID NO: 1168312 - RNA, 12 nt, Human
uuuccugugucu

SEQ ID NO: 1168313 - RNA, 11 nt, Human
uuuccuucagu

SEQ ID NO: 1168314 - RNA, 12 nt, Human
uuuccuucagug

SEQ ID NO: 1168315 - RNA, 15 nt, Human
uuuccuucagugccu

SEQ ID NO: 1168316 - RNA, 18 nt, Human
uuuccuucagugccuuau

SEQ ID NO: 1168317 - RNA, 21 nt, Human
uuuccuucagugccuuaugga

SEQ ID NO: 1168318 - RNA, 22 nt, Human
uuuccuucagugccuuauggaa

SEQ ID NO: 1168319 - RNA, 21 nt, Human
uuuccuucauucaacccaccu

SEQ ID NO: 1168320 - RNA, 23 nt, Human
uuuccuucauucaacccaccugc

SEQ ID NO: 1168321 - RNA, 14 nt, Human
uuucugccgcagcc

SEQ ID NO: 1168322 - RNA, 16 nt, Human
uuucugccgcagcccu

SEQ ID NO: 1168323 - RNA, 14 nt, Human
uuucuaaagcugcc

SEQ ID NO: 1168324 - RNA, 13 nt, Human
uuucuaugaaaua

SEQ ID NO: 1168325 - RNA, 14 nt, Human
uuucuaugaaauau

SEQ ID NO: 1168326 - RNA, 20 nt, Human
uuucuaugaaauauuauguu

SEQ ID NO: 1168327 - RNA, 15 nt, Human
uuucuaugacacaug

SEQ ID NO: 1168328 - RNA, 21 nt, Human
uuucuaugacacaugcaaggu

SEQ ID NO: 1168329 - RNA, 13 nt, Human
uuucuuuguggcu

SEQ ID NO: 1168330 - RNA, 14 nt, Human
uuugaaauauugac

SEQ ID NO: 1168331 - RNA, 15 nt, Human
uuugaaauauugacu

SEQ ID NO: 1168332 - RNA, 23 nt, Human
augggcuggguucuacccaggug

SEQ ID NO: 1168333 - RNA, 14 nt, Human
auggggcccugccu

SEQ ID NO: 1168334 - RNA, 20 nt, Human
augugcuaguaauuggaaag

SEQ ID NO: 1168335 - RNA, 20 nt, Human
auguggaguucaucuugaau

SEQ ID NO: 1168336 - RNA, 24 nt, Human
auguggaguucaucuugaauugua

SEQ ID NO: 1168337 - RNA, 20 nt, Human
auggggcccugccuccuuug

SEQ ID NO: 1168338 - RNA, 12 nt, Human
auggggcugcac

SEQ ID NO: 1168339 - RNA, 12 nt, Human
uuuuaauaaugu

SEQ ID NO: 1168340 - RNA, 13 nt, Human
uuuuaauaauguu

SEQ ID NO: 1168341 - RNA, 14 nt, Human
uuuuaauaauguuu

SEQ ID NO: 1168342 - RNA, 16 nt, Human
uuuuaauaauguuuca

SEQ ID NO: 1168343 - RNA, 22 nt, Human
augugccagguuuuuggucuga

SEQ ID NO: 1168344 - RNA, 20 nt, Human
uuuuaauaauguuucaaaca

SEQ ID NO: 1168345 - RNA, 19 nt, Human
augugcuaguaauuggaaa

SEQ ID NO: 1168346 - RNA, 18 nt, Human
auguucaucaaugaauga

SEQ ID NO: 1168347 - RNA, 12 nt, Human
auguugcccagg

SEQ ID NO: 1168348 - RNA, 17 nt, Human
auguugcccaggcaggu

SEQ ID NO: 1168349 - RNA, 20 nt, Human
auguugcccaggcaggucuu

SEQ ID NO: 1168350 - RNA, 16 nt, Human
auuaaacuuaaucuaa

SEQ ID NO: 1168351 - RNA, 19 nt, Human
auuaaaaaucucaaauuuc

SEQ ID NO: 1168352 - RNA, 20 nt, Human
auuaaaaaucucaaauuucu

SEQ ID NO: 1168353 - RNA, 22 nt, Human
auuaaaaaucucaaauuucuaa

SEQ ID NO: 1168354 - RNA, 17 nt, Human
auguuuucaggcuagau

SEQ ID NO: 1168355 - RNA, 21 nt, Human
auguuuucaggcuagauguau

SEQ ID NO: 1168356 - RNA, 11 nt, Human
uuuuauuuuau

SEQ ID NO: 1168357 - RNA, 13 nt, Human
uuuuauuaugcau

SEQ ID NO: 1168358 - RNA, 20 nt, Human
uuuucauuuaggugaggaag

SEQ ID NO: 1168359 - RNA, 14 nt, Human
uuuucucuaggaaa

SEQ ID NO: 1168360 - RNA, 16 nt, Human
uuuucucuaggaaaua

SEQ ID NO: 1168361 - RNA, 17 nt, Human
uuuugugcauuaucuag

SEQ ID NO: 1168362 - RNA, 20 nt, Human
uuuugugcauuaucuagaua

SEQ ID NO: 1168363 - RNA, 23 nt, Human
uuuugugcauuaucuagauacug

SEQ ID NO: 1168364 - RNA, 15 nt, Human
uuuuguuccacaagu

SEQ ID NO: 1168365 - RNA, 21 nt, Human
uuuuguuccacaaguuaaaua

SEQ ID NO: 1168366 - RNA, 22 nt, Human
uuuuuagacagagucucacugu

SEQ ID NO: 1168367 - RNA, 11 nt, Human
uuuuuacuaau

SEQ ID NO: 1168368 - RNA, 23 nt, Human
uuuuuauacauaaacaagaccac

SEQ ID NO: 1168369 - RNA, 19 nt, Human
uuuuuauauuugaaauauu

SEQ ID NO: 1168370 - RNA, 20 nt, Human
uuuuuaucgucacugcuuaa

SEQ ID NO: 1168371 - RNA, 12 nt, Human
uuuuuauggcuu

SEQ ID NO: 1168372 - RNA, 17 nt, Human
uuuugagugccuuacac

SEQ ID NO: 1168373 - RNA, 17 nt, Human
uuuugauccaagcuggu

SEQ ID NO: 1168374 - RNA, 23 nt, Human
uuuugccauguuggccaggcugg

SEQ ID NO: 1168375 - RNA, 12 nt, Human
auuacuucugcu

SEQ ID NO: 1168376 - RNA, 19 nt, Human
uuuuugugaaaagcuccau

SEQ ID NO: 1168377 - RNA, 19 nt, Human
uuuuuguagagccaggguc

SEQ ID NO: 1168378 - RNA, 20 nt, Human
uuuuuguagagccagggucu

SEQ ID NO: 1168379 - RNA, 22 nt, Human
uuuuuguuccacaaguuaaaua

SEQ ID NO: 1168380 - RNA, 23 nt, Human
auuaaguaaugauaacuggaaac

SEQ ID NO: 1168381 - RNA, 20 nt, Human
uuuuuauggcuuuugugcau

SEQ ID NO: 1168382 - RNA, 21 nt, Human
uuuuuauggcuuuugugcauu

SEQ ID NO: 1168383 - RNA, 22 nt, Human
uuuuuauggcuuuugugcauua

SEQ ID NO: 1168384 - RNA, 14 nt, Human
auuaaguacuaugu

SEQ ID NO: 1168385 - RNA, 16 nt, Human
auuaaguacuauguau

SEQ ID NO: 1168386 - RNA, 17 nt, Human
auuacauuuguauaaaa

SEQ ID NO: 1168387 - RNA, 18 nt, Human
auuacauuuguauaaaau

SEQ ID NO: 1168388 - RNA, 20 nt, Human
auuacauuuguauaaaauaa

SEQ ID NO: 1168389 - RNA, 19 nt, Human
auucuccaccugccaggga

SEQ ID NO: 1168390 - RNA, 20 nt, Human
auucuccaccugccagggac

SEQ ID NO: 1168391 - RNA, 21 nt, Human
auucuccaccugccagggaca

SEQ ID NO: 1168392 - RNA, 11 nt, Human
auucuccugcc

SEQ ID NO: 1168393 - RNA, 13 nt, Human
auucuccugccuc

SEQ ID NO: 1168394 - RNA, 14 nt, Human
auucuccugccuca

SEQ ID NO: 1168395 - RNA, 15 nt, Human
auucuccugccucag

SEQ ID NO: 1168396 - RNA, 17 nt, Human
auucuccugccucagcc

SEQ ID NO: 1168397 - RNA, 19 nt, Human
auucuccugccucagccuc

SEQ ID NO: 1168398 - RNA, 20 nt, Human
auucuccugccucagccucc

SEQ ID NO: 1168399 - RNA, 16 nt, Human
auucuccuuguguuac

SEQ ID NO: 1168400 - RNA, 14 nt, Human
auucccaagcucug

SEQ ID NO: 1168401 - RNA, 15 nt, Human
auucccaagcucugc

SEQ ID NO: 1168402 - RNA, 16 nt, Human
auucccaagcucugcu

SEQ ID NO: 1168403 - RNA, 17 nt, Human
auucccaagcucugcuc

SEQ ID NO: 1168404 - RNA, 14 nt, Human
auucaggaagcuca

SEQ ID NO: 1168405 - RNA, 17 nt, Human
auucaggaagcucaggg

SEQ ID NO: 1168406 - RNA, 19 nt, Human
auucaggaagcucagggcc

SEQ ID NO: 1168407 - RNA, 20 nt, Human
auucaggaagcucagggccu

SEQ ID NO: 1168408 - RNA, 15 nt, Human
auucaguaauaacuc

SEQ ID NO: 1168409 - RNA, 19 nt, Human
auucaguaauaacucuacc

SEQ ID NO: 1168410 - RNA, 12 nt, Human
auugaaaucuuu

SEQ ID NO: 1168411 - RNA, 19 nt, Human
auuuauuuuaauaauguuu

SEQ ID NO: 1168412 - RNA, 20 nt, Human
auuuauuuuaauaauguuuc

SEQ ID NO: 1168413 - RNA, 21 nt, Human
auuuauuuuaauaauguuuca

SEQ ID NO: 1168414 - RNA, 17 nt, Human
auuuccagccaaagccu

SEQ ID NO: 1168415 - RNA, 15 nt, Human
auuuccguuaaaaua

SEQ ID NO: 1168416 - RNA, 16 nt, Human
auuuccguuaaaauac

SEQ ID NO: 1168417 - RNA, 17 nt, Human
auuuccguuaaaauacc

SEQ ID NO: 1168418 - RNA, 14 nt, Human
auuugaaaauuuug

SEQ ID NO: 1168419 - RNA, 15 nt, Human
auuugaaaauuuuga

SEQ ID NO: 1168420 - RNA, 14 nt, Human
auuugaaauauuga

SEQ ID NO: 1168421 - RNA, 13 nt, Human
auuuauucugcuc

SEQ ID NO: 1168422 - RNA, 12 nt, Human
auuuaacagaaa

SEQ ID NO: 1168423 - RNA, 14 nt, Human
auuuaacagaaaug

SEQ ID NO: 1168424 - RNA, 15 nt, Human
auuuaacagaaaugu

SEQ ID NO: 1168425 - RNA, 14 nt, Human
auuuacuucuuaua

SEQ ID NO: 1168426 - RNA, 16 nt, Human
auuuacuucuuauaca

SEQ ID NO: 1168427 - RNA, 17 nt, Human
auuuacuucuuauacau

SEQ ID NO: 1168428 - RNA, 15 nt, Human
auuuagaaauauaau

SEQ ID NO: 1168429 - RNA, 13 nt, Human
auuuagauguaua

SEQ ID NO: 1168430 - RNA, 14 nt, Human
auuuauucugcuca

SEQ ID NO: 1168431 - RNA, 14 nt, Human
auugugucucuugg

SEQ ID NO: 1168432 - RNA, 18 nt, Human
auugugucucuugguccu

SEQ ID NO: 1168433 - RNA, 16 nt, Human
auugucaaagugguga

SEQ ID NO: 1168434 - RNA, 17 nt, Human
auuguccccgacccuug

SEQ ID NO: 1168435 - RNA, 19 nt, Human
auuguccccgacccuugcc

SEQ ID NO: 1168436 - RNA, 20 nt, Human
auuguccccgacccuugccg

SEQ ID NO: 1168437 - RNA, 14 nt, Human
auucuuauuuaaug

SEQ ID NO: 1168438 - RNA, 18 nt, Human
auucuuauuuaaugaaag

SEQ ID NO: 1168439 - RNA, 13 nt, Human
auucuuauuuaau

SEQ ID NO: 1168440 - RNA, 22 nt, Human
auucuuccucccucccucuuuc

SEQ ID NO: 1168441 - RNA, 13 nt, Human
auucuucuccacu

SEQ ID NO: 1168442 - RNA, 17 nt, Human
auucuccuuguguuacu

SEQ ID NO: 1168443 - RNA, 21 nt, Human
auugacccacaagaaaugaaa

SEQ ID NO: 1168444 - RNA, 18 nt, Human
auugacccacaagaaaug

SEQ ID NO: 1168445 - RNA, 22 nt, Human
auuuucaguuauuauauuuaca

SEQ ID NO: 1168446 - RNA, 18 nt, Human
auuuguauaaaauaauuu

SEQ ID NO: 1168447 - RNA, 19 nt, Human
auuuguauaaaauaauuuu

SEQ ID NO: 1168448 - RNA, 21 nt, Human
auuuguauaaaauaauuuuua

SEQ ID NO: 1168449 - RNA, 14 nt, Human
auuugugauacaau

SEQ ID NO: 1168450 - RNA, 15 nt, Human
auuugugauacaaug

SEQ ID NO: 1168451 - RNA, 18 nt, Human
auuuuaaaagaaugauua

SEQ ID NO: 1168452 - RNA, 22 nt, Human
auuuuaaaagaaugauuaugaa

SEQ ID NO: 1168453 - RNA, 15 nt, Human
auuuuaauucaguug

SEQ ID NO: 1168454 - RNA, 20 nt, Human
cagaaguuucugccgcagcc

SEQ ID NO: 1168455 - RNA, 21 nt, Human
cagaaguuucugccgcagccc

SEQ ID NO: 1168456 - RNA, 22 nt, Human
cagaaguuucugccgcagcccu

SEQ ID NO: 1168457 - RNA, 23 nt, Human
cagaaguuucugccgcagcccug

SEQ ID NO: 1168458 - RNA, 15 nt, Human
cacuguugcccaggc

SEQ ID NO: 1168459 - RNA, 16 nt, Human
cacuguugcccaggcu

SEQ ID NO: 1168460 - RNA, 17 nt, Human
cacuggugacaugucuu

SEQ ID NO: 1168461 - RNA, 22 nt, Human
cacugggcuuggggaccagagc

SEQ ID NO: 1168462 - RNA, 23 nt, Human
cacugggcuuggggaccagagcu

SEQ ID NO: 1168463 - RNA, 19 nt, Human
cacuguuucaaacuuuacu

SEQ ID NO: 1168464 - RNA, 17 nt, Human
cacuguugcccaggcug

SEQ ID NO: 1168465 - RNA, 20 nt, Human
cacuuggucugugagaugcu

SEQ ID NO: 1168466 - RNA, 14 nt, Human
caccugccagggac

SEQ ID NO: 1168467 - RNA, 16 nt, Human
caccugccagggacag

SEQ ID NO: 1168468 - RNA, 21 nt, Human
caccuacaugagguacugaga

SEQ ID NO: 1168469 - RNA, 17 nt, Human
caccuuuguccccaccg

SEQ ID NO: 1168470 - RNA, 14 nt, Human
caccuuugucccca

SEQ ID NO: 1168471 - RNA, 15 nt, Human
caccuuuguccccac

SEQ ID NO: 1168472 - RNA, 17 nt, Human
caccugccagggacaga

SEQ ID NO: 1168473 - RNA, 19 nt, Human
caccuugacagggcacacc

SEQ ID NO: 1168474 - RNA, 13 nt, Human
caccuuggcucaa

SEQ ID NO: 1168475 - RNA, 14 nt, Human
caccuuggcucaag

SEQ ID NO: 1168476 - RNA, 23 nt, Human
cacuacggaauaguuggcuagga

SEQ ID NO: 1168477 - RNA, 17 nt, Human
cacggccaggccagagg

SEQ ID NO: 1168478 - RNA, 20 nt, Human
cacggagggugacgggggug

SEQ ID NO: 1168479 - RNA, 14 nt, Human
cacggccaggccag

SEQ ID NO: 1168480 - RNA, 15 nt, Human
cacggccaggccaga

SEQ ID NO: 1168481 - RNA, 16 nt, Human
cacggccaggccagag

SEQ ID NO: 1168482 - RNA, 17 nt, Human
cacucuuauugcccacg

SEQ ID NO: 1168483 - RNA, 18 nt, Human
cacucuuauugcccacgc

SEQ ID NO: 1168484 - RNA, 19 nt, Human
cacucuuauugcccacgcu

SEQ ID NO: 1168485 - RNA, 11 nt, Human
cacugaagaag

SEQ ID NO: 1168486 - RNA, 22 nt, Human
caaugcugugcccuaaagugua

SEQ ID NO: 1168487 - RNA, 12 nt, Human
caauauuucaga

SEQ ID NO: 1168488 - RNA, 20 nt, Human
caauauuucagauaaucaca

SEQ ID NO: 1168489 - RNA, 21 nt, Human
caauauuucagauaaucacaa

SEQ ID NO: 1168490 - RNA, 22 nt, Human
caaugcuggcuguuggcugggg

SEQ ID NO: 1168491 - RNA, 23 nt, Human
caaugcuggcuguuggcuggggg

SEQ ID NO: 1168492 - RNA, 14 nt, Human
caaugcuguauuuu

SEQ ID NO: 1168493 - RNA, 15 nt, Human
caaugcuguauuuua

SEQ ID NO: 1168494 - RNA, 13 nt, Human
cacaagcuccaag

SEQ ID NO: 1168495 - RNA, 14 nt, Human
cacaagccuucggc

SEQ ID NO: 1168496 - RNA, 12 nt, Human
caauuuaaaaaa

SEQ ID NO: 1168497 - RNA, 14 nt, Human
cacaagacccuugu

SEQ ID NO: 1168498 - RNA, 16 nt, Human
cacaagacccuugugg

SEQ ID NO: 1168499 - RNA, 16 nt, Human
cacaagacugcacauc

SEQ ID NO: 1168500 - RNA, 18 nt, Human
cacaagacugcacaucaa

SEQ ID NO: 1168501 - RNA, 14 nt, Human
caaguauuagaaua

SEQ ID NO: 1168502 - RNA, 20 nt, Human
caaguauuagaauaccacag

SEQ ID NO: 1168503 - RNA, 13 nt, Human
caaguauuauacc

SEQ ID NO: 1168504 - RNA, 19 nt, Human
cacagacccugcccugugg

SEQ ID NO: 1168505 - RNA, 20 nt, Human
cacagacccugcccuguggg

SEQ ID NO: 1168506 - RNA, 21 nt, Human
cacagacccugcccugugggc

SEQ ID NO: 1168507 - RNA, 18 nt, Human
cacagacauacuaaccag

SEQ ID NO: 1168508 - RNA, 22 nt, Human
cacagacccugcccugugggcc

SEQ ID NO: 1168509 - RNA, 15 nt, Human
cacagcuaacaugga

SEQ ID NO: 1168510 - RNA, 16 nt, Human
cacagcuaacauggaa

SEQ ID NO: 1168511 - RNA, 22 nt, Human
cacagcuaacauggaaguacua

SEQ ID NO: 1168512 - RNA, 20 nt, Human
cacagcucuguccugggagu

SEQ ID NO: 1168513 - RNA, 23 nt, Human
cacagcucuguccugggagugag

SEQ ID NO: 1168514 - RNA, 10 nt, Human
cacagcucuu

SEQ ID NO: 1168515 - RNA, 16 nt, Human
cacaguauuacuucug

SEQ ID NO: 1168516 - RNA, 18 nt, Human
cacaguauuacuucugcu

SEQ ID NO: 1168517 - RNA, 19 nt, Human
cacaguauuacuucugcua

SEQ ID NO: 1168518 - RNA, 20 nt, Human
cacaucagcacgauuucugu

SEQ ID NO: 1168519 - RNA, 21 nt, Human
cacaucagcacgauuucuguu

SEQ ID NO: 1168520 - RNA, 22 nt, Human
cacaucagcacgauuucuguuu

SEQ ID NO: 1168521 - RNA, 17 nt, Human
cacaucuugcucugcug

SEQ ID NO: 1168522 - RNA, 18 nt, Human
cacaucuugcucugcuga

SEQ ID NO: 1168523 - RNA, 19 nt, Human
cacaucuugcucugcugac

SEQ ID NO: 1168524 - RNA, 15 nt, Human
cacauuuuauuuuau

SEQ ID NO: 1168525 - RNA, 17 nt, Human
cacauuuuauuuuauua

SEQ ID NO: 1168526 - RNA, 13 nt, Human
cacauuuuucuua

SEQ ID NO: 1168527 - RNA, 14 nt, Human
cacauuuuucuuag

SEQ ID NO: 1168528 - RNA, 17 nt, Human
cacauuuuuuaaaugca

SEQ ID NO: 1168529 - RNA, 21 nt, Human
cacauuuuuuaaaugcaccug

SEQ ID NO: 1168530 - RNA, 20 nt, Human
caccaacauacucccaucug

SEQ ID NO: 1168531 - RNA, 21 nt, Human
caccaacauacucccaucugu

SEQ ID NO: 1168532 - RNA, 24 nt, Human
cacccaggagccccgaggccuucu

SEQ ID NO: 1168533 - RNA, 19 nt, Human
cacccagcccacuucugcc

SEQ ID NO: 1168534 - RNA, 20 nt, Human
cacccaggagccccgaggcc

SEQ ID NO: 1168535 - RNA, 23 nt, Human
cacccaggagccccgaggccuuc

SEQ ID NO: 1168536 - RNA, 23 nt, Human
caccaacauacucccaucuguga

SEQ ID NO: 1168537 - RNA, 14 nt, Human
caccagcagccugg

SEQ ID NO: 1168538 - RNA, 15 nt, Human
caccagcagccugga

SEQ ID NO: 1168539 - RNA, 17 nt, Human
cacccagcccacuucug

SEQ ID NO: 1168540 - RNA, 21 nt, Human
caaaucugcuuuuuaaagaau

SEQ ID NO: 1168541 - RNA, 23 nt, Human
caacaaaccuguuucugcagcca

SEQ ID NO: 1168542 - RNA, 13 nt, Human
caaagaugcagcc

SEQ ID NO: 1168543 - RNA, 14 nt, Human
caaagaugcagccg

SEQ ID NO: 1168544 - RNA, 16 nt, Human
caaaguacacuguuuc

SEQ ID NO: 1168545 - RNA, 20 nt, Human
caaaguacacuguuucaaac

SEQ ID NO: 1168546 - RNA, 21 nt, Human
caaaguacacuguuucaaacu

SEQ ID NO: 1168547 - RNA, 22 nt, Human
caaaguacacuguuucaaacuu

SEQ ID NO: 1168548 - RNA, 20 nt, Human
caacaccuuguuucccucuc

SEQ ID NO: 1168549 - RNA, 22 nt, Human
caacaccucugcacaagcugca

SEQ ID NO: 1168550 - RNA, 19 nt, Human
caacccaaauguucaucaa

SEQ ID NO: 1168551 - RNA, 15 nt, Human
caacccccagccugc

SEQ ID NO: 1168552 - RNA, 16 nt, Human
caacccccagccugcu

SEQ ID NO: 1168553 - RNA, 17 nt, Human
caacccccagccugcua

SEQ ID NO: 1168554 - RNA, 18 nt, Human
caagacccuugugguccc

SEQ ID NO: 1168555 - RNA, 19 nt, Human
caagacccuugugguccca

SEQ ID NO: 1168556 - RNA, 22 nt, Human
caagacccuuguggucccaccc

SEQ ID NO: 1168557 - RNA, 23 nt, Human
caagacccuuguggucccacccc

SEQ ID NO: 1168558 - RNA, 13 nt, Human
caacucaccccag

SEQ ID NO: 1168559 - RNA, 15 nt, Human
caacucaccccagcc

SEQ ID NO: 1168560 - RNA, 16 nt, Human
caacucaccccagccc

SEQ ID NO: 1168561 - RNA, 17 nt, Human
caacucaccccagcccc

SEQ ID NO: 1168562 - RNA, 18 nt, Human
caaccacugcgaccacaa

SEQ ID NO: 1168563 - RNA, 17 nt, Human
auuuuauagcuacuaau

SEQ ID NO: 1168564 - RNA, 20 nt, Human
auuuguuugaacugauaaag

SEQ ID NO: 1168565 - RNA, 14 nt, Human
auuuguuugaacug

SEQ ID NO: 1168566 - RNA, 16 nt, Human
auuuguuugaacugau

SEQ ID NO: 1168567 - RNA, 13 nt, Human
auuuguuugaacu

SEQ ID NO: 1168568 - RNA, 18 nt, Human
auuuugauccaagcuggu

SEQ ID NO: 1168569 - RNA, 15 nt, Human
caaaagcugggcagg

SEQ ID NO: 1168570 - RNA, 19 nt, Human
caaaagcugggcagguugg

SEQ ID NO: 1168571 - RNA, 13 nt, Human
auuuuuaagugcu

SEQ ID NO: 1168572 - RNA, 13 nt, Human
auuuuuuuuuccu

SEQ ID NO: 1168573 - RNA, 16 nt, Human
auuuuuuuuuccuuca

SEQ ID NO: 1168574 - RNA, 17 nt, Human
auuuuuuuuuccuucag

SEQ ID NO: 1168575 - RNA, 16 nt, Human
auuucagcagcugcag

SEQ ID NO: 1168576 - RNA, 14 nt, Human
auuuaaugaaagac

SEQ ID NO: 1168577 - RNA, 15 nt, Human
auuuaaugaaagacu

SEQ ID NO: 1168578 - RNA, 19 nt, Human
auuucuguuuagauaauac

SEQ ID NO: 1168579 - RNA, 12 nt, Human
auuucuguuuag

SEQ ID NO: 1168580 - RNA, 14 nt, Human
auuucuguuuagau

SEQ ID NO: 1168581 - RNA, 16 nt, Human
auuucuguuuagauaa

SEQ ID NO: 1168582 - RNA, 15 nt, Human
auuucuaugaaauau

SEQ ID NO: 1168583 - RNA, 18 nt, Human
auuucuaugaaauauuau

SEQ ID NO: 1168584 - RNA, 20 nt, Human
auuucuaugaaauauuaugu

SEQ ID NO: 1168585 - RNA, 23 nt, Human
auuguaauaggcguaacuaauuu

SEQ ID NO: 1168586 - RNA, 16 nt, Human
auuguaaggaaugauu

SEQ ID NO: 1168587 - RNA, 15 nt, Human
auuguaaggaaugau

SEQ ID NO: 1168588 - RNA, 13 nt, Human
auuguaaaauggu

SEQ ID NO: 1168589 - RNA, 19 nt, Human
auuguucuuaguuugcagu

SEQ ID NO: 1168590 - RNA, 18 nt, Human
auucacaagacccaaaag

SEQ ID NO: 1168591 - RNA, 21 nt, Human
auuauguuaaaacugggacag

SEQ ID NO: 1168592 - RNA, 14 nt, Human
auuaaauucuugca

SEQ ID NO: 1168593 - RNA, 18 nt, Human
auuaaauucuugcaaagu

SEQ ID NO: 1168594 - RNA, 20 nt, Human
auuaaauucuugcaaaguau

SEQ ID NO: 1168595 - RNA, 19 nt, Human
auucacaagacccaaaagg

SEQ ID NO: 1168596 - RNA, 18 nt, Human
auucauauuuacuucuua

SEQ ID NO: 1168597 - RNA, 19 nt, Human
auucauauuuacuucuuau

SEQ ID NO: 1168598 - RNA, 20 nt, Human
auucauauuuacuucuuaua

SEQ ID NO: 1168599 - RNA, 17 nt, Human
auucuuuccugaggcug

SEQ ID NO: 1168600 - RNA, 22 nt, Human
auucuuuccugaggcugggcuc

SEQ ID NO: 1168601 - RNA, 21 nt, Human
auuccugaugcuucuucagag

SEQ ID NO: 1168602 - RNA, 19 nt, Human
auucucuccuguaccucuu

SEQ ID NO: 1168603 - RNA, 21 nt, Human
auucucuccuguaccucuuga

SEQ ID NO: 1168604 - RNA, 13 nt, Human
cagauccuggaaa

SEQ ID NO: 1168605 - RNA, 12 nt, Human
cagauccuggaa

SEQ ID NO: 1168606 - RNA, 17 nt, Human
cagagguugcagugagc

SEQ ID NO: 1168607 - RNA, 23 nt, Human
cagaggggguggccucccaacuc

SEQ ID NO: 1168608 - RNA, 17 nt, Human
cagauucuuuccugagg

SEQ ID NO: 1168609 - RNA, 18 nt, Human
cagauucuuuccugaggc

SEQ ID NO: 1168610 - RNA, 19 nt, Human
cagauucuuuccugaggcu

SEQ ID NO: 1168611 - RNA, 13 nt, Human
cagccaguaaaug

SEQ ID NO: 1168612 - RNA, 20 nt, Human
cagcaucauggagguuugaa

SEQ ID NO: 1168613 - RNA, 17 nt, Human
cagauugcaacaggcug

SEQ ID NO: 1168614 - RNA, 20 nt, Human
cagauucuuuccugaggcug

SEQ ID NO: 1168615 - RNA, 22 nt, Human
cagauucuuuccugaggcuggg

SEQ ID NO: 1168616 - RNA, 16 nt, Human
cagcacgauuucuguu

SEQ ID NO: 1168617 - RNA, 18 nt, Human
cagcacgauuucuguuua

SEQ ID NO: 1168618 - RNA, 19 nt, Human
cagcacgauuucuguuuag

SEQ ID NO: 1168619 - RNA, 20 nt, Human
cagcacgauuucuguuuaga

SEQ ID NO: 1168620 - RNA, 17 nt, Human
cagcauagaaguaacuu

SEQ ID NO: 1168621 - RNA, 18 nt, Human
caggaaaagcugcugaca

SEQ ID NO: 1168622 - RNA, 15 nt, Human
caggaaaagcugcug

SEQ ID NO: 1168623 - RNA, 16 nt, Human
caggaaaagcugcuga

SEQ ID NO: 1168624 - RNA, 12 nt, Human
cagcugccuggg

SEQ ID NO: 1168625 - RNA, 13 nt, Human
cagcugccuggga

SEQ ID NO: 1168626 - RNA, 14 nt, Human
cagcugccugggau

SEQ ID NO: 1168627 - RNA, 15 nt, Human
cagcugccugggauc

SEQ ID NO: 1168628 - RNA, 20 nt, Human
cagcugugcucuggacaggc

SEQ ID NO: 1168629 - RNA, 24 nt, Human
cagcugugcucuggacaggcaugu

SEQ ID NO: 1168630 - RNA, 21 nt, Human
cagcggggacagcuccuucug

SEQ ID NO: 1168631 - RNA, 18 nt, Human
cagcggggacagcuccuu

SEQ ID NO: 1168632 - RNA, 19 nt, Human
cagcggggacagcuccuuc

SEQ ID NO: 1168633 - RNA, 19 nt, Human
cagccugcuaauuccccag

SEQ ID NO: 1168634 - RNA, 12 nt, Human
cagccugcucca

SEQ ID NO: 1168635 - RNA, 15 nt, Human
cagccugcuccagcu

SEQ ID NO: 1168636 - RNA, 19 nt, Human
cagccgagauagccaaggc

SEQ ID NO: 1168637 - RNA, 20 nt, Human
cagccgagauagccaaggcc

SEQ ID NO: 1168638 - RNA, 18 nt, Human
caggcagauacaggaaaa

SEQ ID NO: 1168639 - RNA, 13 nt, Human
caggccagaggga

SEQ ID NO: 1168640 - RNA, 15 nt, Human
caggccagagggagu

SEQ ID NO: 1168641 - RNA, 18 nt, Human
caggcacccaccaucaug

SEQ ID NO: 1168642 - RNA, 19 nt, Human
caggccagcugcuugggcu

SEQ ID NO: 1168643 - RNA, 21 nt, Human
caggccagcugcuugggcuuc

SEQ ID NO: 1168644 - RNA, 23 nt, Human
caggccagcugcuugggcuucau

SEQ ID NO: 1168645 - RNA, 17 nt, Human
caggccaggcccucugc

SEQ ID NO: 1168646 - RNA, 18 nt, Human
caggccaggcccucugcc

SEQ ID NO: 1168647 - RNA, 19 nt, Human
caggccaggcccucugccc

SEQ ID NO: 1168648 - RNA, 16 nt, Human
caggccagagggagug

SEQ ID NO: 1168649 - RNA, 20 nt, Human
caggccaggcccucugccca

SEQ ID NO: 1168650 - RNA, 12 nt, Human
caggcugggaga

SEQ ID NO: 1168651 - RNA, 14 nt, Human
caggcugggagagc

SEQ ID NO: 1168652 - RNA, 15 nt, Human
caggcugggagagcc

SEQ ID NO: 1168653 - RNA, 20 nt, Human
caggcugggcuucaguggca

SEQ ID NO: 1168654 - RNA, 21 nt, Human
caggcugggcuucaguggcag

SEQ ID NO: 1168655 - RNA, 22 nt, Human
caggcugggcuucaguggcagc

SEQ ID NO: 1168656 - RNA, 23 nt, Human
caggcugggcuucaguggcagcu

SEQ ID NO: 1168657 - RNA, 21 nt, Human
cagggcucagcggggacagcu

SEQ ID NO: 1168658 - RNA, 23 nt, Human
cagggcucagcggggacagcucc

SEQ ID NO: 1168659 - RNA, 19 nt, Human
caggggaaaaucagccugc

SEQ ID NO: 1168660 - RNA, 20 nt, Human
caggggaaaaucagccugcu

SEQ ID NO: 1168661 - RNA, 21 nt, Human
caggugcacaagcuccaagcu

SEQ ID NO: 1168662 - RNA, 22 nt, Human
caggugcacaagcuccaagcuc

SEQ ID NO: 1168663 - RNA, 14 nt, Human
cagguuuaagcugu

SEQ ID NO: 1168664 - RNA, 12 nt, Human
cagguuuuccug

SEQ ID NO: 1168665 - RNA, 16 nt, Human
cagguuuuccugaaga

SEQ ID NO: 1168666 - RNA, 21 nt, Human
caggugauccacccaccucag

SEQ ID NO: 1168667 - RNA, 15 nt, Human
caggugcacaagcuc

SEQ ID NO: 1168668 - RNA, 22 nt, Human
caggugauccacccaccucagc

SEQ ID NO: 1168669 - RNA, 23 nt, Human
caggugauccacccaccucagcc

SEQ ID NO: 1168670 - RNA, 17 nt, Human
caggugcacaagcucca

SEQ ID NO: 1168671 - RNA, 18 nt, Human
caggugcacaagcuccaa

SEQ ID NO: 1168672 - RNA, 19 nt, Human
caggugcacaagcuccaag

SEQ ID NO: 1168673 - RNA, 20 nt, Human
caggugcacaagcuccaagc

SEQ ID NO: 1168674 - RNA, 15 nt, Human
cagucacauuccaag

SEQ ID NO: 1168675 - RNA, 16 nt, Human
cagucaccucauggaa

SEQ ID NO: 1168676 - RNA, 19 nt, Human
cagucaccucauggaauug

SEQ ID NO: 1168677 - RNA, 14 nt, Human
cagucaccccggcc

SEQ ID NO: 1168678 - RNA, 18 nt, Human
cagucuggaaugcagugg

SEQ ID NO: 1168679 - RNA, 17 nt, Human
cagucuggaaugcagug

SEQ ID NO: 1168680 - RNA, 15 nt, Human
cagucuggaaugcag

SEQ ID NO: 1168681 - RNA, 13 nt, Human
cagugcaugcugu

SEQ ID NO: 1168682 - RNA, 14 nt, Human
cagugcaugcuguc

SEQ ID NO: 1168683 - RNA, 20 nt, Human
cagucugacuguuuccauca

SEQ ID NO: 1168684 - RNA, 21 nt, Human
caguggugcgaucuggguuca

SEQ ID NO: 1168685 - RNA, 18 nt, Human
caguggugguuuucuguu

SEQ ID NO: 1168686 - RNA, 16 nt, Human
cagugcaugcuguccc

SEQ ID NO: 1168687 - RNA, 17 nt, Human
cagugcaugcugucccu

SEQ ID NO: 1168688 - RNA, 13 nt, Human
cagugcccacagg

SEQ ID NO: 1168689 - RNA, 15 nt, Human
cagugcccacaggau

SEQ ID NO: 1168690 - RNA, 17 nt, Human
cagugcccacaggauca

SEQ ID NO: 1168691 - RNA, 20 nt, Human
cagugggagcugccuguuca

SEQ ID NO: 1168692 - RNA, 23 nt, Human
cagugggagcugccuguucagcu

SEQ ID NO: 1168693 - RNA, 18 nt, Human
cagugcccacaggaucag

SEQ ID NO: 1168694 - RNA, 19 nt, Human
cagugcaugcugucccuua

SEQ ID NO: 1168695 - RNA, 16 nt, Human
cauguuggccaggcug

SEQ ID NO: 1168696 - RNA, 14 nt, Human
cauguuggccaggc

SEQ ID NO: 1168697 - RNA, 15 nt, Human
cauguuggccaggcu

SEQ ID NO: 1168698 - RNA, 13 nt, Human
cauucuccaccug

SEQ ID NO: 1168699 - RNA, 14 nt, Human
cauucuccaccugc

SEQ ID NO: 1168700 - RNA, 16 nt, Human
cauucuccaccugcca

SEQ ID NO: 1168701 - RNA, 17 nt, Human
cauucuccaccugccag

SEQ ID NO: 1168702 - RNA, 19 nt, Human
cauuauauuuauuacugua

SEQ ID NO: 1168703 - RNA, 14 nt, Human
caugcuacacacug

SEQ ID NO: 1168704 - RNA, 20 nt, Human
caugcuacacacugcauguu

SEQ ID NO: 1168705 - RNA, 23 nt, Human
caugcuacacacugcauguuugu

SEQ ID NO: 1168706 - RNA, 13 nt, Human
caugauguuuucc

SEQ ID NO: 1168707 - RNA, 14 nt, Human
caugauguuuagaa

SEQ ID NO: 1168708 - RNA, 17 nt, Human
cauggcugccaauggga

SEQ ID NO: 1168709 - RNA, 14 nt, Human
caugggaaugaaug

SEQ ID NO: 1168710 - RNA, 15 nt, Human
caugggaaugaaugu

SEQ ID NO: 1168711 - RNA, 16 nt, Human
caugggaaugaauguc

SEQ ID NO: 1168712 - RNA, 17 nt, Human
caugggaaugaauguca

SEQ ID NO: 1168713 - RNA, 16 nt, Human
cauauuaccacagaca

SEQ ID NO: 1168714 - RNA, 17 nt, Human
cauauucuguuggccag

SEQ ID NO: 1168715 - RNA, 18 nt, Human
cauauucuguuggccagu

SEQ ID NO: 1168716 - RNA, 19 nt, Human
caguggugguuuucuguuc

SEQ ID NO: 1168717 - RNA, 20 nt, Human
caguggugguuuucuguucu

SEQ ID NO: 1168718 - RNA, 21 nt, Human
caguggugguuuucuguucuu

SEQ ID NO: 1168719 - RNA, 22 nt, Human
caguggugguuuucuguucuuu

SEQ ID NO: 1168720 - RNA, 12 nt, Human
caucacuucccu

SEQ ID NO: 1168721 - RNA, 14 nt, Human
caucacuucccuac

SEQ ID NO: 1168722 - RNA, 15 nt, Human
cauccuggcacccgg

SEQ ID NO: 1168723 - RNA, 22 nt, Human
cauccuggcacccggccccugc

SEQ ID NO: 1168724 - RNA, 23 nt, Human
cauccuggcacccggccccugcu

SEQ ID NO: 1168725 - RNA, 18 nt, Human
ccacgcccccacugguga

SEQ ID NO: 1168726 - RNA, 19 nt, Human
ccacgcccccacuggugac

SEQ ID NO: 1168727 - RNA, 16 nt, Human
ccacgcccccacuggu

SEQ ID NO: 1168728 - RNA, 17 nt, Human
ccacgcccccacuggug

SEQ ID NO: 1168729 - RNA, 13 nt, Human
ccaccgcagacag

SEQ ID NO: 1168730 - RNA, 22 nt, Human
ccaccgcagacaggaccaggga

SEQ ID NO: 1168731 - RNA, 21 nt, Human
ccaccuuugaagaaguaagga

SEQ ID NO: 1168732 - RNA, 13 nt, Human
ccaccaucaagcc

SEQ ID NO: 1168733 - RNA, 14 nt, Human
ccaccaucaagcca

SEQ ID NO: 1168734 - RNA, 15 nt, Human
ccaccaucaagccac

SEQ ID NO: 1168735 - RNA, 19 nt, Human
cauuuguauaaaauaauuu

SEQ ID NO: 1168736 - RNA, 20 nt, Human
cauuuguauaaaauaauuuu

SEQ ID NO: 1168737 - RNA, 22 nt, Human
cauuuuuuuuaagaaaaaggau

SEQ ID NO: 1168738 - RNA, 21 nt, Human
ccaaaacucuccucugcugcu

SEQ ID NO: 1168739 - RNA, 17 nt, Human
ccaaugggagcucaugg

SEQ ID NO: 1168740 - RNA, 17 nt, Human
ccaaauguucaucaaug

SEQ ID NO: 1168741 - RNA, 16 nt, Human
ccaacucaccccagcc

SEQ ID NO: 1168742 - RNA, 17 nt, Human
ccaacucaccccagccc

SEQ ID NO: 1168743 - RNA, 18 nt, Human
ccaacucaccccagcccc

SEQ ID NO: 1168744 - RNA, 18 nt, Human
ccaaauguucaucaauga

SEQ ID NO: 1168745 - RNA, 12 nt, Human
ccaagcucugcu

SEQ ID NO: 1168746 - RNA, 13 nt, Human
ccaagcucugcuc

SEQ ID NO: 1168747 - RNA, 18 nt, Human
ccaagcucugcuccucuc

SEQ ID NO: 1168748 - RNA, 17 nt, Human
ccaauauuuaccagacc

SEQ ID NO: 1168749 - RNA, 15 nt, Human
ccaaugauggucacc

SEQ ID NO: 1168750 - RNA, 14 nt, Human
ccaaugcacuuugu

SEQ ID NO: 1168751 - RNA, 12 nt, Human
cucauguucuua

SEQ ID NO: 1168752 - RNA, 15 nt, Human
cuccaagaccuucuc

SEQ ID NO: 1168753 - RNA, 22 nt, Human
cuccaagaccuucuccuucacc

SEQ ID NO: 1168754 - RNA, 13 nt, Human
cuccaagcaggac

SEQ ID NO: 1168755 - RNA, 14 nt, Human
cuccaagcaggaca

SEQ ID NO: 1168756 - RNA, 22 nt, Human
cuccaagcaggacauggacaag

SEQ ID NO: 1168757 - RNA, 24 nt, Human
cuccaagcaggacauggacaagga

SEQ ID NO: 1168758 - RNA, 13 nt, Human
cuccaagcuccca

SEQ ID NO: 1168759 - RNA, 14 nt, Human
cuccaagcucccag

SEQ ID NO: 1168760 - RNA, 15 nt, Human
cuccaagcucccagg

SEQ ID NO: 1168761 - RNA, 16 nt, Human
cuccaagcucccaggc

SEQ ID NO: 1168762 - RNA, 17 nt, Human
cuccaagcucccaggca

SEQ ID NO: 1168763 - RNA, 13 nt, Human
cuccacuuggucu

SEQ ID NO: 1168764 - RNA, 15 nt, Human
cuccacuuggucugu

SEQ ID NO: 1168765 - RNA, 16 nt, Human
cuccacuuggucugug

SEQ ID NO: 1168766 - RNA, 17 nt, Human
cuccacuuggucuguga

SEQ ID NO: 1168767 - RNA, 21 nt, Human
cuccacuuggucugugagaug

SEQ ID NO: 1168768 - RNA, 22 nt, Human
cuccacuuggucugugagaugc

SEQ ID NO: 1168769 - RNA, 23 nt, Human
cuccacuuggucugugagaugcu

SEQ ID NO: 1168770 - RNA, 16 nt, Human
cuccacuuucuagcca

SEQ ID NO: 1168771 - RNA, 19 nt, Human
cuccacuuucuagccagag

SEQ ID NO: 1168772 - RNA, 20 nt, Human
cuccacuuucuagccagagg

SEQ ID NO: 1168773 - RNA, 22 nt, Human
cucccccagccccauccucugu

SEQ ID NO: 1168774 - RNA, 15 nt, Human
cucccccagccccau

SEQ ID NO: 1168775 - RNA, 20 nt, Human
cucccccagccccauccucu

SEQ ID NO: 1168776 - RNA, 16 nt, Human
cuccucugcugcuggc

SEQ ID NO: 1168777 - RNA, 18 nt, Human
cuccucugcugcuggcug

SEQ ID NO: 1168778 - RNA, 16 nt, Human
cuccuggcccacugca

SEQ ID NO: 1168779 - RNA, 18 nt, Human
cuccuggcccacugcauc

SEQ ID NO: 1168780 - RNA, 13 nt, Human
cucgaacuggcug

SEQ ID NO: 1168781 - RNA, 14 nt, Human
cucgaacuggcugc

SEQ ID NO: 1168782 - RNA, 15 nt, Human
cucgaacuggcugca

SEQ ID NO: 1168783 - RNA, 16 nt, Human
cucgaacuggcugcaa

SEQ ID NO: 1168784 - RNA, 14 nt, Human
cucguuaauuugua

SEQ ID NO: 1168785 - RNA, 15 nt, Human
cucugguuaucuaau

SEQ ID NO: 1168786 - RNA, 15 nt, Human
cucugguccauagag

SEQ ID NO: 1168787 - RNA, 13 nt, Human
cucugcugacaga

SEQ ID NO: 1168788 - RNA, 14 nt, Human
cucugcugacagac

SEQ ID NO: 1168789 - RNA, 16 nt, Human
cucugcugacagacac

SEQ ID NO: 1168790 - RNA, 14 nt, Human
cucugguccauaga

SEQ ID NO: 1168791 - RNA, 20 nt, Human
cucugcacuccccugcuggg

SEQ ID NO: 1168792 - RNA, 21 nt, Human
cucugcacuccccugcugggu

SEQ ID NO: 1168793 - RNA, 13 nt, Human
cucugcagcaaua

SEQ ID NO: 1168794 - RNA, 13 nt, Human
cucugcuccucuc

SEQ ID NO: 1168795 - RNA, 18 nt, Human
cucugcuccucuccccag

SEQ ID NO: 1168796 - RNA, 20 nt, Human
cucugcuccucuccccagca

SEQ ID NO: 1168797 - RNA, 14 nt, Human
cucuucaaucucuu

SEQ ID NO: 1168798 - RNA, 18 nt, Human
cucuucagaucucuaacu

SEQ ID NO: 1168799 - RNA, 19 nt, Human
cucuucagaucucuaacuu

SEQ ID NO: 1168800 - RNA, 22 nt, Human
cucuuagaugcaguucugaaga

SEQ ID NO: 1168801 - RNA, 14 nt, Human
cucuuauugcccac

SEQ ID NO: 1168802 - RNA, 15 nt, Human
cucuuauugcccacg

SEQ ID NO: 1168803 - RNA, 19 nt, Human
cucuuauugcccacgcugg

SEQ ID NO: 1168804 - RNA, 20 nt, Human
cucuuauugcccacgcugga

SEQ ID NO: 1168805 - RNA, 22 nt, Human
cugacaacacucauugaccuga

SEQ ID NO: 1168806 - RNA, 23 nt, Human
cugacaacacucauugaccugag

SEQ ID NO: 1168807 - RNA, 19 nt, Human
cugaaggccccgcccaggc

SEQ ID NO: 1168808 - RNA, 21 nt, Human
cugaaggccccgcccaggcuu

SEQ ID NO: 1168809 - RNA, 17 nt, Human
cugaaggcuggguucug

SEQ ID NO: 1168810 - RNA, 23 nt, Human
cugaaggacauugcggacagcca

SEQ ID NO: 1168811 - RNA, 22 nt, Human
cucuugauucauaaugacuuaa

SEQ ID NO: 1168812 - RNA, 16 nt, Human
cucuugagccuugaac

SEQ ID NO: 1168813 - RNA, 17 nt, Human
cucuugagccuugaacu

SEQ ID NO: 1168814 - RNA, 18 nt, Human
cucuugagccuugaacuu

SEQ ID NO: 1168815 - RNA, 23 nt, Human
cucuugagccuugaacuuugacc

SEQ ID NO: 1168816 - RNA, 21 nt, Human
cugacccaugcugcccuguga

SEQ ID NO: 1168817 - RNA, 22 nt, Human
cugacccaugcugcccugugag

SEQ ID NO: 1168818 - RNA, 23 nt, Human
cugagacagcccgggcucugccu

SEQ ID NO: 1168819 - RNA, 21 nt, Human
cugagacucgcgacaaugcaa

SEQ ID NO: 1168820 - RNA, 22 nt, Human
cugagacucgcgacaaugcaaa

SEQ ID NO: 1168821 - RNA, 21 nt, Human
cugagaggacuuuucuuugug

SEQ ID NO: 1168822 - RNA, 22 nt, Human
cugagaggacuuuucuuugugg

SEQ ID NO: 1168823 - RNA, 17 nt, Human
cugagaguagagucacu

SEQ ID NO: 1168824 - RNA, 18 nt, Human
cugaguacguugugcauu

SEQ ID NO: 1168825 - RNA, 19 nt, Human
cugaguacguugugcauuu

SEQ ID NO: 1168826 - RNA, 20 nt, Human
cugaguacguugugcauuug

SEQ ID NO: 1168827 - RNA, 21 nt, Human
cugaguacguugugcauuugg

SEQ ID NO: 1168828 - RNA, 12 nt, Human
cugaggugggag

SEQ ID NO: 1168829 - RNA, 21 nt, Human
cugagaucaaaacgguuuuac

SEQ ID NO: 1168830 - RNA, 14 nt, Human
cugagcuuucugcu

SEQ ID NO: 1168831 - RNA, 15 nt, Human
cugagcuuucugcua

SEQ ID NO: 1168832 - RNA, 17 nt, Human
cugaggaauccagaccc

SEQ ID NO: 1168833 - RNA, 20 nt, Human
cugaggaauccagacccggc

SEQ ID NO: 1168834 - RNA, 21 nt, Human
cugaggaauccagacccggcu

SEQ ID NO: 1168835 - RNA, 20 nt, Human
cugaggacacuaaccacgcu

SEQ ID NO: 1168836 - RNA, 23 nt, Human
cugaggacacuaaccacgcugga

SEQ ID NO: 1168837 - RNA, 16 nt, Human
cgguuuuacugcagcu

SEQ ID NO: 1168838 - RNA, 18 nt, Human
cgugaguccuggcauggg

SEQ ID NO: 1168839 - RNA, 17 nt, Human
cgugaguccuggcaugg

SEQ ID NO: 1168840 - RNA, 17 nt, Human
cgugaggccagagacac

SEQ ID NO: 1168841 - RNA, 16 nt, Human
cgugaguccuggcaug

SEQ ID NO: 1168842 - RNA, 14 nt, Human
cgugcacacaccag

SEQ ID NO: 1168843 - RNA, 20 nt, Human
cguguaaccauggacccaau

SEQ ID NO: 1168844 - RNA, 13 nt, Human
cgcugccccuggc

SEQ ID NO: 1168845 - RNA, 16 nt, Human
cggagucccaccuugg

SEQ ID NO: 1168846 - RNA, 18 nt, Human
cggagucccaccuuggcu

SEQ ID NO: 1168847 - RNA, 20 nt, Human
cggagucccaccuuggcugc

SEQ ID NO: 1168848 - RNA, 21 nt, Human
cggagucccaccuuggcugca

SEQ ID NO: 1168849 - RNA, 15 nt, Human
cggcucacugcagcc

SEQ ID NO: 1168850 - RNA, 16 nt, Human
cggcucacugcagccu

SEQ ID NO: 1168851 - RNA, 17 nt, Human
cggcucacugcagccuc

SEQ ID NO: 1168852 - RNA, 12 nt, Human
cggcuccaggcu

SEQ ID NO: 1168853 - RNA, 13 nt, Human
cggcuccaggcuc

SEQ ID NO: 1168854 - RNA, 14 nt, Human
cggcuccaggcucc

SEQ ID NO: 1168855 - RNA, 15 nt, Human
cggcuccaggcuccu

SEQ ID NO: 1168856 - RNA, 16 nt, Human
cggcuccaggcuccuu

SEQ ID NO: 1168857 - RNA, 12 nt, Human
cgggccacagag

SEQ ID NO: 1168858 - RNA, 14 nt, Human
cgggccacagagaa

SEQ ID NO: 1168859 - RNA, 17 nt, Human
cgggccacagagaaagu

SEQ ID NO: 1168860 - RNA, 11 nt, Human
cgggcucagca

SEQ ID NO: 1168861 - RNA, 15 nt, Human
cgggcucagcaaaag

SEQ ID NO: 1168862 - RNA, 19 nt, Human
cgggcucagcaaaagaugc

SEQ ID NO: 1168863 - RNA, 14 nt, Human
cgggcucugccucc

SEQ ID NO: 1168864 - RNA, 16 nt, Human
cgggcucugccuccca

SEQ ID NO: 1168865 - RNA, 17 nt, Human
cgggcucugccucccau

SEQ ID NO: 1168866 - RNA, 14 nt, Human
cggggacagcuccu

SEQ ID NO: 1168867 - RNA, 15 nt, Human
cggggacagcuccuu

SEQ ID NO: 1168868 - RNA, 22 nt, Human
cggggacagcuccuucuguccu

SEQ ID NO: 1168869 - RNA, 18 nt, Human
cgguguggagaagcggcu

SEQ ID NO: 1168870 - RNA, 17 nt, Human
cgccagauucuuuccug

SEQ ID NO: 1168871 - RNA, 14 nt, Human
cgauagugguggug

SEQ ID NO: 1168872 - RNA, 22 nt, Human
cgcaggauucuuccucccuccc

SEQ ID NO: 1168873 - RNA, 21 nt, Human
ccuuucaauaggaaaaacuga

SEQ ID NO: 1168874 - RNA, 15 nt, Human
ccuuuugagugccuu

SEQ ID NO: 1168875 - RNA, 17 nt, Human
ccuuuugagugccuuac

SEQ ID NO: 1168876 - RNA, 16 nt, Human
ccuugccgucuaccug

SEQ ID NO: 1168877 - RNA, 17 nt, Human
ccuugccgucuaccuga

SEQ ID NO: 1168878 - RNA, 12 nt, Human
cgacaaugcaaa

SEQ ID NO: 1168879 - RNA, 13 nt, Human
cgacaaugcaaac

SEQ ID NO: 1168880 - RNA, 21 nt, Human
ccuuuuuuagaguugauacua

SEQ ID NO: 1168881 - RNA, 17 nt, Human
cgacugcccggcagggu

SEQ ID NO: 1168882 - RNA, 19 nt, Human
cgacccuugccgucuaccu

SEQ ID NO: 1168883 - RNA, 20 nt, Human
cgacccuugccgucuaccug

SEQ ID NO: 1168884 - RNA, 21 nt, Human
cuaagugguacuaacuuuccu

SEQ ID NO: 1168885 - RNA, 23 nt, Human
cuaaguuuuuauggcuuuugugc

SEQ ID NO: 1168886 - RNA, 20 nt, Human
cuacaugagguacugagagu

SEQ ID NO: 1168887 - RNA, 19 nt, Human
cuacaguccucccaucuca

SEQ ID NO: 1168888 - RNA, 20 nt, Human
cuacaguccucccaucucac

SEQ ID NO: 1168889 - RNA, 21 nt, Human
cuacaguugaaaaacagcuga

SEQ ID NO: 1168890 - RNA, 22 nt, Human
cuacaguugaaaaacagcugag

SEQ ID NO: 1168891 - RNA, 12 nt, Human
cuagaacucccu

SEQ ID NO: 1168892 - RNA, 13 nt, Human
cuagaacucccuu

SEQ ID NO: 1168893 - RNA, 22 nt, Human
cuagaagauuuugaaauuuuua

SEQ ID NO: 1168894 - RNA, 21 nt, Human
cuagcauacguacacauuuua

SEQ ID NO: 1168895 - RNA, 23 nt, Human
cuagcauacguacacauuuuauu

SEQ ID NO: 1168896 - RNA, 13 nt, Human
cucaaugcacuga

SEQ ID NO: 1168897 - RNA, 15 nt, Human
cucaaugcacugaca

SEQ ID NO: 1168898 - RNA, 20 nt, Human
cucaaacucuugaccucagg

SEQ ID NO: 1168899 - RNA, 18 nt, Human
cuaucucccccagcccca

SEQ ID NO: 1168900 - RNA, 16 nt, Human
cuaucucccccagccc

SEQ ID NO: 1168901 - RNA, 17 nt, Human
cuaucucccccagcccc

SEQ ID NO: 1168902 - RNA, 17 nt, Human
cucaaaaaaagaaaaag

SEQ ID NO: 1168903 - RNA, 18 nt, Human
cucaaaagcugggcaggu

SEQ ID NO: 1168904 - RNA, 14 nt, Human
cuaucuaaauguug

SEQ ID NO: 1168905 - RNA, 15 nt, Human
cuaucucccccagcc

SEQ ID NO: 1168906 - RNA, 22 nt, Human
cuaguuugauuaaauucuugca

SEQ ID NO: 1168907 - RNA, 12 nt, Human
cuagccagagga

SEQ ID NO: 1168908 - RNA, 13 nt, Human
cuagccagaggag

SEQ ID NO: 1168909 - RNA, 15 nt, Human
cuagccagaggagag

SEQ ID NO: 1168910 - RNA, 17 nt, Human
cuagccagaggagagag

SEQ ID NO: 1168911 - RNA, 23 nt, Human
cuaguuguuugauucagacagcu

SEQ ID NO: 1168912 - RNA, 13 nt, Human
cuaguuugauuaa

SEQ ID NO: 1168913 - RNA, 15 nt, Human
cuaguuugauuaaau

SEQ ID NO: 1168914 - RNA, 13 nt, Human
ccucuuucccucc

SEQ ID NO: 1168915 - RNA, 16 nt, Human
ccucuuucccucccuu

SEQ ID NO: 1168916 - RNA, 17 nt, Human
ccugcacuugcagacuc

SEQ ID NO: 1168917 - RNA, 18 nt, Human
ccugcacuugcagacucu

SEQ ID NO: 1168918 - RNA, 19 nt, Human
ccugcacuugcagacucua

SEQ ID NO: 1168919 - RNA, 13 nt, Human
ccugcccaggccc

SEQ ID NO: 1168920 - RNA, 15 nt, Human
ccugcccaccuggcc

SEQ ID NO: 1168921 - RNA, 12 nt, Human
ccugcccaccug

SEQ ID NO: 1168922 - RNA, 13 nt, Human
ccugcccaccugg

SEQ ID NO: 1168923 - RNA, 14 nt, Human
ccugcccaccuggc

SEQ ID NO: 1168924 - RNA, 20 nt, Human
ccugcccaccuggccucugc

SEQ ID NO: 1168925 - RNA, 20 nt, Human
ccugcugcaguugccaguca

SEQ ID NO: 1168926 - RNA, 21 nt, Human
ccugcugcaguugccagucac

SEQ ID NO: 1168927 - RNA, 21 nt, Human
ccugccucgaacuggcugcaa

SEQ ID NO: 1168928 - RNA, 23 nt, Human
ccugccucgaacuggcugcaaag

SEQ ID NO: 1168929 - RNA, 17 nt, Human
ccugcugcaguugccag

SEQ ID NO: 1168930 - RNA, 19 nt, Human
ccugcugcaguugccaguc

SEQ ID NO: 1168931 - RNA, 11 nt, Human
ccucuuucccu

SEQ ID NO: 1168932 - RNA, 15 nt, Human
ccugucuaaugaaac

SEQ ID NO: 1168933 - RNA, 22 nt, Human
ccugucuaaugaaaccuguguc

SEQ ID NO: 1168934 - RNA, 15 nt, Human
ccuguaaucacagcu

SEQ ID NO: 1168935 - RNA, 18 nt, Human
ccugggggcugggcagag

SEQ ID NO: 1168936 - RNA, 21 nt, Human
ccugguggcagugggagcugc

SEQ ID NO: 1168937 - RNA, 22 nt, Human
ccuggccucugcacuccccugc

SEQ ID NO: 1168938 - RNA, 22 nt, Human
ccuggccuagcauacguacaca

SEQ ID NO: 1168939 - RNA, 22 nt, Human
ccuggccucaagugauucuccu

SEQ ID NO: 1168940 - RNA, 20 nt, Human
ccuggccucugcacuccccu

SEQ ID NO: 1168941 - RNA, 21 nt, Human
ccuggccucugcacuccccug

SEQ ID NO: 1168942 - RNA, 15 nt, Human
ccucauguccacugg

SEQ ID NO: 1168943 - RNA, 15 nt, Human
ccucccaccucagcc

SEQ ID NO: 1168944 - RNA, 17 nt, Human
ccucccaccucagccuc

SEQ ID NO: 1168945 - RNA, 13 nt, Human
ccucccaucucac

SEQ ID NO: 1168946 - RNA, 16 nt, Human
ccucccaucucacaca

SEQ ID NO: 1168947 - RNA, 23 nt, Human
ccucauggaauuggagcucgugg

SEQ ID NO: 1168948 - RNA, 14 nt, Human
ccggccccugcugg

SEQ ID NO: 1168949 - RNA, 15 nt, Human
ccggccccugcuggu

SEQ ID NO: 1168950 - RNA, 16 nt, Human
cccugucuaaugaaac

SEQ ID NO: 1168951 - RNA, 20 nt, Human
cccugucucaaaaaaagaaa

SEQ ID NO: 1168952 - RNA, 23 nt, Human
cccugucucaaaaaaagaaaaag

SEQ ID NO: 1168953 - RNA, 18 nt, Human
cccugugauggggcccug

SEQ ID NO: 1168954 - RNA, 19 nt, Human
cccugugauggggcccugc

SEQ ID NO: 1168955 - RNA, 20 nt, Human
cccugugauggggcccugcc

SEQ ID NO: 1168956 - RNA, 13 nt, Human
cccuucgcuccug

SEQ ID NO: 1168957 - RNA, 13 nt, Human
ccggccccugcug

SEQ ID NO: 1168958 - RNA, 14 nt, Human
cccuucgcuccugu

SEQ ID NO: 1168959 - RNA, 15 nt, Human
cccuucgcuccugug

SEQ ID NO: 1168960 - RNA, 21 nt, Human
cccuucucuccagccccugga

SEQ ID NO: 1168961 - RNA, 22 nt, Human
cccuucucuccagccccuggau

SEQ ID NO: 1168962 - RNA, 12 nt, Human
cccggcugcgga

SEQ ID NO: 1168963 - RNA, 12 nt, Human
cccgggaagggg

SEQ ID NO: 1168964 - RNA, 17 nt, Human
ccccuucugacccaugc

SEQ ID NO: 1168965 - RNA, 18 nt, Human
ccccugcacuccagccug

SEQ ID NO: 1168966 - RNA, 14 nt, Human
ccccuucgcuccug

SEQ ID NO: 1168967 - RNA, 15 nt, Human
ccccuucgcuccugu

SEQ ID NO: 1168968 - RNA, 17 nt, Human
ccccuucgcuccugugu

SEQ ID NO: 1168969 - RNA, 19 nt, Human
ccccuucgcuccugugucu

SEQ ID NO: 1168970 - RNA, 21 nt, Human
ccccauucugccugcccaggc

SEQ ID NO: 1168971 - RNA, 15 nt, Human
ccccauucugccugc

SEQ ID NO: 1168972 - RNA, 13 nt, Human
ccccauucugccu

SEQ ID NO: 1168973 - RNA, 14 nt, Human
ccccauucugccug

SEQ ID NO: 1168974 - RNA, 21 nt, Human
cccauucugccugcccaggcc

SEQ ID NO: 1168975 - RNA, 22 nt, Human
cccauucugccugcccaggccc

SEQ ID NO: 1168976 - RNA, 23 nt, Human
cccauucugccugcccaggcccc

SEQ ID NO: 1168977 - RNA, 22 nt, Human
ccccagauugcaacaggcuggg

SEQ ID NO: 1168978 - RNA, 23 nt, Human
ccccagauugcaacaggcugggc

SEQ ID NO: 1168979 - RNA, 17 nt, Human
ccccagcaagugagagc

SEQ ID NO: 1168980 - RNA, 19 nt, Human
ccccagcaagugagagcug

SEQ ID NO: 1168981 - RNA, 20 nt, Human
ccccagcaagugagagcugg

SEQ ID NO: 1168982 - RNA, 21 nt, Human
ccccagcaagugagagcuggg

SEQ ID NO: 1168983 - RNA, 19 nt, Human
ccccauccucuguacagag

SEQ ID NO: 1168984 - RNA, 21 nt, Human
ccccauccucuguacagagcc

SEQ ID NO: 1168985 - RNA, 22 nt, Human
ccccauccucuguacagagccc

SEQ ID NO: 1168986 - RNA, 14 nt, Human
cccagcccacuucu

SEQ ID NO: 1168987 - RNA, 17 nt, Human
cccagcccacuucugcc

SEQ ID NO: 1168988 - RNA, 21 nt, Human
cccagcugugcucuggacagg

SEQ ID NO: 1168989 - RNA, 23 nt, Human
cccagcugugcucuggacaggca

SEQ ID NO: 1168990 - RNA, 22 nt, Human
cccagcuuaaaggggcuagagu

SEQ ID NO: 1168991 - RNA, 21 nt, Human
cccaggaaaggcuccaggagc

SEQ ID NO: 1168992 - RNA, 22 nt, Human
cccaggaaaggcuccaggagca

SEQ ID NO: 1168993 - RNA, 23 nt, Human
cccaggaaaggcuccaggagcag

SEQ ID NO: 1168994 - RNA, 15 nt, Human
cccaggcuuagucac

SEQ ID NO: 1168995 - RNA, 20 nt, Human
cccaggcuuagucacugaga

SEQ ID NO: 1168996 - RNA, 12 nt, Human
ccagucaccccg

SEQ ID NO: 1168997 - RNA, 13 nt, Human
ccagucaccccgg

SEQ ID NO: 1168998 - RNA, 20 nt, Human
ccagucaccccggccaccug

SEQ ID NO: 1168999 - RNA, 21 nt, Human
ccagucaccccggccaccugc

SEQ ID NO: 1169000 - RNA, 13 nt, Human
ccaggcugggaga

SEQ ID NO: 1169001 - RNA, 14 nt, Human
ccaggcugggagag

SEQ ID NO: 1169002 - RNA, 15 nt, Human
ccaggcugggagagc

SEQ ID NO: 1169003 - RNA, 17 nt, Human
ccaggcugggagagccu

SEQ ID NO: 1169004 - RNA, 18 nt, Human
ccaggcugggagagccuu

SEQ ID NO: 1169005 - RNA, 21 nt, Human
ccaggcugggagagccuucca

SEQ ID NO: 1169006 - RNA, 22 nt, Human
ccaggcugggagagccuuccag

SEQ ID NO: 1169007 - RNA, 23 nt, Human
ccaggcugggagagccuuccagg

SEQ ID NO: 1169008 - RNA, 21 nt, Human
ccaggaaaggcuccaggagca

SEQ ID NO: 1169009 - RNA, 22 nt, Human
ccaggaaaggcuccaggagcag

SEQ ID NO: 1169010 - RNA, 23 nt, Human
ccaggaaaggcuccaggagcagc

SEQ ID NO: 1169011 - RNA, 15 nt, Human
ccagcagccuggacc

SEQ ID NO: 1169012 - RNA, 19 nt, Human
ccagcagccuggacccugu

SEQ ID NO: 1169013 - RNA, 20 nt, Human
ccagcagccuggacccugug

SEQ ID NO: 1169014 - RNA, 21 nt, Human
ccagccccuggaugcagccuc

SEQ ID NO: 1169015 - RNA, 10 nt, Human
ccagccccuu

SEQ ID NO: 1169016 - RNA, 23 nt, Human
ccagcagagcaccuuagacaguc

SEQ ID NO: 1169017 - RNA, 19 nt, Human
ccagcagagcaccuuagac

SEQ ID NO: 1169018 - RNA, 13 nt, Human
ccauacauuugug

SEQ ID NO: 1169019 - RNA, 14 nt, Human
ccauacauuugugu

SEQ ID NO: 1169020 - RNA, 23 nt, Human
ccaucccaaacccuucagugcca

SEQ ID NO: 1169021 - RNA, 12 nt, Human
ccaucccagccc

SEQ ID NO: 1169022 - RNA, 13 nt, Human
ccaucccagcccc

SEQ ID NO: 1169023 - RNA, 16 nt, Human
ccauccccuguagagu

SEQ ID NO: 1169024 - RNA, 22 nt, Human
ccauccccuguagagugggagc

SEQ ID NO: 1169025 - RNA, 14 nt, Human
ccaugagccucagc

SEQ ID NO: 1169026 - RNA, 18 nt, Human
ccaugagccucagcaucc

SEQ ID NO: 1169027 - RNA, 19 nt, Human
ccaugagccucagcauccu

SEQ ID NO: 1169028 - RNA, 14 nt, Human
ccaugaguccccug

SEQ ID NO: 1169029 - RNA, 15 nt, Human
ccaugaguccccugu

SEQ ID NO: 1169030 - RNA, 16 nt, Human
ccaugaguccccuguu

SEQ ID NO: 1169031 - RNA, 13 nt, Human
ccaugggccuccu

SEQ ID NO: 1169032 - RNA, 18 nt, Human
ccaugaguccccuguuug

SEQ ID NO: 1169033 - RNA, 17 nt, Human
ccaugggccuccugugu

SEQ ID NO: 1169034 - RNA, 14 nt, Human
ccaugggccuccug

SEQ ID NO: 1169035 - RNA, 15 nt, Human
ccaugggccuccugu

SEQ ID NO: 1169036 - RNA, 16 nt, Human
aaaauauuuuccugcc

SEQ ID NO: 1169037 - RNA, 20 nt, Human
aaaauggaagacagcucuua

SEQ ID NO: 1169038 - RNA, 22 nt, Human
aaaaggagccaauuuaaagaaa

SEQ ID NO: 1169039 - RNA, 13 nt, Human
aaaaggaugcaca

SEQ ID NO: 1169040 - RNA, 14 nt, Human
aaaaggaugcacag

SEQ ID NO: 1169041 - RNA, 15 nt, Human
aaaaggaugcacaga

SEQ ID NO: 1169042 - RNA, 19 nt, Human
aaaaggaugcacagaguug

SEQ ID NO: 1169043 - RNA, 22 nt, Human
aaaaggaugcacagaguuguua

SEQ ID NO: 1169044 - RNA, 11 nt, Human
aaaaggcagga

SEQ ID NO: 1169045 - RNA, 16 nt, Human
aaaagguuaauaaagu

SEQ ID NO: 1169046 - RNA, 17 nt, Human
aaaagguuaauaaagua

SEQ ID NO: 1169047 - RNA, 11 nt, Human
aaaauaauuuu

SEQ ID NO: 1169048 - RNA, 16 nt, Human
aaaauaauuuuuauau

SEQ ID NO: 1169049 - RNA, 17 nt, Human
aaaauaauuuuuauauu

SEQ ID NO: 1169050 - RNA, 20 nt, Human
aaaauaauuuuuauauuuga

SEQ ID NO: 1169051 - RNA, 15 nt, Human
gggcgugguggugag

SEQ ID NO: 1169052 - RNA, 13 nt, Human
gggccucagugcc

SEQ ID NO: 1169053 - RNA, 14 nt, Human
gggccucagugcca

SEQ ID NO: 1169054 - RNA, 15 nt, Human
gggccucagugccac

SEQ ID NO: 1169055 - RNA, 22 nt, Human
gggccucgguguggagaagcgg

SEQ ID NO: 1169056 - RNA, 18 nt, Human
gggccucuuaugggcugg

SEQ ID NO: 1169057 - RNA, 19 nt, Human
gggccucuuaugggcuggg

SEQ ID NO: 1169058 - RNA, 13 nt, Human
gggccaggagccu

SEQ ID NO: 1169059 - RNA, 14 nt, Human
gggccaggagccuc

SEQ ID NO: 1169060 - RNA, 15 nt, Human
gggcuaguugggcuu

SEQ ID NO: 1169061 - RNA, 18 nt, Human
gggcuaguugggcuuccu

SEQ ID NO: 1169062 - RNA, 22 nt, Human
gggcucagcaaaagaugcuucu

SEQ ID NO: 1169063 - RNA, 17 nt, Human
gggcucagcggggacag

SEQ ID NO: 1169064 - RNA, 19 nt, Human
gggcucagcggggacagcu

SEQ ID NO: 1169065 - RNA, 21 nt, Human
gggcucagcggggacagcucc

SEQ ID NO: 1169066 - RNA, 10 nt, Human
gggcuccaga

SEQ ID NO: 1169067 - RNA, 13 nt, Human
gggcuccagacac

SEQ ID NO: 1169068 - RNA, 19 nt, Human
gggcugcaccggcuggccu

SEQ ID NO: 1169069 - RNA, 20 nt, Human
gggcugcaccggcuggccug

SEQ ID NO: 1169070 - RNA, 21 nt, Human
gggcugcaccggcuggccugg

SEQ ID NO: 1169071 - RNA, 22 nt, Human
gggcugcaccggcuggccuggc

SEQ ID NO: 1169072 - RNA, 15 nt, Human
gggcugggcagagga

SEQ ID NO: 1169073 - RNA, 17 nt, Human
gggcuggguucuaccca

SEQ ID NO: 1169074 - RNA, 16 nt, Human
aaaaugguuuaaaugg

SEQ ID NO: 1169075 - RNA, 18 nt, Human
aaaaugguuuaaaugguc

SEQ ID NO: 1169076 - RNA, 22 nt, Human
aaaccugugucucugagaguag

SEQ ID NO: 1169077 - RNA, 14 nt, Human
gggucacucuggca

SEQ ID NO: 1169078 - RNA, 20 nt, Human
gggucacucuggcagcucag

SEQ ID NO: 1169079 - RNA, 22 nt, Human
gggucacucuggcagcucagag

SEQ ID NO: 1169080 - RNA, 19 nt, Human
aaacauuuugucauauaag

SEQ ID NO: 1169081 - RNA, 18 nt, Human
aaaauguauguguaagua

SEQ ID NO: 1169082 - RNA, 12 nt, Human
ggggaccagagc

SEQ ID NO: 1169083 - RNA, 13 nt, Human
ggggaccagagcu

SEQ ID NO: 1169084 - RNA, 14 nt, Human
ggggaccagagcug

SEQ ID NO: 1169085 - RNA, 15 nt, Human
ggggaccagagcugc

SEQ ID NO: 1169086 - RNA, 15 nt, Human
ggggcccugccuccu

SEQ ID NO: 1169087 - RNA, 11 nt, Human
gggggcuggga

SEQ ID NO: 1169088 - RNA, 15 nt, Human
gggggcugggcagag

SEQ ID NO: 1169089 - RNA, 13 nt, Human
ggggguggccucc

SEQ ID NO: 1169090 - RNA, 21 nt, Human
ggggucacucuggcagcucag

SEQ ID NO: 1169091 - RNA, 19 nt, Human
gggugggacacccugugau

SEQ ID NO: 1169092 - RNA, 23 nt, Human
ggguuuugccauguuggccaggc

SEQ ID NO: 1169093 - RNA, 20 nt, Human
ggguuuugccauguuggcca

SEQ ID NO: 1169094 - RNA, 13 nt, Human
gguaacaggcaga

SEQ ID NO: 1169095 - RNA, 21 nt, Human
aaacguggcugcuucaaggau

SEQ ID NO: 1169096 - RNA, 14 nt, Human
aaacuuaaucuaaa

SEQ ID NO: 1169097 - RNA, 19 nt, Human
aaacuucagacauagaauu

SEQ ID NO: 1169098 - RNA, 15 nt, Human
gggugggacacccug

SEQ ID NO: 1169099 - RNA, 18 nt, Human
gggugggacacccuguga

SEQ ID NO: 1169100 - RNA, 20 nt, Human
gguaggguaagugagagagg

SEQ ID NO: 1169101 - RNA, 14 nt, Human
gguaucaggugcug

SEQ ID NO: 1169102 - RNA, 20 nt, Human
gguaaggaauaccugucccc

SEQ ID NO: 1169103 - RNA, 22 nt, Human
aaacuugauguguuaucucuua

SEQ ID NO: 1169104 - RNA, 14 nt, Human
ggucagugcaaaua

SEQ ID NO: 1169105 - RNA, 19 nt, Human
gguaucaggugcugccauc

SEQ ID NO: 1169106 - RNA, 16 nt, Human
gguuucuaaagcugcc

SEQ ID NO: 1169107 - RNA, 22 nt, Human
gguuucuaaagcugccagccga

SEQ ID NO: 1169108 - RNA, 20 nt, Human
gguuuguaaauuaacuuuua

SEQ ID NO: 1169109 - RNA, 18 nt, Human
aaaguacacuguuucaaa

SEQ ID NO: 1169110 - RNA, 19 nt, Human
aaaguacacuguuucaaac

SEQ ID NO: 1169111 - RNA, 20 nt, Human
aaaguacacuguuucaaacu

SEQ ID NO: 1169112 - RNA, 20 nt, Human
aaaguagaagucuuagaugu

SEQ ID NO: 1169113 - RNA, 22 nt, Human
aaaguagaagucuuagauguau

SEQ ID NO: 1169114 - RNA, 21 nt, Human
aaaguaucccuacuguaauuu

SEQ ID NO: 1169115 - RNA, 17 nt, Human
aaaguauguuagugcaa

SEQ ID NO: 1169116 - RNA, 14 nt, Human
aaaguguauuuuuu

SEQ ID NO: 1169117 - RNA, 21 nt, Human
aaaguguauuuuuuuacuaau

SEQ ID NO: 1169118 - RNA, 13 nt, Human
ggugggggccucg

SEQ ID NO: 1169119 - RNA, 14 nt, Human
gguguggagaagcg

SEQ ID NO: 1169120 - RNA, 23 nt, Human
gguguggagaagcggcuggcagc

SEQ ID NO: 1169121 - RNA, 11 nt, Human
gguguggggga

SEQ ID NO: 1169122 - RNA, 13 nt, Human
ggugugggggaag

SEQ ID NO: 1169123 - RNA, 17 nt, Human
gguguuuccuggcacug

SEQ ID NO: 1169124 - RNA, 19 nt, Human
gguguuuccuggcacugcu

SEQ ID NO: 1169125 - RNA, 17 nt, Human
gguucccauuugcuccu

SEQ ID NO: 1169126 - RNA, 23 nt, Human
gguucccuuugacgccaucccag

SEQ ID NO: 1169127 - RNA, 22 nt, Human
gguucccuuuuuuggcugcuga

SEQ ID NO: 1169128 - RNA, 15 nt, Human
aaagcagcguuucua

SEQ ID NO: 1169129 - RNA, 13 nt, Human
aaagcagugcaug

SEQ ID NO: 1169130 - RNA, 16 nt, Human
aaagcagugcaugcug

SEQ ID NO: 1169131 - RNA, 14 nt, Human
aaagcuaggccugg

SEQ ID NO: 1169132 - RNA, 16 nt, Human
aaagcuaggccuggcc

SEQ ID NO: 1169133 - RNA, 17 nt, Human
aaagcuaggccuggcca

SEQ ID NO: 1169134 - RNA, 12 nt, Human
aaagcugccagc

SEQ ID NO: 1169135 - RNA, 13 nt, Human
aaagcugccagcc

SEQ ID NO: 1169136 - RNA, 22 nt, Human
aaagcugccagccgagauagcc

SEQ ID NO: 1169137 - RNA, 12 nt, Human
aaacuuuaugcu

SEQ ID NO: 1169138 - RNA, 19 nt, Human
aaacuuuaugcuaagugaa

SEQ ID NO: 1169139 - RNA, 14 nt, Human
gguggcaccagcag

SEQ ID NO: 1169140 - RNA, 20 nt, Human
gguggcaccagcagccugga

SEQ ID NO: 1169141 - RNA, 16 nt, Human
aaagcagaacagugau

SEQ ID NO: 1169142 - RNA, 13 nt, Human
gguggcagcucac

SEQ ID NO: 1169143 - RNA, 20 nt, Human
aaagggcccagagagggugg

SEQ ID NO: 1169144 - RNA, 20 nt, Human
aaagggcuguuauaaucuuu

SEQ ID NO: 1169145 - RNA, 22 nt, Human
aaagggcuguuauaaucuuuca

SEQ ID NO: 1169146 - RNA, 18 nt, Human
gguggcuggguuggaggg

SEQ ID NO: 1169147 - RNA, 13 nt, Human
ggugggacacccu

SEQ ID NO: 1169148 - RNA, 16 nt, Human
ggugggacacccugug

SEQ ID NO: 1169149 - RNA, 17 nt, Human
ggugggacacccuguga

SEQ ID NO: 1169150 - RNA, 20 nt, Human
ggugggaggaucucuugagc

SEQ ID NO: 1169151 - RNA, 19 nt, Human
gguggggaccucaggccug

SEQ ID NO: 1169152 - RNA, 23 nt, Human
guaauccuagcacuuugggaggc

SEQ ID NO: 1169153 - RNA, 15 nt, Human
guaauuugugauaca

SEQ ID NO: 1169154 - RNA, 17 nt, Human
guaauuugugauacaau

SEQ ID NO: 1169155 - RNA, 20 nt, Human
guaauuugugauacaaugcu

SEQ ID NO: 1169156 - RNA, 22 nt, Human
guaauuugugauacaaugcugu

SEQ ID NO: 1169157 - RNA, 22 nt, Human
aaaguguauuuuuuuacuaaua

SEQ ID NO: 1169158 - RNA, 12 nt, Human
aaaguggugaga

SEQ ID NO: 1169159 - RNA, 22 nt, Human
aaauaaugugaaacuggauuaa

SEQ ID NO: 1169160 - RNA, 16 nt, Human
guaacaagccacccca

SEQ ID NO: 1169161 - RNA, 19 nt, Human
guaacaggaaaauuuuaaa

SEQ ID NO: 1169162 - RNA, 20 nt, Human
guaacaggaaaauuuuaaaa

SEQ ID NO: 1169163 - RNA, 19 nt, Human
aaauauuaagaaagacuau

SEQ ID NO: 1169164 - RNA, 19 nt, Human
aaaucagccugcuccagcu

SEQ ID NO: 1169165 - RNA, 21 nt, Human
aaaucagccugcuccagcugu

SEQ ID NO: 1169166 - RNA, 23 nt, Human
aaaucagccugcuccagcuguuc

SEQ ID NO: 1169167 - RNA, 16 nt, Human
aaaucagcugcuacua

SEQ ID NO: 1169168 - RNA, 12 nt, Human
aaauaucugaaa

SEQ ID NO: 1169169 - RNA, 14 nt, Human
aaauaucugaaaau

SEQ ID NO: 1169170 - RNA, 17 nt, Human
aaauaucugaaaaugua

SEQ ID NO: 1169171 - RNA, 18 nt, Human
aaauaucugaaaauguau

SEQ ID NO: 1169172 - RNA, 19 nt, Human
aaauaucugaaaauguaug

SEQ ID NO: 1169173 - RNA, 21 nt, Human
aaauaucugaaaauguaugug

SEQ ID NO: 1169174 - RNA, 22 nt, Human
aaauaucugaaaauguaugugu

SEQ ID NO: 1169175 - RNA, 23 nt, Human
aaauaucugaaaauguaugugua

SEQ ID NO: 1169176 - RNA, 18 nt, Human
aaauauaugcuaagucuu

SEQ ID NO: 1169177 - RNA, 22 nt, Human
aaauaucacuugucaauaaaau

SEQ ID NO: 1169178 - RNA, 15 nt, Human
aaauauaggaacuua

SEQ ID NO: 1169179 - RNA, 16 nt, Human
guacacacacauacac

SEQ ID NO: 1169180 - RNA, 19 nt, Human
aaauaccagccaguaaaug

SEQ ID NO: 1169181 - RNA, 20 nt, Human
aaauaccagccaguaaaugg

SEQ ID NO: 1169182 - RNA, 21 nt, Human
aaauaccagccaguaaauggg

SEQ ID NO: 1169183 - RNA, 13 nt, Human
ggcucccuuccca

SEQ ID NO: 1169184 - RNA, 15 nt, Human
ggcucuuccaggcug

SEQ ID NO: 1169185 - RNA, 17 nt, Human
ggcucuuccaggcuggg

SEQ ID NO: 1169186 - RNA, 18 nt, Human
ggcucuuccaggcuggga

SEQ ID NO: 1169187 - RNA, 20 nt, Human
ggcucuuccaggcugggaga

SEQ ID NO: 1169188 - RNA, 13 nt, Human
ggcucacugcagc

SEQ ID NO: 1169189 - RNA, 14 nt, Human
ggcucacugcagcc

SEQ ID NO: 1169190 - RNA, 15 nt, Human
ggcucacugcagccu

SEQ ID NO: 1169191 - RNA, 13 nt, Human
ggcuggccuggcc

SEQ ID NO: 1169192 - RNA, 14 nt, Human
ggcuggccuggccc

SEQ ID NO: 1169193 - RNA, 15 nt, Human
ggcuggccuggcccc

SEQ ID NO: 1169194 - RNA, 22 nt, Human
aaaaaacugcugacuguuuucu

SEQ ID NO: 1169195 - RNA, 14 nt, Human
aaaaaggaggaaga

SEQ ID NO: 1169196 - RNA, 21 nt, Human
aaaaaggaugcacagaguugu

SEQ ID NO: 1169197 - RNA, 12 nt, Human
aaaaaggcagga

SEQ ID NO: 1169198 - RNA, 13 nt, Human
aaaaauacaaaaa

SEQ ID NO: 1169199 - RNA, 14 nt, Human
ggcuggguuggagg

SEQ ID NO: 1169200 - RNA, 20 nt, Human
ggcuaagcuucacuguaaaa

SEQ ID NO: 1169201 - RNA, 14 nt, Human
ggcgugcaguggug

SEQ ID NO: 1169202 - RNA, 16 nt, Human
ggccuucggccuccau

SEQ ID NO: 1169203 - RNA, 18 nt, Human
ggccuucggccuccaucc

SEQ ID NO: 1169204 - RNA, 22 nt, Human
ggccuucggccuccauccugag

SEQ ID NO: 1169205 - RNA, 20 nt, Human
ggcuaagugauccucccacc

SEQ ID NO: 1169206 - RNA, 16 nt, Human
ggcuaauguacugcau

SEQ ID NO: 1169207 - RNA, 13 nt, Human
ggcuaccuuugua

SEQ ID NO: 1169208 - RNA, 14 nt, Human
ggcuaccuuuguau

SEQ ID NO: 1169209 - RNA, 16 nt, Human
ggcuagagguucaaag

SEQ ID NO: 1169210 - RNA, 12 nt, Human
ggccuggccaga

SEQ ID NO: 1169211 - RNA, 15 nt, Human
ggccuggccagaugc

SEQ ID NO: 1169212 - RNA, 16 nt, Human
ggccuggccagaugca

SEQ ID NO: 1169213 - RNA, 16 nt, Human
ggccugcaagggagug

SEQ ID NO: 1169214 - RNA, 22 nt, Human
ggccagagggagugacagaggc

SEQ ID NO: 1169215 - RNA, 15 nt, Human
ggccagaugcaccag

SEQ ID NO: 1169216 - RNA, 16 nt, Human
ggccagaugcaccagc

SEQ ID NO: 1169217 - RNA, 17 nt, Human
ggccagaugcaccagcc

SEQ ID NO: 1169218 - RNA, 13 nt, Human
ggccucagugcca

SEQ ID NO: 1169219 - RNA, 18 nt, Human
ggccucccaacucacccc

SEQ ID NO: 1169220 - RNA, 19 nt, Human
ggccucccaacucacccca

SEQ ID NO: 1169221 - RNA, 20 nt, Human
ggccucccaacucaccccag

SEQ ID NO: 1169222 - RNA, 22 nt, Human
ggccucccaacucaccccagcc

SEQ ID NO: 1169223 - RNA, 23 nt, Human
ggccucccaacucaccccagccc

SEQ ID NO: 1169224 - RNA, 14 nt, Human
ggcauuugcugaau

SEQ ID NO: 1169225 - RNA, 19 nt, Human
ggccaaaggaagcacaugc

SEQ ID NO: 1169226 - RNA, 21 nt, Human
ggccaaaggaagcacaugccu

SEQ ID NO: 1169227 - RNA, 17 nt, Human
ggcauuuguuugaacug

SEQ ID NO: 1169228 - RNA, 14 nt, Human
ggccaaaggaagca

SEQ ID NO: 1169229 - RNA, 16 nt, Human
ggccaaaggaagcaca

SEQ ID NO: 1169230 - RNA, 17 nt, Human
ggccagagacacaagcc

SEQ ID NO: 1169231 - RNA, 18 nt, Human
ggccagagacacaagccu

SEQ ID NO: 1169232 - RNA, 17 nt, Human
ggccagagggagugaca

SEQ ID NO: 1169233 - RNA, 19 nt, Human
ggccagagggagugacaga

SEQ ID NO: 1169234 - RNA, 22 nt, Human
ggcagccccauucugccugccc

SEQ ID NO: 1169235 - RNA, 23 nt, Human
ggcagccccauucugccugccca

SEQ ID NO: 1169236 - RNA, 16 nt, Human
ggcagccccauucugc

SEQ ID NO: 1169237 - RNA, 20 nt, Human
ggcagccccauucugccugc

SEQ ID NO: 1169238 - RNA, 21 nt, Human
ggcagccccauucugccugcc

SEQ ID NO: 1169239 - RNA, 20 nt, Human
ggcacugcuuccagugaggc

SEQ ID NO: 1169240 - RNA, 22 nt, Human
ggcacugcuuccagugaggcuc

SEQ ID NO: 1169241 - RNA, 13 nt, Human
ggcagccaggcca

SEQ ID NO: 1169242 - RNA, 14 nt, Human
ggcagccaggccac

SEQ ID NO: 1169243 - RNA, 18 nt, Human
ggcaggaggaucacuuga

SEQ ID NO: 1169244 - RNA, 10 nt, Human
ggcaaaauaa

SEQ ID NO: 1169245 - RNA, 15 nt, Human
ggcaaaaaggcagga

SEQ ID NO: 1169246 - RNA, 18 nt, Human
ggcacaccgggcacucag

SEQ ID NO: 1169247 - RNA, 19 nt, Human
ggcacagaaaauggaagac

SEQ ID NO: 1169248 - RNA, 16 nt, Human
ggcacugcuuccagug

SEQ ID NO: 1169249 - RNA, 14 nt, Human
ggaugaaaaaauaa

SEQ ID NO: 1169250 - RNA, 13 nt, Human
ggauuguccccga

SEQ ID NO: 1169251 - RNA, 16 nt, Human
ggauuguccccgaccc

SEQ ID NO: 1169252 - RNA, 20 nt, Human
ggauuguccccgacccuugc

SEQ ID NO: 1169253 - RNA, 12 nt, Human
ggauuuaacaga

SEQ ID NO: 1169254 - RNA, 16 nt, Human
ggauuuaacagaaaug

SEQ ID NO: 1169255 - RNA, 17 nt, Human
ggauuuaacagaaaugu

SEQ ID NO: 1169256 - RNA, 22 nt, Human
ggauuuaacagaaauguacagc

SEQ ID NO: 1169257 - RNA, 18 nt, Human
ggaucucuugagccuggg

SEQ ID NO: 1169258 - RNA, 16 nt, Human
ggaguucaucuugaau

SEQ ID NO: 1169259 - RNA, 16 nt, Human
ggauccugagccagau

SEQ ID NO: 1169260 - RNA, 18 nt, Human
ggauccugagccagauuu

SEQ ID NO: 1169261 - RNA, 19 nt, Human
ggauccugagccagauuuc

SEQ ID NO: 1169262 - RNA, 20 nt, Human
ggauccugagccagauuuca

SEQ ID NO: 1169263 - RNA, 23 nt, Human
ggauccugagccagauuucacuc

SEQ ID NO: 1169264 - RNA, 15 nt, Human
ggaguggccacagaa

SEQ ID NO: 1169265 - RNA, 16 nt, Human
ggaguggccacagaaa

SEQ ID NO: 1169266 - RNA, 12 nt, Human
ggagugggccca

SEQ ID NO: 1169267 - RNA, 22 nt, Human
ggagugggcccaaugcacuuug

SEQ ID NO: 1169268 - RNA, 21 nt, Human
ggagggugacgggggugaacu

SEQ ID NO: 1169269 - RNA, 22 nt, Human
ggagguaaggaauaccuguccc

SEQ ID NO: 1169270 - RNA, 22 nt, Human
ggaggugggauccuccaggugc

SEQ ID NO: 1169271 - RNA, 23 nt, Human
ggaggugggauccuccaggugca

SEQ ID NO: 1169272 - RNA, 13 nt, Human
ggaggggggaggu

SEQ ID NO: 1169273 - RNA, 14 nt, Human
ggaggggggaggug

SEQ ID NO: 1169274 - RNA, 17 nt, Human
ggacagucaccucaugg

SEQ ID NO: 1169275 - RNA, 18 nt, Human
ggacagucaccucaugga

SEQ ID NO: 1169276 - RNA, 21 nt, Human
ggacagucaccucauggaauu

SEQ ID NO: 1169277 - RNA, 17 nt, Human
ggacagggaggugaccc

SEQ ID NO: 1169278 - RNA, 13 nt, Human
ggacacccuguga

SEQ ID NO: 1169279 - RNA, 23 nt, Human
ggacacccugugauggggcccug

SEQ ID NO: 1169280 - RNA, 13 nt, Human
ggacauggacaag

SEQ ID NO: 1169281 - RNA, 14 nt, Human
ggacauggacaagg

SEQ ID NO: 1169282 - RNA, 16 nt, Human
ggaagcucagggccug

SEQ ID NO: 1169283 - RNA, 17 nt, Human
ggaagcucagggccugg

SEQ ID NO: 1169284 - RNA, 21 nt, Human
ggaagcucagggccuggcuca

SEQ ID NO: 1169285 - RNA, 22 nt, Human
ggaagcucagggccuggcucag

SEQ ID NO: 1169286 - RNA, 15 nt, Human
ggaauaccugucccc

SEQ ID NO: 1169287 - RNA, 16 nt, Human
ggaauaccuguccccc

SEQ ID NO: 1169288 - RNA, 19 nt, Human
ggaauaccugucccccuga

SEQ ID NO: 1169289 - RNA, 16 nt, Human
ggaauauauaaccagu

SEQ ID NO: 1169290 - RNA, 19 nt, Human
ggaaugaaugucaguguga

SEQ ID NO: 1169291 - RNA, 14 nt, Human
ggaaugauuaauua

SEQ ID NO: 1169292 - RNA, 12 nt, Human
ggacacagcucu

SEQ ID NO: 1169293 - RNA, 13 nt, Human
ggacacagcucuu

SEQ ID NO: 1169294 - RNA, 14 nt, Human
ggacacagcucuuc

SEQ ID NO: 1169295 - RNA, 12 nt, Human
ggacacccugug

SEQ ID NO: 1169296 - RNA, 19 nt, Human
ggaaaucaggguuaguauu

SEQ ID NO: 1169297 - RNA, 21 nt, Human
ggaagccagcaggcucucagg

SEQ ID NO: 1169298 - RNA, 22 nt, Human
ggaagccagcaggcucucaggc

SEQ ID NO: 1169299 - RNA, 23 nt, Human
ggaagccagcaggcucucaggcc

SEQ ID NO: 1169300 - RNA, 18 nt, Human
ggaagccgcuggggccag

SEQ ID NO: 1169301 - RNA, 16 nt, Human
gcuuaacuucacauau

SEQ ID NO: 1169302 - RNA, 17 nt, Human
gcuuaacuucacauauu

SEQ ID NO: 1169303 - RNA, 16 nt, Human
gcuucuucagagacuc

SEQ ID NO: 1169304 - RNA, 19 nt, Human
gcuucuucagagacuccug

SEQ ID NO: 1169305 - RNA, 21 nt, Human
gcuucuucagagacuccugca

SEQ ID NO: 1169306 - RNA, 23 nt, Human
gcuucuucagagacuccugcagg

SEQ ID NO: 1169307 - RNA, 17 nt, Human
gcuugaccgugaggcca

SEQ ID NO: 1169308 - RNA, 18 nt, Human
gcuugaccgugaggccag

SEQ ID NO: 1169309 - RNA, 19 nt, Human
gcuugaccgugaggccaga

SEQ ID NO: 1169310 - RNA, 23 nt, Human
gcuugggcuucauccuccucaga

SEQ ID NO: 1169311 - RNA, 16 nt, Human
gcuuggggaccagagc

SEQ ID NO: 1169312 - RNA, 17 nt, Human
gcuuggggaccagagcu

SEQ ID NO: 1169313 - RNA, 18 nt, Human
gcuuggggaccagagcug

SEQ ID NO: 1169314 - RNA, 20 nt, Human
gcuuggggaccagagcugcc

SEQ ID NO: 1169315 - RNA, 21 nt, Human
gcuuggggaccagagcugcca

SEQ ID NO: 1169316 - RNA, 22 nt, Human
gcuuggggaccagagcugccac

SEQ ID NO: 1169317 - RNA, 20 nt, Human
gcuugaccgugaggccagag

SEQ ID NO: 1169318 - RNA, 13 nt, Human
gcuuucuacccag

SEQ ID NO: 1169319 - RNA, 19 nt, Human
gcuuucuacccagcgagcc

SEQ ID NO: 1169320 - RNA, 22 nt, Human
gcuuucuacccagcgagcccug

SEQ ID NO: 1169321 - RNA, 23 nt, Human
gcuuucuacccagcgagcccugg

SEQ ID NO: 1169322 - RNA, 16 nt, Human
ggaaaaaauaacaaug

SEQ ID NO: 1169323 - RNA, 15 nt, Human
gcuuuuuaauauuga

SEQ ID NO: 1169324 - RNA, 13 nt, Human
gcuuuugugcauu

SEQ ID NO: 1169325 - RNA, 19 nt, Human
gcuuuugugcauuaucuag

SEQ ID NO: 1169326 - RNA, 20 nt, Human
ggaaacagcuaaugggacac

SEQ ID NO: 1169327 - RNA, 15 nt, Human
ggaaacccagcucug

SEQ ID NO: 1169328 - RNA, 20 nt, Human
ggaaagacuuuuccaacccu

SEQ ID NO: 1169329 - RNA, 14 nt, Human
ggaaagaggcucug

SEQ ID NO: 1169330 - RNA, 16 nt, Human
ggaaagaguaggaaga

SEQ ID NO: 1169331 - RNA, 17 nt, Human
ggaaagaguaggaagac

SEQ ID NO: 1169332 - RNA, 19 nt, Human
ggaaagcaaaggagauugg

SEQ ID NO: 1169333 - RNA, 16 nt, Human
ggaaagcccugugcuc

SEQ ID NO: 1169334 - RNA, 13 nt, Human
gcugugcucugga

SEQ ID NO: 1169335 - RNA, 15 nt, Human
gcugugcucuggaca

SEQ ID NO: 1169336 - RNA, 16 nt, Human
gcugugcucuggacag

SEQ ID NO: 1169337 - RNA, 18 nt, Human
gcugugcucuggacaggc

SEQ ID NO: 1169338 - RNA, 16 nt, Human
gcuguuggcugggggc

SEQ ID NO: 1169339 - RNA, 20 nt, Human
gcuguuggcugggggccuca

SEQ ID NO: 1169340 - RNA, 15 nt, Human
gcugugcugcccugc

SEQ ID NO: 1169341 - RNA, 16 nt, Human
gcugugcugcccugcc

SEQ ID NO: 1169342 - RNA, 17 nt, Human
gcugugcugcccugccc

SEQ ID NO: 1169343 - RNA, 15 nt, Human
gcuguuggcuggggg

SEQ ID NO: 1169344 - RNA, 17 nt, Human
gcuguaucccaugagcc

SEQ ID NO: 1169345 - RNA, 19 nt, Human
gcuguaucccaugagccuc

SEQ ID NO: 1169346 - RNA, 20 nt, Human
gcuguauuuuaaaagaauga

SEQ ID NO: 1169347 - RNA, 21 nt, Human
gcuguauuuuaaaagaaugau

SEQ ID NO: 1169348 - RNA, 22 nt, Human
gcuguauuuuaaaagaaugauu

SEQ ID NO: 1169349 - RNA, 18 nt, Human
gcuggcuguuggcugggg

SEQ ID NO: 1169350 - RNA, 19 nt, Human
gcuggcuguuggcuggggg

SEQ ID NO: 1169351 - RNA, 15 nt, Human
gcuggcgugcagugg

SEQ ID NO: 1169352 - RNA, 18 nt, Human
gcuggcgugcaguggugc

SEQ ID NO: 1169353 - RNA, 20 nt, Human
gcuggcgugcaguggugcga

SEQ ID NO: 1169354 - RNA, 14 nt, Human
gcuggcgugcagug

SEQ ID NO: 1169355 - RNA, 12 nt, Human
gcugcugaaggc

SEQ ID NO: 1169356 - RNA, 22 nt, Human
gcugggguggggaccucaggcc

SEQ ID NO: 1169357 - RNA, 23 nt, Human
gcugggguggggaccucaggccu

SEQ ID NO: 1169358 - RNA, 18 nt, Human
gcuggguucuacccaggu

SEQ ID NO: 1169359 - RNA, 20 nt, Human
gcuggguucuacccaggugc

SEQ ID NO: 1169360 - RNA, 21 nt, Human
gcuggguucuacccaggugcu

SEQ ID NO: 1169361 - RNA, 20 nt, Human
gcuggcuguuggcugggggc

SEQ ID NO: 1169362 - RNA, 23 nt, Human
gcuggcuguuggcugggggccuc

SEQ ID NO: 1169363 - RNA, 19 nt, Human
gcugggguggggaccucag

SEQ ID NO: 1169364 - RNA, 16 nt, Human
gcugccucucccauca

SEQ ID NO: 1169365 - RNA, 18 nt, Human
gcugccuguucagcucca

SEQ ID NO: 1169366 - RNA, 17 nt, Human
gcugccuguucagcucc

SEQ ID NO: 1169367 - RNA, 12 nt, Human
gcugccuguuca

SEQ ID NO: 1169368 - RNA, 13 nt, Human
gcugccuguucag

SEQ ID NO: 1169369 - RNA, 21 nt, Human
gcugccugggaucccucaucc

SEQ ID NO: 1169370 - RNA, 18 nt, Human
gcugccccuggcagcccc

SEQ ID NO: 1169371 - RNA, 19 nt, Human
gcugccccuggcagccccu

SEQ ID NO: 1169372 - RNA, 20 nt, Human
gcugccccuggcagccccug

SEQ ID NO: 1169373 - RNA, 18 nt, Human
gcugcacccucaggcagg

SEQ ID NO: 1169374 - RNA, 19 nt, Human
gcugcacccucaggcaggu

SEQ ID NO: 1169375 - RNA, 13 nt, Human
gcugcaccggcug

SEQ ID NO: 1169376 - RNA, 14 nt, Human
gcugcaccggcugg

SEQ ID NO: 1169377 - RNA, 23 nt, Human
gcugagggugagugggugaauaa

SEQ ID NO: 1169378 - RNA, 14 nt, Human
gcugaggugggagg

SEQ ID NO: 1169379 - RNA, 15 nt, Human
gcugaggugggagga

SEQ ID NO: 1169380 - RNA, 21 nt, Human
gcgcagcauauucaggaagcu

SEQ ID NO: 1169381 - RNA, 23 nt, Human
gcgauucuucugcuucagccucc

SEQ ID NO: 1169382 - RNA, 23 nt, Human
gccuugaacuuugaccucugcag

SEQ ID NO: 1169383 - RNA, 16 nt, Human
gccuugaccauucucc

SEQ ID NO: 1169384 - RNA, 22 nt, Human
gccuugaccauucuccaccugc

SEQ ID NO: 1169385 - RNA, 23 nt, Human
gccuugaccauucuccaccugcc

SEQ ID NO: 1169386 - RNA, 22 nt, Human
gcgauucuucugcuucagccuc

SEQ ID NO: 1169387 - RNA, 23 nt, Human
gccugggaucccucauccucaua

SEQ ID NO: 1169388 - RNA, 11 nt, Human
gccugggcaga

SEQ ID NO: 1169389 - RNA, 15 nt, Human
gccuguucagcucca

SEQ ID NO: 1169390 - RNA, 16 nt, Human
gccuguucagcuccag

SEQ ID NO: 1169391 - RNA, 17 nt, Human
gccuguucagcuccagc

SEQ ID NO: 1169392 - RNA, 15 nt, Human
gccuucucugaagga

SEQ ID NO: 1169393 - RNA, 16 nt, Human
gccuucucugaaggac

SEQ ID NO: 1169394 - RNA, 21 nt, Human
gccuucuuuucucccuuuuaa

SEQ ID NO: 1169395 - RNA, 14 nt, Human
gccuugaacuuuga

SEQ ID NO: 1169396 - RNA, 15 nt, Human
gcggcuggcagccca

SEQ ID NO: 1169397 - RNA, 20 nt, Human
gcgggaggauguucugggac

SEQ ID NO: 1169398 - RNA, 20 nt, Human
gcuaggaccccuccaugugg

SEQ ID NO: 1169399 - RNA, 22 nt, Human
gcuaggaccccuccaugugggc

SEQ ID NO: 1169400 - RNA, 21 nt, Human
gcuaguaauuggaaaggcagc

SEQ ID NO: 1169401 - RNA, 14 nt, Human
gcuaguugggcuuc

SEQ ID NO: 1169402 - RNA, 16 nt, Human
gcuaguugggcuuccu

SEQ ID NO: 1169403 - RNA, 21 nt, Human
gcuaguugggcuuccucauag

SEQ ID NO: 1169404 - RNA, 18 nt, Human
gcuauucaguaauaacuc

SEQ ID NO: 1169405 - RNA, 18 nt, Human
gcuaagugauccucccac

SEQ ID NO: 1169406 - RNA, 22 nt, Human
gcuaagugauccucccaccuca

SEQ ID NO: 1169407 - RNA, 23 nt, Human
gcuaagugauccucccaccucag

SEQ ID NO: 1169408 - RNA, 20 nt, Human
gcucagggccuggcucaggu

SEQ ID NO: 1169409 - RNA, 13 nt, Human
gcucaggaguuug

SEQ ID NO: 1169410 - RNA, 18 nt, Human
gcucagggccuggcucag

SEQ ID NO: 1169411 - RNA, 19 nt, Human
gcucagggccuggcucagg

SEQ ID NO: 1169412 - RNA, 22 nt, Human
gccucauguccacugguucuuc

SEQ ID NO: 1169413 - RNA, 18 nt, Human
gccuccugcccuuaccug

SEQ ID NO: 1169414 - RNA, 22 nt, Human
gccuccuuugugaggaagccgc

SEQ ID NO: 1169415 - RNA, 13 nt, Human
gccucgaacuggc

SEQ ID NO: 1169416 - RNA, 16 nt, Human
gccucgaacuggcugc

SEQ ID NO: 1169417 - RNA, 13 nt, Human
gccuccauccuga

SEQ ID NO: 1169418 - RNA, 14 nt, Human
gccuccauccugag

SEQ ID NO: 1169419 - RNA, 15 nt, Human
gccuccauccugagg

SEQ ID NO: 1169420 - RNA, 17 nt, Human
gccuacaggagugagca

SEQ ID NO: 1169421 - RNA, 12 nt, Human
gccuagcauacg

SEQ ID NO: 1169422 - RNA, 19 nt, Human
gccuagcauacguacacau

SEQ ID NO: 1169423 - RNA, 13 nt, Human
gcccugugcucca

SEQ ID NO: 1169424 - RNA, 14 nt, Human
gcccugcccaccug

SEQ ID NO: 1169425 - RNA, 15 nt, Human
gcccugcccaccugg

SEQ ID NO: 1169426 - RNA, 16 nt, Human
gcccugugggccccca

SEQ ID NO: 1169427 - RNA, 17 nt, Human
gcccugugggcccccaa

SEQ ID NO: 1169428 - RNA, 22 nt, Human
gcccuuaccugccaggaagcca

SEQ ID NO: 1169429 - RNA, 23 nt, Human
gcccuuaccugccaggaagccag

SEQ ID NO: 1169430 - RNA, 21 nt, Human
gcccugugggcccccaaaugg

SEQ ID NO: 1169431 - RNA, 19 nt, Human
gcccuuagcagggaaacag

SEQ ID NO: 1169432 - RNA, 16 nt, Human
gccuacaggagugagc

SEQ ID NO: 1169433 - RNA, 16 nt, Human
gccccuggcagccccu

SEQ ID NO: 1169434 - RNA, 17 nt, Human
gccccuggcagccccug

SEQ ID NO: 1169435 - RNA, 21 nt, Human
gccccugcugguucaggguug

SEQ ID NO: 1169436 - RNA, 15 nt, Human
gccccugcugguuca

SEQ ID NO: 1169437 - RNA, 16 nt, Human
gccccugcugguucag

SEQ ID NO: 1169438 - RNA, 12 nt, Human
gccccuggcagc

SEQ ID NO: 1169439 - RNA, 15 nt, Human
gccccuggcagcccc

SEQ ID NO: 1169440 - RNA, 20 nt, Human
gccccaaaacucuccucugc

SEQ ID NO: 1169441 - RNA, 21 nt, Human
gccccaaaacucuccucugcu

SEQ ID NO: 1169442 - RNA, 11 nt, Human
gccccaaaagg

SEQ ID NO: 1169443 - RNA, 16 nt, Human
gcccacgcccccacug

SEQ ID NO: 1169444 - RNA, 17 nt, Human
gcccacgcccccacugg

SEQ ID NO: 1169445 - RNA, 21 nt, Human
gcccacgcccccacuggugac

SEQ ID NO: 1169446 - RNA, 18 nt, Human
gcauuuacuuuguguuca

SEQ ID NO: 1169447 - RNA, 12 nt, Human
gcauuuagaugu

SEQ ID NO: 1169448 - RNA, 13 nt, Human
gcauuuagaugua

SEQ ID NO: 1169449 - RNA, 19 nt, Human
gcauuuaggccaugggaca

SEQ ID NO: 1169450 - RNA, 21 nt, Human
gcccacgcuggagugcaguga

SEQ ID NO: 1169451 - RNA, 23 nt, Human
gcccacgcuggagugcagugagc

SEQ ID NO: 1169452 - RNA, 13 nt, Human
gcccacuucugcc

SEQ ID NO: 1169453 - RNA, 22 nt, Human
gcccaggaaaggcuccaggagc

SEQ ID NO: 1169454 - RNA, 23 nt, Human
gcccaggaaaggcuccaggagca

SEQ ID NO: 1169455 - RNA, 24 nt, Human
gcccaggaaaggcuccaggagcag

SEQ ID NO: 1169456 - RNA, 14 nt, Human
gcccacuucugcca

SEQ ID NO: 1169457 - RNA, 11 nt, Human
gcccaggcagg

SEQ ID NO: 1169458 - RNA, 12 nt, Human
gcccaggcaggu

SEQ ID NO: 1169459 - RNA, 11 nt, Human
gcccaggcccc

SEQ ID NO: 1169460 - RNA, 12 nt, Human
gcccaggccccu

SEQ ID NO: 1169461 - RNA, 20 nt, Human
gcccaggccccugccacccu

SEQ ID NO: 1169462 - RNA, 21 nt, Human
gcccaggccccugccacccug

SEQ ID NO: 1169463 - RNA, 22 nt, Human
gcccaggccccugccacccugg

SEQ ID NO: 1169464 - RNA, 13 nt, Human
gcccaggccccug

SEQ ID NO: 1169465 - RNA, 13 nt, Human
gcauccuggcacc

SEQ ID NO: 1169466 - RNA, 14 nt, Human
gcauccuggcaccc

SEQ ID NO: 1169467 - RNA, 20 nt, Human
gcaucuagcaugucgucaaa

SEQ ID NO: 1169468 - RNA, 21 nt, Human
gcauggcugccaaugggagcu

SEQ ID NO: 1169469 - RNA, 13 nt, Human
gcaugggaaugaa

SEQ ID NO: 1169470 - RNA, 19 nt, Human
gcaugugaugagaggaaau

SEQ ID NO: 1169471 - RNA, 21 nt, Human
gcaugugaugagaggaaauca

SEQ ID NO: 1169472 - RNA, 13 nt, Human
gcauugugggaag

SEQ ID NO: 1169473 - RNA, 15 nt, Human
gcauugugggaaggg

SEQ ID NO: 1169474 - RNA, 16 nt, Human
gcauugugggaagggg

SEQ ID NO: 1169475 - RNA, 18 nt, Human
gcauugugggaaggggag

SEQ ID NO: 1169476 - RNA, 16 nt, Human
gcauuuaaaagauaca

SEQ ID NO: 1169477 - RNA, 17 nt, Human
gcauuuaaaagauacag

SEQ ID NO: 1169478 - RNA, 18 nt, Human
gcauuuaaaagauacagu

SEQ ID NO: 1169479 - RNA, 22 nt, Human
gcauuuaaaagauacaguuacu

SEQ ID NO: 1169480 - RNA, 15 nt, Human
gcauuuacuuugugu

SEQ ID NO: 1169481 - RNA, 14 nt, Human
gcauccaguaucuu

SEQ ID NO: 1169482 - RNA, 17 nt, Human
gcauccaguaucuugaa

SEQ ID NO: 1169483 - RNA, 18 nt, Human
gcauccaguaucuugaag

SEQ ID NO: 1169484 - RNA, 22 nt, Human
gcaguuguugcccacagcugua

SEQ ID NO: 1169485 - RNA, 15 nt, Human
gcauacguacacauu

SEQ ID NO: 1169486 - RNA, 16 nt, Human
gcauacguacacauuu

SEQ ID NO: 1169487 - RNA, 17 nt, Human
gcauacguacacauuuu

SEQ ID NO: 1169488 - RNA, 18 nt, Human
gcauacguacacauuuua

SEQ ID NO: 1169489 - RNA, 18 nt, Human
gcagcccaccccucaaca

SEQ ID NO: 1169490 - RNA, 15 nt, Human
gcagccacauuccug

SEQ ID NO: 1169491 - RNA, 20 nt, Human
gcacucagaagacacugaug

SEQ ID NO: 1169492 - RNA, 18 nt, Human
gcaagugagagcugggug

SEQ ID NO: 1169493 - RNA, 19 nt, Human
gcaagugagagcugggugu

SEQ ID NO: 1169494 - RNA, 14 nt, Human
gcacuccagccugg

SEQ ID NO: 1169495 - RNA, 15 nt, Human
gcacuccagccuggg

SEQ ID NO: 1169496 - RNA, 13 nt, Human
gcacuccccugcu

SEQ ID NO: 1169497 - RNA, 14 nt, Human
gcacuccccugcug

SEQ ID NO: 1169498 - RNA, 15 nt, Human
gcacuccccugcugg

SEQ ID NO: 1169499 - RNA, 16 nt, Human
gcacuccccugcuggg

SEQ ID NO: 1169500 - RNA, 18 nt, Human
gcacuuuguucuggcucu

SEQ ID NO: 1169501 - RNA, 19 nt, Human
gcacuuuguucuggcucuu

SEQ ID NO: 1169502 - RNA, 22 nt, Human
gcacuuuguucuggcucuucca

SEQ ID NO: 1169503 - RNA, 12 nt, Human
gcagaacaguga

SEQ ID NO: 1169504 - RNA, 13 nt, Human
gcagaacagugau

SEQ ID NO: 1169505 - RNA, 18 nt, Human
gcagaacagugauuacca

SEQ ID NO: 1169506 - RNA, 22 nt, Human
gcagaacagugauuaccaggga

SEQ ID NO: 1169507 - RNA, 13 nt, Human
gcagaggaaagca

SEQ ID NO: 1169508 - RNA, 14 nt, Human
gcagaggaaagcaa

SEQ ID NO: 1169509 - RNA, 18 nt, Human
gcagaggaaagcaaagga

SEQ ID NO: 1169510 - RNA, 20 nt, Human
gcagaggaaagcaaaggaga

SEQ ID NO: 1169511 - RNA, 21 nt, Human
gcagaggaaagcaaaggagau

SEQ ID NO: 1169512 - RNA, 14 nt, Human
gcagagggcacaga

SEQ ID NO: 1169513 - RNA, 17 nt, Human
gcagcauauucaggaag

SEQ ID NO: 1169514 - RNA, 18 nt, Human
gcagcauauucaggaagc

SEQ ID NO: 1169515 - RNA, 19 nt, Human
gcagcauauucaggaagcu

SEQ ID NO: 1169516 - RNA, 23 nt, Human
gcagcauauucaggaagcucagg

SEQ ID NO: 1169517 - RNA, 20 nt, Human
gcaaccuccgccucuugggu

SEQ ID NO: 1169518 - RNA, 14 nt, Human
gcaacccccagccu

SEQ ID NO: 1169519 - RNA, 15 nt, Human
gcaacccccagccug

SEQ ID NO: 1169520 - RNA, 16 nt, Human
gcaacccccagccugc

SEQ ID NO: 1169521 - RNA, 17 nt, Human
gcaacccccagccugcu

SEQ ID NO: 1169522 - RNA, 13 nt, Human
gcaacaggcuggg

SEQ ID NO: 1169523 - RNA, 14 nt, Human
gcaacaggcugggc

SEQ ID NO: 1169524 - RNA, 15 nt, Human
gcaacaggcugggcu

SEQ ID NO: 1169525 - RNA, 16 nt, Human
gcaacaggcugggcuu

SEQ ID NO: 1169526 - RNA, 19 nt, Human
gcaacaggcugggcuucag

SEQ ID NO: 1169527 - RNA, 13 nt, Human
gcaaccaccacca

SEQ ID NO: 1169528 - RNA, 16 nt, Human
gcaaccaccaccaacc

SEQ ID NO: 1169529 - RNA, 18 nt, Human
gcaaccaccaccaaccac

SEQ ID NO: 1169530 - RNA, 16 nt, Human
gcaagugagagcuggg

SEQ ID NO: 1169531 - RNA, 13 nt, Human
gauucuucugcuu

SEQ ID NO: 1169532 - RNA, 15 nt, Human
gauucuucugcuuca

SEQ ID NO: 1169533 - RNA, 20 nt, Human
gauucuucugcuucagccuc

SEQ ID NO: 1169534 - RNA, 17 nt, Human
gauuuaacagaaaugua

SEQ ID NO: 1169535 - RNA, 18 nt, Human
gauuuaacagaaauguac

SEQ ID NO: 1169536 - RNA, 19 nt, Human
gauuuaacagaaauguaca

SEQ ID NO: 1169537 - RNA, 11 nt, Human
gauuucacucu

SEQ ID NO: 1169538 - RNA, 12 nt, Human
gauuucacucuc

SEQ ID NO: 1169539 - RNA, 17 nt, Human
gauuuuuuuuuccuuca

SEQ ID NO: 1169540 - RNA, 18 nt, Human
gauuuuuuuuuccuucag

SEQ ID NO: 1169541 - RNA, 21 nt, Human
gauuuuuuuuuccuucagugc

SEQ ID NO: 1169542 - RNA, 14 nt, Human
gcaaaaaggcagga

SEQ ID NO: 1169543 - RNA, 22 nt, Human
gcaaaagaugcuucucacugcc

SEQ ID NO: 1169544 - RNA, 19 nt, Human
gaucucuugagccugggag

SEQ ID NO: 1169545 - RNA, 13 nt, Human
gaugauccuaggc

SEQ ID NO: 1169546 - RNA, 14 nt, Human
gaugauccuaggca

SEQ ID NO: 1169547 - RNA, 22 nt, Human
gaugauuggaggggggaggugg

SEQ ID NO: 1169548 - RNA, 17 nt, Human
gaugcuucuucagagac

SEQ ID NO: 1169549 - RNA, 20 nt, Human
gaugcuucuucagagacucc

SEQ ID NO: 1169550 - RNA, 21 nt, Human
gaugcuucuucagagacuccu

SEQ ID NO: 1169551 - RNA, 15 nt, Human
gauauuuugcuuugu

SEQ ID NO: 1169552 - RNA, 20 nt, Human
gaucaaaagguuaauaaagu

SEQ ID NO: 1169553 - RNA, 23 nt, Human
gaucaaaagguuaauaaaguaau

SEQ ID NO: 1169554 - RNA, 21 nt, Human
gaucaaccccuucgcuccugu

SEQ ID NO: 1169555 - RNA, 12 nt, Human
gauccaagcugg

SEQ ID NO: 1169556 - RNA, 16 nt, Human
gauccaagcugguccc

SEQ ID NO: 1169557 - RNA, 17 nt, Human
gauccaagcugguccca

SEQ ID NO: 1169558 - RNA, 19 nt, Human
gauccaagcuggucccacu

SEQ ID NO: 1169559 - RNA, 21 nt, Human
gauccaagcuggucccacuca

SEQ ID NO: 1169560 - RNA, 18 nt, Human
gauccacccaccucagcc

SEQ ID NO: 1169561 - RNA, 19 nt, Human
gauccacccaccucagccu

SEQ ID NO: 1169562 - RNA, 20 nt, Human
gauccacccaccucagccuc

SEQ ID NO: 1169563 - RNA, 21 nt, Human
gauccacccaccucagccucc

SEQ ID NO: 1169564 - RNA, 22 nt, Human
gauccacccaccucagccuccc

SEQ ID NO: 1169565 - RNA, 16 nt, Human
gauacaguuacucaga

SEQ ID NO: 1169566 - RNA, 19 nt, Human
gauacaguuacucagaauu

SEQ ID NO: 1169567 - RNA, 23 nt, Human
gauacaguuacucagaauucucu

SEQ ID NO: 1169568 - RNA, 17 nt, Human
gauacuguaucaugaca

SEQ ID NO: 1169569 - RNA, 21 nt, Human
gauacuguaucaugacaaaga

SEQ ID NO: 1169570 - RNA, 14 nt, Human
gagggccugcaagg

SEQ ID NO: 1169571 - RNA, 17 nt, Human
gagggccugcaagggag

SEQ ID NO: 1169572 - RNA, 21 nt, Human
gagggccugcaagggagugag

SEQ ID NO: 1169573 - RNA, 20 nt, Human
gaggcaugugaugagaggaa

SEQ ID NO: 1169574 - RNA, 21 nt, Human
gaggcaugugaugagaggaaa

SEQ ID NO: 1169575 - RNA, 22 nt, Human
gaggcaugugaugagaggaaau

SEQ ID NO: 1169576 - RNA, 19 nt, Human
gaggcauuuguuugaacug

SEQ ID NO: 1169577 - RNA, 21 nt, Human
gaggcauuuguuugaacugau

SEQ ID NO: 1169578 - RNA, 17 nt, Human
gaggccaaggugggagg

SEQ ID NO: 1169579 - RNA, 15 nt, Human
gaggcuccacuuggu

SEQ ID NO: 1169580 - RNA, 17 nt, Human
gaggcuccacuuggucu

SEQ ID NO: 1169581 - RNA, 18 nt, Human
gaggcuccacuuggucug

SEQ ID NO: 1169582 - RNA, 18 nt, Human
gaggcugagaugggagaa

SEQ ID NO: 1169583 - RNA, 21 nt, Human
gaggacgcucucuggccuucg

SEQ ID NO: 1169584 - RNA, 16 nt, Human
gaggacuuuucuuugu

SEQ ID NO: 1169585 - RNA, 20 nt, Human
gaggacuuuucuuuguggcu

SEQ ID NO: 1169586 - RNA, 23 nt, Human
gaggacuuuucuuuguggcuucc

SEQ ID NO: 1169587 - RNA, 12 nt, Human
gaggagaaacug

SEQ ID NO: 1169588 - RNA, 14 nt, Human
gaggagaaacugga

SEQ ID NO: 1169589 - RNA, 12 nt, Human
gaggagagagga

SEQ ID NO: 1169590 - RNA, 14 nt, Human
gaggagagaggacc

SEQ ID NO: 1169591 - RNA, 15 nt, Human
gaggagagaggaccc

SEQ ID NO: 1169592 - RNA, 19 nt, Human
gaggcagggucucacucug

SEQ ID NO: 1169593 - RNA, 20 nt, Human
gaggcagggucucacucugu

SEQ ID NO: 1169594 - RNA, 22 nt, Human
gaggcagggucucacucugucg

SEQ ID NO: 1169595 - RNA, 14 nt, Human
gagcagucaggaaa

SEQ ID NO: 1169596 - RNA, 14 nt, Human
gagcaucaggccag

SEQ ID NO: 1169597 - RNA, 15 nt, Human
gagcaucaggccagg

SEQ ID NO: 1169598 - RNA, 16 nt, Human
gagcaucaggccaggc

SEQ ID NO: 1169599 - RNA, 17 nt, Human
gagcaucaggccaggcc

SEQ ID NO: 1169600 - RNA, 13 nt, Human
gagcaugccugga

SEQ ID NO: 1169601 - RNA, 21 nt, Human
gagcaugccuggauggggcug

SEQ ID NO: 1169602 - RNA, 14 nt, Human
gagccccgaggccu

SEQ ID NO: 1169603 - RNA, 17 nt, Human
gagccccgaggccuucu

SEQ ID NO: 1169604 - RNA, 13 nt, Human
gagcccugguggc

SEQ ID NO: 1169605 - RNA, 14 nt, Human
gagcccugguggca

SEQ ID NO: 1169606 - RNA, 12 nt, Human
gagaggaaauca

SEQ ID NO: 1169607 - RNA, 20 nt, Human
gagagcugggugucaagagg

SEQ ID NO: 1169608 - RNA, 15 nt, Human
gagaggacccccuga

SEQ ID NO: 1169609 - RNA, 13 nt, Human
gagacuccugcag

SEQ ID NO: 1169610 - RNA, 14 nt, Human
gagacuccugcagg

SEQ ID NO: 1169611 - RNA, 15 nt, Human
gagagccuuccaggg

SEQ ID NO: 1169612 - RNA, 16 nt, Human
gagagccuuccagggg

SEQ ID NO: 1169613 - RNA, 18 nt, Human
gagagccuuccaggggug

SEQ ID NO: 1169614 - RNA, 20 nt, Human
gagagccuuccagggguggg

SEQ ID NO: 1169615 - RNA, 15 nt, Human
gagagcuagcagcag

SEQ ID NO: 1169616 - RNA, 21 nt, Human
gagagcuagcagcagggaggg

SEQ ID NO: 1169617 - RNA, 13 nt, Human
gagagcugggugu

SEQ ID NO: 1169618 - RNA, 16 nt, Human
gagaugcuagaacucc

SEQ ID NO: 1169619 - RNA, 20 nt, Human
gagaugcuagaacucccuuu

SEQ ID NO: 1169620 - RNA, 14 nt, Human
gagauuggaaggaa

SEQ ID NO: 1169621 - RNA, 21 nt, Human
gagauugugccccugcacucc

SEQ ID NO: 1169622 - RNA, 14 nt, Human
gacuuuuccaaccc

SEQ ID NO: 1169623 - RNA, 19 nt, Human
gacuuuuccaacccucauc

SEQ ID NO: 1169624 - RNA, 22 nt, Human
gacuuuuuauggcacuaguauu

SEQ ID NO: 1169625 - RNA, 20 nt, Human
gacuuuuccaacccucauca

SEQ ID NO: 1169626 - RNA, 15 nt, Human
gagaaugaaagggcc

SEQ ID NO: 1169627 - RNA, 23 nt, Human
gagaaugaaagggcccagagagg

SEQ ID NO: 1169628 - RNA, 14 nt, Human
gagacggaguccca

SEQ ID NO: 1169629 - RNA, 16 nt, Human
gagacggagucccacc

SEQ ID NO: 1169630 - RNA, 19 nt, Human
gagacggagucccaccuug

SEQ ID NO: 1169631 - RNA, 18 nt, Human
gagacgggggcagagagg

SEQ ID NO: 1169632 - RNA, 19 nt, Human
gaccucaggccugggggcu

SEQ ID NO: 1169633 - RNA, 18 nt, Human
gaccucaggugagaagca

SEQ ID NO: 1169634 - RNA, 19 nt, Human
gaccucaggugagaagcag

SEQ ID NO: 1169635 - RNA, 21 nt, Human
gaccucaggugagaagcagag

SEQ ID NO: 1169636 - RNA, 19 nt, Human
gaccucaggugauccaccc

SEQ ID NO: 1169637 - RNA, 20 nt, Human
gaccucaggugauccaccca

SEQ ID NO: 1169638 - RNA, 21 nt, Human
gaccucaggugauccacccac

SEQ ID NO: 1169639 - RNA, 10 nt, Human
gacccugagg

SEQ ID NO: 1169640 - RNA, 14 nt, Human
gaccucaggccugg

SEQ ID NO: 1169641 - RNA, 22 nt, Human
gacgcuacccgggaagggggcu

SEQ ID NO: 1169642 - RNA, 23 nt, Human
gacgcuacccgggaagggggcug

SEQ ID NO: 1169643 - RNA, 14 nt, Human
gacgcucucuggcc

SEQ ID NO: 1169644 - RNA, 16 nt, Human
gacgcugugcugcccu

SEQ ID NO: 1169645 - RNA, 17 nt, Human
gacgcugugcugcccug

SEQ ID NO: 1169646 - RNA, 18 nt, Human
gacgcugugcugcccugc

SEQ ID NO: 1169647 - RNA, 15 nt, Human
gacgcucucuggccu

SEQ ID NO: 1169648 - RNA, 21 nt, Human
gacgcugugcugcccugccca

SEQ ID NO: 1169649 - RNA, 16 nt, Human
gaccucugcagcaaua

SEQ ID NO: 1169650 - RNA, 18 nt, Human
gaccucugcagcaauaaa

SEQ ID NO: 1169651 - RNA, 22 nt, Human
gaccucugcagcaauaaagcag

SEQ ID NO: 1169652 - RNA, 13 nt, Human
gaccucugccuga

SEQ ID NO: 1169653 - RNA, 12 nt, Human
gacgccauccca

SEQ ID NO: 1169654 - RNA, 13 nt, Human
gacgccaucccag

SEQ ID NO: 1169655 - RNA, 15 nt, Human
gacgccaucccagcc

SEQ ID NO: 1169656 - RNA, 21 nt, Human
gacgccaucccagccccaaug

SEQ ID NO: 1169657 - RNA, 23 nt, Human
gacauugcggacagccacggcca

SEQ ID NO: 1169658 - RNA, 14 nt, Human
gacagcccgggcuc

SEQ ID NO: 1169659 - RNA, 16 nt, Human
gacagcccgggcucug

SEQ ID NO: 1169660 - RNA, 17 nt, Human
gacagcuccuucugucc

SEQ ID NO: 1169661 - RNA, 18 nt, Human
gacagcuccuucuguccu

SEQ ID NO: 1169662 - RNA, 19 nt, Human
gacagcuccuucuguccua

SEQ ID NO: 1169663 - RNA, 12 nt, Human
gacagcucugca

SEQ ID NO: 1169664 - RNA, 10 nt, Human
gacagcucuu

SEQ ID NO: 1169665 - RNA, 11 nt, Human
gacagcucuua

SEQ ID NO: 1169666 - RNA, 18 nt, Human
gacagucaccucauggaa

SEQ ID NO: 1169667 - RNA, 12 nt, Human
gacagcugccug

SEQ ID NO: 1169668 - RNA, 12 nt, Human
gacagucccugc

SEQ ID NO: 1169669 - RNA, 14 nt, Human
gacagucccugcca

SEQ ID NO: 1169670 - RNA, 15 nt, Human
gacagucccugccaa

SEQ ID NO: 1169671 - RNA, 16 nt, Human
gacagucccugccaau

SEQ ID NO: 1169672 - RNA, 20 nt, Human
gacagucccugccaauggac

SEQ ID NO: 1169673 - RNA, 14 nt, Human
gaaugaauggcuaa

SEQ ID NO: 1169674 - RNA, 22 nt, Human
gaauauugcugauggugcaaug

SEQ ID NO: 1169675 - RNA, 23 nt, Human
gaauauugcugauggugcaauga

SEQ ID NO: 1169676 - RNA, 24 nt, Human
gaauauugcugauggugcaaugac

SEQ ID NO: 1169677 - RNA, 15 nt, Human
gaauauauaaccagu

SEQ ID NO: 1169678 - RNA, 11 nt, Human
gaauauugcug

SEQ ID NO: 1169679 - RNA, 12 nt, Human
gaauauugcuga

SEQ ID NO: 1169680 - RNA, 13 nt, Human
gaauauugcugau

SEQ ID NO: 1169681 - RNA, 21 nt, Human
gacacagcucuucuccaggcu

SEQ ID NO: 1169682 - RNA, 13 nt, Human
gacacagcucuuc

SEQ ID NO: 1169683 - RNA, 12 nt, Human
gacacagcucuu

SEQ ID NO: 1169684 - RNA, 19 nt, Human
gacacagcucuucuccagg

SEQ ID NO: 1169685 - RNA, 20 nt, Human
gacacagcucuucuccaggc

SEQ ID NO: 1169686 - RNA, 22 nt, Human
gaaugauuaugaauuacauuug

SEQ ID NO: 1169687 - RNA, 18 nt, Human
gaaugcacaaacagaggc

SEQ ID NO: 1169688 - RNA, 19 nt, Human
gaaugcacaaacagaggcc

SEQ ID NO: 1169689 - RNA, 16 nt, Human
gaauguuugccucugc

SEQ ID NO: 1169690 - RNA, 17 nt, Human
gaauguuugccucugcc

SEQ ID NO: 1169691 - RNA, 15 nt, Human
gaaugaauggcuaag

SEQ ID NO: 1169692 - RNA, 20 nt, Human
gaaugaauggcuaagcaaaa

SEQ ID NO: 1169693 - RNA, 20 nt, Human
gaaugaugauccuaggcauu

SEQ ID NO: 1169694 - RNA, 14 nt, Human
gaaugaugccauga

SEQ ID NO: 1169695 - RNA, 14 nt, Human
gaaugauuaauuaa

SEQ ID NO: 1169696 - RNA, 14 nt, Human
gaaugauuaugaau

SEQ ID NO: 1169697 - RNA, 18 nt, Human
gaauguuugccucugccu

SEQ ID NO: 1169698 - RNA, 19 nt, Human
gaauguuugccucugccuc

SEQ ID NO: 1169699 - RNA, 14 nt, Human
gaauuaacacauga

SEQ ID NO: 1169700 - RNA, 15 nt, Human
gaauuaacacaugau

SEQ ID NO: 1169701 - RNA, 13 nt, Human
gaauuacauuugu

SEQ ID NO: 1169702 - RNA, 15 nt, Human
gaauuacauuuguau

SEQ ID NO: 1169703 - RNA, 18 nt, Human
gaauuacauuuguauaaa

SEQ ID NO: 1169704 - RNA, 20 nt, Human
gaauuacauuuguauaaaau

SEQ ID NO: 1169705 - RNA, 23 nt, Human
gaaacuucagcgguuuauauaag

SEQ ID NO: 1169706 - RNA, 18 nt, Human
gaaagacuaucuaaaugu

SEQ ID NO: 1169707 - RNA, 20 nt, Human
gaaagacuaucuaaauguug

SEQ ID NO: 1169708 - RNA, 17 nt, Human
gaaaggcuccaggagca

SEQ ID NO: 1169709 - RNA, 18 nt, Human
gaaaggcuccaggagcag

SEQ ID NO: 1169710 - RNA, 19 nt, Human
gaaaggcuccaggagcagc

SEQ ID NO: 1169711 - RNA, 20 nt, Human
gaaaggcuccaggagcagcc

SEQ ID NO: 1169712 - RNA, 21 nt, Human
gaaaguacuucuccacccugc

SEQ ID NO: 1169713 - RNA, 22 nt, Human
gaaaguacuucuccacccugcu

SEQ ID NO: 1169714 - RNA, 17 nt, Human
gaaaucaccgaaaacgu

SEQ ID NO: 1169715 - RNA, 19 nt, Human
gaaaucaccgaaaacgugg

SEQ ID NO: 1169716 - RNA, 18 nt, Human
gaaaugaaagcagggacu

SEQ ID NO: 1169717 - RNA, 18 nt, Human
gaaauuuuuauuaaauua

SEQ ID NO: 1169718 - RNA, 19 nt, Human
gaaauuuuuauuaaauuau

SEQ ID NO: 1169719 - RNA, 18 nt, Human
gaacaaauuuacagagac

SEQ ID NO: 1169720 - RNA, 23 nt, Human
gaacaaauuuacagagacagaaa

SEQ ID NO: 1169721 - RNA, 14 nt, Human
gaacaaggcaaggc

SEQ ID NO: 1169722 - RNA, 15 nt, Human
gaacaaggcaaggcu

SEQ ID NO: 1169723 - RNA, 17 nt, Human
gaacaaggcaaggcugu

SEQ ID NO: 1169724 - RNA, 18 nt, Human
gaacaaggcaaggcuguc

SEQ ID NO: 1169725 - RNA, 21 nt, Human
gaacaaggcaaggcugucaau

SEQ ID NO: 1169726 - RNA, 18 nt, Human
gaaaauuuugauguuuua

SEQ ID NO: 1169727 - RNA, 18 nt, Human
cuuuugccguuauuaaaa

SEQ ID NO: 1169728 - RNA, 15 nt, Human
cuuuuggucugugug

SEQ ID NO: 1169729 - RNA, 16 nt, Human
cuuuuggucuguguga

SEQ ID NO: 1169730 - RNA, 17 nt, Human
cuuuugucuaugggacu

SEQ ID NO: 1169731 - RNA, 14 nt, Human
cuuuugugcauuau

SEQ ID NO: 1169732 - RNA, 18 nt, Human
cuuuugugcauuaucuag

SEQ ID NO: 1169733 - RNA, 21 nt, Human
cuuuuuuuuuuuuuuugacaa

SEQ ID NO: 1169734 - RNA, 19 nt, Human
gaaaaaauauuuuccugcc

SEQ ID NO: 1169735 - RNA, 21 nt, Human
cuuccucuuuccaucuacccu

SEQ ID NO: 1169736 - RNA, 12 nt, Human
cuuccucccucc

SEQ ID NO: 1169737 - RNA, 13 nt, Human
cuuccucccuccc

SEQ ID NO: 1169738 - RNA, 14 nt, Human
cuuccucccucccu

SEQ ID NO: 1169739 - RNA, 18 nt, Human
cuuccucccucccucuuu

SEQ ID NO: 1169740 - RNA, 19 nt, Human
cuucugaacuuggcgcugc

SEQ ID NO: 1169741 - RNA, 22 nt, Human
cuucugaacuuggcgcugcccc

SEQ ID NO: 1169742 - RNA, 16 nt, Human
cuucugacccaugcug

SEQ ID NO: 1169743 - RNA, 17 nt, Human
cuucugacccaugcugc

SEQ ID NO: 1169744 - RNA, 18 nt, Human
cuucugacccaugcugcc

SEQ ID NO: 1169745 - RNA, 23 nt, Human
cuucugaacuuggcgcugccccu

SEQ ID NO: 1169746 - RNA, 20 nt, Human
cuucugacccaugcugcccu

SEQ ID NO: 1169747 - RNA, 13 nt, Human
cuucuuauacauu

SEQ ID NO: 1169748 - RNA, 16 nt, Human
cuucuuauacauuuga

SEQ ID NO: 1169749 - RNA, 15 nt, Human
cuugauguguuaucu

SEQ ID NO: 1169750 - RNA, 19 nt, Human
cuugauucauaaugacuua

SEQ ID NO: 1169751 - RNA, 18 nt, Human
cuugccgucuaccugagg

SEQ ID NO: 1169752 - RNA, 19 nt, Human
cuugccgucuaccugaggg

SEQ ID NO: 1169753 - RNA, 15 nt, Human
cuuggauuguccccg

SEQ ID NO: 1169754 - RNA, 18 nt, Human
cuuggauuguccccgacc

SEQ ID NO: 1169755 - RNA, 20 nt, Human
cuuggauuguccccgacccu

SEQ ID NO: 1169756 - RNA, 22 nt, Human
cuuggauuguccccgacccuug

SEQ ID NO: 1169757 - RNA, 21 nt, Human
cuuggcgcugccccuggcagc

SEQ ID NO: 1169758 - RNA, 22 nt, Human
cuuggcgcugccccuggcagcc

SEQ ID NO: 1169759 - RNA, 23 nt, Human
cuuggcgcugccccuggcagccc

SEQ ID NO: 1169760 - RNA, 16 nt, Human
cuugguccugcugcag

SEQ ID NO: 1169761 - RNA, 17 nt, Human
cuugguccugcugcagu

SEQ ID NO: 1169762 - RNA, 18 nt, Human
cuugguccugcugcaguu

SEQ ID NO: 1169763 - RNA, 20 nt, Human
cuugguccugcugcaguugc

SEQ ID NO: 1169764 - RNA, 22 nt, Human
cuugguccugcugcaguugcca

SEQ ID NO: 1169765 - RNA, 23 nt, Human
cuuggucucagugucaaugcagc

SEQ ID NO: 1169766 - RNA, 16 nt, Human
cuugguucccauuugc

SEQ ID NO: 1169767 - RNA, 20 nt, Human
cuugguucccauuugcuccu

SEQ ID NO: 1169768 - RNA, 13 nt, Human
cuugucuguagau

SEQ ID NO: 1169769 - RNA, 20 nt, Human
cuugucuuuggacccugagg

SEQ ID NO: 1169770 - RNA, 21 nt, Human
cuugucuuuggacccugaggc

SEQ ID NO: 1169771 - RNA, 22 nt, Human
cuugucuuuggacccugaggcc

SEQ ID NO: 1169772 - RNA, 17 nt, Human
cuuuaaugucacaggca

SEQ ID NO: 1169773 - RNA, 18 nt, Human
cuuuaaugucacaggcag

SEQ ID NO: 1169774 - RNA, 19 nt, Human
cuuuaaugucacaggcagg

SEQ ID NO: 1169775 - RNA, 20 nt, Human
cuuuaaugucacaggcaggu

SEQ ID NO: 1169776 - RNA, 22 nt, Human
cuuuaaugucacaggcaggucc

SEQ ID NO: 1169777 - RNA, 23 nt, Human
cuuuaaugucacaggcaggucca

SEQ ID NO: 1169778 - RNA, 14 nt, Human
cuuucaauaggaaa

SEQ ID NO: 1169779 - RNA, 15 nt, Human
cuuucaauaggaaaa

SEQ ID NO: 1169780 - RNA, 17 nt, Human
cuuucaauaggaaaaac

SEQ ID NO: 1169781 - RNA, 18 nt, Human
cuuucaauaggaaaaacu

SEQ ID NO: 1169782 - RNA, 12 nt, Human
cuguuggccagu

SEQ ID NO: 1169783 - RNA, 15 nt, Human
cuguuggccagugug

SEQ ID NO: 1169784 - RNA, 14 nt, Human
cuuaaauaauguga

SEQ ID NO: 1169785 - RNA, 16 nt, Human
cuuaaauaaugugaaa

SEQ ID NO: 1169786 - RNA, 19 nt, Human
cuuaaauaaugugaaacug

SEQ ID NO: 1169787 - RNA, 13 nt, Human
cuuaaaaaugguu

SEQ ID NO: 1169788 - RNA, 20 nt, Human
cuuaaaaaugguuuaaaugg

SEQ ID NO: 1169789 - RNA, 21 nt, Human
cuuaaaaaugguuuaaauggu

SEQ ID NO: 1169790 - RNA, 15 nt, Human
cuguucagcuccagc

SEQ ID NO: 1169791 - RNA, 16 nt, Human
cuguucagcuccagcu

SEQ ID NO: 1169792 - RNA, 18 nt, Human
cuguucagcuccagcuca

SEQ ID NO: 1169793 - RNA, 19 nt, Human
cuguucagcuccagcucac

SEQ ID NO: 1169794 - RNA, 22 nt, Human
cuguucagcuccagcucaccag

SEQ ID NO: 1169795 - RNA, 12 nt, Human
cuguucagcugg

SEQ ID NO: 1169796 - RNA, 18 nt, Human
cuguucagcugguugagg

SEQ ID NO: 1169797 - RNA, 18 nt, Human
cugugcucuggacaggca

SEQ ID NO: 1169798 - RNA, 19 nt, Human
cugugcucuggacaggcau

SEQ ID NO: 1169799 - RNA, 17 nt, Human
cuguuacugucuucagu

SEQ ID NO: 1169800 - RNA, 23 nt, Human
cugugagaugcuagaacucccuu

SEQ ID NO: 1169801 - RNA, 17 nt, Human
cugugcucuggacaggc

SEQ ID NO: 1169802 - RNA, 12 nt, Human
cuggugccucac

SEQ ID NO: 1169803 - RNA, 22 nt, Human
cugucuaaugaaaccugugucu

SEQ ID NO: 1169804 - RNA, 20 nt, Human
cugucuacacuaagagagaa

SEQ ID NO: 1169805 - RNA, 18 nt, Human
cuguaggaagguuaaugu

SEQ ID NO: 1169806 - RNA, 14 nt, Human
cugucauuugagca

SEQ ID NO: 1169807 - RNA, 13 nt, Human
cuguccugggagu

SEQ ID NO: 1169808 - RNA, 14 nt, Human
cuguccugggagug

SEQ ID NO: 1169809 - RNA, 20 nt, Human
cuguccugggagugagcugg

SEQ ID NO: 1169810 - RNA, 16 nt, Human
cugucauuugagcagg

SEQ ID NO: 1169811 - RNA, 21 nt, Human
cuguccugggagugagcuggu

SEQ ID NO: 1169812 - RNA, 20 nt, Human
cuguaagaaaauaucacuug

SEQ ID NO: 1169813 - RNA, 16 nt, Human
cuggcagcucagagag

SEQ ID NO: 1169814 - RNA, 17 nt, Human
cuggcagcucagagagg

SEQ ID NO: 1169815 - RNA, 19 nt, Human
cuggcagcucagagagggu

SEQ ID NO: 1169816 - RNA, 13 nt, Human
cuggcucuuccag

SEQ ID NO: 1169817 - RNA, 14 nt, Human
cuggcucuuccagg

SEQ ID NO: 1169818 - RNA, 15 nt, Human
cuggcucuuccaggc

SEQ ID NO: 1169819 - RNA, 17 nt, Human
cuggcucuuccaggcug

SEQ ID NO: 1169820 - RNA, 17 nt, Human
cugggacuacaggcacc

SEQ ID NO: 1169821 - RNA, 21 nt, Human
cugggacuacaggcacccacc

SEQ ID NO: 1169822 - RNA, 17 nt, Human
cugggacuacaggugug

SEQ ID NO: 1169823 - RNA, 23 nt, Human
cuggcagccccuguucuggcaga

SEQ ID NO: 1169824 - RNA, 22 nt, Human
cuggcagaguugaagacagagc

SEQ ID NO: 1169825 - RNA, 20 nt, Human
cuggcagaguugaagacaga

SEQ ID NO: 1169826 - RNA, 21 nt, Human
cuggcagaguugaagacagag

SEQ ID NO: 1169827 - RNA, 16 nt, Human
cuggaugcagccucac

SEQ ID NO: 1169828 - RNA, 17 nt, Human
cuggaugcagccucaca

SEQ ID NO: 1169829 - RNA, 18 nt, Human
cuggaugcagccucacag

SEQ ID NO: 1169830 - RNA, 22 nt, Human
cuggaugcagccucacaguccu

SEQ ID NO: 1169831 - RNA, 21 nt, Human
cuggagaaaauggacguguua

SEQ ID NO: 1169832 - RNA, 14 nt, Human
cugcuucaaggauc

SEQ ID NO: 1169833 - RNA, 16 nt, Human
cugcuucaaggauccu

SEQ ID NO: 1169834 - RNA, 19 nt, Human
cugcuucaaggauccugag

SEQ ID NO: 1169835 - RNA, 20 nt, Human
cugcuucaaggauccugagc

SEQ ID NO: 1169836 - RNA, 14 nt, Human
cugcuuccagugag

SEQ ID NO: 1169837 - RNA, 15 nt, Human
cugcuuccagugagg

SEQ ID NO: 1169838 - RNA, 23 nt, Human
cuggaaaaguauguuagugcaaa

SEQ ID NO: 1169839 - RNA, 14 nt, Human
cugccuguugggcc

SEQ ID NO: 1169840 - RNA, 23 nt, Human
cugccuguucagcuccagcucac

SEQ ID NO: 1169841 - RNA, 14 nt, Human
cugcucacauaucu

SEQ ID NO: 1169842 - RNA, 23 nt, Human
cugcugaaggcucgagcaugccu

SEQ ID NO: 1169843 - RNA, 24 nt, Human
cugcugaaggcucgagcaugccug

SEQ ID NO: 1169844 - RNA, 14 nt, Human
cugccuccuuugug

SEQ ID NO: 1169845 - RNA, 17 nt, Human
cugccuccuuugugagg

SEQ ID NO: 1169846 - RNA, 21 nt, Human
cugccuccuuugugaggaagc

SEQ ID NO: 1169847 - RNA, 23 nt, Human
cugccuccuuugugaggaagccg

SEQ ID NO: 1169848 - RNA, 14 nt, Human
cugccucgaacugg

SEQ ID NO: 1169849 - RNA, 20 nt, Human
cugccucgaacuggcugcaa

SEQ ID NO: 1169850 - RNA, 24 nt, Human
cugcccugugaguacuacaguccu

SEQ ID NO: 1169851 - RNA, 14 nt, Human
cugcccugugggcc

SEQ ID NO: 1169852 - RNA, 19 nt, Human
cugcccuuaccugccagga

SEQ ID NO: 1169853 - RNA, 11 nt, Human
cugcccugugg

SEQ ID NO: 1169854 - RNA, 12 nt, Human
cugcccuguggg

SEQ ID NO: 1169855 - RNA, 22 nt, Human
cugcccuuaccugccaggaagc

SEQ ID NO: 1169856 - RNA, 23 nt, Human
cugcccuuaccugccaggaagcc

SEQ ID NO: 1169857 - RNA, 19 nt, Human
caaagugcugggauuacag

SEQ ID NO: 1169858 - RNA, 19 nt, Human
caaaggguaucaggugcug

SEQ ID NO: 1169859 - RNA, 23 nt, Human
caaagugcugggauuacaggugu

SEQ ID NO: 1169860 - RNA, 15 nt, Human
caaauugugugaaag

SEQ ID NO: 1169861 - RNA, 11 nt, Human
caaauuucuaa

SEQ ID NO: 1169862 - RNA, 12 nt, Human
caaauuucuaaa

SEQ ID NO: 1169863 - RNA, 14 nt, Human
caaauuucuaaauc

SEQ ID NO: 1169864 - RNA, 12 nt, Human
caaaauaaaacu

SEQ ID NO: 1169865 - RNA, 14 nt, Human
caaaauaaaacuuu

SEQ ID NO: 1169866 - RNA, 15 nt, Human
caaaauguaggguua

SEQ ID NO: 1169867 - RNA, 21 nt, Human
caaaauuuuuucucuaggaaa

SEQ ID NO: 1169868 - RNA, 22 nt, Human
caaaauuuuuucucuaggaaau

SEQ ID NO: 1169869 - RNA, 15 nt, Human
caaacacauacagga

SEQ ID NO: 1169870 - RNA, 20 nt, Human
caaacccuucagugccaaaa

SEQ ID NO: 1169871 - RNA, 17 nt, Human
caaacucaccugccccu

SEQ ID NO: 1169872 - RNA, 17 nt, Human
caaagccuccuccagcc

SEQ ID NO: 1169873 - RNA, 18 nt, Human
caaagccuccuccagccg

SEQ ID NO: 1169874 - RNA, 13 nt, Human
caaagcuaggccu

SEQ ID NO: 1169875 - RNA, 14 nt, Human
caaagcuaggccug

SEQ ID NO: 1169876 - RNA, 15 nt, Human
caaagcuaggccugg

SEQ ID NO: 1169877 - RNA, 19 nt, Human
caaagcuaggccuggccag

SEQ ID NO: 1169878 - RNA, 13 nt, Human
caaaggaagcaca

SEQ ID NO: 1169879 - RNA, 14 nt, Human
caaaggaagcacau

SEQ ID NO: 1169880 - RNA, 16 nt, Human
caaaggguaucaggug

SEQ ID NO: 1169881 - RNA, 18 nt, Human
caaaggguaucaggugcu

SEQ ID NO: 1169882 - RNA, 23 nt, Human
caaaacuucagacauagaauuaa

SEQ ID NO: 1169883 - RNA, 17 nt, Human
caaaauaaaaaugaggu

SEQ ID NO: 1169884 - RNA, 20 nt, Human
caaaacucuccucugcugcu

SEQ ID NO: 1169885 - RNA, 21 nt, Human
caaaacucuccucugcugcug

SEQ ID NO: 1169886 - RNA, 22 nt, Human
caaaacucuccucugcugcugg

SEQ ID NO: 1169887 - RNA, 23 nt, Human
caaaacucuccucugcugcuggc

SEQ ID NO: 1169888 - RNA, 19 nt, Human
caaaaaucucaauauuuca

SEQ ID NO: 1169889 - RNA, 13 nt, Human
auuuuccugaaaa

SEQ ID NO: 1169890 - RNA, 14 nt, Human
auuuuccugaaaac

SEQ ID NO: 1169891 - RNA, 21 nt, Human
auuuugggguacccacugcuc

SEQ ID NO: 1169892 - RNA, 22 nt, Human
auuuugggguacccacugcucu

SEQ ID NO: 1169893 - RNA, 23 nt, Human
auuuugggguacccacugcucug

SEQ ID NO: 1169894 - RNA, 13 nt, Human
caaaaaggcagga

SEQ ID NO: 1169895 - RNA, 18 nt, Human
caacacucauugaccuga

SEQ ID NO: 1169896 - RNA, 20 nt, Human
caacacucauugaccugagg

SEQ ID NO: 1169897 - RNA, 22 nt, Human
caacacucauugaccugaggcc

SEQ ID NO: 1169898 - RNA, 13 nt, Human
caacgucugugcc

SEQ ID NO: 1169899 - RNA, 14 nt, Human
caacgucugugcca

SEQ ID NO: 1169900 - RNA, 14 nt, Human
caaccuccugggcu

SEQ ID NO: 1169901 - RNA, 15 nt, Human
caaccuccugggcua

SEQ ID NO: 1169902 - RNA, 20 nt, Human
caagaacuuuccaggaaggc

SEQ ID NO: 1169903 - RNA, 16 nt, Human
caagaccuucuccuuc

SEQ ID NO: 1169904 - RNA, 17 nt, Human
caagaccuucuccuuca

SEQ ID NO: 1169905 - RNA, 18 nt, Human
caagaccuucuccuucac

SEQ ID NO: 1169906 - RNA, 16 nt, Human
caagacgcugugcugc

SEQ ID NO: 1169907 - RNA, 17 nt, Human
caagacgcugugcugcc

SEQ ID NO: 1169908 - RNA, 16 nt, Human
caagagcccaggccuc

SEQ ID NO: 1169909 - RNA, 17 nt, Human
caagagcccaggccucc

SEQ ID NO: 1169910 - RNA, 15 nt, Human
caagcaccuccugcc

SEQ ID NO: 1169911 - RNA, 16 nt, Human
caagcaccuccugccu

SEQ ID NO: 1169912 - RNA, 17 nt, Human
caagcaccuccugccuc

SEQ ID NO: 1169913 - RNA, 18 nt, Human
caagacgcugugcugccc

SEQ ID NO: 1169914 - RNA, 19 nt, Human
caagacgcugugcugcccu

SEQ ID NO: 1169915 - RNA, 18 nt, Human
caagacucuuuggacacu

SEQ ID NO: 1169916 - RNA, 19 nt, Human
caagacugcacaucaaaau

SEQ ID NO: 1169917 - RNA, 14 nt, Human
caagagcccaggcc

SEQ ID NO: 1169918 - RNA, 15 nt, Human
caagagcccaggccu

SEQ ID NO: 1169919 - RNA, 18 nt, Human
caagcaccuccugccucg

SEQ ID NO: 1169920 - RNA, 14 nt, Human
caagcaggacaugg

SEQ ID NO: 1169921 - RNA, 18 nt, Human
caagcaggacauggacaa

SEQ ID NO: 1169922 - RNA, 21 nt, Human
caagccagauuuuccugaaaa

SEQ ID NO: 1169923 - RNA, 20 nt, Human
caagcgauucuucugcuuca

SEQ ID NO: 1169924 - RNA, 22 nt, Human
caagcgauucuucugcuucagc

SEQ ID NO: 1169925 - RNA, 21 nt, Human
caagcuggucccacucagucc

SEQ ID NO: 1169926 - RNA, 17 nt, Human
caagcuggucccacuca

SEQ ID NO: 1169927 - RNA, 19 nt, Human
caagcuggucccacucagu

SEQ ID NO: 1169928 - RNA, 17 nt, Human
caaggcugauuaaacca

SEQ ID NO: 1169929 - RNA, 14 nt, Human
caaggucauuuuuu

SEQ ID NO: 1169930 - RNA, 20 nt, Human
caaggucauuuuuuuuaaga

SEQ ID NO: 1169931 - RNA, 14 nt, Human
caaguccucuuuuc

SEQ ID NO: 1169932 - RNA, 12 nt, Human
caaggcugcagu

SEQ ID NO: 1169933 - RNA, 15 nt, Human
caaggcugcagugag

SEQ ID NO: 1169934 - RNA, 23 nt, Human
caaggcugucaauuacaggaagu

SEQ ID NO: 1169935 - RNA, 18 nt, Human
caaggggcccaaauucuu

SEQ ID NO: 1169936 - RNA, 18 nt, Human
caagugagagcugggugu

SEQ ID NO: 1169937 - RNA, 21 nt, Human
caaguccucuuuucugagagg

SEQ ID NO: 1169938 - RNA, 14 nt, Human
caagugagagcugg

SEQ ID NO: 1169939 - RNA, 15 nt, Human
caagugagagcuggg

SEQ ID NO: 1169940 - RNA, 17 nt, Human
caagugagagcugggug

SEQ ID NO: 1169941 - RNA, 17 nt, Human
caauuacaggaaguacu

SEQ ID NO: 1169942 - RNA, 23 nt, Human
caauucucauuugucacacacuu

SEQ ID NO: 1169943 - RNA, 16 nt, Human
caauuacaggaaguac

SEQ ID NO: 1169944 - RNA, 15 nt, Human
caaugugauaaaacc

SEQ ID NO: 1169945 - RNA, 17 nt, Human
caaugugauaaaacccc

SEQ ID NO: 1169946 - RNA, 17 nt, Human
caaugcacuuuguucug

SEQ ID NO: 1169947 - RNA, 20 nt, Human
caaugcacuuuguucuggcu

SEQ ID NO: 1169948 - RNA, 21 nt, Human
caaugcacuuuguucuggcuc

SEQ ID NO: 1169949 - RNA, 22 nt, Human
caaugcacuuuguucuggcucu

SEQ ID NO: 1169950 - RNA, 23 nt, Human
caauacaucccuuaccugggaaa

SEQ ID NO: 1169951 - RNA, 12 nt, Human
caauaggaaaaa

SEQ ID NO: 1169952 - RNA, 13 nt, Human
caauaggaaaaac

SEQ ID NO: 1169953 - RNA, 17 nt, Human
caauauucgcuguguca

SEQ ID NO: 1169954 - RNA, 23 nt, Human
caaugaccuuucaauaggaaaaa

SEQ ID NO: 1169955 - RNA, 15 nt, Human
caaugacuuacugua

SEQ ID NO: 1169956 - RNA, 17 nt, Human
caaugacuuacuguaca

SEQ ID NO: 1169957 - RNA, 18 nt, Human
caaugacuuacuguacau

SEQ ID NO: 1169958 - RNA, 14 nt, Human
caauguucucucuu

SEQ ID NO: 1169959 - RNA, 14 nt, Human
caauaggaaaaacu

SEQ ID NO: 1169960 - RNA, 11 nt, Human
cacaggcaggu

SEQ ID NO: 1169961 - RNA, 14 nt, Human
cacaggcaggucca

SEQ ID NO: 1169962 - RNA, 15 nt, Human
cacaggcagguccag

SEQ ID NO: 1169963 - RNA, 22 nt, Human
cacagcugggguggggaccuca

SEQ ID NO: 1169964 - RNA, 23 nt, Human
cacagcugggguggggaccucag

SEQ ID NO: 1169965 - RNA, 21 nt, Human
cacagcuucauuuccuguguc

SEQ ID NO: 1169966 - RNA, 22 nt, Human
cacagcuucauuuccugugucu

SEQ ID NO: 1169967 - RNA, 19 nt, Human
cacaggcagguccaggguu

SEQ ID NO: 1169968 - RNA, 22 nt, Human
cacagugagucgaggacaggga

SEQ ID NO: 1169969 - RNA, 15 nt, Human
cacaguccuuaccag

SEQ ID NO: 1169970 - RNA, 21 nt, Human
cacaguccuuaccagcagagc

SEQ ID NO: 1169971 - RNA, 22 nt, Human
cacaguccuuaccagcagagca

SEQ ID NO: 1169972 - RNA, 14 nt, Human
cacaguucucuccu

SEQ ID NO: 1169973 - RNA, 15 nt, Human
cacaguucucuccuu

SEQ ID NO: 1169974 - RNA, 15 nt, Human
caccgggcacucaga

SEQ ID NO: 1169975 - RNA, 22 nt, Human
caccgggcacucagaagacacu

SEQ ID NO: 1169976 - RNA, 15 nt, Human
caccgggccacagag

SEQ ID NO: 1169977 - RNA, 18 nt, Human
caccgggccacagagaaa

SEQ ID NO: 1169978 - RNA, 14 nt, Human
caccggcuggccug

SEQ ID NO: 1169979 - RNA, 15 nt, Human
caccggcuggccugg

SEQ ID NO: 1169980 - RNA, 16 nt, Human
caccggcuggccuggc

SEQ ID NO: 1169981 - RNA, 17 nt, Human
caccggcuggccuggcc

SEQ ID NO: 1169982 - RNA, 18 nt, Human
caccggcuggccuggccc

SEQ ID NO: 1169983 - RNA, 20 nt, Human
caccggcuggccuggccccu

SEQ ID NO: 1169984 - RNA, 14 nt, Human
caccgggcacucag

SEQ ID NO: 1169985 - RNA, 21 nt, Human
caccgcagacaggaccaggga

SEQ ID NO: 1169986 - RNA, 11 nt, Human
caccucaugga

SEQ ID NO: 1169987 - RNA, 12 nt, Human
caccucauggaa

SEQ ID NO: 1169988 - RNA, 14 nt, Human
caccucauggaauu

SEQ ID NO: 1169989 - RNA, 11 nt, Human
caccuccugcc

SEQ ID NO: 1169990 - RNA, 13 nt, Human
caccuccugccuc

SEQ ID NO: 1169991 - RNA, 14 nt, Human
caccuccugccucg

SEQ ID NO: 1169992 - RNA, 14 nt, Human
caccuccugcuggg

SEQ ID NO: 1169993 - RNA, 15 nt, Human
caccuccugcugggc

SEQ ID NO: 1169994 - RNA, 17 nt, Human
caccuccugcugggcag

SEQ ID NO: 1169995 - RNA, 13 nt, Human
caccucucccuug

SEQ ID NO: 1169996 - RNA, 14 nt, Human
caccucucccuugg

SEQ ID NO: 1169997 - RNA, 17 nt, Human
caccucucccuuggauu

SEQ ID NO: 1169998 - RNA, 15 nt, Human
caccucucucacucc

SEQ ID NO: 1169999 - RNA, 17 nt, Human
caccucucucacuccuu

SEQ ID NO: 1170000 - RNA, 18 nt, Human
caccucucucacuccuug

SEQ ID NO: 1170001 - RNA, 19 nt, Human
caccucucucacuccuuga

SEQ ID NO: 1170002 - RNA, 18 nt, Human
caccucugcacaagcugc

SEQ ID NO: 1170003 - RNA, 19 nt, Human
caccucugcacaagcugca

SEQ ID NO: 1170004 - RNA, 14 nt, Human
caccugaagacuca

SEQ ID NO: 1170005 - RNA, 15 nt, Human
caccugaagacucau

SEQ ID NO: 1170006 - RNA, 23 nt, Human
caccugaagacucauucuucugu

SEQ ID NO: 1170007 - RNA, 23 nt, Human
caccugcggugcuaucuccccca

SEQ ID NO: 1170008 - RNA, 20 nt, Human
caccuggaauauauaaccag

SEQ ID NO: 1170009 - RNA, 12 nt, Human
caccuggccucu

SEQ ID NO: 1170010 - RNA, 13 nt, Human
caccuggccucug

SEQ ID NO: 1170011 - RNA, 14 nt, Human
caccuggccucugc

SEQ ID NO: 1170012 - RNA, 15 nt, Human
caccuggccucugca

SEQ ID NO: 1170013 - RNA, 17 nt, Human
caccuggccucugcacu

SEQ ID NO: 1170014 - RNA, 18 nt, Human
caccuggccucugcacuc

SEQ ID NO: 1170015 - RNA, 19 nt, Human
caccuggccucugcacucc

SEQ ID NO: 1170016 - RNA, 20 nt, Human
caccuggccucugcacuccc

SEQ ID NO: 1170017 - RNA, 23 nt, Human
caccuggccucugcacuccccug

SEQ ID NO: 1170018 - RNA, 20 nt, Human
cacauauugauuuccguuaa

SEQ ID NO: 1170019 - RNA, 13 nt, Human
cacauauugauuu

SEQ ID NO: 1170020 - RNA, 20 nt, Human
caccccucaacaccucugca

SEQ ID NO: 1170021 - RNA, 19 nt, Human
cacccgcuaagagggaggg

SEQ ID NO: 1170022 - RNA, 12 nt, Human
cacccggccccu

SEQ ID NO: 1170023 - RNA, 13 nt, Human
cacccggccccug

SEQ ID NO: 1170024 - RNA, 14 nt, Human
cacccggccccugc

SEQ ID NO: 1170025 - RNA, 16 nt, Human
cacccggccccugcug

SEQ ID NO: 1170026 - RNA, 17 nt, Human
cacccggccccugcugg

SEQ ID NO: 1170027 - RNA, 18 nt, Human
cacccggccccugcuggu

SEQ ID NO: 1170028 - RNA, 21 nt, Human
cacccggccccugcugguuca

SEQ ID NO: 1170029 - RNA, 11 nt, Human
cacccugugau

SEQ ID NO: 1170030 - RNA, 12 nt, Human
cacccugugaug

SEQ ID NO: 1170031 - RNA, 15 nt, Human
cacccugugaugggg

SEQ ID NO: 1170032 - RNA, 18 nt, Human
cacccugugauggggccc

SEQ ID NO: 1170033 - RNA, 20 nt, Human
cacccugugauggggcccug

SEQ ID NO: 1170034 - RNA, 21 nt, Human
cacccugugauggggcccugc

SEQ ID NO: 1170035 - RNA, 22 nt, Human
cacccugugauggggcccugcc

SEQ ID NO: 1170036 - RNA, 23 nt, Human
cacccugugauggggcccugccu

SEQ ID NO: 1170037 - RNA, 15 nt, Human
caccgaaaacguggc

SEQ ID NO: 1170038 - RNA, 18 nt, Human
caccgaaaacguggcugc

SEQ ID NO: 1170039 - RNA, 19 nt, Human
caccgaaaacguggcugcu

SEQ ID NO: 1170040 - RNA, 21 nt, Human
caccgaaaacguggcugcuuc

SEQ ID NO: 1170041 - RNA, 22 nt, Human
caccgaaaacguggcugcuuca

SEQ ID NO: 1170042 - RNA, 12 nt, Human
caccgcagacag

SEQ ID NO: 1170043 - RNA, 13 nt, Human
caccgcagacagg

SEQ ID NO: 1170044 - RNA, 14 nt, Human
caccgcagacagga

SEQ ID NO: 1170045 - RNA, 15 nt, Human
caccgcagacaggac

SEQ ID NO: 1170046 - RNA, 17 nt, Human
caccgcagacaggacca

SEQ ID NO: 1170047 - RNA, 18 nt, Human
caccgcagacaggaccag

SEQ ID NO: 1170048 - RNA, 16 nt, Human
cacgccagauucuuuc

SEQ ID NO: 1170049 - RNA, 21 nt, Human
caccuuagacagucccugcca

SEQ ID NO: 1170050 - RNA, 23 nt, Human
caccuuagacagucccugccaau

SEQ ID NO: 1170051 - RNA, 14 nt, Human
caccuuagacaguc

SEQ ID NO: 1170052 - RNA, 16 nt, Human
caccuuagacaguccc

SEQ ID NO: 1170053 - RNA, 18 nt, Human
caccuuagacagucccug

SEQ ID NO: 1170054 - RNA, 19 nt, Human
caccuuagacagucccugc

SEQ ID NO: 1170055 - RNA, 13 nt, Human
caccuugacaggg

SEQ ID NO: 1170056 - RNA, 15 nt, Human
caccuugacagggca

SEQ ID NO: 1170057 - RNA, 16 nt, Human
caccuugacagggcac

SEQ ID NO: 1170058 - RNA, 18 nt, Human
caccuugacagggcacac

SEQ ID NO: 1170059 - RNA, 16 nt, Human
cacgaauauugcugau

SEQ ID NO: 1170060 - RNA, 19 nt, Human
cacgaauauugcugauggu

SEQ ID NO: 1170061 - RNA, 22 nt, Human
cacgaauauugcugauggugca

SEQ ID NO: 1170062 - RNA, 16 nt, Human
cacgacugcccggcag

SEQ ID NO: 1170063 - RNA, 17 nt, Human
cacgacugcccggcagg

SEQ ID NO: 1170064 - RNA, 12 nt, Human
cacgauuucugu

SEQ ID NO: 1170065 - RNA, 14 nt, Human
cacgauuucuguuu

SEQ ID NO: 1170066 - RNA, 16 nt, Human
cacgauuucuguuuag

SEQ ID NO: 1170067 - RNA, 17 nt, Human
cacgcacuucgggaggu

SEQ ID NO: 1170068 - RNA, 13 nt, Human
cacgccacugcac

SEQ ID NO: 1170069 - RNA, 15 nt, Human
cacgccacugcacua

SEQ ID NO: 1170070 - RNA, 19 nt, Human
cacgccagauucuuuccug

SEQ ID NO: 1170071 - RNA, 20 nt, Human
cacgccagauucuuuccuga

SEQ ID NO: 1170072 - RNA, 22 nt, Human
cacgccagauucuuuccugagg

SEQ ID NO: 1170073 - RNA, 23 nt, Human
cacgccagauucuuuccugaggc

SEQ ID NO: 1170074 - RNA, 13 nt, Human
cacgcccccacug

SEQ ID NO: 1170075 - RNA, 15 nt, Human
cacgcccccacuggu

SEQ ID NO: 1170076 - RNA, 17 nt, Human
cacgcccccacugguga

SEQ ID NO: 1170077 - RNA, 18 nt, Human
cacgcccccacuggugac

SEQ ID NO: 1170078 - RNA, 17 nt, Human
cacgcuggaccuugaac

SEQ ID NO: 1170079 - RNA, 20 nt, Human
cacgcuggaccuugaacugg

SEQ ID NO: 1170080 - RNA, 15 nt, Human
cacgcuggagugcag

SEQ ID NO: 1170081 - RNA, 16 nt, Human
cacggcucacugcagc

SEQ ID NO: 1170082 - RNA, 17 nt, Human
cacggcucacugcagcc

SEQ ID NO: 1170083 - RNA, 19 nt, Human
cacggcucacugcagccuc

SEQ ID NO: 1170084 - RNA, 20 nt, Human
cacggcucacugcagccuca

SEQ ID NO: 1170085 - RNA, 19 nt, Human
cacgccuguaauccuagca

SEQ ID NO: 1170086 - RNA, 20 nt, Human
cacgccuguaauccuagcac

SEQ ID NO: 1170087 - RNA, 15 nt, Human
cacgcgugcacacac

SEQ ID NO: 1170088 - RNA, 16 nt, Human
cacgcgugcacacacc

SEQ ID NO: 1170089 - RNA, 21 nt, Human
cacgcgugcacacaccagagc

SEQ ID NO: 1170090 - RNA, 23 nt, Human
cacgcgugcacacaccagagccc

SEQ ID NO: 1170091 - RNA, 14 nt, Human
cacguacacacaca

SEQ ID NO: 1170092 - RNA, 18 nt, Human
cacguacacacacauaca

SEQ ID NO: 1170093 - RNA, 19 nt, Human
cacguacacacacauacac

SEQ ID NO: 1170094 - RNA, 13 nt, Human
cacuaaacaaaga

SEQ ID NO: 1170095 - RNA, 12 nt, Human
cacguuucuaaa

SEQ ID NO: 1170096 - RNA, 14 nt, Human
cacguuucuaaagg

SEQ ID NO: 1170097 - RNA, 23 nt, Human
cacguuucuaaaggcuaccuuug

SEQ ID NO: 1170098 - RNA, 16 nt, Human
cacgugguccuaaucu

SEQ ID NO: 1170099 - RNA, 19 nt, Human
cacgugguccuaaucuucu

SEQ ID NO: 1170100 - RNA, 22 nt, Human
cacguucuuacuaguuucccuu

SEQ ID NO: 1170101 - RNA, 15 nt, Human
cacuauguugcccag

SEQ ID NO: 1170102 - RNA, 16 nt, Human
cacuauguugcccagg

SEQ ID NO: 1170103 - RNA, 17 nt, Human
cacuauguugcccaggc

SEQ ID NO: 1170104 - RNA, 18 nt, Human
cacuauguugcccaggca

SEQ ID NO: 1170105 - RNA, 19 nt, Human
cacuauguugcccaggcag

SEQ ID NO: 1170106 - RNA, 19 nt, Human
cacuaguauuucuaugaaa

SEQ ID NO: 1170107 - RNA, 14 nt, Human
cacuauaauguaag

SEQ ID NO: 1170108 - RNA, 18 nt, Human
cacuauaauguaagcucu

SEQ ID NO: 1170109 - RNA, 14 nt, Human
cacuauagccuagg

SEQ ID NO: 1170110 - RNA, 21 nt, Human
cacuauagccuaggugacaga

SEQ ID NO: 1170111 - RNA, 21 nt, Human
cacuaaauugacacuuaaaaa

SEQ ID NO: 1170112 - RNA, 14 nt, Human
cacuaaccacgcug

SEQ ID NO: 1170113 - RNA, 15 nt, Human
cacuaaccacgcugg

SEQ ID NO: 1170114 - RNA, 16 nt, Human
cacuaaccacgcugga

SEQ ID NO: 1170115 - RNA, 18 nt, Human
cacuaaccacgcuggacc

SEQ ID NO: 1170116 - RNA, 17 nt, Human
cacuaagagagaaugag

SEQ ID NO: 1170117 - RNA, 17 nt, Human
cacuaaggugugcucug

SEQ ID NO: 1170118 - RNA, 18 nt, Human
cacuaaggugugcucuga

SEQ ID NO: 1170119 - RNA, 20 nt, Human
cacuauguugcccaggcagg

SEQ ID NO: 1170120 - RNA, 21 nt, Human
cacuauguugcccaggcaggu

SEQ ID NO: 1170121 - RNA, 15 nt, Human
cacucaaaagcuggg

SEQ ID NO: 1170122 - RNA, 17 nt, Human
cacucaaaagcugggca

SEQ ID NO: 1170123 - RNA, 18 nt, Human
cacucaaaagcugggcag

SEQ ID NO: 1170124 - RNA, 19 nt, Human
cacucaaaagcugggcagg

SEQ ID NO: 1170125 - RNA, 20 nt, Human
cacucaaaagcugggcaggu

SEQ ID NO: 1170126 - RNA, 19 nt, Human
cacucacauuuauucugcu

SEQ ID NO: 1170127 - RNA, 20 nt, Human
cacucacauuuauucugcuc

SEQ ID NO: 1170128 - RNA, 12 nt, Human
cacucagaagac

SEQ ID NO: 1170129 - RNA, 16 nt, Human
cacucagaagacacug

SEQ ID NO: 1170130 - RNA, 17 nt, Human
cacucagaagacacuga

SEQ ID NO: 1170131 - RNA, 18 nt, Human
cacucagaagacacugau

SEQ ID NO: 1170132 - RNA, 19 nt, Human
cacucagaagacacugaug

SEQ ID NO: 1170133 - RNA, 22 nt, Human
cacucagaagacacugaugggc

SEQ ID NO: 1170134 - RNA, 17 nt, Human
cacucccugcaaccuga

SEQ ID NO: 1170135 - RNA, 14 nt, Human
cacuccuucacaga

SEQ ID NO: 1170136 - RNA, 21 nt, Human
cacuccuucacagaugggugc

SEQ ID NO: 1170137 - RNA, 16 nt, Human
cacucaguccauagca

SEQ ID NO: 1170138 - RNA, 15 nt, Human
cacucauugaccuga

SEQ ID NO: 1170139 - RNA, 18 nt, Human
cacucauugaccugaggc

SEQ ID NO: 1170140 - RNA, 19 nt, Human
cacucauugaccugaggcc

SEQ ID NO: 1170141 - RNA, 20 nt, Human
cacucauugaccugaggccc

SEQ ID NO: 1170142 - RNA, 22 nt, Human
cacucauugaccugaggcccuu

SEQ ID NO: 1170143 - RNA, 12 nt, Human
cacucccugcaa

SEQ ID NO: 1170144 - RNA, 13 nt, Human
cacucccugcaac

SEQ ID NO: 1170145 - RNA, 16 nt, Human
cacucccugcaaccug

SEQ ID NO: 1170146 - RNA, 12 nt, Human
cacucuccuugg

SEQ ID NO: 1170147 - RNA, 12 nt, Human
cacucugagacu

SEQ ID NO: 1170148 - RNA, 23 nt, Human
cacucugagacucgcgacaaugc

SEQ ID NO: 1170149 - RNA, 12 nt, Human
cacucuggcagc

SEQ ID NO: 1170150 - RNA, 13 nt, Human
cacucuggcagcu

SEQ ID NO: 1170151 - RNA, 14 nt, Human
cacucuggcagcuc

SEQ ID NO: 1170152 - RNA, 13 nt, Human
cacugcaaccucc

SEQ ID NO: 1170153 - RNA, 14 nt, Human
cacugcaaccuccg

SEQ ID NO: 1170154 - RNA, 16 nt, Human
cacugcaaccuccgcc

SEQ ID NO: 1170155 - RNA, 23 nt, Human
cacugcaaccuccgccucuuggg

SEQ ID NO: 1170156 - RNA, 23 nt, Human
cacugagacagcccgggcucugc

SEQ ID NO: 1170157 - RNA, 14 nt, Human
cacugaugggcaac

SEQ ID NO: 1170158 - RNA, 18 nt, Human
cacugaugggcaaccccc

SEQ ID NO: 1170159 - RNA, 24 nt, Human
cacugaugggcaacccccagccug

SEQ ID NO: 1170160 - RNA, 15 nt, Human
cacucuggcagcuca

SEQ ID NO: 1170161 - RNA, 16 nt, Human
cacucuggcagcucag

SEQ ID NO: 1170162 - RNA, 17 nt, Human
cacucuggcagcucaga

SEQ ID NO: 1170163 - RNA, 19 nt, Human
cacucuggcagcucagaga

SEQ ID NO: 1170164 - RNA, 20 nt, Human
cacucuggcagcucagagag

SEQ ID NO: 1170165 - RNA, 21 nt, Human
cacucuggcagcucagagagg

SEQ ID NO: 1170166 - RNA, 23 nt, Human
cacucuggcagcucagagagggu

SEQ ID NO: 1170167 - RNA, 15 nt, Human
cacucugucgcccag

SEQ ID NO: 1170168 - RNA, 16 nt, Human
cacucugucgcccagu

SEQ ID NO: 1170169 - RNA, 19 nt, Human
cacucugucgcccagucug

SEQ ID NO: 1170170 - RNA, 20 nt, Human
cacucugucgcccagucugg

SEQ ID NO: 1170171 - RNA, 23 nt, Human
cacugacauuguuggccaaagcc

SEQ ID NO: 1170172 - RNA, 12 nt, Human
cacugagacagc

SEQ ID NO: 1170173 - RNA, 13 nt, Human
cacugagacagcc

SEQ ID NO: 1170174 - RNA, 14 nt, Human
cacugagacagccc

SEQ ID NO: 1170175 - RNA, 17 nt, Human
cacugagacagcccggg

SEQ ID NO: 1170176 - RNA, 19 nt, Human
cacugagacagcccgggcu

SEQ ID NO: 1170177 - RNA, 22 nt, Human
cacugagacagcccgggcucug

SEQ ID NO: 1170178 - RNA, 14 nt, Human
cacugcaccgggcc

SEQ ID NO: 1170179 - RNA, 15 nt, Human
cacugcaccgggcca

SEQ ID NO: 1170180 - RNA, 16 nt, Human
cacugcaccgggccac

SEQ ID NO: 1170181 - RNA, 18 nt, Human
cacugcaccgggccacag

SEQ ID NO: 1170182 - RNA, 19 nt, Human
cacugcaccgggccacaga

SEQ ID NO: 1170183 - RNA, 18 nt, Human
cacugcacuauagccuag

SEQ ID NO: 1170184 - RNA, 19 nt, Human
cacugcacuauagccuagg

SEQ ID NO: 1170185 - RNA, 20 nt, Human
cacugccuucucaacuccaa

SEQ ID NO: 1170186 - RNA, 12 nt, Human
cacugcucuggu

SEQ ID NO: 1170187 - RNA, 13 nt, Human
cacugcuuaacuu

SEQ ID NO: 1170188 - RNA, 14 nt, Human
cacugcuuccagug

SEQ ID NO: 1170189 - RNA, 15 nt, Human
cacugcuuccaguga

SEQ ID NO: 1170190 - RNA, 16 nt, Human
cacugcuuccagugag

SEQ ID NO: 1170191 - RNA, 18 nt, Human
cacugcuuccagugaggc

SEQ ID NO: 1170192 - RNA, 19 nt, Human
cacugcuuccagugaggcu

SEQ ID NO: 1170193 - RNA, 20 nt, Human
cacugcuuccagugaggcuc

SEQ ID NO: 1170194 - RNA, 21 nt, Human
cacugcuuccagugaggcucu

SEQ ID NO: 1170195 - RNA, 22 nt, Human
cacugcuuccagugaggcucug

SEQ ID NO: 1170196 - RNA, 20 nt, Human
cacugcuuuuggucugugug

SEQ ID NO: 1170197 - RNA, 21 nt, Human
cacugcuuuuggucuguguga

SEQ ID NO: 1170198 - RNA, 17 nt, Human
cacuggaacacuaauga

SEQ ID NO: 1170199 - RNA, 12 nt, Human
cacuucagcuga

SEQ ID NO: 1170200 - RNA, 21 nt, Human
cacuucagcugacuuuucugu

SEQ ID NO: 1170201 - RNA, 14 nt, Human
cacuguugcccagg

SEQ ID NO: 1170202 - RNA, 16 nt, Human
cacuucccuacaugga

SEQ ID NO: 1170203 - RNA, 21 nt, Human
cacuucgggaggucgaggcag

SEQ ID NO: 1170204 - RNA, 23 nt, Human
cacuucgggaggucgaggcagga

SEQ ID NO: 1170205 - RNA, 22 nt, Human
cacuucugccauauucuguugg

SEQ ID NO: 1170206 - RNA, 13 nt, Human
cacuugaguccag

SEQ ID NO: 1170207 - RNA, 13 nt, Human
cacuugcagacuc

SEQ ID NO: 1170208 - RNA, 19 nt, Human
cacuugacaucaacugcau

SEQ ID NO: 1170209 - RNA, 17 nt, Human
cacuugagaauuacccu

SEQ ID NO: 1170210 - RNA, 20 nt, Human
cacuugagaauuacccuuuu

SEQ ID NO: 1170211 - RNA, 20 nt, Human
cacuugaacccgggaggcag

SEQ ID NO: 1170212 - RNA, 21 nt, Human
cacuugaacccgggaggcaga

SEQ ID NO: 1170213 - RNA, 23 nt, Human
cacuugaacccgggaggcagagg

SEQ ID NO: 1170214 - RNA, 16 nt, Human
cacuugacaucaacug

SEQ ID NO: 1170215 - RNA, 14 nt, Human
cacuugcagacucu

SEQ ID NO: 1170216 - RNA, 18 nt, Human
cacuugcagacucuacag

SEQ ID NO: 1170217 - RNA, 19 nt, Human
cacuugcagacucuacaga

SEQ ID NO: 1170218 - RNA, 22 nt, Human
cacuugcagacucuacagaggc

SEQ ID NO: 1170219 - RNA, 24 nt, Human
cacuugcagacucuacagaggcca

SEQ ID NO: 1170220 - RNA, 15 nt, Human
cacuuggucugugag

SEQ ID NO: 1170221 - RNA, 17 nt, Human
cacuuggucugugagau

SEQ ID NO: 1170222 - RNA, 19 nt, Human
cacuuucuagccagaggag

SEQ ID NO: 1170223 - RNA, 20 nt, Human
cacuuucuagccagaggaga

SEQ ID NO: 1170224 - RNA, 19 nt, Human
cacuguggguagacacaca

SEQ ID NO: 1170225 - RNA, 17 nt, Human
cacugugcugagucuga

SEQ ID NO: 1170226 - RNA, 20 nt, Human
cacugugcugagucugaagg

SEQ ID NO: 1170227 - RNA, 21 nt, Human
cacugugcugagucugaaggc

SEQ ID NO: 1170228 - RNA, 22 nt, Human
cacugugcugagucugaaggcu

SEQ ID NO: 1170229 - RNA, 15 nt, Human
cacugugccaugugc

SEQ ID NO: 1170230 - RNA, 16 nt, Human
cacugugccaugugcc

SEQ ID NO: 1170231 - RNA, 18 nt, Human
cacugugccaugugccag

SEQ ID NO: 1170232 - RNA, 13 nt, Human
cacugugcugagu

SEQ ID NO: 1170233 - RNA, 15 nt, Human
cacugugcugagucu

SEQ ID NO: 1170234 - RNA, 22 nt, Human
cacuguggguagacacacauga

SEQ ID NO: 1170235 - RNA, 24 nt, Human
cacuguggguagacacacaugaag

SEQ ID NO: 1170236 - RNA, 13 nt, Human
cacuguucucugc

SEQ ID NO: 1170237 - RNA, 14 nt, Human
cacuguucucugcc

SEQ ID NO: 1170238 - RNA, 15 nt, Human
cacuguucucugccc

SEQ ID NO: 1170239 - RNA, 16 nt, Human
cacuguucucugcccu

SEQ ID NO: 1170240 - RNA, 17 nt, Human
cacuguucucugcccuc

SEQ ID NO: 1170241 - RNA, 19 nt, Human
cacuguucucugcccucca

SEQ ID NO: 1170242 - RNA, 21 nt, Human
cacuguucucugcccuccaag

SEQ ID NO: 1170243 - RNA, 22 nt, Human
cacuguucucugcccuccaaga

SEQ ID NO: 1170244 - RNA, 13 nt, Human
cacugugaagaga

SEQ ID NO: 1170245 - RNA, 14 nt, Human
cacugugccaugug

SEQ ID NO: 1170246 - RNA, 14 nt, Human
cacuuuuguucuug

SEQ ID NO: 1170247 - RNA, 22 nt, Human
cacuuuuguucuugguuuguaa

SEQ ID NO: 1170248 - RNA, 22 nt, Human
cacuuucuagccagaggagaga

SEQ ID NO: 1170249 - RNA, 12 nt, Human
cacuuugggagg

SEQ ID NO: 1170250 - RNA, 13 nt, Human
cacuuugggaggc

SEQ ID NO: 1170251 - RNA, 16 nt, Human
cacuuugggaggccaa

SEQ ID NO: 1170252 - RNA, 13 nt, Human
cacuuuguucugg

SEQ ID NO: 1170253 - RNA, 14 nt, Human
cacuuuguucuggc

SEQ ID NO: 1170254 - RNA, 16 nt, Human
cacuuuguucuggcuc

SEQ ID NO: 1170255 - RNA, 23 nt, Human
cacuuuguucuggcucuuccagg

SEQ ID NO: 1170256 - RNA, 18 nt, Human
cagaaagcagaacaguga

SEQ ID NO: 1170257 - RNA, 19 nt, Human
cagaaagcagaacagugau

SEQ ID NO: 1170258 - RNA, 23 nt, Human
cagaacagugauuaccagggacu

SEQ ID NO: 1170259 - RNA, 21 nt, Human
cagaaaagaaaguucaugcuu

SEQ ID NO: 1170260 - RNA, 11 nt, Human
cagaaaauaua

SEQ ID NO: 1170261 - RNA, 12 nt, Human
cagaaaauauac

SEQ ID NO: 1170262 - RNA, 13 nt, Human
cagaaaauauacu

SEQ ID NO: 1170263 - RNA, 14 nt, Human
cagaaaauauacug

SEQ ID NO: 1170264 - RNA, 15 nt, Human
cagaaaauauacugu

SEQ ID NO: 1170265 - RNA, 16 nt, Human
cagaaaauauacugua

SEQ ID NO: 1170266 - RNA, 17 nt, Human
cagaaaauauacuguaa

SEQ ID NO: 1170267 - RNA, 18 nt, Human
cagaaaauauacuguaaa

SEQ ID NO: 1170268 - RNA, 19 nt, Human
cagaaaauauacuguaaag

SEQ ID NO: 1170269 - RNA, 20 nt, Human
cagaaaauauacuguaaaga

SEQ ID NO: 1170270 - RNA, 21 nt, Human
cagaaaauauacuguaaagaa

SEQ ID NO: 1170271 - RNA, 16 nt, Human
cagaaaauggaagaca

SEQ ID NO: 1170272 - RNA, 20 nt, Human
cagaaaauggaagacagcuc

SEQ ID NO: 1170273 - RNA, 21 nt, Human
cagaaaauggaagacagcucu

SEQ ID NO: 1170274 - RNA, 22 nt, Human
cagaaaauggaagacagcucuu

SEQ ID NO: 1170275 - RNA, 23 nt, Human
cagaaaauggaagacagcucuua

SEQ ID NO: 1170276 - RNA, 19 nt, Human
cagaagcaacccaaauguu

SEQ ID NO: 1170277 - RNA, 20 nt, Human
cagaagcaacccaaauguuc

SEQ ID NO: 1170278 - RNA, 21 nt, Human
cagaagacacugaugggcaac

SEQ ID NO: 1170279 - RNA, 16 nt, Human
cagaaggaagacuuca

SEQ ID NO: 1170280 - RNA, 17 nt, Human
cagaaggaagacuucau

SEQ ID NO: 1170281 - RNA, 18 nt, Human
cagaaggaagacuucauc

SEQ ID NO: 1170282 - RNA, 19 nt, Human
cagaaggaagacuucaucc

SEQ ID NO: 1170283 - RNA, 17 nt, Human
cagaaucucaaauaacu

SEQ ID NO: 1170284 - RNA, 18 nt, Human
cagaaucucaaauaacua

SEQ ID NO: 1170285 - RNA, 11 nt, Human
cagaauucuca

SEQ ID NO: 1170286 - RNA, 15 nt, Human
cagaauucucuaguu

SEQ ID NO: 1170287 - RNA, 18 nt, Human
cagaauucucuaguuuga

SEQ ID NO: 1170288 - RNA, 14 nt, Human
cagaauuucccaaa

SEQ ID NO: 1170289 - RNA, 17 nt, Human
cagaauuucccaaagca

SEQ ID NO: 1170290 - RNA, 18 nt, Human
cagaauuucccaaagcag

SEQ ID NO: 1170291 - RNA, 19 nt, Human
cagaauuucccaaagcagu

SEQ ID NO: 1170292 - RNA, 20 nt, Human
cagaauuucccaaagcagug

SEQ ID NO: 1170293 - RNA, 24 nt, Human
cagaauuucccaaagcagugcaug

SEQ ID NO: 1170294 - RNA, 12 nt, Human
cagacaaagcgu

SEQ ID NO: 1170295 - RNA, 22 nt, Human
cagacaaagcgugguggacaug

SEQ ID NO: 1170296 - RNA, 20 nt, Human
cagacaacaaaccuguuucu

SEQ ID NO: 1170297 - RNA, 13 nt, Human
cagacacaggccc

SEQ ID NO: 1170298 - RNA, 14 nt, Human
cagacacaggcccg

SEQ ID NO: 1170299 - RNA, 15 nt, Human
cagacacaggcccgg

SEQ ID NO: 1170300 - RNA, 17 nt, Human
cagacacaggcccggcu

SEQ ID NO: 1170301 - RNA, 18 nt, Human
cagacacaggcccggcuc

SEQ ID NO: 1170302 - RNA, 21 nt, Human
cagacacaggcccggcuccag

SEQ ID NO: 1170303 - RNA, 22 nt, Human
cagacacaggcccggcuccagg

SEQ ID NO: 1170304 - RNA, 23 nt, Human
cagacacaggcccggcuccaggc

SEQ ID NO: 1170305 - RNA, 14 nt, Human
cagacacaugucca

SEQ ID NO: 1170306 - RNA, 17 nt, Human
cagacacauguccaaga

SEQ ID NO: 1170307 - RNA, 21 nt, Human
cagacacauguccaagaagcc

SEQ ID NO: 1170308 - RNA, 22 nt, Human
cagacacauguccaagaagccc

SEQ ID NO: 1170309 - RNA, 23 nt, Human
cagacacauguccaagaagccca

SEQ ID NO: 1170310 - RNA, 19 nt, Human
cagacaccuugacagggca

SEQ ID NO: 1170311 - RNA, 20 nt, Human
cagacaccuugacagggcac

SEQ ID NO: 1170312 - RNA, 22 nt, Human
cagacaccuugacagggcacac

SEQ ID NO: 1170313 - RNA, 20 nt, Human
cagacaguuaagagaaauga

SEQ ID NO: 1170314 - RNA, 19 nt, Human
cagacauacuaaccagcag

SEQ ID NO: 1170315 - RNA, 17 nt, Human
cagacauagaauuaaca

SEQ ID NO: 1170316 - RNA, 19 nt, Human
cagacauagaauuaacaca

SEQ ID NO: 1170317 - RNA, 14 nt, Human
cagaccacaaaacu

SEQ ID NO: 1170318 - RNA, 20 nt, Human
cagaccacaaaacuuuucua

SEQ ID NO: 1170319 - RNA, 12 nt, Human
cagacccggcug

SEQ ID NO: 1170320 - RNA, 14 nt, Human
cagacccggcugcg

SEQ ID NO: 1170321 - RNA, 16 nt, Human
cagacccggcugcgug

SEQ ID NO: 1170322 - RNA, 12 nt, Human
cagacccugccc

SEQ ID NO: 1170323 - RNA, 13 nt, Human
cagacccugcccu

SEQ ID NO: 1170324 - RNA, 14 nt, Human
cagacccugcccug

SEQ ID NO: 1170325 - RNA, 15 nt, Human
cagacccugcccugu

SEQ ID NO: 1170326 - RNA, 16 nt, Human
cagacccugcccugug

SEQ ID NO: 1170327 - RNA, 17 nt, Human
cagacccugcccugugg

SEQ ID NO: 1170328 - RNA, 21 nt, Human
cagacccugcccugugggccc

SEQ ID NO: 1170329 - RNA, 22 nt, Human
cagacccugcccugugggcccc

SEQ ID NO: 1170330 - RNA, 19 nt, Human
cagagaaaguacuucucca

SEQ ID NO: 1170331 - RNA, 23 nt, Human
cagagaaaguacuucuccacccu

SEQ ID NO: 1170332 - RNA, 16 nt, Human
cagacaacaaaccugu

SEQ ID NO: 1170333 - RNA, 16 nt, Human
cagagcaccuuagaca

SEQ ID NO: 1170334 - RNA, 14 nt, Human
cagagcaagugaga

SEQ ID NO: 1170335 - RNA, 20 nt, Human
cagagcaagugagacccugu

SEQ ID NO: 1170336 - RNA, 17 nt, Human
cagagaccaucccugaa

SEQ ID NO: 1170337 - RNA, 18 nt, Human
cagagaccaucccugaag

SEQ ID NO: 1170338 - RNA, 19 nt, Human
cagagaccaucccugaagg

SEQ ID NO: 1170339 - RNA, 20 nt, Human
cagagaccaucccugaaggc

SEQ ID NO: 1170340 - RNA, 21 nt, Human
cagagaccaucccugaaggcc

SEQ ID NO: 1170341 - RNA, 13 nt, Human
cagagacuccugc

SEQ ID NO: 1170342 - RNA, 14 nt, Human
cagagacuccugca

SEQ ID NO: 1170343 - RNA, 15 nt, Human
cagagacuccugcag

SEQ ID NO: 1170344 - RNA, 16 nt, Human
cagagacuccugcagg

SEQ ID NO: 1170345 - RNA, 17 nt, Human
cagagacuccugcaggc

SEQ ID NO: 1170346 - RNA, 18 nt, Human
cagagacuccugcaggca

SEQ ID NO: 1170347 - RNA, 19 nt, Human
cagagacuccugcaggcag

SEQ ID NO: 1170348 - RNA, 19 nt, Human
cagagaaugaaagggccca

SEQ ID NO: 1170349 - RNA, 20 nt, Human
cagagaaugaaagggcccag

SEQ ID NO: 1170350 - RNA, 21 nt, Human
cagagaaugaaagggcccaga

SEQ ID NO: 1170351 - RNA, 15 nt, Human
cagagaauucucuua

SEQ ID NO: 1170352 - RNA, 14 nt, Human
cagagacacaagcc

SEQ ID NO: 1170353 - RNA, 15 nt, Human
cagagacacaagccu

SEQ ID NO: 1170354 - RNA, 16 nt, Human
cagagacacaagccuu

SEQ ID NO: 1170355 - RNA, 17 nt, Human
cagagacacaagccuuc

SEQ ID NO: 1170356 - RNA, 13 nt, Human
cagagaccauccc

SEQ ID NO: 1170357 - RNA, 14 nt, Human
cagagaccaucccu

SEQ ID NO: 1170358 - RNA, 16 nt, Human
cagagaccaucccuga

SEQ ID NO: 1170359 - RNA, 15 nt, Human
cagagcccaccuugg

SEQ ID NO: 1170360 - RNA, 17 nt, Human
cagagcccaccuuggcu

SEQ ID NO: 1170361 - RNA, 19 nt, Human
cagagcccaccuuggcuca

SEQ ID NO: 1170362 - RNA, 20 nt, Human
cagagcccaccuuggcucaa

SEQ ID NO: 1170363 - RNA, 16 nt, Human
cagagcccacgccccc

SEQ ID NO: 1170364 - RNA, 18 nt, Human
cagagcaccuuagacagu

SEQ ID NO: 1170365 - RNA, 19 nt, Human
cagagcaccuuagacaguc

SEQ ID NO: 1170366 - RNA, 21 nt, Human
cagagcaccuuagacaguccc

SEQ ID NO: 1170367 - RNA, 22 nt, Human
cagagcaccuuagacagucccu

SEQ ID NO: 1170368 - RNA, 23 nt, Human
cagagcaccuuagacagucccug

SEQ ID NO: 1170369 - RNA, 11 nt, Human
cagagcagaga

SEQ ID NO: 1170370 - RNA, 12 nt, Human
cagagcagagac

SEQ ID NO: 1170371 - RNA, 13 nt, Human
cagagcagagacc

SEQ ID NO: 1170372 - RNA, 14 nt, Human
cagagcagagacca

SEQ ID NO: 1170373 - RNA, 15 nt, Human
cagagcagagaccau

SEQ ID NO: 1170374 - RNA, 17 nt, Human
cagagcagagaccaucc

SEQ ID NO: 1170375 - RNA, 18 nt, Human
cagagcagagaccauccc

SEQ ID NO: 1170376 - RNA, 19 nt, Human
cagagcagagaccaucccu

SEQ ID NO: 1170377 - RNA, 21 nt, Human
cagagcagagaccaucccuga

SEQ ID NO: 1170378 - RNA, 17 nt, Human
cagagcccacgccccca

SEQ ID NO: 1170379 - RNA, 19 nt, Human
cagagcccacgcccccacu

SEQ ID NO: 1170380 - RNA, 20 nt, Human
cagagcccacgcccccacug

SEQ ID NO: 1170381 - RNA, 21 nt, Human
cagagcccacgcccccacugg

SEQ ID NO: 1170382 - RNA, 23 nt, Human
cagagcccacgcccccacuggug

SEQ ID NO: 1170383 - RNA, 12 nt, Human
cagagccugcag

SEQ ID NO: 1170384 - RNA, 13 nt, Human
cagagccugcagu

SEQ ID NO: 1170385 - RNA, 13 nt, Human
cagaggaaggaga

SEQ ID NO: 1170386 - RNA, 13 nt, Human
cagaggagagagg

SEQ ID NO: 1170387 - RNA, 15 nt, Human
cagaggagagaggac

SEQ ID NO: 1170388 - RNA, 19 nt, Human
cagaggagagaggaccccc

SEQ ID NO: 1170389 - RNA, 20 nt, Human
cagaggagagaggacccccu

SEQ ID NO: 1170390 - RNA, 11 nt, Human
cagaggcagcc

SEQ ID NO: 1170391 - RNA, 13 nt, Human
cagaugcaccagc

SEQ ID NO: 1170392 - RNA, 14 nt, Human
cagaugcaccagcc

SEQ ID NO: 1170393 - RNA, 16 nt, Human
cagaugcaccagcccu

SEQ ID NO: 1170394 - RNA, 17 nt, Human
cagaugcaccagcccuu

SEQ ID NO: 1170395 - RNA, 22 nt, Human
cagaugcaccagcccuuagcag

SEQ ID NO: 1170396 - RNA, 20 nt, Human
cagauacaggaaaagcugcu

SEQ ID NO: 1170397 - RNA, 21 nt, Human
cagauacaggaaaagcugcug

SEQ ID NO: 1170398 - RNA, 22 nt, Human
cagauacaggaaaagcugcuga

SEQ ID NO: 1170399 - RNA, 23 nt, Human
cagauacaggaaaagcugcugac

SEQ ID NO: 1170400 - RNA, 14 nt, Human
cagauccuggaaau

SEQ ID NO: 1170401 - RNA, 20 nt, Human
cagaucucuaacuucaccau

SEQ ID NO: 1170402 - RNA, 14 nt, Human
cagaguugaagaca

SEQ ID NO: 1170403 - RNA, 15 nt, Human
cagaguugaagacag

SEQ ID NO: 1170404 - RNA, 16 nt, Human
cagaguugaagacaga

SEQ ID NO: 1170405 - RNA, 17 nt, Human
cagaguugaagacagag

SEQ ID NO: 1170406 - RNA, 18 nt, Human
cagaguugaagacagagc

SEQ ID NO: 1170407 - RNA, 19 nt, Human
cagaguugaagacagagcu

SEQ ID NO: 1170408 - RNA, 20 nt, Human
cagaguugaagacagagcua

SEQ ID NO: 1170409 - RNA, 22 nt, Human
cagaguugaagacagagcuaca

SEQ ID NO: 1170410 - RNA, 14 nt, Human
cagaguuguuacau

SEQ ID NO: 1170411 - RNA, 15 nt, Human
cagaguuguuacauu

SEQ ID NO: 1170412 - RNA, 18 nt, Human
cagaguuguuacauuuuu

SEQ ID NO: 1170413 - RNA, 19 nt, Human
cagaguuguuacauuuuua

SEQ ID NO: 1170414 - RNA, 14 nt, Human
cagauaaacaguag

SEQ ID NO: 1170415 - RNA, 23 nt, Human
cagauaaauaguuuaugauucca

SEQ ID NO: 1170416 - RNA, 14 nt, Human
cagauaaucacaau

SEQ ID NO: 1170417 - RNA, 12 nt, Human
cagaggcagccc

SEQ ID NO: 1170418 - RNA, 13 nt, Human
cagaggcagcccc

SEQ ID NO: 1170419 - RNA, 14 nt, Human
cagaggcagcccca

SEQ ID NO: 1170420 - RNA, 15 nt, Human
cagaggcagccccau

SEQ ID NO: 1170421 - RNA, 18 nt, Human
cagaggcagccccauucu

SEQ ID NO: 1170422 - RNA, 19 nt, Human
cagaggcagccccauucug

SEQ ID NO: 1170423 - RNA, 20 nt, Human
cagaggcagccccauucugc

SEQ ID NO: 1170424 - RNA, 22 nt, Human
cagaggcagccccauucugccu

SEQ ID NO: 1170425 - RNA, 23 nt, Human
cagaggcagccccauucugccug

SEQ ID NO: 1170426 - RNA, 19 nt, Human
cagaggccaugggccuccu

SEQ ID NO: 1170427 - RNA, 20 nt, Human
cagaggccaugggccuccug

SEQ ID NO: 1170428 - RNA, 21 nt, Human
cagaggccaugggccuccugu

SEQ ID NO: 1170429 - RNA, 13 nt, Human
cagaggcugccuc

SEQ ID NO: 1170430 - RNA, 23 nt, Human
cagaggcugccucucccaucacu

SEQ ID NO: 1170431 - RNA, 14 nt, Human
cagagggagugaca

SEQ ID NO: 1170432 - RNA, 16 nt, Human
cagagggagugacaga

SEQ ID NO: 1170433 - RNA, 18 nt, Human
cagagggagugacagagg

SEQ ID NO: 1170434 - RNA, 19 nt, Human
cagagggagugacagaggc

SEQ ID NO: 1170435 - RNA, 20 nt, Human
cagagggagugacagaggca

SEQ ID NO: 1170436 - RNA, 21 nt, Human
cagagggagugacagaggcag

SEQ ID NO: 1170437 - RNA, 22 nt, Human
cagagggagugacagaggcagc

SEQ ID NO: 1170438 - RNA, 23 nt, Human
cagagggagugacagaggcagcc

SEQ ID NO: 1170439 - RNA, 15 nt, Human
cagagggccugcaag

SEQ ID NO: 1170440 - RNA, 19 nt, Human
cagagggccugcaagggag

SEQ ID NO: 1170441 - RNA, 13 nt, Human
cagagucucacug

SEQ ID NO: 1170442 - RNA, 17 nt, Human
cagagucucacuguugc

SEQ ID NO: 1170443 - RNA, 19 nt, Human
cagagucucacuguugccc

SEQ ID NO: 1170444 - RNA, 20 nt, Human
cagagucucacuguugccca

SEQ ID NO: 1170445 - RNA, 21 nt, Human
cagagucucacuguugcccag

SEQ ID NO: 1170446 - RNA, 22 nt, Human
cagagucucacuguugcccagg

SEQ ID NO: 1170447 - RNA, 23 nt, Human
cagagucucacuguugcccaggc

SEQ ID NO: 1170448 - RNA, 16 nt, Human
cagagugagacucugu

SEQ ID NO: 1170449 - RNA, 17 nt, Human
cagagugagacucuguc

SEQ ID NO: 1170450 - RNA, 18 nt, Human
cagagugagacucugucu

SEQ ID NO: 1170451 - RNA, 19 nt, Human
cagagugagacucugucuc

SEQ ID NO: 1170452 - RNA, 20 nt, Human
cagagugagacucugucuca

SEQ ID NO: 1170453 - RNA, 16 nt, Human
cagaggccaugggccu

SEQ ID NO: 1170454 - RNA, 18 nt, Human
cagaugggugcuuggagg

SEQ ID NO: 1170455 - RNA, 23 nt, Human
cagaugggugcuuggaggaagga

SEQ ID NO: 1170456 - RNA, 14 nt, Human
cagauuuuccugaa

SEQ ID NO: 1170457 - RNA, 15 nt, Human
cagauuuuccugaaa

SEQ ID NO: 1170458 - RNA, 14 nt, Human
cagauucuuuccug

SEQ ID NO: 1170459 - RNA, 15 nt, Human
cagauucuuuccuga

SEQ ID NO: 1170460 - RNA, 18 nt, Human
cagcaaaagaugcuucuc

SEQ ID NO: 1170461 - RNA, 19 nt, Human
cagcaagugagagcugggu

SEQ ID NO: 1170462 - RNA, 21 nt, Human
cagcaagugagagcugggugu

SEQ ID NO: 1170463 - RNA, 13 nt, Human
cagcaauaaagca

SEQ ID NO: 1170464 - RNA, 21 nt, Human
cagcaauaaagcagcguuucu

SEQ ID NO: 1170465 - RNA, 22 nt, Human
cagcaauaaagcagcguuucua

SEQ ID NO: 1170466 - RNA, 17 nt, Human
cagcaaggagauuuaca

SEQ ID NO: 1170467 - RNA, 18 nt, Human
cagcaaggagauuuacaa

SEQ ID NO: 1170468 - RNA, 12 nt, Human
cagcaagugaga

SEQ ID NO: 1170469 - RNA, 14 nt, Human
cagcaagugagagc

SEQ ID NO: 1170470 - RNA, 15 nt, Human
cagcaagugagagcu

SEQ ID NO: 1170471 - RNA, 16 nt, Human
cagcaagugagagcug

SEQ ID NO: 1170472 - RNA, 17 nt, Human
cagcaagugagagcugg

SEQ ID NO: 1170473 - RNA, 15 nt, Human
cagcagaaaugccuu

SEQ ID NO: 1170474 - RNA, 17 nt, Human
cagcagaaaugccuuac

SEQ ID NO: 1170475 - RNA, 19 nt, Human
cagcagaaaugccuuaccc

SEQ ID NO: 1170476 - RNA, 22 nt, Human
cagcagaaaugccuuacccuca

SEQ ID NO: 1170477 - RNA, 11 nt, Human
cagcagagcac

SEQ ID NO: 1170478 - RNA, 13 nt, Human
cagcagagcaccu

SEQ ID NO: 1170479 - RNA, 19 nt, Human
cagcauccuggcacccggc

SEQ ID NO: 1170480 - RNA, 20 nt, Human
cagcauccuggcacccggcc

SEQ ID NO: 1170481 - RNA, 21 nt, Human
cagcauccuggcacccggccc

SEQ ID NO: 1170482 - RNA, 15 nt, Human
cagccaaagccuccu

SEQ ID NO: 1170483 - RNA, 16 nt, Human
cagccaaagccuccuc

SEQ ID NO: 1170484 - RNA, 18 nt, Human
cagccaaagccuccucca

SEQ ID NO: 1170485 - RNA, 21 nt, Human
cagccaaagccuccuccagcc

SEQ ID NO: 1170486 - RNA, 12 nt, Human
cagcagccugga

SEQ ID NO: 1170487 - RNA, 14 nt, Human
cagcagccuggacc

SEQ ID NO: 1170488 - RNA, 15 nt, Human
cagcagccuggaccc

SEQ ID NO: 1170489 - RNA, 18 nt, Human
cagcagccuggacccugu

SEQ ID NO: 1170490 - RNA, 19 nt, Human
cagcagccuggacccugug

SEQ ID NO: 1170491 - RNA, 22 nt, Human
cagcagccuggacccuguggau

SEQ ID NO: 1170492 - RNA, 12 nt, Human
cagcaggcucuc

SEQ ID NO: 1170493 - RNA, 14 nt, Human
cagcaggcucucag

SEQ ID NO: 1170494 - RNA, 15 nt, Human
cagcaggcucucagg

SEQ ID NO: 1170495 - RNA, 16 nt, Human
cagcaggcucucaggc

SEQ ID NO: 1170496 - RNA, 17 nt, Human
cagcaggcucucaggcc

SEQ ID NO: 1170497 - RNA, 18 nt, Human
cagcaggcucucaggcca

SEQ ID NO: 1170498 - RNA, 19 nt, Human
cagcaggcucucaggccag

SEQ ID NO: 1170499 - RNA, 20 nt, Human
cagcaggcucucaggccagc

SEQ ID NO: 1170500 - RNA, 22 nt, Human
cagcaggcucucaggccagcug

SEQ ID NO: 1170501 - RNA, 18 nt, Human
cagcagggagggcuucug

SEQ ID NO: 1170502 - RNA, 20 nt, Human
cagcagggagggcuucugcc

SEQ ID NO: 1170503 - RNA, 14 nt, Human
cagcauccuggcac

SEQ ID NO: 1170504 - RNA, 15 nt, Human
cagcauccuggcacc

SEQ ID NO: 1170505 - RNA, 16 nt, Human
cagcauccuggcaccc

SEQ ID NO: 1170506 - RNA, 17 nt, Human
cagcauccuggcacccg

SEQ ID NO: 1170507 - RNA, 15 nt, Human
cagcccaccccucaa

SEQ ID NO: 1170508 - RNA, 15 nt, Human
cagcccacuucugcc

SEQ ID NO: 1170509 - RNA, 18 nt, Human
cagcccacuucugccaua

SEQ ID NO: 1170510 - RNA, 20 nt, Human
cagccccaaaacucuccucu

SEQ ID NO: 1170511 - RNA, 21 nt, Human
cagccccaaaacucuccucug

SEQ ID NO: 1170512 - RNA, 22 nt, Human
cagccccaaaacucuccucugc

SEQ ID NO: 1170513 - RNA, 9 nt, Human
cagccacac

SEQ ID NO: 1170514 - RNA, 11 nt, Human
cagccacacac

SEQ ID NO: 1170515 - RNA, 12 nt, Human
cagccacacaca

SEQ ID NO: 1170516 - RNA, 13 nt, Human
cagccacacacac

SEQ ID NO: 1170517 - RNA, 14 nt, Human
cagccacacacaca

SEQ ID NO: 1170518 - RNA, 15 nt, Human
cagccacacacacag

SEQ ID NO: 1170519 - RNA, 16 nt, Human
cagccacacacacaga

SEQ ID NO: 1170520 - RNA, 17 nt, Human
cagccacacacacagaa

SEQ ID NO: 1170521 - RNA, 18 nt, Human
cagccacacacacagaaa

SEQ ID NO: 1170522 - RNA, 19 nt, Human
cagccacacacacagaaaa

SEQ ID NO: 1170523 - RNA, 20 nt, Human
cagccacacacacagaaaau

SEQ ID NO: 1170524 - RNA, 21 nt, Human
cagccacacacacagaaaaua

SEQ ID NO: 1170525 - RNA, 22 nt, Human
cagccacacacacagaaaauau

SEQ ID NO: 1170526 - RNA, 23 nt, Human
cagccacacacacagaaaauaua

SEQ ID NO: 1170527 - RNA, 14 nt, Human
cagccacauuccug

SEQ ID NO: 1170528 - RNA, 15 nt, Human
cagccacauuccuga

SEQ ID NO: 1170529 - RNA, 17 nt, Human
cagccacauuccugaug

SEQ ID NO: 1170530 - RNA, 19 nt, Human
cagccacauuccugaugcu

SEQ ID NO: 1170531 - RNA, 14 nt, Human
cagccacggccagg

SEQ ID NO: 1170532 - RNA, 15 nt, Human
cagccacggccaggc

SEQ ID NO: 1170533 - RNA, 16 nt, Human
cagccacggccaggcc

SEQ ID NO: 1170534 - RNA, 17 nt, Human
cagccacggccaggcca

SEQ ID NO: 1170535 - RNA, 18 nt, Human
cagccacggccaggccag

SEQ ID NO: 1170536 - RNA, 19 nt, Human
cagccacggccaggccaga

SEQ ID NO: 1170537 - RNA, 21 nt, Human
cagccacggccaggccagagg

SEQ ID NO: 1170538 - RNA, 22 nt, Human
cagccacggccaggccagaggg

SEQ ID NO: 1170539 - RNA, 23 nt, Human
cagccacggccaggccagaggga

SEQ ID NO: 1170540 - RNA, 22 nt, Human
cagccaguaaaugggggugcau

SEQ ID NO: 1170541 - RNA, 14 nt, Human
cagcucaccagccc

SEQ ID NO: 1170542 - RNA, 17 nt, Human
cagcccgggcucugccu

SEQ ID NO: 1170543 - RNA, 18 nt, Human
cagcccgggcucugccuc

SEQ ID NO: 1170544 - RNA, 19 nt, Human
cagcccgggcucugccucc

SEQ ID NO: 1170545 - RNA, 20 nt, Human
cagcccgggcucugccuccc

SEQ ID NO: 1170546 - RNA, 21 nt, Human
cagcccgggcucugccuccca

SEQ ID NO: 1170547 - RNA, 22 nt, Human
cagcccgggcucugccucccau

SEQ ID NO: 1170548 - RNA, 16 nt, Human
cagccccuucugaccc

SEQ ID NO: 1170549 - RNA, 17 nt, Human
cagccccuucugaccca

SEQ ID NO: 1170550 - RNA, 19 nt, Human
cagccccuucugacccaug

SEQ ID NO: 1170551 - RNA, 21 nt, Human
cagccccuucugacccaugcu

SEQ ID NO: 1170552 - RNA, 22 nt, Human
cagccccuucugacccaugcug

SEQ ID NO: 1170553 - RNA, 23 nt, Human
cagccccuucugacccaugcugc

SEQ ID NO: 1170554 - RNA, 24 nt, Human
cagccccuucugacccaugcugcc

SEQ ID NO: 1170555 - RNA, 13 nt, Human
cagcccgggcucu

SEQ ID NO: 1170556 - RNA, 14 nt, Human
cagcccgggcucug

SEQ ID NO: 1170557 - RNA, 15 nt, Human
cagcccgggcucugc

SEQ ID NO: 1170558 - RNA, 16 nt, Human
cagcccgggcucugcc

SEQ ID NO: 1170559 - RNA, 13 nt, Human
cagccccagugcc

SEQ ID NO: 1170560 - RNA, 14 nt, Human
cagccccagugccc

SEQ ID NO: 1170561 - RNA, 15 nt, Human
cagccccagugccca

SEQ ID NO: 1170562 - RNA, 16 nt, Human
cagccccagugcccac

SEQ ID NO: 1170563 - RNA, 17 nt, Human
cagccccagugcccaca

SEQ ID NO: 1170564 - RNA, 18 nt, Human
cagccccagugcccacag

SEQ ID NO: 1170565 - RNA, 11 nt, Human
cagccccaucc

SEQ ID NO: 1170566 - RNA, 21 nt, Human
cagccccaucccaaacccuuc

SEQ ID NO: 1170567 - RNA, 22 nt, Human
cagccccaucccaaacccuuca

SEQ ID NO: 1170568 - RNA, 12 nt, Human
cagccccauccu

SEQ ID NO: 1170569 - RNA, 13 nt, Human
cagccccauccuc

SEQ ID NO: 1170570 - RNA, 14 nt, Human
cagccccauccucu

SEQ ID NO: 1170571 - RNA, 16 nt, Human
cagccccauccucugu

SEQ ID NO: 1170572 - RNA, 22 nt, Human
cagccccauccucuguacagag

SEQ ID NO: 1170573 - RNA, 13 nt, Human
cagccccauucug

SEQ ID NO: 1170574 - RNA, 14 nt, Human
cagccccauucugc

SEQ ID NO: 1170575 - RNA, 16 nt, Human
cagccccauucugccu

SEQ ID NO: 1170576 - RNA, 17 nt, Human
cagccccauucugccug

SEQ ID NO: 1170577 - RNA, 18 nt, Human
cagccccauucugccugc

SEQ ID NO: 1170578 - RNA, 23 nt, Human
cagccccuggaugcagccucaca

SEQ ID NO: 1170579 - RNA, 20 nt, Human
cagccccuguucuggcagag

SEQ ID NO: 1170580 - RNA, 21 nt, Human
cagccccuguucuggcagagu

SEQ ID NO: 1170581 - RNA, 13 nt, Human
cagcccugcagag

SEQ ID NO: 1170582 - RNA, 14 nt, Human
cagcccugcagagg

SEQ ID NO: 1170583 - RNA, 15 nt, Human
cagcccugcagaggg

SEQ ID NO: 1170584 - RNA, 16 nt, Human
cagcccugcagagggc

SEQ ID NO: 1170585 - RNA, 18 nt, Human
cagcccugcagagggcac

SEQ ID NO: 1170586 - RNA, 20 nt, Human
cagcccugcagagggcacag

SEQ ID NO: 1170587 - RNA, 21 nt, Human
cagccguguaaccauggaccc

SEQ ID NO: 1170588 - RNA, 14 nt, Human
cagccucacagucc

SEQ ID NO: 1170589 - RNA, 15 nt, Human
cagccucacaguccu

SEQ ID NO: 1170590 - RNA, 20 nt, Human
cagccucacaguccuuacca

SEQ ID NO: 1170591 - RNA, 16 nt, Human
cagccuaguugaucag

SEQ ID NO: 1170592 - RNA, 17 nt, Human
cagccucaaccuccugg

SEQ ID NO: 1170593 - RNA, 18 nt, Human
cagccucaaccuccuggg

SEQ ID NO: 1170594 - RNA, 19 nt, Human
cagccucaaccuccugggc

SEQ ID NO: 1170595 - RNA, 20 nt, Human
cagccucaaccuccugggcu

SEQ ID NO: 1170596 - RNA, 21 nt, Human
cagccucaaccuccugggcua

SEQ ID NO: 1170597 - RNA, 19 nt, Human
cagccucccaaagugcugg

SEQ ID NO: 1170598 - RNA, 20 nt, Human
cagccucccaaagugcuggg

SEQ ID NO: 1170599 - RNA, 21 nt, Human
cagccucccaaagugcuggga

SEQ ID NO: 1170600 - RNA, 23 nt, Human
cagccucccaaagugcugggauu

SEQ ID NO: 1170601 - RNA, 20 nt, Human
cagccucccgaauagcuggg

SEQ ID NO: 1170602 - RNA, 21 nt, Human
cagccucccgaauagcuggga

SEQ ID NO: 1170603 - RNA, 22 nt, Human
cagccucccgaauagcugggac

SEQ ID NO: 1170604 - RNA, 20 nt, Human
cagccugcuccagcuguuca

SEQ ID NO: 1170605 - RNA, 23 nt, Human
cagccucccgaauagcugggacu

SEQ ID NO: 1170606 - RNA, 19 nt, Human
cagccucccgaguagcugg

SEQ ID NO: 1170607 - RNA, 20 nt, Human
cagccucccgaguagcuggg

SEQ ID NO: 1170608 - RNA, 21 nt, Human
cagccucccgaguagcuggga

SEQ ID NO: 1170609 - RNA, 22 nt, Human
cagccucccgaguagcugggac

SEQ ID NO: 1170610 - RNA, 23 nt, Human
cagccucccgaguagcugggacu

SEQ ID NO: 1170611 - RNA, 15 nt, Human
cagccuggacccugu

SEQ ID NO: 1170612 - RNA, 19 nt, Human
cagccuggacccuguggau

SEQ ID NO: 1170613 - RNA, 16 nt, Human
cagccugggcaaugug

SEQ ID NO: 1170614 - RNA, 19 nt, Human
cagccugggcaaugugaua

SEQ ID NO: 1170615 - RNA, 23 nt, Human
cagccugugucuuuaaaugcugc

SEQ ID NO: 1170616 - RNA, 14 nt, Human
cagccugugucuuu

SEQ ID NO: 1170617 - RNA, 17 nt, Human
cagccuugaccauucuc

SEQ ID NO: 1170618 - RNA, 20 nt, Human
cagccuugaccauucuccac

SEQ ID NO: 1170619 - RNA, 21 nt, Human
cagccuugaccauucuccacc

SEQ ID NO: 1170620 - RNA, 22 nt, Human
cagccuugaccauucuccaccu

SEQ ID NO: 1170621 - RNA, 23 nt, Human
cagccuugaccauucuccaccug

SEQ ID NO: 1170622 - RNA, 24 nt, Human
cagccuugaccauucuccaccugc

SEQ ID NO: 1170623 - RNA, 15 nt, Human
cagcuaaugggacac

SEQ ID NO: 1170624 - RNA, 16 nt, Human
cagcuaaugggacacu

SEQ ID NO: 1170625 - RNA, 20 nt, Human
cagcuaacauggaaguacua

SEQ ID NO: 1170626 - RNA, 19 nt, Human
cagcuacuugggaggcuga

SEQ ID NO: 1170627 - RNA, 13 nt, Human
cagcgagcccugg

SEQ ID NO: 1170628 - RNA, 16 nt, Human
cagcgagcccuggugg

SEQ ID NO: 1170629 - RNA, 17 nt, Human
cagcgagcccugguggc

SEQ ID NO: 1170630 - RNA, 19 nt, Human
cagcgagcccugguggcag

SEQ ID NO: 1170631 - RNA, 20 nt, Human
cagcgagcccugguggcagu

SEQ ID NO: 1170632 - RNA, 21 nt, Human
cagcgagcccugguggcagug

SEQ ID NO: 1170633 - RNA, 19 nt, Human
cagcuaacauggaaguacu

SEQ ID NO: 1170634 - RNA, 19 nt, Human
cagcucaccucucccuugg

SEQ ID NO: 1170635 - RNA, 20 nt, Human
cagcucaccucucccuugga

SEQ ID NO: 1170636 - RNA, 12 nt, Human
cagcucagagag

SEQ ID NO: 1170637 - RNA, 20 nt, Human
cagcucaccagccccagugc

SEQ ID NO: 1170638 - RNA, 21 nt, Human
cagcucaccagccccagugcc

SEQ ID NO: 1170639 - RNA, 22 nt, Human
cagcucaccagccccagugccc

SEQ ID NO: 1170640 - RNA, 13 nt, Human
cagcucaccucuc

SEQ ID NO: 1170641 - RNA, 15 nt, Human
cagcucaccucuccc

SEQ ID NO: 1170642 - RNA, 16 nt, Human
cagcucaccucucccu

SEQ ID NO: 1170643 - RNA, 17 nt, Human
cagcucaccucucccuu

SEQ ID NO: 1170644 - RNA, 13 nt, Human
cagcucaccagcc

SEQ ID NO: 1170645 - RNA, 15 nt, Human
cagcucaccagcccc

SEQ ID NO: 1170646 - RNA, 16 nt, Human
cagcucaccagcccca

SEQ ID NO: 1170647 - RNA, 17 nt, Human
cagcucaccagccccag

SEQ ID NO: 1170648 - RNA, 19 nt, Human
cagcucaccagccccagug

SEQ ID NO: 1170649 - RNA, 23 nt, Human
cagcugcuuuugucuaugggacu

SEQ ID NO: 1170650 - RNA, 17 nt, Human
cagcugcuacuacuccu

SEQ ID NO: 1170651 - RNA, 13 nt, Human
cagcugcuugggc

SEQ ID NO: 1170652 - RNA, 14 nt, Human
cagcugcuugggcu

SEQ ID NO: 1170653 - RNA, 15 nt, Human
cagcugcuugggcuu

SEQ ID NO: 1170654 - RNA, 16 nt, Human
cagcugcuugggcuuc

SEQ ID NO: 1170655 - RNA, 18 nt, Human
cagcugcuugggcuucau

SEQ ID NO: 1170656 - RNA, 19 nt, Human
cagcugcuugggcuucauc

SEQ ID NO: 1170657 - RNA, 21 nt, Human
cagcugcuugggcuucauccu

SEQ ID NO: 1170658 - RNA, 22 nt, Human
cagcugcuugggcuucauccuc

SEQ ID NO: 1170659 - RNA, 18 nt, Human
cagcugccugggaucccu

SEQ ID NO: 1170660 - RNA, 23 nt, Human
cagcugccugggaucccucaucc

SEQ ID NO: 1170661 - RNA, 18 nt, Human
cagcugcgguccacccag

SEQ ID NO: 1170662 - RNA, 19 nt, Human
cagcugcgguccacccagg

SEQ ID NO: 1170663 - RNA, 20 nt, Human
cagcugcgguccacccagga

SEQ ID NO: 1170664 - RNA, 21 nt, Human
cagcugcgguccacccaggag

SEQ ID NO: 1170665 - RNA, 22 nt, Human
cagcugcgguccacccaggagc

SEQ ID NO: 1170666 - RNA, 23 nt, Human
cagcugcgguccacccaggagcc

SEQ ID NO: 1170667 - RNA, 24 nt, Human
cagcugcgguccacccaggagccc

SEQ ID NO: 1170668 - RNA, 22 nt, Human
cagcugcuuuugucuaugggac

SEQ ID NO: 1170669 - RNA, 18 nt, Human
cagcugguugagguuuca

SEQ ID NO: 1170670 - RNA, 18 nt, Human
cagcuguaugauucccag

SEQ ID NO: 1170671 - RNA, 21 nt, Human
cagcugggguggggaccucag

SEQ ID NO: 1170672 - RNA, 22 nt, Human
cagcugggguggggaccucagg

SEQ ID NO: 1170673 - RNA, 23 nt, Human
cagcugggguggggaccucaggc

SEQ ID NO: 1170674 - RNA, 13 nt, Human
cagcucagagagg

SEQ ID NO: 1170675 - RNA, 17 nt, Human
cagcucagagagggugg

SEQ ID NO: 1170676 - RNA, 19 nt, Human
cagcucagagaggguggga

SEQ ID NO: 1170677 - RNA, 20 nt, Human
cagcucagagagggugggag

SEQ ID NO: 1170678 - RNA, 16 nt, Human
cagcuccuucuguccu

SEQ ID NO: 1170679 - RNA, 17 nt, Human
cagcuccuucuguccua

SEQ ID NO: 1170680 - RNA, 21 nt, Human
cagcuccuucuguccuacucu

SEQ ID NO: 1170681 - RNA, 23 nt, Human
cagcuccuucuguccuacucugu

SEQ ID NO: 1170682 - RNA, 15 nt, Human
cagcucugcaagaau

SEQ ID NO: 1170683 - RNA, 16 nt, Human
cagcucugcaagaauu

SEQ ID NO: 1170684 - RNA, 21 nt, Human
cagcucugcaagaauugaagc

SEQ ID NO: 1170685 - RNA, 20 nt, Human
cagcucugcauacucauuag

SEQ ID NO: 1170686 - RNA, 10 nt, Human
cagcucuggu

SEQ ID NO: 1170687 - RNA, 13 nt, Human
cagcucuggucca

SEQ ID NO: 1170688 - RNA, 16 nt, Human
cagcucugguccauag

SEQ ID NO: 1170689 - RNA, 17 nt, Human
cagcucugguccauaga

SEQ ID NO: 1170690 - RNA, 18 nt, Human
cagcucugguccauagag

SEQ ID NO: 1170691 - RNA, 21 nt, Human
cagcucugguccauagagagc

SEQ ID NO: 1170692 - RNA, 22 nt, Human
cagcucugguccauagagagca

SEQ ID NO: 1170693 - RNA, 23 nt, Human
cagcucugguccauagagagcaa

SEQ ID NO: 1170694 - RNA, 12 nt, Human
cagcucuguccu

SEQ ID NO: 1170695 - RNA, 13 nt, Human
cagcucuguccug

SEQ ID NO: 1170696 - RNA, 14 nt, Human
cagcucuguccugg

SEQ ID NO: 1170697 - RNA, 16 nt, Human
cagcucuguccuggga

SEQ ID NO: 1170698 - RNA, 17 nt, Human
cagcucuguccugggag

SEQ ID NO: 1170699 - RNA, 18 nt, Human
cagcucuguccugggagu

SEQ ID NO: 1170700 - RNA, 23 nt, Human
cagcucuguccugggagugagcu

SEQ ID NO: 1170701 - RNA, 10 nt, Human
cagcucuuau

SEQ ID NO: 1170702 - RNA, 21 nt, Human
cagcucuuauauugccauuuc

SEQ ID NO: 1170703 - RNA, 13 nt, Human
cagcucuucucca

SEQ ID NO: 1170704 - RNA, 14 nt, Human
cagcucuucuccag

SEQ ID NO: 1170705 - RNA, 15 nt, Human
cagcucuucuccagg

SEQ ID NO: 1170706 - RNA, 16 nt, Human
cagcucuucuccaggc

SEQ ID NO: 1170707 - RNA, 17 nt, Human
cagcucuucuccaggcu

SEQ ID NO: 1170708 - RNA, 18 nt, Human
cagcucuucuccaggcug

SEQ ID NO: 1170709 - RNA, 19 nt, Human
cagcucuucuccaggcugu

SEQ ID NO: 1170710 - RNA, 23 nt, Human
cagcucuucuccaggcuguaucc

SEQ ID NO: 1170711 - RNA, 23 nt, Human
cagcuuuccucaaaacuucagac

SEQ ID NO: 1170712 - RNA, 18 nt, Human
cagcuuguaaauagcuca

SEQ ID NO: 1170713 - RNA, 19 nt, Human
cagcuuguaaauagcucag

SEQ ID NO: 1170714 - RNA, 20 nt, Human
cagcuuguaaauagcucagg

SEQ ID NO: 1170715 - RNA, 21 nt, Human
cagcuuguaaauagcucaggu

SEQ ID NO: 1170716 - RNA, 22 nt, Human
cagcuuguaaauagcucaggug

SEQ ID NO: 1170717 - RNA, 12 nt, Human
cagcuuuguuug

SEQ ID NO: 1170718 - RNA, 21 nt, Human
cagcuuuguuuguugucagcu

SEQ ID NO: 1170719 - RNA, 22 nt, Human
cagcuuuguuuguugucagcug

SEQ ID NO: 1170720 - RNA, 23 nt, Human
cagcuuuguuuguugucagcuga

SEQ ID NO: 1170721 - RNA, 18 nt, Human
caggaaccacaagacugc

SEQ ID NO: 1170722 - RNA, 19 nt, Human
cagcuguaugauucccagc

SEQ ID NO: 1170723 - RNA, 20 nt, Human
cagcuucauuuccugugucu

SEQ ID NO: 1170724 - RNA, 21 nt, Human
cagcuucauuuccugugucuu

SEQ ID NO: 1170725 - RNA, 18 nt, Human
cagcuugaccgugaggcc

SEQ ID NO: 1170726 - RNA, 19 nt, Human
cagcuugaccgugaggcca

SEQ ID NO: 1170727 - RNA, 20 nt, Human
cagcuugaccgugaggccag

SEQ ID NO: 1170728 - RNA, 21 nt, Human
cagcuugaccgugaggccaga

SEQ ID NO: 1170729 - RNA, 14 nt, Human
cagcuugaggguug

SEQ ID NO: 1170730 - RNA, 15 nt, Human
cagcuugaggguugg

SEQ ID NO: 1170731 - RNA, 18 nt, Human
cagcuugaggguugggcu

SEQ ID NO: 1170732 - RNA, 19 nt, Human
cagcuugaggguugggcug

SEQ ID NO: 1170733 - RNA, 20 nt, Human
cagcuugaggguugggcugg

SEQ ID NO: 1170734 - RNA, 21 nt, Human
cagcuugaggguugggcuggu

SEQ ID NO: 1170735 - RNA, 14 nt, Human
caggaagccagcag

SEQ ID NO: 1170736 - RNA, 16 nt, Human
caggaagccagcaggc

SEQ ID NO: 1170737 - RNA, 17 nt, Human
caggaagccagcaggcu

SEQ ID NO: 1170738 - RNA, 18 nt, Human
caggaagccagcaggcuc

SEQ ID NO: 1170739 - RNA, 19 nt, Human
caggaagccagcaggcucu

SEQ ID NO: 1170740 - RNA, 21 nt, Human
caggaagccagcaggcucuca

SEQ ID NO: 1170741 - RNA, 22 nt, Human
caggaagccagcaggcucucag

SEQ ID NO: 1170742 - RNA, 13 nt, Human
caggaagcucagg

SEQ ID NO: 1170743 - RNA, 14 nt, Human
caggaagcucaggg

SEQ ID NO: 1170744 - RNA, 15 nt, Human
caggaagcucagggc

SEQ ID NO: 1170745 - RNA, 16 nt, Human
caggaagcucagggcc

SEQ ID NO: 1170746 - RNA, 17 nt, Human
caggaagcucagggccu

SEQ ID NO: 1170747 - RNA, 18 nt, Human
caggaagcucagggccug

SEQ ID NO: 1170748 - RNA, 19 nt, Human
caggaagcucagggccugg

SEQ ID NO: 1170749 - RNA, 20 nt, Human
caggaagcucagggccuggc

SEQ ID NO: 1170750 - RNA, 21 nt, Human
caggaagcucagggccuggcu

SEQ ID NO: 1170751 - RNA, 23 nt, Human
caggaagcucagggccuggcuca

SEQ ID NO: 1170752 - RNA, 15 nt, Human
caggaaggcuaaagg

SEQ ID NO: 1170753 - RNA, 12 nt, Human
caggaaguacug

SEQ ID NO: 1170754 - RNA, 14 nt, Human
caggaaguacugga

SEQ ID NO: 1170755 - RNA, 16 nt, Human
caggaaguacuggaga

SEQ ID NO: 1170756 - RNA, 17 nt, Human
caggaaguacuggagaa

SEQ ID NO: 1170757 - RNA, 18 nt, Human
caggaaguacuggagaaa

SEQ ID NO: 1170758 - RNA, 20 nt, Human
caggaaguacuggagaaaau

SEQ ID NO: 1170759 - RNA, 15 nt, Human
caggaaguagaggag

SEQ ID NO: 1170760 - RNA, 16 nt, Human
caggaaguagaggagg

SEQ ID NO: 1170761 - RNA, 22 nt, Human
caggaagcucagggccuggcuc

SEQ ID NO: 1170762 - RNA, 12 nt, Human
caggagcagcca

SEQ ID NO: 1170763 - RNA, 13 nt, Human
caggagcagccac

SEQ ID NO: 1170764 - RNA, 14 nt, Human
caggagcagccaca

SEQ ID NO: 1170765 - RNA, 19 nt, Human
caggagcagccacauuccu

SEQ ID NO: 1170766 - RNA, 15 nt, Human
caggagccccgaggc

SEQ ID NO: 1170767 - RNA, 16 nt, Human
caggagccccgaggcc

SEQ ID NO: 1170768 - RNA, 18 nt, Human
caggagccccgaggccuu

SEQ ID NO: 1170769 - RNA, 20 nt, Human
caggagccccgaggccuucu

SEQ ID NO: 1170770 - RNA, 22 nt, Human
caggagccccgaggccuucucu

SEQ ID NO: 1170771 - RNA, 23 nt, Human
caggagccccgaggccuucucug

SEQ ID NO: 1170772 - RNA, 14 nt, Human
caggagccuccugc

SEQ ID NO: 1170773 - RNA, 17 nt, Human
caggagccuccugcccu

SEQ ID NO: 1170774 - RNA, 20 nt, Human
caggagccuccugcccuuac

SEQ ID NO: 1170775 - RNA, 12 nt, Human
caggagugagca

SEQ ID NO: 1170776 - RNA, 21 nt, Human
caggaguuugagaccaaccug

SEQ ID NO: 1170777 - RNA, 22 nt, Human
caggaguuugagaccaaccugg

SEQ ID NO: 1170778 - RNA, 23 nt, Human
caggaguuugagaccaaccuggg

SEQ ID NO: 1170779 - RNA, 17 nt, Human
caggauucuuccucccu

SEQ ID NO: 1170780 - RNA, 18 nt, Human
caggauucuuccucccuc

SEQ ID NO: 1170781 - RNA, 21 nt, Human
caggaugguucccuugaugaa

SEQ ID NO: 1170782 - RNA, 23 nt, Human
caggaugguucccuugaugaaga

SEQ ID NO: 1170783 - RNA, 23 nt, Human
caggauggccgggcgcgguggcu

SEQ ID NO: 1170784 - RNA, 13 nt, Human
caggaucagucug

SEQ ID NO: 1170785 - RNA, 14 nt, Human
caggaucagucuga

SEQ ID NO: 1170786 - RNA, 16 nt, Human
caggcagccaggccac

SEQ ID NO: 1170787 - RNA, 17 nt, Human
caggcagccaggccaca

SEQ ID NO: 1170788 - RNA, 13 nt, Human
caggcagguccag

SEQ ID NO: 1170789 - RNA, 20 nt, Human
caggauucuuccucccuccc

SEQ ID NO: 1170790 - RNA, 14 nt, Human
caggcaagcaccuc

SEQ ID NO: 1170791 - RNA, 15 nt, Human
caggcaagcaccucc

SEQ ID NO: 1170792 - RNA, 16 nt, Human
caggcaagcaccuccu

SEQ ID NO: 1170793 - RNA, 21 nt, Human
caggcaagcaccuccugccuc

SEQ ID NO: 1170794 - RNA, 14 nt, Human
caggcaaugcuggc

SEQ ID NO: 1170795 - RNA, 14 nt, Human
caggcagccaggcc

SEQ ID NO: 1170796 - RNA, 15 nt, Human
caggcagccaggcca

SEQ ID NO: 1170797 - RNA, 14 nt, Human
caggcagguccagg

SEQ ID NO: 1170798 - RNA, 15 nt, Human
caggcagguccaggg

SEQ ID NO: 1170799 - RNA, 19 nt, Human
caggcagguccaggguuug

SEQ ID NO: 1170800 - RNA, 12 nt, Human
caggcaggucuu

SEQ ID NO: 1170801 - RNA, 13 nt, Human
caggcaggucuug

SEQ ID NO: 1170802 - RNA, 22 nt, Human
caggcaggucuugaacuccugg

SEQ ID NO: 1170803 - RNA, 23 nt, Human
caggcaggucuugaacuccuggc

SEQ ID NO: 1170804 - RNA, 15 nt, Human
caggcaggugggaug

SEQ ID NO: 1170805 - RNA, 17 nt, Human
caggcaugguggcccac

SEQ ID NO: 1170806 - RNA, 15 nt, Human
caggcauguucucug

SEQ ID NO: 1170807 - RNA, 18 nt, Human
caggcauguucucugagg

SEQ ID NO: 1170808 - RNA, 19 nt, Human
caggcauguucucugagga

SEQ ID NO: 1170809 - RNA, 20 nt, Human
caggcauguucucugaggac

SEQ ID NO: 1170810 - RNA, 13 nt, Human
caggcauucccca

SEQ ID NO: 1170811 - RNA, 15 nt, Human
caggcauuccccagg

SEQ ID NO: 1170812 - RNA, 16 nt, Human
caggcauuccccagga

SEQ ID NO: 1170813 - RNA, 17 nt, Human
caggcauuccccaggag

SEQ ID NO: 1170814 - RNA, 18 nt, Human
caggcauuccccaggagg

SEQ ID NO: 1170815 - RNA, 19 nt, Human
caggcauuccccaggaggc

SEQ ID NO: 1170816 - RNA, 20 nt, Human
caggcauuccccaggaggcc

SEQ ID NO: 1170817 - RNA, 21 nt, Human
caggcauuccccaggaggcca

SEQ ID NO: 1170818 - RNA, 22 nt, Human
caggcauuccccaggaggccag

SEQ ID NO: 1170819 - RNA, 23 nt, Human
caggcauuccccaggaggccagc

SEQ ID NO: 1170820 - RNA, 24 nt, Human
caggcauuccccaggaggccagcc

SEQ ID NO: 1170821 - RNA, 20 nt, Human
caggccacaagacccuugug

SEQ ID NO: 1170822 - RNA, 21 nt, Human
caggccaggcccucugcccac

SEQ ID NO: 1170823 - RNA, 22 nt, Human
caggccaggcccucugcccacu

SEQ ID NO: 1170824 - RNA, 18 nt, Human
caggccaaacucaccugc

SEQ ID NO: 1170825 - RNA, 23 nt, Human
caggccaaacucaccugccccuc

SEQ ID NO: 1170826 - RNA, 13 nt, Human
caggccacaagac

SEQ ID NO: 1170827 - RNA, 17 nt, Human
caggccacaagacccuu

SEQ ID NO: 1170828 - RNA, 18 nt, Human
caggccacaagacccuug

SEQ ID NO: 1170829 - RNA, 13 nt, Human
caggccccugcca

SEQ ID NO: 1170830 - RNA, 15 nt, Human
caggccccugccacc

SEQ ID NO: 1170831 - RNA, 17 nt, Human
caggccccugccacccu

SEQ ID NO: 1170832 - RNA, 19 nt, Human
caggccccugccacccugg

SEQ ID NO: 1170833 - RNA, 20 nt, Human
caggccccugccacccuggg

SEQ ID NO: 1170834 - RNA, 13 nt, Human
caggcccggcucc

SEQ ID NO: 1170835 - RNA, 14 nt, Human
caggcccggcucca

SEQ ID NO: 1170836 - RNA, 15 nt, Human
caggcccggcuccag

SEQ ID NO: 1170837 - RNA, 16 nt, Human
caggcccggcuccagg

SEQ ID NO: 1170838 - RNA, 16 nt, Human
caggcccucugcccac

SEQ ID NO: 1170839 - RNA, 17 nt, Human
caggcccucugcccacu

SEQ ID NO: 1170840 - RNA, 19 nt, Human
caggcccucugcccacucc

SEQ ID NO: 1170841 - RNA, 20 nt, Human
caggcccucugcccacuccc

SEQ ID NO: 1170842 - RNA, 21 nt, Human
caggcccucugcccacucccu

SEQ ID NO: 1170843 - RNA, 22 nt, Human
caggcccucugcccacucccug

SEQ ID NO: 1170844 - RNA, 17 nt, Human
caggcccggcuccaggc

SEQ ID NO: 1170845 - RNA, 18 nt, Human
caggcccggcuccaggcu

SEQ ID NO: 1170846 - RNA, 19 nt, Human
caggcccggcuccaggcuc

SEQ ID NO: 1170847 - RNA, 20 nt, Human
caggcccggcuccaggcucc

SEQ ID NO: 1170848 - RNA, 21 nt, Human
caggcccggcuccaggcuccu

SEQ ID NO: 1170849 - RNA, 22 nt, Human
caggcccggcuccaggcuccuu

SEQ ID NO: 1170850 - RNA, 13 nt, Human
caggcccucugcc

SEQ ID NO: 1170851 - RNA, 14 nt, Human
caggcccucugccc

SEQ ID NO: 1170852 - RNA, 15 nt, Human
caggcccucugccca

SEQ ID NO: 1170853 - RNA, 14 nt, Human
caggcuccuuuagc

SEQ ID NO: 1170854 - RNA, 19 nt, Human
caggcuccuuuagcgccca

SEQ ID NO: 1170855 - RNA, 20 nt, Human
caggcuccuuuagcgcccag

SEQ ID NO: 1170856 - RNA, 13 nt, Human
caggcuagaugua

SEQ ID NO: 1170857 - RNA, 19 nt, Human
caggcuagauguauguacu

SEQ ID NO: 1170858 - RNA, 21 nt, Human
caggcuccuuuagcgcccagu

SEQ ID NO: 1170859 - RNA, 20 nt, Human
caggcucgggcuccccagcc

SEQ ID NO: 1170860 - RNA, 12 nt, Human
caggcucucagg

SEQ ID NO: 1170861 - RNA, 13 nt, Human
caggcucucaggc

SEQ ID NO: 1170862 - RNA, 14 nt, Human
caggcucucaggcc

SEQ ID NO: 1170863 - RNA, 15 nt, Human
caggcucucaggcca

SEQ ID NO: 1170864 - RNA, 16 nt, Human
caggcucucaggccag

SEQ ID NO: 1170865 - RNA, 17 nt, Human
caggcucucaggccagc

SEQ ID NO: 1170866 - RNA, 18 nt, Human
caggcucucaggccagcu

SEQ ID NO: 1170867 - RNA, 19 nt, Human
caggcucucaggccagcug

SEQ ID NO: 1170868 - RNA, 20 nt, Human
caggcucucaggccagcugc

SEQ ID NO: 1170869 - RNA, 21 nt, Human
caggcucucaggccagcugcu

SEQ ID NO: 1170870 - RNA, 23 nt, Human
caggcucucaggccagcugcuug

SEQ ID NO: 1170871 - RNA, 19 nt, Human
caggcuggucucaaacucu

SEQ ID NO: 1170872 - RNA, 12 nt, Human
caggcuggucuc

SEQ ID NO: 1170873 - RNA, 14 nt, Human
caggcuguauccca

SEQ ID NO: 1170874 - RNA, 20 nt, Human
caggcuguaucccaugagcc

SEQ ID NO: 1170875 - RNA, 21 nt, Human
caggcuguaucccaugagccu

SEQ ID NO: 1170876 - RNA, 22 nt, Human
caggcuguaucccaugagccuc

SEQ ID NO: 1170877 - RNA, 23 nt, Human
caggcuguaucccaugagccuca

SEQ ID NO: 1170878 - RNA, 16 nt, Human
caggcuuagucacuga

SEQ ID NO: 1170879 - RNA, 17 nt, Human
caggcuuagucacugag

SEQ ID NO: 1170880 - RNA, 20 nt, Human
caggcuuagucacugagaca

SEQ ID NO: 1170881 - RNA, 21 nt, Human
caggcuuagucacugagacag

SEQ ID NO: 1170882 - RNA, 22 nt, Human
caggcuuagucacugagacagc

SEQ ID NO: 1170883 - RNA, 23 nt, Human
caggcuuagucacugagacagcc

SEQ ID NO: 1170884 - RNA, 16 nt, Human
cagggaaacagcuaau

SEQ ID NO: 1170885 - RNA, 13 nt, Human
cagggacagaggg

SEQ ID NO: 1170886 - RNA, 14 nt, Human
cagggacagagggg

SEQ ID NO: 1170887 - RNA, 20 nt, Human
cagggacagaggggguggcc

SEQ ID NO: 1170888 - RNA, 22 nt, Human
cagggaaacagcuaaugggaca

SEQ ID NO: 1170889 - RNA, 23 nt, Human
cagggacagaggggguggccucc

SEQ ID NO: 1170890 - RNA, 14 nt, Human
cagggcacaccggg

SEQ ID NO: 1170891 - RNA, 15 nt, Human
cagggcacaccgggc

SEQ ID NO: 1170892 - RNA, 17 nt, Human
cagggcacaccgggcac

SEQ ID NO: 1170893 - RNA, 19 nt, Human
cagggcacaccgggcacuc

SEQ ID NO: 1170894 - RNA, 21 nt, Human
cagggcacaccgggcacucag

SEQ ID NO: 1170895 - RNA, 22 nt, Human
cagggcacaccgggcacucaga

SEQ ID NO: 1170896 - RNA, 23 nt, Human
cagggcacaccgggcacucagaa

SEQ ID NO: 1170897 - RNA, 13 nt, Human
cagggccuggcuc

SEQ ID NO: 1170898 - RNA, 14 nt, Human
cagggccuggcuca

SEQ ID NO: 1170899 - RNA, 15 nt, Human
cagggccuggcucag

SEQ ID NO: 1170900 - RNA, 16 nt, Human
cagggccuggcucagg

SEQ ID NO: 1170901 - RNA, 19 nt, Human
cagggccuggcucaggugg

SEQ ID NO: 1170902 - RNA, 11 nt, Human
caggggacagg

SEQ ID NO: 1170903 - RNA, 16 nt, Human
caggggacaggauggu

SEQ ID NO: 1170904 - RNA, 19 nt, Human
caggggaggguagagcgga

SEQ ID NO: 1170905 - RNA, 20 nt, Human
cagguaacaggcagauacag

SEQ ID NO: 1170906 - RNA, 21 nt, Human
cagguaacaggcagauacagg

SEQ ID NO: 1170907 - RNA, 13 nt, Human
caggugagaagca

SEQ ID NO: 1170908 - RNA, 20 nt, Human
caggugagaagcagaggaag

SEQ ID NO: 1170909 - RNA, 21 nt, Human
caggugagaagcagaggaagg

SEQ ID NO: 1170910 - RNA, 18 nt, Human
caggucuugaacuccugg

SEQ ID NO: 1170911 - RNA, 19 nt, Human
caggucuugaacuccuggc

SEQ ID NO: 1170912 - RNA, 20 nt, Human
caggucuugaacuccuggcc

SEQ ID NO: 1170913 - RNA, 21 nt, Human
caggucuugaacuccuggccu

SEQ ID NO: 1170914 - RNA, 22 nt, Human
caggucuugaacuccuggccuc

SEQ ID NO: 1170915 - RNA, 23 nt, Human
caggucuugaacuccuggccuca

SEQ ID NO: 1170916 - RNA, 20 nt, Human
caggguauuccagagugggg

SEQ ID NO: 1170917 - RNA, 21 nt, Human
caggguauuccagagugggga

SEQ ID NO: 1170918 - RNA, 12 nt, Human
cagggucccugg

SEQ ID NO: 1170919 - RNA, 14 nt, Human
cagggucccuggug

SEQ ID NO: 1170920 - RNA, 15 nt, Human
cagggucccuggugg

SEQ ID NO: 1170921 - RNA, 18 nt, Human
cagggucccugguggcag

SEQ ID NO: 1170922 - RNA, 19 nt, Human
cagggucccugguggcagc

SEQ ID NO: 1170923 - RNA, 22 nt, Human
cagggucccugguggcagcuca

SEQ ID NO: 1170924 - RNA, 23 nt, Human
cagggucccugguggcagcucac

SEQ ID NO: 1170925 - RNA, 18 nt, Human
caggguccuguagcccua

SEQ ID NO: 1170926 - RNA, 21 nt, Human
cagggucucacuauguugccc

SEQ ID NO: 1170927 - RNA, 22 nt, Human
cagggucucacuauguugccca

SEQ ID NO: 1170928 - RNA, 23 nt, Human
cagggucucacuauguugcccag

SEQ ID NO: 1170929 - RNA, 15 nt, Human
cagggucucacucug

SEQ ID NO: 1170930 - RNA, 16 nt, Human
cagggucucacucugu

SEQ ID NO: 1170931 - RNA, 17 nt, Human
cagggucucacucuguc

SEQ ID NO: 1170932 - RNA, 16 nt, Human
caggguuuugccaugu

SEQ ID NO: 1170933 - RNA, 14 nt, Human
cagguaacaggcag

SEQ ID NO: 1170934 - RNA, 15 nt, Human
cagguaacaggcaga

SEQ ID NO: 1170935 - RNA, 16 nt, Human
cagguaacaggcagau

SEQ ID NO: 1170936 - RNA, 17 nt, Human
cagguaacaggcagaua

SEQ ID NO: 1170937 - RNA, 14 nt, Human
caggggugggacac

SEQ ID NO: 1170938 - RNA, 15 nt, Human
caggggugggacacc

SEQ ID NO: 1170939 - RNA, 20 nt, Human
caggggugggacacccugug

SEQ ID NO: 1170940 - RNA, 21 nt, Human
caggggugggacacccuguga

SEQ ID NO: 1170941 - RNA, 16 nt, Human
caggugugagucacca

SEQ ID NO: 1170942 - RNA, 20 nt, Human
caggugugagucaccaagcc

SEQ ID NO: 1170943 - RNA, 21 nt, Human
caggugugagucaccaagccc

SEQ ID NO: 1170944 - RNA, 16 nt, Human
caggugugaaccacca

SEQ ID NO: 1170945 - RNA, 19 nt, Human
caggugugaaccaccacac

SEQ ID NO: 1170946 - RNA, 22 nt, Human
caggugugaaccaccacaccca

SEQ ID NO: 1170947 - RNA, 23 nt, Human
caggugugaaccaccacacccag

SEQ ID NO: 1170948 - RNA, 22 nt, Human
caggugugagucaccaagccca

SEQ ID NO: 1170949 - RNA, 23 nt, Human
caggugugagucaccaagcccag

SEQ ID NO: 1170950 - RNA, 16 nt, Human
caggugucccugcacu

SEQ ID NO: 1170951 - RNA, 15 nt, Human
caggugucccugcac

SEQ ID NO: 1170952 - RNA, 18 nt, Human
caggugucccugcacuug

SEQ ID NO: 1170953 - RNA, 19 nt, Human
caggugucccugcacuugc

SEQ ID NO: 1170954 - RNA, 12 nt, Human
caggugugaacc

SEQ ID NO: 1170955 - RNA, 12 nt, Human
caguaauaacuc

SEQ ID NO: 1170956 - RNA, 13 nt, Human
caguaauaacucu

SEQ ID NO: 1170957 - RNA, 12 nt, Human
cagguucagcuu

SEQ ID NO: 1170958 - RNA, 13 nt, Human
cagguucagcuug

SEQ ID NO: 1170959 - RNA, 21 nt, Human
caguaaaugggggugcauuug

SEQ ID NO: 1170960 - RNA, 22 nt, Human
caguaaaugggggugcauuuga

SEQ ID NO: 1170961 - RNA, 13 nt, Human
cagguggggcagc

SEQ ID NO: 1170962 - RNA, 14 nt, Human
cagguggggcagcu

SEQ ID NO: 1170963 - RNA, 15 nt, Human
cagguggggcagcuu

SEQ ID NO: 1170964 - RNA, 16 nt, Human
cagguggggcagcuug

SEQ ID NO: 1170965 - RNA, 17 nt, Human
cagguggggcagcuuga

SEQ ID NO: 1170966 - RNA, 18 nt, Human
cagguggggucacucugg

SEQ ID NO: 1170967 - RNA, 19 nt, Human
cagguggggucacucuggc

SEQ ID NO: 1170968 - RNA, 20 nt, Human
cagguggggucacucuggca

SEQ ID NO: 1170969 - RNA, 21 nt, Human
cagguggggucacucuggcag

SEQ ID NO: 1170970 - RNA, 22 nt, Human
cagguggggucacucuggcagc

SEQ ID NO: 1170971 - RNA, 23 nt, Human
cagguggggucacucuggcagcu

SEQ ID NO: 1170972 - RNA, 18 nt, Human
caggugguuauggagagg

SEQ ID NO: 1170973 - RNA, 20 nt, Human
caggugguuauggagagggu

SEQ ID NO: 1170974 - RNA, 11 nt, Human
caggugucccu

SEQ ID NO: 1170975 - RNA, 14 nt, Human
caggugucccugca

SEQ ID NO: 1170976 - RNA, 13 nt, Human
caguaucucaggg

SEQ ID NO: 1170977 - RNA, 15 nt, Human
caguaucucagggcc

SEQ ID NO: 1170978 - RNA, 12 nt, Human
caguaucuugaa

SEQ ID NO: 1170979 - RNA, 18 nt, Human
caguaucuugaagacuuu

SEQ ID NO: 1170980 - RNA, 21 nt, Human
caguaucuugaagacuuuucu

SEQ ID NO: 1170981 - RNA, 12 nt, Human
caguauggcagc

SEQ ID NO: 1170982 - RNA, 12 nt, Human
caguagugauag

SEQ ID NO: 1170983 - RNA, 16 nt, Human
caguauuacuucugcu

SEQ ID NO: 1170984 - RNA, 18 nt, Human
caguauuacuucugcuac

SEQ ID NO: 1170985 - RNA, 19 nt, Human
caguauuacuucugcuaca

SEQ ID NO: 1170986 - RNA, 15 nt, Human
cagucaggaaagaga

SEQ ID NO: 1170987 - RNA, 18 nt, Human
cagucaggaaagagaacu

SEQ ID NO: 1170988 - RNA, 22 nt, Human
cagucaggaaagagaacuucca

SEQ ID NO: 1170989 - RNA, 16 nt, Human
caguccauagcagaga

SEQ ID NO: 1170990 - RNA, 13 nt, Human
caguccaugaaga

SEQ ID NO: 1170991 - RNA, 12 nt, Human
cagucccugcca

SEQ ID NO: 1170992 - RNA, 13 nt, Human
cagucccugccaa

SEQ ID NO: 1170993 - RNA, 14 nt, Human
cagucccugccaau

SEQ ID NO: 1170994 - RNA, 15 nt, Human
cagucccugccaaug

SEQ ID NO: 1170995 - RNA, 16 nt, Human
cagucccugccaaugg

SEQ ID NO: 1170996 - RNA, 17 nt, Human
cagucccugccaaugga

SEQ ID NO: 1170997 - RNA, 12 nt, Human
caguccucccau

SEQ ID NO: 1170998 - RNA, 13 nt, Human
caguccucccauc

SEQ ID NO: 1170999 - RNA, 14 nt, Human
caguccucccaucu

SEQ ID NO: 1171000 - RNA, 15 nt, Human
caguccucccaucuc

SEQ ID NO: 1171001 - RNA, 17 nt, Human
cagugauuaccagggac

SEQ ID NO: 1171002 - RNA, 18 nt, Human
cagugauuaccagggacu

SEQ ID NO: 1171003 - RNA, 22 nt, Human
cagugauuaccagggacugagg

SEQ ID NO: 1171004 - RNA, 19 nt, Human
cagugagucgaggacaggg

SEQ ID NO: 1171005 - RNA, 20 nt, Human
cagugagucgaggacaggga

SEQ ID NO: 1171006 - RNA, 22 nt, Human
cagugagucgaggacagggagg

SEQ ID NO: 1171007 - RNA, 23 nt, Human
cagugagucgaggacagggaggu

SEQ ID NO: 1171008 - RNA, 15 nt, Human
cagugccgagaagga

SEQ ID NO: 1171009 - RNA, 18 nt, Human
cagugccgagaaggaagc

SEQ ID NO: 1171010 - RNA, 11 nt, Human
cagugccuuau

SEQ ID NO: 1171011 - RNA, 13 nt, Human
cagugccuuaugg

SEQ ID NO: 1171012 - RNA, 15 nt, Human
cagugccuuauggaa

SEQ ID NO: 1171013 - RNA, 16 nt, Human
cagugccuuauggaac

SEQ ID NO: 1171014 - RNA, 17 nt, Human
cagugccuuauggaaca

SEQ ID NO: 1171015 - RNA, 18 nt, Human
cagugccuuauggaacac

SEQ ID NO: 1171016 - RNA, 19 nt, Human
cagugccuuauggaacacu

SEQ ID NO: 1171017 - RNA, 20 nt, Human
cagugccuuauggaacacuc

SEQ ID NO: 1171018 - RNA, 21 nt, Human
cagugccuuauggaacacucu

SEQ ID NO: 1171019 - RNA, 22 nt, Human
cagugccuuauggaacacucug

SEQ ID NO: 1171020 - RNA, 20 nt, Human
cagugaaagaaaauaacaau

SEQ ID NO: 1171021 - RNA, 16 nt, Human
cagugaaagaaaauaa

SEQ ID NO: 1171022 - RNA, 19 nt, Human
cagucuggaaugcaguggu

SEQ ID NO: 1171023 - RNA, 16 nt, Human
caguccucccaucuca

SEQ ID NO: 1171024 - RNA, 17 nt, Human
caguccucccaucucac

SEQ ID NO: 1171025 - RNA, 15 nt, Human
caguccuuaccagca

SEQ ID NO: 1171026 - RNA, 18 nt, Human
caguccuuaccagcagag

SEQ ID NO: 1171027 - RNA, 19 nt, Human
caguccuuaccagcagagc

SEQ ID NO: 1171028 - RNA, 20 nt, Human
caguccuuaccagcagagca

SEQ ID NO: 1171029 - RNA, 21 nt, Human
caguccuuaccagcagagcac

SEQ ID NO: 1171030 - RNA, 15 nt, Human
cagugagacagcucu

SEQ ID NO: 1171031 - RNA, 24 nt, Human
cagugagccgagauugcaccacug

SEQ ID NO: 1171032 - RNA, 12 nt, Human
cagugaggcucu

SEQ ID NO: 1171033 - RNA, 13 nt, Human
cagugaggcucug

SEQ ID NO: 1171034 - RNA, 14 nt, Human
cagugaggcucugc

SEQ ID NO: 1171035 - RNA, 15 nt, Human
cagugaggcucugcc

SEQ ID NO: 1171036 - RNA, 16 nt, Human
cagugaggcucugccc

SEQ ID NO: 1171037 - RNA, 17 nt, Human
cagugaggcucugcccu

SEQ ID NO: 1171038 - RNA, 18 nt, Human
cagugaggcucugcccuu

SEQ ID NO: 1171039 - RNA, 19 nt, Human
cagugaggcucugcccuug

SEQ ID NO: 1171040 - RNA, 20 nt, Human
cagugaggcucugcccuugg

SEQ ID NO: 1171041 - RNA, 21 nt, Human
cagugaggcucugcccuuggu

SEQ ID NO: 1171042 - RNA, 17 nt, Human
cagugagucgaggacag

SEQ ID NO: 1171043 - RNA, 18 nt, Human
cagugagucgaggacagg

SEQ ID NO: 1171044 - RNA, 23 nt, Human
cagugccuuauggaacacucuga

SEQ ID NO: 1171045 - RNA, 13 nt, Human
cagugcuccagcc

SEQ ID NO: 1171046 - RNA, 13 nt, Human
cauauauaacaau

SEQ ID NO: 1171047 - RNA, 23 nt, Human
cauauaagauucauauuuacuuc

SEQ ID NO: 1171048 - RNA, 15 nt, Human
cauauauaacaaugc

SEQ ID NO: 1171049 - RNA, 20 nt, Human
cauauauaacaaugcuguau

SEQ ID NO: 1171050 - RNA, 15 nt, Human
cauaguaugguggcu

SEQ ID NO: 1171051 - RNA, 16 nt, Human
cauaguaugguggcug

SEQ ID NO: 1171052 - RNA, 17 nt, Human
cauaguaugguggcugg

SEQ ID NO: 1171053 - RNA, 22 nt, Human
cauauucuguuggccaguguga

SEQ ID NO: 1171054 - RNA, 17 nt, Human
cauauugauuuccguua

SEQ ID NO: 1171055 - RNA, 21 nt, Human
cauauugauuuccguuaaaau

SEQ ID NO: 1171056 - RNA, 14 nt, Human
caucaacaucuugg

SEQ ID NO: 1171057 - RNA, 14 nt, Human
cauccacugugcca

SEQ ID NO: 1171058 - RNA, 17 nt, Human
cauccacugugccaugu

SEQ ID NO: 1171059 - RNA, 23 nt, Human
cauccacugugccaugugccagg

SEQ ID NO: 1171060 - RNA, 15 nt, Human
caucccucuggggcu

SEQ ID NO: 1171061 - RNA, 18 nt, Human
caucccuuaccugggaaa

SEQ ID NO: 1171062 - RNA, 12 nt, Human
caucacccgcua

SEQ ID NO: 1171063 - RNA, 16 nt, Human
caucauccuaagcuau

SEQ ID NO: 1171064 - RNA, 13 nt, Human
caucaugucuggc

SEQ ID NO: 1171065 - RNA, 14 nt, Human
caucaugucuggcu

SEQ ID NO: 1171066 - RNA, 15 nt, Human
caucaugucuggcua

SEQ ID NO: 1171067 - RNA, 16 nt, Human
caucucuacaaaaagc

SEQ ID NO: 1171068 - RNA, 15 nt, Human
caucucuccuccuuu

SEQ ID NO: 1171069 - RNA, 16 nt, Human
caucuugaauuguaag

SEQ ID NO: 1171070 - RNA, 21 nt, Human
caucuugaauuguaaggaaug

SEQ ID NO: 1171071 - RNA, 16 nt, Human
caucuugcucugcuga

SEQ ID NO: 1171072 - RNA, 17 nt, Human
caucuugcucugcugac

SEQ ID NO: 1171073 - RNA, 19 nt, Human
caucuugcucugcugacag

SEQ ID NO: 1171074 - RNA, 18 nt, Human
caugaagauguagaggag

SEQ ID NO: 1171075 - RNA, 19 nt, Human
caugaagauguagaggaga

SEQ ID NO: 1171076 - RNA, 13 nt, Human
caugagcaucagg

SEQ ID NO: 1171077 - RNA, 15 nt, Human
caugagcaucaggcc

SEQ ID NO: 1171078 - RNA, 16 nt, Human
caugagcaucaggcca

SEQ ID NO: 1171079 - RNA, 17 nt, Human
caugagcaucaggccag

SEQ ID NO: 1171080 - RNA, 18 nt, Human
caugagcaucaggccagg

SEQ ID NO: 1171081 - RNA, 20 nt, Human
caugagcaucaggccaggcc

SEQ ID NO: 1171082 - RNA, 21 nt, Human
caugagcaucaggccaggccc

SEQ ID NO: 1171083 - RNA, 22 nt, Human
caugagcaucaggccaggcccu

SEQ ID NO: 1171084 - RNA, 23 nt, Human
caugagcaucaggccaggcccuc

SEQ ID NO: 1171085 - RNA, 12 nt, Human
caugagccucag

SEQ ID NO: 1171086 - RNA, 15 nt, Human
caugagccucagcau

SEQ ID NO: 1171087 - RNA, 17 nt, Human
caugagccucagcaucc

SEQ ID NO: 1171088 - RNA, 18 nt, Human
caugagccucagcauccu

SEQ ID NO: 1171089 - RNA, 19 nt, Human
caugagccucagcauccug

SEQ ID NO: 1171090 - RNA, 20 nt, Human
caugagccucagcauccugg

SEQ ID NO: 1171091 - RNA, 21 nt, Human
caugagccucagcauccuggc

SEQ ID NO: 1171092 - RNA, 22 nt, Human
caugagccucagcauccuggca

SEQ ID NO: 1171093 - RNA, 23 nt, Human
caugagccucagcauccuggcac

SEQ ID NO: 1171094 - RNA, 16 nt, Human
caugaggaacaaggca

SEQ ID NO: 1171095 - RNA, 17 nt, Human
caugaggaacaaggcaa

SEQ ID NO: 1171096 - RNA, 20 nt, Human
caugaggaacaaggcaaggc

SEQ ID NO: 1171097 - RNA, 21 nt, Human
caugaggaacaaggcaaggcu

SEQ ID NO: 1171098 - RNA, 23 nt, Human
caugaggaacaaggcaaggcugu

SEQ ID NO: 1171099 - RNA, 16 nt, Human
caugagguacugagag

SEQ ID NO: 1171100 - RNA, 19 nt, Human
caugagguacugagaguga

SEQ ID NO: 1171101 - RNA, 13 nt, Human
caugaguccccug

SEQ ID NO: 1171102 - RNA, 14 nt, Human
caugaguccccugu

SEQ ID NO: 1171103 - RNA, 15 nt, Human
caugaguccccuguu

SEQ ID NO: 1171104 - RNA, 23 nt, Human
caugaguccccuguuuguuucug

SEQ ID NO: 1171105 - RNA, 19 nt, Human
caugaaaacacauuuuucu

SEQ ID NO: 1171106 - RNA, 21 nt, Human
caugaaaacacauuuuucuua

SEQ ID NO: 1171107 - RNA, 13 nt, Human
caugaaaacacau

SEQ ID NO: 1171108 - RNA, 14 nt, Human
caugaaaacacauu

SEQ ID NO: 1171109 - RNA, 15 nt, Human
caugaaaacacauuu

SEQ ID NO: 1171110 - RNA, 16 nt, Human
caugaaaacacauuuu

SEQ ID NO: 1171111 - RNA, 17 nt, Human
caugaaaacacauuuuu

SEQ ID NO: 1171112 - RNA, 17 nt, Human
caugcgggcuuccuccu

SEQ ID NO: 1171113 - RNA, 13 nt, Human
caugcugucccuu

SEQ ID NO: 1171114 - RNA, 15 nt, Human
caugcugucccuuac

SEQ ID NO: 1171115 - RNA, 17 nt, Human
caugcugucccuuacgu

SEQ ID NO: 1171116 - RNA, 20 nt, Human
cauggaauuggagcucgugg

SEQ ID NO: 1171117 - RNA, 15 nt, Human
cauggacuuccacug

SEQ ID NO: 1171118 - RNA, 12 nt, Human
caugucuggcua

SEQ ID NO: 1171119 - RNA, 15 nt, Human
caugugaugagagga

SEQ ID NO: 1171120 - RNA, 16 nt, Human
caugugaugagaggaa

SEQ ID NO: 1171121 - RNA, 17 nt, Human
caugugaugagaggaaa

SEQ ID NO: 1171122 - RNA, 18 nt, Human
caugugaugagaggaaau

SEQ ID NO: 1171123 - RNA, 20 nt, Human
caugugaugagaggaaauca

SEQ ID NO: 1171124 - RNA, 21 nt, Human
caugugaugagaggaaaucac

SEQ ID NO: 1171125 - RNA, 14 nt, Human
caugugcacaugca

SEQ ID NO: 1171126 - RNA, 15 nt, Human
caugugcacaugcac

SEQ ID NO: 1171127 - RNA, 20 nt, Human
caugugcuaguaauuggaaa

SEQ ID NO: 1171128 - RNA, 23 nt, Human
cauggucggaaaacaugcuacac

SEQ ID NO: 1171129 - RNA, 19 nt, Human
cauggucggaaaacaugcu

SEQ ID NO: 1171130 - RNA, 12 nt, Human
cauguuugugau

SEQ ID NO: 1171131 - RNA, 14 nt, Human
cauguuugugauug

SEQ ID NO: 1171132 - RNA, 19 nt, Human
cauguuuuucuucucccuc

SEQ ID NO: 1171133 - RNA, 20 nt, Human
cauguuuuucuucucccuca

SEQ ID NO: 1171134 - RNA, 15 nt, Human
cauguuugugauuga

SEQ ID NO: 1171135 - RNA, 22 nt, Human
cauuccaacuaucucauuucca

SEQ ID NO: 1171136 - RNA, 20 nt, Human
cauuccccaggaggccagcc

SEQ ID NO: 1171137 - RNA, 18 nt, Human
cauuccccaggaggccag

SEQ ID NO: 1171138 - RNA, 19 nt, Human
cauuccccaggaggccagc

SEQ ID NO: 1171139 - RNA, 13 nt, Human
cauuccccaggag

SEQ ID NO: 1171140 - RNA, 15 nt, Human
cauuccccaggaggc

SEQ ID NO: 1171141 - RNA, 17 nt, Human
cauuccccaggaggcca

SEQ ID NO: 1171142 - RNA, 17 nt, Human
cauucuguuaaucauua

SEQ ID NO: 1171143 - RNA, 13 nt, Human
cauucuggaauaa

SEQ ID NO: 1171144 - RNA, 12 nt, Human
cauucugccugc

SEQ ID NO: 1171145 - RNA, 13 nt, Human
cauucugccugcc

SEQ ID NO: 1171146 - RNA, 15 nt, Human
cauucugccugccca

SEQ ID NO: 1171147 - RNA, 16 nt, Human
cauucugccugcccag

SEQ ID NO: 1171148 - RNA, 17 nt, Human
cauucugccugcccagg

SEQ ID NO: 1171149 - RNA, 18 nt, Human
cauucugccugcccaggc

SEQ ID NO: 1171150 - RNA, 19 nt, Human
cauucugccugcccaggcc

SEQ ID NO: 1171151 - RNA, 20 nt, Human
cauucugccugcccaggccc

SEQ ID NO: 1171152 - RNA, 14 nt, Human
cauuccugaugcuu

SEQ ID NO: 1171153 - RNA, 16 nt, Human
cauuccugaugcuucu

SEQ ID NO: 1171154 - RNA, 19 nt, Human
cauuccugaugcuucuuca

SEQ ID NO: 1171155 - RNA, 22 nt, Human
cauuccugaugcuucuucagag

SEQ ID NO: 1171156 - RNA, 23 nt, Human
cauuccugaugcuucuucagaga

SEQ ID NO: 1171157 - RNA, 12 nt, Human
cauuccuguucc

SEQ ID NO: 1171158 - RNA, 23 nt, Human
cauucuucuguacgucugacagg

SEQ ID NO: 1171159 - RNA, 17 nt, Human
cauuuuuaguagagaca

SEQ ID NO: 1171160 - RNA, 18 nt, Human
cauuuuuaguagagacag

SEQ ID NO: 1171161 - RNA, 16 nt, Human
ccaaacccuucagugc

SEQ ID NO: 1171162 - RNA, 23 nt, Human
cauuuuauuuuauuaugcaugaa

SEQ ID NO: 1171163 - RNA, 15 nt, Human
cauugaccugaggcc

SEQ ID NO: 1171164 - RNA, 17 nt, Human
cauugaccugaggcccu

SEQ ID NO: 1171165 - RNA, 18 nt, Human
cauugaccugaggcccuu

SEQ ID NO: 1171166 - RNA, 15 nt, Human
cauugugggaagggg

SEQ ID NO: 1171167 - RNA, 15 nt, Human
cauuuaaaaaaaauc

SEQ ID NO: 1171168 - RNA, 17 nt, Human
cauuugaaaauuuugau

SEQ ID NO: 1171169 - RNA, 19 nt, Human
cauuugaaaauuuugaugu

SEQ ID NO: 1171170 - RNA, 20 nt, Human
cauuugaaaauuuugauguu

SEQ ID NO: 1171171 - RNA, 13 nt, Human
ccacacccagccc

SEQ ID NO: 1171172 - RNA, 14 nt, Human
ccacacccagccca

SEQ ID NO: 1171173 - RNA, 15 nt, Human
ccacacccagcccac

SEQ ID NO: 1171174 - RNA, 18 nt, Human
ccacacacacagaaaaua

SEQ ID NO: 1171175 - RNA, 19 nt, Human
ccacacacacagaaaauau

SEQ ID NO: 1171176 - RNA, 20 nt, Human
ccacacacacagaaaauaua

SEQ ID NO: 1171177 - RNA, 21 nt, Human
ccacacacacagaaaauauac

SEQ ID NO: 1171178 - RNA, 22 nt, Human
ccacacacacagaaaauauacu

SEQ ID NO: 1171179 - RNA, 23 nt, Human
ccacacacacagaaaauauacug

SEQ ID NO: 1171180 - RNA, 12 nt, Human
ccacacccagcc

SEQ ID NO: 1171181 - RNA, 14 nt, Human
ccacaucuugcucu

SEQ ID NO: 1171182 - RNA, 16 nt, Human
ccacaucuugcucugc

SEQ ID NO: 1171183 - RNA, 17 nt, Human
ccacaucuugcucugcu

SEQ ID NO: 1171184 - RNA, 22 nt, Human
ccacaucuugcucugcugacag

SEQ ID NO: 1171185 - RNA, 23 nt, Human
ccacaucuugcucugcugacaga

SEQ ID NO: 1171186 - RNA, 14 nt, Human
ccaccaacauacuc

SEQ ID NO: 1171187 - RNA, 18 nt, Human
ccaccaacauacucccau

SEQ ID NO: 1171188 - RNA, 20 nt, Human
ccaccaacauacucccaucu

SEQ ID NO: 1171189 - RNA, 21 nt, Human
ccaccaacauacucccaucug

SEQ ID NO: 1171190 - RNA, 14 nt, Human
ccaccacacccagc

SEQ ID NO: 1171191 - RNA, 16 nt, Human
ccaccacacccagccc

SEQ ID NO: 1171192 - RNA, 17 nt, Human
ccaccacacccagccca

SEQ ID NO: 1171193 - RNA, 16 nt, Human
ccacccaagggccugg

SEQ ID NO: 1171194 - RNA, 17 nt, Human
ccacccaagggccuggc

SEQ ID NO: 1171195 - RNA, 19 nt, Human
ccacccaagggccuggccu

SEQ ID NO: 1171196 - RNA, 20 nt, Human
ccacccaagggccuggccug

SEQ ID NO: 1171197 - RNA, 21 nt, Human
ccacccaagggccuggccuga

SEQ ID NO: 1171198 - RNA, 22 nt, Human
ccacccaagggccuggccugag

SEQ ID NO: 1171199 - RNA, 13 nt, Human
ccacccaccucag

SEQ ID NO: 1171200 - RNA, 14 nt, Human
ccacccaccucagc

SEQ ID NO: 1171201 - RNA, 15 nt, Human
ccacccaccucagcc

SEQ ID NO: 1171202 - RNA, 16 nt, Human
ccacccaccucagccu

SEQ ID NO: 1171203 - RNA, 21 nt, Human
ccacccaggagccccgaggcc

SEQ ID NO: 1171204 - RNA, 12 nt, Human
ccaccugccagg

SEQ ID NO: 1171205 - RNA, 17 nt, Human
ccaccugccuguugggc

SEQ ID NO: 1171206 - RNA, 20 nt, Human
ccaccugccuguugggccag

SEQ ID NO: 1171207 - RNA, 17 nt, Human
ccaccucccacaaagga

SEQ ID NO: 1171208 - RNA, 22 nt, Human
ccaccugcggugcuaucucccc

SEQ ID NO: 1171209 - RNA, 15 nt, Human
ccaccuggccucugc

SEQ ID NO: 1171210 - RNA, 16 nt, Human
ccaccuggccucugca

SEQ ID NO: 1171211 - RNA, 17 nt, Human
ccaccuggccucugcac

SEQ ID NO: 1171212 - RNA, 18 nt, Human
ccaccuggccucugcacu

SEQ ID NO: 1171213 - RNA, 12 nt, Human
ccacggccaggc

SEQ ID NO: 1171214 - RNA, 13 nt, Human
ccacggccaggcc

SEQ ID NO: 1171215 - RNA, 14 nt, Human
ccacggccaggcca

SEQ ID NO: 1171216 - RNA, 15 nt, Human
ccacggccaggccag

SEQ ID NO: 1171217 - RNA, 16 nt, Human
ccacggccaggccaga

SEQ ID NO: 1171218 - RNA, 12 nt, Human
ccacccaggagc

SEQ ID NO: 1171219 - RNA, 14 nt, Human
ccacccaggagccc

SEQ ID NO: 1171220 - RNA, 19 nt, Human
ccaccccucaacaccucug

SEQ ID NO: 1171221 - RNA, 16 nt, Human
ccacccugaaagcccu

SEQ ID NO: 1171222 - RNA, 17 nt, Human
ccacccugaaagcccug

SEQ ID NO: 1171223 - RNA, 18 nt, Human
ccacccugaaagcccuga

SEQ ID NO: 1171224 - RNA, 12 nt, Human
ccaccucagccu

SEQ ID NO: 1171225 - RNA, 13 nt, Human
ccaccucagccuc

SEQ ID NO: 1171226 - RNA, 14 nt, Human
ccaccucagccucc

SEQ ID NO: 1171227 - RNA, 15 nt, Human
ccaccucagccuccc

SEQ ID NO: 1171228 - RNA, 12 nt, Human
ccacucccugca

SEQ ID NO: 1171229 - RNA, 13 nt, Human
ccacucccugcaa

SEQ ID NO: 1171230 - RNA, 18 nt, Human
ccacuacauucuguuaau

SEQ ID NO: 1171231 - RNA, 22 nt, Human
ccacuacggaauaguuggcuag

SEQ ID NO: 1171232 - RNA, 23 nt, Human
ccacuacggaauaguuggcuagg

SEQ ID NO: 1171233 - RNA, 16 nt, Human
ccacugcgaccacaag

SEQ ID NO: 1171234 - RNA, 11 nt, Human
ccacugcucug

SEQ ID NO: 1171235 - RNA, 15 nt, Human
ccacucccugcaacc

SEQ ID NO: 1171236 - RNA, 17 nt, Human
ccacucccugcaaccug

SEQ ID NO: 1171237 - RNA, 19 nt, Human
ccacugcacuccagccugg

SEQ ID NO: 1171238 - RNA, 20 nt, Human
ccacugcacuccagccuggg

SEQ ID NO: 1171239 - RNA, 23 nt, Human
ccacugcacuccagccuggguga

SEQ ID NO: 1171240 - RNA, 13 nt, Human
ccacguuucuaaa

SEQ ID NO: 1171241 - RNA, 16 nt, Human
ccagcaagugagagcu

SEQ ID NO: 1171242 - RNA, 21 nt, Human
ccagcaagugagagcugggug

SEQ ID NO: 1171243 - RNA, 22 nt, Human
ccagcaagugagagcugggugu

SEQ ID NO: 1171244 - RNA, 15 nt, Human
ccagauuucacucuc

SEQ ID NO: 1171245 - RNA, 14 nt, Human
ccagauuucacucu

SEQ ID NO: 1171246 - RNA, 15 nt, Human
ccagcaagugagagc

SEQ ID NO: 1171247 - RNA, 16 nt, Human
ccagcccuuagcaggg

SEQ ID NO: 1171248 - RNA, 17 nt, Human
ccagcccuuagcaggga

SEQ ID NO: 1171249 - RNA, 16 nt, Human
ccagccccagugccca

SEQ ID NO: 1171250 - RNA, 23 nt, Human
ccagccccaaaacucuccucugc

SEQ ID NO: 1171251 - RNA, 13 nt, Human
ccagccccagugc

SEQ ID NO: 1171252 - RNA, 15 nt, Human
ccagccccagugccc

SEQ ID NO: 1171253 - RNA, 14 nt, Human
ccagccgccaugcu

SEQ ID NO: 1171254 - RNA, 18 nt, Human
ccagccgccaugcuccug

SEQ ID NO: 1171255 - RNA, 19 nt, Human
ccagccgccaugcuccugg

SEQ ID NO: 1171256 - RNA, 15 nt, Human
ccagccaaagccucc

SEQ ID NO: 1171257 - RNA, 18 nt, Human
ccagccaaagccuccucc

SEQ ID NO: 1171258 - RNA, 19 nt, Human
ccagccaaagccuccucca

SEQ ID NO: 1171259 - RNA, 17 nt, Human
ccagacaccuugacagg

SEQ ID NO: 1171260 - RNA, 19 nt, Human
ccagacaccuugacagggc

SEQ ID NO: 1171261 - RNA, 20 nt, Human
ccagacaccuugacagggca

SEQ ID NO: 1171262 - RNA, 14 nt, Human
ccagagaggguggu

SEQ ID NO: 1171263 - RNA, 21 nt, Human
ccagagaggguggugaccucu

SEQ ID NO: 1171264 - RNA, 23 nt, Human
ccagagaggguggugaccucugc

SEQ ID NO: 1171265 - RNA, 11 nt, Human
ccagagcugcc

SEQ ID NO: 1171266 - RNA, 12 nt, Human
ccagagcugcca

SEQ ID NO: 1171267 - RNA, 13 nt, Human
ccagagcugccac

SEQ ID NO: 1171268 - RNA, 14 nt, Human
ccagagcugccacc

SEQ ID NO: 1171269 - RNA, 15 nt, Human
ccagagcugccaccu

SEQ ID NO: 1171270 - RNA, 16 nt, Human
ccagagcugccaccug

SEQ ID NO: 1171271 - RNA, 19 nt, Human
ccagagcugccaccugccu

SEQ ID NO: 1171272 - RNA, 21 nt, Human
ccagaggagagaggacccccu

SEQ ID NO: 1171273 - RNA, 22 nt, Human
ccagaggagagaggacccccug

SEQ ID NO: 1171274 - RNA, 16 nt, Human
ccagagggagugacag

SEQ ID NO: 1171275 - RNA, 17 nt, Human
ccagagggagugacaga

SEQ ID NO: 1171276 - RNA, 18 nt, Human
ccagagggagugacagag

SEQ ID NO: 1171277 - RNA, 19 nt, Human
ccagagggagugacagagg

SEQ ID NO: 1171278 - RNA, 20 nt, Human
ccagagggagugacagaggc

SEQ ID NO: 1171279 - RNA, 21 nt, Human
ccagagggagugacagaggca

SEQ ID NO: 1171280 - RNA, 22 nt, Human
ccagagggagugacagaggcag

SEQ ID NO: 1171281 - RNA, 23 nt, Human
ccagagggagugacagaggcagc

SEQ ID NO: 1171282 - RNA, 13 nt, Human
ccagagggccugc

SEQ ID NO: 1171283 - RNA, 15 nt, Human
ccagagggccugcaa

SEQ ID NO: 1171284 - RNA, 16 nt, Human
ccagagggccugcaag

SEQ ID NO: 1171285 - RNA, 18 nt, Human
ccagauucuuuccugagg

SEQ ID NO: 1171286 - RNA, 19 nt, Human
ccagauucuuuccugaggc

SEQ ID NO: 1171287 - RNA, 20 nt, Human
ccagauucuuuccugaggcu

SEQ ID NO: 1171288 - RNA, 21 nt, Human
ccagauucuuuccugaggcug

SEQ ID NO: 1171289 - RNA, 22 nt, Human
ccagauucuuuccugaggcugg

SEQ ID NO: 1171290 - RNA, 23 nt, Human
ccagauucuuuccugaggcuggg

SEQ ID NO: 1171291 - RNA, 19 nt, Human
ccagauugcaacaggcugg

SEQ ID NO: 1171292 - RNA, 20 nt, Human
ccagauugcaacaggcuggg

SEQ ID NO: 1171293 - RNA, 21 nt, Human
ccagauugcaacaggcugggc

SEQ ID NO: 1171294 - RNA, 12 nt, Human
ccagauuucacu

SEQ ID NO: 1171295 - RNA, 17 nt, Human
ccaggcuuagucacuga

SEQ ID NO: 1171296 - RNA, 21 nt, Human
ccaggcccucugcccacuccc

SEQ ID NO: 1171297 - RNA, 22 nt, Human
ccaggcccucugcccacucccu

SEQ ID NO: 1171298 - RNA, 23 nt, Human
ccaggcccucugcccacucccug

SEQ ID NO: 1171299 - RNA, 19 nt, Human
ccaggagccccgaggccuu

SEQ ID NO: 1171300 - RNA, 20 nt, Human
ccaggagccccgaggccuuc

SEQ ID NO: 1171301 - RNA, 12 nt, Human
ccaggagccucc

SEQ ID NO: 1171302 - RNA, 18 nt, Human
ccaggcauuccccaggag

SEQ ID NO: 1171303 - RNA, 19 nt, Human
ccaggcauuccccaggagg

SEQ ID NO: 1171304 - RNA, 21 nt, Human
ccaggcauuccccaggaggcc

SEQ ID NO: 1171305 - RNA, 22 nt, Human
ccaggcauuccccaggaggcca

SEQ ID NO: 1171306 - RNA, 19 nt, Human
ccaggugcacaagcuccaa

SEQ ID NO: 1171307 - RNA, 20 nt, Human
ccaggugcacaagcuccaag

SEQ ID NO: 1171308 - RNA, 24 nt, Human
ccaggugcacaagcuccaagcucc

SEQ ID NO: 1171309 - RNA, 17 nt, Human
ccagguuuuuggucuga

SEQ ID NO: 1171310 - RNA, 18 nt, Human
ccagucuggaaugcagug

SEQ ID NO: 1171311 - RNA, 19 nt, Human
ccagucuggaaugcagugg

SEQ ID NO: 1171312 - RNA, 20 nt, Human
ccagucuggaaugcaguggu

SEQ ID NO: 1171313 - RNA, 22 nt, Human
ccagggacagaggggguggccu

SEQ ID NO: 1171314 - RNA, 20 nt, Human
ccaggcuuagucacugagac

SEQ ID NO: 1171315 - RNA, 15 nt, Human
ccagggacagagggg

SEQ ID NO: 1171316 - RNA, 21 nt, Human
ccagggacagaggggguggcc

SEQ ID NO: 1171317 - RNA, 23 nt, Human
ccauauucuguuggccaguguga

SEQ ID NO: 1171318 - RNA, 22 nt, Human
ccaguguuguggauuuaacaga

SEQ ID NO: 1171319 - RNA, 17 nt, Human
ccagugaggcucugccc

SEQ ID NO: 1171320 - RNA, 14 nt, Human
ccagugaggcucug

SEQ ID NO: 1171321 - RNA, 15 nt, Human
ccagugaggcucugc

SEQ ID NO: 1171322 - RNA, 16 nt, Human
ccagugaggcucugcc

SEQ ID NO: 1171323 - RNA, 20 nt, Human
ccagugccgagaaggaagcc

SEQ ID NO: 1171324 - RNA, 13 nt, Human
ccaucuacccucc

SEQ ID NO: 1171325 - RNA, 18 nt, Human
ccauguuggccaggcugg

SEQ ID NO: 1171326 - RNA, 17 nt, Human
ccauguuggccaggcug

SEQ ID NO: 1171327 - RNA, 16 nt, Human
ccaugggacagggagg

SEQ ID NO: 1171328 - RNA, 19 nt, Human
ccaugggacagggaggacg

SEQ ID NO: 1171329 - RNA, 16 nt, Human
cccaaagugcugggau

SEQ ID NO: 1171330 - RNA, 18 nt, Human
cccaaauggaaaugggca

SEQ ID NO: 1171331 - RNA, 22 nt, Human
cccaaauggaaaugggcagagc

SEQ ID NO: 1171332 - RNA, 23 nt, Human
cccaaauggaaaugggcagagca

SEQ ID NO: 1171333 - RNA, 14 nt, Human
ccauuuguguuuau

SEQ ID NO: 1171334 - RNA, 19 nt, Human
ccauucuccaccugccagg

SEQ ID NO: 1171335 - RNA, 20 nt, Human
ccauucuccaccugccaggg

SEQ ID NO: 1171336 - RNA, 16 nt, Human
cccaaaacucuccucu

SEQ ID NO: 1171337 - RNA, 18 nt, Human
cccaaaacucuccucugc

SEQ ID NO: 1171338 - RNA, 20 nt, Human
cccaaaacucuccucugcug

SEQ ID NO: 1171339 - RNA, 13 nt, Human
cccaaagugcugg

SEQ ID NO: 1171340 - RNA, 15 nt, Human
cccaaagugcuggga

SEQ ID NO: 1171341 - RNA, 18 nt, Human
ccauguuuuguuuacggu

SEQ ID NO: 1171342 - RNA, 17 nt, Human
cccacacacacacacau

SEQ ID NO: 1171343 - RNA, 18 nt, Human
cccacacacacacacaug

SEQ ID NO: 1171344 - RNA, 19 nt, Human
cccacacacacacacaugc

SEQ ID NO: 1171345 - RNA, 20 nt, Human
cccacacacacacacaugca

SEQ ID NO: 1171346 - RNA, 13 nt, Human
cccacaggaucag

SEQ ID NO: 1171347 - RNA, 16 nt, Human
cccaaugcacuuuguu

SEQ ID NO: 1171348 - RNA, 20 nt, Human
cccaaugcacuuuguucugg

SEQ ID NO: 1171349 - RNA, 23 nt, Human
cccaaugcacuuuguucuggcuc

SEQ ID NO: 1171350 - RNA, 13 nt, Human
cccacaagaaaug

SEQ ID NO: 1171351 - RNA, 20 nt, Human
cccacaagaaaugaaagcag

SEQ ID NO: 1171352 - RNA, 10 nt, Human
cccacacaca

SEQ ID NO: 1171353 - RNA, 11 nt, Human
cccacacacac

SEQ ID NO: 1171354 - RNA, 13 nt, Human
cccacacacacac

SEQ ID NO: 1171355 - RNA, 14 nt, Human
cccacacacacaca

SEQ ID NO: 1171356 - RNA, 22 nt, Human
cccaccucucucacuccuugaa

SEQ ID NO: 1171357 - RNA, 18 nt, Human
cccaccaucaugucuggc

SEQ ID NO: 1171358 - RNA, 20 nt, Human
cccaccgcagacaggaccag

SEQ ID NO: 1171359 - RNA, 17 nt, Human
cccaccuggccucugca

SEQ ID NO: 1171360 - RNA, 19 nt, Human
cccaccuggccucugcacu

SEQ ID NO: 1171361 - RNA, 21 nt, Human
cccaccuggccucugcacucc

SEQ ID NO: 1171362 - RNA, 20 nt, Human
cccacgacugcccggcaggg

SEQ ID NO: 1171363 - RNA, 21 nt, Human
cccacgacugcccggcagggu

SEQ ID NO: 1171364 - RNA, 19 nt, Human
cccacgcuggagugcagug

SEQ ID NO: 1171365 - RNA, 20 nt, Human
cccacgcuggagugcaguga

SEQ ID NO: 1171366 - RNA, 21 nt, Human
cccacgcuggagugcagugag

SEQ ID NO: 1171367 - RNA, 23 nt, Human
cccacuugagaauuacccuuuug

SEQ ID NO: 1171368 - RNA, 16 nt, Human
cccgggcucugccucc

SEQ ID NO: 1171369 - RNA, 15 nt, Human
cccgugggguuccuc

SEQ ID NO: 1171370 - RNA, 20 nt, Human
cccuacaguugaaaaacagc

SEQ ID NO: 1171371 - RNA, 14 nt, Human
cccagagggccugc

SEQ ID NO: 1171372 - RNA, 15 nt, Human
cccagagggccugca

SEQ ID NO: 1171373 - RNA, 18 nt, Human
cccagagggccugcaagg

SEQ ID NO: 1171374 - RNA, 13 nt, Human
cccgaguagcugg

SEQ ID NO: 1171375 - RNA, 14 nt, Human
cccgaguagcuggg

SEQ ID NO: 1171376 - RNA, 15 nt, Human
cccgaguagcuggga

SEQ ID NO: 1171377 - RNA, 16 nt, Human
cccgaguagcugggac

SEQ ID NO: 1171378 - RNA, 17 nt, Human
cccgaguagcugggacu

SEQ ID NO: 1171379 - RNA, 18 nt, Human
cccgaguagcugggacua

SEQ ID NO: 1171380 - RNA, 21 nt, Human
cccgaguagcugggacuacag

SEQ ID NO: 1171381 - RNA, 22 nt, Human
cccgaguagcugggacuacagg

SEQ ID NO: 1171382 - RNA, 19 nt, Human
cccgcugucagccauuccu

SEQ ID NO: 1171383 - RNA, 20 nt, Human
cccgcugucagccauuccug

SEQ ID NO: 1171384 - RNA, 12 nt, Human
cccgggcucugc

SEQ ID NO: 1171385 - RNA, 14 nt, Human
cccgggcucugccu

SEQ ID NO: 1171386 - RNA, 15 nt, Human
cccgggcucugccuc

SEQ ID NO: 1171387 - RNA, 16 nt, Human
cccugcaaccugauug

SEQ ID NO: 1171388 - RNA, 12 nt, Human
cccugcacuugc

SEQ ID NO: 1171389 - RNA, 19 nt, Human
cccugcacuugcagacucu

SEQ ID NO: 1171390 - RNA, 22 nt, Human
cccugcacuugcagacucuaca

SEQ ID NO: 1171391 - RNA, 16 nt, Human
cccucuggggcuguuc

SEQ ID NO: 1171392 - RNA, 15 nt, Human
cccugaaagcccuga

SEQ ID NO: 1171393 - RNA, 16 nt, Human
cccugaaagcccugag

SEQ ID NO: 1171394 - RNA, 14 nt, Human
cccugaggcccaga

SEQ ID NO: 1171395 - RNA, 15 nt, Human
cccugaggcccagag

SEQ ID NO: 1171396 - RNA, 16 nt, Human
cccugaggcccagagg

SEQ ID NO: 1171397 - RNA, 17 nt, Human
cccugaggcccagaggg

SEQ ID NO: 1171398 - RNA, 18 nt, Human
cccugaggcccagagggc

SEQ ID NO: 1171399 - RNA, 19 nt, Human
cccugaggcccagagggcc

SEQ ID NO: 1171400 - RNA, 20 nt, Human
cccugaggcccagagggccu

SEQ ID NO: 1171401 - RNA, 23 nt, Human
cccugaggcccagagggccugca

SEQ ID NO: 1171402 - RNA, 22 nt, Human
cccugcuggguguggcgcagca

SEQ ID NO: 1171403 - RNA, 14 nt, Human
cccugcccaccugg

SEQ ID NO: 1171404 - RNA, 17 nt, Human
cccugcccaccuggccu

SEQ ID NO: 1171405 - RNA, 18 nt, Human
cccugcccaccuggccuc

SEQ ID NO: 1171406 - RNA, 20 nt, Human
cccugcccaccuggccucug

SEQ ID NO: 1171407 - RNA, 16 nt, Human
cccugcuggguguggc

SEQ ID NO: 1171408 - RNA, 21 nt, Human
cccugcuggguguggcgcagc

SEQ ID NO: 1171409 - RNA, 15 nt, Human
cccugguggcagcuc

SEQ ID NO: 1171410 - RNA, 16 nt, Human
cccugguggcagcuca

SEQ ID NO: 1171411 - RNA, 17 nt, Human
cccugguggcagcucac

SEQ ID NO: 1171412 - RNA, 21 nt, Human
cccuggugaccagcaccaucu

SEQ ID NO: 1171413 - RNA, 20 nt, Human
cccugguggcagcucaccuc

SEQ ID NO: 1171414 - RNA, 14 nt, Human
ccgaggccuucucu

SEQ ID NO: 1171415 - RNA, 17 nt, Human
ccgaggccuucucugaa

SEQ ID NO: 1171416 - RNA, 17 nt, Human
ccgaguagcugggacua

SEQ ID NO: 1171417 - RNA, 20 nt, Human
ccgaguagcugggacuacag

SEQ ID NO: 1171418 - RNA, 23 nt, Human
ccgcuaagagggagggagggcuc

SEQ ID NO: 1171419 - RNA, 21 nt, Human
ccgcuaagagggagggagggc

SEQ ID NO: 1171420 - RNA, 14 nt, Human
ccgcacugggcuug

SEQ ID NO: 1171421 - RNA, 19 nt, Human
ccgcacugggcuuggggac

SEQ ID NO: 1171422 - RNA, 12 nt, Human
ccgcuuucuacc

SEQ ID NO: 1171423 - RNA, 19 nt, Human
ccgcuuucuacccagcgag

SEQ ID NO: 1171424 - RNA, 23 nt, Human
ccgcuuucuacccagcgagcccu

SEQ ID NO: 1171425 - RNA, 17 nt, Human
ccggcuggccuggcccc

SEQ ID NO: 1171426 - RNA, 18 nt, Human
ccggcuggccuggccccu

SEQ ID NO: 1171427 - RNA, 16 nt, Human
ccgggcguggugguga

SEQ ID NO: 1171428 - RNA, 13 nt, Human
ccgggcucugccu

SEQ ID NO: 1171429 - RNA, 15 nt, Human
ccuaaaauucagugg

SEQ ID NO: 1171430 - RNA, 22 nt, Human
ccuauauuguuuucaguguaca

SEQ ID NO: 1171431 - RNA, 18 nt, Human
ccuauauuguuuucagug

SEQ ID NO: 1171432 - RNA, 13 nt, Human
ccuaguuccacca

SEQ ID NO: 1171433 - RNA, 21 nt, Human
ccuaguuccaccaucaagcca

SEQ ID NO: 1171434 - RNA, 23 nt, Human
ccuaguuccaccaucaagccacc

SEQ ID NO: 1171435 - RNA, 20 nt, Human
ccucagucuggcccuuccuu

SEQ ID NO: 1171436 - RNA, 11 nt, Human
ccucagugcca

SEQ ID NO: 1171437 - RNA, 13 nt, Human
ccucauacccacc

SEQ ID NO: 1171438 - RNA, 20 nt, Human
ccucauaguaugguggcugg

SEQ ID NO: 1171439 - RNA, 21 nt, Human
ccucauaguaugguggcuggg

SEQ ID NO: 1171440 - RNA, 22 nt, Human
ccucauaguaugguggcugggu

SEQ ID NO: 1171441 - RNA, 13 nt, Human
ccucaucaccaac

SEQ ID NO: 1171442 - RNA, 14 nt, Human
ccucaucaccaacg

SEQ ID NO: 1171443 - RNA, 13 nt, Human
ccucauccucaua

SEQ ID NO: 1171444 - RNA, 20 nt, Human
ccucauccucauacccaccc

SEQ ID NO: 1171445 - RNA, 22 nt, Human
ccuccaggugcacaagcuccaa

SEQ ID NO: 1171446 - RNA, 19 nt, Human
ccuccaggugcacaagcuc

SEQ ID NO: 1171447 - RNA, 21 nt, Human
ccuccaggugcacaagcucca

SEQ ID NO: 1171448 - RNA, 23 nt, Human
ccuccaugugggcuaguugggcu

SEQ ID NO: 1171449 - RNA, 15 nt, Human
ccucccaaagugcug

SEQ ID NO: 1171450 - RNA, 16 nt, Human
ccucccaaagugcugg

SEQ ID NO: 1171451 - RNA, 10 nt, Human
ccucccuccc

SEQ ID NO: 1171452 - RNA, 20 nt, Human
ccucccgaguagcugggacu

SEQ ID NO: 1171453 - RNA, 21 nt, Human
ccucccgaguagcugggacua

SEQ ID NO: 1171454 - RNA, 23 nt, Human
ccuccugccucgaacuggcugca

SEQ ID NO: 1171455 - RNA, 14 nt, Human
ccuccugggcuaag

SEQ ID NO: 1171456 - RNA, 13 nt, Human
ccuccugcugggc

SEQ ID NO: 1171457 - RNA, 16 nt, Human
ccucggugccuuccuc

SEQ ID NO: 1171458 - RNA, 14 nt, Human
ccucgguguggaga

SEQ ID NO: 1171459 - RNA, 18 nt, Human
ccucgguguggagaagcg

SEQ ID NO: 1171460 - RNA, 16 nt, Human
ccucuaggaggucucu

SEQ ID NO: 1171461 - RNA, 17 nt, Human
ccucccgaauagcuggg

SEQ ID NO: 1171462 - RNA, 12 nt, Human
ccugagccagau

SEQ ID NO: 1171463 - RNA, 11 nt, Human
ccugagcccca

SEQ ID NO: 1171464 - RNA, 14 nt, Human
ccugagcuuucugc

SEQ ID NO: 1171465 - RNA, 16 nt, Human
ccugagcuuucugcua

SEQ ID NO: 1171466 - RNA, 21 nt, Human
ccugaggcccagagggccugc

SEQ ID NO: 1171467 - RNA, 14 nt, Human
ccugcaagaacaag

SEQ ID NO: 1171468 - RNA, 11 nt, Human
ccugaggcccu

SEQ ID NO: 1171469 - RNA, 12 nt, Human
ccugaggcccuu

SEQ ID NO: 1171470 - RNA, 20 nt, Human
ccugaugcuucuucagagac

SEQ ID NO: 1171471 - RNA, 21 nt, Human
ccugaugcuucuucagagacu

SEQ ID NO: 1171472 - RNA, 22 nt, Human
ccugaugcuucuucagagacuc

SEQ ID NO: 1171473 - RNA, 14 nt, Human
ccugaggcccuucu

SEQ ID NO: 1171474 - RNA, 15 nt, Human
ccugauugugucucu

SEQ ID NO: 1171475 - RNA, 17 nt, Human
ccugauugugucucuug

SEQ ID NO: 1171476 - RNA, 19 nt, Human
ccugauugugucucuuggu

SEQ ID NO: 1171477 - RNA, 22 nt, Human
ccugcaaccugauugugucucu

SEQ ID NO: 1171478 - RNA, 13 nt, Human
ccugccaggaagc

SEQ ID NO: 1171479 - RNA, 14 nt, Human
ccugccaggaagcc

SEQ ID NO: 1171480 - RNA, 15 nt, Human
ccugccaggaagcca

SEQ ID NO: 1171481 - RNA, 17 nt, Human
ccugccaggaagccagc

SEQ ID NO: 1171482 - RNA, 18 nt, Human
ccugccaggaagccagca

SEQ ID NO: 1171483 - RNA, 19 nt, Human
ccugccaggaagccagcag

SEQ ID NO: 1171484 - RNA, 21 nt, Human
ccugccaggaagccagcaggc

SEQ ID NO: 1171485 - RNA, 22 nt, Human
ccugccaggaagccagcaggcu

SEQ ID NO: 1171486 - RNA, 23 nt, Human
ccugccaggaagccagcaggcuc

SEQ ID NO: 1171487 - RNA, 16 nt, Human
ccugccaggcauggug

SEQ ID NO: 1171488 - RNA, 11 nt, Human
ccugccaggga

SEQ ID NO: 1171489 - RNA, 12 nt, Human
ccugccagggac

SEQ ID NO: 1171490 - RNA, 13 nt, Human
ccugccagggaca

SEQ ID NO: 1171491 - RNA, 14 nt, Human
ccugccagggacag

SEQ ID NO: 1171492 - RNA, 15 nt, Human
ccugccagggacaga

SEQ ID NO: 1171493 - RNA, 16 nt, Human
ccugccagggacagag

SEQ ID NO: 1171494 - RNA, 22 nt, Human
ccugccagggacagagggggug

SEQ ID NO: 1171495 - RNA, 22 nt, Human
ccugccccucaacucuccucca

SEQ ID NO: 1171496 - RNA, 11 nt, Human
ccugccucagc

SEQ ID NO: 1171497 - RNA, 23 nt, Human
ccugccuguugggccaggagccu

SEQ ID NO: 1171498 - RNA, 16 nt, Human
ccugcggugcuaucuc

SEQ ID NO: 1171499 - RNA, 17 nt, Human
ccugcggugcuaucucc

SEQ ID NO: 1171500 - RNA, 22 nt, Human
ccugcucuccgaccagacaccu

SEQ ID NO: 1171501 - RNA, 22 nt, Human
ccugcggugcuaucucccccag

SEQ ID NO: 1171502 - RNA, 21 nt, Human
ccugcucuccgaccagacacc

SEQ ID NO: 1171503 - RNA, 14 nt, Human
ccugcuucaaauau

SEQ ID NO: 1171504 - RNA, 23 nt, Human
ccuggaaaucaggguuaguauug

SEQ ID NO: 1171505 - RNA, 15 nt, Human
ccuggccagaugcac

SEQ ID NO: 1171506 - RNA, 20 nt, Human
ccuggccagaugcaccagcc

SEQ ID NO: 1171507 - RNA, 18 nt, Human
ccuggaauauauaaccag

SEQ ID NO: 1171508 - RNA, 22 nt, Human
ccuggcacccggccccugcugg

SEQ ID NO: 1171509 - RNA, 23 nt, Human
ccuggcacccggccccugcuggu

SEQ ID NO: 1171510 - RNA, 22 nt, Human
ccuggcacuauaauguaagcuc

SEQ ID NO: 1171511 - RNA, 12 nt, Human
ccuggcagcccc

SEQ ID NO: 1171512 - RNA, 13 nt, Human
ccuggcagccccu

SEQ ID NO: 1171513 - RNA, 14 nt, Human
ccuggcagccccug

SEQ ID NO: 1171514 - RNA, 13 nt, Human
ccuuaccagcaga

SEQ ID NO: 1171515 - RNA, 20 nt, Human
ccuuaccagcagagcaccuu

SEQ ID NO: 1171516 - RNA, 15 nt, Human
ccuuacccucauguu

SEQ ID NO: 1171517 - RNA, 19 nt, Human
ccuuacccucauguucuua

SEQ ID NO: 1171518 - RNA, 19 nt, Human
ccuuaccugccaggaagcc

SEQ ID NO: 1171519 - RNA, 17 nt, Human
ccuuagaagucacacag

SEQ ID NO: 1171520 - RNA, 18 nt, Human
ccuuagaagucacacagu

SEQ ID NO: 1171521 - RNA, 17 nt, Human
ccuuaaagaguguggca

SEQ ID NO: 1171522 - RNA, 14 nt, Human
ccuuacacaauggu

SEQ ID NO: 1171523 - RNA, 20 nt, Human
ccuuacacaaugguuuucuu

SEQ ID NO: 1171524 - RNA, 16 nt, Human
ccuguuucugcagcca

SEQ ID NO: 1171525 - RNA, 14 nt, Human
ccuguuuguuucug

SEQ ID NO: 1171526 - RNA, 18 nt, Human
ccuguuuguuucugaaag

SEQ ID NO: 1171527 - RNA, 17 nt, Human
ccugugucuugcaaugg

SEQ ID NO: 1171528 - RNA, 19 nt, Human
ccugugucuugcaauggca

SEQ ID NO: 1171529 - RNA, 21 nt, Human
ccugugucuugcaauggcagc

SEQ ID NO: 1171530 - RNA, 22 nt, Human
ccugugucuugcaauggcagcc

SEQ ID NO: 1171531 - RNA, 22 nt, Human
ccugugucuuuaaaugcugcuu

SEQ ID NO: 1171532 - RNA, 20 nt, Human
ccugugugugcgccuacagg

SEQ ID NO: 1171533 - RNA, 21 nt, Human
ccugugugugcgccuacagga

SEQ ID NO: 1171534 - RNA, 12 nt, Human
ccuucagugccu

SEQ ID NO: 1171535 - RNA, 21 nt, Human
ccuucaccuuuguccccaccg

SEQ ID NO: 1171536 - RNA, 17 nt, Human
ccuucacagaugggugc

SEQ ID NO: 1171537 - RNA, 14 nt, Human
ccuuagacaguccc

SEQ ID NO: 1171538 - RNA, 19 nt, Human
ccuucaccuuuguccccac

SEQ ID NO: 1171539 - RNA, 20 nt, Human
ccuucaccuuuguccccacc

SEQ ID NO: 1171540 - RNA, 12 nt, Human
ccuucagccuga

SEQ ID NO: 1171541 - RNA, 11 nt, Human
ccuucagugcc

SEQ ID NO: 1171542 - RNA, 14 nt, Human
ccuucagugccaaa

SEQ ID NO: 1171543 - RNA, 22 nt, Human
ccuucauuuggcauuccccacu

SEQ ID NO: 1171544 - RNA, 14 nt, Human
ccuucggccuccau

SEQ ID NO: 1171545 - RNA, 20 nt, Human
ccuucggccuccauccugag

SEQ ID NO: 1171546 - RNA, 17 nt, Human
ccuugaaugaugccaug

SEQ ID NO: 1171547 - RNA, 15 nt, Human
ccuucggcgccuuaa

SEQ ID NO: 1171548 - RNA, 16 nt, Human
ccuucggccuccaucc

SEQ ID NO: 1171549 - RNA, 15 nt, Human
ccuucuccuucaccu

SEQ ID NO: 1171550 - RNA, 19 nt, Human
ccuucuccuucaccuuugu

SEQ ID NO: 1171551 - RNA, 23 nt, Human
ccuugaccauucuccaccugcca

SEQ ID NO: 1171552 - RNA, 13 nt, Human
ccuugacucuuuc

SEQ ID NO: 1171553 - RNA, 20 nt, Human
ccuugaguugauucagcucu

SEQ ID NO: 1171554 - RNA, 19 nt, Human
ccuuggggcugaugcaguu

SEQ ID NO: 1171555 - RNA, 22 nt, Human
ccuuggugucgggcaugacacg

SEQ ID NO: 1171556 - RNA, 21 nt, Human
ccuugguuaggcauuguggga

SEQ ID NO: 1171557 - RNA, 22 nt, Human
ccuugguuaggcauugugggaa

SEQ ID NO: 1171558 - RNA, 16 nt, Human
ccuuugacgccauccc

SEQ ID NO: 1171559 - RNA, 17 nt, Human
ccuuugacgccauccca

SEQ ID NO: 1171560 - RNA, 18 nt, Human
ccuuugacgccaucccag

SEQ ID NO: 1171561 - RNA, 12 nt, Human
cgaacuggcugc

SEQ ID NO: 1171562 - RNA, 14 nt, Human
cgaacuggcugcaa

SEQ ID NO: 1171563 - RNA, 20 nt, Human
cgaaaggaugaaagugacca

SEQ ID NO: 1171564 - RNA, 19 nt, Human
cgaaagggacuuggaagcu

SEQ ID NO: 1171565 - RNA, 22 nt, Human
cgaaagggacuuggaagcuccg

SEQ ID NO: 1171566 - RNA, 23 nt, Human
cgaaagggacuuggaagcuccgc

SEQ ID NO: 1171567 - RNA, 20 nt, Human
ccuuugacgccaucccagcc

SEQ ID NO: 1171568 - RNA, 21 nt, Human
ccuuugacgccaucccagccc

SEQ ID NO: 1171569 - RNA, 22 nt, Human
ccuuugacgccaucccagcccc

SEQ ID NO: 1171570 - RNA, 23 nt, Human
ccuuugacgccaucccagcccca

SEQ ID NO: 1171571 - RNA, 15 nt, Human
cgaaaacguggcugc

SEQ ID NO: 1171572 - RNA, 18 nt, Human
cgaaaacguggcugcuuc

SEQ ID NO: 1171573 - RNA, 19 nt, Human
cgaaaacguggcugcuuca

SEQ ID NO: 1171574 - RNA, 20 nt, Human
cgaaaacguggcugcuucaa

SEQ ID NO: 1171575 - RNA, 15 nt, Human
cgaauagcugggacu

SEQ ID NO: 1171576 - RNA, 13 nt, Human
cgaauagcuggga

SEQ ID NO: 1171577 - RNA, 14 nt, Human
cgaauagcugggac

SEQ ID NO: 1171578 - RNA, 17 nt, Human
cgagaaacagccugugu

SEQ ID NO: 1171579 - RNA, 18 nt, Human
cgagauagccaaggccaa

SEQ ID NO: 1171580 - RNA, 17 nt, Human
cgagaucacgccacugc

SEQ ID NO: 1171581 - RNA, 18 nt, Human
cgagaucacgccacugca

SEQ ID NO: 1171582 - RNA, 20 nt, Human
cgagaucacgccacugcacu

SEQ ID NO: 1171583 - RNA, 20 nt, Human
cgagauugcaccacugcacu

SEQ ID NO: 1171584 - RNA, 20 nt, Human
cgagcaggcuucuucccccc

SEQ ID NO: 1171585 - RNA, 13 nt, Human
cgagcaugccugg

SEQ ID NO: 1171586 - RNA, 16 nt, Human
cgagcaugccuggaug

SEQ ID NO: 1171587 - RNA, 17 nt, Human
cgagcaugccuggaugg

SEQ ID NO: 1171588 - RNA, 14 nt, Human
cgcagcccugcaga

SEQ ID NO: 1171589 - RNA, 15 nt, Human
cgcagacaggaccag

SEQ ID NO: 1171590 - RNA, 16 nt, Human
cgcagacaggaccagg

SEQ ID NO: 1171591 - RNA, 15 nt, Human
cgcagcccugcagag

SEQ ID NO: 1171592 - RNA, 19 nt, Human
cgccagauucuuuccugag

SEQ ID NO: 1171593 - RNA, 20 nt, Human
cgccagauucuuuccugagg

SEQ ID NO: 1171594 - RNA, 21 nt, Human
cgccagauucuuuccugaggc

SEQ ID NO: 1171595 - RNA, 22 nt, Human
cgccagauucuuuccugaggcu

SEQ ID NO: 1171596 - RNA, 22 nt, Human
cgccaggggaaaaucagccugc

SEQ ID NO: 1171597 - RNA, 18 nt, Human
cgagcaugccuggauggg

SEQ ID NO: 1171598 - RNA, 15 nt, Human
cgagcccugguggca

SEQ ID NO: 1171599 - RNA, 16 nt, Human
cgagcccugguggcag

SEQ ID NO: 1171600 - RNA, 18 nt, Human
cgagcccugguggcagug

SEQ ID NO: 1171601 - RNA, 17 nt, Human
cgccaugcuccuggccc

SEQ ID NO: 1171602 - RNA, 14 nt, Human
cgagcaugccugga

SEQ ID NO: 1171603 - RNA, 18 nt, Human
cuaugggacucaaugcac

SEQ ID NO: 1171604 - RNA, 22 nt, Human
cuaugggacucaaugcacugac

SEQ ID NO: 1171605 - RNA, 23 nt, Human
cuaugggacucaaugcacugaca

SEQ ID NO: 1171606 - RNA, 15 nt, Human
cuauuagagaagaga

SEQ ID NO: 1171607 - RNA, 17 nt, Human
cuauagccuaggugaca

SEQ ID NO: 1171608 - RNA, 18 nt, Human
cuauagccuaggugacag

SEQ ID NO: 1171609 - RNA, 18 nt, Human
cuauauuguuugcuaagc

SEQ ID NO: 1171610 - RNA, 16 nt, Human
cuauaauguaagcucu

SEQ ID NO: 1171611 - RNA, 21 nt, Human
cuauaauguaagcucuacuga

SEQ ID NO: 1171612 - RNA, 22 nt, Human
cuauaauuuaccugaagucuuu

SEQ ID NO: 1171613 - RNA, 16 nt, Human
cuaguaauuggaaagg

SEQ ID NO: 1171614 - RNA, 20 nt, Human
cuagugaaacucguuaauuu

SEQ ID NO: 1171615 - RNA, 21 nt, Human
cuagugagcagucaggaaaga

SEQ ID NO: 1171616 - RNA, 20 nt, Human
cgccaucccagccccaauga

SEQ ID NO: 1171617 - RNA, 15 nt, Human
cgccaugcuccuggc

SEQ ID NO: 1171618 - RNA, 22 nt, Human
cgcccaguuggguggaugccug

SEQ ID NO: 1171619 - RNA, 23 nt, Human
cgcccaguuggguggaugccugg

SEQ ID NO: 1171620 - RNA, 14 nt, Human
cuaggugacagagu

SEQ ID NO: 1171621 - RNA, 18 nt, Human
cuaggugacagagugaga

SEQ ID NO: 1171622 - RNA, 24 nt, Human
cuaggugacagagugagacucugu

SEQ ID NO: 1171623 - RNA, 18 nt, Human
cuauuguuagucucuuga

SEQ ID NO: 1171624 - RNA, 21 nt, Human
cucaacaccucugcacaagcu

SEQ ID NO: 1171625 - RNA, 13 nt, Human
cucaaccuccugg

SEQ ID NO: 1171626 - RNA, 15 nt, Human
cucaaccuccugggc

SEQ ID NO: 1171627 - RNA, 17 nt, Human
cucaaccuccugggcua

SEQ ID NO: 1171628 - RNA, 21 nt, Human
cucaaguccucuuuucugaga

SEQ ID NO: 1171629 - RNA, 17 nt, Human
cucaagugauucuccug

SEQ ID NO: 1171630 - RNA, 22 nt, Human
cucacacaugagcaucaggcca

SEQ ID NO: 1171631 - RNA, 24 nt, Human
cucacacaugagcaucaggccagg

SEQ ID NO: 1171632 - RNA, 15 nt, Human
cucacaguccuuacc

SEQ ID NO: 1171633 - RNA, 17 nt, Human
cucacaguccuuaccag

SEQ ID NO: 1171634 - RNA, 19 nt, Human
cucacaguccuuaccagca

SEQ ID NO: 1171635 - RNA, 22 nt, Human
cucacaguccuuaccagcagag

SEQ ID NO: 1171636 - RNA, 23 nt, Human
cucacaguccuuaccagcagagc

SEQ ID NO: 1171637 - RNA, 15 nt, Human
cucacauuuauucug

SEQ ID NO: 1171638 - RNA, 19 nt, Human
cucacauuuauucugcuca

SEQ ID NO: 1171639 - RNA, 22 nt, Human
cucacauuuauucugcucacau

SEQ ID NO: 1171640 - RNA, 13 nt, Human
cucaccagcccca

SEQ ID NO: 1171641 - RNA, 14 nt, Human
cucaccagccccag

SEQ ID NO: 1171642 - RNA, 15 nt, Human
cucaccagccccagu

SEQ ID NO: 1171643 - RNA, 17 nt, Human
cucaccagccccagugc

SEQ ID NO: 1171644 - RNA, 18 nt, Human
cucaccagccccagugcc

SEQ ID NO: 1171645 - RNA, 19 nt, Human
cucaccagccccagugccc

SEQ ID NO: 1171646 - RNA, 21 nt, Human
cucacuauguugcccaggcag

SEQ ID NO: 1171647 - RNA, 22 nt, Human
cucacuauguugcccaggcagg

SEQ ID NO: 1171648 - RNA, 23 nt, Human
cucacuauguugcccaggcaggu

SEQ ID NO: 1171649 - RNA, 15 nt, Human
cucaccccagcccca

SEQ ID NO: 1171650 - RNA, 20 nt, Human
cucacuauguugcccaggca

SEQ ID NO: 1171651 - RNA, 13 nt, Human
cucacuccuugaa

SEQ ID NO: 1171652 - RNA, 11 nt, Human
cucacucuguc

SEQ ID NO: 1171653 - RNA, 12 nt, Human
cucacucugucg

SEQ ID NO: 1171654 - RNA, 14 nt, Human
cucacugcagccuc

SEQ ID NO: 1171655 - RNA, 13 nt, Human
cucacugcagccu

SEQ ID NO: 1171656 - RNA, 12 nt, Human
cucacugcagcc

SEQ ID NO: 1171657 - RNA, 13 nt, Human
cucacucugucgc

SEQ ID NO: 1171658 - RNA, 21 nt, Human
cucacucugucgcccagucug

SEQ ID NO: 1171659 - RNA, 22 nt, Human
cucacucugucgcccagucugg

SEQ ID NO: 1171660 - RNA, 19 nt, Human
cucacugccaugccagcuu

SEQ ID NO: 1171661 - RNA, 22 nt, Human
cucacugccaugccagcuuauc

SEQ ID NO: 1171662 - RNA, 20 nt, Human
cucacuguugcccaggcugg

SEQ ID NO: 1171663 - RNA, 21 nt, Human
cucacuguugcccaggcuggc

SEQ ID NO: 1171664 - RNA, 22 nt, Human
cucacuguugcccaggcuggcg

SEQ ID NO: 1171665 - RNA, 14 nt, Human
cucagagagggugg

SEQ ID NO: 1171666 - RNA, 18 nt, Human
cucagagagggugggagu

SEQ ID NO: 1171667 - RNA, 15 nt, Human
cucagaucuucugug

SEQ ID NO: 1171668 - RNA, 16 nt, Human
cucagaucuucugugg

SEQ ID NO: 1171669 - RNA, 16 nt, Human
cucagcauccuggcac

SEQ ID NO: 1171670 - RNA, 17 nt, Human
cucagcauccuggcacc

SEQ ID NO: 1171671 - RNA, 18 nt, Human
cucaggaguuugagacca

SEQ ID NO: 1171672 - RNA, 23 nt, Human
cucaggaguuugagaccaaccug

SEQ ID NO: 1171673 - RNA, 18 nt, Human
cucagcauccuggcaccc

SEQ ID NO: 1171674 - RNA, 14 nt, Human
cucagggccuggcu

SEQ ID NO: 1171675 - RNA, 15 nt, Human
cucagggccuggcuc

SEQ ID NO: 1171676 - RNA, 16 nt, Human
cucagggccuggcuca

SEQ ID NO: 1171677 - RNA, 15 nt, Human
cucagggccuggucg

SEQ ID NO: 1171678 - RNA, 18 nt, Human
cucagggccuggcucagg

SEQ ID NO: 1171679 - RNA, 15 nt, Human
cucagggucccuggu

SEQ ID NO: 1171680 - RNA, 16 nt, Human
cucagggucccuggug

SEQ ID NO: 1171681 - RNA, 17 nt, Human
cucagggucccuggugg

SEQ ID NO: 1171682 - RNA, 18 nt, Human
cucagggucccugguggc

SEQ ID NO: 1171683 - RNA, 16 nt, Human
cucaggugagaagcag

SEQ ID NO: 1171684 - RNA, 19 nt, Human
cucaggugagaagcagagg

SEQ ID NO: 1171685 - RNA, 20 nt, Human
cucaggugagaagcagagga

SEQ ID NO: 1171686 - RNA, 21 nt, Human
cucauaguaugguggcugggu

SEQ ID NO: 1171687 - RNA, 14 nt, Human
cucauacucaccuc

SEQ ID NO: 1171688 - RNA, 22 nt, Human
cucauacucaccucaccccacu

SEQ ID NO: 1171689 - RNA, 18 nt, Human
cucaggugauccacccac

SEQ ID NO: 1171690 - RNA, 19 nt, Human
cucaggugauccacccacc

SEQ ID NO: 1171691 - RNA, 20 nt, Human
cucaggugauccacccaccu

SEQ ID NO: 1171692 - RNA, 22 nt, Human
cucaggugauccacccaccuca

SEQ ID NO: 1171693 - RNA, 16 nt, Human
cucauacccaccccca

SEQ ID NO: 1171694 - RNA, 18 nt, Human
cucauacccacccccacc

SEQ ID NO: 1171695 - RNA, 19 nt, Human
cucauacccacccccaccc

SEQ ID NO: 1171696 - RNA, 21 nt, Human
cucauacccacccccacccaa

SEQ ID NO: 1171697 - RNA, 23 nt, Human
cucauaguaugguggcuggguug

SEQ ID NO: 1171698 - RNA, 21 nt, Human
cucaucaccaacgucugugcc

SEQ ID NO: 1171699 - RNA, 22 nt, Human
cucaucaccaacgucugugcca

SEQ ID NO: 1171700 - RNA, 15 nt, Human
cucauccucauaccc

SEQ ID NO: 1171701 - RNA, 13 nt, Human
cuccacccugcuc

SEQ ID NO: 1171702 - RNA, 15 nt, Human
cuccacccugcucuc

SEQ ID NO: 1171703 - RNA, 18 nt, Human
cuccaaaauaaaacuuuu

SEQ ID NO: 1171704 - RNA, 21 nt, Human
cuccaaacugacucuuaagaa

SEQ ID NO: 1171705 - RNA, 18 nt, Human
cucauuugucacacacuu

SEQ ID NO: 1171706 - RNA, 15 nt, Human
cuccaaaauaaaacu

SEQ ID NO: 1171707 - RNA, 16 nt, Human
cuccaaaauaaaacuu

SEQ ID NO: 1171708 - RNA, 17 nt, Human
cucauuugucacacacu

SEQ ID NO: 1171709 - RNA, 12 nt, Human
cuccaccugcca

SEQ ID NO: 1171710 - RNA, 13 nt, Human
cuccaccugccag

SEQ ID NO: 1171711 - RNA, 14 nt, Human
cuccaccugccagg

SEQ ID NO: 1171712 - RNA, 15 nt, Human
cuccaccugccaggg

SEQ ID NO: 1171713 - RNA, 16 nt, Human
cuccagccccuggaug

SEQ ID NO: 1171714 - RNA, 17 nt, Human
cuccagccccuggaugc

SEQ ID NO: 1171715 - RNA, 20 nt, Human
cuccagccccuggaugcagc

SEQ ID NO: 1171716 - RNA, 12 nt, Human
cuccagccuggg

SEQ ID NO: 1171717 - RNA, 14 nt, Human
cuccagcucaccag

SEQ ID NO: 1171718 - RNA, 11 nt, Human
cuccaggagca

SEQ ID NO: 1171719 - RNA, 13 nt, Human
cuccaggagcagc

SEQ ID NO: 1171720 - RNA, 14 nt, Human
cuccaggagcagcc

SEQ ID NO: 1171721 - RNA, 15 nt, Human
cuccaggagcagcca

SEQ ID NO: 1171722 - RNA, 16 nt, Human
cuccaggagcagccac

SEQ ID NO: 1171723 - RNA, 17 nt, Human
cuccaggagcagccaca

SEQ ID NO: 1171724 - RNA, 18 nt, Human
cuccaggagcagccacau

SEQ ID NO: 1171725 - RNA, 23 nt, Human
cuccaggagcagccacauuccug

SEQ ID NO: 1171726 - RNA, 12 nt, Human
cuccauccugag

SEQ ID NO: 1171727 - RNA, 13 nt, Human
cuccauccugagg

SEQ ID NO: 1171728 - RNA, 14 nt, Human
cuccauccugaggc

SEQ ID NO: 1171729 - RNA, 22 nt, Human
cuccccagcaagugagagcugg

SEQ ID NO: 1171730 - RNA, 23 nt, Human
cuccccagcaagugagagcuggg

SEQ ID NO: 1171731 - RNA, 16 nt, Human
cucccgaauagcuggg

SEQ ID NO: 1171732 - RNA, 19 nt, Human
cucccgaguagcugggacu

SEQ ID NO: 1171733 - RNA, 20 nt, Human
cucccgaguagcugggacua

SEQ ID NO: 1171734 - RNA, 12 nt, Human
cucccuuucaac

SEQ ID NO: 1171735 - RNA, 18 nt, Human
cuccucagaucuucugug

SEQ ID NO: 1171736 - RNA, 13 nt, Human
cuccuccagaguc

SEQ ID NO: 1171737 - RNA, 15 nt, Human
cuccuccagagucag

SEQ ID NO: 1171738 - RNA, 15 nt, Human
cuccuccagccgcca

SEQ ID NO: 1171739 - RNA, 22 nt, Human
cuccuccagccgccaugcuccu

SEQ ID NO: 1171740 - RNA, 11 nt, Human
cuccugccuca

SEQ ID NO: 1171741 - RNA, 12 nt, Human
cuccugccucag

SEQ ID NO: 1171742 - RNA, 17 nt, Human
cuccugccucagccucc

SEQ ID NO: 1171743 - RNA, 13 nt, Human
cuccucuccccag

SEQ ID NO: 1171744 - RNA, 15 nt, Human
cuccucuccccagca

SEQ ID NO: 1171745 - RNA, 22 nt, Human
cuccucuccccagcaagugaga

SEQ ID NO: 1171746 - RNA, 18 nt, Human
cuccugccucgaacuggc

SEQ ID NO: 1171747 - RNA, 20 nt, Human
cuccugccucgaacuggcug

SEQ ID NO: 1171748 - RNA, 21 nt, Human
cuccugccucgaacuggcugc

SEQ ID NO: 1171749 - RNA, 22 nt, Human
cuccugccucgaacuggcugca

SEQ ID NO: 1171750 - RNA, 21 nt, Human
cuccugugugugcgccuacag

SEQ ID NO: 1171751 - RNA, 23 nt, Human
cuccugugugugcgccuacagga

SEQ ID NO: 1171752 - RNA, 24 nt, Human
cuccugugugugcgccuacaggag

SEQ ID NO: 1171753 - RNA, 13 nt, Human
cuccugcugggca

SEQ ID NO: 1171754 - RNA, 14 nt, Human
cuccuggaaauauu

SEQ ID NO: 1171755 - RNA, 13 nt, Human
cucgcgacaaugc

SEQ ID NO: 1171756 - RNA, 22 nt, Human
cucgagcaugccuggauggggc

SEQ ID NO: 1171757 - RNA, 23 nt, Human
cuccuuggugucgggcaugacac

SEQ ID NO: 1171758 - RNA, 13 nt, Human
cucgagcaugccu

SEQ ID NO: 1171759 - RNA, 15 nt, Human
cucgagcaugccugg

SEQ ID NO: 1171760 - RNA, 16 nt, Human
cucgagcaugccugga

SEQ ID NO: 1171761 - RNA, 19 nt, Human
cucgagcaugccuggaugg

SEQ ID NO: 1171762 - RNA, 14 nt, Human
cucugacacacagc

SEQ ID NO: 1171763 - RNA, 15 nt, Human
cucugacacacagcu

SEQ ID NO: 1171764 - RNA, 16 nt, Human
cucugacacacagcuc

SEQ ID NO: 1171765 - RNA, 17 nt, Human
cucugacacacagcucu

SEQ ID NO: 1171766 - RNA, 18 nt, Human
cucugacacacagcucug

SEQ ID NO: 1171767 - RNA, 19 nt, Human
cucugacacacagcucugu

SEQ ID NO: 1171768 - RNA, 23 nt, Human
cucugacagaagaaccccagggu

SEQ ID NO: 1171769 - RNA, 21 nt, Human
cucugagacucgcgacaaugc

SEQ ID NO: 1171770 - RNA, 23 nt, Human
cucugagacucgcgacaaugcaa

SEQ ID NO: 1171771 - RNA, 12 nt, Human
cucugaggacac

SEQ ID NO: 1171772 - RNA, 14 nt, Human
cucugaggacacua

SEQ ID NO: 1171773 - RNA, 16 nt, Human
cucugaggacacuaac

SEQ ID NO: 1171774 - RNA, 13 nt, Human
cucugccucccau

SEQ ID NO: 1171775 - RNA, 14 nt, Human
cucugccucccauc

SEQ ID NO: 1171776 - RNA, 16 nt, Human
cucugccucccaucac

SEQ ID NO: 1171777 - RNA, 17 nt, Human
cucugccucccaucacc

SEQ ID NO: 1171778 - RNA, 13 nt, Human
cucugcccacucc

SEQ ID NO: 1171779 - RNA, 15 nt, Human
cucugcccacucccu

SEQ ID NO: 1171780 - RNA, 16 nt, Human
cucugcccacucccug

SEQ ID NO: 1171781 - RNA, 17 nt, Human
cucugcccacucccugc

SEQ ID NO: 1171782 - RNA, 18 nt, Human
cucugcccacucccugca

SEQ ID NO: 1171783 - RNA, 20 nt, Human
cucugcccacucccugcaac

SEQ ID NO: 1171784 - RNA, 13 nt, Human
cucugcacaagcu

SEQ ID NO: 1171785 - RNA, 14 nt, Human
cucugcacaagcug

SEQ ID NO: 1171786 - RNA, 15 nt, Human
cucugcacaagcugc

SEQ ID NO: 1171787 - RNA, 16 nt, Human
cucugcacaagcugca

SEQ ID NO: 1171788 - RNA, 13 nt, Human
cucugucgcccag

SEQ ID NO: 1171789 - RNA, 17 nt, Human
cucugucgcccagucug

SEQ ID NO: 1171790 - RNA, 18 nt, Human
cucugucgcccagucugg

SEQ ID NO: 1171791 - RNA, 19 nt, Human
cucugucgcccagucugga

SEQ ID NO: 1171792 - RNA, 14 nt, Human
cucuguccugggag

SEQ ID NO: 1171793 - RNA, 15 nt, Human
cucuguccugggagu

SEQ ID NO: 1171794 - RNA, 22 nt, Human
cucuguccugggagugagcugg

SEQ ID NO: 1171795 - RNA, 21 nt, Human
cucugccucccaucacccgcu

SEQ ID NO: 1171796 - RNA, 19 nt, Human
cucugccucugacacacag

SEQ ID NO: 1171797 - RNA, 20 nt, Human
cucugccucugacacacagc

SEQ ID NO: 1171798 - RNA, 10 nt, Human
cucugccuga

SEQ ID NO: 1171799 - RNA, 23 nt, Human
cucuggcagcucagagagggugg

SEQ ID NO: 1171800 - RNA, 21 nt, Human
cucuggccuucggccuccauc

SEQ ID NO: 1171801 - RNA, 22 nt, Human
cucuggccuucggccuccaucc

SEQ ID NO: 1171802 - RNA, 15 nt, Human
cucuucuccaggcug

SEQ ID NO: 1171803 - RNA, 20 nt, Human
cucugugucagguggggcag

SEQ ID NO: 1171804 - RNA, 21 nt, Human
cucugugucagguggggcagc

SEQ ID NO: 1171805 - RNA, 22 nt, Human
cucugugucagguggggcagcu

SEQ ID NO: 1171806 - RNA, 23 nt, Human
cucugugucagguggggcagcuu

SEQ ID NO: 1171807 - RNA, 13 nt, Human
cucuuaaaaccca

SEQ ID NO: 1171808 - RNA, 19 nt, Human
cucuuaagaagacugcauu

SEQ ID NO: 1171809 - RNA, 21 nt, Human
cugaagucacacagugagucg

SEQ ID NO: 1171810 - RNA, 14 nt, Human
cugaagaagauggu

SEQ ID NO: 1171811 - RNA, 17 nt, Human
cugaagucacacaguga

SEQ ID NO: 1171812 - RNA, 18 nt, Human
cugaagucacacagugag

SEQ ID NO: 1171813 - RNA, 19 nt, Human
cugaagucacacagugagu

SEQ ID NO: 1171814 - RNA, 22 nt, Human
cugaagucccagauacuugggg

SEQ ID NO: 1171815 - RNA, 17 nt, Human
cugaagucuuuguacag

SEQ ID NO: 1171816 - RNA, 20 nt, Human
cugaagucuuuguacagaca

SEQ ID NO: 1171817 - RNA, 24 nt, Human
cugaagucuuuguacagacaacaa

SEQ ID NO: 1171818 - RNA, 19 nt, Human
cugaaugguuuucaaaaua

SEQ ID NO: 1171819 - RNA, 20 nt, Human
cugaaugguuuucaaaauaa

SEQ ID NO: 1171820 - RNA, 12 nt, Human
cugaauuucuuu

SEQ ID NO: 1171821 - RNA, 16 nt, Human
cucuucuccaggcugu

SEQ ID NO: 1171822 - RNA, 22 nt, Human
cucuuuggucuacacugugcug

SEQ ID NO: 1171823 - RNA, 23 nt, Human
cucuuuggucuacacugugcuga

SEQ ID NO: 1171824 - RNA, 14 nt, Human
cucuuuucaaaaca

SEQ ID NO: 1171825 - RNA, 23 nt, Human
cugaaagggacgcuacccgggaa

SEQ ID NO: 1171826 - RNA, 19 nt, Human
cugacagacacaggcccgg

SEQ ID NO: 1171827 - RNA, 17 nt, Human
cugacagacacaggccc

SEQ ID NO: 1171828 - RNA, 18 nt, Human
cugacagacacaggcccg

SEQ ID NO: 1171829 - RNA, 14 nt, Human
cugaauuucuuuug

SEQ ID NO: 1171830 - RNA, 16 nt, Human
cugacagacacaggcc

SEQ ID NO: 1171831 - RNA, 20 nt, Human
cugagacagcccgggcucug

SEQ ID NO: 1171832 - RNA, 21 nt, Human
cugagacagcccgggcucugc

SEQ ID NO: 1171833 - RNA, 22 nt, Human
cugagacagcccgggcucugcc

SEQ ID NO: 1171834 - RNA, 13 nt, Human
cugagccagauuu

SEQ ID NO: 1171835 - RNA, 14 nt, Human
cugagccagauuuc

SEQ ID NO: 1171836 - RNA, 15 nt, Human
cugagccagauuuca

SEQ ID NO: 1171837 - RNA, 18 nt, Human
cugagucugaaggcuggg

SEQ ID NO: 1171838 - RNA, 19 nt, Human
cugagucugaaggcugggu

SEQ ID NO: 1171839 - RNA, 20 nt, Human
cugauccuaguuccaccauc

SEQ ID NO: 1171840 - RNA, 21 nt, Human
cugauccuaguuccaccauca

SEQ ID NO: 1171841 - RNA, 14 nt, Human
cugauggugcaaug

SEQ ID NO: 1171842 - RNA, 15 nt, Human
cugauggugcaauga

SEQ ID NO: 1171843 - RNA, 16 nt, Human
cugauggugcaaugac

SEQ ID NO: 1171844 - RNA, 15 nt, Human
cugaggcuccacuug

SEQ ID NO: 1171845 - RNA, 21 nt, Human
cugaggcuccacuuggucugu

SEQ ID NO: 1171846 - RNA, 13 nt, Human
cugaggcugggcu

SEQ ID NO: 1171847 - RNA, 15 nt, Human
cugaggcugggcucc

SEQ ID NO: 1171848 - RNA, 16 nt, Human
cugaggcugggcuccc

SEQ ID NO: 1171849 - RNA, 17 nt, Human
cugaggcugggcucccu

SEQ ID NO: 1171850 - RNA, 22 nt, Human
cugaggcugggcucccuuccca

SEQ ID NO: 1171851 - RNA, 21 nt, Human
cugauuuuuuuuuccuucagu

SEQ ID NO: 1171852 - RNA, 22 nt, Human
cugauuuuuuuuuccuucagug

SEQ ID NO: 1171853 - RNA, 23 nt, Human
cugauuuuuuuuuccuucagugc

SEQ ID NO: 1171854 - RNA, 16 nt, Human
cugauuuuuuuuuccu

SEQ ID NO: 1171855 - RNA, 18 nt, Human
cugauuuuuuuuuccuuc

SEQ ID NO: 1171856 - RNA, 19 nt, Human
cugauuuuuuuuuccuuca

SEQ ID NO: 1171857 - RNA, 20 nt, Human
cugauuuuuuuuuccuucag

SEQ ID NO: 1171858 - RNA, 17 nt, Human
cugauggugcaaugacc

SEQ ID NO: 1171859 - RNA, 19 nt, Human
cugauggugcaaugaccuu

SEQ ID NO: 1171860 - RNA, 20 nt, Human
cugauggugcaaugaccuuu

SEQ ID NO: 1171861 - RNA, 21 nt, Human
cugauggugcaaugaccuuuc

SEQ ID NO: 1171862 - RNA, 17 nt, Human
cugauugugucucuugg

SEQ ID NO: 1171863 - RNA, 21 nt, Human
cugauugugucucuugguccu

SEQ ID NO: 1171864 - RNA, 18 nt, Human
cugcaauaaggggagagu

SEQ ID NO: 1171865 - RNA, 22 nt, Human
cugcacaagcugcacccucagg

SEQ ID NO: 1171866 - RNA, 13 nt, Human
cugcacccucagg

SEQ ID NO: 1171867 - RNA, 14 nt, Human
cugcacccucaggc

SEQ ID NO: 1171868 - RNA, 16 nt, Human
cugcacccucaggcag

SEQ ID NO: 1171869 - RNA, 22 nt, Human
cugcaccggcuggccuggcccc

SEQ ID NO: 1171870 - RNA, 23 nt, Human
cugcaccggcuggccuggccccu

SEQ ID NO: 1171871 - RNA, 12 nt, Human
cugcaccgggcc

SEQ ID NO: 1171872 - RNA, 14 nt, Human
cugcaccgggccac

SEQ ID NO: 1171873 - RNA, 15 nt, Human
cugcacuccccugcu

SEQ ID NO: 1171874 - RNA, 16 nt, Human
cugcacuccccugcug

SEQ ID NO: 1171875 - RNA, 17 nt, Human
cugcacuccccugcugg

SEQ ID NO: 1171876 - RNA, 18 nt, Human
cugcacuccccugcuggg

SEQ ID NO: 1171877 - RNA, 18 nt, Human
cugcacuugcagacucua

SEQ ID NO: 1171878 - RNA, 16 nt, Human
cugcaucguuucaucu

SEQ ID NO: 1171879 - RNA, 22 nt, Human
cugcaucguuucaucuuccaac

SEQ ID NO: 1171880 - RNA, 23 nt, Human
cugcacuugcagacucuacagag

SEQ ID NO: 1171881 - RNA, 19 nt, Human
cugcaguugccagucaccc

SEQ ID NO: 1171882 - RNA, 21 nt, Human
cugcaguugccagucaccccg

SEQ ID NO: 1171883 - RNA, 22 nt, Human
cugcaguugccagucaccccgg

SEQ ID NO: 1171884 - RNA, 18 nt, Human
cugcaugcgggcuuccuc

SEQ ID NO: 1171885 - RNA, 22 nt, Human
cugcaugcgggcuuccuccugg

SEQ ID NO: 1171886 - RNA, 18 nt, Human
cugccaaugggagcucau

SEQ ID NO: 1171887 - RNA, 19 nt, Human
cugccaaugggagcucaug

SEQ ID NO: 1171888 - RNA, 18 nt, Human
cugcccacucccugcaac

SEQ ID NO: 1171889 - RNA, 17 nt, Human
cugcccaccuggccucu

SEQ ID NO: 1171890 - RNA, 18 nt, Human
cugcccaccuggccucug

SEQ ID NO: 1171891 - RNA, 19 nt, Human
cugcccaccuggccucugc

SEQ ID NO: 1171892 - RNA, 20 nt, Human
cugcccaccuggccucugca

SEQ ID NO: 1171893 - RNA, 22 nt, Human
cugcccaccuggccucugcacu

SEQ ID NO: 1171894 - RNA, 14 nt, Human
cugcccacucccug

SEQ ID NO: 1171895 - RNA, 15 nt, Human
cugcccacucccugc

SEQ ID NO: 1171896 - RNA, 16 nt, Human
cugcccacucccugca

SEQ ID NO: 1171897 - RNA, 11 nt, Human
cugccaggcau

SEQ ID NO: 1171898 - RNA, 13 nt, Human
cugccaggcaugg

SEQ ID NO: 1171899 - RNA, 23 nt, Human
cugccaucucaccuccugcuggg

SEQ ID NO: 1171900 - RNA, 21 nt, Human
cugccaucucaccuccugcug

SEQ ID NO: 1171901 - RNA, 14 nt, Human
cugccaugccagcu

SEQ ID NO: 1171902 - RNA, 15 nt, Human
cugccaugccagcuu

SEQ ID NO: 1171903 - RNA, 14 nt, Human
cugcccaccuggcc

SEQ ID NO: 1171904 - RNA, 15 nt, Human
cugcccaccuggccu

SEQ ID NO: 1171905 - RNA, 12 nt, Human
cugccgcagccc

SEQ ID NO: 1171906 - RNA, 13 nt, Human
cugccgcagcccu

SEQ ID NO: 1171907 - RNA, 20 nt, Human
cugccgcagcccugcagagg

SEQ ID NO: 1171908 - RNA, 21 nt, Human
cugccgcagcccugcagaggg

SEQ ID NO: 1171909 - RNA, 22 nt, Human
cugccgcagcccugcagagggc

SEQ ID NO: 1171910 - RNA, 23 nt, Human
cugccgcagcccugcagagggca

SEQ ID NO: 1171911 - RNA, 14 nt, Human
cugccgcagcccug

SEQ ID NO: 1171912 - RNA, 19 nt, Human
cugccucagccucccaaag

SEQ ID NO: 1171913 - RNA, 15 nt, Human
cugccucagccuccc

SEQ ID NO: 1171914 - RNA, 18 nt, Human
cugcgguccacccaggag

SEQ ID NO: 1171915 - RNA, 19 nt, Human
cugcgguccacccaggagc

SEQ ID NO: 1171916 - RNA, 20 nt, Human
cugcgguccacccaggagcc

SEQ ID NO: 1171917 - RNA, 17 nt, Human
cugccucugacacacag

SEQ ID NO: 1171918 - RNA, 18 nt, Human
cugccucugacacacagc

SEQ ID NO: 1171919 - RNA, 21 nt, Human
cugccucugacacacagcucu

SEQ ID NO: 1171920 - RNA, 22 nt, Human
cugccugcccaggccccugcca

SEQ ID NO: 1171921 - RNA, 21 nt, Human
cugggauuacaagcgugagcc

SEQ ID NO: 1171922 - RNA, 20 nt, Human
cuggguaacuagggaagaua

SEQ ID NO: 1171923 - RNA, 15 nt, Human
cugggcuucaguggc

SEQ ID NO: 1171924 - RNA, 17 nt, Human
cugggcuucaguggcag

SEQ ID NO: 1171925 - RNA, 22 nt, Human
cugggcuuggggaccagagcug

SEQ ID NO: 1171926 - RNA, 18 nt, Human
cugggcuugucuguagau

SEQ ID NO: 1171927 - RNA, 14 nt, Human
cugggggcugggca

SEQ ID NO: 1171928 - RNA, 18 nt, Human
cugggggcugggcagagg

SEQ ID NO: 1171929 - RNA, 19 nt, Human
cuguacgucugacaggcaa

SEQ ID NO: 1171930 - RNA, 20 nt, Human
cuguacgucugacaggcaau

SEQ ID NO: 1171931 - RNA, 17 nt, Human
cuguacaugaaaacaca

SEQ ID NO: 1171932 - RNA, 20 nt, Human
cuguacaugaaaacacauuu

SEQ ID NO: 1171933 - RNA, 21 nt, Human
cuguacaugaaaacacauuuu

SEQ ID NO: 1171934 - RNA, 14 nt, Human
cuguacgucugaca

SEQ ID NO: 1171935 - RNA, 15 nt, Human
cuguacgucugacag

SEQ ID NO: 1171936 - RNA, 16 nt, Human
cuguacgucugacagg

SEQ ID NO: 1171937 - RNA, 18 nt, Human
cuguacgucugacaggca

SEQ ID NO: 1171938 - RNA, 21 nt, Human
cuguaucccaugagccucagc

SEQ ID NO: 1171939 - RNA, 22 nt, Human
cuguaucccaugagccucagca

SEQ ID NO: 1171940 - RNA, 20 nt, Human
cuguaucccaugagccucag

SEQ ID NO: 1171941 - RNA, 20 nt, Human
cuguauuuuguuuuugucuu

SEQ ID NO: 1171942 - RNA, 15 nt, Human
cugucaauuacagga

SEQ ID NO: 1171943 - RNA, 16 nt, Human
cugucaauuacaggaa

SEQ ID NO: 1171944 - RNA, 17 nt, Human
cugguggcagcucaccu

SEQ ID NO: 1171945 - RNA, 18 nt, Human
cugguggcagcucaccuc

SEQ ID NO: 1171946 - RNA, 20 nt, Human
cugguggcagcucaccucuc

SEQ ID NO: 1171947 - RNA, 15 nt, Human
cugguggcagcugcg

SEQ ID NO: 1171948 - RNA, 14 nt, Human
cugguggcaguggg

SEQ ID NO: 1171949 - RNA, 18 nt, Human
cugguggcagugggagcu

SEQ ID NO: 1171950 - RNA, 21 nt, Human
cugguggcagcucaccucucc

SEQ ID NO: 1171951 - RNA, 19 nt, Human
cugguggcagugggagcug

SEQ ID NO: 1171952 - RNA, 21 nt, Human
cugguuagagguucccuuuga

SEQ ID NO: 1171953 - RNA, 22 nt, Human
cugguuagagguucccuuugac

SEQ ID NO: 1171954 - RNA, 19 nt, Human
cuguaauccuagcacuuug

SEQ ID NO: 1171955 - RNA, 14 nt, Human
cuguaauuugugau

SEQ ID NO: 1171956 - RNA, 15 nt, Human
cuguaauuugugaua

SEQ ID NO: 1171957 - RNA, 17 nt, Human
cuguaauuugugauaca

SEQ ID NO: 1171958 - RNA, 15 nt, Human
cuguacagagcccac

SEQ ID NO: 1171959 - RNA, 18 nt, Human
cuguacagagcccacgcc

SEQ ID NO: 1171960 - RNA, 22 nt, Human
cuguacagagcccacgccccca

SEQ ID NO: 1171961 - RNA, 14 nt, Human
cugugggcccccaa

SEQ ID NO: 1171962 - RNA, 21 nt, Human
cuguggguuucuaaagcugcc

SEQ ID NO: 1171963 - RNA, 22 nt, Human
cuguggguuucuaaagcugcca

SEQ ID NO: 1171964 - RNA, 19 nt, Human
cugugucuuuaaaugcugc

SEQ ID NO: 1171965 - RNA, 20 nt, Human
cugugucuuuaaaugcugcu

SEQ ID NO: 1171966 - RNA, 21 nt, Human
cugugucuuuaaaugcugcuu

SEQ ID NO: 1171967 - RNA, 20 nt, Human
cugugucuuuuuucacuaca

SEQ ID NO: 1171968 - RNA, 18 nt, Human
cugugugugcgccuacag

SEQ ID NO: 1171969 - RNA, 18 nt, Human
cugucaauuacaggaagu

SEQ ID NO: 1171970 - RNA, 19 nt, Human
cugucaauuacaggaagua

SEQ ID NO: 1171971 - RNA, 21 nt, Human
cugucauuugagcagggcuca

SEQ ID NO: 1171972 - RNA, 22 nt, Human
cugucauuugagcagggcucag

SEQ ID NO: 1171973 - RNA, 23 nt, Human
cugucauuugagcagggcucagc

SEQ ID NO: 1171974 - RNA, 18 nt, Human
cugucuucaguaagccgu

SEQ ID NO: 1171975 - RNA, 15 nt, Human
cugugaaaggaaaga

SEQ ID NO: 1171976 - RNA, 16 nt, Human
cugugaaaggaaagag

SEQ ID NO: 1171977 - RNA, 22 nt, Human
cugugaaaggaaagagggaggu

SEQ ID NO: 1171978 - RNA, 15 nt, Human
cugugauggggcccu

SEQ ID NO: 1171979 - RNA, 16 nt, Human
cugugauggggcccug

SEQ ID NO: 1171980 - RNA, 21 nt, Human
cugugauggggcccugccucc

SEQ ID NO: 1171981 - RNA, 23 nt, Human
cugugauggggcccugccuccuu

SEQ ID NO: 1171982 - RNA, 17 nt, Human
cugugauggggcccugc

SEQ ID NO: 1171983 - RNA, 14 nt, Human
cugugccaugugcc

SEQ ID NO: 1171984 - RNA, 15 nt, Human
cugugccaugugcca

SEQ ID NO: 1171985 - RNA, 19 nt, Human
cugugcccuaaaguguauu

SEQ ID NO: 1171986 - RNA, 14 nt, Human
cuguuuuauaauuu

SEQ ID NO: 1171987 - RNA, 15 nt, Human
cuguuuuauaauuuu

SEQ ID NO: 1171988 - RNA, 19 nt, Human
cuguuuuauaauuuuguga

SEQ ID NO: 1171989 - RNA, 13 nt, Human
cuguuuucucuug

SEQ ID NO: 1171990 - RNA, 16 nt, Human
cuuaaaaaguggaaaa

SEQ ID NO: 1171991 - RNA, 17 nt, Human
cuuaaaaaguggaaaaa

SEQ ID NO: 1171992 - RNA, 17 nt, Human
cuguuugcuaagugagg

SEQ ID NO: 1171993 - RNA, 19 nt, Human
cuguuugcuaagugaggau

SEQ ID NO: 1171994 - RNA, 17 nt, Human
cuguugcccaggcuggc

SEQ ID NO: 1171995 - RNA, 18 nt, Human
cuguugcccaggcuggcg

SEQ ID NO: 1171996 - RNA, 17 nt, Human
cuguuuagauaauacac

SEQ ID NO: 1171997 - RNA, 18 nt, Human
cuguuuagauaauacacc

SEQ ID NO: 1171998 - RNA, 15 nt, Human
cuguuucaaacuuua

SEQ ID NO: 1171999 - RNA, 17 nt, Human
cuguuucaaacuuuacu

SEQ ID NO: 1172000 - RNA, 16 nt, Human
cuguuaauaguucagg

SEQ ID NO: 1172001 - RNA, 15 nt, Human
cuguucuuuccaaag

SEQ ID NO: 1172002 - RNA, 16 nt, Human
cuguucuuuccaaagu

SEQ ID NO: 1172003 - RNA, 19 nt, Human
cuguucuuuccaaaguaca

SEQ ID NO: 1172004 - RNA, 21 nt, Human
cuguucuuuccaaaguacacu

SEQ ID NO: 1172005 - RNA, 13 nt, Human
cuguucuuucugg

SEQ ID NO: 1172006 - RNA, 14 nt, Human
cuguucuuucuggc

SEQ ID NO: 1172007 - RNA, 21 nt, Human
cuguucuuucuggcuaugcau

SEQ ID NO: 1172008 - RNA, 23 nt, Human
cuguucuuucuggcuaugcauuu

SEQ ID NO: 1172009 - RNA, 12 nt, Human
cuguugcccagg

SEQ ID NO: 1172010 - RNA, 13 nt, Human
cuguugcccaggc

SEQ ID NO: 1172011 - RNA, 14 nt, Human
cuguugcccaggcu

SEQ ID NO: 1172012 - RNA, 15 nt, Human
cuguugcccaggcug

SEQ ID NO: 1172013 - RNA, 16 nt, Human
cuguugcccaggcugg

SEQ ID NO: 1172014 - RNA, 23 nt, Human
cuuaagaagacugcauuauauuu

SEQ ID NO: 1172015 - RNA, 12 nt, Human
cuuaaaaauggu

SEQ ID NO: 1172016 - RNA, 20 nt, Human
cuuaauucuuagcucauucu

SEQ ID NO: 1172017 - RNA, 20 nt, Human
cuuagaagucacacaguauu

SEQ ID NO: 1172018 - RNA, 20 nt, Human
cuuagaaaaaccaccaccau

SEQ ID NO: 1172019 - RNA, 13 nt, Human
cuuacuguacaug

SEQ ID NO: 1172020 - RNA, 20 nt, Human
cuuaccugccaggaagccag

SEQ ID NO: 1172021 - RNA, 11 nt, Human
cuuagacaguc

SEQ ID NO: 1172022 - RNA, 23 nt, Human
cuuagguuggcaaaaaggcagga

SEQ ID NO: 1172023 - RNA, 14 nt, Human
cuuagucacugaga

SEQ ID NO: 1172024 - RNA, 17 nt, Human
cuucaaggauccugagc

SEQ ID NO: 1172025 - RNA, 18 nt, Human
cuucaaggauccugagcc

SEQ ID NO: 1172026 - RNA, 19 nt, Human
cuucaaggauccugagcca

SEQ ID NO: 1172027 - RNA, 20 nt, Human
cuucaaggauccugagccag

SEQ ID NO: 1172028 - RNA, 22 nt, Human
cuuagucacugagacagcccgg

SEQ ID NO: 1172029 - RNA, 21 nt, Human
cuuagucacugagacagcccg

SEQ ID NO: 1172030 - RNA, 17 nt, Human
cuucaaauccuugaaga

SEQ ID NO: 1172031 - RNA, 23 nt, Human
cuucaaggauccugagccagauu

SEQ ID NO: 1172032 - RNA, 21 nt, Human
cuucaaggauccugagccaga

SEQ ID NO: 1172033 - RNA, 22 nt, Human
cuucaaggauccugagccagau

SEQ ID NO: 1172034 - RNA, 14 nt, Human
cuucacauauugau

SEQ ID NO: 1172035 - RNA, 23 nt, Human
cuucacauauugauuuccguuaa

SEQ ID NO: 1172036 - RNA, 20 nt, Human
cuucauucaacccaccugcg

SEQ ID NO: 1172037 - RNA, 13 nt, Human
cuuccacaagagc

SEQ ID NO: 1172038 - RNA, 14 nt, Human
cuuccacaagagcc

SEQ ID NO: 1172039 - RNA, 15 nt, Human
cuuccacaagagccc

SEQ ID NO: 1172040 - RNA, 15 nt, Human
cuucaguaagccgug

SEQ ID NO: 1172041 - RNA, 14 nt, Human
cuucagugccaaaa

SEQ ID NO: 1172042 - RNA, 14 nt, Human
cuucagccucccga

SEQ ID NO: 1172043 - RNA, 16 nt, Human
cuucagccucccgagu

SEQ ID NO: 1172044 - RNA, 20 nt, Human
cuucagccucccgaguagcu

SEQ ID NO: 1172045 - RNA, 15 nt, Human
cuucagccugaaaga

SEQ ID NO: 1172046 - RNA, 16 nt, Human
cuucagcgguuuauau

SEQ ID NO: 1172047 - RNA, 19 nt, Human
cuucagcugacuuuucugu

SEQ ID NO: 1172048 - RNA, 14 nt, Human
cuucaguaagccgu

SEQ ID NO: 1172049 - RNA, 16 nt, Human
cuuccacaagagccca

SEQ ID NO: 1172050 - RNA, 19 nt, Human
cuuccagauccuggaaauc

SEQ ID NO: 1172051 - RNA, 17 nt, Human
cuucgcuccugugucuu

SEQ ID NO: 1172052 - RNA, 20 nt, Human
cuucggccuccauccugagg

SEQ ID NO: 1172053 - RNA, 19 nt, Human
cuucgggaggucgaggcag

SEQ ID NO: 1172054 - RNA, 16 nt, Human
cuucucacugccaugc

SEQ ID NO: 1172055 - RNA, 21 nt, Human
cuucucacugccaugccagcu

SEQ ID NO: 1172056 - RNA, 17 nt, Human
cuucuccacccugcucu

SEQ ID NO: 1172057 - RNA, 18 nt, Human
cuucuccacccugcucuc

SEQ ID NO: 1172058 - RNA, 21 nt, Human
cuucuccacccugcucuccga

SEQ ID NO: 1172059 - RNA, 18 nt, Human
cuugcccuggugccucac

SEQ ID NO: 1172060 - RNA, 14 nt, Human
cuugcucugcugac

SEQ ID NO: 1172061 - RNA, 16 nt, Human
cuugcucugcugacag

SEQ ID NO: 1172062 - RNA, 17 nt, Human
cuugcucugcugacaga

SEQ ID NO: 1172063 - RNA, 20 nt, Human
cuugcuucaaccccaugaga

SEQ ID NO: 1172064 - RNA, 16 nt, Human
cuuggaaaugggagac

SEQ ID NO: 1172065 - RNA, 13 nt, Human
cuuggaagcuccg

SEQ ID NO: 1172066 - RNA, 14 nt, Human
cuuggaagcuccgc

SEQ ID NO: 1172067 - RNA, 13 nt, Human
cuuggaggaagga

SEQ ID NO: 1172068 - RNA, 19 nt, Human
cuuguaaaggaauuuaaaa

SEQ ID NO: 1172069 - RNA, 16 nt, Human
cuuggggggcugaggu

SEQ ID NO: 1172070 - RNA, 22 nt, Human
cuuggggggcugaggugggagg

SEQ ID NO: 1172071 - RNA, 22 nt, Human
cuuggggaccagagcugccacc

SEQ ID NO: 1172072 - RNA, 16 nt, Human
cuuggggaccagagcu

SEQ ID NO: 1172073 - RNA, 15 nt, Human
cuuggggggcugagg

SEQ ID NO: 1172074 - RNA, 14 nt, Human
cuugggccacugug

SEQ ID NO: 1172075 - RNA, 18 nt, Human
cuugggccacugugaaga

SEQ ID NO: 1172076 - RNA, 13 nt, Human
cuugggcuucauc

SEQ ID NO: 1172077 - RNA, 22 nt, Human
cuugggcuucauccuccucaga

SEQ ID NO: 1172078 - RNA, 21 nt, Human
cuuggggaccagagcugccac

SEQ ID NO: 1172079 - RNA, 22 nt, Human
cuuggaggaaggaaacccagcu

SEQ ID NO: 1172080 - RNA, 16 nt, Human
cuuggcugcagggagu

SEQ ID NO: 1172081 - RNA, 17 nt, Human
cuuggcugcagggaguc

SEQ ID NO: 1172082 - RNA, 16 nt, Human
cuuguaaauagcucag

SEQ ID NO: 1172083 - RNA, 21 nt, Human
cuuguguguuuauugucaaag

SEQ ID NO: 1172084 - RNA, 13 nt, Human
cuuuauaauucua

SEQ ID NO: 1172085 - RNA, 21 nt, Human
cuuuauuuucuauaauuuaaa

SEQ ID NO: 1172086 - RNA, 18 nt, Human
cuuuccaaaugcccagcu

SEQ ID NO: 1172087 - RNA, 19 nt, Human
cuuuccaaaugcccagcuu

SEQ ID NO: 1172088 - RNA, 22 nt, Human
cuuuccaaaugcccagcuuaaa

SEQ ID NO: 1172089 - RNA, 13 nt, Human
cuuuccacagaag

SEQ ID NO: 1172090 - RNA, 15 nt, Human
cuuuggacccugagg

SEQ ID NO: 1172091 - RNA, 16 nt, Human
cuuuggacccugaggc

SEQ ID NO: 1172092 - RNA, 17 nt, Human
cuuuggacccugaggcc

SEQ ID NO: 1172093 - RNA, 18 nt, Human
cuuuggacccugaggccc

SEQ ID NO: 1172094 - RNA, 19 nt, Human
cuuuggacccugaggccca

SEQ ID NO: 1172095 - RNA, 16 nt, Human
cuuucccaucuuccaa

SEQ ID NO: 1172096 - RNA, 13 nt, Human
cuuugggaggcca

SEQ ID NO: 1172097 - RNA, 18 nt, Human
cuuuguccccaccgcaga

SEQ ID NO: 1172098 - RNA, 22 nt, Human
cuuuguccccaccgcagacagg

SEQ ID NO: 1172099 - RNA, 23 nt, Human
cuuugggaggccaaggugggagg

SEQ ID NO: 1172100 - RNA, 14 nt, Human
cuuugugauuuuug

SEQ ID NO: 1172101 - RNA, 17 nt, Human
cuuugugauuuuuguaa

SEQ ID NO: 1172102 - RNA, 18 nt, Human
cuuugugauuuuuguaau

SEQ ID NO: 1172103 - RNA, 19 nt, Human
cuuugugauuuuuguaauu

SEQ ID NO: 1172104 - RNA, 14 nt, Human
cuuuguucuggcuc

SEQ ID NO: 1172105 - RNA, 15 nt, Human
cuuuguucuggcucu

SEQ ID NO: 1172106 - RNA, 20 nt, Human
cuuuucauaaccuagccuua

SEQ ID NO: 1172107 - RNA, 22 nt, Human
cuuuucauaaccuagccuuaga

SEQ ID NO: 1172108 - RNA, 18 nt, Human
cuuuguuuguugucagcu

SEQ ID NO: 1172109 - RNA, 20 nt, Human
cuuuguuuguugucagcuga

SEQ ID NO: 1172110 - RNA, 18 nt, Human
cuuuucuguccgagcuuu

SEQ ID NO: 1172111 - RNA, 23 nt, Human
cuuuucuguccgagcuuugaaaa

SEQ ID NO: 1172112 - RNA, 23 nt, Human
cuuuucuugcaugaggcuagugu

SEQ ID NO: 1172113 - RNA, 16 nt, Human
cuuuucuuucagccaa

SEQ ID NO: 1172114 - RNA, 16 nt, Human
gaaaacaugcuacaca

SEQ ID NO: 1172115 - RNA, 15 nt, Human
gaaaacguggcugcu

SEQ ID NO: 1172116 - RNA, 16 nt, Human
gaaaacguggcugcuu

SEQ ID NO: 1172117 - RNA, 18 nt, Human
gaaaacguggcugcuuca

SEQ ID NO: 1172118 - RNA, 19 nt, Human
gaaaacguggcugcuucaa

SEQ ID NO: 1172119 - RNA, 22 nt, Human
gaaaacaauaacgauaaaagac

SEQ ID NO: 1172120 - RNA, 13 nt, Human
gaaaacacauuuu

SEQ ID NO: 1172121 - RNA, 14 nt, Human
gaaaacacauuuuu

SEQ ID NO: 1172122 - RNA, 12 nt, Human
gaaaacaugcua

SEQ ID NO: 1172123 - RNA, 14 nt, Human
gaaaacaugcuaca

SEQ ID NO: 1172124 - RNA, 15 nt, Human
gaaaacaugcuacac

SEQ ID NO: 1172125 - RNA, 16 nt, Human
cuuuugagcauuuaga

SEQ ID NO: 1172126 - RNA, 21 nt, Human
cuuuugagugccuuacacaau

SEQ ID NO: 1172127 - RNA, 14 nt, Human
cuuuuuuggcugcu

SEQ ID NO: 1172128 - RNA, 15 nt, Human
cuuuuuuggcugcug

SEQ ID NO: 1172129 - RNA, 23 nt, Human
gaaaaaggaugcacagaguuguu

SEQ ID NO: 1172130 - RNA, 16 nt, Human
cuuuuuuggcugcuga

SEQ ID NO: 1172131 - RNA, 20 nt, Human
gaaaaucuuauaauuuaaaa

SEQ ID NO: 1172132 - RNA, 16 nt, Human
gaaacagccugugucu

SEQ ID NO: 1172133 - RNA, 17 nt, Human
gaaacagccugugucuu

SEQ ID NO: 1172134 - RNA, 18 nt, Human
gaaacagcuaaugggaca

SEQ ID NO: 1172135 - RNA, 19 nt, Human
gaaaaucuuauaauuuaaa

SEQ ID NO: 1172136 - RNA, 16 nt, Human
gaaaaucagccugcuc

SEQ ID NO: 1172137 - RNA, 18 nt, Human
gaaaaucagccugcucca

SEQ ID NO: 1172138 - RNA, 12 nt, Human
gaaaauaucacu

SEQ ID NO: 1172139 - RNA, 21 nt, Human
gaaaauauacuguaaagaaag

SEQ ID NO: 1172140 - RNA, 23 nt, Human
gaaaauauacuguaaagaaagag

SEQ ID NO: 1172141 - RNA, 14 nt, Human
gaaaaucagccugc

SEQ ID NO: 1172142 - RNA, 19 nt, Human
gaaaauaacgauaaaagac

SEQ ID NO: 1172143 - RNA, 13 nt, Human
gaaaagcugcuga

SEQ ID NO: 1172144 - RNA, 17 nt, Human
gaaaagcugcugacagu

SEQ ID NO: 1172145 - RNA, 19 nt, Human
gaaaagcugcugacagugu

SEQ ID NO: 1172146 - RNA, 19 nt, Human
gaaaauauacuguaaagaa

SEQ ID NO: 1172147 - RNA, 20 nt, Human
gaaaauauacuguaaagaaa

SEQ ID NO: 1172148 - RNA, 11 nt, Human
gaaacauuugg

SEQ ID NO: 1172149 - RNA, 20 nt, Human
gaaacagccugugucuuuaa

SEQ ID NO: 1172150 - RNA, 13 nt, Human
gaaauauaauuga

SEQ ID NO: 1172151 - RNA, 17 nt, Human
gaaauauaggaacuuaa

SEQ ID NO: 1172152 - RNA, 21 nt, Human
gaaauaucugaaaauguaugu

SEQ ID NO: 1172153 - RNA, 17 nt, Human
gaaauuuguuauaauga

SEQ ID NO: 1172154 - RNA, 13 nt, Human
gaaauauuauguu

SEQ ID NO: 1172155 - RNA, 16 nt, Human
gaaauauuauguuaaa

SEQ ID NO: 1172156 - RNA, 14 nt, Human
gaaaugggcagagc

SEQ ID NO: 1172157 - RNA, 20 nt, Human
gaaaugggcagagcagagac

SEQ ID NO: 1172158 - RNA, 15 nt, Human
gaaaugggcagagca

SEQ ID NO: 1172159 - RNA, 16 nt, Human
gaaccaccacacccag

SEQ ID NO: 1172160 - RNA, 17 nt, Human
gaaccaccacacccagc

SEQ ID NO: 1172161 - RNA, 15 nt, Human
gaacagacuggaagc

SEQ ID NO: 1172162 - RNA, 16 nt, Human
gaacagacuggaagca

SEQ ID NO: 1172163 - RNA, 19 nt, Human
gaacagacuggaagcacag

SEQ ID NO: 1172164 - RNA, 21 nt, Human
gaaccacaucuugcucugcug

SEQ ID NO: 1172165 - RNA, 22 nt, Human
gaacuagaguuuagcuggaaaa

SEQ ID NO: 1172166 - RNA, 22 nt, Human
gaacuuguaaaggaauuuaaaa

SEQ ID NO: 1172167 - RNA, 21 nt, Human
gaagaagcaccaaucaugaau

SEQ ID NO: 1172168 - RNA, 21 nt, Human
gaacuuguaaaggaauuuaaa

SEQ ID NO: 1172169 - RNA, 17 nt, Human
gaacuuggcgcugcccc

SEQ ID NO: 1172170 - RNA, 23 nt, Human
gaacuugguucccauuugcuccu

SEQ ID NO: 1172171 - RNA, 13 nt, Human
gaacuuggcgcug

SEQ ID NO: 1172172 - RNA, 15 nt, Human
gaacuuggcgcugcc

SEQ ID NO: 1172173 - RNA, 16 nt, Human
gaacuuggcgcugccc

SEQ ID NO: 1172174 - RNA, 14 nt, Human
gaacucccuuucaa

SEQ ID NO: 1172175 - RNA, 15 nt, Human
gaacucccuuucaac

SEQ ID NO: 1172176 - RNA, 22 nt, Human
gaacuggguacuuguggacaca

SEQ ID NO: 1172177 - RNA, 22 nt, Human
gaacuuccagauccuggaaauc

SEQ ID NO: 1172178 - RNA, 14 nt, Human
gaagcggcuggcag

SEQ ID NO: 1172179 - RNA, 21 nt, Human
gaagccuuggggcugaugcag

SEQ ID NO: 1172180 - RNA, 20 nt, Human
gaagcccaggaaaggcucca

SEQ ID NO: 1172181 - RNA, 21 nt, Human
gaagcccaggaaaggcuccag

SEQ ID NO: 1172182 - RNA, 22 nt, Human
gaagcccaggaaaggcuccagg

SEQ ID NO: 1172183 - RNA, 23 nt, Human
gaagcccaggaaaggcuccagga

SEQ ID NO: 1172184 - RNA, 19 nt, Human
gaagacucauucuucugua

SEQ ID NO: 1172185 - RNA, 21 nt, Human
gaagacucauucuucuguacg

SEQ ID NO: 1172186 - RNA, 14 nt, Human
gaagaagcucucuc

SEQ ID NO: 1172187 - RNA, 17 nt, Human
gaagacugcauuauauu

SEQ ID NO: 1172188 - RNA, 15 nt, Human
gaagccagcaggcuc

SEQ ID NO: 1172189 - RNA, 16 nt, Human
gaagccagcaggcucu

SEQ ID NO: 1172190 - RNA, 19 nt, Human
gaagccagcaggcucucag

SEQ ID NO: 1172191 - RNA, 14 nt, Human
gaaggccccgccca

SEQ ID NO: 1172192 - RNA, 15 nt, Human
gaaggccccgcccag

SEQ ID NO: 1172193 - RNA, 16 nt, Human
gaaggccccgcccagg

SEQ ID NO: 1172194 - RNA, 17 nt, Human
gaaggccccgcccaggc

SEQ ID NO: 1172195 - RNA, 14 nt, Human
gaaggaaacccagc

SEQ ID NO: 1172196 - RNA, 17 nt, Human
gaaggaaacccagcucu

SEQ ID NO: 1172197 - RNA, 18 nt, Human
gaaggaaacccagcucug

SEQ ID NO: 1172198 - RNA, 19 nt, Human
gaaggaaacccagcucugg

SEQ ID NO: 1172199 - RNA, 12 nt, Human
gaaggauacaaa

SEQ ID NO: 1172200 - RNA, 19 nt, Human
gaaggauacaaaagcaugu

SEQ ID NO: 1172201 - RNA, 21 nt, Human
gaaggauacaaaagcauguga

SEQ ID NO: 1172202 - RNA, 12 nt, Human
gaaguuucugcc

SEQ ID NO: 1172203 - RNA, 20 nt, Human
gaaguuucugccgcagcccu

SEQ ID NO: 1172204 - RNA, 14 nt, Human
gaauaacauguaau

SEQ ID NO: 1172205 - RNA, 14 nt, Human
gaauacuuuauaaa

SEQ ID NO: 1172206 - RNA, 14 nt, Human
gaauagcugggacu

SEQ ID NO: 1172207 - RNA, 15 nt, Human
gaauagcugggacua

SEQ ID NO: 1172208 - RNA, 18 nt, Human
gaauccagacccggcugc

SEQ ID NO: 1172209 - RNA, 16 nt, Human
gaaucucaaauaacua

SEQ ID NO: 1172210 - RNA, 19 nt, Human
gaaugaaacccccacacac

SEQ ID NO: 1172211 - RNA, 20 nt, Human
gaaugaaacccccacacaca

SEQ ID NO: 1172212 - RNA, 14 nt, Human
gaaugaaagggccc

SEQ ID NO: 1172213 - RNA, 19 nt, Human
gaaugaaagggcccagaga

SEQ ID NO: 1172214 - RNA, 21 nt, Human
gaaugaaacccccacacacac

SEQ ID NO: 1172215 - RNA, 21 nt, Human
gaaugaaagggcccagagagg

SEQ ID NO: 1172216 - RNA, 13 nt, Human
gagccacugcacc

SEQ ID NO: 1172217 - RNA, 21 nt, Human
gagcagccacauuccugaugc

SEQ ID NO: 1172218 - RNA, 18 nt, Human
gagcagccacauuccuga

SEQ ID NO: 1172219 - RNA, 22 nt, Human
gagccacugcaccgggccacag

SEQ ID NO: 1172220 - RNA, 13 nt, Human
gagccagauuuca

SEQ ID NO: 1172221 - RNA, 12 nt, Human
gagcccacgccc

SEQ ID NO: 1172222 - RNA, 15 nt, Human
gagcccacgccccca

SEQ ID NO: 1172223 - RNA, 16 nt, Human
gagcccacgcccccac

SEQ ID NO: 1172224 - RNA, 12 nt, Human
gagcccaggccu

SEQ ID NO: 1172225 - RNA, 13 nt, Human
gagcccaggccuc

SEQ ID NO: 1172226 - RNA, 14 nt, Human
gagcccaggccucc

SEQ ID NO: 1172227 - RNA, 18 nt, Human
gagcccacgcccccacug

SEQ ID NO: 1172228 - RNA, 20 nt, Human
gagaucaaccccuucgcucc

SEQ ID NO: 1172229 - RNA, 23 nt, Human
gagaucaaccccuucgcuccugu

SEQ ID NO: 1172230 - RNA, 13 nt, Human
gagaucagccugg

SEQ ID NO: 1172231 - RNA, 14 nt, Human
gagaucagccuggg

SEQ ID NO: 1172232 - RNA, 16 nt, Human
gagaucagccugggca

SEQ ID NO: 1172233 - RNA, 19 nt, Human
gagcaaaaucgaugcagug

SEQ ID NO: 1172234 - RNA, 21 nt, Human
gagcaagacgcugugcugccc

SEQ ID NO: 1172235 - RNA, 22 nt, Human
gagcaagacgcugugcugcccu

SEQ ID NO: 1172236 - RNA, 23 nt, Human
gagcaagacgcugugcugcccug

SEQ ID NO: 1172237 - RNA, 17 nt, Human
gagcaccuuagacaguc

SEQ ID NO: 1172238 - RNA, 19 nt, Human
gagcaccuuagacaguccc

SEQ ID NO: 1172239 - RNA, 18 nt, Human
gagcccugguggcagugg

SEQ ID NO: 1172240 - RNA, 14 nt, Human
gagccuccugcccu

SEQ ID NO: 1172241 - RNA, 20 nt, Human
gagccucagcauccuggcac

SEQ ID NO: 1172242 - RNA, 21 nt, Human
gagccucagcauccuggcacc

SEQ ID NO: 1172243 - RNA, 15 nt, Human
gagcccugguggcag

SEQ ID NO: 1172244 - RNA, 16 nt, Human
gagcccugguggcagu

SEQ ID NO: 1172245 - RNA, 17 nt, Human
gagcccugguggcagug

SEQ ID NO: 1172246 - RNA, 20 nt, Human
gagccuccugcccuuaccug

SEQ ID NO: 1172247 - RNA, 22 nt, Human
gagccuccugcccuuaccugcc

SEQ ID NO: 1172248 - RNA, 13 nt, Human
gagcuacaaaugc

SEQ ID NO: 1172249 - RNA, 12 nt, Human
gagcuacaaaug

SEQ ID NO: 1172250 - RNA, 10 nt, Human
gagccuggca

SEQ ID NO: 1172251 - RNA, 15 nt, Human
gagccuggcaagaau

SEQ ID NO: 1172252 - RNA, 13 nt, Human
gagccugggaggu

SEQ ID NO: 1172253 - RNA, 21 nt, Human
gagccugggaggucaaggcug

SEQ ID NO: 1172254 - RNA, 13 nt, Human
gagcugccaccug

SEQ ID NO: 1172255 - RNA, 15 nt, Human
gagcugccaccugcc

SEQ ID NO: 1172256 - RNA, 16 nt, Human
gagcugccaccugccu

SEQ ID NO: 1172257 - RNA, 14 nt, Human
gagcuacaaaugca

SEQ ID NO: 1172258 - RNA, 23 nt, Human
gagcuacacaggggaaaagagga

SEQ ID NO: 1172259 - RNA, 22 nt, Human
gaggaaggaaacccagcucugg

SEQ ID NO: 1172260 - RNA, 14 nt, Human
gaggaauccagacc

SEQ ID NO: 1172261 - RNA, 15 nt, Human
gaggaauccagaccc

SEQ ID NO: 1172262 - RNA, 13 nt, Human
gaggacagggagg

SEQ ID NO: 1172263 - RNA, 22 nt, Human
gaggacagggaggugaccccag

SEQ ID NO: 1172264 - RNA, 23 nt, Human
gaggacagggaggugaccccagg

SEQ ID NO: 1172265 - RNA, 23 nt, Human
gaggaguuugggguaugggagag

SEQ ID NO: 1172266 - RNA, 12 nt, Human
gaggauguucug

SEQ ID NO: 1172267 - RNA, 17 nt, Human
gaggauguucugggaca

SEQ ID NO: 1172268 - RNA, 20 nt, Human
gaggauguucugggacacag

SEQ ID NO: 1172269 - RNA, 16 nt, Human
gaggauugcuugagcu

SEQ ID NO: 1172270 - RNA, 13 nt, Human
gaggcagccccau

SEQ ID NO: 1172271 - RNA, 18 nt, Human
gaggcagccccauucugc

SEQ ID NO: 1172272 - RNA, 22 nt, Human
gaggcagccccauucugccugc

SEQ ID NO: 1172273 - RNA, 23 nt, Human
gaggcagccccauucugccugcc

SEQ ID NO: 1172274 - RNA, 12 nt, Human
gaggccagccuu

SEQ ID NO: 1172275 - RNA, 13 nt, Human
gaggccagccuug

SEQ ID NO: 1172276 - RNA, 14 nt, Human
gaggccuucucuga

SEQ ID NO: 1172277 - RNA, 13 nt, Human
gaggcugggcucc

SEQ ID NO: 1172278 - RNA, 14 nt, Human
gaggcugggcuccc

SEQ ID NO: 1172279 - RNA, 15 nt, Human
gaggcugggcucccu

SEQ ID NO: 1172280 - RNA, 16 nt, Human
gaggcugggcucccuu

SEQ ID NO: 1172281 - RNA, 19 nt, Human
gaggcccccaucuccuuaa

SEQ ID NO: 1172282 - RNA, 14 nt, Human
gaggcccuucucuc

SEQ ID NO: 1172283 - RNA, 23 nt, Human
gaggcccuucucuccagccccug

SEQ ID NO: 1172284 - RNA, 24 nt, Human
gaggcccuucucuccagccccugg

SEQ ID NO: 1172285 - RNA, 23 nt, Human
gagggcacagaaaauggaagaca

SEQ ID NO: 1172286 - RNA, 22 nt, Human
gagggcacagaaaauggaagac

SEQ ID NO: 1172287 - RNA, 13 nt, Human
gagggagugacag

SEQ ID NO: 1172288 - RNA, 14 nt, Human
gagggagugacaga

SEQ ID NO: 1172289 - RNA, 16 nt, Human
gagggagggcuccaga

SEQ ID NO: 1172290 - RNA, 16 nt, Human
gagggagugacagagg

SEQ ID NO: 1172291 - RNA, 22 nt, Human
gaggggccucuuaugggcuggg

SEQ ID NO: 1172292 - RNA, 14 nt, Human
gagggagggagggc

SEQ ID NO: 1172293 - RNA, 15 nt, Human
gagggagggagggcu

SEQ ID NO: 1172294 - RNA, 15 nt, Human
gagggagggcuccag

SEQ ID NO: 1172295 - RNA, 15 nt, Human
gaggggguggccucc

SEQ ID NO: 1172296 - RNA, 22 nt, Human
gaggggggaggugggauccucc

SEQ ID NO: 1172297 - RNA, 15 nt, Human
gaggggggagguggg

SEQ ID NO: 1172298 - RNA, 21 nt, Human
gaggugggauccuccaggugc

SEQ ID NO: 1172299 - RNA, 22 nt, Human
gaggugggauccuccaggugca

SEQ ID NO: 1172300 - RNA, 19 nt, Human
gagguucaaagauauuuug

SEQ ID NO: 1172301 - RNA, 14 nt, Human
gagguucccuuuga

SEQ ID NO: 1172302 - RNA, 19 nt, Human
gagguuuuaaaaaaauccc

SEQ ID NO: 1172303 - RNA, 16 nt, Human
gaguacguugugcauu

SEQ ID NO: 1172304 - RNA, 17 nt, Human
gaguacguugugcauuu

SEQ ID NO: 1172305 - RNA, 18 nt, Human
gaguacguugugcauuug

SEQ ID NO: 1172306 - RNA, 20 nt, Human
gaguacguugugcauuuggu

SEQ ID NO: 1172307 - RNA, 15 nt, Human
gaguacuacaguccu

SEQ ID NO: 1172308 - RNA, 18 nt, Human
gaguacuacaguccuccc

SEQ ID NO: 1172309 - RNA, 19 nt, Human
gaguacuacaguccuccca

SEQ ID NO: 1172310 - RNA, 20 nt, Human
gaguacuacaguccucccau

SEQ ID NO: 1172311 - RNA, 12 nt, Human
gaguccccuguu

SEQ ID NO: 1172312 - RNA, 14 nt, Human
gaguccccuguuug

SEQ ID NO: 1172313 - RNA, 23 nt, Human
gaguccccuguuuguuucugaaa

SEQ ID NO: 1172314 - RNA, 12 nt, Human
gaguagcuggga

SEQ ID NO: 1172315 - RNA, 14 nt, Human
gaguagcugggacu

SEQ ID NO: 1172316 - RNA, 19 nt, Human
gaguagcugggacuacagg

SEQ ID NO: 1172317 - RNA, 22 nt, Human
gagucucacuguugcccaggcu

SEQ ID NO: 1172318 - RNA, 23 nt, Human
gagucucacuguugcccaggcug

SEQ ID NO: 1172319 - RNA, 21 nt, Human
gagucugaaggcuggguucug

SEQ ID NO: 1172320 - RNA, 17 nt, Human
gagucgaggacagggag

SEQ ID NO: 1172321 - RNA, 20 nt, Human
gagucucacuguugcccagg

SEQ ID NO: 1172322 - RNA, 21 nt, Human
gagucucacuguugcccaggc

SEQ ID NO: 1172323 - RNA, 12 nt, Human
gagugggcccaa

SEQ ID NO: 1172324 - RNA, 23 nt, Human
gagugggggaucacagccucuga

SEQ ID NO: 1172325 - RNA, 19 nt, Human
gagugaacaaauuuacaga

SEQ ID NO: 1172326 - RNA, 22 nt, Human
gagugaacaaauuuacagagac

SEQ ID NO: 1172327 - RNA, 23 nt, Human
gagugaacaaauuuacagagaca

SEQ ID NO: 1172328 - RNA, 21 nt, Human
gaguugaaaaucuuauaauuu

SEQ ID NO: 1172329 - RNA, 14 nt, Human
gaguugaagacaga

SEQ ID NO: 1172330 - RNA, 17 nt, Human
gagugugccugaagucc

SEQ ID NO: 1172331 - RNA, 23 nt, Human
gaguucaucuugaauuguaagga

SEQ ID NO: 1172332 - RNA, 23 nt, Human
gauagauaggucagugcaaauac

SEQ ID NO: 1172333 - RNA, 12 nt, Human
gauagccaaggc

SEQ ID NO: 1172334 - RNA, 19 nt, Human
gauagcacagacccugccc

SEQ ID NO: 1172335 - RNA, 20 nt, Human
gauagcacagacccugcccu

SEQ ID NO: 1172336 - RNA, 13 nt, Human
gauagccaaggcc

SEQ ID NO: 1172337 - RNA, 14 nt, Human
gauagccaaggcca

SEQ ID NO: 1172338 - RNA, 22 nt, Human
gaucaaccccuucgcuccugug

SEQ ID NO: 1172339 - RNA, 13 nt, Human
gauacaaugcugu

SEQ ID NO: 1172340 - RNA, 18 nt, Human
gauacaaugcugugcccu

SEQ ID NO: 1172341 - RNA, 17 nt, Human
gauagcacagacccugc

SEQ ID NO: 1172342 - RNA, 18 nt, Human
gauagcacagacccugcc

SEQ ID NO: 1172343 - RNA, 21 nt, Human
gauccugagccagauuucacu

SEQ ID NO: 1172344 - RNA, 16 nt, Human
gaucuuugcagacagg

SEQ ID NO: 1172345 - RNA, 17 nt, Human
gaucuuugcagacaggc

SEQ ID NO: 1172346 - RNA, 15 nt, Human
gaugaaaaaauaaca

SEQ ID NO: 1172347 - RNA, 23 nt, Human
gaucaaccccuucgcuccugugu

SEQ ID NO: 1172348 - RNA, 13 nt, Human
gaucacgccacug

SEQ ID NO: 1172349 - RNA, 14 nt, Human
gaucacgccacugc

SEQ ID NO: 1172350 - RNA, 15 nt, Human
gaucacgccacugca

SEQ ID NO: 1172351 - RNA, 18 nt, Human
gauccuaguuccaccauc

SEQ ID NO: 1172352 - RNA, 16 nt, Human
gaucacgccacugcac

SEQ ID NO: 1172353 - RNA, 11 nt, Human
gauccuccagg

SEQ ID NO: 1172354 - RNA, 12 nt, Human
gauccuccaggu

SEQ ID NO: 1172355 - RNA, 19 nt, Human
gauccucccaccucagccu

SEQ ID NO: 1172356 - RNA, 20 nt, Human
gauccucccaccucagccuc

SEQ ID NO: 1172357 - RNA, 21 nt, Human
gauccucccaccucagccucc

SEQ ID NO: 1172358 - RNA, 14 nt, Human
gauccugagccaga

SEQ ID NO: 1172359 - RNA, 15 nt, Human
gauccugagccagau

SEQ ID NO: 1172360 - RNA, 19 nt, Human
gauccugagccagauuuca

SEQ ID NO: 1172361 - RNA, 14 nt, Human
gaugccugguggca

SEQ ID NO: 1172362 - RNA, 11 nt, Human
gaugagaaagg

SEQ ID NO: 1172363 - RNA, 22 nt, Human
gaugagaaagguugaagcacca

SEQ ID NO: 1172364 - RNA, 23 nt, Human
gaugagaaauaaaguuucuguug

SEQ ID NO: 1172365 - RNA, 21 nt, Human
gaugcacagaguuguuacauu

SEQ ID NO: 1172366 - RNA, 23 nt, Human
gauggugcaaugaccuuucaaua

SEQ ID NO: 1172367 - RNA, 20 nt, Human
gauggugcaaugaccuuuca

SEQ ID NO: 1172368 - RNA, 16 nt, Human
gauguucugggacaca

SEQ ID NO: 1172369 - RNA, 21 nt, Human
gauguucuuucacccuuuucu

SEQ ID NO: 1172370 - RNA, 19 nt, Human
gauguugaaaaaguucugc

SEQ ID NO: 1172371 - RNA, 14 nt, Human
gauguuuuccauga

SEQ ID NO: 1172372 - RNA, 15 nt, Human
gauguuuuccaugag

SEQ ID NO: 1172373 - RNA, 23 nt, Human
gauguuuuccaugaguccccugu

SEQ ID NO: 1172374 - RNA, 12 nt, Human
gauuaaauucuu

SEQ ID NO: 1172375 - RNA, 19 nt, Human
gauuaaauucuugcaaagu

SEQ ID NO: 1172376 - RNA, 18 nt, Human
gauuaaccacuucagcug

SEQ ID NO: 1172377 - RNA, 19 nt, Human
gauuaaccacuucagcuga

SEQ ID NO: 1172378 - RNA, 21 nt, Human
gauuaaccacuucagcugacu

SEQ ID NO: 1172379 - RNA, 19 nt, Human
gauucaacagguuuuccug

SEQ ID NO: 1172380 - RNA, 23 nt, Human
gauugacgggacuguugguauug

SEQ ID NO: 1172381 - RNA, 15 nt, Human
gauuguccccgaccc

SEQ ID NO: 1172382 - RNA, 20 nt, Human
gauuguccccgacccuugcc

SEQ ID NO: 1172383 - RNA, 13 nt, Human
gauugugccccug

SEQ ID NO: 1172384 - RNA, 12 nt, Human
gauucagacagc

SEQ ID NO: 1172385 - RNA, 22 nt, Human
gauucccaagcucugcuccucu

SEQ ID NO: 1172386 - RNA, 18 nt, Human
gcacagccucuuagaugc

SEQ ID NO: 1172387 - RNA, 23 nt, Human
gcacagcuucauuuccugugucu

SEQ ID NO: 1172388 - RNA, 15 nt, Human
gcacagccucuuaga

SEQ ID NO: 1172389 - RNA, 20 nt, Human
gauugugucucuugguccug

SEQ ID NO: 1172390 - RNA, 13 nt, Human
gcaccagcagccu

SEQ ID NO: 1172391 - RNA, 14 nt, Human
gcaccagcagccug

SEQ ID NO: 1172392 - RNA, 14 nt, Human
gcaccaucucuccu

SEQ ID NO: 1172393 - RNA, 15 nt, Human
gcaccaucucuccuc

SEQ ID NO: 1172394 - RNA, 17 nt, Human
gcaccaucucuccuccu

SEQ ID NO: 1172395 - RNA, 19 nt, Human
gcacuguuuuauuuuaauu

SEQ ID NO: 1172396 - RNA, 14 nt, Human
gcacugggcuuggg

SEQ ID NO: 1172397 - RNA, 12 nt, Human
gcacugggcuug

SEQ ID NO: 1172398 - RNA, 14 nt, Human
gcacuauaauguaa

SEQ ID NO: 1172399 - RNA, 15 nt, Human
gcacuauaauguaag

SEQ ID NO: 1172400 - RNA, 20 nt, Human
gcacuauaauguaagcucua

SEQ ID NO: 1172401 - RNA, 22 nt, Human
gcacuauaauguaagcucuacu

SEQ ID NO: 1172402 - RNA, 12 nt, Human
gcacugcuucca

SEQ ID NO: 1172403 - RNA, 13 nt, Human
gcacugcuuccag

SEQ ID NO: 1172404 - RNA, 14 nt, Human
gcacugcuuccagu

SEQ ID NO: 1172405 - RNA, 15 nt, Human
gcacugcuuccagug

SEQ ID NO: 1172406 - RNA, 14 nt, Human
gcacccggccccug

SEQ ID NO: 1172407 - RNA, 19 nt, Human
gcacccucaggcagguggg

SEQ ID NO: 1172408 - RNA, 14 nt, Human
gcacgugugugcac

SEQ ID NO: 1172409 - RNA, 20 nt, Human
gcacuaaggugugcucugau

SEQ ID NO: 1172410 - RNA, 18 nt, Human
gcagagguugcagugagc

SEQ ID NO: 1172411 - RNA, 23 nt, Human
gcagagguugcagugagccgaga

SEQ ID NO: 1172412 - RNA, 18 nt, Human
gcagauggagaccccuug

SEQ ID NO: 1172413 - RNA, 22 nt, Human
gcacuucgggaggucgaggcag

SEQ ID NO: 1172414 - RNA, 14 nt, Human
gcacuugcagacuc

SEQ ID NO: 1172415 - RNA, 16 nt, Human
gcacuugcagacucua

SEQ ID NO: 1172416 - RNA, 18 nt, Human
gcagacucuacagaggcc

SEQ ID NO: 1172417 - RNA, 19 nt, Human
gcagacucuacagaggcca

SEQ ID NO: 1172418 - RNA, 22 nt, Human
gcagacucuacagaggccaugg

SEQ ID NO: 1172419 - RNA, 20 nt, Human
gcagagaccaucccugaagg

SEQ ID NO: 1172420 - RNA, 21 nt, Human
gcagagaccaucccugaaggc

SEQ ID NO: 1172421 - RNA, 22 nt, Human
gcagagaccaucccugaaggcc

SEQ ID NO: 1172422 - RNA, 20 nt, Human
gcagcagggagggcuucugc

SEQ ID NO: 1172423 - RNA, 18 nt, Human
gcagcagggagggcuucu

SEQ ID NO: 1172424 - RNA, 19 nt, Human
gcagcagggagggcuucug

SEQ ID NO: 1172425 - RNA, 17 nt, Human
gcagccucacaguccuu

SEQ ID NO: 1172426 - RNA, 19 nt, Human
gcagccucacaguccuuac

SEQ ID NO: 1172427 - RNA, 16 nt, Human
gcagcucaccucuccc

SEQ ID NO: 1172428 - RNA, 17 nt, Human
gcagcucaccucucccu

SEQ ID NO: 1172429 - RNA, 20 nt, Human
gcagcucaccucucccuugg

SEQ ID NO: 1172430 - RNA, 21 nt, Human
gcagcucaccucucccuugga

SEQ ID NO: 1172431 - RNA, 14 nt, Human
gcagcucagagagg

SEQ ID NO: 1172432 - RNA, 18 nt, Human
gcagcucagagagggugg

SEQ ID NO: 1172433 - RNA, 19 nt, Human
gcagcucagagaggguggg

SEQ ID NO: 1172434 - RNA, 11 nt, Human
gcagugggagc

SEQ ID NO: 1172435 - RNA, 12 nt, Human
gcagugggagcu

SEQ ID NO: 1172436 - RNA, 18 nt, Human
gcaguggugcgaucuggg

SEQ ID NO: 1172437 - RNA, 19 nt, Human
gcaguggugcgaucugggu

SEQ ID NO: 1172438 - RNA, 17 nt, Human
gcagggucucacucugu

SEQ ID NO: 1172439 - RNA, 20 nt, Human
gcaguggugcgaucuggguu

SEQ ID NO: 1172440 - RNA, 21 nt, Human
gcaguggugcgaucuggguuc

SEQ ID NO: 1172441 - RNA, 22 nt, Human
gcaguggugcgaucuggguuca

SEQ ID NO: 1172442 - RNA, 19 nt, Human
gcaguggugguuuucuguu

SEQ ID NO: 1172443 - RNA, 20 nt, Human
gcaguggugguuuucuguuc

SEQ ID NO: 1172444 - RNA, 21 nt, Human
gcaguggugguuuucuguucu

SEQ ID NO: 1172445 - RNA, 22 nt, Human
gcaguggugguuuucuguucuu

SEQ ID NO: 1172446 - RNA, 19 nt, Human
gcauacguacacauuuuau

SEQ ID NO: 1172447 - RNA, 18 nt, Human
gcaggcagccaggccaca

SEQ ID NO: 1172448 - RNA, 22 nt, Human
gcaggggaggguagagcggaga

SEQ ID NO: 1172449 - RNA, 19 nt, Human
gcaggguccuagaaauucc

SEQ ID NO: 1172450 - RNA, 16 nt, Human
gcagggucucacucug

SEQ ID NO: 1172451 - RNA, 23 nt, Human
gcaucaggccaggcccucugccc

SEQ ID NO: 1172452 - RNA, 13 nt, Human
gcaucaggccagg

SEQ ID NO: 1172453 - RNA, 12 nt, Human
gcaucaggccag

SEQ ID NO: 1172454 - RNA, 20 nt, Human
gcaugaaguaauaugcacac

SEQ ID NO: 1172455 - RNA, 21 nt, Human
gcaugaaguaauaugcacaca

SEQ ID NO: 1172456 - RNA, 22 nt, Human
gcaugaaguaauaugcacacau

SEQ ID NO: 1172457 - RNA, 23 nt, Human
gcaugaaguaauaugcacacauu

SEQ ID NO: 1172458 - RNA, 21 nt, Human
gcaugacacgaauauugcuga

SEQ ID NO: 1172459 - RNA, 22 nt, Human
gcaugacacgaauauugcugau

SEQ ID NO: 1172460 - RNA, 14 nt, Human
gcaugccuggaugg

SEQ ID NO: 1172461 - RNA, 15 nt, Human
gcaugccuggauggg

SEQ ID NO: 1172462 - RNA, 13 nt, Human
gcauguuacauaa

SEQ ID NO: 1172463 - RNA, 14 nt, Human
gcauguucucugag

SEQ ID NO: 1172464 - RNA, 22 nt, Human
gcauuaucuagauacuguauca

SEQ ID NO: 1172465 - RNA, 24 nt, Human
gcauuaucuagauacuguaucaug

SEQ ID NO: 1172466 - RNA, 14 nt, Human
gcauuccccaggag

SEQ ID NO: 1172467 - RNA, 15 nt, Human
gcauuccccaggagg

SEQ ID NO: 1172468 - RNA, 16 nt, Human
gcauuccccaggaggc

SEQ ID NO: 1172469 - RNA, 17 nt, Human
gcauuccccaggaggcc

SEQ ID NO: 1172470 - RNA, 18 nt, Human
gcauuccccaggaggcca

SEQ ID NO: 1172471 - RNA, 19 nt, Human
gcauuccccaggaggccag

SEQ ID NO: 1172472 - RNA, 20 nt, Human
gcauuccccaggaggccagc

SEQ ID NO: 1172473 - RNA, 21 nt, Human
gcauuccccaggaggccagcc

SEQ ID NO: 1172474 - RNA, 22 nt, Human
gcauuccccaggaggccagccu

SEQ ID NO: 1172475 - RNA, 18 nt, Human
gcauuugaggucuguucu

SEQ ID NO: 1172476 - RNA, 21 nt, Human
gccaaggcugggggaagaagc

SEQ ID NO: 1172477 - RNA, 21 nt, Human
gcauuugaggucuguucuuuc

SEQ ID NO: 1172478 - RNA, 19 nt, Human
gcauuugaggucuguucuu

SEQ ID NO: 1172479 - RNA, 20 nt, Human
gcauuugaggucuguucuuu

SEQ ID NO: 1172480 - RNA, 22 nt, Human
gcauuuggugguuucagaaaug

SEQ ID NO: 1172481 - RNA, 23 nt, Human
gcauuuggugguuucagaaaugu

SEQ ID NO: 1172482 - RNA, 14 nt, Human
gccaaggugggagg

SEQ ID NO: 1172483 - RNA, 15 nt, Human
gccaaggugggagga

SEQ ID NO: 1172484 - RNA, 23 nt, Human
gccaaggugggaggauugcuuga

SEQ ID NO: 1172485 - RNA, 13 nt, Human
gccacagagaaag

SEQ ID NO: 1172486 - RNA, 14 nt, Human
gccacagagaaagu

SEQ ID NO: 1172487 - RNA, 20 nt, Human
gccacagagaaaguacuucu

SEQ ID NO: 1172488 - RNA, 23 nt, Human
gccacagagaaaguacuucucca

SEQ ID NO: 1172489 - RNA, 16 nt, Human
gccacaagacccuugu

SEQ ID NO: 1172490 - RNA, 22 nt, Human
gccacaagacccuugugguccc

SEQ ID NO: 1172491 - RNA, 10 nt, Human
gccacacaca

SEQ ID NO: 1172492 - RNA, 11 nt, Human
gccacacacac

SEQ ID NO: 1172493 - RNA, 12 nt, Human
gccacacacaca

SEQ ID NO: 1172494 - RNA, 13 nt, Human
gccacacacacag

SEQ ID NO: 1172495 - RNA, 14 nt, Human
gccacacacacaga

SEQ ID NO: 1172496 - RNA, 15 nt, Human
gccacacacacagaa

SEQ ID NO: 1172497 - RNA, 16 nt, Human
gccacacacacagaaa

SEQ ID NO: 1172498 - RNA, 17 nt, Human
gccacacacacagaaaa

SEQ ID NO: 1172499 - RNA, 18 nt, Human
gccacacacacagaaaau

SEQ ID NO: 1172500 - RNA, 19 nt, Human
gccacacacacagaaaaua

SEQ ID NO: 1172501 - RNA, 20 nt, Human
gccacacacacagaaaauau

SEQ ID NO: 1172502 - RNA, 21 nt, Human
gccacacacacagaaaauaua

SEQ ID NO: 1172503 - RNA, 22 nt, Human
gccacacacacagaaaauauac

SEQ ID NO: 1172504 - RNA, 23 nt, Human
gccacacacacagaaaauauacu

SEQ ID NO: 1172505 - RNA, 17 nt, Human
gccaccugccuguuggg

SEQ ID NO: 1172506 - RNA, 14 nt, Human
gccaccugcggugc

SEQ ID NO: 1172507 - RNA, 20 nt, Human
gccaccugcggugcuaucuc

SEQ ID NO: 1172508 - RNA, 22 nt, Human
gccaccugcggugcuaucuccc

SEQ ID NO: 1172509 - RNA, 18 nt, Human
gccacggccaggccagag

SEQ ID NO: 1172510 - RNA, 19 nt, Human
gccacggccaggccagagg

SEQ ID NO: 1172511 - RNA, 20 nt, Human
gccacuauuguuagucucuu

SEQ ID NO: 1172512 - RNA, 17 nt, Human
gccagagacacaagccu

SEQ ID NO: 1172513 - RNA, 19 nt, Human
gccagagacacaagccuuc

SEQ ID NO: 1172514 - RNA, 20 nt, Human
gccagagacacaagccuucg

SEQ ID NO: 1172515 - RNA, 10 nt, Human
gccagaggag

SEQ ID NO: 1172516 - RNA, 12 nt, Human
gccagaggagag

SEQ ID NO: 1172517 - RNA, 13 nt, Human
gccagaggagaga

SEQ ID NO: 1172518 - RNA, 15 nt, Human
gccagaggagagagg

SEQ ID NO: 1172519 - RNA, 17 nt, Human
gccagaggagagaggac

SEQ ID NO: 1172520 - RNA, 19 nt, Human
gccagaggagagaggaccc

SEQ ID NO: 1172521 - RNA, 22 nt, Human
gccagaggagagaggacccccu

SEQ ID NO: 1172522 - RNA, 21 nt, Human
gccagagggagugacagaggc

SEQ ID NO: 1172523 - RNA, 22 nt, Human
gccagagggagugacagaggca

SEQ ID NO: 1172524 - RNA, 23 nt, Human
gccagagggagugacagaggcag

SEQ ID NO: 1172525 - RNA, 16 nt, Human
gccagaugcaccagcc

SEQ ID NO: 1172526 - RNA, 17 nt, Human
gccagaugcaccagccc

SEQ ID NO: 1172527 - RNA, 18 nt, Human
gccagaugcaccagcccu

SEQ ID NO: 1172528 - RNA, 19 nt, Human
gccagauuuuccugaaaac

SEQ ID NO: 1172529 - RNA, 18 nt, Human
gccagauuucacucuccu

SEQ ID NO: 1172530 - RNA, 21 nt, Human
gccagauuucacucuccuugg

SEQ ID NO: 1172531 - RNA, 13 nt, Human
gccagggacagag

SEQ ID NO: 1172532 - RNA, 16 nt, Human
gccagggacagagggg

SEQ ID NO: 1172533 - RNA, 18 nt, Human
gccagggacagagggggu

SEQ ID NO: 1172534 - RNA, 23 nt, Human
gccagggacagaggggguggccu

SEQ ID NO: 1172535 - RNA, 17 nt, Human
gccagguuuuuggucug

SEQ ID NO: 1172536 - RNA, 12 nt, Human
gccaguaaaugg

SEQ ID NO: 1172537 - RNA, 17 nt, Human
gccagucaccccggcca

SEQ ID NO: 1172538 - RNA, 18 nt, Human
gccagucaccccggccac

SEQ ID NO: 1172539 - RNA, 20 nt, Human
gccagucaccccggccaccu

SEQ ID NO: 1172540 - RNA, 21 nt, Human
gccagucaccccggccaccug

SEQ ID NO: 1172541 - RNA, 15 nt, Human
gcccaaagaugcagc

SEQ ID NO: 1172542 - RNA, 23 nt, Human
gccaugggacagggaggacgcuc

SEQ ID NO: 1172543 - RNA, 19 nt, Human
gccaugggcacugugggua

SEQ ID NO: 1172544 - RNA, 19 nt, Human
gccaucucaccuccugcug

SEQ ID NO: 1172545 - RNA, 20 nt, Human
gccaucucaccuccugcugg

SEQ ID NO: 1172546 - RNA, 21 nt, Human
gccaucucaccuccugcuggg

SEQ ID NO: 1172547 - RNA, 18 nt, Human
gccaugaggaacaaggca

SEQ ID NO: 1172548 - RNA, 20 nt, Human
gccaugaggaacaaggcaag

SEQ ID NO: 1172549 - RNA, 13 nt, Human
gccaugccagcuu

SEQ ID NO: 1172550 - RNA, 18 nt, Human
gccaugccagcuuaucuc

SEQ ID NO: 1172551 - RNA, 19 nt, Human
gccaugccagcuuaucuca

SEQ ID NO: 1172552 - RNA, 13 nt, Human
gcccagccccuuc

SEQ ID NO: 1172553 - RNA, 14 nt, Human
gcccagccccuucu

SEQ ID NO: 1172554 - RNA, 16 nt, Human
gcccagccccuucuga

SEQ ID NO: 1172555 - RNA, 17 nt, Human
gcccagccccuucugac

SEQ ID NO: 1172556 - RNA, 20 nt, Human
gcccagccccuucugaccca

SEQ ID NO: 1172557 - RNA, 24 nt, Human
gcccagccccuucugacccaugcu

SEQ ID NO: 1172558 - RNA, 18 nt, Human
gcccaggaaaggcuccag

SEQ ID NO: 1172559 - RNA, 19 nt, Human
gcccaggaaaggcuccagg

SEQ ID NO: 1172560 - RNA, 20 nt, Human
gcccaggaaaggcuccagga

SEQ ID NO: 1172561 - RNA, 21 nt, Human
gcccaggaaaggcuccaggag

SEQ ID NO: 1172562 - RNA, 19 nt, Human
gcccaggcuggcgugcagu

SEQ ID NO: 1172563 - RNA, 20 nt, Human
gcccaggcuggcgugcagug

SEQ ID NO: 1172564 - RNA, 22 nt, Human
gcccaggcuggcgugcaguggu

SEQ ID NO: 1172565 - RNA, 19 nt, Human
gcccaggcuuagucacuga

SEQ ID NO: 1172566 - RNA, 21 nt, Human
gcccaggcuuagucacugaga

SEQ ID NO: 1172567 - RNA, 23 nt, Human
gcccaggcuuagucacugagaca

SEQ ID NO: 1172568 - RNA, 19 nt, Human
gcccagucuggaaugcagu

SEQ ID NO: 1172569 - RNA, 20 nt, Human
gcccagucuggaaugcagug

SEQ ID NO: 1172570 - RNA, 21 nt, Human
gcccaaugcacuuuguucugg

SEQ ID NO: 1172571 - RNA, 15 nt, Human
gcccagagagggugg

SEQ ID NO: 1172572 - RNA, 12 nt, Human
gcccagagggcc

SEQ ID NO: 1172573 - RNA, 14 nt, Human
gcccagagggccug

SEQ ID NO: 1172574 - RNA, 15 nt, Human
gcccagagggccugc

SEQ ID NO: 1172575 - RNA, 18 nt, Human
gcccagagggccugcaag

SEQ ID NO: 1172576 - RNA, 19 nt, Human
gcccagagggccugcaagg

SEQ ID NO: 1172577 - RNA, 20 nt, Human
gcccagagggccugcaaggg

SEQ ID NO: 1172578 - RNA, 21 nt, Human
gcccagagggccugcaaggga

SEQ ID NO: 1172579 - RNA, 22 nt, Human
gcccagagggccugcaagggag

SEQ ID NO: 1172580 - RNA, 9 nt, Human
gcccagccc

SEQ ID NO: 1172581 - RNA, 11 nt, Human
gcccagccccu

SEQ ID NO: 1172582 - RNA, 12 nt, Human
gcccagccccuu

SEQ ID NO: 1172583 - RNA, 20 nt, Human
gccuggauggggcugcaccg

SEQ ID NO: 1172584 - RNA, 14 nt, Human
gccuggacccugug

SEQ ID NO: 1172585 - RNA, 18 nt, Human
gccuggauggggcugcac

SEQ ID NO: 1172586 - RNA, 19 nt, Human
gcccaguuggguggaugcc

SEQ ID NO: 1172587 - RNA, 21 nt, Human
gcccaguuggguggaugccug

SEQ ID NO: 1172588 - RNA, 22 nt, Human
gcccaguuggguggaugccugg

SEQ ID NO: 1172589 - RNA, 16 nt, Human
gccugaagucacacag

SEQ ID NO: 1172590 - RNA, 17 nt, Human
gccugaagucacacagu

SEQ ID NO: 1172591 - RNA, 18 nt, Human
gccugaagucacacagug

SEQ ID NO: 1172592 - RNA, 17 nt, Human
gccugagcgacagugag

SEQ ID NO: 1172593 - RNA, 20 nt, Human
gccugagcgacagugagacu

SEQ ID NO: 1172594 - RNA, 12 nt, Human
gccugagcuggg

SEQ ID NO: 1172595 - RNA, 20 nt, Human
gccuggccagaugcaccagc

SEQ ID NO: 1172596 - RNA, 21 nt, Human
gccuggccagaugcaccagcc

SEQ ID NO: 1172597 - RNA, 22 nt, Human
gccuggccagaugcaccagccc

SEQ ID NO: 1172598 - RNA, 13 nt, Human
gccuggccccuca

SEQ ID NO: 1172599 - RNA, 14 nt, Human
gccuggccccucag

SEQ ID NO: 1172600 - RNA, 15 nt, Human
gccuguaauccuagc

SEQ ID NO: 1172601 - RNA, 20 nt, Human
gccuguaauccuagcacuuu

SEQ ID NO: 1172602 - RNA, 12 nt, Human
gcgacaaugcaa

SEQ ID NO: 1172603 - RNA, 13 nt, Human
gcgacaaugcaaa

SEQ ID NO: 1172604 - RNA, 20 nt, Human
gcgacaaugcaaaccaucau

SEQ ID NO: 1172605 - RNA, 21 nt, Human
gcgacaaugcaaaccaucauu

SEQ ID NO: 1172606 - RNA, 15 nt, Human
gccuuacacaauggu

SEQ ID NO: 1172607 - RNA, 16 nt, Human
gccuuacacaaugguu

SEQ ID NO: 1172608 - RNA, 23 nt, Human
gcgcccaguuggguggaugccug

SEQ ID NO: 1172609 - RNA, 21 nt, Human
gcgccuuaaggauguucuagc

SEQ ID NO: 1172610 - RNA, 18 nt, Human
gcgcugccccuggcagcc

SEQ ID NO: 1172611 - RNA, 21 nt, Human
gcgcugccccuggcagccccu

SEQ ID NO: 1172612 - RNA, 16 nt, Human
gcggagaaaggaaggg

SEQ ID NO: 1172613 - RNA, 19 nt, Human
gcggagacggagucccacc

SEQ ID NO: 1172614 - RNA, 14 nt, Human
gcggggacagcucc

SEQ ID NO: 1172615 - RNA, 15 nt, Human
gcggggacagcuccu

SEQ ID NO: 1172616 - RNA, 17 nt, Human
gcggggacagcuccuuc

SEQ ID NO: 1172617 - RNA, 18 nt, Human
gcggggacagcuccuucu

SEQ ID NO: 1172618 - RNA, 13 nt, Human
gcgguccacccag

SEQ ID NO: 1172619 - RNA, 14 nt, Human
gcgguccacccagg

SEQ ID NO: 1172620 - RNA, 19 nt, Human
gcggugagaggggaacaga

SEQ ID NO: 1172621 - RNA, 19 nt, Human
gcggugcuaucucccccag

SEQ ID NO: 1172622 - RNA, 22 nt, Human
gcggugcuaucucccccagccc

SEQ ID NO: 1172623 - RNA, 13 nt, Human
gcuagauguaugu

SEQ ID NO: 1172624 - RNA, 14 nt, Human
gcuagauguaugua

SEQ ID NO: 1172625 - RNA, 16 nt, Human
gcuagauguauguacu

SEQ ID NO: 1172626 - RNA, 13 nt, Human
gcuaucuccccca

SEQ ID NO: 1172627 - RNA, 14 nt, Human
gcuaucucccccag

SEQ ID NO: 1172628 - RNA, 15 nt, Human
gcuaucucccccagc

SEQ ID NO: 1172629 - RNA, 18 nt, Human
gcucaaguccucuuuucu

SEQ ID NO: 1172630 - RNA, 19 nt, Human
gcucaaguccucuuuucug

SEQ ID NO: 1172631 - RNA, 22 nt, Human
gcucaaguccucuuuucugaga

SEQ ID NO: 1172632 - RNA, 16 nt, Human
gcucacauaucuguca

SEQ ID NO: 1172633 - RNA, 12 nt, Human
gcucaccagccc

SEQ ID NO: 1172634 - RNA, 13 nt, Human
gcucaccagcccc

SEQ ID NO: 1172635 - RNA, 14 nt, Human
gcucaccagcccca

SEQ ID NO: 1172636 - RNA, 15 nt, Human
gcucaccagccccag

SEQ ID NO: 1172637 - RNA, 18 nt, Human
gcucaccagccccagugc

SEQ ID NO: 1172638 - RNA, 16 nt, Human
gcucaccucucccuug

SEQ ID NO: 1172639 - RNA, 17 nt, Human
gcucaccucucccuugg

SEQ ID NO: 1172640 - RNA, 18 nt, Human
gcucaccucucccuugga

SEQ ID NO: 1172641 - RNA, 17 nt, Human
gcucagcggggacagcu

SEQ ID NO: 1172642 - RNA, 18 nt, Human
gcucagcggggacagcuc

SEQ ID NO: 1172643 - RNA, 19 nt, Human
gcucagcggggacagcucc

SEQ ID NO: 1172644 - RNA, 23 nt, Human
gcucagcggggacagcuccuucu

SEQ ID NO: 1172645 - RNA, 21 nt, Human
gcuccagcuguucagcugguu

SEQ ID NO: 1172646 - RNA, 11 nt, Human
gcuccaggagc

SEQ ID NO: 1172647 - RNA, 12 nt, Human
gcuccaggagca

SEQ ID NO: 1172648 - RNA, 14 nt, Human
gcuccaggagcagc

SEQ ID NO: 1172649 - RNA, 15 nt, Human
gcuccaggagcagcc

SEQ ID NO: 1172650 - RNA, 16 nt, Human
gcuccaggagcagcca

SEQ ID NO: 1172651 - RNA, 17 nt, Human
gcuccaggagcagccac

SEQ ID NO: 1172652 - RNA, 18 nt, Human
gcuccaggagcagccaca

SEQ ID NO: 1172653 - RNA, 12 nt, Human
gcuccaggcucc

SEQ ID NO: 1172654 - RNA, 13 nt, Human
gcuccaggcuccu

SEQ ID NO: 1172655 - RNA, 20 nt, Human
gcucccuucccaccucucuc

SEQ ID NO: 1172656 - RNA, 18 nt, Human
gcuccgcuuucuacccag

SEQ ID NO: 1172657 - RNA, 21 nt, Human
gcuccgcuuucuacccagcga

SEQ ID NO: 1172658 - RNA, 22 nt, Human
gcuccgcuuucuacccagcgag

SEQ ID NO: 1172659 - RNA, 23 nt, Human
gcuccgcuuucuacccagcgagc

SEQ ID NO: 1172660 - RNA, 24 nt, Human
gcuccgcuuucuacccagcgagcc

SEQ ID NO: 1172661 - RNA, 12 nt, Human
gcuccugugucu

SEQ ID NO: 1172662 - RNA, 13 nt, Human
gcuccugugucuu

SEQ ID NO: 1172663 - RNA, 13 nt, Human
gcuccuucugucc

SEQ ID NO: 1172664 - RNA, 15 nt, Human
gcuccuucuguccua

SEQ ID NO: 1172665 - RNA, 17 nt, Human
gcuccuuuagcgcccag

SEQ ID NO: 1172666 - RNA, 19 nt, Human
gcucgagcaugccuggaug

SEQ ID NO: 1172667 - RNA, 21 nt, Human
gcucgagcaugccuggauggg

SEQ ID NO: 1172668 - RNA, 21 nt, Human
gcucucaggccagcugcuugg

SEQ ID NO: 1172669 - RNA, 18 nt, Human
gcugacagacacaggccc

SEQ ID NO: 1172670 - RNA, 19 nt, Human
gcugacagacacaggcccg

SEQ ID NO: 1172671 - RNA, 20 nt, Human
gcugacagacacaggcccgg

SEQ ID NO: 1172672 - RNA, 22 nt, Human
gcugacuguuuucucuugagag

SEQ ID NO: 1172673 - RNA, 21 nt, Human
gcugauuaaaccaaggcuaga

SEQ ID NO: 1172674 - RNA, 22 nt, Human
gcugcaaaggguaucaggugcu

SEQ ID NO: 1172675 - RNA, 23 nt, Human
gcugcaaaggguaucaggugcug

SEQ ID NO: 1172676 - RNA, 12 nt, Human
gcugccaccugc

SEQ ID NO: 1172677 - RNA, 13 nt, Human
gcugccaccugcc

SEQ ID NO: 1172678 - RNA, 13 nt, Human
gcugcaguugcca

SEQ ID NO: 1172679 - RNA, 14 nt, Human
gcugcaguugccag

SEQ ID NO: 1172680 - RNA, 17 nt, Human
gcugcaguugccaguca

SEQ ID NO: 1172681 - RNA, 18 nt, Human
gcugcauuuaaaagauac

SEQ ID NO: 1172682 - RNA, 19 nt, Human
gcugcauuuaaaagauaca

SEQ ID NO: 1172683 - RNA, 19 nt, Human
gcugccuguucagcuccag

SEQ ID NO: 1172684 - RNA, 20 nt, Human
gcugccuguucagcuccagc

SEQ ID NO: 1172685 - RNA, 22 nt, Human
gcugccuguucagcuccagcuc

SEQ ID NO: 1172686 - RNA, 22 nt, Human
gcugcgguccacccaggagccc

SEQ ID NO: 1172687 - RNA, 16 nt, Human
gcugcgguccacccag

SEQ ID NO: 1172688 - RNA, 21 nt, Human
gcugcgguccacccaggagcc

SEQ ID NO: 1172689 - RNA, 14 nt, Human
gcugcgguccaccc

SEQ ID NO: 1172690 - RNA, 15 nt, Human
gcugcgguccaccca

SEQ ID NO: 1172691 - RNA, 12 nt, Human
gcugcccugccc

SEQ ID NO: 1172692 - RNA, 13 nt, Human
gcugcccugccca

SEQ ID NO: 1172693 - RNA, 14 nt, Human
gcugcccugcccac

SEQ ID NO: 1172694 - RNA, 16 nt, Human
gcugcccugcccaccu

SEQ ID NO: 1172695 - RNA, 18 nt, Human
gcugcccugcccaccugg

SEQ ID NO: 1172696 - RNA, 20 nt, Human
gcugcccugcccaccuggcc

SEQ ID NO: 1172697 - RNA, 21 nt, Human
gcugcccugcccaccuggccu

SEQ ID NO: 1172698 - RNA, 22 nt, Human
gcugcccugcccaccuggccuc

SEQ ID NO: 1172699 - RNA, 23 nt, Human
gcugcccugcccaccuggccucu

SEQ ID NO: 1172700 - RNA, 24 nt, Human
gcugcccugcccaccuggccucug

SEQ ID NO: 1172701 - RNA, 21 nt, Human
gcuggaaaaguauguuagugc

SEQ ID NO: 1172702 - RNA, 23 nt, Human
gcuggaaaaguauguuagugcaa

SEQ ID NO: 1172703 - RNA, 22 nt, Human
gcugcuuuugucuaugggacuc

SEQ ID NO: 1172704 - RNA, 15 nt, Human
gcuggaccuugaacu

SEQ ID NO: 1172705 - RNA, 16 nt, Human
gcuggaccuugaacug

SEQ ID NO: 1172706 - RNA, 14 nt, Human
gcuggucccacuca

SEQ ID NO: 1172707 - RNA, 14 nt, Human
gcugggggccucag

SEQ ID NO: 1172708 - RNA, 15 nt, Human
gcugggggccucagu

SEQ ID NO: 1172709 - RNA, 18 nt, Human
gcugggggccucagugcc

SEQ ID NO: 1172710 - RNA, 13 nt, Human
gcuggccuggccc

SEQ ID NO: 1172711 - RNA, 14 nt, Human
gcuggccuggcccc

SEQ ID NO: 1172712 - RNA, 15 nt, Human
gcuggccuggccccu

SEQ ID NO: 1172713 - RNA, 16 nt, Human
gcuggccuggccccuc

SEQ ID NO: 1172714 - RNA, 19 nt, Human
gcugggaugauuggagggg

SEQ ID NO: 1172715 - RNA, 21 nt, Human
gcugggaugauuggagggggg

SEQ ID NO: 1172716 - RNA, 20 nt, Human
gcugggcuucaguggcagcu

SEQ ID NO: 1172717 - RNA, 21 nt, Human
gcugggcuucaguggcagcug

SEQ ID NO: 1172718 - RNA, 22 nt, Human
gcugggcuucaguggcagcugc

SEQ ID NO: 1172719 - RNA, 17 nt, Human
gcugucagccauuccug

SEQ ID NO: 1172720 - RNA, 16 nt, Human
gcuggugucaccugaa

SEQ ID NO: 1172721 - RNA, 14 nt, Human
gcuggugucaccug

SEQ ID NO: 1172722 - RNA, 15 nt, Human
gcuggugucaccuga

SEQ ID NO: 1172723 - RNA, 23 nt, Human
gcugucccuuacgugaguccugg

SEQ ID NO: 1172724 - RNA, 16 nt, Human
gcugucccuuuuccuu

SEQ ID NO: 1172725 - RNA, 15 nt, Human
gcugugucucccuuc

SEQ ID NO: 1172726 - RNA, 19 nt, Human
gcuucuguuuuauaauuuu

SEQ ID NO: 1172727 - RNA, 22 nt, Human
gcuucucacugccaugccagcu

SEQ ID NO: 1172728 - RNA, 20 nt, Human
gcuucaguggcagcugcuuu

SEQ ID NO: 1172729 - RNA, 13 nt, Human
gcuuaucucaggg

SEQ ID NO: 1172730 - RNA, 16 nt, Human
ggacagaggggguggc

SEQ ID NO: 1172731 - RNA, 20 nt, Human
ggacagaggggguggccucc

SEQ ID NO: 1172732 - RNA, 11 nt, Human
ggacagcuccu

SEQ ID NO: 1172733 - RNA, 15 nt, Human
ggacagcuccuucug

SEQ ID NO: 1172734 - RNA, 16 nt, Human
ggacagcuccuucugu

SEQ ID NO: 1172735 - RNA, 17 nt, Human
ggacagcuccuucuguc

SEQ ID NO: 1172736 - RNA, 17 nt, Human
ggacauuugcucaugga

SEQ ID NO: 1172737 - RNA, 20 nt, Human
ggacauuugcucauggaauu

SEQ ID NO: 1172738 - RNA, 19 nt, Human
ggaccagagcugccaccug

SEQ ID NO: 1172739 - RNA, 16 nt, Human
ggacgcucucuggccu

SEQ ID NO: 1172740 - RNA, 19 nt, Human
ggacgcucucuggccuucg

SEQ ID NO: 1172741 - RNA, 11 nt, Human
ggagaagaacu

SEQ ID NO: 1172742 - RNA, 14 nt, Human
ggagaagaacugaa

SEQ ID NO: 1172743 - RNA, 22 nt, Human
ggagucccaccuuggcugcagg

SEQ ID NO: 1172744 - RNA, 16 nt, Human
ggaggacgcucucugg

SEQ ID NO: 1172745 - RNA, 19 nt, Human
ggaggacgcucucuggccu

SEQ ID NO: 1172746 - RNA, 18 nt, Human
ggaggauguucugggaca

SEQ ID NO: 1172747 - RNA, 21 nt, Human
ggaggauguucugggacacag

SEQ ID NO: 1172748 - RNA, 13 nt, Human
ggagggagggcuc

SEQ ID NO: 1172749 - RNA, 16 nt, Human
ggagggagggcuccag

SEQ ID NO: 1172750 - RNA, 17 nt, Human
ggagggagggcuccaga

SEQ ID NO: 1172751 - RNA, 21 nt, Human
ggagaccccuuggggagcagg

SEQ ID NO: 1172752 - RNA, 14 nt, Human
ggagccuccugccc

SEQ ID NO: 1172753 - RNA, 15 nt, Human
ggagccuccugcccu

SEQ ID NO: 1172754 - RNA, 19 nt, Human
ggaugcccaaagaugcagc

SEQ ID NO: 1172755 - RNA, 13 nt, Human
ggaugccuggugg

SEQ ID NO: 1172756 - RNA, 17 nt, Human
ggaugccugguggcagc

SEQ ID NO: 1172757 - RNA, 18 nt, Human
ggaugcccaaagaugcag

SEQ ID NO: 1172758 - RNA, 23 nt, Human
ggagucccaccuuggcugcaggg

SEQ ID NO: 1172759 - RNA, 16 nt, Human
ggaugaucuaggaaga

SEQ ID NO: 1172760 - RNA, 18 nt, Human
ggaugaucuaggaagacu

SEQ ID NO: 1172761 - RNA, 22 nt, Human
ggaugaucuaggaagacuuugg

SEQ ID NO: 1172762 - RNA, 18 nt, Human
ggaugccugguggcagcu

SEQ ID NO: 1172763 - RNA, 19 nt, Human
ggaugccugguggcagcug

SEQ ID NO: 1172764 - RNA, 20 nt, Human
ggaugccugguggcagcugc

SEQ ID NO: 1172765 - RNA, 21 nt, Human
ggaugccugguggcagcugcg

SEQ ID NO: 1172766 - RNA, 21 nt, Human
ggauucuuccucccucccucu

SEQ ID NO: 1172767 - RNA, 17 nt, Human
ggcaagcaccuccugcc

SEQ ID NO: 1172768 - RNA, 18 nt, Human
ggcaagcaccuccugccu

SEQ ID NO: 1172769 - RNA, 19 nt, Human
ggcaagcaccuccugccuc

SEQ ID NO: 1172770 - RNA, 15 nt, Human
ggcaaggcugucaau

SEQ ID NO: 1172771 - RNA, 17 nt, Human
ggcaccagcagccugga

SEQ ID NO: 1172772 - RNA, 20 nt, Human
ggcacccaccaucaugucug

SEQ ID NO: 1172773 - RNA, 18 nt, Human
ggcacccggccccugcug

SEQ ID NO: 1172774 - RNA, 19 nt, Human
ggcacccggccccugcugg

SEQ ID NO: 1172775 - RNA, 20 nt, Human
ggcacccggccccugcuggu

SEQ ID NO: 1172776 - RNA, 18 nt, Human
ggcacucagaagacacug

SEQ ID NO: 1172777 - RNA, 19 nt, Human
ggcacucagaagacacuga

SEQ ID NO: 1172778 - RNA, 20 nt, Human
ggcacucagaagacacugau

SEQ ID NO: 1172779 - RNA, 21 nt, Human
ggcagagguugcagugagccg

SEQ ID NO: 1172780 - RNA, 15 nt, Human
ggcaugaugcgggcc

SEQ ID NO: 1172781 - RNA, 18 nt, Human
ggcaugugaugagaggaa

SEQ ID NO: 1172782 - RNA, 23 nt, Human
ggcaugugaugagaggaaaucac

SEQ ID NO: 1172783 - RNA, 17 nt, Human
ggcagaguugaagacag

SEQ ID NO: 1172784 - RNA, 19 nt, Human
ggcagaguugaagacagag

SEQ ID NO: 1172785 - RNA, 21 nt, Human
ggcagaguugaagacagagcu

SEQ ID NO: 1172786 - RNA, 23 nt, Human
ggcagcugcgguccacccaggag

SEQ ID NO: 1172787 - RNA, 24 nt, Human
ggcagcugcgguccacccaggagc

SEQ ID NO: 1172788 - RNA, 22 nt, Human
ggcagcugcuuuugucuauggg

SEQ ID NO: 1172789 - RNA, 12 nt, Human
ggcaggguccua

SEQ ID NO: 1172790 - RNA, 17 nt, Human
ggcagggucucacucug

SEQ ID NO: 1172791 - RNA, 18 nt, Human
ggcagggucucacucugu

SEQ ID NO: 1172792 - RNA, 20 nt, Human
ggcauguucucugaggacac

SEQ ID NO: 1172793 - RNA, 23 nt, Human
ggcauguucucugaggacacuaa

SEQ ID NO: 1172794 - RNA, 22 nt, Human
ggccacagaaaauucuucucca

SEQ ID NO: 1172795 - RNA, 11 nt, Human
ggccaggagcc

SEQ ID NO: 1172796 - RNA, 13 nt, Human
ggccaggagccuc

SEQ ID NO: 1172797 - RNA, 14 nt, Human
ggccaggagccucc

SEQ ID NO: 1172798 - RNA, 15 nt, Human
ggccaggcccucugc

SEQ ID NO: 1172799 - RNA, 16 nt, Human
ggccaggcccucugcc

SEQ ID NO: 1172800 - RNA, 17 nt, Human
ggccaggcccucugccc

SEQ ID NO: 1172801 - RNA, 14 nt, Human
ggcccagagggccu

SEQ ID NO: 1172802 - RNA, 17 nt, Human
ggcccagagggccugca

SEQ ID NO: 1172803 - RNA, 19 nt, Human
ggcccagagggccugcaag

SEQ ID NO: 1172804 - RNA, 20 nt, Human
ggcccagagggccugcaagg

SEQ ID NO: 1172805 - RNA, 14 nt, Human
ggccuccugugugu

SEQ ID NO: 1172806 - RNA, 20 nt, Human
ggccuagcauacguacacau

SEQ ID NO: 1172807 - RNA, 22 nt, Human
ggccuagcauacguacacauuu

SEQ ID NO: 1172808 - RNA, 23 nt, Human
ggccuagcauacguacacauuuu

SEQ ID NO: 1172809 - RNA, 14 nt, Human
ggccucaagugauu

SEQ ID NO: 1172810 - RNA, 22 nt, Human
ggccucaagugauucuccugcc

SEQ ID NO: 1172811 - RNA, 23 nt, Human
ggccucaagugauucuccugccu

SEQ ID NO: 1172812 - RNA, 23 nt, Human
ggccugggggcugggcagaggaa

SEQ ID NO: 1172813 - RNA, 15 nt, Human
ggccuggccugagcu

SEQ ID NO: 1172814 - RNA, 16 nt, Human
ggccuggccugagcug

SEQ ID NO: 1172815 - RNA, 19 nt, Human
ggccuggccugagcuggga

SEQ ID NO: 1172816 - RNA, 23 nt, Human
ggcgcagcauauucaggaagcuc

SEQ ID NO: 1172817 - RNA, 24 nt, Human
ggcgcagcauauucaggaagcuca

SEQ ID NO: 1172818 - RNA, 18 nt, Human
ggccucugcacuccccug

SEQ ID NO: 1172819 - RNA, 19 nt, Human
ggccucugcacuccccugc

SEQ ID NO: 1172820 - RNA, 22 nt, Human
ggccucugcacuccccugcugg

SEQ ID NO: 1172821 - RNA, 12 nt, Human
ggccugagcugg

SEQ ID NO: 1172822 - RNA, 13 nt, Human
ggccuggccccuc

SEQ ID NO: 1172823 - RNA, 14 nt, Human
ggccuggccccuca

SEQ ID NO: 1172824 - RNA, 15 nt, Human
ggccuggccccucag

SEQ ID NO: 1172825 - RNA, 17 nt, Human
ggccuggccccucaggg

SEQ ID NO: 1172826 - RNA, 18 nt, Human
ggccuggccccucagggu

SEQ ID NO: 1172827 - RNA, 23 nt, Human
ggccuggccccucagggucccug

SEQ ID NO: 1172828 - RNA, 10 nt, Human
ggccuggccu

SEQ ID NO: 1172829 - RNA, 13 nt, Human
ggccuggccugag

SEQ ID NO: 1172830 - RNA, 14 nt, Human
ggccuggccugagc

SEQ ID NO: 1172831 - RNA, 11 nt, Human
ggcgcugcccc

SEQ ID NO: 1172832 - RNA, 17 nt, Human
ggcgcugccccuggcag

SEQ ID NO: 1172833 - RNA, 18 nt, Human
ggcgcugccccuggcagc

SEQ ID NO: 1172834 - RNA, 20 nt, Human
ggcuaguaucaaaagaaaga

SEQ ID NO: 1172835 - RNA, 23 nt, Human
ggcuagugugguguuuccuggca

SEQ ID NO: 1172836 - RNA, 12 nt, Human
ggcuaugcauuu

SEQ ID NO: 1172837 - RNA, 13 nt, Human
ggcuaugcauuug

SEQ ID NO: 1172838 - RNA, 14 nt, Human
ggcuaugcauuuga

SEQ ID NO: 1172839 - RNA, 9 nt, Human
ggcuccaga

SEQ ID NO: 1172840 - RNA, 10 nt, Human
ggcuccagac

SEQ ID NO: 1172841 - RNA, 14 nt, Human
ggcuccaggagcag

SEQ ID NO: 1172842 - RNA, 16 nt, Human
ggcuccaggagcagcc

SEQ ID NO: 1172843 - RNA, 17 nt, Human
ggcuccaggagcagcca

SEQ ID NO: 1172844 - RNA, 18 nt, Human
ggcuccaggagcagccac

SEQ ID NO: 1172845 - RNA, 12 nt, Human
ggcuccaggcuc

SEQ ID NO: 1172846 - RNA, 13 nt, Human
ggcuccaggcucc

SEQ ID NO: 1172847 - RNA, 14 nt, Human
ggcuccaggcuccu

SEQ ID NO: 1172848 - RNA, 15 nt, Human
ggcuccaggcuccuu

SEQ ID NO: 1172849 - RNA, 15 nt, Human
ggcucucaggccagc

SEQ ID NO: 1172850 - RNA, 16 nt, Human
ggcucucaggccagcu

SEQ ID NO: 1172851 - RNA, 17 nt, Human
ggcucucaggccagcug

SEQ ID NO: 1172852 - RNA, 18 nt, Human
ggcucucaggccagcugc

SEQ ID NO: 1172853 - RNA, 19 nt, Human
ggcucucaggccagcugcu

SEQ ID NO: 1172854 - RNA, 20 nt, Human
ggcucucaggccagcugcuu

SEQ ID NO: 1172855 - RNA, 12 nt, Human
ggcucugcccuu

SEQ ID NO: 1172856 - RNA, 14 nt, Human
ggcucugcccuugg

SEQ ID NO: 1172857 - RNA, 15 nt, Human
ggcucugcccuuggu

SEQ ID NO: 1172858 - RNA, 13 nt, Human
ggcucugccuccc

SEQ ID NO: 1172859 - RNA, 15 nt, Human
ggcucugccucccau

SEQ ID NO: 1172860 - RNA, 16 nt, Human
ggcucugccucccauc

SEQ ID NO: 1172861 - RNA, 20 nt, Human
ggcugggcucccuucccacc

SEQ ID NO: 1172862 - RNA, 21 nt, Human
ggcugggcucccuucccaccu

SEQ ID NO: 1172863 - RNA, 11 nt, Human
ggcugggcuuc

SEQ ID NO: 1172864 - RNA, 21 nt, Human
ggcugggcuucaguggcagcu

SEQ ID NO: 1172865 - RNA, 22 nt, Human
ggcugggcuucaguggcagcug

SEQ ID NO: 1172866 - RNA, 16 nt, Human
ggcugggggaagaagc

SEQ ID NO: 1172867 - RNA, 14 nt, Human
ggcugggggccuca

SEQ ID NO: 1172868 - RNA, 17 nt, Human
ggcucugccucccauca

SEQ ID NO: 1172869 - RNA, 15 nt, Human
ggcugcuucaaggau

SEQ ID NO: 1172870 - RNA, 19 nt, Human
ggcugcuucaaggauccug

SEQ ID NO: 1172871 - RNA, 20 nt, Human
ggcugcuucaaggauccuga

SEQ ID NO: 1172872 - RNA, 21 nt, Human
ggcugcuucaaggauccugag

SEQ ID NO: 1172873 - RNA, 14 nt, Human
ggcuguuggcuggg

SEQ ID NO: 1172874 - RNA, 15 nt, Human
ggcuguuggcugggg

SEQ ID NO: 1172875 - RNA, 16 nt, Human
ggcuguuggcuggggg

SEQ ID NO: 1172876 - RNA, 20 nt, Human
ggcuguuggcugggggccuc

SEQ ID NO: 1172877 - RNA, 15 nt, Human
ggcuuaaaacaacac

SEQ ID NO: 1172878 - RNA, 17 nt, Human
ggcuuggggaccagagc

SEQ ID NO: 1172879 - RNA, 18 nt, Human
ggcuuggggaccagagcu

SEQ ID NO: 1172880 - RNA, 19 nt, Human
ggcuuggggaccagagcug

SEQ ID NO: 1172881 - RNA, 14 nt, Human
ggcuuagucacuga

SEQ ID NO: 1172882 - RNA, 15 nt, Human
ggcuuagucacugag

SEQ ID NO: 1172883 - RNA, 20 nt, Human
ggcuucacggaagagccuug

SEQ ID NO: 1172884 - RNA, 21 nt, Human
ggcuucacggaagagccuugc

SEQ ID NO: 1172885 - RNA, 19 nt, Human
gggaauguuugccucugcc

SEQ ID NO: 1172886 - RNA, 21 nt, Human
gggaauguuugccucugccuc

SEQ ID NO: 1172887 - RNA, 14 nt, Human
gggaauugaggaca

SEQ ID NO: 1172888 - RNA, 14 nt, Human
gggacacccuguga

SEQ ID NO: 1172889 - RNA, 17 nt, Human
gggacucaaugcacuga

SEQ ID NO: 1172890 - RNA, 19 nt, Human
gggacucaaugcacugaca

SEQ ID NO: 1172891 - RNA, 23 nt, Human
gggacucaaugcacugacauugu

SEQ ID NO: 1172892 - RNA, 21 nt, Human
gggacugaggggaggggagca

SEQ ID NO: 1172893 - RNA, 13 nt, Human
gggagcugccugu

SEQ ID NO: 1172894 - RNA, 21 nt, Human
gggagcugccuguucagcucc

SEQ ID NO: 1172895 - RNA, 22 nt, Human
gggagcugccuguucagcucca

SEQ ID NO: 1172896 - RNA, 17 nt, Human
gggaggacgcucucugg

SEQ ID NO: 1172897 - RNA, 20 nt, Human
gggaggacgcucucuggccu

SEQ ID NO: 1172898 - RNA, 23 nt, Human
gggaggaucucuugagccuggga

SEQ ID NO: 1172899 - RNA, 22 nt, Human
gggaggauguucugggacacag

SEQ ID NO: 1172900 - RNA, 21 nt, Human
gggaggauugcuugagcucag

SEQ ID NO: 1172901 - RNA, 23 nt, Human
gggaggauugcuugagcucagga

SEQ ID NO: 1172902 - RNA, 11 nt, Human
gggaggcagag

SEQ ID NO: 1172903 - RNA, 17 nt, Human
gggagugacagaggcag

SEQ ID NO: 1172904 - RNA, 21 nt, Human
gggagugaguugauagcacag

SEQ ID NO: 1172905 - RNA, 13 nt, Human
uauguugcccagg

SEQ ID NO: 1172906 - RNA, 16 nt, Human
uauguugcccaggcag

SEQ ID NO: 1172907 - RNA, 19 nt, Human
uauguugcccaggcagguc

SEQ ID NO: 1172908 - RNA, 20 nt, Human
uauguugcccaggcaggucu

SEQ ID NO: 1172909 - RNA, 12 nt, Human
uauuaaauuaug

SEQ ID NO: 1172910 - RNA, 13 nt, Human
gggaguggccaca

SEQ ID NO: 1172911 - RNA, 15 nt, Human
gggaguggccacaga

SEQ ID NO: 1172912 - RNA, 13 nt, Human
uauguacuucaug

SEQ ID NO: 1172913 - RNA, 17 nt, Human
uauguacuucaugcugu

SEQ ID NO: 1172914 - RNA, 17 nt, Human
uauugcugauggugcaa

SEQ ID NO: 1172915 - RNA, 22 nt, Human
uauugcugauggugcaaugacc

SEQ ID NO: 1172916 - RNA, 22 nt, Human
uauuggaaauuuguuauaauga

SEQ ID NO: 1172917 - RNA, 17 nt, Human
uauucucuccuguaccu

SEQ ID NO: 1172918 - RNA, 18 nt, Human
uauucucuccuguaccuc

SEQ ID NO: 1172919 - RNA, 12 nt, Human
uauuguuuucag

SEQ ID NO: 1172920 - RNA, 18 nt, Human
uauuguuuucaguguaca

SEQ ID NO: 1172921 - RNA, 20 nt, Human
uauuguuuucaguguacaug

SEQ ID NO: 1172922 - RNA, 22 nt, Human
uauuguuuucaguguacaugga

SEQ ID NO: 1172923 - RNA, 14 nt, Human
uauuuuauuaugca

SEQ ID NO: 1172924 - RNA, 17 nt, Human
uauuuuauuaugcauga

SEQ ID NO: 1172925 - RNA, 22 nt, Human
uauuuucccuauuagagaagag

SEQ ID NO: 1172926 - RNA, 14 nt, Human
uauuuuuuuacuaa

SEQ ID NO: 1172927 - RNA, 15 nt, Human
uauuuuuuuacuaau

SEQ ID NO: 1172928 - RNA, 17 nt, Human
uauuuuuuucuuuucuu

SEQ ID NO: 1172929 - RNA, 14 nt, Human
ucaaaaaaagaaaa

SEQ ID NO: 1172930 - RNA, 15 nt, Human
ucaaaaaaagaaaaa

SEQ ID NO: 1172931 - RNA, 15 nt, Human
ucaaauccuugaaga

SEQ ID NO: 1172932 - RNA, 14 nt, Human
ucaaauugugugaa

SEQ ID NO: 1172933 - RNA, 15 nt, Human
ucaaauugugugaaa

SEQ ID NO: 1172934 - RNA, 23 nt, Human
ucaaccccuucgcuccugugucu

SEQ ID NO: 1172935 - RNA, 20 nt, Human
ucaagugauucuccugccuc

SEQ ID NO: 1172936 - RNA, 21 nt, Human
ucaagugauucuccugccuca

SEQ ID NO: 1172937 - RNA, 21 nt, Human
ucaauaaaauccauacauuug

SEQ ID NO: 1172938 - RNA, 21 nt, Human
ucaauuacaggaaguacugga

SEQ ID NO: 1172939 - RNA, 23 nt, Human
ucaauuacaggaaguacuggaga

SEQ ID NO: 1172940 - RNA, 13 nt, Human
ucacaagacccaa

SEQ ID NO: 1172941 - RNA, 17 nt, Human
ucacaagacccaaaagg

SEQ ID NO: 1172942 - RNA, 18 nt, Human
ucacaagacccaaaaggc

SEQ ID NO: 1172943 - RNA, 17 nt, Human
ucacaggcagguccagg

SEQ ID NO: 1172944 - RNA, 18 nt, Human
ucacaggcagguccaggg

SEQ ID NO: 1172945 - RNA, 19 nt, Human
ucacaggcagguccagggu

SEQ ID NO: 1172946 - RNA, 19 nt, Human
ucacaguccuuaccagcag

SEQ ID NO: 1172947 - RNA, 22 nt, Human
ucacaguccuuaccagcagagc

SEQ ID NO: 1172948 - RNA, 23 nt, Human
ucacaguccuuaccagcagagca

SEQ ID NO: 1172949 - RNA, 17 nt, Human
ucacauuuauucugcuc

SEQ ID NO: 1172950 - RNA, 18 nt, Human
ucacauuuauucugcuca

SEQ ID NO: 1172951 - RNA, 19 nt, Human
ucacauuuauucugcucac

SEQ ID NO: 1172952 - RNA, 19 nt, Human
ucaccaaaucagcugcuac

SEQ ID NO: 1172953 - RNA, 20 nt, Human
ucaccaaaucagcugcuacu

SEQ ID NO: 1172954 - RNA, 21 nt, Human
ucaccaaaucagcugcuacua

SEQ ID NO: 1172955 - RNA, 14 nt, Human
ucaccaaggcugau

SEQ ID NO: 1172956 - RNA, 16 nt, Human
ucaccacaugugcaca

SEQ ID NO: 1172957 - RNA, 20 nt, Human
ucacucuuauugcccacgcu

SEQ ID NO: 1172958 - RNA, 18 nt, Human
ucacugccaugccagcuu

SEQ ID NO: 1172959 - RNA, 13 nt, Human
ucaccagccccag

SEQ ID NO: 1172960 - RNA, 16 nt, Human
ucaccagccccagugc

SEQ ID NO: 1172961 - RNA, 17 nt, Human
ucacucuuauugcccac

SEQ ID NO: 1172962 - RNA, 14 nt, Human
ucacugcuuaacuu

SEQ ID NO: 1172963 - RNA, 10 nt, Human
ucagaaaugu

SEQ ID NO: 1172964 - RNA, 15 nt, Human
ucagaaauguguuau

SEQ ID NO: 1172965 - RNA, 23 nt, Human
ucagaauucucuaguuugauuaa

SEQ ID NO: 1172966 - RNA, 13 nt, Human
ucagacagcugcc

SEQ ID NO: 1172967 - RNA, 14 nt, Human
ucagacagcugccu

SEQ ID NO: 1172968 - RNA, 14 nt, Human
ucagccucccaaag

SEQ ID NO: 1172969 - RNA, 19 nt, Human
ucagccucccaaagugcug

SEQ ID NO: 1172970 - RNA, 21 nt, Human
ucagccucccaaagugcuggg

SEQ ID NO: 1172971 - RNA, 21 nt, Human
ucagccucccgaauagcuggg

SEQ ID NO: 1172972 - RNA, 22 nt, Human
ucagccucccgaauagcuggga

SEQ ID NO: 1172973 - RNA, 18 nt, Human
ucagccucccgaguagcu

SEQ ID NO: 1172974 - RNA, 20 nt, Human
ucagccucccgaguagcugg

SEQ ID NO: 1172975 - RNA, 21 nt, Human
ucagccucccgaguagcuggg

SEQ ID NO: 1172976 - RNA, 22 nt, Human
ucagccucccgaguagcuggga

SEQ ID NO: 1172977 - RNA, 19 nt, Human
ucagccugcuccagcuguu

SEQ ID NO: 1172978 - RNA, 15 nt, Human
ucagcugaaccuggg

SEQ ID NO: 1172979 - RNA, 16 nt, Human
ucagcugaaccugggu

SEQ ID NO: 1172980 - RNA, 17 nt, Human
ucaggcuagauguaugu

SEQ ID NO: 1172981 - RNA, 14 nt, Human
ucagggccuggcuc

SEQ ID NO: 1172982 - RNA, 16 nt, Human
ucagggccuggcucag

SEQ ID NO: 1172983 - RNA, 15 nt, Human
ucaggugagaagcag

SEQ ID NO: 1172984 - RNA, 16 nt, Human
ucaggugagaagcaga

SEQ ID NO: 1172985 - RNA, 15 nt, Human
ucauacucaccucac

SEQ ID NO: 1172986 - RNA, 19 nt, Human
ucaucaccaacgucugugc

SEQ ID NO: 1172987 - RNA, 20 nt, Human
ucaucaccaacgucugugcc

SEQ ID NO: 1172988 - RNA, 21 nt, Human
ucaucaccaacgucugugcca

SEQ ID NO: 1172989 - RNA, 21 nt, Human
ucaggugagaagcagaggaag

SEQ ID NO: 1172990 - RNA, 23 nt, Human
ucaggugagaagcagaggaagga

SEQ ID NO: 1172991 - RNA, 13 nt, Human
ucaggugcugcca

SEQ ID NO: 1172992 - RNA, 14 nt, Human
ucaggugcugccau

SEQ ID NO: 1172993 - RNA, 15 nt, Human
ucaggugcugccauc

SEQ ID NO: 1172994 - RNA, 23 nt, Human
ucaucuuagguuggcaaaaaggc

SEQ ID NO: 1172995 - RNA, 19 nt, Human
ucaucuugaauuguaagga

SEQ ID NO: 1172996 - RNA, 21 nt, Human
ucauucaacccaccugcgucu

SEQ ID NO: 1172997 - RNA, 13 nt, Human
ucauuuccaagca

SEQ ID NO: 1172998 - RNA, 16 nt, Human
ucauuuccaagcaagu

SEQ ID NO: 1172999 - RNA, 13 nt, Human
ucauuuccugugu

SEQ ID NO: 1173000 - RNA, 16 nt, Human
ucauuuccugugucuu

SEQ ID NO: 1173001 - RNA, 15 nt, Human
uccacuuggucugug

SEQ ID NO: 1173002 - RNA, 16 nt, Human
uccacuuggucuguga

SEQ ID NO: 1173003 - RNA, 17 nt, Human
uccacuuggucugugag

SEQ ID NO: 1173004 - RNA, 17 nt, Human
uccagccacagaaaaga

SEQ ID NO: 1173005 - RNA, 16 nt, Human
uccagcucaccagccc

SEQ ID NO: 1173006 - RNA, 17 nt, Human
uccagcucaccagcccc

SEQ ID NO: 1173007 - RNA, 18 nt, Human
uccagcucaccagcccca

SEQ ID NO: 1173008 - RNA, 17 nt, Human
uccagcuguucagcugg

SEQ ID NO: 1173009 - RNA, 16 nt, Human
uccaggagcagccaca

SEQ ID NO: 1173010 - RNA, 15 nt, Human
uccagguucagcuug

SEQ ID NO: 1173011 - RNA, 16 nt, Human
uccagguucagcuugu

SEQ ID NO: 1173012 - RNA, 18 nt, Human
uccaggugcacaagcucc

SEQ ID NO: 1173013 - RNA, 20 nt, Human
uccaggugcacaagcuccaa

SEQ ID NO: 1173014 - RNA, 21 nt, Human
uccaggugcacaagcuccaag

SEQ ID NO: 1173015 - RNA, 22 nt, Human
uccaggugcacaagcuccaagc

SEQ ID NO: 1173016 - RNA, 17 nt, Human
uccaggagcagccacau

SEQ ID NO: 1173017 - RNA, 18 nt, Human
uccaggagcagccacauu

SEQ ID NO: 1173018 - RNA, 22 nt, Human
uccaggagcagccacauuccug

SEQ ID NO: 1173019 - RNA, 23 nt, Human
uccaggggugggacacccuguga

SEQ ID NO: 1173020 - RNA, 15 nt, Human
uccaggugcacaagc

SEQ ID NO: 1173021 - RNA, 17 nt, Human
uccaauuuacauacucu

SEQ ID NO: 1173022 - RNA, 18 nt, Human
uccaauuuacauacucug

SEQ ID NO: 1173023 - RNA, 20 nt, Human
uccaaaauaaaacuuuuuaa

SEQ ID NO: 1173024 - RNA, 16 nt, Human
uccacaagagcccagg

SEQ ID NO: 1173025 - RNA, 17 nt, Human
uccacaagagcccaggc

SEQ ID NO: 1173026 - RNA, 18 nt, Human
uccacaagagcccaggcc

SEQ ID NO: 1173027 - RNA, 19 nt, Human
uccacaagagcccaggccu

SEQ ID NO: 1173028 - RNA, 17 nt, Human
uccacaaguuaaauaaa

SEQ ID NO: 1173029 - RNA, 18 nt, Human
uccacaaguuaaauaaau

SEQ ID NO: 1173030 - RNA, 19 nt, Human
uccacagaagcuccaggua

SEQ ID NO: 1173031 - RNA, 12 nt, Human
uccacccugcuc

SEQ ID NO: 1173032 - RNA, 13 nt, Human
uccacccugcucu

SEQ ID NO: 1173033 - RNA, 17 nt, Human
uccaccugccagggaca

SEQ ID NO: 1173034 - RNA, 18 nt, Human
uccaccugccagggacag

SEQ ID NO: 1173035 - RNA, 21 nt, Human
uccaccugccagggacagagg

SEQ ID NO: 1173036 - RNA, 13 nt, Human
ucccugcacuugc

SEQ ID NO: 1173037 - RNA, 14 nt, Human
ucccugcacuugca

SEQ ID NO: 1173038 - RNA, 20 nt, Human
ucccugcacuugcagacucu

SEQ ID NO: 1173039 - RNA, 13 nt, Human
ucccuucccaccu

SEQ ID NO: 1173040 - RNA, 14 nt, Human
ucccuucccaccuc

SEQ ID NO: 1173041 - RNA, 15 nt, Human
ucccuugaugaagaa

SEQ ID NO: 1173042 - RNA, 16 nt, Human
ucccuugaugaagaag

SEQ ID NO: 1173043 - RNA, 16 nt, Human
ucccuauuagagaaga

SEQ ID NO: 1173044 - RNA, 17 nt, Human
uccagguuuaagcuguu

SEQ ID NO: 1173045 - RNA, 18 nt, Human
uccagguuuaagcuguua

SEQ ID NO: 1173046 - RNA, 20 nt, Human
uccccuguuuguuucugaaa

SEQ ID NO: 1173047 - RNA, 21 nt, Human
uccccuguuuguuucugaaag

SEQ ID NO: 1173048 - RNA, 18 nt, Human
uccuacccacccuccuuu

SEQ ID NO: 1173049 - RNA, 13 nt, Human
uccgaccagacac

SEQ ID NO: 1173050 - RNA, 17 nt, Human
uccgaccagacaccuug

SEQ ID NO: 1173051 - RNA, 16 nt, Human
uccuaaucuucugaac

SEQ ID NO: 1173052 - RNA, 18 nt, Human
uccuauauuguuuucagu

SEQ ID NO: 1173053 - RNA, 21 nt, Human
uccuauauuguuuucagugua

SEQ ID NO: 1173054 - RNA, 17 nt, Human
uccucauuagcauuuug

SEQ ID NO: 1173055 - RNA, 16 nt, Human
uccucuguacagagcc

SEQ ID NO: 1173056 - RNA, 17 nt, Human
uccucuguacagagccc

SEQ ID NO: 1173057 - RNA, 18 nt, Human
uccucuguacagagccca

SEQ ID NO: 1173058 - RNA, 19 nt, Human
uccucuguacagagcccac

SEQ ID NO: 1173059 - RNA, 17 nt, Human
uccucuaggaggucucu

SEQ ID NO: 1173060 - RNA, 14 nt, Human
uccucugcugcugg

SEQ ID NO: 1173061 - RNA, 15 nt, Human
uccucugcugcuggc

SEQ ID NO: 1173062 - RNA, 16 nt, Human
uccucugcugcuggcu

SEQ ID NO: 1173063 - RNA, 17 nt, Human
uccucugcugcuggcug

SEQ ID NO: 1173064 - RNA, 19 nt, Human
uccuccuuuucacaguucu

SEQ ID NO: 1173065 - RNA, 14 nt, Human
uccucuaggagguc

SEQ ID NO: 1173066 - RNA, 14 nt, Human
uccugccucagccu

SEQ ID NO: 1173067 - RNA, 14 nt, Human
uccugagccagauu

SEQ ID NO: 1173068 - RNA, 13 nt, Human
uccugagccagau

SEQ ID NO: 1173069 - RNA, 13 nt, Human
uccugccucagcc

SEQ ID NO: 1173070 - RNA, 15 nt, Human
uccugccucagccuc

SEQ ID NO: 1173071 - RNA, 16 nt, Human
uccugccucagccucc

SEQ ID NO: 1173072 - RNA, 17 nt, Human
uccugccucagccuccc

SEQ ID NO: 1173073 - RNA, 14 nt, Human
uccuggcacccggc

SEQ ID NO: 1173074 - RNA, 16 nt, Human
uccuggcacccggccc

SEQ ID NO: 1173075 - RNA, 19 nt, Human
uccuggcacccggccccug

SEQ ID NO: 1173076 - RNA, 20 nt, Human
uccuggcacccggccccugc

SEQ ID NO: 1173077 - RNA, 21 nt, Human
uccuggcacccggccccugcu

SEQ ID NO: 1173078 - RNA, 22 nt, Human
uccuggcacccggccccugcug

SEQ ID NO: 1173079 - RNA, 18 nt, Human
uccuggcacugcuuccag

SEQ ID NO: 1173080 - RNA, 22 nt, Human
uccuggcacugcuuccagugag

SEQ ID NO: 1173081 - RNA, 20 nt, Human
uccuguaccucuugagccuu

SEQ ID NO: 1173082 - RNA, 22 nt, Human
uccuguaccucuugagccuuga

SEQ ID NO: 1173083 - RNA, 23 nt, Human
uccuuuucacaguucucuccuuc

SEQ ID NO: 1173084 - RNA, 13 nt, Human
ucgaacuggcugc

SEQ ID NO: 1173085 - RNA, 18 nt, Human
uccuuuucgcaggauucu

SEQ ID NO: 1173086 - RNA, 21 nt, Human
uccuucaccuuuguccccacc

SEQ ID NO: 1173087 - RNA, 22 nt, Human
uccuucaccuuuguccccaccg

SEQ ID NO: 1173088 - RNA, 16 nt, Human
uccuuaccagcagagc

SEQ ID NO: 1173089 - RNA, 17 nt, Human
uccuuaccagcagagca

SEQ ID NO: 1173090 - RNA, 18 nt, Human
uccuuaccagcagagcac

SEQ ID NO: 1173091 - RNA, 18 nt, Human
uccuucacagaugggugc

SEQ ID NO: 1173092 - RNA, 19 nt, Human
uccuucacagaugggugcu

SEQ ID NO: 1173093 - RNA, 20 nt, Human
uccuuaccagcagagcaccu

SEQ ID NO: 1173094 - RNA, 18 nt, Human
uccuucaccuuugucccc

SEQ ID NO: 1173095 - RNA, 20 nt, Human
uccuucaccuuuguccccac

SEQ ID NO: 1173096 - RNA, 16 nt, Human
ucgugauugauaagaa

SEQ ID NO: 1173097 - RNA, 18 nt, Human
ucggccuccauccugagg

SEQ ID NO: 1173098 - RNA, 21 nt, Human
ucguggaacaguuaccucugc

SEQ ID NO: 1173099 - RNA, 22 nt, Human
ucgugggacagucaccucaugg

SEQ ID NO: 1173100 - RNA, 22 nt, Human
ucuaaaucuccaaaauaaaacu

SEQ ID NO: 1173101 - RNA, 13 nt, Human
ucguuaauuugua

SEQ ID NO: 1173102 - RNA, 21 nt, Human
ucuaaaucuccaaaauaaaac

SEQ ID NO: 1173103 - RNA, 14 nt, Human
ucuaauauguaaca

SEQ ID NO: 1173104 - RNA, 18 nt, Human
ucuaggaggucucuaaga

SEQ ID NO: 1173105 - RNA, 19 nt, Human
ucuagugagcagucaggaa

SEQ ID NO: 1173106 - RNA, 22 nt, Human
ucuagugagcagucaggaaaga

SEQ ID NO: 1173107 - RNA, 15 nt, Human
ucuaucaaguauuau

SEQ ID NO: 1173108 - RNA, 21 nt, Human
ucuaucaaguauuauaccuuu

SEQ ID NO: 1173109 - RNA, 22 nt, Human
ucuaucaaguauuauaccuuuu

SEQ ID NO: 1173110 - RNA, 14 nt, Human
ucuaugaaauauua

SEQ ID NO: 1173111 - RNA, 17 nt, Human
ucuaugaaauauuaugu

SEQ ID NO: 1173112 - RNA, 18 nt, Human
ucuaugaaauauuauguu

SEQ ID NO: 1173113 - RNA, 17 nt, Human
ucucaaauaacuaaaag

SEQ ID NO: 1173114 - RNA, 17 nt, Human
ucuccugccucagccuc

SEQ ID NO: 1173115 - RNA, 15 nt, Human
ucuccugccucagcc

SEQ ID NO: 1173116 - RNA, 19 nt, Human
ucuccugccucagccuccc

SEQ ID NO: 1173117 - RNA, 21 nt, Human
ucuccuggaaauauuaagaaa

SEQ ID NO: 1173118 - RNA, 15 nt, Human
ucuccuguaccucuu

SEQ ID NO: 1173119 - RNA, 16 nt, Human
ucuccuguaccucuug

SEQ ID NO: 1173120 - RNA, 17 nt, Human
ucuccuguaccucuuga

SEQ ID NO: 1173121 - RNA, 19 nt, Human
ucuccuguaccucuugagc

SEQ ID NO: 1173122 - RNA, 14 nt, Human
ucucgugauugaua

SEQ ID NO: 1173123 - RNA, 22 nt, Human
ucucgugauugauaagaaccuu

SEQ ID NO: 1173124 - RNA, 12 nt, Human
ucucuaacuuca

SEQ ID NO: 1173125 - RNA, 19 nt, Human
ucucuaacuucaccauauu

SEQ ID NO: 1173126 - RNA, 15 nt, Human
ucucuaguuugauua

SEQ ID NO: 1173127 - RNA, 16 nt, Human
ucucuaguuugauuaa

SEQ ID NO: 1173128 - RNA, 17 nt, Human
ucucugaggacacuaac

SEQ ID NO: 1173129 - RNA, 20 nt, Human
ucugcaagaauugaagcagg

SEQ ID NO: 1173130 - RNA, 21 nt, Human
ucugcaagaauugaagcagga

SEQ ID NO: 1173131 - RNA, 14 nt, Human
ucugacccacugcu

SEQ ID NO: 1173132 - RNA, 15 nt, Human
ucugacccacugcuu

SEQ ID NO: 1173133 - RNA, 13 nt, Human
ucugaaaauguau

SEQ ID NO: 1173134 - RNA, 14 nt, Human
ucugaaaauguaug

SEQ ID NO: 1173135 - RNA, 17 nt, Human
ucugacacacagcucug

SEQ ID NO: 1173136 - RNA, 18 nt, Human
ucugacacacagcucugu

SEQ ID NO: 1173137 - RNA, 19 nt, Human
ucugacacacagcucuguc

SEQ ID NO: 1173138 - RNA, 12 nt, Human
ucugacaggcaa

SEQ ID NO: 1173139 - RNA, 21 nt, Human
ucugacaggcaaugcuggcug

SEQ ID NO: 1173140 - RNA, 22 nt, Human
ucugacaggcaaugcuggcugu

SEQ ID NO: 1173141 - RNA, 13 nt, Human
ucugacccacugc

SEQ ID NO: 1173142 - RNA, 19 nt, Human
ucugcugacagacacaggc

SEQ ID NO: 1173143 - RNA, 20 nt, Human
ucugcugacagacacaggcc

SEQ ID NO: 1173144 - RNA, 21 nt, Human
ucugcugacagacacaggccc

SEQ ID NO: 1173145 - RNA, 22 nt, Human
ucugcugacagacacaggcccg

SEQ ID NO: 1173146 - RNA, 15 nt, Human
ucuggaaugcagugg

SEQ ID NO: 1173147 - RNA, 16 nt, Human
ucuggaaugcaguggu

SEQ ID NO: 1173148 - RNA, 14 nt, Human
ucuggacaggcaug

SEQ ID NO: 1173149 - RNA, 21 nt, Human
ucuggacaggcauguucucug

SEQ ID NO: 1173150 - RNA, 18 nt, Human
ucugccauauucuguugg

SEQ ID NO: 1173151 - RNA, 14 nt, Human
ucugccugcccagg

SEQ ID NO: 1173152 - RNA, 15 nt, Human
ucugccugcccaggc

SEQ ID NO: 1173153 - RNA, 16 nt, Human
ucugccugcccaggcc

SEQ ID NO: 1173154 - RNA, 18 nt, Human
ucugcuccucuccccagc

SEQ ID NO: 1173155 - RNA, 21 nt, Human
ucugcuccucuccccagcaag

SEQ ID NO: 1173156 - RNA, 18 nt, Human
ucugcugacagacacagg

SEQ ID NO: 1173157 - RNA, 19 nt, Human
ucuggcuaugcauuugaaa

SEQ ID NO: 1173158 - RNA, 22 nt, Human
ucuggcuaugcauuugaaaauu

SEQ ID NO: 1173159 - RNA, 17 nt, Human
ucuggccuucggccucc

SEQ ID NO: 1173160 - RNA, 18 nt, Human
ucuggccuucggccucca

SEQ ID NO: 1173161 - RNA, 23 nt, Human
ucuggccuucggccuccauccug

SEQ ID NO: 1173162 - RNA, 23 nt, Human
ucuggcucuuccaggcugggaga

SEQ ID NO: 1173163 - RNA, 14 nt, Human
ucugggacacaguu

SEQ ID NO: 1173164 - RNA, 23 nt, Human
ucuggugacuuuccucuuugguc

SEQ ID NO: 1173165 - RNA, 15 nt, Human
ucuguccuacucugu

SEQ ID NO: 1173166 - RNA, 19 nt, Human
ucuguccuacucuguguca

SEQ ID NO: 1173167 - RNA, 20 nt, Human
ucuguccuacucugugucag

SEQ ID NO: 1173168 - RNA, 14 nt, Human
ucugucgcccaguc

SEQ ID NO: 1173169 - RNA, 16 nt, Human
ucugucgcccagucug

SEQ ID NO: 1173170 - RNA, 22 nt, Human
ucuuaggguuaugauuaaguaa

SEQ ID NO: 1173171 - RNA, 18 nt, Human
ucuucagaucucuaacuu

SEQ ID NO: 1173172 - RNA, 23 nt, Human
ucuucagaucucuaacuucacca

SEQ ID NO: 1173173 - RNA, 12 nt, Human
ucuugaacuccu

SEQ ID NO: 1173174 - RNA, 13 nt, Human
ucuuaaaaagugg

SEQ ID NO: 1173175 - RNA, 22 nt, Human
ucuuaaauauguggaguucauc

SEQ ID NO: 1173176 - RNA, 12 nt, Human
ucuuaagaagac

SEQ ID NO: 1173177 - RNA, 18 nt, Human
ucuuaagaagacugcauu

SEQ ID NO: 1173178 - RNA, 22 nt, Human
ugaccucaggugauccacccac

SEQ ID NO: 1173179 - RNA, 13 nt, Human
ugaccucugcagc

SEQ ID NO: 1173180 - RNA, 16 nt, Human
ugaccucugcagcaau

SEQ ID NO: 1173181 - RNA, 18 nt, Human
ugaccucugcagcaauaa

SEQ ID NO: 1173182 - RNA, 21 nt, Human
ugaccucugcagcaauaaagc

SEQ ID NO: 1173183 - RNA, 23 nt, Human
ugaccucugcagcaauaaagcag

SEQ ID NO: 1173184 - RNA, 12 nt, Human
ugaccucugccu

SEQ ID NO: 1173185 - RNA, 13 nt, Human
ugaccucugccug

SEQ ID NO: 1173186 - RNA, 14 nt, Human
ugaccuuucaauag

SEQ ID NO: 1173187 - RNA, 15 nt, Human
ugaccuuucaauagg

SEQ ID NO: 1173188 - RNA, 16 nt, Human
ugaccuuucaauagga

SEQ ID NO: 1173189 - RNA, 23 nt, Human
ugaccauucuccaccugccaggg

SEQ ID NO: 1173190 - RNA, 15 nt, Human
ucuugaacuccuggc

SEQ ID NO: 1173191 - RNA, 17 nt, Human
ucuugaauuguaaggaa

SEQ ID NO: 1173192 - RNA, 20 nt, Human
ugaccauucuccaccugcca

SEQ ID NO: 1173193 - RNA, 21 nt, Human
ugaccauucuccaccugccag

SEQ ID NO: 1173194 - RNA, 22 nt, Human
ugaccauucuccaccugccagg

SEQ ID NO: 1173195 - RNA, 18 nt, Human
ugaccuuucaauaggaaa

SEQ ID NO: 1173196 - RNA, 22 nt, Human
ugaccuuucaauaggaaaaacu

SEQ ID NO: 1173197 - RNA, 13 nt, Human
ugacgccauccca

SEQ ID NO: 1173198 - RNA, 14 nt, Human
ugacgccaucccag

SEQ ID NO: 1173199 - RNA, 15 nt, Human
ugacgccaucccagc

SEQ ID NO: 1173200 - RNA, 16 nt, Human
ugacgccaucccagcc

SEQ ID NO: 1173201 - RNA, 17 nt, Human
ugacgccaucccagccc

SEQ ID NO: 1173202 - RNA, 18 nt, Human
ugacgccaucccagcccc

SEQ ID NO: 1173203 - RNA, 19 nt, Human
ugacgccaucccagcccca

SEQ ID NO: 1173204 - RNA, 20 nt, Human
ugacgccaucccagccccaa

SEQ ID NO: 1173205 - RNA, 12 nt, Human
ugacucuuaaga

SEQ ID NO: 1173206 - RNA, 13 nt, Human
ugacugaauuucu

SEQ ID NO: 1173207 - RNA, 14 nt, Human
ugacugaauuucuu

SEQ ID NO: 1173208 - RNA, 15 nt, Human
ugacugaauuucuuu

SEQ ID NO: 1173209 - RNA, 13 nt, Human
ugacucuuaagaa

SEQ ID NO: 1173210 - RNA, 14 nt, Human
ugagacagcucugc

SEQ ID NO: 1173211 - RNA, 16 nt, Human
ugagacagcucugcau

SEQ ID NO: 1173212 - RNA, 12 nt, Human
ugagacccuguc

SEQ ID NO: 1173213 - RNA, 12 nt, Human
ugagacucuguc

SEQ ID NO: 1173214 - RNA, 13 nt, Human
ugagacucugucu

SEQ ID NO: 1173215 - RNA, 14 nt, Human
ugagacucugucuc

SEQ ID NO: 1173216 - RNA, 22 nt, Human
ugagaggcauccaguaucuuga

SEQ ID NO: 1173217 - RNA, 23 nt, Human
ugagaggcauccaguaucuugaa

SEQ ID NO: 1173218 - RNA, 20 nt, Human
ugagacucugucucaaaaaa

SEQ ID NO: 1173219 - RNA, 17 nt, Human
ugagaguagagucacug

SEQ ID NO: 1173220 - RNA, 14 nt, Human
ugagaugcuagaac

SEQ ID NO: 1173221 - RNA, 16 nt, Human
ugagaugcuagaacuc

SEQ ID NO: 1173222 - RNA, 20 nt, Human
ugagaugcuagaacucccuu

SEQ ID NO: 1173223 - RNA, 17 nt, Human
ugagcagucaggaaaga

SEQ ID NO: 1173224 - RNA, 20 nt, Human
ugagcagucaggaaagagaa

SEQ ID NO: 1173225 - RNA, 13 nt, Human
ugagcaucaggcc

SEQ ID NO: 1173226 - RNA, 14 nt, Human
ugagcaucaggcca

SEQ ID NO: 1173227 - RNA, 15 nt, Human
ugagcaucaggccag

SEQ ID NO: 1173228 - RNA, 16 nt, Human
ugagcaucaggccagg

SEQ ID NO: 1173229 - RNA, 13 nt, Human
ugagccccaaaag

SEQ ID NO: 1173230 - RNA, 13 nt, Human
ugagccucagcau

SEQ ID NO: 1173231 - RNA, 15 nt, Human
ugagccucagcaucc

SEQ ID NO: 1173232 - RNA, 11 nt, Human
ugaggcugggc

SEQ ID NO: 1173233 - RNA, 14 nt, Human
ugaggucuguucuu

SEQ ID NO: 1173234 - RNA, 15 nt, Human
ugaggucuguucuuu

SEQ ID NO: 1173235 - RNA, 20 nt, Human
ugaggucuguucuuuccaaa

SEQ ID NO: 1173236 - RNA, 16 nt, Human
ugaggugcuauguucu

SEQ ID NO: 1173237 - RNA, 19 nt, Human
ugagguuucaaaccucccu

SEQ ID NO: 1173238 - RNA, 21 nt, Human
ugaguccccuguuuguuucug

SEQ ID NO: 1173239 - RNA, 11 nt, Human
ugaguccuggc

SEQ ID NO: 1173240 - RNA, 18 nt, Human
ugaguccuggcaugggaa

SEQ ID NO: 1173241 - RNA, 19 nt, Human
ugaguccuggcaugggaau

SEQ ID NO: 1173242 - RNA, 22 nt, Human
ugaguccuggcaugggaaugaa

SEQ ID NO: 1173243 - RNA, 14 nt, Human
ugagucgaggacag

SEQ ID NO: 1173244 - RNA, 22 nt, Human
ugauagcacagacccugcccug

SEQ ID NO: 1173245 - RNA, 23 nt, Human
ugauagcacagacccugcccugu

SEQ ID NO: 1173246 - RNA, 15 nt, Human
ugauagcacagaccc

SEQ ID NO: 1173247 - RNA, 16 nt, Human
ugauagcacagacccu

SEQ ID NO: 1173248 - RNA, 17 nt, Human
ugauagcacagacccug

SEQ ID NO: 1173249 - RNA, 18 nt, Human
ugauagcacagacccugc

SEQ ID NO: 1173250 - RNA, 20 nt, Human
ugauagcacagacccugccc

SEQ ID NO: 1173251 - RNA, 21 nt, Human
ugauagcacagacccugcccu

SEQ ID NO: 1173252 - RNA, 15 nt, Human
ugagucgaggacagg

SEQ ID NO: 1173253 - RNA, 16 nt, Human
ugagucgaggacaggg

SEQ ID NO: 1173254 - RNA, 23 nt, Human
ugaguugauagcacagacccugc

SEQ ID NO: 1173255 - RNA, 16 nt, Human
ugaguugauucagcuc

SEQ ID NO: 1173256 - RNA, 19 nt, Human
ugaguugauucagcucugc

SEQ ID NO: 1173257 - RNA, 18 nt, Human
ugagucgaggacagggag

SEQ ID NO: 1173258 - RNA, 21 nt, Human
ugauccacccaccucagccuc

SEQ ID NO: 1173259 - RNA, 22 nt, Human
ugauccacccaccucagccucc

SEQ ID NO: 1173260 - RNA, 19 nt, Human
ugaucuaggaagacuuugg

SEQ ID NO: 1173261 - RNA, 21 nt, Human
ugaucuaggaagacuuuggaa

SEQ ID NO: 1173262 - RNA, 13 nt, Human
ugaucauccacug

SEQ ID NO: 1173263 - RNA, 24 nt, Human
ugaucauccacugugccaugugcc

SEQ ID NO: 1173264 - RNA, 21 nt, Human
ugauccaagcuggucccacuc

SEQ ID NO: 1173265 - RNA, 15 nt, Human
ugauccacccaccuc

SEQ ID NO: 1173266 - RNA, 16 nt, Human
ugauccacccaccuca

SEQ ID NO: 1173267 - RNA, 20 nt, Human
ugauccacccaccucagccu

SEQ ID NO: 1173268 - RNA, 24 nt, Human
ugauaguuguaccgcaaugugacu

SEQ ID NO: 1173269 - RNA, 22 nt, Human
ugaucacggcucacugcagccu

SEQ ID NO: 1173270 - RNA, 19 nt, Human
ugaucuuugcagacaggca

SEQ ID NO: 1173271 - RNA, 20 nt, Human
ugaucuuugcagacaggcaa

SEQ ID NO: 1173272 - RNA, 21 nt, Human
ugaucuuugcagacaggcaag

SEQ ID NO: 1173273 - RNA, 23 nt, Human
ugaucuuugcagacaggcaagca

SEQ ID NO: 1173274 - RNA, 23 nt, Human
ugaugaucuuugcagacaggcaa

SEQ ID NO: 1173275 - RNA, 20 nt, Human
ugaugaugaaaugaggucag

SEQ ID NO: 1173276 - RNA, 14 nt, Human
ugaugccaugagga

SEQ ID NO: 1173277 - RNA, 19 nt, Human
ugaugcuucuucagagacu

SEQ ID NO: 1173278 - RNA, 21 nt, Human
ugaugcuucuucagagacucc

SEQ ID NO: 1173279 - RNA, 22 nt, Human
ugaugcuucuucagagacuccu

SEQ ID NO: 1173280 - RNA, 23 nt, Human
ugaugcuucuucagagacuccug

SEQ ID NO: 1173281 - RNA, 16 nt, Human
ugauuuuuuuuuccuu

SEQ ID NO: 1173282 - RNA, 17 nt, Human
ugauuuuuuuuuccuuc

SEQ ID NO: 1173283 - RNA, 19 nt, Human
ugauuuuuuuuuccuucag

SEQ ID NO: 1173284 - RNA, 20 nt, Human
ugauuuuuuuuuccuucagu

SEQ ID NO: 1173285 - RNA, 22 nt, Human
ugauuuuuuuuuccuucagugc

SEQ ID NO: 1173286 - RNA, 23 nt, Human
ugauuuuuuuuuccuucagugcc

SEQ ID NO: 1173287 - RNA, 13 nt, Human
ugauuuucauugc

SEQ ID NO: 1173288 - RNA, 15 nt, Human
ugauuuucauugcug

SEQ ID NO: 1173289 - RNA, 22 nt, Human
ugcaaccugauugugucucuug

SEQ ID NO: 1173290 - RNA, 18 nt, Human
ugcaaccuccgccucuug

SEQ ID NO: 1173291 - RNA, 20 nt, Human
ugcaaccuccgccucuuggg

SEQ ID NO: 1173292 - RNA, 21 nt, Human
ugcaaccuccgccucuugggu

SEQ ID NO: 1173293 - RNA, 19 nt, Human
ugcaaccugauugugucuc

SEQ ID NO: 1173294 - RNA, 20 nt, Human
ugcaaccugauugugucucu

SEQ ID NO: 1173295 - RNA, 14 nt, Human
ugcaacaggcuggg

SEQ ID NO: 1173296 - RNA, 15 nt, Human
ugcaacaggcugggc

SEQ ID NO: 1173297 - RNA, 16 nt, Human
ugcaacaggcugggcu

SEQ ID NO: 1173298 - RNA, 17 nt, Human
ugcaacaggcugggcuu

SEQ ID NO: 1173299 - RNA, 19 nt, Human
ugcaacaggcugggcuuca

SEQ ID NO: 1173300 - RNA, 20 nt, Human
ugcaacaggcugggcuucag

SEQ ID NO: 1173301 - RNA, 13 nt, Human
ugcaaccuccgcc

SEQ ID NO: 1173302 - RNA, 14 nt, Human
ugcaaccuccgccu

SEQ ID NO: 1173303 - RNA, 17 nt, Human
ugcacagaguuguuaca

SEQ ID NO: 1173304 - RNA, 18 nt, Human
ugcacagaguuguuacau

SEQ ID NO: 1173305 - RNA, 19 nt, Human
ugcacagaguuguuacauu

SEQ ID NO: 1173306 - RNA, 17 nt, Human
ugcacaaacagaggccg

SEQ ID NO: 1173307 - RNA, 19 nt, Human
ugcacaaacagaggccgcc

SEQ ID NO: 1173308 - RNA, 20 nt, Human
ugcacaaacagaggccgcca

SEQ ID NO: 1173309 - RNA, 15 nt, Human
ugcacaaacagaggc

SEQ ID NO: 1173310 - RNA, 16 nt, Human
ugcacaaacagaggcc

SEQ ID NO: 1173311 - RNA, 13 nt, Human
ugcaaugaccuuu

SEQ ID NO: 1173312 - RNA, 16 nt, Human
ugcaaugaccuuucaa

SEQ ID NO: 1173313 - RNA, 17 nt, Human
ugcaaugaccuuucaau

SEQ ID NO: 1173314 - RNA, 19 nt, Human
ugcaaugaccuuucaauag

SEQ ID NO: 1173315 - RNA, 22 nt, Human
ugcaaugaccuuucaauaggaa

SEQ ID NO: 1173316 - RNA, 23 nt, Human
ugcaaugaccuuucaauaggaaa

SEQ ID NO: 1173317 - RNA, 13 nt, Human
ugcaauggcagcc

SEQ ID NO: 1173318 - RNA, 14 nt, Human
ugcaauggcagccu

SEQ ID NO: 1173319 - RNA, 15 nt, Human
ugcaauggcagccuu

SEQ ID NO: 1173320 - RNA, 16 nt, Human
ugcaauggcagccuug

SEQ ID NO: 1173321 - RNA, 20 nt, Human
ugcacagaguuguuacauuu

SEQ ID NO: 1173322 - RNA, 19 nt, Human
ugcaccggcuggccuggcc

SEQ ID NO: 1173323 - RNA, 20 nt, Human
ugcaccggcuggccuggccc

SEQ ID NO: 1173324 - RNA, 21 nt, Human
ugcaccggcuggccuggcccc

SEQ ID NO: 1173325 - RNA, 17 nt, Human
ugcaccuggaauauaua

SEQ ID NO: 1173326 - RNA, 20 nt, Human
ugcaccuggaauauauaacc

SEQ ID NO: 1173327 - RNA, 22 nt, Human
ugcaccuggaauauauaaccag

SEQ ID NO: 1173328 - RNA, 16 nt, Human
ugcacuugcagacucu

SEQ ID NO: 1173329 - RNA, 18 nt, Human
ugcacugacauuguuggc

SEQ ID NO: 1173330 - RNA, 21 nt, Human
ugcacugacauuguuggccaa

SEQ ID NO: 1173331 - RNA, 19 nt, Human
ugcagauaaacaguaguga

SEQ ID NO: 1173332 - RNA, 15 nt, Human
ugcauguuugugauu

SEQ ID NO: 1173333 - RNA, 14 nt, Human
ugcauuauauuuau

SEQ ID NO: 1173334 - RNA, 12 nt, Human
ugcauuaucuag

SEQ ID NO: 1173335 - RNA, 17 nt, Human
ugcauuaucuagauacu

SEQ ID NO: 1173336 - RNA, 18 nt, Human
ugcauuaucuagauacug

SEQ ID NO: 1173337 - RNA, 16 nt, Human
ugccaggaagccagca

SEQ ID NO: 1173338 - RNA, 18 nt, Human
ugccaggaagccagcagg

SEQ ID NO: 1173339 - RNA, 19 nt, Human
ugccaggaagccagcaggc

SEQ ID NO: 1173340 - RNA, 17 nt, Human
ugccagguuuuuggucu

SEQ ID NO: 1173341 - RNA, 12 nt, Human
ugccauccaggu

SEQ ID NO: 1173342 - RNA, 15 nt, Human
ugccauccagguuca

SEQ ID NO: 1173343 - RNA, 20 nt, Human
ugccauccagguucagcuug

SEQ ID NO: 1173344 - RNA, 20 nt, Human
ugccaugaggaacaaggcaa

SEQ ID NO: 1173345 - RNA, 23 nt, Human
ugccaugaggaacaaggcaaggc

SEQ ID NO: 1173346 - RNA, 14 nt, Human
ugccaugugccagg

SEQ ID NO: 1173347 - RNA, 15 nt, Human
ugccaugugccaggu

SEQ ID NO: 1173348 - RNA, 12 nt, Human
ugccauguuggc

SEQ ID NO: 1173349 - RNA, 15 nt, Human
ugccauguuggccag

SEQ ID NO: 1173350 - RNA, 16 nt, Human
ugccauguuggccagg

SEQ ID NO: 1173351 - RNA, 20 nt, Human
ugcccaccuggccucugcac

SEQ ID NO: 1173352 - RNA, 18 nt, Human
ugcccacgcuggagugca

SEQ ID NO: 1173353 - RNA, 13 nt, Human
ugcccacucccug

SEQ ID NO: 1173354 - RNA, 17 nt, Human
ugcccuaaaguguauuu

SEQ ID NO: 1173355 - RNA, 19 nt, Human
ugcccuaaaguguauuuuu

SEQ ID NO: 1173356 - RNA, 22 nt, Human
ugcccugcccaccuggccucug

SEQ ID NO: 1173357 - RNA, 23 nt, Human
ugcccugcccaccuggccucugc

SEQ ID NO: 1173358 - RNA, 15 nt, Human
ugccgucuaccugag

SEQ ID NO: 1173359 - RNA, 16 nt, Human
ugccgucuaccugagg

SEQ ID NO: 1173360 - RNA, 17 nt, Human
ugccgucuaccugaggg

SEQ ID NO: 1173361 - RNA, 19 nt, Human
ugccgucuaccugaggggc

SEQ ID NO: 1173362 - RNA, 13 nt, Human
ugccucugggacu

SEQ ID NO: 1173363 - RNA, 14 nt, Human
ugccucugggacug

SEQ ID NO: 1173364 - RNA, 21 nt, Human
ugccuccuuugugaggaagcc

SEQ ID NO: 1173365 - RNA, 22 nt, Human
ugccuccuuugugaggaagccg

SEQ ID NO: 1173366 - RNA, 21 nt, Human
ugccucuucucuacucuaggg

SEQ ID NO: 1173367 - RNA, 13 nt, Human
ugccugcccaggc

SEQ ID NO: 1173368 - RNA, 17 nt, Human
ugccugguggcagcugc

SEQ ID NO: 1173369 - RNA, 18 nt, Human
ugccugguggcagcugcg

SEQ ID NO: 1173370 - RNA, 19 nt, Human
ugccugguggcagcugcgg

SEQ ID NO: 1173371 - RNA, 22 nt, Human
ugcuucuguuuuauaauuuugu

SEQ ID NO: 1173372 - RNA, 13 nt, Human
ugcuucuucagag

SEQ ID NO: 1173373 - RNA, 18 nt, Human
ugcuugugaaaggaaaga

SEQ ID NO: 1173374 - RNA, 22 nt, Human
uggaaaaguauguuagugcaaa

SEQ ID NO: 1173375 - RNA, 15 nt, Human
uggaacacucugaga

SEQ ID NO: 1173376 - RNA, 17 nt, Human
uggaacacucugagacu

SEQ ID NO: 1173377 - RNA, 19 nt, Human
ugcuuaacuucacauauug

SEQ ID NO: 1173378 - RNA, 13 nt, Human
ugcuuaacuucac

SEQ ID NO: 1173379 - RNA, 14 nt, Human
ugcuuaacuucaca

SEQ ID NO: 1173380 - RNA, 17 nt, Human
ugcuuaacuucacauau

SEQ ID NO: 1173381 - RNA, 18 nt, Human
ugcuuaacuucacauauu

SEQ ID NO: 1173382 - RNA, 22 nt, Human
ugcuuccagugaggcucugccc

SEQ ID NO: 1173383 - RNA, 23 nt, Human
ugcuuccagugaggcucugcccu

SEQ ID NO: 1173384 - RNA, 18 nt, Human
uggacaggcauguucucu

SEQ ID NO: 1173385 - RNA, 22 nt, Human
uggacaggcauguucucugagg

SEQ ID NO: 1173386 - RNA, 23 nt, Human
uggacaggcauguucucugagga

SEQ ID NO: 1173387 - RNA, 19 nt, Human
uggacguguuaugacucca

SEQ ID NO: 1173388 - RNA, 23 nt, Human
uggacguguuaugacuccagaau

SEQ ID NO: 1173389 - RNA, 19 nt, Human
uggacuaacuugucuuugg

SEQ ID NO: 1173390 - RNA, 20 nt, Human
uggacuaacuugucuuugga

SEQ ID NO: 1173391 - RNA, 23 nt, Human
uggaggggggaggugggauccuc

SEQ ID NO: 1173392 - RNA, 13 nt, Human
uggaugcagccuc

SEQ ID NO: 1173393 - RNA, 21 nt, Human
uggaugcagccucacaguccu

SEQ ID NO: 1173394 - RNA, 22 nt, Human
uggaugcagccucacaguccuu

SEQ ID NO: 1173395 - RNA, 15 nt, Human
uggauuuaacagaaa

SEQ ID NO: 1173396 - RNA, 17 nt, Human
uggauuuaacagaaaug

SEQ ID NO: 1173397 - RNA, 22 nt, Human
uggcacuauaauguaagcucua

SEQ ID NO: 1173398 - RNA, 22 nt, Human
uggcacugcuuccagugaggcu

SEQ ID NO: 1173399 - RNA, 22 nt, Human
uggccuucggccuccauccuga

SEQ ID NO: 1173400 - RNA, 23 nt, Human
uggccuucggccuccauccugag

SEQ ID NO: 1173401 - RNA, 13 nt, Human
uggccucugcacu

SEQ ID NO: 1173402 - RNA, 13 nt, Human
uggcugcugaagg

SEQ ID NO: 1173403 - RNA, 14 nt, Human
uggcugcugaaggc

SEQ ID NO: 1173404 - RNA, 16 nt, Human
uggcugcugaaggcuc

SEQ ID NO: 1173405 - RNA, 22 nt, Human
uggcuuccuaaaauucagugga

SEQ ID NO: 1173406 - RNA, 17 nt, Human
uggcagcugcgguccac

SEQ ID NO: 1173407 - RNA, 19 nt, Human
uggcagcugcgguccaccc

SEQ ID NO: 1173408 - RNA, 13 nt, Human
uggccccucaggg

SEQ ID NO: 1173409 - RNA, 20 nt, Human
uggccccucagggucccugg

SEQ ID NO: 1173410 - RNA, 21 nt, Human
uggccccucagggucccuggu

SEQ ID NO: 1173411 - RNA, 22 nt, Human
uggccccucagggucccuggug

SEQ ID NO: 1173412 - RNA, 14 nt, Human
uggccccugcccgg

SEQ ID NO: 1173413 - RNA, 20 nt, Human
uggccuagcauacguacaca

SEQ ID NO: 1173414 - RNA, 23 nt, Human
uggccuagcauacguacacauuu

SEQ ID NO: 1173415 - RNA, 18 nt, Human
uggccucaagugauucuc

SEQ ID NO: 1173416 - RNA, 23 nt, Human
uggccucaagugauucuccugcc

SEQ ID NO: 1173417 - RNA, 11 nt, Human
uggccucccaa

SEQ ID NO: 1173418 - RNA, 14 nt, Human
uggccucccaacuc

SEQ ID NO: 1173419 - RNA, 19 nt, Human
uggccucccaacucacccc

SEQ ID NO: 1173420 - RNA, 20 nt, Human
uggccucccaacucacccca

SEQ ID NO: 1173421 - RNA, 21 nt, Human
uggccucccaacucaccccag

SEQ ID NO: 1173422 - RNA, 22 nt, Human
uggccucccaacucaccccagc

SEQ ID NO: 1173423 - RNA, 23 nt, Human
uggccucccaacucaccccagcc

SEQ ID NO: 1173424 - RNA, 18 nt, Human
ugggaugauuggaggggg

SEQ ID NO: 1173425 - RNA, 18 nt, Human
ugggaggaucucuugagc

SEQ ID NO: 1173426 - RNA, 16 nt, Human
ugggaaugaaugucag

SEQ ID NO: 1173427 - RNA, 21 nt, Human
ugggaaugaaugucaguguga

SEQ ID NO: 1173428 - RNA, 14 nt, Human
ugggacacccugug

SEQ ID NO: 1173429 - RNA, 15 nt, Human
ugggacacccuguga

SEQ ID NO: 1173430 - RNA, 14 nt, Human
ugggacagggagga

SEQ ID NO: 1173431 - RNA, 16 nt, Human
ugggaggaucucuuga

SEQ ID NO: 1173432 - RNA, 14 nt, Human
ugggcagagcagag

SEQ ID NO: 1173433 - RNA, 15 nt, Human
ugggcagagcagaga

SEQ ID NO: 1173434 - RNA, 17 nt, Human
ugggcagagcagagacc

SEQ ID NO: 1173435 - RNA, 18 nt, Human
ugggcagagcagagacca

SEQ ID NO: 1173436 - RNA, 14 nt, Human
ugggccuggcuccc

SEQ ID NO: 1173437 - RNA, 22 nt, Human
ugggcuucaguggcagcugcuu

SEQ ID NO: 1173438 - RNA, 15 nt, Human
ugggcuucauccucc

SEQ ID NO: 1173439 - RNA, 22 nt, Human
ugggcuucauccuccucagauc

SEQ ID NO: 1173440 - RNA, 23 nt, Human
ugggcuuggggaccagagcugcc

SEQ ID NO: 1173441 - RNA, 17 nt, Human
ugggcuugucuguagau

SEQ ID NO: 1173442 - RNA, 21 nt, Human
ugggcuugucuguagauuuua

SEQ ID NO: 1173443 - RNA, 13 nt, Human
uggggcagcuuga

SEQ ID NO: 1173444 - RNA, 16 nt, Human
ugggggccucagugcc

SEQ ID NO: 1173445 - RNA, 19 nt, Human
uggggggcugaggugggag

SEQ ID NO: 1173446 - RNA, 20 nt, Human
ugguggcagugggagcugcc

SEQ ID NO: 1173447 - RNA, 13 nt, Human
ugguggcaguggg

SEQ ID NO: 1173448 - RNA, 18 nt, Human
ugguggcagugggagcug

SEQ ID NO: 1173449 - RNA, 14 nt, Human
uggugcaaugaccu

SEQ ID NO: 1173450 - RNA, 19 nt, Human
uggugcaaugaccuuucaa

SEQ ID NO: 1173451 - RNA, 20 nt, Human
uggugcaaugaccuuucaau

SEQ ID NO: 1173452 - RNA, 23 nt, Human
uggguacuuguggacacagcucu

SEQ ID NO: 1173453 - RNA, 14 nt, Human
uggguagacacaca

SEQ ID NO: 1173454 - RNA, 16 nt, Human
uggguagacacacaug

SEQ ID NO: 1173455 - RNA, 14 nt, Human
uggugagaggcauc

SEQ ID NO: 1173456 - RNA, 13 nt, Human
ugguggcuggguu

SEQ ID NO: 1173457 - RNA, 16 nt, Human
uggugggggccucggu

SEQ ID NO: 1173458 - RNA, 18 nt, Human
uggugggggccucggugu

SEQ ID NO: 1173459 - RNA, 17 nt, Human
uggugguuucagaaaug

SEQ ID NO: 1173460 - RNA, 18 nt, Human
uggugguuucagaaaugu

SEQ ID NO: 1173461 - RNA, 19 nt, Human
uggugguuuucuguucuuu

SEQ ID NO: 1173462 - RNA, 18 nt, Human
uggugucgggcaugacac

SEQ ID NO: 1173463 - RNA, 19 nt, Human
uggugucgggcaugacacg

SEQ ID NO: 1173464 - RNA, 16 nt, Human
uggugucaccugaaga

SEQ ID NO: 1173465 - RNA, 15 nt, Human
uggugucgggcauga

SEQ ID NO: 1173466 - RNA, 16 nt, Human
ugguucccuugaugaa

SEQ ID NO: 1173467 - RNA, 17 nt, Human
ugguucccuugaugaag

SEQ ID NO: 1173468 - RNA, 20 nt, Human
ugguucccuugaugaagaag

SEQ ID NO: 1173469 - RNA, 18 nt, Human
ugguugaugaucuuugca

SEQ ID NO: 1173470 - RNA, 16 nt, Human
ugguuuucuguucuuu

SEQ ID NO: 1173471 - RNA, 19 nt, Human
ugguuuucuuguguguuua

SEQ ID NO: 1173472 - RNA, 21 nt, Human
ugguuuuuaaaaaacugcuga

SEQ ID NO: 1173473 - RNA, 23 nt, Human
ugguuuuuaaaaaacugcugacu

SEQ ID NO: 1173474 - RNA, 11 nt, Human
uguaaaauggu

SEQ ID NO: 1173475 - RNA, 12 nt, Human
uguaaaauggug

SEQ ID NO: 1173476 - RNA, 14 nt, Human
uguaacaagccacc

SEQ ID NO: 1173477 - RNA, 17 nt, Human
uguaacaagccacccca

SEQ ID NO: 1173478 - RNA, 14 nt, Human
uguacagacaacaa

SEQ ID NO: 1173479 - RNA, 11 nt, Human
uguacagagcc

SEQ ID NO: 1173480 - RNA, 13 nt, Human
uguaucugagcag

SEQ ID NO: 1173481 - RNA, 18 nt, Human
uguaggaagguuaauguu

SEQ ID NO: 1173482 - RNA, 22 nt, Human
uguaguguuggagaagaacuga

SEQ ID NO: 1173483 - RNA, 13 nt, Human
uguauaaaauaau

SEQ ID NO: 1173484 - RNA, 14 nt, Human
uguauaaaauaauu

SEQ ID NO: 1173485 - RNA, 20 nt, Human
uguaguguuggagaagaacu

SEQ ID NO: 1173486 - RNA, 21 nt, Human
uguaguguuggagaagaacug

SEQ ID NO: 1173487 - RNA, 12 nt, Human
uguacagagccc

SEQ ID NO: 1173488 - RNA, 13 nt, Human
uguacagagccca

SEQ ID NO: 1173489 - RNA, 22 nt, Human
uguacagcaaggagauuuacaa

SEQ ID NO: 1173490 - RNA, 23 nt, Human
uguacagcaaggagauuuacaac

SEQ ID NO: 1173491 - RNA, 18 nt, Human
uguauuuuaaaagaauga

SEQ ID NO: 1173492 - RNA, 19 nt, Human
uguauuuuaaaagaaugau

SEQ ID NO: 1173493 - RNA, 19 nt, Human
uguauuuuacuaauaaaau

SEQ ID NO: 1173494 - RNA, 21 nt, Human
ugucaauuacaggaaguacug

SEQ ID NO: 1173495 - RNA, 13 nt, Human
ugucacacacuuu

SEQ ID NO: 1173496 - RNA, 14 nt, Human
ugucacaggcaggu

SEQ ID NO: 1173497 - RNA, 15 nt, Human
ugucacaggcagguc

SEQ ID NO: 1173498 - RNA, 16 nt, Human
ugucacaggcaggucc

SEQ ID NO: 1173499 - RNA, 17 nt, Human
ugucacaggcaggucca

SEQ ID NO: 1173500 - RNA, 21 nt, Human
ugucacaggcagguccagggu

SEQ ID NO: 1173501 - RNA, 15 nt, Human
ugucagugugacuga

SEQ ID NO: 1173502 - RNA, 16 nt, Human
ugucagugugacugau

SEQ ID NO: 1173503 - RNA, 19 nt, Human
ugucagugugacugaucuc

SEQ ID NO: 1173504 - RNA, 17 nt, Human
uguccccgcacugggcu

SEQ ID NO: 1173505 - RNA, 19 nt, Human
uguccccgcacugggcuug

SEQ ID NO: 1173506 - RNA, 12 nt, Human
uguccugggagu

SEQ ID NO: 1173507 - RNA, 19 nt, Human
uguccugggagugagcugg

SEQ ID NO: 1173508 - RNA, 20 nt, Human
uguccugggagugagcuggu

SEQ ID NO: 1173509 - RNA, 14 nt, Human
ugucuaaugaaacc

SEQ ID NO: 1173510 - RNA, 17 nt, Human
ugucuacacuaagagag

SEQ ID NO: 1173511 - RNA, 22 nt, Human
ugucuacacuaagagagaauga

SEQ ID NO: 1173512 - RNA, 21 nt, Human
ugucucaaaaaaagaaaaaga

SEQ ID NO: 1173513 - RNA, 15 nt, Human
ugucuaguuguuuga

SEQ ID NO: 1173514 - RNA, 23 nt, Human
ugucuaguuguuugauucagaca

SEQ ID NO: 1173515 - RNA, 14 nt, Human
ugucuaugggacuc

SEQ ID NO: 1173516 - RNA, 15 nt, Human
ugucuaugggacuca

SEQ ID NO: 1173517 - RNA, 16 nt, Human
ugucuaugggacucaa

SEQ ID NO: 1173518 - RNA, 23 nt, Human
ugucuuuggacccugaggcccag

SEQ ID NO: 1173519 - RNA, 16 nt, Human
ugucuuuucuugcaug

SEQ ID NO: 1173520 - RNA, 13 nt, Human
ugugaaaagaaaa

SEQ ID NO: 1173521 - RNA, 15 nt, Human
ugugaaaagaaaaau

SEQ ID NO: 1173522 - RNA, 17 nt, Human
ugugaaaagaaaaauga

SEQ ID NO: 1173523 - RNA, 21 nt, Human
ugucuuuucuugcaugaggcu

SEQ ID NO: 1173524 - RNA, 21 nt, Human
ugugaaaagaaaaaugagccu

SEQ ID NO: 1173525 - RNA, 12 nt, Human
uuauaauuuaaa

SEQ ID NO: 1173526 - RNA, 14 nt, Human
uuauaauuuuguga

SEQ ID NO: 1173527 - RNA, 15 nt, Human
uuauaauuuugugaa

SEQ ID NO: 1173528 - RNA, 15 nt, Human
uuauaauaauguuaa

SEQ ID NO: 1173529 - RNA, 18 nt, Human
uuauaauaauguuaacau

SEQ ID NO: 1173530 - RNA, 11 nt, Human
uuauaaucuuu

SEQ ID NO: 1173531 - RNA, 15 nt, Human
uuauaaugaaugaaa

SEQ ID NO: 1173532 - RNA, 16 nt, Human
uuauaauuuugugaag

SEQ ID NO: 1173533 - RNA, 17 nt, Human
uuauaauuuugugaagc

SEQ ID NO: 1173534 - RNA, 18 nt, Human
uuauaauuuugugaagca

SEQ ID NO: 1173535 - RNA, 11 nt, Human
uuauacauaaa

SEQ ID NO: 1173536 - RNA, 13 nt, Human
uuauacauaaaca

SEQ ID NO: 1173537 - RNA, 14 nt, Human
uuaucuagauacug

SEQ ID NO: 1173538 - RNA, 16 nt, Human
uuauauuuacaaaugg

SEQ ID NO: 1173539 - RNA, 20 nt, Human
uuauauuuauuacuguaaga

SEQ ID NO: 1173540 - RNA, 12 nt, Human
uuauauuugaaa

SEQ ID NO: 1173541 - RNA, 13 nt, Human
uuauauuugaaau

SEQ ID NO: 1173542 - RNA, 15 nt, Human
uuauauuugaaauau

SEQ ID NO: 1173543 - RNA, 17 nt, Human
uuauggaacacucugag

SEQ ID NO: 1173544 - RNA, 18 nt, Human
uuauggaacacucugaga

SEQ ID NO: 1173545 - RNA, 20 nt, Human
uuauggaacacucugagacu

SEQ ID NO: 1173546 - RNA, 21 nt, Human
uuauggacaaugacccagugg

SEQ ID NO: 1173547 - RNA, 14 nt, Human
uuauggcacaucag

SEQ ID NO: 1173548 - RNA, 16 nt, Human
uuauggcuuuugugca

SEQ ID NO: 1173549 - RNA, 17 nt, Human
uuauggcuuuugugcau

SEQ ID NO: 1173550 - RNA, 18 nt, Human
uuauggcuuuugugcauu

SEQ ID NO: 1173551 - RNA, 23 nt, Human
uuauuaaaaaucucaaauuucua

SEQ ID NO: 1173552 - RNA, 19 nt, Human
uuauuaaaugcccagcccc

SEQ ID NO: 1173553 - RNA, 21 nt, Human
uuauuaaaugcccagccccuu

SEQ ID NO: 1173554 - RNA, 16 nt, Human
uuauuacuguaagaaa

SEQ ID NO: 1173555 - RNA, 22 nt, Human
uuauuuuggaaaauaaauuauu

SEQ ID NO: 1173556 - RNA, 19 nt, Human
uuauuuuaauaauguuuca

SEQ ID NO: 1173557 - RNA, 20 nt, Human
uuauuuuaauaauguuucaa

SEQ ID NO: 1173558 - RNA, 17 nt, Human
uuauuuuaauucaguug

SEQ ID NO: 1173559 - RNA, 18 nt, Human
uuauuuuauuaugcauga

SEQ ID NO: 1173560 - RNA, 22 nt, Human
uucacaagacccaaaaggcaga

SEQ ID NO: 1173561 - RNA, 13 nt, Human
uucacccuuuucu

SEQ ID NO: 1173562 - RNA, 14 nt, Human
uucaccuuuguccc

SEQ ID NO: 1173563 - RNA, 19 nt, Human
uucaccuuuguccccaccg

SEQ ID NO: 1173564 - RNA, 20 nt, Human
uucaccuuuguccccaccgc

SEQ ID NO: 1173565 - RNA, 21 nt, Human
uucaauaggaaaaacugauuu

SEQ ID NO: 1173566 - RNA, 22 nt, Human
uucaauaggaaaaacugauuuu

SEQ ID NO: 1173567 - RNA, 22 nt, Human
uucaccuuuguccccaccgcag

SEQ ID NO: 1173568 - RNA, 13 nt, Human
uucacggaagagc

SEQ ID NO: 1173569 - RNA, 17 nt, Human
uucacggaagagccuug

SEQ ID NO: 1173570 - RNA, 18 nt, Human
uucacggaagagccuugc

SEQ ID NO: 1173571 - RNA, 15 nt, Human
uucagacagcugccu

SEQ ID NO: 1173572 - RNA, 16 nt, Human
uucagacagcugccug

SEQ ID NO: 1173573 - RNA, 17 nt, Human
uucagacagcugccugg

SEQ ID NO: 1173574 - RNA, 21 nt, Human
uucagacagcugccugggauc

SEQ ID NO: 1173575 - RNA, 19 nt, Human
uuccagauccuggaaauca

SEQ ID NO: 1173576 - RNA, 14 nt, Human
uuccauggacuuug

SEQ ID NO: 1173577 - RNA, 15 nt, Human
uuccauggacuuugu

SEQ ID NO: 1173578 - RNA, 19 nt, Human
uuccaacccucaucaccaa

SEQ ID NO: 1173579 - RNA, 18 nt, Human
uuccagauccuggaaauc

SEQ ID NO: 1173580 - RNA, 13 nt, Human
uuccaaaguacac

SEQ ID NO: 1173581 - RNA, 16 nt, Human
uuccaaaguacacugu

SEQ ID NO: 1173582 - RNA, 23 nt, Human
uucaguuauuauauuuacaaaug

SEQ ID NO: 1173583 - RNA, 15 nt, Human
uucauaaccuagccu

SEQ ID NO: 1173584 - RNA, 15 nt, Human
uucauccuccucaga

SEQ ID NO: 1173585 - RNA, 19 nt, Human
uucauccuccucagaucuu

SEQ ID NO: 1173586 - RNA, 12 nt, Human
uucagcuccagc

SEQ ID NO: 1173587 - RNA, 15 nt, Human
uucagcuccagcuca

SEQ ID NO: 1173588 - RNA, 22 nt, Human
uucagcuccagcucaccagccc

SEQ ID NO: 1173589 - RNA, 22 nt, Human
uucagcuuguaaauagcucagg

SEQ ID NO: 1173590 - RNA, 14 nt, Human
uucaguggcagcug

SEQ ID NO: 1173591 - RNA, 15 nt, Human
uucaguggcagcugc

SEQ ID NO: 1173592 - RNA, 16 nt, Human
uucaguggcagcugcu

SEQ ID NO: 1173593 - RNA, 17 nt, Human
uucaguggcagcugcuu

SEQ ID NO: 1173594 - RNA, 12 nt, Human
uucaguguacau

SEQ ID NO: 1173595 - RNA, 13 nt, Human
uucaguguacaug

SEQ ID NO: 1173596 - RNA, 12 nt, Human
uuccauggccuc

SEQ ID NO: 1173597 - RNA, 16 nt, Human
uuccauggccucuuca

SEQ ID NO: 1173598 - RNA, 15 nt, Human
uuccugaggcugggc

SEQ ID NO: 1173599 - RNA, 20 nt, Human
uuccugaggcugggcucccu

SEQ ID NO: 1173600 - RNA, 21 nt, Human
uuccuugaguugauucagcuc

SEQ ID NO: 1173601 - RNA, 18 nt, Human
uucggugagcuacaaaug

SEQ ID NO: 1173602 - RNA, 12 nt, Human
uucuacccagcg

SEQ ID NO: 1173603 - RNA, 19 nt, Human
uucuacccagcgagcccug

SEQ ID NO: 1173604 - RNA, 13 nt, Human
uucuacgccaggg

SEQ ID NO: 1173605 - RNA, 20 nt, Human
uucuacccagcgagcccugg

SEQ ID NO: 1173606 - RNA, 21 nt, Human
uucuacccagcgagcccuggu

SEQ ID NO: 1173607 - RNA, 14 nt, Human
uucuacccaggugc

SEQ ID NO: 1173608 - RNA, 22 nt, Human
uucuacucgaguuacagacaaa

SEQ ID NO: 1173609 - RNA, 14 nt, Human
uucuaugaaauauu

SEQ ID NO: 1173610 - RNA, 21 nt, Human
uucuaugaaauauuauguuaa

SEQ ID NO: 1173611 - RNA, 20 nt, Human
uucuccaccugccagggaca

SEQ ID NO: 1173612 - RNA, 16 nt, Human
uucuccaccugccagg

SEQ ID NO: 1173613 - RNA, 18 nt, Human
uucuccaccugccaggga

SEQ ID NO: 1173614 - RNA, 21 nt, Human
uucuccaccucccacaaagga

SEQ ID NO: 1173615 - RNA, 12 nt, Human
uucuccaccugc

SEQ ID NO: 1173616 - RNA, 14 nt, Human
uucuccaccugcca

SEQ ID NO: 1173617 - RNA, 15 nt, Human
uucuccaccugccag

SEQ ID NO: 1173618 - RNA, 13 nt, Human
uucucuccagccc

SEQ ID NO: 1173619 - RNA, 14 nt, Human
uucucuccagcccc

SEQ ID NO: 1173620 - RNA, 15 nt, Human
uucucuccagccccu

SEQ ID NO: 1173621 - RNA, 16 nt, Human
uucucuccagccccug

SEQ ID NO: 1173622 - RNA, 14 nt, Human
uucucuccuguacc

SEQ ID NO: 1173623 - RNA, 18 nt, Human
uucucuccuguaccucuu

SEQ ID NO: 1173624 - RNA, 19 nt, Human
uucucuccuguaccucuug

SEQ ID NO: 1173625 - RNA, 22 nt, Human
uucucuccuguaccucuugagc

SEQ ID NO: 1173626 - RNA, 14 nt, Human
uucucugaggacac

SEQ ID NO: 1173627 - RNA, 20 nt, Human
uucucugaggacacuaacca

SEQ ID NO: 1173628 - RNA, 11 nt, Human
uucucugcccu

SEQ ID NO: 1173629 - RNA, 12 nt, Human
uucucugcccuc

SEQ ID NO: 1173630 - RNA, 16 nt, Human
uucucugcccuccaag

SEQ ID NO: 1173631 - RNA, 17 nt, Human
uucucugcccuccaaga

SEQ ID NO: 1173632 - RNA, 23 nt, Human
uucugacccaugcugcccuguga

SEQ ID NO: 1173633 - RNA, 18 nt, Human
uucugacccugcuucaaa

SEQ ID NO: 1173634 - RNA, 21 nt, Human
uucugacccugcuucaaauau

SEQ ID NO: 1173635 - RNA, 19 nt, Human
uucugauccuaguuccacc

SEQ ID NO: 1173636 - RNA, 19 nt, Human
uucugcucacauaucuguc

SEQ ID NO: 1173637 - RNA, 14 nt, Human
uucugcuucagccu

SEQ ID NO: 1173638 - RNA, 15 nt, Human
uucugcuucagccuc

SEQ ID NO: 1173639 - RNA, 16 nt, Human
uucugcuucagccucc

SEQ ID NO: 1173640 - RNA, 19 nt, Human
uucugcuucagccucccga

SEQ ID NO: 1173641 - RNA, 18 nt, Human
uucuguauuuuguuuuug

SEQ ID NO: 1173642 - RNA, 17 nt, Human
uucuguccgagcuuuga

SEQ ID NO: 1173643 - RNA, 21 nt, Human
uucuuauacauuugauaaagu

SEQ ID NO: 1173644 - RNA, 21 nt, Human
uucuuccacaagagcccaggc

SEQ ID NO: 1173645 - RNA, 13 nt, Human
uucuuccucccuc

SEQ ID NO: 1173646 - RNA, 23 nt, Human
uucuuccucccucccucuuuccc

SEQ ID NO: 1173647 - RNA, 21 nt, Human
uucuuguguguuuauugucaa

SEQ ID NO: 1173648 - RNA, 12 nt, Human
uucuuucagcca

SEQ ID NO: 1173649 - RNA, 14 nt, Human
uucuuuccaaagua

SEQ ID NO: 1173650 - RNA, 21 nt, Human
uucuuuccaaaguacacuguu

SEQ ID NO: 1173651 - RNA, 18 nt, Human
uucuuuccacagaagcuc

SEQ ID NO: 1173652 - RNA, 20 nt, Human
uugaaaaaccauuuugcugu

SEQ ID NO: 1173653 - RNA, 23 nt, Human
uugaaaacacuguucucugcccu

SEQ ID NO: 1173654 - RNA, 15 nt, Human
uugaacuccuggccu

SEQ ID NO: 1173655 - RNA, 16 nt, Human
uugaacuccuggccuc

SEQ ID NO: 1173656 - RNA, 18 nt, Human
uugaacuggguacuugug

SEQ ID NO: 1173657 - RNA, 13 nt, Human
uugaacuuugacc

SEQ ID NO: 1173658 - RNA, 17 nt, Human
uugacccacaagaaaug

SEQ ID NO: 1173659 - RNA, 17 nt, Human
uugaccgugaggccaga

SEQ ID NO: 1173660 - RNA, 14 nt, Human
uugaccucugcagc

SEQ ID NO: 1173661 - RNA, 15 nt, Human
uugaccucugcagca

SEQ ID NO: 1173662 - RNA, 16 nt, Human
uugaccucugcagcaa

SEQ ID NO: 1173663 - RNA, 17 nt, Human
uugacgccaucccagcc

SEQ ID NO: 1173664 - RNA, 18 nt, Human
uugacgccaucccagccc

SEQ ID NO: 1173665 - RNA, 19 nt, Human
uugacgccaucccagcccc

SEQ ID NO: 1173666 - RNA, 20 nt, Human
uugacgccaucccagcccca

SEQ ID NO: 1173667 - RNA, 16 nt, Human
uugaugaucuuugcag

SEQ ID NO: 1173668 - RNA, 21 nt, Human
uugcaaaguaucccuacugua

SEQ ID NO: 1173669 - RNA, 11 nt, Human
uugagccuggg

SEQ ID NO: 1173670 - RNA, 14 nt, Human
uugagccugggagg

SEQ ID NO: 1173671 - RNA, 13 nt, Human
uugaggguugggc

SEQ ID NO: 1173672 - RNA, 16 nt, Human
uugaggguugggcugg

SEQ ID NO: 1173673 - RNA, 15 nt, Human
uugaggucuguucuu

SEQ ID NO: 1173674 - RNA, 23 nt, Human
uugauauccucuuugagugaagc

SEQ ID NO: 1173675 - RNA, 14 nt, Human
uugaugaagaaguu

SEQ ID NO: 1173676 - RNA, 23 nt, Human
uugaugaagaaguugauaugccu

SEQ ID NO: 1173677 - RNA, 17 nt, Human
uuguaaauagcucaggu

SEQ ID NO: 1173678 - RNA, 18 nt, Human
uuguacauaaugcgugca

SEQ ID NO: 1173679 - RNA, 15 nt, Human
uuguaaauuaacuuu

SEQ ID NO: 1173680 - RNA, 16 nt, Human
uuguaaauuaacuuuu

SEQ ID NO: 1173681 - RNA, 18 nt, Human
uuguaaauuaacuuuuau

SEQ ID NO: 1173682 - RNA, 23 nt, Human
uuguaaauuaacuuuuauaaacu

SEQ ID NO: 1173683 - RNA, 22 nt, Human
uuggguucaagcgauucuucug

SEQ ID NO: 1173684 - RNA, 16 nt, Human
uuggucccccuuccau

SEQ ID NO: 1173685 - RNA, 16 nt, Human
uuggucugugagaugc

SEQ ID NO: 1173686 - RNA, 13 nt, Human
uuggucuguguga

SEQ ID NO: 1173687 - RNA, 15 nt, Human
uugucuuaaaaagug

SEQ ID NO: 1173688 - RNA, 15 nt, Human
uugucuagugaaacu

SEQ ID NO: 1173689 - RNA, 12 nt, Human
uugugauuuuug

SEQ ID NO: 1173690 - RNA, 16 nt, Human
uugugauuuuuguaau

SEQ ID NO: 1173691 - RNA, 17 nt, Human
uugugauuuuuguaauu

SEQ ID NO: 1173692 - RNA, 22 nt, Human
uugucuuaaaaaguggaaaaau

SEQ ID NO: 1173693 - RNA, 20 nt, Human
uugugaaaggaaagaggcuc

SEQ ID NO: 1173694 - RNA, 14 nt, Human
uuguauuacaaauc

SEQ ID NO: 1173695 - RNA, 15 nt, Human
uuguauucucuccug

SEQ ID NO: 1173696 - RNA, 16 nt, Human
uuguauucucuccugu

SEQ ID NO: 1173697 - RNA, 19 nt, Human
uuguauucucuccuguacc

SEQ ID NO: 1173698 - RNA, 21 nt, Human
uuguauucucuccuguaccuc

SEQ ID NO: 1173699 - RNA, 12 nt, Human
uugugccccugc

SEQ ID NO: 1173700 - RNA, 17 nt, Human
uugugcauuaucuagau

SEQ ID NO: 1173701 - RNA, 22 nt, Human
uugugcauuaucuagauacugu

SEQ ID NO: 1173702 - RNA, 23 nt, Human
uugugcauuaucuagauacugua

SEQ ID NO: 1173703 - RNA, 12 nt, Human
uugugcauuugg

SEQ ID NO: 1173704 - RNA, 16 nt, Human
uuguggacacagcucu

SEQ ID NO: 1173705 - RNA, 17 nt, Human
uuguggacacagcucuu

SEQ ID NO: 1173706 - RNA, 20 nt, Human
uuguggauuuaacagaaaug

SEQ ID NO: 1173707 - RNA, 21 nt, Human
uuguggauuuaacagaaaugu

SEQ ID NO: 1173708 - RNA, 21 nt, Human
uuguguuuauauauaagccaa

SEQ ID NO: 1173709 - RNA, 22 nt, Human
uuguggauuuaacagaaaugua

SEQ ID NO: 1173710 - RNA, 23 nt, Human
uuguggauuuaacagaaauguac

SEQ ID NO: 1173711 - RNA, 22 nt, Human
uuguuaguaugaggcauuuguu

SEQ ID NO: 1173712 - RNA, 20 nt, Human
uuguuagugugucuuagugu

SEQ ID NO: 1173713 - RNA, 18 nt, Human
uuguguuuugcaagccag

SEQ ID NO: 1173714 - RNA, 14 nt, Human
uuguuacauuuuua

SEQ ID NO: 1173715 - RNA, 19 nt, Human
uuguuaguaugaggcauuu

SEQ ID NO: 1173716 - RNA, 21 nt, Human
uuguuaguaugaggcauuugu

SEQ ID NO: 1173717 - RNA, 19 nt, Human
uuuaacucuauaauguguu

SEQ ID NO: 1173718 - RNA, 22 nt, Human
uuuaagaaaaaggaugcacaga

SEQ ID NO: 1173719 - RNA, 18 nt, Human
uuuaagaaaaaggaugca

SEQ ID NO: 1173720 - RNA, 13 nt, Human
uuuaauaauguuu

SEQ ID NO: 1173721 - RNA, 13 nt, Human
uuuacagagacag

SEQ ID NO: 1173722 - RNA, 13 nt, Human
uuuaccacuugug

SEQ ID NO: 1173723 - RNA, 14 nt, Human
uuuaauaauguuuc

SEQ ID NO: 1173724 - RNA, 19 nt, Human
uuuacuucuuauacauuug

SEQ ID NO: 1173725 - RNA, 22 nt, Human
uuuacuucuuauacauuugaua

SEQ ID NO: 1173726 - RNA, 14 nt, Human
uuuagaaauauaau

SEQ ID NO: 1173727 - RNA, 12 nt, Human
uuuagacagagu

SEQ ID NO: 1173728 - RNA, 19 nt, Human
uuuauuuaguuccuugagu

SEQ ID NO: 1173729 - RNA, 14 nt, Human
uuuauggcuuuugu

SEQ ID NO: 1173730 - RNA, 16 nt, Human
uuuauggcuuuugugc

SEQ ID NO: 1173731 - RNA, 13 nt, Human
uuuauuauggcac

SEQ ID NO: 1173732 - RNA, 20 nt, Human
uuuauggcuuuugugcauua

SEQ ID NO: 1173733 - RNA, 22 nt, Human
uuuauaauuuugugaagcaaaa

SEQ ID NO: 1173734 - RNA, 12 nt, Human
uuucaauaggaa

SEQ ID NO: 1173735 - RNA, 14 nt, Human
uuucaauaggaaaa

SEQ ID NO: 1173736 - RNA, 17 nt, Human
uuucaauaggaaaaacu

SEQ ID NO: 1173737 - RNA, 19 nt, Human
uuucaauaggaaaaacuga

SEQ ID NO: 1173738 - RNA, 15 nt, Human
uuucagcagcugcag

SEQ ID NO: 1173739 - RNA, 13 nt, Human
uuucaguguacau

SEQ ID NO: 1173740 - RNA, 14 nt, Human
uuucaguguacaug

SEQ ID NO: 1173741 - RNA, 14 nt, Human
uuucauuuagguga

SEQ ID NO: 1173742 - RNA, 18 nt, Human
uuucauuuaggugaggaa

SEQ ID NO: 1173743 - RNA, 17 nt, Human
uuuggucuacacugugc

SEQ ID NO: 1173744 - RNA, 17 nt, Human
uuuguauaaaauaauuu

SEQ ID NO: 1173745 - RNA, 18 nt, Human
uuuguauaaaauaauuuu

SEQ ID NO: 1173746 - RNA, 19 nt, Human
uuuguauaaaauaauuuuu

SEQ ID NO: 1173747 - RNA, 16 nt, Human
uuuguugucagcugaa

SEQ ID NO: 1173748 - RNA, 22 nt, Human
uuuguuaguaugaggcauuugu

SEQ ID NO: 1173749 - RNA, 15 nt, Human
uuuguugucagcuga

SEQ ID NO: 1173750 - RNA, 15 nt, Human
uuuccacagaagcuc

SEQ ID NO: 1173751 - RNA, 15 nt, Human
uuuccguuaaaauac

SEQ ID NO: 1173752 - RNA, 17 nt, Human
uuuccguuaaaauacca

SEQ ID NO: 1173753 - RNA, 21 nt, Human
uuugagugccuuacacaaugg

SEQ ID NO: 1173754 - RNA, 13 nt, Human
uuuggacccugag

SEQ ID NO: 1173755 - RNA, 21 nt, Human
uuuuaaaguaacccuacaaaa

SEQ ID NO: 1173756 - RNA, 15 nt, Human
uuuuacuaauagaca

SEQ ID NO: 1173757 - RNA, 23 nt, Human
uuuuauaauuuugugaagcaaaa

SEQ ID NO: 1173758 - RNA, 13 nt, Human
uuuuauacauaaa

SEQ ID NO: 1173759 - RNA, 21 nt, Human
uuuuauacauaaacaagacca

SEQ ID NO: 1173760 - RNA, 13 nt, Human
uuuuauauuugaa

SEQ ID NO: 1173761 - RNA, 18 nt, Human
uuuuauauuugaaauauu

SEQ ID NO: 1173762 - RNA, 18 nt, Human
uuuuauuuuuagacagag

SEQ ID NO: 1173763 - RNA, 17 nt, Human
uuuucaaaauaaaaaug

SEQ ID NO: 1173764 - RNA, 18 nt, Human
uuuucccuauuagagaag

SEQ ID NO: 1173765 - RNA, 22 nt, Human
uuuucccuauuagagaagagau

SEQ ID NO: 1173766 - RNA, 13 nt, Human
uuuucuacucgag

SEQ ID NO: 1173767 - RNA, 20 nt, Human
uuuucuacucgaguuacaga

SEQ ID NO: 1173768 - RNA, 22 nt, Human
uuuucuacucgaguuacagaca

SEQ ID NO: 1173769 - RNA, 23 nt, Human
uuuucuacucgaguuacagacaa

SEQ ID NO: 1173770 - RNA, 13 nt, Human
uuuucuucucccu

SEQ ID NO: 1173771 - RNA, 22 nt, Human
uuuucuuguguguuuauuguca

SEQ ID NO: 1173772 - RNA, 14 nt, Human
uuuucuucucccuc

SEQ ID NO: 1173773 - RNA, 16 nt, Human
uuuucuuucagccaag

SEQ ID NO: 1173774 - RNA, 17 nt, Human
uuuuuuccuucagugcc

SEQ ID NO: 1173775 - RNA, 11 nt, Human
uuuuuuuacua

SEQ ID NO: 1173776 - RNA, 12 nt, Human
uuuuuuuuaaga

SEQ ID NO: 1173777 - RNA, 12 nt, Human
uuuuuuacuaau

SEQ ID NO: 1173778 - RNA, 12 nt, Human
uuuuuaagaaaa

SEQ ID NO: 1173779 - RNA, 23 nt, Human
uuuuuaagaaaaaggaugcacag

SEQ ID NO: 1173780 - RNA, 16 nt, Human
uuuuuaagugcugcau

SEQ ID NO: 1173781 - RNA, 17 nt, Human
uuuuuaagugcugcauu

SEQ ID NO: 1173782 - RNA, 18 nt, Human
uuuuuaagugcugcauuu

SEQ ID NO: 1173783 - RNA, 19 nt, Human
uuuuuaagugcugcauuua

SEQ ID NO: 1173784 - RNA, 22 nt, Human
uuuuuaagugcugcauuuaaaa

SEQ ID NO: 1173785 - RNA, 23 nt, Human
uuuuuaagugcugcauuuaaaag

SEQ ID NO: 1173786 - RNA, 13 nt, Human
uuuuuuuugacaa

SEQ ID NO: 1173787 - RNA, 14 nt, Human
caaagagguuuuaa

SEQ ID NO: 1173788 - RNA, 21 nt, Human
caaagagguuuuaaaaaaauc

SEQ ID NO: 1173789 - RNA, 18 nt, Human
auuuuaauaauguuucaa

SEQ ID NO: 1173790 - RNA, 19 nt, Human
auuuuaauaauguuucaaa

SEQ ID NO: 1173791 - RNA, 14 nt, Human
caaaggagauugga

SEQ ID NO: 1173792 - RNA, 20 nt, Human
caaaggagauuggaaggaac

SEQ ID NO: 1173793 - RNA, 20 nt, Human
caaaggguaucaggugcugc

SEQ ID NO: 1173794 - RNA, 21 nt, Human
caaaggguaucaggugcugcc

SEQ ID NO: 1173795 - RNA, 23 nt, Human
caaaggguaucaggugcugccau

SEQ ID NO: 1173796 - RNA, 16 nt, Human
caaaguggugagaggc

SEQ ID NO: 1173797 - RNA, 17 nt, Human
caaaguggugagaggca

SEQ ID NO: 1173798 - RNA, 19 nt, Human
caaaguggugagaggcauc

SEQ ID NO: 1173799 - RNA, 20 nt, Human
caacaggcugggcuucagug

SEQ ID NO: 1173800 - RNA, 12 nt, Human
caagagggucug

SEQ ID NO: 1173801 - RNA, 16 nt, Human
caagagggucugagga

SEQ ID NO: 1173802 - RNA, 17 nt, Human
caagagggucugaggaa

SEQ ID NO: 1173803 - RNA, 13 nt, Human
caagaaaugaaag

SEQ ID NO: 1173804 - RNA, 15 nt, Human
caagaaaugaaagca

SEQ ID NO: 1173805 - RNA, 13 nt, Human
caagaccuucucc

SEQ ID NO: 1173806 - RNA, 14 nt, Human
caagaccuucuccu

SEQ ID NO: 1173807 - RNA, 20 nt, Human
caagacgcugugcugcccug

SEQ ID NO: 1173808 - RNA, 21 nt, Human
caagacgcugugcugcccugc

SEQ ID NO: 1173809 - RNA, 22 nt, Human
caagacgcugugcugcccugcc

SEQ ID NO: 1173810 - RNA, 23 nt, Human
caagacgcugugcugcccugccc

SEQ ID NO: 1173811 - RNA, 14 nt, Human
caaggauccugagc

SEQ ID NO: 1173812 - RNA, 15 nt, Human
caaggauccugagcc

SEQ ID NO: 1173813 - RNA, 16 nt, Human
caaggauccugagcca

SEQ ID NO: 1173814 - RNA, 17 nt, Human
caaggauccugagccag

SEQ ID NO: 1173815 - RNA, 21 nt, Human
caaggcugggggaagaagcuc

SEQ ID NO: 1173816 - RNA, 13 nt, Human
caaggcugucaau

SEQ ID NO: 1173817 - RNA, 14 nt, Human
caaggcugucaauu

SEQ ID NO: 1173818 - RNA, 21 nt, Human
caaggcugucaauuacaggaa

SEQ ID NO: 1173819 - RNA, 16 nt, Human
caagcauuuagaugua

SEQ ID NO: 1173820 - RNA, 19 nt, Human
caagcauuuagauguauag

SEQ ID NO: 1173821 - RNA, 13 nt, Human
caagggccuggcc

SEQ ID NO: 1173822 - RNA, 14 nt, Human
caagggccuggccu

SEQ ID NO: 1173823 - RNA, 15 nt, Human
caagggccuggccug

SEQ ID NO: 1173824 - RNA, 21 nt, Human
caaggggaauguuugccucug

SEQ ID NO: 1173825 - RNA, 23 nt, Human
caaggggaauguuugccucugcc

SEQ ID NO: 1173826 - RNA, 17 nt, Human
caaggggcccaaauucu

SEQ ID NO: 1173827 - RNA, 13 nt, Human
caaggucauuuuu

SEQ ID NO: 1173828 - RNA, 22 nt, Human
caagugaaaaaggaggaagaga

SEQ ID NO: 1173829 - RNA, 23 nt, Human
caagugaaaaaggaggaagagaa

SEQ ID NO: 1173830 - RNA, 14 nt, Human
caagugagacccug

SEQ ID NO: 1173831 - RNA, 15 nt, Human
caagugagacccugu

SEQ ID NO: 1173832 - RNA, 19 nt, Human
caagugagacccugucuca

SEQ ID NO: 1173833 - RNA, 19 nt, Human
caagugauucuccugccuc

SEQ ID NO: 1173834 - RNA, 20 nt, Human
caagugauucuccugccuca

SEQ ID NO: 1173835 - RNA, 21 nt, Human
caagugauucuccugccucag

SEQ ID NO: 1173836 - RNA, 16 nt, Human
caagggccuggccuga

SEQ ID NO: 1173837 - RNA, 17 nt, Human
caaauuuacagagacag

SEQ ID NO: 1173838 - RNA, 23 nt, Human
caaauuuacagagacagaaagca

SEQ ID NO: 1173839 - RNA, 14 nt, Human
caacaggcugggcu

SEQ ID NO: 1173840 - RNA, 17 nt, Human
caacaggcugggcuuca

SEQ ID NO: 1173841 - RNA, 14 nt, Human
caacauacucccau

SEQ ID NO: 1173842 - RNA, 15 nt, Human
caacauacucccauc

SEQ ID NO: 1173843 - RNA, 16 nt, Human
caacauacucccaucu

SEQ ID NO: 1173844 - RNA, 17 nt, Human
caaccugauugugucuc

SEQ ID NO: 1173845 - RNA, 19 nt, Human
caaccugauugugucucuu

SEQ ID NO: 1173846 - RNA, 21 nt, Human
caaccugauugugucucuugg

SEQ ID NO: 1173847 - RNA, 17 nt, Human
caacugcaucaagaugu

SEQ ID NO: 1173848 - RNA, 20 nt, Human
caacugcaucaagaugugac

SEQ ID NO: 1173849 - RNA, 23 nt, Human
caacugcaucaagaugugacaug

SEQ ID NO: 1173850 - RNA, 16 nt, Human
caacugcauuggcuuu

SEQ ID NO: 1173851 - RNA, 14 nt, Human
caaugaccuuucaa

SEQ ID NO: 1173852 - RNA, 15 nt, Human
caaugaccuuucaau

SEQ ID NO: 1173853 - RNA, 16 nt, Human
caaugaccuuucaaua

SEQ ID NO: 1173854 - RNA, 21 nt, Human
caaugaccuuucaauaggaaa

SEQ ID NO: 1173855 - RNA, 13 nt, Human
caaugauggucac

SEQ ID NO: 1173856 - RNA, 14 nt, Human
caaugauggucacc

SEQ ID NO: 1173857 - RNA, 14 nt, Human
caaugcaaaccauc

SEQ ID NO: 1173858 - RNA, 21 nt, Human
caaugcaaaccaucauugaaa

SEQ ID NO: 1173859 - RNA, 22 nt, Human
caaugcaaaccaucauugaaau

SEQ ID NO: 1173860 - RNA, 23 nt, Human
caaugcaaaccaucauugaaauc

SEQ ID NO: 1173861 - RNA, 14 nt, Human
caaugcacugacau

SEQ ID NO: 1173862 - RNA, 13 nt, Human
caaugcacuuugu

SEQ ID NO: 1173863 - RNA, 23 nt, Human
cacaagaaaugaaagcagggacu

SEQ ID NO: 1173864 - RNA, 23 nt, Human
cacaagacccaaaaggcagaagc

SEQ ID NO: 1173865 - RNA, 13 nt, Human
cacaagaaaugaa

SEQ ID NO: 1173866 - RNA, 15 nt, Human
cacaagaaaugaaag

SEQ ID NO: 1173867 - RNA, 18 nt, Human
cacaagaaaugaaagcag

SEQ ID NO: 1173868 - RNA, 14 nt, Human
caaugcacuuuguu

SEQ ID NO: 1173869 - RNA, 18 nt, Human
caaugguuuucuugugug

SEQ ID NO: 1173870 - RNA, 17 nt, Human
cacaaacgggcucagca

SEQ ID NO: 1173871 - RNA, 16 nt, Human
cacacaccagagccca

SEQ ID NO: 1173872 - RNA, 20 nt, Human
cacacaccagagcccaccuu

SEQ ID NO: 1173873 - RNA, 17 nt, Human
cacacagaaaauauacu

SEQ ID NO: 1173874 - RNA, 18 nt, Human
cacacagaaaauauacug

SEQ ID NO: 1173875 - RNA, 19 nt, Human
cacacagaaaauauacugu

SEQ ID NO: 1173876 - RNA, 13 nt, Human
cacacagaaaaua

SEQ ID NO: 1173877 - RNA, 14 nt, Human
cacacagaaaauau

SEQ ID NO: 1173878 - RNA, 15 nt, Human
cacacagaaaauaua

SEQ ID NO: 1173879 - RNA, 16 nt, Human
cacacagaaaauauac

SEQ ID NO: 1173880 - RNA, 11 nt, Human
cacacacacac

SEQ ID NO: 1173881 - RNA, 12 nt, Human
cacacacacaca

SEQ ID NO: 1173882 - RNA, 14 nt, Human
cacacacuuuggcu

SEQ ID NO: 1173883 - RNA, 11 nt, Human
cacacagaaaa

SEQ ID NO: 1173884 - RNA, 12 nt, Human
cacacagaaaau

SEQ ID NO: 1173885 - RNA, 13 nt, Human
cacacagcucugu

SEQ ID NO: 1173886 - RNA, 14 nt, Human
cacacagcucuguc

SEQ ID NO: 1173887 - RNA, 15 nt, Human
cacacagcucugucc

SEQ ID NO: 1173888 - RNA, 21 nt, Human
cacaccagagcccaccuuggc

SEQ ID NO: 1173889 - RNA, 22 nt, Human
cacaccagagcccaccuuggcu

SEQ ID NO: 1173890 - RNA, 16 nt, Human
cacacagcucuguccu

SEQ ID NO: 1173891 - RNA, 14 nt, Human
cacacccagcccac

SEQ ID NO: 1173892 - RNA, 20 nt, Human
cacacccagcccacuucugc

SEQ ID NO: 1173893 - RNA, 18 nt, Human
cacagugagucgaggaca

SEQ ID NO: 1173894 - RNA, 19 nt, Human
cacagcucuucuccaggcu

SEQ ID NO: 1173895 - RNA, 20 nt, Human
cacagcucuucuccaggcug

SEQ ID NO: 1173896 - RNA, 21 nt, Human
cacagcucuucuccaggcugu

SEQ ID NO: 1173897 - RNA, 14 nt, Human
cacaggcccggcuc

SEQ ID NO: 1173898 - RNA, 23 nt, Human
cacaguccuuaccagcagagcac

SEQ ID NO: 1173899 - RNA, 22 nt, Human
cacacggacacucaaaagcugg

SEQ ID NO: 1173900 - RNA, 17 nt, Human
cacaugaaguccaagca

SEQ ID NO: 1173901 - RNA, 20 nt, Human
cacaugaaguccaagcauuu

SEQ ID NO: 1173902 - RNA, 13 nt, Human
cacaugagcauca

SEQ ID NO: 1173903 - RNA, 17 nt, Human
cacaugagcaucaggcc

SEQ ID NO: 1173904 - RNA, 18 nt, Human
cacaugagcaucaggcca

SEQ ID NO: 1173905 - RNA, 19 nt, Human
cacaugagcaucaggccag

SEQ ID NO: 1173906 - RNA, 20 nt, Human
cacaugagcaucaggccagg

SEQ ID NO: 1173907 - RNA, 21 nt, Human
cacaugagcaucaggccaggc

SEQ ID NO: 1173908 - RNA, 17 nt, Human
cacaugcaaggucauuu

SEQ ID NO: 1173909 - RNA, 19 nt, Human
cacaugcaaggucauuuuu

SEQ ID NO: 1173910 - RNA, 20 nt, Human
cacaugcaaggucauuuuuu

SEQ ID NO: 1173911 - RNA, 18 nt, Human
cacaugcacgugugugca

SEQ ID NO: 1173912 - RNA, 13 nt, Human
cacaugcauacac

SEQ ID NO: 1173913 - RNA, 14 nt, Human
cacaugcauacaca

SEQ ID NO: 1173914 - RNA, 15 nt, Human
cacaugcauacacac

SEQ ID NO: 1173915 - RNA, 16 nt, Human
cacaugcauacacaca

SEQ ID NO: 1173916 - RNA, 17 nt, Human
cacaugcauacacacac

SEQ ID NO: 1173917 - RNA, 18 nt, Human
cacaugcauacacacaca

SEQ ID NO: 1173918 - RNA, 20 nt, Human
cacaugccucucucaggcca

SEQ ID NO: 1173919 - RNA, 21 nt, Human
cacaugccucucucaggccaa

SEQ ID NO: 1173920 - RNA, 13 nt, Human
cacaugccucucu

SEQ ID NO: 1173921 - RNA, 16 nt, Human
cacauguccaagaagc

SEQ ID NO: 1173922 - RNA, 17 nt, Human
cacauguccaagaagcc

SEQ ID NO: 1173923 - RNA, 19 nt, Human
caccacacccagcccacuu

SEQ ID NO: 1173924 - RNA, 15 nt, Human
caccagagcccaccu

SEQ ID NO: 1173925 - RNA, 17 nt, Human
caccagagcccaccuug

SEQ ID NO: 1173926 - RNA, 18 nt, Human
caccagagcccaccuugg

SEQ ID NO: 1173927 - RNA, 20 nt, Human
caccagagcccaccuuggcu

SEQ ID NO: 1173928 - RNA, 22 nt, Human
caccagagcccaccuuggcuca

SEQ ID NO: 1173929 - RNA, 18 nt, Human
cacauguccaagaagccc

SEQ ID NO: 1173930 - RNA, 19 nt, Human
cacauguccaagaagccca

SEQ ID NO: 1173931 - RNA, 21 nt, Human
cacauguccaagaagcccagg

SEQ ID NO: 1173932 - RNA, 22 nt, Human
cacauguccaagaagcccagga

SEQ ID NO: 1173933 - RNA, 17 nt, Human
caccaacgucugugcca

SEQ ID NO: 1173934 - RNA, 23 nt, Human
cacauguccaagaagcccaggaa

SEQ ID NO: 1173935 - RNA, 12 nt, Human
caccaagcccag

SEQ ID NO: 1173936 - RNA, 13 nt, Human
caccaagcccagu

SEQ ID NO: 1173937 - RNA, 15 nt, Human
caccaagcccaguua

SEQ ID NO: 1173938 - RNA, 21 nt, Human
caccauauuaccacagacaua

SEQ ID NO: 1173939 - RNA, 13 nt, Human
caccaucaagcca

SEQ ID NO: 1173940 - RNA, 14 nt, Human
caccaucaagccac

SEQ ID NO: 1173941 - RNA, 15 nt, Human
caccaucaagccacc

SEQ ID NO: 1173942 - RNA, 12 nt, Human
caccagcagccu

SEQ ID NO: 1173943 - RNA, 16 nt, Human
caccaucaagccacca

SEQ ID NO: 1173944 - RNA, 17 nt, Human
caccaucaagccaccaa

SEQ ID NO: 1173945 - RNA, 19 nt, Human
caccaucaagccaccaaca

SEQ ID NO: 1173946 - RNA, 24 nt, Human
caccaucaagccaccaacauacuc

SEQ ID NO: 1173947 - RNA, 15 nt, Human
caccaucaugucugg

SEQ ID NO: 1173948 - RNA, 17 nt, Human
caccaucaugucuggcu

SEQ ID NO: 1173949 - RNA, 18 nt, Human
caccaucaugucuggcua

SEQ ID NO: 1173950 - RNA, 13 nt, Human
cacccaagggccu

SEQ ID NO: 1173951 - RNA, 11 nt, Human
aagaacugaaa

SEQ ID NO: 1173952 - RNA, 12 nt, Human
aagaacugaaau

SEQ ID NO: 1173953 - RNA, 13 nt, Human
aagaacugaaauc

SEQ ID NO: 1173954 - RNA, 15 nt, Human
aagaacugaaaucau

SEQ ID NO: 1173955 - RNA, 21 nt, Human
aagacaaggaaaaaauaacaa

SEQ ID NO: 1173956 - RNA, 20 nt, Human
aagaagacugcauuauauuu

SEQ ID NO: 1173957 - RNA, 15 nt, Human
aagaagacugcauua

SEQ ID NO: 1173958 - RNA, 22 nt, Human
aagacaaugacuuacuguacau

SEQ ID NO: 1173959 - RNA, 19 nt, Human
aagacaaugugaaaagaaa

SEQ ID NO: 1173960 - RNA, 20 nt, Human
aagacaaugugaaaagaaaa

SEQ ID NO: 1173961 - RNA, 16 nt, Human
aagagagaaaauaaaa

SEQ ID NO: 1173962 - RNA, 17 nt, Human
aagagagaaaauaaaaa

SEQ ID NO: 1173963 - RNA, 18 nt, Human
aagagagaaaauaaaaag

SEQ ID NO: 1173964 - RNA, 14 nt, Human
aagagagaaaauaa

SEQ ID NO: 1173965 - RNA, 12 nt, Human
aagagagaaaau

SEQ ID NO: 1173966 - RNA, 13 nt, Human
aagagagaaaaua

SEQ ID NO: 1173967 - RNA, 15 nt, Human
aagagagaaaauaaa

SEQ ID NO: 1173968 - RNA, 15 nt, Human
aagaccacguuucua

SEQ ID NO: 1173969 - RNA, 17 nt, Human
aagaccacguuucuaaa

SEQ ID NO: 1173970 - RNA, 21 nt, Human
aagacuuuuccaacccucauc

SEQ ID NO: 1173971 - RNA, 12 nt, Human
aagacuuuucuu

SEQ ID NO: 1173972 - RNA, 19 nt, Human
aagacuuuucuuucagcca

SEQ ID NO: 1173973 - RNA, 13 nt, Human
aagagaaaaaaua

SEQ ID NO: 1173974 - RNA, 12 nt, Human
aagaguguggca

SEQ ID NO: 1173975 - RNA, 15 nt, Human
aaggcaaggcuguca

SEQ ID NO: 1173976 - RNA, 16 nt, Human
aaggcaaggcugucaa

SEQ ID NO: 1173977 - RNA, 13 nt, Human
aaggcaaggcugu

SEQ ID NO: 1173978 - RNA, 22 nt, Human
aagcuagacgagcaggcuucuu

SEQ ID NO: 1173979 - RNA, 13 nt, Human
aagcugcacccuc

SEQ ID NO: 1173980 - RNA, 19 nt, Human
aagcugcacccucaggcag

SEQ ID NO: 1173981 - RNA, 20 nt, Human
aagcugcacccucaggcagg

SEQ ID NO: 1173982 - RNA, 14 nt, Human
aagcggcuggcagc

SEQ ID NO: 1173983 - RNA, 14 nt, Human
aagcgauucuucug

SEQ ID NO: 1173984 - RNA, 15 nt, Human
aagcgugagccacug

SEQ ID NO: 1173985 - RNA, 16 nt, Human
aagcgugagccacugc

SEQ ID NO: 1173986 - RNA, 18 nt, Human
aagccauaauuguucuua

SEQ ID NO: 1173987 - RNA, 19 nt, Human
aagauaauauuaaggaaga

SEQ ID NO: 1173988 - RNA, 21 nt, Human
aagauaauauuaaggaagaca

SEQ ID NO: 1173989 - RNA, 17 nt, Human
aagauacaguuacucag

SEQ ID NO: 1173990 - RNA, 23 nt, Human
aagauacaguuacucagaauucu

SEQ ID NO: 1173991 - RNA, 21 nt, Human
aaucaccgaaaacguggcugc

SEQ ID NO: 1173992 - RNA, 23 nt, Human
aaucaccgaaaacguggcugcuu

SEQ ID NO: 1173993 - RNA, 23 nt, Human
aauauguggaguucaucuugaau

SEQ ID NO: 1173994 - RNA, 13 nt, Human
aauauuaagaaag

SEQ ID NO: 1173995 - RNA, 20 nt, Human
aaugaugccaugaggaacaa

SEQ ID NO: 1173996 - RNA, 20 nt, Human
aaugaauacuuuauaaagga

SEQ ID NO: 1173997 - RNA, 20 nt, Human
aaugaaagacuguacaaagu

SEQ ID NO: 1173998 - RNA, 21 nt, Human
aaugaaagacuguacaaagua

SEQ ID NO: 1173999 - RNA, 16 nt, Human
aaucucaauauuucag

SEQ ID NO: 1174000 - RNA, 10 nt, Human
aauaaaccau

SEQ ID NO: 1174001 - RNA, 22 nt, Human
aaguuguaggcauaaagucagg

SEQ ID NO: 1174002 - RNA, 22 nt, Human
aagugcugcauuuaaaagauac

SEQ ID NO: 1174003 - RNA, 12 nt, Human
aagugcugggau

SEQ ID NO: 1174004 - RNA, 22 nt, Human
aagugcugggauuacaggugug

SEQ ID NO: 1174005 - RNA, 19 nt, Human
aauaauguuaacauggaca

SEQ ID NO: 1174006 - RNA, 14 nt, Human
aauaaagcagcguu

SEQ ID NO: 1174007 - RNA, 17 nt, Human
aauaaugugaaacugga

SEQ ID NO: 1174008 - RNA, 22 nt, Human
aauaaugugaaacuggauuaaa

SEQ ID NO: 1174009 - RNA, 23 nt, Human
aaccuuuugagugccuuacacaa

SEQ ID NO: 1174010 - RNA, 16 nt, Human
aaccuuuugagugccu

SEQ ID NO: 1174011 - RNA, 13 nt, Human
aacaggcugggcu

SEQ ID NO: 1174012 - RNA, 12 nt, Human
aacagccugugu

SEQ ID NO: 1174013 - RNA, 15 nt, Human
aacagccugugucuu

SEQ ID NO: 1174014 - RNA, 11 nt, Human
aacaggcagau

SEQ ID NO: 1174015 - RNA, 18 nt, Human
aaauucuugcaaaguauc

SEQ ID NO: 1174016 - RNA, 23 nt, Human
aaauucuucuccacuuucuagcc

SEQ ID NO: 1174017 - RNA, 15 nt, Human
aaauucuugcaaagu

SEQ ID NO: 1174018 - RNA, 20 nt, Human
aaaggaugcccaaagaugca

SEQ ID NO: 1174019 - RNA, 13 nt, Human
aaauauuuauuuu

SEQ ID NO: 1174020 - RNA, 18 nt, Human
aaaucucaauauuucaga

SEQ ID NO: 1174021 - RNA, 19 nt, Human
aaaucuccaaaauaaaacu

SEQ ID NO: 1174022 - RNA, 13 nt, Human
aaaucuuuuugcu

SEQ ID NO: 1174023 - RNA, 14 nt, Human
aaaucuuuuugcuu

SEQ ID NO: 1174024 - RNA, 10 nt, Human
aaaugcugcu

SEQ ID NO: 1174025 - RNA, 23 nt, Human
aaaugcugcuuuuucucaaaaug

SEQ ID NO: 1174026 - RNA, 13 nt, Human
aaauguucaucaa

SEQ ID NO: 1174027 - RNA, 17 nt, Human
aaauguucaucaaugaa

SEQ ID NO: 1174028 - RNA, 22 nt, Human
aaauguugacaugggacauuug

SEQ ID NO: 1174029 - RNA, 23 nt, Human
aaauguugacaugggacauuugc

SEQ ID NO: 1174030 - RNA, 17 nt, Human
aaaagaaagaaaaucag

SEQ ID NO: 1174031 - RNA, 20 nt, Human
aaaagacaaggaaaaaauaa

SEQ ID NO: 1174032 - RNA, 11 nt, Human
aaaagaaugau

SEQ ID NO: 1174033 - RNA, 17 nt, Human
aaaacacauuuuucuua

SEQ ID NO: 1174034 - RNA, 19 nt, Human
aaaacacuguucucugccc

SEQ ID NO: 1174035 - RNA, 11 nt, Human
aaaagaaaaag

SEQ ID NO: 1174036 - RNA, 15 nt, Human
aaaauaaaaaguuaa

SEQ ID NO: 1174037 - RNA, 16 nt, Human
aaaauaaaaaguuaaa

SEQ ID NO: 1174038 - RNA, 19 nt, Human
aaaauaaaaaguuaaaaag

SEQ ID NO: 1174039 - RNA, 14 nt, Human
aaaauaaaacuuuu

SEQ ID NO: 1174040 - RNA, 16 nt, Human
aaaauaaaacuuuuua

SEQ ID NO: 1174041 - RNA, 13 nt, Human
aaaaucagccugc

SEQ ID NO: 1174042 - RNA, 17 nt, Human
aaaaucagccugcucca

SEQ ID NO: 1174043 - RNA, 21 nt, Human
aaaaucagccugcuccagcug

SEQ ID NO: 1174044 - RNA, 18 nt, Human
aaaaucucaaauuucuaa

SEQ ID NO: 1174045 - RNA, 15 nt, Human
aaaaucucaaauuuc

SEQ ID NO: 1174046 - RNA, 16 nt, Human
aaaaucucaaauuucu

SEQ ID NO: 1174047 - RNA, 12 nt, Human
aaacccagcucu

SEQ ID NO: 1174048 - RNA, 16 nt, Human
aaacccagcucugguc

SEQ ID NO: 1174049 - RNA, 18 nt, Human
aaacccagcucuggucca

SEQ ID NO: 1174050 - RNA, 15 nt, Human
aaaccgccaaggcug

SEQ ID NO: 1174051 - RNA, 16 nt, Human
aaaccgccaaggcugg

SEQ ID NO: 1174052 - RNA, 12 nt, Human
aaacucuuaaaa

SEQ ID NO: 1174053 - RNA, 23 nt, Human
aaacucuuaaaacccaagugccu

SEQ ID NO: 1174054 - RNA, 23 nt, Human
aaacugauuuuuuuuuccuucag

SEQ ID NO: 1174055 - RNA, 22 nt, Human
acucccaucugugaaaggaaag

SEQ ID NO: 1174056 - RNA, 14 nt, Human
acucccuuucaaca

SEQ ID NO: 1174057 - RNA, 14 nt, Human
acucguuaauuugu

SEQ ID NO: 1174058 - RNA, 19 nt, Human
acucguuaauuuguagugu

SEQ ID NO: 1174059 - RNA, 15 nt, Human
acucuacagaggcca

SEQ ID NO: 1174060 - RNA, 23 nt, Human
acugaauuucuuuugccguuauu

SEQ ID NO: 1174061 - RNA, 17 nt, Human
acugacauuguuggcca

SEQ ID NO: 1174062 - RNA, 18 nt, Human
acugacauuguuggccaa

SEQ ID NO: 1174063 - RNA, 13 nt, Human
acucuacccucuu

SEQ ID NO: 1174064 - RNA, 23 nt, Human
acugaaugaaacccccacacaca

SEQ ID NO: 1174065 - RNA, 12 nt, Human
acugaauuucuu

SEQ ID NO: 1174066 - RNA, 19 nt, Human
acugauaugggucuugaua

SEQ ID NO: 1174067 - RNA, 22 nt, Human
acugacauuguuggccaaagcc

SEQ ID NO: 1174068 - RNA, 16 nt, Human
acugauuuuuuuuucc

SEQ ID NO: 1174069 - RNA, 17 nt, Human
acugauuuuuuuuuccu

SEQ ID NO: 1174070 - RNA, 18 nt, Human
acugauuuuuuuuuccuu

SEQ ID NO: 1174071 - RNA, 19 nt, Human
acugauuuuuuuuuccuuc

SEQ ID NO: 1174072 - RNA, 20 nt, Human
acugauuuuuuuuuccuuca

SEQ ID NO: 1174073 - RNA, 13 nt, Human
acuguaaagaaag

SEQ ID NO: 1174074 - RNA, 14 nt, Human
acuguaaagaaaga

SEQ ID NO: 1174075 - RNA, 15 nt, Human
acuguaaagaaagag

SEQ ID NO: 1174076 - RNA, 16 nt, Human
acuguaaagaaagaga

SEQ ID NO: 1174077 - RNA, 18 nt, Human
acuguaaagaaagagaga

SEQ ID NO: 1174078 - RNA, 19 nt, Human
acuguaaagaaagagagaa

SEQ ID NO: 1174079 - RNA, 20 nt, Human
acuguaaagaaagagagaaa

SEQ ID NO: 1174080 - RNA, 21 nt, Human
acuguaaagaaagagagaaaa

SEQ ID NO: 1174081 - RNA, 22 nt, Human
acuguaaagaaagagagaaaau

SEQ ID NO: 1174082 - RNA, 23 nt, Human
acuguaaagaaagagagaaaaua

SEQ ID NO: 1174083 - RNA, 17 nt, Human
acugugccaugugccag

SEQ ID NO: 1174084 - RNA, 18 nt, Human
acugugccaugugccagg

SEQ ID NO: 1174085 - RNA, 16 nt, Human
acugugaagagaacca

SEQ ID NO: 1174086 - RNA, 13 nt, Human
acuguaagaaaau

SEQ ID NO: 1174087 - RNA, 17 nt, Human
acuguaaaauaauaacu

SEQ ID NO: 1174088 - RNA, 12 nt, Human
acuggaacucuc

SEQ ID NO: 1174089 - RNA, 17 nt, Human
acuucaaauccuugaag

SEQ ID NO: 1174090 - RNA, 18 nt, Human
acuucaaauccuugaaga

SEQ ID NO: 1174091 - RNA, 19 nt, Human
acuucaaauccuugaagau

SEQ ID NO: 1174092 - RNA, 22 nt, Human
acuuaaaaaugguuuaaauggu

SEQ ID NO: 1174093 - RNA, 19 nt, Human
acuguuucaaacuuuacua

SEQ ID NO: 1174094 - RNA, 15 nt, Human
acuguuucaaacuuu

SEQ ID NO: 1174095 - RNA, 18 nt, Human
acuguuucaaacuuuacu

SEQ ID NO: 1174096 - RNA, 21 nt, Human
acuucagacauagaauuaaca

SEQ ID NO: 1174097 - RNA, 17 nt, Human
acuucagcgguuuauau

SEQ ID NO: 1174098 - RNA, 23 nt, Human
acuuggggggcugaggugggagg

SEQ ID NO: 1174099 - RNA, 13 nt, Human
acuuggucuguga

SEQ ID NO: 1174100 - RNA, 22 nt, Human
acgcugugcugcccugcccacc

SEQ ID NO: 1174101 - RNA, 19 nt, Human
acggaauaguuggcuagga

SEQ ID NO: 1174102 - RNA, 17 nt, Human
acggacacucaaaagcu

SEQ ID NO: 1174103 - RNA, 19 nt, Human
acggacacucaaaagcugg

SEQ ID NO: 1174104 - RNA, 13 nt, Human
acgucugugccau

SEQ ID NO: 1174105 - RNA, 20 nt, Human
acgauuucuguuuagauaau

SEQ ID NO: 1174106 - RNA, 23 nt, Human
acgauuucuguuuagauaauaca

SEQ ID NO: 1174107 - RNA, 18 nt, Human
acuaauggggcggugaga

SEQ ID NO: 1174108 - RNA, 12 nt, Human
accucugccuga

SEQ ID NO: 1174109 - RNA, 20 nt, Human
accucugccugaagucacac

SEQ ID NO: 1174110 - RNA, 23 nt, Human
accucugccugaagucacacagu

SEQ ID NO: 1174111 - RNA, 21 nt, Human
accugccaggaagccagcagg

SEQ ID NO: 1174112 - RNA, 22 nt, Human
accugccaggaagccagcaggc

SEQ ID NO: 1174113 - RNA, 23 nt, Human
accugccaggaagccagcaggcu

SEQ ID NO: 1174114 - RNA, 12 nt, Human
accugccccuca

SEQ ID NO: 1174115 - RNA, 15 nt, Human
accugccccucaacu

SEQ ID NO: 1174116 - RNA, 20 nt, Human
accugccccucaacucuccu

SEQ ID NO: 1174117 - RNA, 12 nt, Human
accuuggcucaa

SEQ ID NO: 1174118 - RNA, 18 nt, Human
accgugaggccagagaca

SEQ ID NO: 1174119 - RNA, 23 nt, Human
accgugaggccagagacacaagc

SEQ ID NO: 1174120 - RNA, 12 nt, Human
accucagccucc

SEQ ID NO: 1174121 - RNA, 17 nt, Human
acccugugauggggccc

SEQ ID NO: 1174122 - RNA, 19 nt, Human
acccugugauggggcccug

SEQ ID NO: 1174123 - RNA, 20 nt, Human
acccugugauggggcccugc

SEQ ID NO: 1174124 - RNA, 21 nt, Human
acccugugauggggcccugcc

SEQ ID NO: 1174125 - RNA, 12 nt, Human
accgggcacuca

SEQ ID NO: 1174126 - RNA, 14 nt, Human
accgggcacucaga

SEQ ID NO: 1174127 - RNA, 16 nt, Human
accgggcacucagaag

SEQ ID NO: 1174128 - RNA, 20 nt, Human
accgggcacucagaagacac

SEQ ID NO: 1174129 - RNA, 11 nt, Human
accucaggccu

SEQ ID NO: 1174130 - RNA, 20 nt, Human
accucaggugauccacccac

SEQ ID NO: 1174131 - RNA, 21 nt, Human
accucaggugauccacccacc

SEQ ID NO: 1174132 - RNA, 14 nt, Human
acccuauugcugcu

SEQ ID NO: 1174133 - RNA, 19 nt, Human
acccuauugcugcuugagg

SEQ ID NO: 1174134 - RNA, 13 nt, Human
acccuauugcugc

SEQ ID NO: 1174135 - RNA, 13 nt, Human
acccucaggcagg

SEQ ID NO: 1174136 - RNA, 14 nt, Human
acccucaggcaggu

SEQ ID NO: 1174137 - RNA, 15 nt, Human
acccucaggcaggug

SEQ ID NO: 1174138 - RNA, 16 nt, Human
acccucaggcaggugg

SEQ ID NO: 1174139 - RNA, 13 nt, Human
acccucaucacca

SEQ ID NO: 1174140 - RNA, 23 nt, Human
acccuggcacuauaauguaagcu

SEQ ID NO: 1174141 - RNA, 23 nt, Human
acccucaucaccaacgucugugc

SEQ ID NO: 1174142 - RNA, 16 nt, Human
acccuggggagaaagu

SEQ ID NO: 1174143 - RNA, 21 nt, Human
acccugucucuacuaaaaaua

SEQ ID NO: 1174144 - RNA, 16 nt, Human
acccugugauggggcc

SEQ ID NO: 1174145 - RNA, 19 nt, Human
acagugauuaccagggacu

SEQ ID NO: 1174146 - RNA, 20 nt, Human
acagugauuaccagggacug

SEQ ID NO: 1174147 - RNA, 23 nt, Human
acaggcacccaccaucaugucug

SEQ ID NO: 1174148 - RNA, 18 nt, Human
acaggcaaugcuggcugu

SEQ ID NO: 1174149 - RNA, 15 nt, Human
acaggcagauacagg

SEQ ID NO: 1174150 - RNA, 19 nt, Human
acagcucuucuccaggcug

SEQ ID NO: 1174151 - RNA, 20 nt, Human
acagcucuucuccaggcugu

SEQ ID NO: 1174152 - RNA, 24 nt, Human
acaggaugguucccuugaugaaga

SEQ ID NO: 1174153 - RNA, 14 nt, Human
acaggauuauugga

SEQ ID NO: 1174154 - RNA, 15 nt, Human
acaggcaaugcuggc

SEQ ID NO: 1174155 - RNA, 16 nt, Human
acaggcaaugcuggcu

SEQ ID NO: 1174156 - RNA, 17 nt, Human
acaggcaaugcuggcug

SEQ ID NO: 1174157 - RNA, 21 nt, Human
accaacgucugugccauuuug

SEQ ID NO: 1174158 - RNA, 16 nt, Human
accacgcuggaccuug

SEQ ID NO: 1174159 - RNA, 18 nt, Human
accacgcuggaccuugaa

SEQ ID NO: 1174160 - RNA, 13 nt, Human
accacguuucuaa

SEQ ID NO: 1174161 - RNA, 14 nt, Human
accacguuucuaaa

SEQ ID NO: 1174162 - RNA, 15 nt, Human
acauuugcucaugga

SEQ ID NO: 1174163 - RNA, 16 nt, Human
acauuugcucauggaa

SEQ ID NO: 1174164 - RNA, 16 nt, Human
acauuuguauaaaaua

SEQ ID NO: 1174165 - RNA, 19 nt, Human
acauuuguauaaaauaauu

SEQ ID NO: 1174166 - RNA, 21 nt, Human
acauuuguauaaaauaauuuu

SEQ ID NO: 1174167 - RNA, 14 nt, Human
accaacgucugugc

SEQ ID NO: 1174168 - RNA, 17 nt, Human
accaacgucugugccau

SEQ ID NO: 1174169 - RNA, 19 nt, Human
accagagcugccaccugcc

SEQ ID NO: 1174170 - RNA, 13 nt, Human
accagagcugcca

SEQ ID NO: 1174171 - RNA, 14 nt, Human
accagagcugccac

SEQ ID NO: 1174172 - RNA, 16 nt, Human
accagagcugccaccu

SEQ ID NO: 1174173 - RNA, 19 nt, Human
acauguuuuucuucucccu

SEQ ID NO: 1174174 - RNA, 15 nt, Human
acauaagauaaaugu

SEQ ID NO: 1174175 - RNA, 16 nt, Human
acauacaauuccaaac

SEQ ID NO: 1174176 - RNA, 21 nt, Human
acauaaugcgugcauaccacu

SEQ ID NO: 1174177 - RNA, 20 nt, Human
acauacaggaagguagaaau

SEQ ID NO: 1174178 - RNA, 20 nt, Human
acaucccuuaccugggaaag

SEQ ID NO: 1174179 - RNA, 13 nt, Human
acaugcacgugug

SEQ ID NO: 1174180 - RNA, 19 nt, Human
aauuaugaguuauuuuuau

SEQ ID NO: 1174181 - RNA, 14 nt, Human
aauucuacuuugag

SEQ ID NO: 1174182 - RNA, 19 nt, Human
aauucucagaaucucaaau

SEQ ID NO: 1174183 - RNA, 21 nt, Human
aauucucauuugucacacacu

SEQ ID NO: 1174184 - RNA, 15 nt, Human
aauucucuaguuuga

SEQ ID NO: 1174185 - RNA, 17 nt, Human
aauucucuaguuugauu

SEQ ID NO: 1174186 - RNA, 15 nt, Human
aauucucuuauccaa

SEQ ID NO: 1174187 - RNA, 14 nt, Human
aauucuguuuuucu

SEQ ID NO: 1174188 - RNA, 18 nt, Human
aauucuguuuuucuaggc

SEQ ID NO: 1174189 - RNA, 13 nt, Human
aauucuuaaauau

SEQ ID NO: 1174190 - RNA, 22 nt, Human
aauuguaaggaaugauuaauua

SEQ ID NO: 1174191 - RNA, 11 nt, Human
aauuguaauag

SEQ ID NO: 1174192 - RNA, 15 nt, Human
aauuucccaaagcag

SEQ ID NO: 1174193 - RNA, 17 nt, Human
aauuucccaaagcagug

SEQ ID NO: 1174194 - RNA, 15 nt, Human
acaaguuaaauaaau

SEQ ID NO: 1174195 - RNA, 16 nt, Human
acaaggcaaggcuguc

SEQ ID NO: 1174196 - RNA, 17 nt, Human
acaaggcaaggcuguca

SEQ ID NO: 1174197 - RNA, 19 nt, Human
acaaggcaaggcugucaau

SEQ ID NO: 1174198 - RNA, 20 nt, Human
acaaggcaaggcugucaauu

SEQ ID NO: 1174199 - RNA, 11 nt, Human
acacagaaaau

SEQ ID NO: 1174200 - RNA, 12 nt, Human
acacagaaaaua

SEQ ID NO: 1174201 - RNA, 13 nt, Human
acacagaaaauau

SEQ ID NO: 1174202 - RNA, 14 nt, Human
acacagaaaauaua

SEQ ID NO: 1174203 - RNA, 15 nt, Human
acacagaaaauauac

SEQ ID NO: 1174204 - RNA, 16 nt, Human
acacagaaaauauacu

SEQ ID NO: 1174205 - RNA, 17 nt, Human
acacagaaaauauacug

SEQ ID NO: 1174206 - RNA, 18 nt, Human
acacagaaaauauacugu

SEQ ID NO: 1174207 - RNA, 19 nt, Human
acacagaaaauauacugua

SEQ ID NO: 1174208 - RNA, 20 nt, Human
acacagaaaauauacuguaa

SEQ ID NO: 1174209 - RNA, 21 nt, Human
acacagaaaauauacuguaaa

SEQ ID NO: 1174210 - RNA, 22 nt, Human
acacagaaaauauacuguaaag

SEQ ID NO: 1174211 - RNA, 23 nt, Human
acacagaaaauauacuguaaaga

SEQ ID NO: 1174212 - RNA, 11 nt, Human
acacagccaca

SEQ ID NO: 1174213 - RNA, 12 nt, Human
acacagccacac

SEQ ID NO: 1174214 - RNA, 13 nt, Human
acacagccacaca

SEQ ID NO: 1174215 - RNA, 14 nt, Human
acacagccacacac

SEQ ID NO: 1174216 - RNA, 15 nt, Human
acacagccacacaca

SEQ ID NO: 1174217 - RNA, 18 nt, Human
acacagccacacacacag

SEQ ID NO: 1174218 - RNA, 19 nt, Human
acacagccacacacacaga

SEQ ID NO: 1174219 - RNA, 20 nt, Human
acacagccacacacacagaa

SEQ ID NO: 1174220 - RNA, 21 nt, Human
acacagccacacacacagaaa

SEQ ID NO: 1174221 - RNA, 22 nt, Human
acacagccacacacacagaaaa

SEQ ID NO: 1174222 - RNA, 23 nt, Human
acacagccacacacacagaaaau

SEQ ID NO: 1174223 - RNA, 14 nt, Human
acacagcucuucuc

SEQ ID NO: 1174224 - RNA, 16 nt, Human
acacagcucuucucca

SEQ ID NO: 1174225 - RNA, 18 nt, Human
acacagcucuucuccagg

SEQ ID NO: 1174226 - RNA, 19 nt, Human
acacagcucuucuccaggc

SEQ ID NO: 1174227 - RNA, 15 nt, Human
acaccaauauucaua

SEQ ID NO: 1174228 - RNA, 18 nt, Human
acaccagagcccaccuug

SEQ ID NO: 1174229 - RNA, 23 nt, Human
acaccagagcccaccuuggcuca

SEQ ID NO: 1174230 - RNA, 12 nt, Human
auccuugaagau

SEQ ID NO: 1174231 - RNA, 19 nt, Human
aucauggagguuugaagau

SEQ ID NO: 1174232 - RNA, 15 nt, Human
aucauccuaagcuau

SEQ ID NO: 1174233 - RNA, 20 nt, Human
aucaugacaaagacugagua

SEQ ID NO: 1174234 - RNA, 21 nt, Human
auccacugugccaugugccag

SEQ ID NO: 1174235 - RNA, 20 nt, Human
aucaaagagguuuuaaaaaa

SEQ ID NO: 1174236 - RNA, 19 nt, Human
aucaaagagguuuuaaaaa

SEQ ID NO: 1174237 - RNA, 20 nt, Human
aucaaaagguuaauaaagua

SEQ ID NO: 1174238 - RNA, 24 nt, Human
aucaaaagguuaauaaaguaauua

SEQ ID NO: 1174239 - RNA, 14 nt, Human
aucaaaagaaagaa

SEQ ID NO: 1174240 - RNA, 18 nt, Human
auauuuuuuucuuuucuu

SEQ ID NO: 1174241 - RNA, 15 nt, Human
auagcacagacccug

SEQ ID NO: 1174242 - RNA, 14 nt, Human
auagcacagacccu

SEQ ID NO: 1174243 - RNA, 14 nt, Human
augaaguaauaugc

SEQ ID NO: 1174244 - RNA, 21 nt, Human
augaaguaauaugcacacauu

SEQ ID NO: 1174245 - RNA, 23 nt, Human
augaaguaauaugcacacauuuu

SEQ ID NO: 1174246 - RNA, 13 nt, Human
augaaguacucau

SEQ ID NO: 1174247 - RNA, 12 nt, Human
augaaagacugu

SEQ ID NO: 1174248 - RNA, 13 nt, Human
augaaagacugua

SEQ ID NO: 1174249 - RNA, 13 nt, Human
augaccuuucaau

SEQ ID NO: 1174250 - RNA, 15 nt, Human
augaccuuucaauag

SEQ ID NO: 1174251 - RNA, 18 nt, Human
augaccuuucaauaggaa

SEQ ID NO: 1174252 - RNA, 21 nt, Human
augagccucagcauccuggca

SEQ ID NO: 1174253 - RNA, 11 nt, Human
augagccuggc

SEQ ID NO: 1174254 - RNA, 12 nt, Human
augagccuggca

SEQ ID NO: 1174255 - RNA, 23 nt, Human
aucuaggaagacuuuggaaagag

SEQ ID NO: 1174256 - RNA, 22 nt, Human
augcauacacacacacacacag

SEQ ID NO: 1174257 - RNA, 23 nt, Human
augcauacacacacacacacagc

SEQ ID NO: 1174258 - RNA, 10 nt, Human
augcauacac

SEQ ID NO: 1174259 - RNA, 11 nt, Human
augcauacaca

SEQ ID NO: 1174260 - RNA, 12 nt, Human
augcauacacac

SEQ ID NO: 1174261 - RNA, 13 nt, Human
augcauacacaca

SEQ ID NO: 1174262 - RNA, 14 nt, Human
augcauacacacac

SEQ ID NO: 1174263 - RNA, 15 nt, Human
augcauacacacaca

SEQ ID NO: 1174264 - RNA, 17 nt, Human
augcauacacacacaca

SEQ ID NO: 1174265 - RNA, 21 nt, Human
augccugguggcagcugcggu

SEQ ID NO: 1174266 - RNA, 12 nt, Human
augccugguggc

SEQ ID NO: 1174267 - RNA, 13 nt, Human
augccugguggca

SEQ ID NO: 1174268 - RNA, 14 nt, Human
augccugguggcag

SEQ ID NO: 1174269 - RNA, 19 nt, Human
augccugguggcagcugcg

SEQ ID NO: 1174270 - RNA, 16 nt, Human
augcuuugaucccuuc

SEQ ID NO: 1174271 - RNA, 18 nt, Human
augcucugcauguuacau

SEQ ID NO: 1174272 - RNA, 19 nt, Human
augcucugcauguuacaua

SEQ ID NO: 1174273 - RNA, 14 nt, Human
augcuucuucagag

SEQ ID NO: 1174274 - RNA, 17 nt, Human
augcuucuucagagacu

SEQ ID NO: 1174275 - RNA, 20 nt, Human
augcuucuucagagacuccu

SEQ ID NO: 1174276 - RNA, 22 nt, Human
augcuucuucagagacuccugc

SEQ ID NO: 1174277 - RNA, 21 nt, Human
augggacauuugcucauggaa

SEQ ID NO: 1174278 - RNA, 15 nt, Human
augggacagggagga

SEQ ID NO: 1174279 - RNA, 20 nt, Human
augggacauuugcucaugga

SEQ ID NO: 1174280 - RNA, 23 nt, Human
auggcuuccuggcaauagucaaa

SEQ ID NO: 1174281 - RNA, 17 nt, Human
auacaccacuacauucu

SEQ ID NO: 1174282 - RNA, 18 nt, Human
auacaccacuacauucug

SEQ ID NO: 1174283 - RNA, 13 nt, Human
auacacuuacacu

SEQ ID NO: 1174284 - RNA, 12 nt, Human
auaauguuaaca

SEQ ID NO: 1174285 - RNA, 23 nt, Human
auacaaugcugugcccuaaagug

SEQ ID NO: 1174286 - RNA, 15 nt, Human
auacaccacuacauu

SEQ ID NO: 1174287 - RNA, 21 nt, Human
auaaagaugagugagcaugcc

SEQ ID NO: 1174288 - RNA, 14 nt, Human
aguucauacccugu

SEQ ID NO: 1174289 - RNA, 18 nt, Human
aguuacacuaaaagguga

SEQ ID NO: 1174290 - RNA, 18 nt, Human
aguuccaccaucaagcca

SEQ ID NO: 1174291 - RNA, 21 nt, Human
aguuccaccaucaagccacca

SEQ ID NO: 1174292 - RNA, 17 nt, Human
aguugaaaaacagcuga

SEQ ID NO: 1174293 - RNA, 18 nt, Human
aguugaaaaacagcugag

SEQ ID NO: 1174294 - RNA, 16 nt, Human
aguugaagacagagcu

SEQ ID NO: 1174295 - RNA, 17 nt, Human
aguugaagacagagcua

SEQ ID NO: 1174296 - RNA, 12 nt, Human
agugcuccagcc

SEQ ID NO: 1174297 - RNA, 17 nt, Human
aguuguuagugugucuu

SEQ ID NO: 1174298 - RNA, 22 nt, Human
aguuguuagugugucuuagugu

SEQ ID NO: 1174299 - RNA, 16 nt, Human
auaaaagacagugaaa

SEQ ID NO: 1174300 - RNA, 14 nt, Human
aguuugauuaaauu

SEQ ID NO: 1174301 - RNA, 16 nt, Human
aguuugauuaaauucu

SEQ ID NO: 1174302 - RNA, 11 nt, Human
aguuugcaguu

SEQ ID NO: 1174303 - RNA, 19 nt, Human
aguaaaugggggugcauuu

SEQ ID NO: 1174304 - RNA, 20 nt, Human
aguaaaugggggugcauuug

SEQ ID NO: 1174305 - RNA, 21 nt, Human
aguaaaugggggugcauuuga

SEQ ID NO: 1174306 - RNA, 17 nt, Human
aguaacuuacuuaggug

SEQ ID NO: 1174307 - RNA, 14 nt, Human
aguacguugugcau

SEQ ID NO: 1174308 - RNA, 15 nt, Human
aguacuggagaaaau

SEQ ID NO: 1174309 - RNA, 20 nt, Human
aguacuucuccacccugcuc

SEQ ID NO: 1174310 - RNA, 21 nt, Human
aguacuucuccacccugcucu

SEQ ID NO: 1174311 - RNA, 22 nt, Human
aguacuucuccacccugcucuc

SEQ ID NO: 1174312 - RNA, 22 nt, Human
aggggcccaaauucuuucagug

SEQ ID NO: 1174313 - RNA, 18 nt, Human
agugauucuccugccuca

SEQ ID NO: 1174314 - RNA, 19 nt, Human
agugauucuccugccucag

SEQ ID NO: 1174315 - RNA, 20 nt, Human
agugauucuccugccucagc

SEQ ID NO: 1174316 - RNA, 15 nt, Human
agugauuaccaggga

SEQ ID NO: 1174317 - RNA, 22 nt, Human
agugauucuccugccucagccu

SEQ ID NO: 1174318 - RNA, 19 nt, Human
agugccuuauggaacacuc

SEQ ID NO: 1174319 - RNA, 20 nt, Human
agugccuuauggaacacucu

SEQ ID NO: 1174320 - RNA, 21 nt, Human
agugccuuauggaacacucug

SEQ ID NO: 1174321 - RNA, 22 nt, Human
agugccuuauggaacacucuga

SEQ ID NO: 1174322 - RNA, 20 nt, Human
agugauccucccaccucagc

SEQ ID NO: 1174323 - RNA, 22 nt, Human
agugauccucccaccucagccu

SEQ ID NO: 1174324 - RNA, 23 nt, Human
agugauccucccaccucagccuc

SEQ ID NO: 1174325 - RNA, 13 nt, Human
agugauuaccagg

SEQ ID NO: 1174326 - RNA, 16 nt, Human
agugacagaggcagcc

SEQ ID NO: 1174327 - RNA, 19 nt, Human
agugacagaggcagcccca

SEQ ID NO: 1174328 - RNA, 14 nt, Human
aguccucuuuucug

SEQ ID NO: 1174329 - RNA, 16 nt, Human
aguccuuaccagcaga

SEQ ID NO: 1174330 - RNA, 18 nt, Human
aguccuuaccagcagagc

SEQ ID NO: 1174331 - RNA, 21 nt, Human
agucugauucccaagcucugc

SEQ ID NO: 1174332 - RNA, 22 nt, Human
agucugauucccaagcucugcu

SEQ ID NO: 1174333 - RNA, 19 nt, Human
aguccuuaccagcagagca

SEQ ID NO: 1174334 - RNA, 16 nt, Human
agucgaggacagggag

SEQ ID NO: 1174335 - RNA, 18 nt, Human
agucuggcccuuccuuuu

SEQ ID NO: 1174336 - RNA, 21 nt, Human
agaaccaaaaagaggcuaugu

SEQ ID NO: 1174337 - RNA, 21 nt, Human
agaagacugcauuauauuuau

SEQ ID NO: 1174338 - RNA, 15 nt, Human
agaagagaaugcaca

SEQ ID NO: 1174339 - RNA, 23 nt, Human
agaagagaaugcacaaacagagg

SEQ ID NO: 1174340 - RNA, 14 nt, Human
agaagucacacagu

SEQ ID NO: 1174341 - RNA, 17 nt, Human
agaagucuuagauguau

SEQ ID NO: 1174342 - RNA, 19 nt, Human
agaagucuuagauguauau

SEQ ID NO: 1174343 - RNA, 23 nt, Human
agaaugcacaaacagaggccgcc

SEQ ID NO: 1174344 - RNA, 17 nt, Human
agaaugauuaugaauua

SEQ ID NO: 1174345 - RNA, 18 nt, Human
agaaugcucuuuacuuca

SEQ ID NO: 1174346 - RNA, 17 nt, Human
agaaucucaaauaacua

SEQ ID NO: 1174347 - RNA, 16 nt, Human
agaaugaaagggccca

SEQ ID NO: 1174348 - RNA, 22 nt, Human
agaacagugauuaccagggacu

SEQ ID NO: 1174349 - RNA, 17 nt, Human
agaaccaaaaagaggcu

SEQ ID NO: 1174350 - RNA, 18 nt, Human
agaaccaaaaagaggcua

SEQ ID NO: 1174351 - RNA, 19 nt, Human
agacaaggaaaaaauaaca

SEQ ID NO: 1174352 - RNA, 20 nt, Human
agacaaugugaaaagaaaaa

SEQ ID NO: 1174353 - RNA, 14 nt, Human
agacaauuuauuau

SEQ ID NO: 1174354 - RNA, 22 nt, Human
agacagcccgggcucugccucc

SEQ ID NO: 1174355 - RNA, 23 nt, Human
agacagcccgggcucugccuccc

SEQ ID NO: 1174356 - RNA, 17 nt, Human
agacccaaaaggcagaa

SEQ ID NO: 1174357 - RNA, 14 nt, Human
agaccacguuucua

SEQ ID NO: 1174358 - RNA, 23 nt, Human
agaccaucccugaaggccccgcc

SEQ ID NO: 1174359 - RNA, 15 nt, Human
agaccacguuucuaa

SEQ ID NO: 1174360 - RNA, 15 nt, Human
agacuaucuaaaugu

SEQ ID NO: 1174361 - RNA, 17 nt, Human
agacgcugugcugcccu

SEQ ID NO: 1174362 - RNA, 18 nt, Human
agacgcugugcugcccug

SEQ ID NO: 1174363 - RNA, 19 nt, Human
agacgcugugcugcccugc

SEQ ID NO: 1174364 - RNA, 20 nt, Human
agacgcugugcugcccugcc

SEQ ID NO: 1174365 - RNA, 16 nt, Human
agacucuuuggacacu

SEQ ID NO: 1174366 - RNA, 11 nt, Human
agagagcaaga

SEQ ID NO: 1174367 - RNA, 19 nt, Human
agagagcaagacgcugugc

SEQ ID NO: 1174368 - RNA, 23 nt, Human
agagagcaagacgcugugcugcc

SEQ ID NO: 1174369 - RNA, 18 nt, Human
agagcccacgcccccacu

SEQ ID NO: 1174370 - RNA, 19 nt, Human
agagaaaauaaaaaguuaa

SEQ ID NO: 1174371 - RNA, 20 nt, Human
agagaaaauaaaaaguuaaa

SEQ ID NO: 1174372 - RNA, 18 nt, Human
agaugacaucugucuagg

SEQ ID NO: 1174373 - RNA, 20 nt, Human
agaugggugcuuggaggaag

SEQ ID NO: 1174374 - RNA, 22 nt, Human
agaugggugcuuggaggaagga

SEQ ID NO: 1174375 - RNA, 14 nt, Human
agauucuuuccuga

SEQ ID NO: 1174376 - RNA, 19 nt, Human
agcaaauucuguuuuucua

SEQ ID NO: 1174377 - RNA, 23 nt, Human
agcaaaauuuuuucucuaggaaa

SEQ ID NO: 1174378 - RNA, 15 nt, Human
agauucuuuccugag

SEQ ID NO: 1174379 - RNA, 16 nt, Human
agauucuuuccugagg

SEQ ID NO: 1174380 - RNA, 18 nt, Human
agauucuuuccugaggcu

SEQ ID NO: 1174381 - RNA, 16 nt, Human
agauugcaacaggcug

SEQ ID NO: 1174382 - RNA, 17 nt, Human
agauugcaacaggcugg

SEQ ID NO: 1174383 - RNA, 19 nt, Human
agauugcaacaggcugggc

SEQ ID NO: 1174384 - RNA, 16 nt, Human
agauugcaccacugca

SEQ ID NO: 1174385 - RNA, 20 nt, Human
agagggucugaggaauccag

SEQ ID NO: 1174386 - RNA, 19 nt, Human
agaggguggugaccucugc

SEQ ID NO: 1174387 - RNA, 20 nt, Human
agauagauaggucagugcaa

SEQ ID NO: 1174388 - RNA, 13 nt, Human
agaguugaagaca

SEQ ID NO: 1174389 - RNA, 14 nt, Human
agaguugaagacag

SEQ ID NO: 1174390 - RNA, 15 nt, Human
agaguugaagacaga

SEQ ID NO: 1174391 - RNA, 21 nt, Human
agcacagacccugcccugugg

SEQ ID NO: 1174392 - RNA, 17 nt, Human
agcagugcaugcugucc

SEQ ID NO: 1174393 - RNA, 18 nt, Human
agcagugcaugcuguccc

SEQ ID NO: 1174394 - RNA, 16 nt, Human
agcagccuggacccug

SEQ ID NO: 1174395 - RNA, 20 nt, Human
agcagccuggacccugugga

SEQ ID NO: 1174396 - RNA, 19 nt, Human
agcagcguuucuaugacac

SEQ ID NO: 1174397 - RNA, 13 nt, Human
agcagugcaugcu

SEQ ID NO: 1174398 - RNA, 16 nt, Human
agcagugcaugcuguc

SEQ ID NO: 1174399 - RNA, 16 nt, Human
agcaucuaugugagac

SEQ ID NO: 1174400 - RNA, 14 nt, Human
agccagauuucacu

SEQ ID NO: 1174401 - RNA, 17 nt, Human
agccagauuucacucuc

SEQ ID NO: 1174402 - RNA, 20 nt, Human
agccagauuucacucuccuu

SEQ ID NO: 1174403 - RNA, 22 nt, Human
agccagauuucacucuccuugg

SEQ ID NO: 1174404 - RNA, 22 nt, Human
agccagcaggcucucaggccag

SEQ ID NO: 1174405 - RNA, 23 nt, Human
agccagcaggcucucaggccagc

SEQ ID NO: 1174406 - RNA, 23 nt, Human
agcccaccccucaacaccucugc

SEQ ID NO: 1174407 - RNA, 13 nt, Human
agcccaccuuggc

SEQ ID NO: 1174408 - RNA, 17 nt, Human
agcccacgcccccacug

SEQ ID NO: 1174409 - RNA, 18 nt, Human
agcccacgcccccacugg

SEQ ID NO: 1174410 - RNA, 19 nt, Human
agcccacgcccccacuggu

SEQ ID NO: 1174411 - RNA, 14 nt, Human
agcccaccuuggcu

SEQ ID NO: 1174412 - RNA, 20 nt, Human
agcccacgcccccacuggug

SEQ ID NO: 1174413 - RNA, 23 nt, Human
aggcuagugugguguuuccuggc

SEQ ID NO: 1174414 - RNA, 24 nt, Human
aggcuguaucccaugagccucagc

SEQ ID NO: 1174415 - RNA, 12 nt, Human
aggcugucaauu

SEQ ID NO: 1174416 - RNA, 19 nt, Human
aggcugucaauuacaggaa

SEQ ID NO: 1174417 - RNA, 17 nt, Human
aggcugcagugagccga

SEQ ID NO: 1174418 - RNA, 19 nt, Human
aggcugcagugagccgaga

SEQ ID NO: 1174419 - RNA, 21 nt, Human
aggcccucugcccacucccug

SEQ ID NO: 1174420 - RNA, 19 nt, Human
aggcccucugcccacuccc

SEQ ID NO: 1174421 - RNA, 20 nt, Human
aggcccucugcccacucccu

SEQ ID NO: 1174422 - RNA, 13 nt, Human
agggccuggcuca

SEQ ID NO: 1174423 - RNA, 14 nt, Human
agggccuggcucag

SEQ ID NO: 1174424 - RNA, 18 nt, Human
agggccuggcucaggugg

SEQ ID NO: 1174425 - RNA, 18 nt, Human
aggcagccaggccacaag

SEQ ID NO: 1174426 - RNA, 23 nt, Human
aggcaugugaugagaggaaauca

SEQ ID NO: 1174427 - RNA, 24 nt, Human
aggcaugugaugagaggaaaucac

SEQ ID NO: 1174428 - RNA, 12 nt, Human
aggcauguucuc

SEQ ID NO: 1174429 - RNA, 20 nt, Human
aggcauguucucugaggaca

SEQ ID NO: 1174430 - RNA, 22 nt, Human
aggcauguucucugaggacacu

SEQ ID NO: 1174431 - RNA, 22 nt, Human
aggcauuccccaggaggccagc

SEQ ID NO: 1174432 - RNA, 23 nt, Human
aggcauuccccaggaggccagcc

SEQ ID NO: 1174433 - RNA, 17 nt, Human
aggcauuccccaggagg

SEQ ID NO: 1174434 - RNA, 13 nt, Human
aggccagcugcuu

SEQ ID NO: 1174435 - RNA, 14 nt, Human
aggccagcugcuug

SEQ ID NO: 1174436 - RNA, 16 nt, Human
aggccagcugcuuggg

SEQ ID NO: 1174437 - RNA, 17 nt, Human
aggccaggcccucugcc

SEQ ID NO: 1174438 - RNA, 18 nt, Human
aggccaggcccucugccc

SEQ ID NO: 1174439 - RNA, 19 nt, Human
aggccaggcccucugccca

SEQ ID NO: 1174440 - RNA, 23 nt, Human
aggccaggcccucugcccacucc

SEQ ID NO: 1174441 - RNA, 23 nt, Human
aggccagcugcuugggcuucauc

SEQ ID NO: 1174442 - RNA, 14 nt, Human
aggccaugggccuc

SEQ ID NO: 1174443 - RNA, 16 nt, Human
aggccaugggccuccu

SEQ ID NO: 1174444 - RNA, 17 nt, Human
aggccaugggccuccug

SEQ ID NO: 1174445 - RNA, 17 nt, Human
aggcccucugcccacuc

SEQ ID NO: 1174446 - RNA, 20 nt, Human
aggcagagguugcagugagc

SEQ ID NO: 1174447 - RNA, 13 nt, Human
aggcagauacagg

SEQ ID NO: 1174448 - RNA, 14 nt, Human
aggcagccaggcca

SEQ ID NO: 1174449 - RNA, 15 nt, Human
aggcagccaggccac

SEQ ID NO: 1174450 - RNA, 16 nt, Human
aggcagccaggccaca

SEQ ID NO: 1174451 - RNA, 19 nt, Human
aggaaguacuggagaaaau

SEQ ID NO: 1174452 - RNA, 13 nt, Human
aggaaguagagga

SEQ ID NO: 1174453 - RNA, 14 nt, Human
aggaggucucuaag

SEQ ID NO: 1174454 - RNA, 15 nt, Human
aggaggucucuaaga

SEQ ID NO: 1174455 - RNA, 12 nt, Human
aggagugagcac

SEQ ID NO: 1174456 - RNA, 14 nt, Human
aggagugagcacua

SEQ ID NO: 1174457 - RNA, 22 nt, Human
aggauguucuagcauggcugcc

SEQ ID NO: 1174458 - RNA, 18 nt, Human
aggaaaaaauaacaauga

SEQ ID NO: 1174459 - RNA, 21 nt, Human
agcuuuguuuguugucagcug

SEQ ID NO: 1174460 - RNA, 22 nt, Human
agcuuuguuuguugucagcuga

SEQ ID NO: 1174461 - RNA, 12 nt, Human
aggaacacuccu

SEQ ID NO: 1174462 - RNA, 15 nt, Human
aggaacacuccuuca

SEQ ID NO: 1174463 - RNA, 14 nt, Human
aggaagguagaaau

SEQ ID NO: 1174464 - RNA, 11 nt, Human
aggaaguacug

SEQ ID NO: 1174465 - RNA, 15 nt, Human
aggaaguacuggaga

SEQ ID NO: 1174466 - RNA, 17 nt, Human
agcuguaugauucccag

SEQ ID NO: 1174467 - RNA, 18 nt, Human
agcuguaugauucccagc

SEQ ID NO: 1174468 - RNA, 15 nt, Human
agcuggucccacuca

SEQ ID NO: 1174469 - RNA, 16 nt, Human
agcuggucccacucag

SEQ ID NO: 1174470 - RNA, 16 nt, Human
agcugguugagguuuc

SEQ ID NO: 1174471 - RNA, 15 nt, Human
agcugacuuuucugu

SEQ ID NO: 1174472 - RNA, 21 nt, Human
agcugacuuuucuguccgagc

SEQ ID NO: 1174473 - RNA, 22 nt, Human
agcucaccagccccagugccca

SEQ ID NO: 1174474 - RNA, 23 nt, Human
agcucaccagccccagugcccac

SEQ ID NO: 1174475 - RNA, 14 nt, Human
agccuggacccugu

SEQ ID NO: 1174476 - RNA, 18 nt, Human
agccugggcaaugugaua

SEQ ID NO: 1174477 - RNA, 13 nt, Human
agcuacaaaugca

SEQ ID NO: 1174478 - RNA, 13 nt, Human
agcucaccagccc

SEQ ID NO: 1174479 - RNA, 14 nt, Human
agcucaccagcccc

SEQ ID NO: 1174480 - RNA, 15 nt, Human
agcucaccagcccca

SEQ ID NO: 1174481 - RNA, 21 nt, Human
agcucaccagccccagugccc

SEQ ID NO: 1174482 - RNA, 13 nt, Human
agcuaaugggaca

SEQ ID NO: 1174483 - RNA, 14 nt, Human
agcuaaugggacac

SEQ ID NO: 1174484 - RNA, 15 nt, Human
agcuaaugggacacu

SEQ ID NO: 1174485 - RNA, 13 nt, Human
agcgacagugaga

SEQ ID NO: 1174486 - RNA, 15 nt, Human
agcgacagugagacu

SEQ ID NO: 1174487 - RNA, 17 nt, Human
agcgacagugagacucu

SEQ ID NO: 1174488 - RNA, 15 nt, Human
agcgauucuucugcu

SEQ ID NO: 1174489 - RNA, 17 nt, Human
agcgauucuucugcuuc

SEQ ID NO: 1174490 - RNA, 19 nt, Human
agcgauucuucugcuucag

SEQ ID NO: 1174491 - RNA, 19 nt, Human
agcuaacauggaaguacua

SEQ ID NO: 1174492 - RNA, 20 nt, Human
agcuaacauggaaguacuau

SEQ ID NO: 1174493 - RNA, 21 nt, Human
guagcugggacuacaggcacc

SEQ ID NO: 1174494 - RNA, 12 nt, Human
guagcugggacu

SEQ ID NO: 1174495 - RNA, 18 nt, Human
guagcugggacuacaggc

SEQ ID NO: 1174496 - RNA, 19 nt, Human
guagcugggacuacaggca

SEQ ID NO: 1174497 - RNA, 17 nt, Human
aaaggagagcuagcagc

SEQ ID NO: 1174498 - RNA, 14 nt, Human
aaaggaugcacaga

SEQ ID NO: 1174499 - RNA, 18 nt, Human
guaggaagguuaauguuc

SEQ ID NO: 1174500 - RNA, 15 nt, Human
guaggaagacuuugg

SEQ ID NO: 1174501 - RNA, 17 nt, Human
aaaugaaaaucgugaca

SEQ ID NO: 1174502 - RNA, 15 nt, Human
aaaucucaaauuucu

SEQ ID NO: 1174503 - RNA, 16 nt, Human
aaaucucaaauuucua

SEQ ID NO: 1174504 - RNA, 17 nt, Human
aaaucucaaauuucuaa

SEQ ID NO: 1174505 - RNA, 19 nt, Human
aaaucucaaauuucuaaau

SEQ ID NO: 1174506 - RNA, 19 nt, Human
aaaucuacacuccagugag

SEQ ID NO: 1174507 - RNA, 14 nt, Human
aaauccuugaagau

SEQ ID NO: 1174508 - RNA, 13 nt, Human
aaaucgaugcagu

SEQ ID NO: 1174509 - RNA, 15 nt, Human
aaaucccauuuaaaa

SEQ ID NO: 1174510 - RNA, 18 nt, Human
aaaucccuuaccucggug

SEQ ID NO: 1174511 - RNA, 14 nt, Human
aaaugcauuucuaa

SEQ ID NO: 1174512 - RNA, 13 nt, Human
aaaugcccagccc

SEQ ID NO: 1174513 - RNA, 14 nt, Human
aaaugcccagcccc

SEQ ID NO: 1174514 - RNA, 15 nt, Human
aaaugcccagccccu

SEQ ID NO: 1174515 - RNA, 18 nt, Human
aaaugcccagccccuucu

SEQ ID NO: 1174516 - RNA, 13 nt, Human
aaaugcccagcuu

SEQ ID NO: 1174517 - RNA, 23 nt, Human
aaaugccuuacccucauguucuu

SEQ ID NO: 1174518 - RNA, 19 nt, Human
aaauggcuuccuggcaaua

SEQ ID NO: 1174519 - RNA, 15 nt, Human
aaaugggcagagcag

SEQ ID NO: 1174520 - RNA, 18 nt, Human
aaaugggcagagcagaga

SEQ ID NO: 1174521 - RNA, 20 nt, Human
aaaugggcagagcagagacc

SEQ ID NO: 1174522 - RNA, 14 nt, Human
aaaugcaccuggaa

SEQ ID NO: 1174523 - RNA, 18 nt, Human
aaaugcaccuggaauaua

SEQ ID NO: 1174524 - RNA, 22 nt, Human
aaaugcaccuggaauauauaac

SEQ ID NO: 1174525 - RNA, 21 nt, Human
aaaugaaagcagggacuugaa

SEQ ID NO: 1174526 - RNA, 22 nt, Human
aaaugaaagcagggacuugaac

SEQ ID NO: 1174527 - RNA, 13 nt, Human
aaaugagccuggc

SEQ ID NO: 1174528 - RNA, 19 nt, Human
aaaugagccuggcaagaau

SEQ ID NO: 1174529 - RNA, 16 nt, Human
aaaugagguacucucc

SEQ ID NO: 1174530 - RNA, 23 nt, Human
aaaugagguacucuccuggaaau

SEQ ID NO: 1174531 - RNA, 17 nt, Human
aaaugaggucagagccu

SEQ ID NO: 1174532 - RNA, 19 nt, Human
aaaugaggucagagccugc

SEQ ID NO: 1174533 - RNA, 15 nt, Human
guaugggagagaaga

SEQ ID NO: 1174534 - RNA, 13 nt, Human
guaugguggcugg

SEQ ID NO: 1174535 - RNA, 15 nt, Human
guauucuuauuuaau

SEQ ID NO: 1174536 - RNA, 15 nt, Human
guaucccuacuguaa

SEQ ID NO: 1174537 - RNA, 14 nt, Human
guaugauucccagc

SEQ ID NO: 1174538 - RNA, 14 nt, Human
guaugggagagaag

SEQ ID NO: 1174539 - RNA, 15 nt, Human
aaaugggggugcauu

SEQ ID NO: 1174540 - RNA, 16 nt, Human
aaaugggggugcauuu

SEQ ID NO: 1174541 - RNA, 17 nt, Human
aaaugggggugcauuug

SEQ ID NO: 1174542 - RNA, 18 nt, Human
aaaugggggugcauuuga

SEQ ID NO: 1174543 - RNA, 19 nt, Human
aaaugggggugcauuugag

SEQ ID NO: 1174544 - RNA, 21 nt, Human
aaauuaacuuuuauaaacuuu

SEQ ID NO: 1174545 - RNA, 22 nt, Human
aaauuaacuuuuauaaacuuua

SEQ ID NO: 1174546 - RNA, 23 nt, Human
aaauuaacuuuuauaaacuuuac

SEQ ID NO: 1174547 - RNA, 22 nt, Human
guauuggcuagagguucaaaga

SEQ ID NO: 1174548 - RNA, 14 nt, Human
aaauucaugcugcu

SEQ ID NO: 1174549 - RNA, 18 nt, Human
aaauuucagcagcugcag

SEQ ID NO: 1174550 - RNA, 17 nt, Human
aaauuucagcagcugca

SEQ ID NO: 1174551 - RNA, 12 nt, Human
aaauuucuaaau

SEQ ID NO: 1174552 - RNA, 14 nt, Human
guauuuuuuuacua

SEQ ID NO: 1174553 - RNA, 15 nt, Human
guauuuuuuuacuaa

SEQ ID NO: 1174554 - RNA, 17 nt, Human
guauuuuuuuacuaaua

SEQ ID NO: 1174555 - RNA, 21 nt, Human
guauuuuuuuacuaauagaca

SEQ ID NO: 1174556 - RNA, 19 nt, Human
gucaaaguggugagaggca

SEQ ID NO: 1174557 - RNA, 16 nt, Human
gucaaauugugugaaa

SEQ ID NO: 1174558 - RNA, 16 nt, Human
gucacacacuuuggcu

SEQ ID NO: 1174559 - RNA, 20 nt, Human
gucacacaguauuacuucug

SEQ ID NO: 1174560 - RNA, 21 nt, Human
gucauuugagcagggcucagc

SEQ ID NO: 1174561 - RNA, 21 nt, Human
aacacuguucucugcccucca

SEQ ID NO: 1174562 - RNA, 16 nt, Human
aacacuguucucugcc

SEQ ID NO: 1174563 - RNA, 22 nt, Human
gucauuugagcagggcucagcg

SEQ ID NO: 1174564 - RNA, 21 nt, Human
guccaagcauuuagauguaua

SEQ ID NO: 1174565 - RNA, 21 nt, Human
aacacucauugaccugaggcc

SEQ ID NO: 1174566 - RNA, 12 nt, Human
aacacuccuuca

SEQ ID NO: 1174567 - RNA, 11 nt, Human
aacacucugag

SEQ ID NO: 1174568 - RNA, 12 nt, Human
aacacucugaga

SEQ ID NO: 1174569 - RNA, 13 nt, Human
aacacucugagac

SEQ ID NO: 1174570 - RNA, 14 nt, Human
aacacucugagacu

SEQ ID NO: 1174571 - RNA, 15 nt, Human
aacacuguucucugc

SEQ ID NO: 1174572 - RNA, 20 nt, Human
aacacuguucucugcccucc

SEQ ID NO: 1174573 - RNA, 14 nt, Human
aacaaugcuguauu

SEQ ID NO: 1174574 - RNA, 13 nt, Human
gucacaggcaggu

SEQ ID NO: 1174575 - RNA, 15 nt, Human
gucacaggcaggucc

SEQ ID NO: 1174576 - RNA, 16 nt, Human
gucacaggcaggucca

SEQ ID NO: 1174577 - RNA, 21 nt, Human
gucacacaguauuacuucugc

SEQ ID NO: 1174578 - RNA, 16 nt, Human
aacaagaccacguuuc

SEQ ID NO: 1174579 - RNA, 17 nt, Human
aacaagaccacguuucu

SEQ ID NO: 1174580 - RNA, 19 nt, Human
aacaagaccacguuucuaa

SEQ ID NO: 1174581 - RNA, 20 nt, Human
aacaagaccacguuucuaaa

SEQ ID NO: 1174582 - RNA, 15 nt, Human
aacaaggaugaauua

SEQ ID NO: 1174583 - RNA, 15 nt, Human
aacaaggcaaggcug

SEQ ID NO: 1174584 - RNA, 21 nt, Human
guccggucccugucccagugc

SEQ ID NO: 1174585 - RNA, 10 nt, Human
aacagaaaug

SEQ ID NO: 1174586 - RNA, 11 nt, Human
aacagaaaugu

SEQ ID NO: 1174587 - RNA, 21 nt, Human
aacagaaauguacagcaagga

SEQ ID NO: 1174588 - RNA, 19 nt, Human
aacagacuggaagcacagc

SEQ ID NO: 1174589 - RNA, 20 nt, Human
aacagacuggaagcacagcu

SEQ ID NO: 1174590 - RNA, 22 nt, Human
aacaggcugggcuucaguggca

SEQ ID NO: 1174591 - RNA, 23 nt, Human
aacaggcugggcuucaguggcag

SEQ ID NO: 1174592 - RNA, 22 nt, Human
aacaguagugauaguuguaccg

SEQ ID NO: 1174593 - RNA, 14 nt, Human
aacauacucccauc

SEQ ID NO: 1174594 - RNA, 15 nt, Human
aacauacucccaucu

SEQ ID NO: 1174595 - RNA, 16 nt, Human
aacauacucccaucug

SEQ ID NO: 1174596 - RNA, 18 nt, Human
aacauuugguaaggggaa

SEQ ID NO: 1174597 - RNA, 20 nt, Human
aaccacaucuugcucugcug

SEQ ID NO: 1174598 - RNA, 22 nt, Human
aaccacaucuugcucugcugac

SEQ ID NO: 1174599 - RNA, 19 nt, Human
aaccaucauugaaaucuuu

SEQ ID NO: 1174600 - RNA, 20 nt, Human
aaccaucauugaaaucuuuu

SEQ ID NO: 1174601 - RNA, 21 nt, Human
aaccaucauugaaaucuuuuu

SEQ ID NO: 1174602 - RNA, 23 nt, Human
aaccaucauugaaaucuuuuugc

SEQ ID NO: 1174603 - RNA, 13 nt, Human
aacccaaauguuc

SEQ ID NO: 1174604 - RNA, 18 nt, Human
aacccaaauguucaucaa

SEQ ID NO: 1174605 - RNA, 11 nt, Human
aacccagcucu

SEQ ID NO: 1174606 - RNA, 13 nt, Human
aacccagcucugg

SEQ ID NO: 1174607 - RNA, 14 nt, Human
aacccagcucuggu

SEQ ID NO: 1174608 - RNA, 17 nt, Human
aacccagcucuggucca

SEQ ID NO: 1174609 - RNA, 23 nt, Human
aacccaaauguucaucaaugaau

SEQ ID NO: 1174610 - RNA, 20 nt, Human
aacccauauuuguacaccaa

SEQ ID NO: 1174611 - RNA, 13 nt, Human
aacccccagccug

SEQ ID NO: 1174612 - RNA, 14 nt, Human
aacccccagccugc

SEQ ID NO: 1174613 - RNA, 15 nt, Human
aacccccagccugcu

SEQ ID NO: 1174614 - RNA, 20 nt, Human
aaccuagggugauauuaacc

SEQ ID NO: 1174615 - RNA, 17 nt, Human
aaccuccgccucuuggg

SEQ ID NO: 1174616 - RNA, 14 nt, Human
aaccuccugggcua

SEQ ID NO: 1174617 - RNA, 19 nt, Human
gucuuauauauuguagaua

SEQ ID NO: 1174618 - RNA, 15 nt, Human
gucuuagauguauau

SEQ ID NO: 1174619 - RNA, 14 nt, Human
gucuuuggacccug

SEQ ID NO: 1174620 - RNA, 15 nt, Human
gucuuuggacccuga

SEQ ID NO: 1174621 - RNA, 17 nt, Human
gucuuuggacccugagg

SEQ ID NO: 1174622 - RNA, 18 nt, Human
gucuuuggacccugaggc

SEQ ID NO: 1174623 - RNA, 14 nt, Human
gucuuuucuugcau

SEQ ID NO: 1174624 - RNA, 19 nt, Human
gucuuuucuugcaugaggc

SEQ ID NO: 1174625 - RNA, 24 nt, Human
gucuuuucuugcaugaggcuagug

SEQ ID NO: 1174626 - RNA, 16 nt, Human
aacguggcugcuucaa

SEQ ID NO: 1174627 - RNA, 19 nt, Human
aacguggcugcuucaagga

SEQ ID NO: 1174628 - RNA, 22 nt, Human
aacguggcugcuucaaggaucc

SEQ ID NO: 1174629 - RNA, 21 nt, Human
aacuccagaaagugacaagcu

SEQ ID NO: 1174630 - RNA, 13 nt, Human
aacucccuuucaa

SEQ ID NO: 1174631 - RNA, 14 nt, Human
aacucccuuucaac

SEQ ID NO: 1174632 - RNA, 18 nt, Human
aacucguuaauuuguagu

SEQ ID NO: 1174633 - RNA, 19 nt, Human
gugaaccaccacacccagc

SEQ ID NO: 1174634 - RNA, 12 nt, Human
gugccucuggga

SEQ ID NO: 1174635 - RNA, 13 nt, Human
gugccucugggac

SEQ ID NO: 1174636 - RNA, 14 nt, Human
gugccucugggacu

SEQ ID NO: 1174637 - RNA, 14 nt, Human
gugccuuauggaac

SEQ ID NO: 1174638 - RNA, 21 nt, Human
gugccuuauggaacacucuga

SEQ ID NO: 1174639 - RNA, 23 nt, Human
gugccuuauggaacacucugaga

SEQ ID NO: 1174640 - RNA, 15 nt, Human
gugccucaagagaag

SEQ ID NO: 1174641 - RNA, 21 nt, Human
gugaaccaccacacccagccc

SEQ ID NO: 1174642 - RNA, 18 nt, Human
aacuugucuuuggacccu

SEQ ID NO: 1174643 - RNA, 22 nt, Human
aacuugucuuuggacccugagg

SEQ ID NO: 1174644 - RNA, 13 nt, Human
aacuuuaccuuuu

SEQ ID NO: 1174645 - RNA, 21 nt, Human
aacuuuaccuuuuuuauacau

SEQ ID NO: 1174646 - RNA, 16 nt, Human
aagaagugaaaaucua

SEQ ID NO: 1174647 - RNA, 22 nt, Human
aagaagugaaaaucuacacucc

SEQ ID NO: 1174648 - RNA, 18 nt, Human
gugcuaggaacacuccuu

SEQ ID NO: 1174649 - RNA, 22 nt, Human
gugcuaggaacacuccuucaca

SEQ ID NO: 1174650 - RNA, 18 nt, Human
gugcuaguaauuggaaag

SEQ ID NO: 1174651 - RNA, 21 nt, Human
gugcuaucucccccagcccca

SEQ ID NO: 1174652 - RNA, 15 nt, Human
aagaaaaaggaugca

SEQ ID NO: 1174653 - RNA, 17 nt, Human
aagaaaaaggaugcaca

SEQ ID NO: 1174654 - RNA, 18 nt, Human
aagaaaaaggaugcacag

SEQ ID NO: 1174655 - RNA, 19 nt, Human
aagaaaaaggaugcacaga

SEQ ID NO: 1174656 - RNA, 13 nt, Human
aagaaagaaaauc

SEQ ID NO: 1174657 - RNA, 20 nt, Human
aagaaagacuaucuaaaugu

SEQ ID NO: 1174658 - RNA, 22 nt, Human
aagaaagacuaucuaaauguug

SEQ ID NO: 1174659 - RNA, 20 nt, Human
gugcugggauuacaggugug

SEQ ID NO: 1174660 - RNA, 21 nt, Human
gugcugggauuacaagcguga

SEQ ID NO: 1174661 - RNA, 22 nt, Human
gugcugggauuacaagcgugag

SEQ ID NO: 1174662 - RNA, 22 nt, Human
gugcuaucucccccagccccau

SEQ ID NO: 1174663 - RNA, 12 nt, Human
gugcuauguucu

SEQ ID NO: 1174664 - RNA, 21 nt, Human
guggaugccugguggcagcug

SEQ ID NO: 1174665 - RNA, 18 nt, Human
guggacacagcucuucuc

SEQ ID NO: 1174666 - RNA, 22 nt, Human
guggacacagcucuucuccagg

SEQ ID NO: 1174667 - RNA, 23 nt, Human
guggacacagcucuucuccaggc

SEQ ID NO: 1174668 - RNA, 18 nt, Human
aagaaugauuaugaauua

SEQ ID NO: 1174669 - RNA, 16 nt, Human
aagaauugaagcagga

SEQ ID NO: 1174670 - RNA, 18 nt, Human
guggauuuaacagaaaug

SEQ ID NO: 1174671 - RNA, 19 nt, Human
guggauuuaacagaaaugu

SEQ ID NO: 1174672 - RNA, 20 nt, Human
guggauuuaacagaaaugua

SEQ ID NO: 1174673 - RNA, 19 nt, Human
guggcaccagcagccugga

SEQ ID NO: 1174674 - RNA, 14 nt, Human
guggcagcucaccu

SEQ ID NO: 1174675 - RNA, 16 nt, Human
guggcagcucaccucu

SEQ ID NO: 1174676 - RNA, 20 nt, Human
guggcagcucaccucucccu

SEQ ID NO: 1174677 - RNA, 16 nt, Human
aagaaugauuaugaau

SEQ ID NO: 1174678 - RNA, 18 nt, Human
aagacccuugugguccca

SEQ ID NO: 1174679 - RNA, 21 nt, Human
aagacccuuguggucccaccc

SEQ ID NO: 1174680 - RNA, 22 nt, Human
aagacccuuguggucccacccc

SEQ ID NO: 1174681 - RNA, 16 nt, Human
aagacuaucuaaaugu

SEQ ID NO: 1174682 - RNA, 17 nt, Human
aagacuaucuaaauguu

SEQ ID NO: 1174683 - RNA, 18 nt, Human
aagacuaucuaaauguug

SEQ ID NO: 1174684 - RNA, 17 nt, Human
aagacugaguacguugu

SEQ ID NO: 1174685 - RNA, 21 nt, Human
aagacugaguacguugugcau

SEQ ID NO: 1174686 - RNA, 22 nt, Human
aagacugaguacguugugcauu

SEQ ID NO: 1174687 - RNA, 17 nt, Human
aagacuguacaaaguag

SEQ ID NO: 1174688 - RNA, 23 nt, Human
guggcgcagcauauucaggaagc

SEQ ID NO: 1174689 - RNA, 21 nt, Human
gugggacagucaccucaugga

SEQ ID NO: 1174690 - RNA, 13 nt, Human
gugggagugggcc

SEQ ID NO: 1174691 - RNA, 14 nt, Human
gugggagugggccc

SEQ ID NO: 1174692 - RNA, 13 nt, Human
gugggauccucca

SEQ ID NO: 1174693 - RNA, 20 nt, Human
gugggggaucacagccucug

SEQ ID NO: 1174694 - RNA, 14 nt, Human
guggguacgggagg

SEQ ID NO: 1174695 - RNA, 14 nt, Human
guggguagacacac

SEQ ID NO: 1174696 - RNA, 14 nt, Human
guggugguuuucug

SEQ ID NO: 1174697 - RNA, 14 nt, Human
aagaugugacaugu

SEQ ID NO: 1174698 - RNA, 18 nt, Human
aagaugugacauguuuua

SEQ ID NO: 1174699 - RNA, 16 nt, Human
aagaugcuucucacug

SEQ ID NO: 1174700 - RNA, 12 nt, Human
aagcaaaggaga

SEQ ID NO: 1174701 - RNA, 13 nt, Human
aagcaaaggagau

SEQ ID NO: 1174702 - RNA, 20 nt, Human
guggugguuuucuguucuuu

SEQ ID NO: 1174703 - RNA, 17 nt, Human
gugguuuucuguucuuu

SEQ ID NO: 1174704 - RNA, 18 nt, Human
aagagguuuuaaaaaaau

SEQ ID NO: 1174705 - RNA, 15 nt, Human
aagauauuuugcuuu

SEQ ID NO: 1174706 - RNA, 12 nt, Human
aagaugcagccg

SEQ ID NO: 1174707 - RNA, 18 nt, Human
gugucuuuuuucacuaca

SEQ ID NO: 1174708 - RNA, 17 nt, Human
gugugacuacuccccca

SEQ ID NO: 1174709 - RNA, 17 nt, Human
gugucuugcaauggcag

SEQ ID NO: 1174710 - RNA, 18 nt, Human
gugucuugcaauggcagc

SEQ ID NO: 1174711 - RNA, 19 nt, Human
gugucuugcaauggcagcc

SEQ ID NO: 1174712 - RNA, 23 nt, Human
guguuuccuggcacugcuuccag

SEQ ID NO: 1174713 - RNA, 18 nt, Human
guuaaugauagcuacugu

SEQ ID NO: 1174714 - RNA, 17 nt, Human
guuaguaugaggcauuu

SEQ ID NO: 1174715 - RNA, 20 nt, Human
guuaguaugaggcauuuguu

SEQ ID NO: 1174716 - RNA, 16 nt, Human
guucagcuccagcuca

SEQ ID NO: 1174717 - RNA, 17 nt, Human
guucagcuccagcucac

SEQ ID NO: 1174718 - RNA, 18 nt, Human
guucagcuccagcucacc

SEQ ID NO: 1174719 - RNA, 17 nt, Human
guucaggguuggccccu

SEQ ID NO: 1174720 - RNA, 18 nt, Human
guucaggguuggccccug

SEQ ID NO: 1174721 - RNA, 19 nt, Human
guucaggguuggccccugc

SEQ ID NO: 1174722 - RNA, 20 nt, Human
guucaggguuggccccugcc

SEQ ID NO: 1174723 - RNA, 17 nt, Human
aagcuaggccuggccag

SEQ ID NO: 1174724 - RNA, 18 nt, Human
aagcuaggccuggccaga

SEQ ID NO: 1174725 - RNA, 22 nt, Human
aagcuaggccuggccagaugca

SEQ ID NO: 1174726 - RNA, 20 nt, Human
guucccauuugcuccuuucu

SEQ ID NO: 1174727 - RNA, 16 nt, Human
guucccauuugcuccu

SEQ ID NO: 1174728 - RNA, 20 nt, Human
guuccauggccucuucagau

SEQ ID NO: 1174729 - RNA, 22 nt, Human
aagcuauucaguaauaacucua

SEQ ID NO: 1174730 - RNA, 21 nt, Human
aagcucuacugaggugcuaug

SEQ ID NO: 1174731 - RNA, 20 nt, Human
guucccuuugacgccauccc

SEQ ID NO: 1174732 - RNA, 21 nt, Human
guucccuuugacgccauccca

SEQ ID NO: 1174733 - RNA, 22 nt, Human
guucccuuugacgccaucccag

SEQ ID NO: 1174734 - RNA, 16 nt, Human
guucuacccaggugcu

SEQ ID NO: 1174735 - RNA, 13 nt, Human
guucucuccuucu

SEQ ID NO: 1174736 - RNA, 17 nt, Human
guucuuaguuugcaguu

SEQ ID NO: 1174737 - RNA, 21 nt, Human
guucuugguuuguaaauuaac

SEQ ID NO: 1174738 - RNA, 14 nt, Human
guugacaugggaca

SEQ ID NO: 1174739 - RNA, 18 nt, Human
guugacaugggacauuug

SEQ ID NO: 1174740 - RNA, 22 nt, Human
guugaugaucuuugcagacagg

SEQ ID NO: 1174741 - RNA, 23 nt, Human
guugaugaucuuugcagacaggc

SEQ ID NO: 1174742 - RNA, 14 nt, Human
aaggauccugagcc

SEQ ID NO: 1174743 - RNA, 15 nt, Human
aaggauccugagcca

SEQ ID NO: 1174744 - RNA, 17 nt, Human
aaggauccugagccaga

SEQ ID NO: 1174745 - RNA, 18 nt, Human
aaggaugaucuaggaaga

SEQ ID NO: 1174746 - RNA, 23 nt, Human
aaggaugaucuaggaagacuuug

SEQ ID NO: 1174747 - RNA, 17 nt, Human
aaggaugcuuguacaua

SEQ ID NO: 1174748 - RNA, 19 nt, Human
aaggaugcuuguacauaau

SEQ ID NO: 1174749 - RNA, 18 nt, Human
aaggaugcacagaguugu

SEQ ID NO: 1174750 - RNA, 20 nt, Human
aaggauccugagccagauuu

SEQ ID NO: 1174751 - RNA, 22 nt, Human
aaggaugcacagaguuguuaca

SEQ ID NO: 1174752 - RNA, 15 nt, Human
aaggaugcuuguaca

SEQ ID NO: 1174753 - RNA, 16 nt, Human
aaggaugcuuguacau

SEQ ID NO: 1174754 - RNA, 18 nt, Human
aaggccaaaggaagcaca

SEQ ID NO: 1174755 - RNA, 19 nt, Human
aaggcuaccuuuguauucu

SEQ ID NO: 1174756 - RNA, 14 nt, Human
aaggcuccaggagc

SEQ ID NO: 1174757 - RNA, 17 nt, Human
guugcccaggcaggucu

SEQ ID NO: 1174758 - RNA, 18 nt, Human
guugcccaggcaggucuu

SEQ ID NO: 1174759 - RNA, 19 nt, Human
guugcccaggcaggucuug

SEQ ID NO: 1174760 - RNA, 15 nt, Human
aaggcuccaggagca

SEQ ID NO: 1174761 - RNA, 21 nt, Human
guugcccaggcuggcgugcag

SEQ ID NO: 1174762 - RNA, 18 nt, Human
guuguaccgcaaugugac

SEQ ID NO: 1174763 - RNA, 18 nt, Human
guuggucccccuuccaug

SEQ ID NO: 1174764 - RNA, 18 nt, Human
guuuggggaugagaaagg

SEQ ID NO: 1174765 - RNA, 15 nt, Human
guuuuacugcagcuu

SEQ ID NO: 1174766 - RNA, 11 nt, Human
guuuucuguuc

SEQ ID NO: 1174767 - RNA, 12 nt, Human
guuuucuguucu

SEQ ID NO: 1174768 - RNA, 22 nt, Human
guuucuaaaggcuaccuuugua

SEQ ID NO: 1174769 - RNA, 23 nt, Human
guuucuaaaggcuaccuuuguau

SEQ ID NO: 1174770 - RNA, 22 nt, Human
guuugauucagacagcugccug

SEQ ID NO: 1174771 - RNA, 13 nt, Human
guuugccucugcc

SEQ ID NO: 1174772 - RNA, 16 nt, Human
guuugccucugccucu

SEQ ID NO: 1174773 - RNA, 13 nt, Human
aagguacuucaaa

SEQ ID NO: 1174774 - RNA, 16 nt, Human
aaggguaucaggugcu

SEQ ID NO: 1174775 - RNA, 17 nt, Human
aaggguaucaggugcug

SEQ ID NO: 1174776 - RNA, 12 nt, Human
aaguaauaugca

SEQ ID NO: 1174777 - RNA, 15 nt, Human
aaguaauaugcacac

SEQ ID NO: 1174778 - RNA, 16 nt, Human
aaguaauaugcacaca

SEQ ID NO: 1174779 - RNA, 17 nt, Human
aaguaauaugcacacau

SEQ ID NO: 1174780 - RNA, 19 nt, Human
guuucuaaaggcuaccuuu

SEQ ID NO: 1174781 - RNA, 21 nt, Human
guuucaaacauauauaacaau

SEQ ID NO: 1174782 - RNA, 14 nt, Human
aagggccuggccug

SEQ ID NO: 1174783 - RNA, 17 nt, Human
aagggccuggccugagc

SEQ ID NO: 1174784 - RNA, 19 nt, Human
aagggccuggccugagcug

SEQ ID NO: 1174785 - RNA, 22 nt, Human
aaggggaauguuugccucugcc

SEQ ID NO: 1174786 - RNA, 23 nt, Human
aaggggaauguuugccucugccu

SEQ ID NO: 1174787 - RNA, 17 nt, Human
aaggggaauugaggaca

SEQ ID NO: 1174788 - RNA, 21 nt, Human
aauaacaaugaaaguugauaa

SEQ ID NO: 1174789 - RNA, 15 nt, Human
aauaacgauaaaaga

SEQ ID NO: 1174790 - RNA, 12 nt, Human
aauaaaacuuuu

SEQ ID NO: 1174791 - RNA, 14 nt, Human
aauaaaacuuuuua

SEQ ID NO: 1174792 - RNA, 15 nt, Human
aauaaaacuuuuuaa

SEQ ID NO: 1174793 - RNA, 18 nt, Human
aauaaaacuuuuuaaaau

SEQ ID NO: 1174794 - RNA, 16 nt, Human
aauaaaucauaaaacu

SEQ ID NO: 1174795 - RNA, 20 nt, Human
aaguuuuuauggcuuuugug

SEQ ID NO: 1174796 - RNA, 12 nt, Human
aauaaaaaguua

SEQ ID NO: 1174797 - RNA, 13 nt, Human
aauaaaaaguuaa

SEQ ID NO: 1174798 - RNA, 14 nt, Human
aauaaaaaguuaaa

SEQ ID NO: 1174799 - RNA, 15 nt, Human
aauaaaaaguuaaaa

SEQ ID NO: 1174800 - RNA, 14 nt, Human
uaaaucuccaaaau

SEQ ID NO: 1174801 - RNA, 15 nt, Human
uaaaucuccaaaaua

SEQ ID NO: 1174802 - RNA, 18 nt, Human
uaaaucuccaaaauaaaa

SEQ ID NO: 1174803 - RNA, 23 nt, Human
uaaaugcaccuggaauauauaac

SEQ ID NO: 1174804 - RNA, 15 nt, Human
uaaauguugaaagau

SEQ ID NO: 1174805 - RNA, 20 nt, Human
uaaauguugaaagaucaaaa

SEQ ID NO: 1174806 - RNA, 15 nt, Human
uaaauguugacaugg

SEQ ID NO: 1174807 - RNA, 12 nt, Human
uaaauuaacuuu

SEQ ID NO: 1174808 - RNA, 14 nt, Human
uaaauuaacuuuua

SEQ ID NO: 1174809 - RNA, 15 nt, Human
uaaauuaacuuuuau

SEQ ID NO: 1174810 - RNA, 16 nt, Human
uaaauuaacuuuuaua

SEQ ID NO: 1174811 - RNA, 17 nt, Human
uaaauuaacuuuuauaa

SEQ ID NO: 1174812 - RNA, 18 nt, Human
uaaauuaacuuuuauaaa

SEQ ID NO: 1174813 - RNA, 16 nt, Human
aauaauuuuuauauuu

SEQ ID NO: 1174814 - RNA, 17 nt, Human
aauaauuuuuauauuug

SEQ ID NO: 1174815 - RNA, 19 nt, Human
aauaauuuuuauauuugaa

SEQ ID NO: 1174816 - RNA, 20 nt, Human
aauaauuuuuauauuugaaa

SEQ ID NO: 1174817 - RNA, 19 nt, Human
uaaauaaugugaaacugga

SEQ ID NO: 1174818 - RNA, 23 nt, Human
aauagacaauuuauuauggcaca

SEQ ID NO: 1174819 - RNA, 20 nt, Human
aauagccugccucuucucua

SEQ ID NO: 1174820 - RNA, 13 nt, Human
aauagcugggacu

SEQ ID NO: 1174821 - RNA, 14 nt, Human
aauagcugggacua

SEQ ID NO: 1174822 - RNA, 18 nt, Human
aauaggcguaacuaauuu

SEQ ID NO: 1174823 - RNA, 15 nt, Human
aauaggaaaaacuga

SEQ ID NO: 1174824 - RNA, 16 nt, Human
aauaggaaaaacugau

SEQ ID NO: 1174825 - RNA, 17 nt, Human
aauaggaaaaacugauu

SEQ ID NO: 1174826 - RNA, 18 nt, Human
aauaggaaaaacugauuu

SEQ ID NO: 1174827 - RNA, 19 nt, Human
aauaggaaaaacugauuuu

SEQ ID NO: 1174828 - RNA, 12 nt, Human
aauaucacuugu

SEQ ID NO: 1174829 - RNA, 15 nt, Human
aauaucacuugucaa

SEQ ID NO: 1174830 - RNA, 20 nt, Human
aauaucacuugucaauaaaa

SEQ ID NO: 1174831 - RNA, 14 nt, Human
uaacauggaaguac

SEQ ID NO: 1174832 - RNA, 15 nt, Human
uaacauggaaguacu

SEQ ID NO: 1174833 - RNA, 16 nt, Human
uaacauggaaguacua

SEQ ID NO: 1174834 - RNA, 15 nt, Human
uaacuaaaagguaug

SEQ ID NO: 1174835 - RNA, 19 nt, Human
uaacuuuuauaaacuuuac

SEQ ID NO: 1174836 - RNA, 15 nt, Human
uaacuuuuauaaacu

SEQ ID NO: 1174837 - RNA, 17 nt, Human
uaacuuuuauaaacuuu

SEQ ID NO: 1174838 - RNA, 18 nt, Human
uaacuuuuauaaacuuua

SEQ ID NO: 1174839 - RNA, 16 nt, Human
aauaucugaaaaugua

SEQ ID NO: 1174840 - RNA, 17 nt, Human
aauaucugaaaauguau

SEQ ID NO: 1174841 - RNA, 18 nt, Human
aauaucugaaaauguaug

SEQ ID NO: 1174842 - RNA, 19 nt, Human
aauaucugaaaauguaugu

SEQ ID NO: 1174843 - RNA, 20 nt, Human
aauaucugaaaauguaugug

SEQ ID NO: 1174844 - RNA, 19 nt, Human
aauaucuuuuuuuuaauaa

SEQ ID NO: 1174845 - RNA, 15 nt, Human
aauaugcacacauuu

SEQ ID NO: 1174846 - RNA, 18 nt, Human
aauauugauaugcuuaua

SEQ ID NO: 1174847 - RNA, 11 nt, Human
aauauugcuga

SEQ ID NO: 1174848 - RNA, 12 nt, Human
aauauugcugau

SEQ ID NO: 1174849 - RNA, 13 nt, Human
aauauugcugaug

SEQ ID NO: 1174850 - RNA, 15 nt, Human
aauauugcugauggu

SEQ ID NO: 1174851 - RNA, 18 nt, Human
aauauugcugauggugca

SEQ ID NO: 1174852 - RNA, 21 nt, Human
aauauugcugauggugcaaug

SEQ ID NO: 1174853 - RNA, 22 nt, Human
aauauugcugauggugcaauga

SEQ ID NO: 1174854 - RNA, 15 nt, Human
aauauuucagauaau

SEQ ID NO: 1174855 - RNA, 20 nt, Human
uaaguuuuuauggcuuuugu

SEQ ID NO: 1174856 - RNA, 18 nt, Human
uaaguuuuuuuuuaaaaa

SEQ ID NO: 1174857 - RNA, 15 nt, Human
aaucaucaagucuuu

SEQ ID NO: 1174858 - RNA, 19 nt, Human
aaucaugaauuaguuuuau

SEQ ID NO: 1174859 - RNA, 23 nt, Human
aaucaugaauuaguuuuauaugc

SEQ ID NO: 1174860 - RNA, 16 nt, Human
aaucuuauaauuuaaa

SEQ ID NO: 1174861 - RNA, 14 nt, Human
aaucuuauaauuua

SEQ ID NO: 1174862 - RNA, 15 nt, Human
aaucucaaauaacua

SEQ ID NO: 1174863 - RNA, 12 nt, Human
aaucucaaauuu

SEQ ID NO: 1174864 - RNA, 14 nt, Human
aaucucaaauuucu

SEQ ID NO: 1174865 - RNA, 15 nt, Human
aaucucaaauuucua

SEQ ID NO: 1174866 - RNA, 13 nt, Human
aauccuugaagau

SEQ ID NO: 1174867 - RNA, 13 nt, Human
aaucuaaauggaa

SEQ ID NO: 1174868 - RNA, 15 nt, Human
aaucuaaauggaacc

SEQ ID NO: 1174869 - RNA, 18 nt, Human
aaucuaaauggaaccacu

SEQ ID NO: 1174870 - RNA, 20 nt, Human
aauccucaguuuuugugaaa

SEQ ID NO: 1174871 - RNA, 14 nt, Human
uaaugaaagacugu

SEQ ID NO: 1174872 - RNA, 17 nt, Human
uaaugaaagacuguaca

SEQ ID NO: 1174873 - RNA, 18 nt, Human
uaaugaaagacuguacaa

SEQ ID NO: 1174874 - RNA, 19 nt, Human
uaaugaaagacuguacaaa

SEQ ID NO: 1174875 - RNA, 22 nt, Human
uaaugaaagacuguacaaagua

SEQ ID NO: 1174876 - RNA, 23 nt, Human
uaaugaaagacuguacaaaguag

SEQ ID NO: 1174877 - RNA, 15 nt, Human
uaaugacuuaagcac

SEQ ID NO: 1174878 - RNA, 21 nt, Human
uaaugacuuaagcacacuuga

SEQ ID NO: 1174879 - RNA, 21 nt, Human
uaauaguucagguaacaggca

SEQ ID NO: 1174880 - RNA, 13 nt, Human
aaucuucugaacu

SEQ ID NO: 1174881 - RNA, 20 nt, Human
aaucuucugaacuuggcgcu

SEQ ID NO: 1174882 - RNA, 23 nt, Human
aaucuucugaacuuggcgcugcc

SEQ ID NO: 1174883 - RNA, 13 nt, Human
uaaugaggaaacu

SEQ ID NO: 1174884 - RNA, 16 nt, Human
uaaugauaacuggaaa

SEQ ID NO: 1174885 - RNA, 14 nt, Human
aaugacuuacugua

SEQ ID NO: 1174886 - RNA, 17 nt, Human
aaugacuuacuguacau

SEQ ID NO: 1174887 - RNA, 18 nt, Human
aaugacuuacuguacaug

SEQ ID NO: 1174888 - RNA, 21 nt, Human
aaugagagacacacugaagaa

SEQ ID NO: 1174889 - RNA, 15 nt, Human
aaugagccuggcaag

SEQ ID NO: 1174890 - RNA, 20 nt, Human
uacaaaaagcauaaaaauua

SEQ ID NO: 1174891 - RNA, 15 nt, Human
uacaaaagcauguga

SEQ ID NO: 1174892 - RNA, 14 nt, Human
aaugcccagccccu

SEQ ID NO: 1174893 - RNA, 15 nt, Human
aaugcccagccccuu

SEQ ID NO: 1174894 - RNA, 20 nt, Human
aaugcccagccccuucugac

SEQ ID NO: 1174895 - RNA, 22 nt, Human
aaugcccagccccuucugaccc

SEQ ID NO: 1174896 - RNA, 23 nt, Human
aaugcccagccccuucugaccca

SEQ ID NO: 1174897 - RNA, 24 nt, Human
aaugcccagccccuucugacccau

SEQ ID NO: 1174898 - RNA, 13 nt, Human
aaugcugugcccu

SEQ ID NO: 1174899 - RNA, 20 nt, Human
aaugcugugcccuaaagugu

SEQ ID NO: 1174900 - RNA, 21 nt, Human
aaugcugugcccuaaagugua

SEQ ID NO: 1174901 - RNA, 16 nt, Human
aauggacguguuauga

SEQ ID NO: 1174902 - RNA, 19 nt, Human
uacacuaagagagaaugag

SEQ ID NO: 1174903 - RNA, 14 nt, Human
uacacuccagugag

SEQ ID NO: 1174904 - RNA, 18 nt, Human
uacagaggccaugggccu

SEQ ID NO: 1174905 - RNA, 19 nt, Human
aauggacuuuuguacauag

SEQ ID NO: 1174906 - RNA, 21 nt, Human
aauggacguguuaugacucca

SEQ ID NO: 1174907 - RNA, 15 nt, Human
uacaccacuacauuc

SEQ ID NO: 1174908 - RNA, 16 nt, Human
uacaccacuacauucu

SEQ ID NO: 1174909 - RNA, 17 nt, Human
uacaccacuacauucug

SEQ ID NO: 1174910 - RNA, 18 nt, Human
uacaccacuacauucugu

SEQ ID NO: 1174911 - RNA, 19 nt, Human
uacaccacuacauucuguu

SEQ ID NO: 1174912 - RNA, 20 nt, Human
uacaccacuacauucuguua

SEQ ID NO: 1174913 - RNA, 11 nt, Human
aaugugauaug

SEQ ID NO: 1174914 - RNA, 14 nt, Human
aauguacugcauau

SEQ ID NO: 1174915 - RNA, 18 nt, Human
aauguacugcauaugaaa

SEQ ID NO: 1174916 - RNA, 12 nt, Human
aauguaugugua

SEQ ID NO: 1174917 - RNA, 14 nt, Human
aauguauguguaag

SEQ ID NO: 1174918 - RNA, 19 nt, Human
aauguauguguaaguauuc

SEQ ID NO: 1174919 - RNA, 12 nt, Human
aauguacugcau

SEQ ID NO: 1174920 - RNA, 21 nt, Human
uacauaaugcgugcauaccac

SEQ ID NO: 1174921 - RNA, 19 nt, Human
uacauaaugcgugcauacc

SEQ ID NO: 1174922 - RNA, 20 nt, Human
uacauaaugcgugcauacca

SEQ ID NO: 1174923 - RNA, 15 nt, Human
uacaguaucucaggg

SEQ ID NO: 1174924 - RNA, 17 nt, Human
uacauaaugcgugcaua

SEQ ID NO: 1174925 - RNA, 18 nt, Human
uacuguacaugaaaacac

SEQ ID NO: 1174926 - RNA, 18 nt, Human
aauugaggacacugauau

SEQ ID NO: 1174927 - RNA, 17 nt, Human
uacugagagugaacaaa

SEQ ID NO: 1174928 - RNA, 19 nt, Human
uacugagagugaacaaauu

SEQ ID NO: 1174929 - RNA, 15 nt, Human
uacuguaauuuguga

SEQ ID NO: 1174930 - RNA, 16 nt, Human
uacuguaauuugugau

SEQ ID NO: 1174931 - RNA, 17 nt, Human
uacuguaauuugugaua

SEQ ID NO: 1174932 - RNA, 13 nt, Human
aauugacccacaa

SEQ ID NO: 1174933 - RNA, 15 nt, Human
uacgucugacaggca

SEQ ID NO: 1174934 - RNA, 16 nt, Human
uacgucugacaggcaa

SEQ ID NO: 1174935 - RNA, 18 nt, Human
uacgggaggguaaggcug

SEQ ID NO: 1174936 - RNA, 13 nt, Human
uacgugaguccug

SEQ ID NO: 1174937 - RNA, 14 nt, Human
uacuaaaaauacaa

SEQ ID NO: 1174938 - RNA, 18 nt, Human
uacuaaaaauacaaaaaa

SEQ ID NO: 1174939 - RNA, 22 nt, Human
uacucuacccucuuagaaaaac

SEQ ID NO: 1174940 - RNA, 13 nt, Human
uacuucuccaccc

SEQ ID NO: 1174941 - RNA, 18 nt, Human
uacuucuccacccugcuc

SEQ ID NO: 1174942 - RNA, 20 nt, Human
uacuucuccacccugcucuc

SEQ ID NO: 1174943 - RNA, 15 nt, Human
uacuucugcuacaua

SEQ ID NO: 1174944 - RNA, 19 nt, Human
uacuucuuaggguuaugau

SEQ ID NO: 1174945 - RNA, 14 nt, Human
uacuucuuauacau

SEQ ID NO: 1174946 - RNA, 15 nt, Human
uacuucuuauacauu

SEQ ID NO: 1174947 - RNA, 16 nt, Human
uacuucuuauacauuu

SEQ ID NO: 1174948 - RNA, 13 nt, Human
aauuuauuauggc

SEQ ID NO: 1174949 - RNA, 14 nt, Human
aauuuauuauggca

SEQ ID NO: 1174950 - RNA, 17 nt, Human
aauuuauuauggcacau

SEQ ID NO: 1174951 - RNA, 15 nt, Human
aauuggagcucgugg

SEQ ID NO: 1174952 - RNA, 17 nt, Human
aauuuacagagacagaa

SEQ ID NO: 1174953 - RNA, 18 nt, Human
aauuuacagagacagaaa

SEQ ID NO: 1174954 - RNA, 15 nt, Human
aauuuacauacucug

SEQ ID NO: 1174955 - RNA, 17 nt, Human
aauuuaccugaagucuu

SEQ ID NO: 1174956 - RNA, 21 nt, Human
acaaagcgugguggacaugca

SEQ ID NO: 1174957 - RNA, 14 nt, Human
acaaaacuuuucua

SEQ ID NO: 1174958 - RNA, 22 nt, Human
uagauaggucagugcaaauacu

SEQ ID NO: 1174959 - RNA, 21 nt, Human
uagaugcaguucugaagaaga

SEQ ID NO: 1174960 - RNA, 16 nt, Human
aauuuguuauaaugaa

SEQ ID NO: 1174961 - RNA, 22 nt, Human
aauuuuuuuaucgucacugcuu

SEQ ID NO: 1174962 - RNA, 17 nt, Human
acaaauuuacagagaca

SEQ ID NO: 1174963 - RNA, 17 nt, Human
acaacaucuuuuucuac

SEQ ID NO: 1174964 - RNA, 16 nt, Human
acaagaccacguuucu

SEQ ID NO: 1174965 - RNA, 17 nt, Human
acaagaccacguuucua

SEQ ID NO: 1174966 - RNA, 18 nt, Human
acaagaccacguuucuaa

SEQ ID NO: 1174967 - RNA, 22 nt, Human
acaagagcccaggccuccuaca

SEQ ID NO: 1174968 - RNA, 17 nt, Human
acaagcgugagccacug

SEQ ID NO: 1174969 - RNA, 13 nt, Human
acaagcuccaagc

SEQ ID NO: 1174970 - RNA, 13 nt, Human
acaagcugcaccc

SEQ ID NO: 1174971 - RNA, 18 nt, Human
acaagcgugagccacugc

SEQ ID NO: 1174972 - RNA, 22 nt, Human
acaagcuccaagcucccaggca

SEQ ID NO: 1174973 - RNA, 15 nt, Human
acaagcuccaagcuc

SEQ ID NO: 1174974 - RNA, 16 nt, Human
acaagcuccaagcucc

SEQ ID NO: 1174975 - RNA, 17 nt, Human
acaagcuccaagcuccc

SEQ ID NO: 1174976 - RNA, 19 nt, Human
acaagcuccaagcucccag

SEQ ID NO: 1174977 - RNA, 16 nt, Human
uagcuacuaauuuuaa

SEQ ID NO: 1174978 - RNA, 16 nt, Human
uagcucaggugucccu

SEQ ID NO: 1174979 - RNA, 13 nt, Human
acacagugagucg

SEQ ID NO: 1174980 - RNA, 21 nt, Human
uagguuggcaaaaaggcagga

SEQ ID NO: 1174981 - RNA, 14 nt, Human
acacacugaagaag

SEQ ID NO: 1174982 - RNA, 11 nt, Human
acacagugagu

SEQ ID NO: 1174983 - RNA, 14 nt, Human
uaguagagacaggg

SEQ ID NO: 1174984 - RNA, 13 nt, Human
uaguagagacagg

SEQ ID NO: 1174985 - RNA, 12 nt, Human
uaguguuggaga

SEQ ID NO: 1174986 - RNA, 16 nt, Human
uaguguuggagaagaa

SEQ ID NO: 1174987 - RNA, 17 nt, Human
uaguguuggagaagaac

SEQ ID NO: 1174988 - RNA, 14 nt, Human
acaaugcuguauuu

SEQ ID NO: 1174989 - RNA, 17 nt, Human
acaaugcuguauuuuaa

SEQ ID NO: 1174990 - RNA, 18 nt, Human
acaaugcuguauuuuaaa

SEQ ID NO: 1174991 - RNA, 15 nt, Human
acaaugguuuucuug

SEQ ID NO: 1174992 - RNA, 21 nt, Human
acaaugguuuucuuguguguu

SEQ ID NO: 1174993 - RNA, 17 nt, Human
acacaacuauauuguuu

SEQ ID NO: 1174994 - RNA, 17 nt, Human
acacacacacaugcaua

SEQ ID NO: 1174995 - RNA, 12 nt, Human
acacacacagaa

SEQ ID NO: 1174996 - RNA, 13 nt, Human
acacacacagaaa

SEQ ID NO: 1174997 - RNA, 14 nt, Human
acacacacagaaaa

SEQ ID NO: 1174998 - RNA, 15 nt, Human
acacacacagaaaau

SEQ ID NO: 1174999 - RNA, 16 nt, Human
acacacacagaaaaua

SEQ ID NO: 1175000 - RNA, 12 nt, Human
acacacacagcc

SEQ ID NO: 1175001 - RNA, 13 nt, Human
acacacacagcca

SEQ ID NO: 1175002 - RNA, 14 nt, Human
acacacacagccac

SEQ ID NO: 1175003 - RNA, 15 nt, Human
acacacacagccaca

SEQ ID NO: 1175004 - RNA, 16 nt, Human
acacacacagccacac

SEQ ID NO: 1175005 - RNA, 14 nt, Human
acacacacauacac

SEQ ID NO: 1175006 - RNA, 13 nt, Human
acacacagccaca

SEQ ID NO: 1175007 - RNA, 14 nt, Human
acacacagccacac

SEQ ID NO: 1175008 - RNA, 15 nt, Human
acacacagccacaca

SEQ ID NO: 1175009 - RNA, 17 nt, Human
acacacagccacacaca

SEQ ID NO: 1175010 - RNA, 18 nt, Human
acacacagccacacacac

SEQ ID NO: 1175011 - RNA, 21 nt, Human
acacacagccacacacacaga

SEQ ID NO: 1175012 - RNA, 22 nt, Human
acacacagccacacacacagaa

SEQ ID NO: 1175013 - RNA, 11 nt, Human
acacacagcuc

SEQ ID NO: 1175014 - RNA, 12 nt, Human
acacacagcucu

SEQ ID NO: 1175015 - RNA, 13 nt, Human
acacacagcucug

SEQ ID NO: 1175016 - RNA, 14 nt, Human
acacacaugcauac

SEQ ID NO: 1175017 - RNA, 15 nt, Human
acacacaugcauaca

SEQ ID NO: 1175018 - RNA, 16 nt, Human
acacacaugcauacac

SEQ ID NO: 1175019 - RNA, 17 nt, Human
acacacaugcauacaca

SEQ ID NO: 1175020 - RNA, 18 nt, Human
acacacaugcauacacac

SEQ ID NO: 1175021 - RNA, 19 nt, Human
acacacaugcauacacaca

SEQ ID NO: 1175022 - RNA, 20 nt, Human
acacacaugcauacacacac

SEQ ID NO: 1175023 - RNA, 21 nt, Human
acacacaugcauacacacaca

SEQ ID NO: 1175024 - RNA, 13 nt, Human
acacacugaagaa

SEQ ID NO: 1175025 - RNA, 22 nt, Human
uauaaccaguguuguggauuua

SEQ ID NO: 1175026 - RNA, 16 nt, Human
acacuaaccacgcugg

SEQ ID NO: 1175027 - RNA, 17 nt, Human
acacuaaccacgcugga

SEQ ID NO: 1175028 - RNA, 19 nt, Human
acacuaaccacgcuggacc

SEQ ID NO: 1175029 - RNA, 17 nt, Human
acacuaagagagaauga

SEQ ID NO: 1175030 - RNA, 18 nt, Human
acacuaagagagaaugag

SEQ ID NO: 1175031 - RNA, 19 nt, Human
acacuaagagagaaugaga

SEQ ID NO: 1175032 - RNA, 20 nt, Human
acacuaaccacgcuggaccu

SEQ ID NO: 1175033 - RNA, 19 nt, Human
acacccagcccacuucugc

SEQ ID NO: 1175034 - RNA, 18 nt, Human
acaccucugcacaagcug

SEQ ID NO: 1175035 - RNA, 19 nt, Human
acaccucugcacaagcugc

SEQ ID NO: 1175036 - RNA, 14 nt, Human
acaccuugacaggg

SEQ ID NO: 1175037 - RNA, 15 nt, Human
acaccuugacagggc

SEQ ID NO: 1175038 - RNA, 16 nt, Human
acaccuugacagggca

SEQ ID NO: 1175039 - RNA, 18 nt, Human
uaguucagguaacaggca

SEQ ID NO: 1175040 - RNA, 13 nt, Human
acacaugcauaca

SEQ ID NO: 1175041 - RNA, 14 nt, Human
acacaugcauacac

SEQ ID NO: 1175042 - RNA, 15 nt, Human
acacaugcauacaca

SEQ ID NO: 1175043 - RNA, 16 nt, Human
acacaugcauacacac

SEQ ID NO: 1175044 - RNA, 17 nt, Human
acacaugcauacacaca

SEQ ID NO: 1175045 - RNA, 18 nt, Human
acacaugcauacacacac

SEQ ID NO: 1175046 - RNA, 19 nt, Human
acacaugcauacacacaca

SEQ ID NO: 1175047 - RNA, 13 nt, Human
acacauguccaag

SEQ ID NO: 1175048 - RNA, 18 nt, Human
acacauguccaagaagcc

SEQ ID NO: 1175049 - RNA, 19 nt, Human
acacauguccaagaagccc

SEQ ID NO: 1175050 - RNA, 21 nt, Human
acacauguccaagaagcccag

SEQ ID NO: 1175051 - RNA, 22 nt, Human
acacauguccaagaagcccagg

SEQ ID NO: 1175052 - RNA, 13 nt, Human
acacauuuuauuu

SEQ ID NO: 1175053 - RNA, 12 nt, Human
acacccagccca

SEQ ID NO: 1175054 - RNA, 13 nt, Human
acacccagcccac

SEQ ID NO: 1175055 - RNA, 15 nt, Human
acacuguuucaaacu

SEQ ID NO: 1175056 - RNA, 16 nt, Human
acacuguuucaaacuu

SEQ ID NO: 1175057 - RNA, 13 nt, Human
acacuuaaaaaug

SEQ ID NO: 1175058 - RNA, 15 nt, Human
acacuuaaaaauggu

SEQ ID NO: 1175059 - RNA, 12 nt, Human
uauauuuacaaa

SEQ ID NO: 1175060 - RNA, 19 nt, Human
acagaaagcagaacaguga

SEQ ID NO: 1175061 - RNA, 17 nt, Human
acagacacaggcccggc

SEQ ID NO: 1175062 - RNA, 18 nt, Human
acagacacaggcccggcu

SEQ ID NO: 1175063 - RNA, 22 nt, Human
acagacacaggcccggcuccag

SEQ ID NO: 1175064 - RNA, 19 nt, Human
acagacuggaagcacagcu

SEQ ID NO: 1175065 - RNA, 21 nt, Human
acagacuggaagcacagcuuc

SEQ ID NO: 1175066 - RNA, 22 nt, Human
acagacuggaagcacagcuuca

SEQ ID NO: 1175067 - RNA, 14 nt, Human
acacuccagugaga

SEQ ID NO: 1175068 - RNA, 11 nt, Human
acacucugaga

SEQ ID NO: 1175069 - RNA, 13 nt, Human
acacucugagacu

SEQ ID NO: 1175070 - RNA, 12 nt, Human
acacugaagaag

SEQ ID NO: 1175071 - RNA, 14 nt, Human
acacugaagaagca

SEQ ID NO: 1175072 - RNA, 14 nt, Human
acacuguucucugc

SEQ ID NO: 1175073 - RNA, 15 nt, Human
acacuguucucugcc

SEQ ID NO: 1175074 - RNA, 16 nt, Human
acacuguucucugccc

SEQ ID NO: 1175075 - RNA, 17 nt, Human
acacuguucucugcccu

SEQ ID NO: 1175076 - RNA, 18 nt, Human
acacuguucucugcccuc

SEQ ID NO: 1175077 - RNA, 20 nt, Human
acacuguucucugcccucca

SEQ ID NO: 1175078 - RNA, 22 nt, Human
acacuguucucugcccuccaag

SEQ ID NO: 1175079 - RNA, 23 nt, Human
acacuguucucugcccuccaaga

SEQ ID NO: 1175080 - RNA, 19 nt, Human
uaucccuacuguaauuugu

SEQ ID NO: 1175081 - RNA, 20 nt, Human
uaucccuacuguaauuugug

SEQ ID NO: 1175082 - RNA, 15 nt, Human
uauauuuauuacugu

SEQ ID NO: 1175083 - RNA, 19 nt, Human
uauauuuauuacuguaaga

SEQ ID NO: 1175084 - RNA, 20 nt, Human
uauauuuauuacuguaagaa

SEQ ID NO: 1175085 - RNA, 13 nt, Human
uaucucagggccu

SEQ ID NO: 1175086 - RNA, 15 nt, Human
uaucucagggccugg

SEQ ID NO: 1175087 - RNA, 21 nt, Human
acagagcaagugagacccugu

SEQ ID NO: 1175088 - RNA, 14 nt, Human
acagagcccacgcc

SEQ ID NO: 1175089 - RNA, 16 nt, Human
acagaguuguuacauu

SEQ ID NO: 1175090 - RNA, 17 nt, Human
acagaguuguuacauuu

SEQ ID NO: 1175091 - RNA, 18 nt, Human
acagaguuguuacauuuu

SEQ ID NO: 1175092 - RNA, 19 nt, Human
acagaguuguuacauuuuu

SEQ ID NO: 1175093 - RNA, 20 nt, Human
acagaguuguuacauuuuua

SEQ ID NO: 1175094 - RNA, 16 nt, Human
acagcaaggagauuua

SEQ ID NO: 1175095 - RNA, 21 nt, Human
acagcccgggcucugccuccc

SEQ ID NO: 1175096 - RNA, 22 nt, Human
acagcccgggcucugccuccca

SEQ ID NO: 1175097 - RNA, 23 nt, Human
acagcccgggcucugccucccau

SEQ ID NO: 1175098 - RNA, 20 nt, Human
acagcccuucuuuccacaga

SEQ ID NO: 1175099 - RNA, 21 nt, Human
acagcccuucuuuccacagaa

SEQ ID NO: 1175100 - RNA, 23 nt, Human
acagaugggugcuuggaggaagg

SEQ ID NO: 1175101 - RNA, 21 nt, Human
acagaguuguuacauuuuuaa

SEQ ID NO: 1175102 - RNA, 22 nt, Human
acagaguuguuacauuuuuaag

SEQ ID NO: 1175103 - RNA, 20 nt, Human
acagauagauauaugcucug

SEQ ID NO: 1175104 - RNA, 19 nt, Human
acauauauaacaaugcugu

SEQ ID NO: 1175105 - RNA, 14 nt, Human
acauagaauuaaca

SEQ ID NO: 1175106 - RNA, 18 nt, Human
acauagaauuaacacaug

SEQ ID NO: 1175107 - RNA, 14 nt, Human
acauauugauuucc

SEQ ID NO: 1175108 - RNA, 16 nt, Human
acauauugauuuccgu

SEQ ID NO: 1175109 - RNA, 18 nt, Human
acauauugauuuccguua

SEQ ID NO: 1175110 - RNA, 22 nt, Human
acauauugauuuccguuaaaau

SEQ ID NO: 1175111 - RNA, 23 nt, Human
acauauugauuuccguuaaaaua

SEQ ID NO: 1175112 - RNA, 13 nt, Human
acaucaacagaua

SEQ ID NO: 1175113 - RNA, 16 nt, Human
acaucaacaucuuggu

SEQ ID NO: 1175114 - RNA, 18 nt, Human
acaucaacaucuugguca

SEQ ID NO: 1175115 - RNA, 13 nt, Human
acaucuugcucug

SEQ ID NO: 1175116 - RNA, 14 nt, Human
acaucuugcucugc

SEQ ID NO: 1175117 - RNA, 18 nt, Human
acaucuugcucugcugac

SEQ ID NO: 1175118 - RNA, 19 nt, Human
acaucuugcucugcugaca

SEQ ID NO: 1175119 - RNA, 21 nt, Human
acaucuugcucugcugacaga

SEQ ID NO: 1175120 - RNA, 17 nt, Human
acaugaaaacacauuuu

SEQ ID NO: 1175121 - RNA, 18 nt, Human
acaugaaaacacauuuuu

SEQ ID NO: 1175122 - RNA, 19 nt, Human
acaugaaaacacauuuuuc

SEQ ID NO: 1175123 - RNA, 22 nt, Human
acaucuugcucugcugacagac

SEQ ID NO: 1175124 - RNA, 22 nt, Human
acaugaaaacacauuuuucuua

SEQ ID NO: 1175125 - RNA, 13 nt, Human
acauacuaaccag

SEQ ID NO: 1175126 - RNA, 21 nt, Human
acauacuaaccagcagaaaug

SEQ ID NO: 1175127 - RNA, 22 nt, Human
acauacuaaccagcagaaaugc

SEQ ID NO: 1175128 - RNA, 13 nt, Human
acauacucccauc

SEQ ID NO: 1175129 - RNA, 17 nt, Human
acauacucccaucugug

SEQ ID NO: 1175130 - RNA, 14 nt, Human
acauacucugcuua

SEQ ID NO: 1175131 - RNA, 16 nt, Human
acaguuuguuaguaug

SEQ ID NO: 1175132 - RNA, 20 nt, Human
acaguuuguuaguaugaggc

SEQ ID NO: 1175133 - RNA, 20 nt, Human
acaguugaaaaacagcugag

SEQ ID NO: 1175134 - RNA, 15 nt, Human
acaguugaaaaacag

SEQ ID NO: 1175135 - RNA, 16 nt, Human
acaguugaaaaacagc

SEQ ID NO: 1175136 - RNA, 23 nt, Human
uauuuccuauauuguuuucagug

SEQ ID NO: 1175137 - RNA, 22 nt, Human
uauuucccucaccuuucccauc

SEQ ID NO: 1175138 - RNA, 21 nt, Human
uaugaaauauuauguuaaaac

SEQ ID NO: 1175139 - RNA, 21 nt, Human
acauguccaagaagcccagga

SEQ ID NO: 1175140 - RNA, 12 nt, Human
acauucuguuaa

SEQ ID NO: 1175141 - RNA, 15 nt, Human
acauucuguuaauca

SEQ ID NO: 1175142 - RNA, 15 nt, Human
ucaaauuucuaaauc

SEQ ID NO: 1175143 - RNA, 16 nt, Human
ucaaauuucuaaaucu

SEQ ID NO: 1175144 - RNA, 17 nt, Human
ucaaauuucuaaaucuc

SEQ ID NO: 1175145 - RNA, 16 nt, Human
ucaacagguuuuccug

SEQ ID NO: 1175146 - RNA, 11 nt, Human
ucaaguauuau

SEQ ID NO: 1175147 - RNA, 15 nt, Human
ucaaguauuauaccu

SEQ ID NO: 1175148 - RNA, 16 nt, Human
ucaaguauuauaccuu

SEQ ID NO: 1175149 - RNA, 21 nt, Human
ucaaguauuauaccuuuuuua

SEQ ID NO: 1175150 - RNA, 23 nt, Human
ucaaguauuauaccuuuuuuaga

SEQ ID NO: 1175151 - RNA, 16 nt, Human
acaugaaguccaagca

SEQ ID NO: 1175152 - RNA, 18 nt, Human
ucaaauaacuaaaaggua

SEQ ID NO: 1175153 - RNA, 17 nt, Human
acaugagcaucaggcca

SEQ ID NO: 1175154 - RNA, 18 nt, Human
acaugagcaucaggccag

SEQ ID NO: 1175155 - RNA, 19 nt, Human
acaugagcaucaggccagg

SEQ ID NO: 1175156 - RNA, 19 nt, Human
acaugauccugcaauucca

SEQ ID NO: 1175157 - RNA, 15 nt, Human
acaugaucuucuuua

SEQ ID NO: 1175158 - RNA, 17 nt, Human
acaugaucuucuuuaua

SEQ ID NO: 1175159 - RNA, 19 nt, Human
acaugaucuucuuuauaau

SEQ ID NO: 1175160 - RNA, 20 nt, Human
acaugagcaucaggccaggc

SEQ ID NO: 1175161 - RNA, 14 nt, Human
ucaaagcugaaaug

SEQ ID NO: 1175162 - RNA, 16 nt, Human
ucaaaagcugggcagg

SEQ ID NO: 1175163 - RNA, 21 nt, Human
ucaaaauaugccccauucaac

SEQ ID NO: 1175164 - RNA, 18 nt, Human
ucaaaagaaagaaaauca

SEQ ID NO: 1175165 - RNA, 23 nt, Human
ucaagugaaaaaggaggaagaga

SEQ ID NO: 1175166 - RNA, 22 nt, Human
ucaaguccucuuuucugagagg

SEQ ID NO: 1175167 - RNA, 15 nt, Human
ucaagugaaaaagga

SEQ ID NO: 1175168 - RNA, 19 nt, Human
accaacauacucccaucug

SEQ ID NO: 1175169 - RNA, 21 nt, Human
accaacauacucccaucugug

SEQ ID NO: 1175170 - RNA, 22 nt, Human
accaacauacucccaucuguga

SEQ ID NO: 1175171 - RNA, 13 nt, Human
accaaucaugaau

SEQ ID NO: 1175172 - RNA, 15 nt, Human
accaaucaugaauua

SEQ ID NO: 1175173 - RNA, 15 nt, Human
accaauguucucucu

SEQ ID NO: 1175174 - RNA, 15 nt, Human
ucaauucuugccaaa

SEQ ID NO: 1175175 - RNA, 15 nt, Human
ucacaguucucuccu

SEQ ID NO: 1175176 - RNA, 12 nt, Human
ucacauaucugu

SEQ ID NO: 1175177 - RNA, 15 nt, Human
ucacauaucugucau

SEQ ID NO: 1175178 - RNA, 16 nt, Human
ucacaguucucuccuu

SEQ ID NO: 1175179 - RNA, 13 nt, Human
ucaccccagcccc

SEQ ID NO: 1175180 - RNA, 14 nt, Human
ucaccccagcccca

SEQ ID NO: 1175181 - RNA, 20 nt, Human
ucaccccagccccaaaacuc

SEQ ID NO: 1175182 - RNA, 15 nt, Human
ucaccccggccaccu

SEQ ID NO: 1175183 - RNA, 21 nt, Human
accacugcacuccagccuggg

SEQ ID NO: 1175184 - RNA, 22 nt, Human
ucaccccggccaccugcggugc

SEQ ID NO: 1175185 - RNA, 13 nt, Human
accacugcagaag

SEQ ID NO: 1175186 - RNA, 17 nt, Human
ucaccccggccaccugc

SEQ ID NO: 1175187 - RNA, 18 nt, Human
ucaccccggccaccugcg

SEQ ID NO: 1175188 - RNA, 20 nt, Human
accacugcacuccagccugg

SEQ ID NO: 1175189 - RNA, 18 nt, Human
accacuuguguuuugcaa

SEQ ID NO: 1175190 - RNA, 15 nt, Human
accacuuuuguucuu

SEQ ID NO: 1175191 - RNA, 16 nt, Human
accacuuuuguucuug

SEQ ID NO: 1175192 - RNA, 21 nt, Human
accacuuuuguucuugguuug

SEQ ID NO: 1175193 - RNA, 22 nt, Human
accacuuuuguucuugguuugu

SEQ ID NO: 1175194 - RNA, 14 nt, Human
accagacaccuuga

SEQ ID NO: 1175195 - RNA, 17 nt, Human
accagacaccuugacag

SEQ ID NO: 1175196 - RNA, 14 nt, Human
accagagcccaccu

SEQ ID NO: 1175197 - RNA, 16 nt, Human
accagagcccaccuug

SEQ ID NO: 1175198 - RNA, 17 nt, Human
accagagcccaccuugg

SEQ ID NO: 1175199 - RNA, 14 nt, Human
accagggacugagg

SEQ ID NO: 1175200 - RNA, 15 nt, Human
ucaccucucccuugg

SEQ ID NO: 1175201 - RNA, 16 nt, Human
ucaccugaagacucau

SEQ ID NO: 1175202 - RNA, 13 nt, Human
ucaccugccccuc

SEQ ID NO: 1175203 - RNA, 15 nt, Human
ucaccugccccucaa

SEQ ID NO: 1175204 - RNA, 16 nt, Human
ucaccugccccucaac

SEQ ID NO: 1175205 - RNA, 18 nt, Human
ucacuauguugcccaggc

SEQ ID NO: 1175206 - RNA, 19 nt, Human
ucacuauguugcccaggca

SEQ ID NO: 1175207 - RNA, 20 nt, Human
ucacuauguugcccaggcag

SEQ ID NO: 1175208 - RNA, 21 nt, Human
ucacucuuauugcccacgcug

SEQ ID NO: 1175209 - RNA, 23 nt, Human
ucacucuuauugcccacgcugga

SEQ ID NO: 1175210 - RNA, 22 nt, Human
accauggucggaaaacaugcua

SEQ ID NO: 1175211 - RNA, 23 nt, Human
accauuucuugagguaaaagcau

SEQ ID NO: 1175212 - RNA, 10 nt, Human
acccacugcu

SEQ ID NO: 1175213 - RNA, 11 nt, Human
acccacugcuc

SEQ ID NO: 1175214 - RNA, 13 nt, Human
acccacugcucug

SEQ ID NO: 1175215 - RNA, 14 nt, Human
acccacugcucugg

SEQ ID NO: 1175216 - RNA, 15 nt, Human
acccacugcucuggu

SEQ ID NO: 1175217 - RNA, 11 nt, Human
acccacugcuu

SEQ ID NO: 1175218 - RNA, 19 nt, Human
ucagaaguuucugccgcag

SEQ ID NO: 1175219 - RNA, 22 nt, Human
ucagaaguuucugccgcagccc

SEQ ID NO: 1175220 - RNA, 18 nt, Human
ucagaaucucaaauaacu

SEQ ID NO: 1175221 - RNA, 19 nt, Human
ucagaaucucaaauaacua

SEQ ID NO: 1175222 - RNA, 23 nt, Human
ucagaaguuucugccgcagcccu

SEQ ID NO: 1175223 - RNA, 17 nt, Human
ucagagacuccugcagg

SEQ ID NO: 1175224 - RNA, 20 nt, Human
ucagagacuccugcaggcag

SEQ ID NO: 1175225 - RNA, 21 nt, Human
ucagagacuccugcaggcagc

SEQ ID NO: 1175226 - RNA, 22 nt, Human
ucagagacuccugcaggcagcc

SEQ ID NO: 1175227 - RNA, 16 nt, Human
ucagagagggugggag

SEQ ID NO: 1175228 - RNA, 21 nt, Human
ucagagagggugggagugggc

SEQ ID NO: 1175229 - RNA, 23 nt, Human
ucagagagggugggagugggccc

SEQ ID NO: 1175230 - RNA, 12 nt, Human
ucagagccugca

SEQ ID NO: 1175231 - RNA, 13 nt, Human
ucagagccugcag

SEQ ID NO: 1175232 - RNA, 14 nt, Human
ucagagccugcagu

SEQ ID NO: 1175233 - RNA, 15 nt, Human
ucagagccugcaguu

SEQ ID NO: 1175234 - RNA, 18 nt, Human
ucagagccugcaguuauu

SEQ ID NO: 1175235 - RNA, 14 nt, Human
ucagcggggacagc

SEQ ID NO: 1175236 - RNA, 15 nt, Human
ucagcggggacagcu

SEQ ID NO: 1175237 - RNA, 20 nt, Human
ucagcuuguaaauagcucag

SEQ ID NO: 1175238 - RNA, 13 nt, Human
ucaggaaagagaa

SEQ ID NO: 1175239 - RNA, 19 nt, Human
ucaggaaagagaacuucca

SEQ ID NO: 1175240 - RNA, 12 nt, Human
acccccacccaa

SEQ ID NO: 1175241 - RNA, 14 nt, Human
accccuucgcuccu

SEQ ID NO: 1175242 - RNA, 15 nt, Human
accccuucgcuccug

SEQ ID NO: 1175243 - RNA, 16 nt, Human
accccuucgcuccugu

SEQ ID NO: 1175244 - RNA, 22 nt, Human
ucagccaagaauucuuaaauau

SEQ ID NO: 1175245 - RNA, 23 nt, Human
ucagccguguaaccauggaccca

SEQ ID NO: 1175246 - RNA, 19 nt, Human
acccagcgagcccuggugg

SEQ ID NO: 1175247 - RNA, 23 nt, Human
acccagcgagcccugguggcagu

SEQ ID NO: 1175248 - RNA, 24 nt, Human
acccagcgagcccugguggcagug

SEQ ID NO: 1175249 - RNA, 12 nt, Human
acccccacacac

SEQ ID NO: 1175250 - RNA, 13 nt, Human
acccccacacaca

SEQ ID NO: 1175251 - RNA, 14 nt, Human
acccccacacacac

SEQ ID NO: 1175252 - RNA, 15 nt, Human
acccccacacacaca

SEQ ID NO: 1175253 - RNA, 20 nt, Human
acccccacacacacacacau

SEQ ID NO: 1175254 - RNA, 21 nt, Human
acccccacacacacacacaug

SEQ ID NO: 1175255 - RNA, 21 nt, Human
accuagggugauauuaaccag

SEQ ID NO: 1175256 - RNA, 13 nt, Human
ucaggaagcucag

SEQ ID NO: 1175257 - RNA, 14 nt, Human
ucaggaagcucagg

SEQ ID NO: 1175258 - RNA, 15 nt, Human
ucaggaagcucaggg

SEQ ID NO: 1175259 - RNA, 16 nt, Human
ucaggaagcucagggc

SEQ ID NO: 1175260 - RNA, 13 nt, Human
accuccugccucg

SEQ ID NO: 1175261 - RNA, 23 nt, Human
accuccugccucgaacuggcugc

SEQ ID NO: 1175262 - RNA, 11 nt, Human
accuccugcug

SEQ ID NO: 1175263 - RNA, 12 nt, Human
accuccugcugg

SEQ ID NO: 1175264 - RNA, 13 nt, Human
accuccugcuggg

SEQ ID NO: 1175265 - RNA, 15 nt, Human
ucauccuaagcuauu

SEQ ID NO: 1175266 - RNA, 18 nt, Human
ucauccucauacccaccc

SEQ ID NO: 1175267 - RNA, 13 nt, Human
ucauccuccucag

SEQ ID NO: 1175268 - RNA, 19 nt, Human
ucauccuccucagaucuuc

SEQ ID NO: 1175269 - RNA, 14 nt, Human
ucauccuucuggaa

SEQ ID NO: 1175270 - RNA, 22 nt, Human
ucauccuucuggaauaaggaga

SEQ ID NO: 1175271 - RNA, 16 nt, Human
ucaugaauuaguuuua

SEQ ID NO: 1175272 - RNA, 21 nt, Human
ucaugaauuaguuuuauaugc

SEQ ID NO: 1175273 - RNA, 12 nt, Human
ucauucuucugu

SEQ ID NO: 1175274 - RNA, 12 nt, Human
ucauugaaaucu

SEQ ID NO: 1175275 - RNA, 13 nt, Human
ucauugaaaucuu

SEQ ID NO: 1175276 - RNA, 22 nt, Human
ucauugaaaucuuuuugcuuug

SEQ ID NO: 1175277 - RNA, 12 nt, Human
ucauugaccuga

SEQ ID NO: 1175278 - RNA, 14 nt, Human
ucauugaccugagg

SEQ ID NO: 1175279 - RNA, 15 nt, Human
ucauugaccugaggc

SEQ ID NO: 1175280 - RNA, 19 nt, Human
ucauugaccugaggcccuu

SEQ ID NO: 1175281 - RNA, 13 nt, Human
accuccugggcua

SEQ ID NO: 1175282 - RNA, 14 nt, Human
accuccugcugggc

SEQ ID NO: 1175283 - RNA, 16 nt, Human
accuccugcugggcag

SEQ ID NO: 1175284 - RNA, 19 nt, Human
accucggugccuuccucuu

SEQ ID NO: 1175285 - RNA, 14 nt, Human
accugaggcccuuc

SEQ ID NO: 1175286 - RNA, 15 nt, Human
accugaggcccuucu

SEQ ID NO: 1175287 - RNA, 16 nt, Human
accugaggcccuucuc

SEQ ID NO: 1175288 - RNA, 20 nt, Human
accugaggcccuucucucca

SEQ ID NO: 1175289 - RNA, 21 nt, Human
accugaggcccuucucuccag

SEQ ID NO: 1175290 - RNA, 22 nt, Human
accugaggcccuucucuccagc

SEQ ID NO: 1175291 - RNA, 15 nt, Human
accugauugugucuc

SEQ ID NO: 1175292 - RNA, 17 nt, Human
accugauugugucucuu

SEQ ID NO: 1175293 - RNA, 18 nt, Human
accugauugugucucuug

SEQ ID NO: 1175294 - RNA, 21 nt, Human
uccaagcuggucccacucagu

SEQ ID NO: 1175295 - RNA, 12 nt, Human
uccaagaagccc

SEQ ID NO: 1175296 - RNA, 20 nt, Human
uccaagcuggucccacucag

SEQ ID NO: 1175297 - RNA, 12 nt, Human
accugccaggaa

SEQ ID NO: 1175298 - RNA, 14 nt, Human
accugccaggaagc

SEQ ID NO: 1175299 - RNA, 15 nt, Human
accugccaggaagcc

SEQ ID NO: 1175300 - RNA, 14 nt, Human
uccaacccucauca

SEQ ID NO: 1175301 - RNA, 16 nt, Human
uccaacccucaucacc

SEQ ID NO: 1175302 - RNA, 17 nt, Human
uccaacccucaucacca

SEQ ID NO: 1175303 - RNA, 23 nt, Human
uccaacccucaucaccaacgucu

SEQ ID NO: 1175304 - RNA, 19 nt, Human
accuguuucugcagccacu

SEQ ID NO: 1175305 - RNA, 18 nt, Human
accuuagacagucccugc

SEQ ID NO: 1175306 - RNA, 19 nt, Human
accuuagacagucccugcc

SEQ ID NO: 1175307 - RNA, 20 nt, Human
accuuagacagucccugcca

SEQ ID NO: 1175308 - RNA, 18 nt, Human
accuggccucugcacucc

SEQ ID NO: 1175309 - RNA, 20 nt, Human
accuggccucugcacucccc

SEQ ID NO: 1175310 - RNA, 23 nt, Human
accuggccucugcacuccccugc

SEQ ID NO: 1175311 - RNA, 18 nt, Human
uccacccaccucagccuc

SEQ ID NO: 1175312 - RNA, 19 nt, Human
uccacccaccucagccucc

SEQ ID NO: 1175313 - RNA, 12 nt, Human
uccacccaggag

SEQ ID NO: 1175314 - RNA, 14 nt, Human
uccacccaggagcc

SEQ ID NO: 1175315 - RNA, 15 nt, Human
uccacccaggagccc

SEQ ID NO: 1175316 - RNA, 17 nt, Human
uccacccaggagccccg

SEQ ID NO: 1175317 - RNA, 14 nt, Human
accuggccucugca

SEQ ID NO: 1175318 - RNA, 16 nt, Human
accuggccucugcacu

SEQ ID NO: 1175319 - RNA, 17 nt, Human
accuggccucugcacuc

SEQ ID NO: 1175320 - RNA, 20 nt, Human
accuuuuggucuggagggaa

SEQ ID NO: 1175321 - RNA, 14 nt, Human
accuuuugagugcc

SEQ ID NO: 1175322 - RNA, 17 nt, Human
accuuuugagugccuua

SEQ ID NO: 1175323 - RNA, 20 nt, Human
accuuuugagugccuuacac

SEQ ID NO: 1175324 - RNA, 20 nt, Human
uccagaauuucccaaagcag

SEQ ID NO: 1175325 - RNA, 22 nt, Human
uccagaauuucccaaagcagug

SEQ ID NO: 1175326 - RNA, 13 nt, Human
uccagacacaugu

SEQ ID NO: 1175327 - RNA, 15 nt, Human
uccagacccggcugc

SEQ ID NO: 1175328 - RNA, 18 nt, Human
uccagacccggcugcgug

SEQ ID NO: 1175329 - RNA, 19 nt, Human
uccagacccggcugcgugg

SEQ ID NO: 1175330 - RNA, 12 nt, Human
uccagccccugg

SEQ ID NO: 1175331 - RNA, 13 nt, Human
uccagccccugga

SEQ ID NO: 1175332 - RNA, 14 nt, Human
uccagccccuggau

SEQ ID NO: 1175333 - RNA, 16 nt, Human
acgagcaggcuucuuc

SEQ ID NO: 1175334 - RNA, 19 nt, Human
acgccagauucuuuccuga

SEQ ID NO: 1175335 - RNA, 21 nt, Human
uccaggcuguaucccaugagc

SEQ ID NO: 1175336 - RNA, 19 nt, Human
accuuuuuuauacauaaac

SEQ ID NO: 1175337 - RNA, 20 nt, Human
accuuuuuuauacauaaaca

SEQ ID NO: 1175338 - RNA, 21 nt, Human
accuuuuuuauacauaaacaa

SEQ ID NO: 1175339 - RNA, 22 nt, Human
accuuuuuuauacauaaacaag

SEQ ID NO: 1175340 - RNA, 14 nt, Human
acgagaaaacaaua

SEQ ID NO: 1175341 - RNA, 20 nt, Human
acgggaggguaaggcugugg

SEQ ID NO: 1175342 - RNA, 15 nt, Human
ucccaccccacacac

SEQ ID NO: 1175343 - RNA, 20 nt, Human
ucccaccccacacacgccag

SEQ ID NO: 1175344 - RNA, 15 nt, Human
acgguuuuacugcag

SEQ ID NO: 1175345 - RNA, 17 nt, Human
acgguuuuacugcagcu

SEQ ID NO: 1175346 - RNA, 22 nt, Human
acgccagauucuuuccugaggc

SEQ ID NO: 1175347 - RNA, 23 nt, Human
acgccagauucuuuccugaggcu

SEQ ID NO: 1175348 - RNA, 20 nt, Human
uccauccugaggcuccacuu

SEQ ID NO: 1175349 - RNA, 21 nt, Human
uccauccugaggcuccacuug

SEQ ID NO: 1175350 - RNA, 13 nt, Human
uccaugaagaugu

SEQ ID NO: 1175351 - RNA, 21 nt, Human
uccaugaagauguagaggaga

SEQ ID NO: 1175352 - RNA, 22 nt, Human
uccaugaagauguagaggagaa

SEQ ID NO: 1175353 - RNA, 18 nt, Human
ucccaaacccuucagugc

SEQ ID NO: 1175354 - RNA, 16 nt, Human
ucccaaagcagugcau

SEQ ID NO: 1175355 - RNA, 17 nt, Human
ucccaaagcagugcaug

SEQ ID NO: 1175356 - RNA, 18 nt, Human
ucccaaagcagugcaugc

SEQ ID NO: 1175357 - RNA, 21 nt, Human
ucccaaagcagugcaugcugu

SEQ ID NO: 1175358 - RNA, 13 nt, Human
ucccaaagugcug

SEQ ID NO: 1175359 - RNA, 14 nt, Human
ucccaaagugcugg

SEQ ID NO: 1175360 - RNA, 22 nt, Human
uccccaccgcagacaggaccag

SEQ ID NO: 1175361 - RNA, 12 nt, Human
uccccacccuga

SEQ ID NO: 1175362 - RNA, 17 nt, Human
uccccaccgcagacagg

SEQ ID NO: 1175363 - RNA, 18 nt, Human
uccccaccgcagacagga

SEQ ID NO: 1175364 - RNA, 21 nt, Human
uccccaccgcagacaggacca

SEQ ID NO: 1175365 - RNA, 20 nt, Human
ucccagcugugcucuggaca

SEQ ID NO: 1175366 - RNA, 22 nt, Human
ucccauaugccugggcagaagg

SEQ ID NO: 1175367 - RNA, 15 nt, Human
ucccaucacccgcua

SEQ ID NO: 1175368 - RNA, 12 nt, Human
acuaaccacgcu

SEQ ID NO: 1175369 - RNA, 11 nt, Human
acuacaggcac

SEQ ID NO: 1175370 - RNA, 15 nt, Human
acuacaggcacccac

SEQ ID NO: 1175371 - RNA, 23 nt, Human
acuacaggugugagucaccaagc

SEQ ID NO: 1175372 - RNA, 13 nt, Human
acuacaguuuguu

SEQ ID NO: 1175373 - RNA, 14 nt, Human
acuacaguuuguua

SEQ ID NO: 1175374 - RNA, 15 nt, Human
acuacaguuuguuag

SEQ ID NO: 1175375 - RNA, 12 nt, Human
acuacauucugu

SEQ ID NO: 1175376 - RNA, 13 nt, Human
acuacauucuguu

SEQ ID NO: 1175377 - RNA, 14 nt, Human
acuacauucuguua

SEQ ID NO: 1175378 - RNA, 15 nt, Human
acuacauucuguuaa

SEQ ID NO: 1175379 - RNA, 12 nt, Human
ucccagccccaa

SEQ ID NO: 1175380 - RNA, 17 nt, Human
ucccagcugugcucugg

SEQ ID NO: 1175381 - RNA, 20 nt, Human
ucccgaguagcugggacuac

SEQ ID NO: 1175382 - RNA, 18 nt, Human
ucccgaguagcugggacu

SEQ ID NO: 1175383 - RNA, 16 nt, Human
ucccgaguagcuggga

SEQ ID NO: 1175384 - RNA, 17 nt, Human
ucccgaguagcugggac

SEQ ID NO: 1175385 - RNA, 20 nt, Human
ucccgaauagcugggacuac

SEQ ID NO: 1175386 - RNA, 15 nt, Human
ucccgaguagcuggg

SEQ ID NO: 1175387 - RNA, 12 nt, Human
acucaccccagc

SEQ ID NO: 1175388 - RNA, 17 nt, Human
acuacucccccaggugg

SEQ ID NO: 1175389 - RNA, 18 nt, Human
ucccucuuucccucccuu

SEQ ID NO: 1175390 - RNA, 20 nt, Human
ucccucuuucccucccuucc

SEQ ID NO: 1175391 - RNA, 21 nt, Human
ucccucuuucccucccuuccu

SEQ ID NO: 1175392 - RNA, 11 nt, Human
ucccugaaggc

SEQ ID NO: 1175393 - RNA, 15 nt, Human
ucccugaaggccccg

SEQ ID NO: 1175394 - RNA, 16 nt, Human
ucccugaaggccccgc

SEQ ID NO: 1175395 - RNA, 17 nt, Human
ucccugaaggccccgcc

SEQ ID NO: 1175396 - RNA, 23 nt, Human
acuccagaauuucccaaagcagu

SEQ ID NO: 1175397 - RNA, 12 nt, Human
acuccagccugg

SEQ ID NO: 1175398 - RNA, 13 nt, Human
acuccagccuggg

SEQ ID NO: 1175399 - RNA, 18 nt, Human
acuccugcaggcagccag

SEQ ID NO: 1175400 - RNA, 19 nt, Human
acuccugcaggcagccagg

SEQ ID NO: 1175401 - RNA, 15 nt, Human
acucauucuucugua

SEQ ID NO: 1175402 - RNA, 14 nt, Human
acucauugaccuga

SEQ ID NO: 1175403 - RNA, 15 nt, Human
acucauugaccugag

SEQ ID NO: 1175404 - RNA, 15 nt, Human
acuccagaauuuccc

SEQ ID NO: 1175405 - RNA, 17 nt, Human
acuccagaauuucccaa

SEQ ID NO: 1175406 - RNA, 16 nt, Human
uccuagaaauucccca

SEQ ID NO: 1175407 - RNA, 17 nt, Human
uccggucccugucccag

SEQ ID NO: 1175408 - RNA, 17 nt, Human
ucccuuuuuuggcugcu

SEQ ID NO: 1175409 - RNA, 12 nt, Human
ucccuuuuccuu

SEQ ID NO: 1175410 - RNA, 21 nt, Human
acuccugcaggcagccaggcc

SEQ ID NO: 1175411 - RNA, 15 nt, Human
ucccugguggcagcu

SEQ ID NO: 1175412 - RNA, 12 nt, Human
ucccugucccag

SEQ ID NO: 1175413 - RNA, 16 nt, Human
ucccugguggcagcuc

SEQ ID NO: 1175414 - RNA, 17 nt, Human
ucccuuacgugaguccu

SEQ ID NO: 1175415 - RNA, 20 nt, Human
acugcaucaagaugugacau

SEQ ID NO: 1175416 - RNA, 22 nt, Human
acugcaucaagaugugacaugu

SEQ ID NO: 1175417 - RNA, 15 nt, Human
acugcauguuuguga

SEQ ID NO: 1175418 - RNA, 16 nt, Human
acugcauguuugugau

SEQ ID NO: 1175419 - RNA, 21 nt, Human
uccuagaaauuccccacccug

SEQ ID NO: 1175420 - RNA, 22 nt, Human
uccuagaaauuccccacccuga

SEQ ID NO: 1175421 - RNA, 16 nt, Human
acugcauaugaaagga

SEQ ID NO: 1175422 - RNA, 15 nt, Human
acugcauuauauuua

SEQ ID NO: 1175423 - RNA, 14 nt, Human
acugcauuauauuu

SEQ ID NO: 1175424 - RNA, 18 nt, Human
acugcuuaacuucacaua

SEQ ID NO: 1175425 - RNA, 13 nt, Human
acugccuucucaa

SEQ ID NO: 1175426 - RNA, 19 nt, Human
acugccuucucaacuccaa

SEQ ID NO: 1175427 - RNA, 20 nt, Human
acugccuucucaacuccaaa

SEQ ID NO: 1175428 - RNA, 20 nt, Human
acugcuuaacuucacauauu

SEQ ID NO: 1175429 - RNA, 17 nt, Human
acugcuuccagugaggc

SEQ ID NO: 1175430 - RNA, 14 nt, Human
acugcuuuuggucu

SEQ ID NO: 1175431 - RNA, 15 nt, Human
acuggauuaaacuua

SEQ ID NO: 1175432 - RNA, 22 nt, Human
acuggauuaaacuuaaucuaaa

SEQ ID NO: 1175433 - RNA, 15 nt, Human
uccuucagugccuua

SEQ ID NO: 1175434 - RNA, 16 nt, Human
uccuucagugccuuau

SEQ ID NO: 1175435 - RNA, 17 nt, Human
uccuucagugccuuaug

SEQ ID NO: 1175436 - RNA, 20 nt, Human
uccuucagugccuuauggaa

SEQ ID NO: 1175437 - RNA, 14 nt, Human
uccuuguguuacua

SEQ ID NO: 1175438 - RNA, 23 nt, Human
uccuuguguuacuaaguuuuuau

SEQ ID NO: 1175439 - RNA, 15 nt, Human
uccuuuagcgcccag

SEQ ID NO: 1175440 - RNA, 19 nt, Human
uccuuuagcgcccaguugg

SEQ ID NO: 1175441 - RNA, 16 nt, Human
ucgagcaugccuggau

SEQ ID NO: 1175442 - RNA, 18 nt, Human
ucgagcaugccuggaugg

SEQ ID NO: 1175443 - RNA, 13 nt, Human
ucgaggacaggga

SEQ ID NO: 1175444 - RNA, 16 nt, Human
ucgcgacaaugcaaac

SEQ ID NO: 1175445 - RNA, 19 nt, Human
ucgcgacaaugcaaaccau

SEQ ID NO: 1175446 - RNA, 18 nt, Human
ucgagaaacagccugugu

SEQ ID NO: 1175447 - RNA, 22 nt, Human
uccuuuagcgcccaguugggug

SEQ ID NO: 1175448 - RNA, 23 nt, Human
uccuuuagcgcccaguugggugg

SEQ ID NO: 1175449 - RNA, 19 nt, Human
ucgggaggucgaggcagga

SEQ ID NO: 1175450 - RNA, 21 nt, Human
ucgggaggucgaggcaggagg

SEQ ID NO: 1175451 - RNA, 11 nt, Human
ucgggcaugac

SEQ ID NO: 1175452 - RNA, 12 nt, Human
ucgggcaugaca

SEQ ID NO: 1175453 - RNA, 18 nt, Human
acuguggguagacacaca

SEQ ID NO: 1175454 - RNA, 17 nt, Human
acuguccuacccacccu

SEQ ID NO: 1175455 - RNA, 18 nt, Human
acuguccuacccacccuc

SEQ ID NO: 1175456 - RNA, 23 nt, Human
acuguccuacccacccuccuuuc

SEQ ID NO: 1175457 - RNA, 18 nt, Human
acugggacaggggagaac

SEQ ID NO: 1175458 - RNA, 17 nt, Human
acuuaaucuaaauggaa

SEQ ID NO: 1175459 - RNA, 13 nt, Human
acuuaaucuaaau

SEQ ID NO: 1175460 - RNA, 15 nt, Human
acuuaaucuaaaugg

SEQ ID NO: 1175461 - RNA, 16 nt, Human
acuuaaucuaaaugga

SEQ ID NO: 1175462 - RNA, 13 nt, Human
acuguugcccagg

SEQ ID NO: 1175463 - RNA, 14 nt, Human
acuguugcccaggc

SEQ ID NO: 1175464 - RNA, 17 nt, Human
acuguugcccaggcugg

SEQ ID NO: 1175465 - RNA, 18 nt, Human
acuguugcccaggcuggc

SEQ ID NO: 1175466 - RNA, 16 nt, Human
acuuaaauaaugugaa

SEQ ID NO: 1175467 - RNA, 17 nt, Human
acuuaaauaaugugaaa

SEQ ID NO: 1175468 - RNA, 18 nt, Human
acuuaaauaaugugaaac

SEQ ID NO: 1175469 - RNA, 20 nt, Human
acuuaaauaaugugaaacug

SEQ ID NO: 1175470 - RNA, 14 nt, Human
acuguucucugccc

SEQ ID NO: 1175471 - RNA, 15 nt, Human
acuguucucugcccu

SEQ ID NO: 1175472 - RNA, 20 nt, Human
acuguucucugcccuccaag

SEQ ID NO: 1175473 - RNA, 21 nt, Human
acuguucucugcccuccaaga

SEQ ID NO: 1175474 - RNA, 20 nt, Human
ucuaaagccauuguaguccu

SEQ ID NO: 1175475 - RNA, 13 nt, Human
ucuaaagcugcca

SEQ ID NO: 1175476 - RNA, 14 nt, Human
ucuaaagcugccag

SEQ ID NO: 1175477 - RNA, 15 nt, Human
ucuaaagcugccagc

SEQ ID NO: 1175478 - RNA, 16 nt, Human
ucuaaagcugccagcc

SEQ ID NO: 1175479 - RNA, 11 nt, Human
acuucagcuga

SEQ ID NO: 1175480 - RNA, 16 nt, Human
acuucagcugacuuuu

SEQ ID NO: 1175481 - RNA, 11 nt, Human
ucucacuccuu

SEQ ID NO: 1175482 - RNA, 13 nt, Human
ucucacuccuuga

SEQ ID NO: 1175483 - RNA, 16 nt, Human
ucucacuauguugccc

SEQ ID NO: 1175484 - RNA, 12 nt, Human
ucucacucuguc

SEQ ID NO: 1175485 - RNA, 16 nt, Human
ucucacucugucgccc

SEQ ID NO: 1175486 - RNA, 14 nt, Human
acuucuccacccug

SEQ ID NO: 1175487 - RNA, 15 nt, Human
acuucuccacccugc

SEQ ID NO: 1175488 - RNA, 16 nt, Human
acuucuccacccugcu

SEQ ID NO: 1175489 - RNA, 18 nt, Human
acuucuccacccugcucu

SEQ ID NO: 1175490 - RNA, 21 nt, Human
acuugaacccauauuuguaca

SEQ ID NO: 1175491 - RNA, 19 nt, Human
acuugaacccgggaggcag

SEQ ID NO: 1175492 - RNA, 20 nt, Human
acuugaacccgggaggcaga

SEQ ID NO: 1175493 - RNA, 21 nt, Human
acuugaacccgggaggcagag

SEQ ID NO: 1175494 - RNA, 19 nt, Human
acuugagcccagagugaac

SEQ ID NO: 1175495 - RNA, 16 nt, Human
acuuguggacacagcu

SEQ ID NO: 1175496 - RNA, 17 nt, Human
acuuguggacacagcuc

SEQ ID NO: 1175497 - RNA, 18 nt, Human
acuuguggacacagcucu

SEQ ID NO: 1175498 - RNA, 12 nt, Human
ucucagggccug

SEQ ID NO: 1175499 - RNA, 13 nt, Human
ucucagggccugg

SEQ ID NO: 1175500 - RNA, 14 nt, Human
ucucagggccuggu

SEQ ID NO: 1175501 - RNA, 15 nt, Human
ucucagggccugguc

SEQ ID NO: 1175502 - RNA, 19 nt, Human
ucucagggccuggucguuu

SEQ ID NO: 1175503 - RNA, 17 nt, Human
ucuccaaaauaaaacuu

SEQ ID NO: 1175504 - RNA, 19 nt, Human
ucuccaaaauaaaacuuuu

SEQ ID NO: 1175505 - RNA, 22 nt, Human
ucuccaaaauaaaacuuuuuaa

SEQ ID NO: 1175506 - RNA, 15 nt, Human
ucuccaagcaggaca

SEQ ID NO: 1175507 - RNA, 16 nt, Human
ucuccaggcuguaucc

SEQ ID NO: 1175508 - RNA, 16 nt, Human
ucuccauguuugaugu

SEQ ID NO: 1175509 - RNA, 21 nt, Human
ucuccuccuuuucacaguucu

SEQ ID NO: 1175510 - RNA, 16 nt, Human
acuuguguuuugcaag

SEQ ID NO: 1175511 - RNA, 17 nt, Human
acuuucuagccagagga

SEQ ID NO: 1175512 - RNA, 18 nt, Human
ucugauucccaagcucug

SEQ ID NO: 1175513 - RNA, 18 nt, Human
ucugcacuccccugcugg

SEQ ID NO: 1175514 - RNA, 19 nt, Human
ucugcacuccccugcuggg

SEQ ID NO: 1175515 - RNA, 23 nt, Human
ucugagacucgcgacaaugcaaa

SEQ ID NO: 1175516 - RNA, 20 nt, Human
ucugcacuccccugcugggu

SEQ ID NO: 1175517 - RNA, 22 nt, Human
ucugcacuccccugcugggugu

SEQ ID NO: 1175518 - RNA, 12 nt, Human
ucugacacacag

SEQ ID NO: 1175519 - RNA, 14 nt, Human
agaaaugaaagcag

SEQ ID NO: 1175520 - RNA, 12 nt, Human
ucugaagaagau

SEQ ID NO: 1175521 - RNA, 14 nt, Human
agaaagaaaaucag

SEQ ID NO: 1175522 - RNA, 14 nt, Human
agaaauauaauuga

SEQ ID NO: 1175523 - RNA, 19 nt, Human
agaaauaucugaaaaugua

SEQ ID NO: 1175524 - RNA, 20 nt, Human
agaaauaucugaaaauguau

SEQ ID NO: 1175525 - RNA, 15 nt, Human
acuuugaccucugca

SEQ ID NO: 1175526 - RNA, 16 nt, Human
acuuugaccucugcag

SEQ ID NO: 1175527 - RNA, 18 nt, Human
acuuugaccucugcagca

SEQ ID NO: 1175528 - RNA, 13 nt, Human
ucucucacuccuu

SEQ ID NO: 1175529 - RNA, 15 nt, Human
ucucucacuccuuga

SEQ ID NO: 1175530 - RNA, 17 nt, Human
ucucuccagccccugga

SEQ ID NO: 1175531 - RNA, 18 nt, Human
ucucuccagccccuggau

SEQ ID NO: 1175532 - RNA, 19 nt, Human
ucucuccagccccuggaug

SEQ ID NO: 1175533 - RNA, 14 nt, Human
ucucuccuguaccu

SEQ ID NO: 1175534 - RNA, 16 nt, Human
ucucuccuguaccucu

SEQ ID NO: 1175535 - RNA, 17 nt, Human
ucucuccuguaccucuu

SEQ ID NO: 1175536 - RNA, 15 nt, Human
ucucugcccuccaag

SEQ ID NO: 1175537 - RNA, 16 nt, Human
ucucugcccuccaaga

SEQ ID NO: 1175538 - RNA, 17 nt, Human
ucucugcccuccaagac

SEQ ID NO: 1175539 - RNA, 12 nt, Human
ucucuggccuuc

SEQ ID NO: 1175540 - RNA, 22 nt, Human
ucucuggccuucggccuccauc

SEQ ID NO: 1175541 - RNA, 23 nt, Human
ucucuggccuucggccuccaucc

SEQ ID NO: 1175542 - RNA, 18 nt, Human
ucucuugagccugggagg

SEQ ID NO: 1175543 - RNA, 13 nt, Human
ucucuggccuucg

SEQ ID NO: 1175544 - RNA, 14 nt, Human
ucucuugauucaua

SEQ ID NO: 1175545 - RNA, 16 nt, Human
ucucuugauucauaau

SEQ ID NO: 1175546 - RNA, 16 nt, Human
ucucuugguccugcug

SEQ ID NO: 1175547 - RNA, 20 nt, Human
ucucuuuaaugucacaggca

SEQ ID NO: 1175548 - RNA, 21 nt, Human
ucucuuuaaugucacaggcag

SEQ ID NO: 1175549 - RNA, 13 nt, Human
agaaaaagaaaaa

SEQ ID NO: 1175550 - RNA, 17 nt, Human
agaaaaaggaugcacag

SEQ ID NO: 1175551 - RNA, 18 nt, Human
agaaaaaggaugcacaga

SEQ ID NO: 1175552 - RNA, 20 nt, Human
agaauuauaauuaguuccuc

SEQ ID NO: 1175553 - RNA, 20 nt, Human
agaauucucagaaucucaaa

SEQ ID NO: 1175554 - RNA, 14 nt, Human
agaauucucuaguu

SEQ ID NO: 1175555 - RNA, 18 nt, Human
agaauucucuaguuugau

SEQ ID NO: 1175556 - RNA, 23 nt, Human
agaaccccaggguccuguagccc

SEQ ID NO: 1175557 - RNA, 21 nt, Human
agaauguguuuaaacuugguu

SEQ ID NO: 1175558 - RNA, 16 nt, Human
ucuguuuagauaauac

SEQ ID NO: 1175559 - RNA, 19 nt, Human
ucuguuuagauaauacacc

SEQ ID NO: 1175560 - RNA, 23 nt, Human
ucuguuuagauaauacaccacua

SEQ ID NO: 1175561 - RNA, 15 nt, Human
agacagcugccuggg

SEQ ID NO: 1175562 - RNA, 16 nt, Human
agacagcugccuggga

SEQ ID NO: 1175563 - RNA, 12 nt, Human
agacagucccug

SEQ ID NO: 1175564 - RNA, 13 nt, Human
agacagucccugc

SEQ ID NO: 1175565 - RNA, 14 nt, Human
agacagucccugcc

SEQ ID NO: 1175566 - RNA, 23 nt, Human
ucuuagaugcaguucugaagaag

SEQ ID NO: 1175567 - RNA, 12 nt, Human
ucuuagauguau

SEQ ID NO: 1175568 - RNA, 14 nt, Human
ucuuagauguauau

SEQ ID NO: 1175569 - RNA, 19 nt, Human
agaauucucuaguuugauu

SEQ ID NO: 1175570 - RNA, 17 nt, Human
agaauucucuuauccaa

SEQ ID NO: 1175571 - RNA, 13 nt, Human
agacacaagccuu

SEQ ID NO: 1175572 - RNA, 14 nt, Human
agacacaagccuuc

SEQ ID NO: 1175573 - RNA, 16 nt, Human
agacacacugaagaag

SEQ ID NO: 1175574 - RNA, 17 nt, Human
agacacacugaagaagc

SEQ ID NO: 1175575 - RNA, 17 nt, Human
agacacaggcccggcuc

SEQ ID NO: 1175576 - RNA, 19 nt, Human
agacacaggcccggcucca

SEQ ID NO: 1175577 - RNA, 20 nt, Human
agacacaggcccggcuccag

SEQ ID NO: 1175578 - RNA, 21 nt, Human
agacacaggcccggcuccagg

SEQ ID NO: 1175579 - RNA, 22 nt, Human
agacacaggcccggcuccaggc

SEQ ID NO: 1175580 - RNA, 23 nt, Human
agacacaggcccggcuccaggcu

SEQ ID NO: 1175581 - RNA, 21 nt, Human
agacacauguccaagaagccc

SEQ ID NO: 1175582 - RNA, 22 nt, Human
agacacauguccaagaagccca

SEQ ID NO: 1175583 - RNA, 24 nt, Human
agacacauguccaagaagcccagg

SEQ ID NO: 1175584 - RNA, 22 nt, Human
agacaccuugacagggcacacc

SEQ ID NO: 1175585 - RNA, 13 nt, Human
agacagcugccug

SEQ ID NO: 1175586 - RNA, 14 nt, Human
agacagcugccugg

SEQ ID NO: 1175587 - RNA, 14 nt, Human
agacccggcugcgu

SEQ ID NO: 1175588 - RNA, 15 nt, Human
agacucauucuucug

SEQ ID NO: 1175589 - RNA, 17 nt, Human
ucuugagccuugaacuu

SEQ ID NO: 1175590 - RNA, 20 nt, Human
ucuugagccuugaacuuuga

SEQ ID NO: 1175591 - RNA, 18 nt, Human
ucuugagccuugaacuuu

SEQ ID NO: 1175592 - RNA, 19 nt, Human
ucuugagccuugaacuuug

SEQ ID NO: 1175593 - RNA, 23 nt, Human
ucuucuguacgucugacaggcaa

SEQ ID NO: 1175594 - RNA, 14 nt, Human
agacauagaauuaa

SEQ ID NO: 1175595 - RNA, 14 nt, Human
ucuuauugcccacg

SEQ ID NO: 1175596 - RNA, 22 nt, Human
ucuucugcuucagccucccgag

SEQ ID NO: 1175597 - RNA, 21 nt, Human
ucuucuguacgucugacaggc

SEQ ID NO: 1175598 - RNA, 22 nt, Human
ucuucuguacgucugacaggca

SEQ ID NO: 1175599 - RNA, 19 nt, Human
ucuuucuggcuaugcauuu

SEQ ID NO: 1175600 - RNA, 18 nt, Human
ucuuucuggcuaugcauu

SEQ ID NO: 1175601 - RNA, 20 nt, Human
ucuuuauaauucuacuuuga

SEQ ID NO: 1175602 - RNA, 13 nt, Human
ucuuucugcuuug

SEQ ID NO: 1175603 - RNA, 15 nt, Human
agacucgcgacaaug

SEQ ID NO: 1175604 - RNA, 17 nt, Human
agacucgcgacaaugca

SEQ ID NO: 1175605 - RNA, 18 nt, Human
agacucgcgacaaugcaa

SEQ ID NO: 1175606 - RNA, 19 nt, Human
agacucgcgacaaugcaaa

SEQ ID NO: 1175607 - RNA, 14 nt, Human
ucuugguuuguaaa

SEQ ID NO: 1175608 - RNA, 16 nt, Human
ucuugguuuguaaauu

SEQ ID NO: 1175609 - RNA, 20 nt, Human
ucuuuaaugucacaggcagg

SEQ ID NO: 1175610 - RNA, 22 nt, Human
ucuuuaaugucacaggcagguc

SEQ ID NO: 1175611 - RNA, 20 nt, Human
agacucgcgacaaugcaaac

SEQ ID NO: 1175612 - RNA, 21 nt, Human
agacucgcgacaaugcaaacc

SEQ ID NO: 1175613 - RNA, 15 nt, Human
agacuguacaaagua

SEQ ID NO: 1175614 - RNA, 16 nt, Human
agacuguacaaaguag

SEQ ID NO: 1175615 - RNA, 22 nt, Human
agagaaaaaauauuuuccugcc

SEQ ID NO: 1175616 - RNA, 15 nt, Human
agagacacaagccuu

SEQ ID NO: 1175617 - RNA, 24 nt, Human
agagacagaaagcagaacagugau

SEQ ID NO: 1175618 - RNA, 19 nt, Human
ugaacuuugaccucugcag

SEQ ID NO: 1175619 - RNA, 20 nt, Human
ugaacuuugaccucugcagc

SEQ ID NO: 1175620 - RNA, 22 nt, Human
ugaacuuugaccucugcagcaa

SEQ ID NO: 1175621 - RNA, 16 nt, Human
ugaacuccuggccuca

SEQ ID NO: 1175622 - RNA, 15 nt, Human
ugaaauuuuuauuaa

SEQ ID NO: 1175623 - RNA, 19 nt, Human
ugaaauuuuuauuaaauua

SEQ ID NO: 1175624 - RNA, 19 nt, Human
ugaacaaauuuacagagac

SEQ ID NO: 1175625 - RNA, 20 nt, Human
ugaacaaauuuacagagaca

SEQ ID NO: 1175626 - RNA, 12 nt, Human
ugaacuccuggc

SEQ ID NO: 1175627 - RNA, 14 nt, Human
ugaacuccuggccu

SEQ ID NO: 1175628 - RNA, 15 nt, Human
ugaacuccuggccuc

SEQ ID NO: 1175629 - RNA, 15 nt, Human
agagguugcagugag

SEQ ID NO: 1175630 - RNA, 13 nt, Human
agaggcagcccca

SEQ ID NO: 1175631 - RNA, 19 nt, Human
agaggcagccccauucugc

SEQ ID NO: 1175632 - RNA, 21 nt, Human
agaggcagccccauucugccu

SEQ ID NO: 1175633 - RNA, 10 nt, Human
agaggcaggg

SEQ ID NO: 1175634 - RNA, 13 nt, Human
agaggcagggucu

SEQ ID NO: 1175635 - RNA, 21 nt, Human
agaggcagggucucacucugu

SEQ ID NO: 1175636 - RNA, 19 nt, Human
agaggccaugggccuccug

SEQ ID NO: 1175637 - RNA, 15 nt, Human
ugaaauuguauuaca

SEQ ID NO: 1175638 - RNA, 18 nt, Human
ugaaauauuauguuaaaa

SEQ ID NO: 1175639 - RNA, 18 nt, Human
agagcugccaccugccug

SEQ ID NO: 1175640 - RNA, 17 nt, Human
ugaaauaagccagacau

SEQ ID NO: 1175641 - RNA, 18 nt, Human
ugaaauaagccagacauc

SEQ ID NO: 1175642 - RNA, 20 nt, Human
ugaaauaagccagacaucaa

SEQ ID NO: 1175643 - RNA, 23 nt, Human
ugaaauaagccagacaucaacag

SEQ ID NO: 1175644 - RNA, 17 nt, Human
ucuuuggacccugaggc

SEQ ID NO: 1175645 - RNA, 21 nt, Human
ucuuuggacccugaggcccag

SEQ ID NO: 1175646 - RNA, 21 nt, Human
agagcaccuuagacagucccu

SEQ ID NO: 1175647 - RNA, 12 nt, Human
agagcagagacc

SEQ ID NO: 1175648 - RNA, 17 nt, Human
agagcagagaccauccc

SEQ ID NO: 1175649 - RNA, 18 nt, Human
agagcagagaccaucccu

SEQ ID NO: 1175650 - RNA, 20 nt, Human
agagcagagaccaucccuga

SEQ ID NO: 1175651 - RNA, 11 nt, Human
agagccuugcg

SEQ ID NO: 1175652 - RNA, 21 nt, Human
agagccuugcggaagguucua

SEQ ID NO: 1175653 - RNA, 20 nt, Human
ugaaugguuuucaaaauaaa

SEQ ID NO: 1175654 - RNA, 19 nt, Human
ugaaugucagugugacuga

SEQ ID NO: 1175655 - RNA, 14 nt, Human
agagugaacaaauu

SEQ ID NO: 1175656 - RNA, 17 nt, Human
agaguugauacuacagu

SEQ ID NO: 1175657 - RNA, 20 nt, Human
agaguugauacuacaguuug

SEQ ID NO: 1175658 - RNA, 22 nt, Human
agaguugauacuacaguuuguu

SEQ ID NO: 1175659 - RNA, 12 nt, Human
agaguuguuaca

SEQ ID NO: 1175660 - RNA, 16 nt, Human
agaguuguuacauuuu

SEQ ID NO: 1175661 - RNA, 16 nt, Human
agaguuuagcuggaaa

SEQ ID NO: 1175662 - RNA, 17 nt, Human
agaguuuagcuggaaaa

SEQ ID NO: 1175663 - RNA, 12 nt, Human
agauaaaugugc

SEQ ID NO: 1175664 - RNA, 14 nt, Human
agaucacgccacug

SEQ ID NO: 1175665 - RNA, 15 nt, Human
agaucacgccacugc

SEQ ID NO: 1175666 - RNA, 16 nt, Human
agaucacgccacugca

SEQ ID NO: 1175667 - RNA, 17 nt, Human
agaucacgccacugcac

SEQ ID NO: 1175668 - RNA, 18 nt, Human
agaucacgccacugcacu

SEQ ID NO: 1175669 - RNA, 15 nt, Human
ugaauuucuuuugcc

SEQ ID NO: 1175670 - RNA, 21 nt, Human
ugacacacagcucuguccugg

SEQ ID NO: 1175671 - RNA, 20 nt, Human
ugacaggcaaugcuggcugu

SEQ ID NO: 1175672 - RNA, 11 nt, Human
ugacagggcac

SEQ ID NO: 1175673 - RNA, 16 nt, Human
ugacagggcacaccgg

SEQ ID NO: 1175674 - RNA, 20 nt, Human
ugacagggcacaccgggcac

SEQ ID NO: 1175675 - RNA, 21 nt, Human
ugacagggcacaccgggcacu

SEQ ID NO: 1175676 - RNA, 20 nt, Human
ugacauuguuggccaaagcc

SEQ ID NO: 1175677 - RNA, 21 nt, Human
ugacauuguuggccaaagcca

SEQ ID NO: 1175678 - RNA, 18 nt, Human
ugaccaaugauggucacc

SEQ ID NO: 1175679 - RNA, 13 nt, Human
agaucagccuggg

SEQ ID NO: 1175680 - RNA, 15 nt, Human
agaucagccugggca

SEQ ID NO: 1175681 - RNA, 14 nt, Human
agaugcaccagccc

SEQ ID NO: 1175682 - RNA, 15 nt, Human
agaugcaccagcccu

SEQ ID NO: 1175683 - RNA, 18 nt, Human
agaugcaguucugaagaa

SEQ ID NO: 1175684 - RNA, 19 nt, Human
agaugcaguucugaagaag

SEQ ID NO: 1175685 - RNA, 20 nt, Human
agaugcaguucugaagaaga

SEQ ID NO: 1175686 - RNA, 14 nt, Human
agaugcuagaacuc

SEQ ID NO: 1175687 - RNA, 15 nt, Human
agaugcuagaacucc

SEQ ID NO: 1175688 - RNA, 15 nt, Human
agaugcuucucacug

SEQ ID NO: 1175689 - RNA, 16 nt, Human
agaugcuucucacugc

SEQ ID NO: 1175690 - RNA, 17 nt, Human
ugacccacaagaaauga

SEQ ID NO: 1175691 - RNA, 12 nt, Human
ugacccacugcu

SEQ ID NO: 1175692 - RNA, 13 nt, Human
ugacccacugcuu

SEQ ID NO: 1175693 - RNA, 13 nt, Human
agcagggaaacag

SEQ ID NO: 1175694 - RNA, 14 nt, Human
agcagggaaacagc

SEQ ID NO: 1175695 - RNA, 15 nt, Human
agcagggaaacagcu

SEQ ID NO: 1175696 - RNA, 21 nt, Human
agcaggcucucaggccagcug

SEQ ID NO: 1175697 - RNA, 22 nt, Human
agcaggcucucaggccagcugc

SEQ ID NO: 1175698 - RNA, 23 nt, Human
agcaggcucucaggccagcugcu

SEQ ID NO: 1175699 - RNA, 17 nt, Human
agcaggcucgggcuccc

SEQ ID NO: 1175700 - RNA, 13 nt, Human
agcaggcucucag

SEQ ID NO: 1175701 - RNA, 14 nt, Human
agcaggcucucagg

SEQ ID NO: 1175702 - RNA, 15 nt, Human
agcaggcucucaggc

SEQ ID NO: 1175703 - RNA, 16 nt, Human
agcaggcucucaggcc

SEQ ID NO: 1175704 - RNA, 17 nt, Human
agcaggcucucaggcca

SEQ ID NO: 1175705 - RNA, 18 nt, Human
agcaggcucucaggccag

SEQ ID NO: 1175706 - RNA, 19 nt, Human
agcaggcucucaggccagc

SEQ ID NO: 1175707 - RNA, 20 nt, Human
agcagggagggcuucugcca

SEQ ID NO: 1175708 - RNA, 13 nt, Human
agcagggcucagc

SEQ ID NO: 1175709 - RNA, 14 nt, Human
agcagggcucagcg

SEQ ID NO: 1175710 - RNA, 15 nt, Human
agcagggcucagcgg

SEQ ID NO: 1175711 - RNA, 22 nt, Human
agcagggcucagcggggacagc

SEQ ID NO: 1175712 - RNA, 18 nt, Human
ugacccaugcugcccugu

SEQ ID NO: 1175713 - RNA, 19 nt, Human
ugacccaugcugcccugug

SEQ ID NO: 1175714 - RNA, 20 nt, Human
ugacccaugcugcccuguga

SEQ ID NO: 1175715 - RNA, 16 nt, Human
agcagcagggagggcu

SEQ ID NO: 1175716 - RNA, 11 nt, Human
agcagccacau

SEQ ID NO: 1175717 - RNA, 15 nt, Human
agcagccacauuccu

SEQ ID NO: 1175718 - RNA, 13 nt, Human
agcaggacaugga

SEQ ID NO: 1175719 - RNA, 19 nt, Human
agcauaaaaauuagccaag

SEQ ID NO: 1175720 - RNA, 19 nt, Human
agcagucaggaaagagaac

SEQ ID NO: 1175721 - RNA, 17 nt, Human
agcagucaggaaagaga

SEQ ID NO: 1175722 - RNA, 18 nt, Human
agcagucaggaaagagaa

SEQ ID NO: 1175723 - RNA, 23 nt, Human
agcauaaaaauuagccaagugug

SEQ ID NO: 1175724 - RNA, 16 nt, Human
ugaguacguugugcau

SEQ ID NO: 1175725 - RNA, 17 nt, Human
ugaguacguugugcauu

SEQ ID NO: 1175726 - RNA, 18 nt, Human
ugaguacguugugcauuu

SEQ ID NO: 1175727 - RNA, 19 nt, Human
ugaguacguugugcauuug

SEQ ID NO: 1175728 - RNA, 20 nt, Human
ugaguacguugugcauuugg

SEQ ID NO: 1175729 - RNA, 14 nt, Human
ugaguacuacaguc

SEQ ID NO: 1175730 - RNA, 13 nt, Human
ugaguccagaagu

SEQ ID NO: 1175731 - RNA, 17 nt, Human
ugagugcagcucuggag

SEQ ID NO: 1175732 - RNA, 13 nt, Human
ugagugccuuaca

SEQ ID NO: 1175733 - RNA, 14 nt, Human
ugagugccuuacac

SEQ ID NO: 1175734 - RNA, 16 nt, Human
ugagugccuuacacaa

SEQ ID NO: 1175735 - RNA, 21 nt, Human
ugagugggggaucacagccuc

SEQ ID NO: 1175736 - RNA, 23 nt, Human
ugagugggggaucacagccucug

SEQ ID NO: 1175737 - RNA, 14 nt, Human
ugauacaaugcugu

SEQ ID NO: 1175738 - RNA, 15 nt, Human
ugauacaaugcugug

SEQ ID NO: 1175739 - RNA, 18 nt, Human
ugaucacggcucacugca

SEQ ID NO: 1175740 - RNA, 15 nt, Human
ugaucacggcucacu

SEQ ID NO: 1175741 - RNA, 13 nt, Human
ugaucacggcuca

SEQ ID NO: 1175742 - RNA, 14 nt, Human
ugaucacggcucac

SEQ ID NO: 1175743 - RNA, 17 nt, Human
agcauauucaggaagcu

SEQ ID NO: 1175744 - RNA, 19 nt, Human
agcauauucaggaagcuca

SEQ ID NO: 1175745 - RNA, 21 nt, Human
agcauauucaggaagcucagg

SEQ ID NO: 1175746 - RNA, 22 nt, Human
agcauauucaggaagcucaggg

SEQ ID NO: 1175747 - RNA, 18 nt, Human
ugauacaaugcugugccc

SEQ ID NO: 1175748 - RNA, 12 nt, Human
agcaucaggcca

SEQ ID NO: 1175749 - RNA, 22 nt, Human
agcaucaggccaggcccucugc

SEQ ID NO: 1175750 - RNA, 23 nt, Human
agcaucaggccaggcccucugcc

SEQ ID NO: 1175751 - RNA, 13 nt, Human
agcauccuggcac

SEQ ID NO: 1175752 - RNA, 19 nt, Human
agcauggcugccaauggga

SEQ ID NO: 1175753 - RNA, 22 nt, Human
agcauuuagauguauagguuga

SEQ ID NO: 1175754 - RNA, 22 nt, Human
agcauuuugcuaaaugugaaug

SEQ ID NO: 1175755 - RNA, 15 nt, Human
agcauuuugcuaaau

SEQ ID NO: 1175756 - RNA, 22 nt, Human
agccacacacacagaaaauaua

SEQ ID NO: 1175757 - RNA, 23 nt, Human
agccacacacacagaaaauauac

SEQ ID NO: 1175758 - RNA, 10 nt, Human
agccacacac

SEQ ID NO: 1175759 - RNA, 12 nt, Human
agccacacacac

SEQ ID NO: 1175760 - RNA, 13 nt, Human
agccacacacaca

SEQ ID NO: 1175761 - RNA, 14 nt, Human
agccacacacacag

SEQ ID NO: 1175762 - RNA, 15 nt, Human
agccacacacacaga

SEQ ID NO: 1175763 - RNA, 16 nt, Human
agccacacacacagaa

SEQ ID NO: 1175764 - RNA, 17 nt, Human
agccacacacacagaaa

SEQ ID NO: 1175765 - RNA, 18 nt, Human
agccacacacacagaaaa

SEQ ID NO: 1175766 - RNA, 19 nt, Human
agccacacacacagaaaau

SEQ ID NO: 1175767 - RNA, 20 nt, Human
agccacacacacagaaaaua

SEQ ID NO: 1175768 - RNA, 21 nt, Human
agccacacacacagaaaauau

SEQ ID NO: 1175769 - RNA, 13 nt, Human
ugaucuaggaaga

SEQ ID NO: 1175770 - RNA, 19 nt, Human
ugauccucccaccucagcc

SEQ ID NO: 1175771 - RNA, 20 nt, Human
ugauccucccaccucagccu

SEQ ID NO: 1175772 - RNA, 18 nt, Human
ugauccucccaccucagc

SEQ ID NO: 1175773 - RNA, 23 nt, Human
ugaugaaaugaggucagagccug

SEQ ID NO: 1175774 - RNA, 19 nt, Human
ugaugaucuuugcagacag

SEQ ID NO: 1175775 - RNA, 20 nt, Human
ugaugaucuuugcagacagg

SEQ ID NO: 1175776 - RNA, 14 nt, Human
ugaucuaggaagac

SEQ ID NO: 1175777 - RNA, 15 nt, Human
ugaucuaggaagacu

SEQ ID NO: 1175778 - RNA, 22 nt, Human
ugaugaaaugaggucagagccu

SEQ ID NO: 1175779 - RNA, 21 nt, Human
ugaugaucuuugcagacaggc

SEQ ID NO: 1175780 - RNA, 22 nt, Human
ugaugaucuuugcagacaggca

SEQ ID NO: 1175781 - RNA, 22 nt, Human
ugaugggcaacccccagccugc

SEQ ID NO: 1175782 - RNA, 13 nt, Human
ugauggggcccug

SEQ ID NO: 1175783 - RNA, 14 nt, Human
ugauggggcccugc

SEQ ID NO: 1175784 - RNA, 22 nt, Human
ugauggggcccugccuccuuug

SEQ ID NO: 1175785 - RNA, 21 nt, Human
ugauguuuuaaggaugcuugu

SEQ ID NO: 1175786 - RNA, 17 nt, Human
ugauguuuuccaugagu

SEQ ID NO: 1175787 - RNA, 19 nt, Human
ugauguuuuccaugagucc

SEQ ID NO: 1175788 - RNA, 23 nt, Human
ugauguuuuccaugaguccccug

SEQ ID NO: 1175789 - RNA, 13 nt, Human
ugauuaaauucuu

SEQ ID NO: 1175790 - RNA, 16 nt, Human
ugauuaaauucuugca

SEQ ID NO: 1175791 - RNA, 17 nt, Human
ugauuaaauucuugcaa

SEQ ID NO: 1175792 - RNA, 15 nt, Human
ugauuaaguaaugau

SEQ ID NO: 1175793 - RNA, 16 nt, Human
ugauuaaguaaugaua

SEQ ID NO: 1175794 - RNA, 12 nt, Human
ugcaaaccauca

SEQ ID NO: 1175795 - RNA, 13 nt, Human
ugcaaaccaucau

SEQ ID NO: 1175796 - RNA, 18 nt, Human
ugauuuccguuaaaauac

SEQ ID NO: 1175797 - RNA, 17 nt, Human
agccacggccaggccag

SEQ ID NO: 1175798 - RNA, 18 nt, Human
agccacggccaggccaga

SEQ ID NO: 1175799 - RNA, 21 nt, Human
ugcaaaggguaucaggugcug

SEQ ID NO: 1175800 - RNA, 20 nt, Human
ugcaaaguaucccuacugua

SEQ ID NO: 1175801 - RNA, 18 nt, Human
ugcaaaccaucauugaaa

SEQ ID NO: 1175802 - RNA, 20 nt, Human
ugcaaaccaucauugaaauc

SEQ ID NO: 1175803 - RNA, 13 nt, Human
ugcaacaggcugg

SEQ ID NO: 1175804 - RNA, 15 nt, Human
ugcaagccagauuuu

SEQ ID NO: 1175805 - RNA, 21 nt, Human
ugcaagccagauuuuccugaa

SEQ ID NO: 1175806 - RNA, 15 nt, Human
ugcaaggucauuuuu

SEQ ID NO: 1175807 - RNA, 12 nt, Human
agcccaggccuc

SEQ ID NO: 1175808 - RNA, 14 nt, Human
agcccaggccuccu

SEQ ID NO: 1175809 - RNA, 19 nt, Human
agcccaggccuccuacagc

SEQ ID NO: 1175810 - RNA, 21 nt, Human
agcccaggccuccuacagcuu

SEQ ID NO: 1175811 - RNA, 14 nt, Human
agccccgaggccuu

SEQ ID NO: 1175812 - RNA, 16 nt, Human
agccccgaggccuucu

SEQ ID NO: 1175813 - RNA, 18 nt, Human
agccccgugggguuccuc

SEQ ID NO: 1175814 - RNA, 14 nt, Human
agccccuucugacc

SEQ ID NO: 1175815 - RNA, 15 nt, Human
agccccuucugaccc

SEQ ID NO: 1175816 - RNA, 16 nt, Human
agccccuucugaccca

SEQ ID NO: 1175817 - RNA, 19 nt, Human
agccccuucugacccaugc

SEQ ID NO: 1175818 - RNA, 14 nt, Human
agcccgggcucugc

SEQ ID NO: 1175819 - RNA, 15 nt, Human
agcccgggcucugcc

SEQ ID NO: 1175820 - RNA, 16 nt, Human
agcccgggcucugccu

SEQ ID NO: 1175821 - RNA, 17 nt, Human
agcccgggcucugccuc

SEQ ID NO: 1175822 - RNA, 14 nt, Human
agcccugcagaggg

SEQ ID NO: 1175823 - RNA, 15 nt, Human
agcccugcagagggc

SEQ ID NO: 1175824 - RNA, 16 nt, Human
agcccugcagagggca

SEQ ID NO: 1175825 - RNA, 19 nt, Human
agcccugcagagggcacag

SEQ ID NO: 1175826 - RNA, 21 nt, Human
ugcaccacugcacuccagccu

SEQ ID NO: 1175827 - RNA, 13 nt, Human
ugcaccagcccuu

SEQ ID NO: 1175828 - RNA, 14 nt, Human
ugcaccggcuggcc

SEQ ID NO: 1175829 - RNA, 15 nt, Human
ugcaccggcuggccu

SEQ ID NO: 1175830 - RNA, 16 nt, Human
ugcaccggcuggccug

SEQ ID NO: 1175831 - RNA, 18 nt, Human
ugcaccggcuggccuggc

SEQ ID NO: 1175832 - RNA, 14 nt, Human
ugcacuccagccug

SEQ ID NO: 1175833 - RNA, 15 nt, Human
ugcacuccagccuga

SEQ ID NO: 1175834 - RNA, 17 nt, Human
ugcacuccagccugagc

SEQ ID NO: 1175835 - RNA, 15 nt, Human
ugcacuccagccugg

SEQ ID NO: 1175836 - RNA, 16 nt, Human
ugcacuccagccuggg

SEQ ID NO: 1175837 - RNA, 20 nt, Human
ugcaugaaguaauaugcaca

SEQ ID NO: 1175838 - RNA, 18 nt, Human
ugcaugcugucccuuacg

SEQ ID NO: 1175839 - RNA, 19 nt, Human
ugcaugcugucccuuacgu

SEQ ID NO: 1175840 - RNA, 21 nt, Human
ugcaugcugucccuuacguga

SEQ ID NO: 1175841 - RNA, 16 nt, Human
ugcauaccacuuuugu

SEQ ID NO: 1175842 - RNA, 18 nt, Human
ugcauaccacuuuuguuc

SEQ ID NO: 1175843 - RNA, 20 nt, Human
ugcauaccacuuuuguucuu

SEQ ID NO: 1175844 - RNA, 21 nt, Human
ugcauaccacuuuuguucuug

SEQ ID NO: 1175845 - RNA, 19 nt, Human
ugcauacucauuaggaugg

SEQ ID NO: 1175846 - RNA, 12 nt, Human
ugcagacaggca

SEQ ID NO: 1175847 - RNA, 13 nt, Human
ugcagacaggcaa

SEQ ID NO: 1175848 - RNA, 21 nt, Human
ugcagacaggcaagcaccucc

SEQ ID NO: 1175849 - RNA, 13 nt, Human
agccuccugcccu

SEQ ID NO: 1175850 - RNA, 14 nt, Human
agccuccugcccuu

SEQ ID NO: 1175851 - RNA, 18 nt, Human
agccuccugcccuuaccu

SEQ ID NO: 1175852 - RNA, 18 nt, Human
ugcagccucacaguccuu

SEQ ID NO: 1175853 - RNA, 21 nt, Human
ugcagccucacaguccuuacc

SEQ ID NO: 1175854 - RNA, 22 nt, Human
agccuugaccauucuccaccug

SEQ ID NO: 1175855 - RNA, 20 nt, Human
agccuuggggcugaugcagu

SEQ ID NO: 1175856 - RNA, 18 nt, Human
agccuugaccauucucca

SEQ ID NO: 1175857 - RNA, 19 nt, Human
agccuugaccauucuccac

SEQ ID NO: 1175858 - RNA, 21 nt, Human
agccuugaccauucuccaccu

SEQ ID NO: 1175859 - RNA, 19 nt, Human
agccuugcggaagguucua

SEQ ID NO: 1175860 - RNA, 20 nt, Human
agccuuagaagucacacagu

SEQ ID NO: 1175861 - RNA, 22 nt, Human
agccuuagaagucacacaguau

SEQ ID NO: 1175862 - RNA, 13 nt, Human
agccuugaacuuu

SEQ ID NO: 1175863 - RNA, 17 nt, Human
agccugugccucuggga

SEQ ID NO: 1175864 - RNA, 18 nt, Human
agccugugccucugggac

SEQ ID NO: 1175865 - RNA, 19 nt, Human
agccugugccucugggacu

SEQ ID NO: 1175866 - RNA, 16 nt, Human
ugcauuuaaaagauac

SEQ ID NO: 1175867 - RNA, 13 nt, Human
ugccaauggacua

SEQ ID NO: 1175868 - RNA, 14 nt, Human
ugccaaugggagcu

SEQ ID NO: 1175869 - RNA, 18 nt, Human
ugccaaugggagcucaug

SEQ ID NO: 1175870 - RNA, 17 nt, Human
ugccagccgagauagcc

SEQ ID NO: 1175871 - RNA, 22 nt, Human
ugccagccgagauagccaaggc

SEQ ID NO: 1175872 - RNA, 13 nt, Human
ugccauaauuacu

SEQ ID NO: 1175873 - RNA, 13 nt, Human
agcucccaggcau

SEQ ID NO: 1175874 - RNA, 23 nt, Human
agcucccaggcauuccccaggag

SEQ ID NO: 1175875 - RNA, 15 nt, Human
agcuccuucuguccu

SEQ ID NO: 1175876 - RNA, 16 nt, Human
agcuccuucuguccua

SEQ ID NO: 1175877 - RNA, 21 nt, Human
agcuccuucuguccuacucug

SEQ ID NO: 1175878 - RNA, 22 nt, Human
agcuccuucuguccuacucugu

SEQ ID NO: 1175879 - RNA, 12 nt, Human
agcucuggucca

SEQ ID NO: 1175880 - RNA, 17 nt, Human
agcucugguccauagag

SEQ ID NO: 1175881 - RNA, 20 nt, Human
agcucugguccauagagagc

SEQ ID NO: 1175882 - RNA, 16 nt, Human
agcucuguccugggag

SEQ ID NO: 1175883 - RNA, 21 nt, Human
agcucuguccugggagugagc

SEQ ID NO: 1175884 - RNA, 23 nt, Human
agcucuguccugggagugagcug

SEQ ID NO: 1175885 - RNA, 20 nt, Human
agcugccagccgagauagcc

SEQ ID NO: 1175886 - RNA, 18 nt, Human
ugcccuuaccugccagga

SEQ ID NO: 1175887 - RNA, 19 nt, Human
ugcccuuaccugccaggaa

SEQ ID NO: 1175888 - RNA, 12 nt, Human
ugccgcagcccu

SEQ ID NO: 1175889 - RNA, 14 nt, Human
ugccgcagcccugc

SEQ ID NO: 1175890 - RNA, 12 nt, Human
ugccucagccuc

SEQ ID NO: 1175891 - RNA, 13 nt, Human
ugccucagccucc

SEQ ID NO: 1175892 - RNA, 22 nt, Human
ugccugcccaggccccugccac

SEQ ID NO: 1175893 - RNA, 23 nt, Human
ugccugcccaggccccugccacc

SEQ ID NO: 1175894 - RNA, 24 nt, Human
ugccugcccaggccccugccaccc

SEQ ID NO: 1175895 - RNA, 14 nt, Human
ugccucagccuccc

SEQ ID NO: 1175896 - RNA, 18 nt, Human
ugccucugccucugacac

SEQ ID NO: 1175897 - RNA, 20 nt, Human
ugccucugccucugacacac

SEQ ID NO: 1175898 - RNA, 16 nt, Human
agcugcuugggcuuca

SEQ ID NO: 1175899 - RNA, 20 nt, Human
agcugcuugggcuucauccu

SEQ ID NO: 1175900 - RNA, 16 nt, Human
ugccuggauggggcug

SEQ ID NO: 1175901 - RNA, 17 nt, Human
ugccuggauggggcugc

SEQ ID NO: 1175902 - RNA, 20 nt, Human
ugccuggauggggcugcacc

SEQ ID NO: 1175903 - RNA, 21 nt, Human
ugccuggauggggcugcaccg

SEQ ID NO: 1175904 - RNA, 14 nt, Human
agcugccuguucag

SEQ ID NO: 1175905 - RNA, 16 nt, Human
agcugccuguucagcu

SEQ ID NO: 1175906 - RNA, 18 nt, Human
agcugccuguucagcucc

SEQ ID NO: 1175907 - RNA, 19 nt, Human
agcugccuguucagcucca

SEQ ID NO: 1175908 - RNA, 19 nt, Human
agcuguuacugucuucagu

SEQ ID NO: 1175909 - RNA, 16 nt, Human
ugccuguugggccagg

SEQ ID NO: 1175910 - RNA, 17 nt, Human
ugccuguugggccagga

SEQ ID NO: 1175911 - RNA, 19 nt, Human
ugccuguugggccaggagc

SEQ ID NO: 1175912 - RNA, 20 nt, Human
ugccuuacccucauguucuu

SEQ ID NO: 1175913 - RNA, 21 nt, Human
ugccuuacccucauguucuua

SEQ ID NO: 1175914 - RNA, 16 nt, Human
ugccuuggggacaaga

SEQ ID NO: 1175915 - RNA, 20 nt, Human
agcugggacuacaggcaccc

SEQ ID NO: 1175916 - RNA, 23 nt, Human
agcugggacuacaggcacccacc

SEQ ID NO: 1175917 - RNA, 16 nt, Human
agcugggacuacaggu

SEQ ID NO: 1175918 - RNA, 20 nt, Human
agcugggguggggaccucag

SEQ ID NO: 1175919 - RNA, 22 nt, Human
agcugggguggggaccucaggc

SEQ ID NO: 1175920 - RNA, 23 nt, Human
agcugggguggggaccucaggcc

SEQ ID NO: 1175921 - RNA, 17 nt, Human
agcugggacuacaggug

SEQ ID NO: 1175922 - RNA, 17 nt, Human
agcugugcucuggacag

SEQ ID NO: 1175923 - RNA, 18 nt, Human
agcugugcucuggacagg

SEQ ID NO: 1175924 - RNA, 19 nt, Human
agcugugcucuggacaggc

SEQ ID NO: 1175925 - RNA, 18 nt, Human
agcuguuacugucuucag

SEQ ID NO: 1175926 - RNA, 19 nt, Human
ugccuuuucccaacuccag

SEQ ID NO: 1175927 - RNA, 14 nt, Human
ugcgguccacccag

SEQ ID NO: 1175928 - RNA, 15 nt, Human
ugcgguccacccagg

SEQ ID NO: 1175929 - RNA, 17 nt, Human
ugcgguccacccaggag

SEQ ID NO: 1175930 - RNA, 14 nt, Human
aggaaaagcugcug

SEQ ID NO: 1175931 - RNA, 20 nt, Human
agcuugaccgugaggccaga

SEQ ID NO: 1175932 - RNA, 22 nt, Human
agcuugaccgugaggccagaga

SEQ ID NO: 1175933 - RNA, 23 nt, Human
agcuugaccgugaggccagagac

SEQ ID NO: 1175934 - RNA, 20 nt, Human
agcuugcccuggugccucac

SEQ ID NO: 1175935 - RNA, 16 nt, Human
ugcucugcugacagac

SEQ ID NO: 1175936 - RNA, 14 nt, Human
ugcucugcugacag

SEQ ID NO: 1175937 - RNA, 15 nt, Human
ugcucugcugacaga

SEQ ID NO: 1175938 - RNA, 21 nt, Human
ugcuccagcuguucagcuggu

SEQ ID NO: 1175939 - RNA, 19 nt, Human
ugcucugaucauccacugu

SEQ ID NO: 1175940 - RNA, 18 nt, Human
ugcuaucucccccagccc

SEQ ID NO: 1175941 - RNA, 16 nt, Human
aggaaaagcugcugac

SEQ ID NO: 1175942 - RNA, 13 nt, Human
ugcuaucuccccc

SEQ ID NO: 1175943 - RNA, 14 nt, Human
ugcuaucuccccca

SEQ ID NO: 1175944 - RNA, 17 nt, Human
ugcuaucucccccagcc

SEQ ID NO: 1175945 - RNA, 13 nt, Human
aggaagccagcag

SEQ ID NO: 1175946 - RNA, 13 nt, Human
aggaagcucaggg

SEQ ID NO: 1175947 - RNA, 14 nt, Human
aggaagcucagggc

SEQ ID NO: 1175948 - RNA, 15 nt, Human
aggaagcucagggcc

SEQ ID NO: 1175949 - RNA, 16 nt, Human
aggaagcucagggccu

SEQ ID NO: 1175950 - RNA, 13 nt, Human
aggacgcucucug

SEQ ID NO: 1175951 - RNA, 14 nt, Human
aggacgcucucugg

SEQ ID NO: 1175952 - RNA, 16 nt, Human
aggacgcucucuggcc

SEQ ID NO: 1175953 - RNA, 17 nt, Human
aggacgcucucuggccu

SEQ ID NO: 1175954 - RNA, 19 nt, Human
aggacgcucucuggccuuc

SEQ ID NO: 1175955 - RNA, 20 nt, Human
aggacgcucucuggccuucg

SEQ ID NO: 1175956 - RNA, 17 nt, Human
aggacuuuucuuugugg

SEQ ID NO: 1175957 - RNA, 19 nt, Human
aggacuuuucuuuguggcu

SEQ ID NO: 1175958 - RNA, 22 nt, Human
aggacuuuucuuuguggcuucc

SEQ ID NO: 1175959 - RNA, 23 nt, Human
aggacuuuucuuuguggcuuccu

SEQ ID NO: 1175960 - RNA, 18 nt, Human
aggagaaacuggaacucu

SEQ ID NO: 1175961 - RNA, 19 nt, Human
aggagaaacuggaacucuc

SEQ ID NO: 1175962 - RNA, 12 nt, Human
aggagcagccac

SEQ ID NO: 1175963 - RNA, 13 nt, Human
aggagcagccaca

SEQ ID NO: 1175964 - RNA, 14 nt, Human
aggagcagccacau

SEQ ID NO: 1175965 - RNA, 17 nt, Human
aggagccccgaggccuu

SEQ ID NO: 1175966 - RNA, 16 nt, Human
aggagccuccugcccu

SEQ ID NO: 1175967 - RNA, 17 nt, Human
aggagccuccugcccuu

SEQ ID NO: 1175968 - RNA, 15 nt, Human
ugcuugagcucagga

SEQ ID NO: 1175969 - RNA, 22 nt, Human
ugcuuugugauuuuuguaauuu

SEQ ID NO: 1175970 - RNA, 18 nt, Human
ugcuuuuggucuguguga

SEQ ID NO: 1175971 - RNA, 20 nt, Human
ugcuuuugucuaugggacuc

SEQ ID NO: 1175972 - RNA, 23 nt, Human
ugcuuuuuaauauugauaugcuu

SEQ ID NO: 1175973 - RNA, 17 nt, Human
ugcuuuuucucaaaaug

SEQ ID NO: 1175974 - RNA, 21 nt, Human
uggaaauuuguuauaaugaau

SEQ ID NO: 1175975 - RNA, 23 nt, Human
uggaaauuuguuauaaugaauga

SEQ ID NO: 1175976 - RNA, 16 nt, Human
uggaagacagcucuua

SEQ ID NO: 1175977 - RNA, 13 nt, Human
aggaucagucuga

SEQ ID NO: 1175978 - RNA, 22 nt, Human
aggaugaucuaggaagacuuug

SEQ ID NO: 1175979 - RNA, 23 nt, Human
aggaugaucuaggaagacuuugg

SEQ ID NO: 1175980 - RNA, 22 nt, Human
aggaugcacagaguuguuacau

SEQ ID NO: 1175981 - RNA, 17 nt, Human
aggauucuuccucccuc

SEQ ID NO: 1175982 - RNA, 19 nt, Human
aggauucuuccucccuccc

SEQ ID NO: 1175983 - RNA, 17 nt, Human
uggagcucguggaacag

SEQ ID NO: 1175984 - RNA, 21 nt, Human
uggagcucguggaacaguuac

SEQ ID NO: 1175985 - RNA, 21 nt, Human
uggagcucgugggacagucac

SEQ ID NO: 1175986 - RNA, 18 nt, Human
aggcaagcaccuccugcc

SEQ ID NO: 1175987 - RNA, 19 nt, Human
aggcaagcaccuccugccu

SEQ ID NO: 1175988 - RNA, 20 nt, Human
aggcaagcaccuccugccuc

SEQ ID NO: 1175989 - RNA, 16 nt, Human
aggcaaggcugucaau

SEQ ID NO: 1175990 - RNA, 17 nt, Human
aggcaaggcugucaauu

SEQ ID NO: 1175991 - RNA, 15 nt, Human
aggauugcuacuguc

SEQ ID NO: 1175992 - RNA, 17 nt, Human
aggauugcuacuguccu

SEQ ID NO: 1175993 - RNA, 18 nt, Human
aggauugcuacuguccua

SEQ ID NO: 1175994 - RNA, 22 nt, Human
aggauugcuacuguccuaccca

SEQ ID NO: 1175995 - RNA, 12 nt, Human
aggcagggucuc

SEQ ID NO: 1175996 - RNA, 18 nt, Human
aggcagggucucacucug

SEQ ID NO: 1175997 - RNA, 17 nt, Human
aggcaggugggauggau

SEQ ID NO: 1175998 - RNA, 15 nt, Human
aggcauaaagucagg

SEQ ID NO: 1175999 - RNA, 22 nt, Human
aggcauaaagucagggguuccc

SEQ ID NO: 1176000 - RNA, 18 nt, Human
aggcauugugggaagggg

SEQ ID NO: 1176001 - RNA, 20 nt, Human
aggcauuuaggccaugggac

SEQ ID NO: 1176002 - RNA, 21 nt, Human
uggaugccugguggcagcugc

SEQ ID NO: 1176003 - RNA, 23 nt, Human
uggaugccugguggcagcugcgg

SEQ ID NO: 1176004 - RNA, 23 nt, Human
uggcacaucagcacgauuucugu

SEQ ID NO: 1176005 - RNA, 14 nt, Human
uggaguugaaaauc

SEQ ID NO: 1176006 - RNA, 16 nt, Human
aggcauuugcugaaua

SEQ ID NO: 1176007 - RNA, 20 nt, Human
aggcauuugcugaauacaga

SEQ ID NO: 1176008 - RNA, 14 nt, Human
uggagugcagugag

SEQ ID NO: 1176009 - RNA, 16 nt, Human
aggccccgcccaggcu

SEQ ID NO: 1176010 - RNA, 14 nt, Human
aggcccggcuccag

SEQ ID NO: 1176011 - RNA, 13 nt, Human
aggcccggcucca

SEQ ID NO: 1176012 - RNA, 14 nt, Human
aggccccgcccagg

SEQ ID NO: 1176013 - RNA, 13 nt, Human
aggcccagagggc

SEQ ID NO: 1176014 - RNA, 15 nt, Human
aggcccagagggccu

SEQ ID NO: 1176015 - RNA, 18 nt, Human
uggcacccggccccugcu

SEQ ID NO: 1176016 - RNA, 19 nt, Human
uggcacccggccccugcug

SEQ ID NO: 1176017 - RNA, 20 nt, Human
uggcacccggccccugcugg

SEQ ID NO: 1176018 - RNA, 21 nt, Human
uggcagcucaccucucccuug

SEQ ID NO: 1176019 - RNA, 22 nt, Human
uggcagcucaccucucccuugg

SEQ ID NO: 1176020 - RNA, 23 nt, Human
uggcagcucaccucucccuugga

SEQ ID NO: 1176021 - RNA, 13 nt, Human
uggcagcucagag

SEQ ID NO: 1176022 - RNA, 13 nt, Human
aggccagccuuga

SEQ ID NO: 1176023 - RNA, 15 nt, Human
aggccagccuugacc

SEQ ID NO: 1176024 - RNA, 12 nt, Human
aggccagcugcu

SEQ ID NO: 1176025 - RNA, 22 nt, Human
agggaaggauacaaaagcaugu

SEQ ID NO: 1176026 - RNA, 18 nt, Human
aggcccggcuccaggcuc

SEQ ID NO: 1176027 - RNA, 20 nt, Human
aggcccggcuccaggcuccu

SEQ ID NO: 1176028 - RNA, 21 nt, Human
aggcccggcuccaggcuccuu

SEQ ID NO: 1176029 - RNA, 20 nt, Human
ugggacucaaugcacugaca

SEQ ID NO: 1176030 - RNA, 16 nt, Human
ugggagagccuuccag

SEQ ID NO: 1176031 - RNA, 19 nt, Human
ugggagagaagagaaugca

SEQ ID NO: 1176032 - RNA, 21 nt, Human
ugggagagaagagaaugcaca

SEQ ID NO: 1176033 - RNA, 21 nt, Human
agggaggacgcucucuggccu

SEQ ID NO: 1176034 - RNA, 22 nt, Human
agggaggacgcucucuggccuu

SEQ ID NO: 1176035 - RNA, 23 nt, Human
agggaggacgcucucuggccuuc

SEQ ID NO: 1176036 - RNA, 14 nt, Human
ugggacuacaggca

SEQ ID NO: 1176037 - RNA, 15 nt, Human
ugggacuacaggcac

SEQ ID NO: 1176038 - RNA, 16 nt, Human
ugggacuacaggcacc

SEQ ID NO: 1176039 - RNA, 16 nt, Human
ugggcccccaaaugga

SEQ ID NO: 1176040 - RNA, 21 nt, Human
ugggcccccaaauggaaaugg

SEQ ID NO: 1176041 - RNA, 15 nt, Human
agggagggagggcuc

SEQ ID NO: 1176042 - RNA, 17 nt, Human
agggagggagggcucca

SEQ ID NO: 1176043 - RNA, 20 nt, Human
ugggaggaucucuugagccu

SEQ ID NO: 1176044 - RNA, 21 nt, Human
ugggaggaucucuugagccug

SEQ ID NO: 1176045 - RNA, 22 nt, Human
ugggaggaucucuugagccugg

SEQ ID NO: 1176046 - RNA, 19 nt, Human
ugggaggccaaggugggag

SEQ ID NO: 1176047 - RNA, 20 nt, Human
ugggaggccaaggugggagg

SEQ ID NO: 1176048 - RNA, 12 nt, Human
ugggcagaagga

SEQ ID NO: 1176049 - RNA, 11 nt, Human
ugggcagagca

SEQ ID NO: 1176050 - RNA, 12 nt, Human
ugggcagagcag

SEQ ID NO: 1176051 - RNA, 18 nt, Human
ugggccaggagccuccug

SEQ ID NO: 1176052 - RNA, 13 nt, Human
ugggcagagcaga

SEQ ID NO: 1176053 - RNA, 14 nt, Human
agggagggcuccag

SEQ ID NO: 1176054 - RNA, 15 nt, Human
agggagggcuccaga

SEQ ID NO: 1176055 - RNA, 16 nt, Human
agggagggcuccagac

SEQ ID NO: 1176056 - RNA, 17 nt, Human
agggagggcuccagaca

SEQ ID NO: 1176057 - RNA, 19 nt, Human
agggcucagcggggacagc

SEQ ID NO: 1176058 - RNA, 20 nt, Human
agggcucagcggggacagcu

SEQ ID NO: 1176059 - RNA, 22 nt, Human
agggcucagcggggacagcucc

SEQ ID NO: 1176060 - RNA, 23 nt, Human
agggcucagcggggacagcuccu

SEQ ID NO: 1176061 - RNA, 12 nt, Human
uggggcccugcc

SEQ ID NO: 1176062 - RNA, 14 nt, Human
uggggcccugccuc

SEQ ID NO: 1176063 - RNA, 23 nt, Human
uggggcugcaccggcuggccugg

SEQ ID NO: 1176064 - RNA, 12 nt, Human
agggcuccagac

SEQ ID NO: 1176065 - RNA, 15 nt, Human
agggcuccagacaca

SEQ ID NO: 1176066 - RNA, 14 nt, Human
uggggaccucaggc

SEQ ID NO: 1176067 - RNA, 15 nt, Human
uggggaccucaggcc

SEQ ID NO: 1176068 - RNA, 16 nt, Human
uggggaccucaggccu

SEQ ID NO: 1176069 - RNA, 17 nt, Human
uggggaccucaggccug

SEQ ID NO: 1176070 - RNA, 13 nt, Human
aggggaauguuug

SEQ ID NO: 1176071 - RNA, 18 nt, Human
aggggaaaaucagccugc

SEQ ID NO: 1176072 - RNA, 22 nt, Human
aggggaaaaucagccugcucca

SEQ ID NO: 1176073 - RNA, 14 nt, Human
aggggaacagacug

SEQ ID NO: 1176074 - RNA, 13 nt, Human
aggggaaaagagg

SEQ ID NO: 1176075 - RNA, 17 nt, Human
ugggguacccacugcuc

SEQ ID NO: 1176076 - RNA, 18 nt, Human
ugggguacccacugcucu

SEQ ID NO: 1176077 - RNA, 19 nt, Human
ugggguacccacugcucug

SEQ ID NO: 1176078 - RNA, 20 nt, Human
ugggguacccacugcucugg

SEQ ID NO: 1176079 - RNA, 13 nt, Human
uggggucacucug

SEQ ID NO: 1176080 - RNA, 14 nt, Human
uggggucacucugg

SEQ ID NO: 1176081 - RNA, 16 nt, Human
uggggucacucuggca

SEQ ID NO: 1176082 - RNA, 22 nt, Human
uggggucacucuggcagcucag

SEQ ID NO: 1176083 - RNA, 20 nt, Human
ugguagagugugccugaagu

SEQ ID NO: 1176084 - RNA, 17 nt, Human
uggguggcaccagcagc

SEQ ID NO: 1176085 - RNA, 20 nt, Human
uggguggcaccagcagccug

SEQ ID NO: 1176086 - RNA, 21 nt, Human
uggguggcaccagcagccugg

SEQ ID NO: 1176087 - RNA, 22 nt, Human
uggguggcaccagcagccugga

SEQ ID NO: 1176088 - RNA, 16 nt, Human
aggguggugaccucug

SEQ ID NO: 1176089 - RNA, 17 nt, Human
aggguggugaccucugc

SEQ ID NO: 1176090 - RNA, 21 nt, Human
agggucucacucugucgccca

SEQ ID NO: 1176091 - RNA, 16 nt, Human
agggucucacucuguc

SEQ ID NO: 1176092 - RNA, 14 nt, Human
agggucucacucug

SEQ ID NO: 1176093 - RNA, 15 nt, Human
agggucucacucugu

SEQ ID NO: 1176094 - RNA, 15 nt, Human
aggguaaggcugugg

SEQ ID NO: 1176095 - RNA, 20 nt, Human
aggggguggccucccaacuc

SEQ ID NO: 1176096 - RNA, 13 nt, Human
agggggcugggac

SEQ ID NO: 1176097 - RNA, 18 nt, Human
aggggugggacacccugu

SEQ ID NO: 1176098 - RNA, 19 nt, Human
aggggaauguuugccucug

SEQ ID NO: 1176099 - RNA, 20 nt, Human
aggggaauguuugccucugc

SEQ ID NO: 1176100 - RNA, 21 nt, Human
aggggaauguuugccucugcc

SEQ ID NO: 1176101 - RNA, 16 nt, Human
aggggaauugaggaca

SEQ ID NO: 1176102 - RNA, 18 nt, Human
aggggagcaugggaagug

SEQ ID NO: 1176103 - RNA, 16 nt, Human
uggugcgaucuggguu

SEQ ID NO: 1176104 - RNA, 17 nt, Human
uggugcgaucuggguuc

SEQ ID NO: 1176105 - RNA, 14 nt, Human
ugguggcagcugcg

SEQ ID NO: 1176106 - RNA, 15 nt, Human
ugguggcagcugcgg

SEQ ID NO: 1176107 - RNA, 12 nt, Human
ugguggcagugg

SEQ ID NO: 1176108 - RNA, 23 nt, Human
uggugugaccacugcagaagaca

SEQ ID NO: 1176109 - RNA, 18 nt, Human
ugguuaggcauuguggga

SEQ ID NO: 1176110 - RNA, 20 nt, Human
ugguuaggcauugugggaag

SEQ ID NO: 1176111 - RNA, 15 nt, Human
uggucagauuugaac

SEQ ID NO: 1176112 - RNA, 16 nt, Human
uggucagauuugaacu

SEQ ID NO: 1176113 - RNA, 22 nt, Human
uggucagauuugaacucuucaa

SEQ ID NO: 1176114 - RNA, 14 nt, Human
aggucagagccugc

SEQ ID NO: 1176115 - RNA, 15 nt, Human
aggucagagccugca

SEQ ID NO: 1176116 - RNA, 17 nt, Human
aggucagagccugcagu

SEQ ID NO: 1176117 - RNA, 18 nt, Human
aggucagagccugcaguu

SEQ ID NO: 1176118 - RNA, 16 nt, Human
aggucuugaacuccug

SEQ ID NO: 1176119 - RNA, 17 nt, Human
aggucuugaacuccugg

SEQ ID NO: 1176120 - RNA, 18 nt, Human
aggucuugaacuccuggc

SEQ ID NO: 1176121 - RNA, 13 nt, Human
aggugacagagug

SEQ ID NO: 1176122 - RNA, 15 nt, Human
aggugacagagugag

SEQ ID NO: 1176123 - RNA, 22 nt, Human
aggugacagagugagacucugu

SEQ ID NO: 1176124 - RNA, 13 nt, Human
aggugaccccagg

SEQ ID NO: 1176125 - RNA, 16 nt, Human
aggugagaagcagagg

SEQ ID NO: 1176126 - RNA, 21 nt, Human
aggugagaagcagaggaagga

SEQ ID NO: 1176127 - RNA, 23 nt, Human
aggugagaagcagaggaaggaga

SEQ ID NO: 1176128 - RNA, 14 nt, Human
ugguuauggagagg

SEQ ID NO: 1176129 - RNA, 15 nt, Human
ugguuuguaaauuaa

SEQ ID NO: 1176130 - RNA, 14 nt, Human
ugguuuucaaaaua

SEQ ID NO: 1176131 - RNA, 15 nt, Human
ugguuuucaaaauaa

SEQ ID NO: 1176132 - RNA, 17 nt, Human
ugguuuucaaaauaaaa

SEQ ID NO: 1176133 - RNA, 21 nt, Human
ugguuuguaaauuaacuuuua

SEQ ID NO: 1176134 - RNA, 15 nt, Human
uguaaauagcucagg

SEQ ID NO: 1176135 - RNA, 16 nt, Human
uguaaauagcucaggu

SEQ ID NO: 1176136 - RNA, 13 nt, Human
uguaaagaaagag

SEQ ID NO: 1176137 - RNA, 14 nt, Human
uguaaagaaagaga

SEQ ID NO: 1176138 - RNA, 15 nt, Human
uguaaagaaagagag

SEQ ID NO: 1176139 - RNA, 16 nt, Human
uguaaagaaagagaga

SEQ ID NO: 1176140 - RNA, 17 nt, Human
uguaaagaaagagagaa

SEQ ID NO: 1176141 - RNA, 18 nt, Human
uguaaagaaagagagaaa

SEQ ID NO: 1176142 - RNA, 19 nt, Human
uguaaagaaagagagaaaa

SEQ ID NO: 1176143 - RNA, 20 nt, Human
uguaaagaaagagagaaaau

SEQ ID NO: 1176144 - RNA, 21 nt, Human
uguaaagaaagagagaaaaua

SEQ ID NO: 1176145 - RNA, 22 nt, Human
uguaaagaaagagagaaaauaa

SEQ ID NO: 1176146 - RNA, 14 nt, Human
aggugauccaccca

SEQ ID NO: 1176147 - RNA, 20 nt, Human
aggugauccacccaccucag

SEQ ID NO: 1176148 - RNA, 21 nt, Human
aggugauccacccaccucagc

SEQ ID NO: 1176149 - RNA, 18 nt, Human
aggugccucaagagaagg

SEQ ID NO: 1176150 - RNA, 15 nt, Human
aggugggauccucca

SEQ ID NO: 1176151 - RNA, 16 nt, Human
aggugggauccuccag

SEQ ID NO: 1176152 - RNA, 17 nt, Human
aggugggauccuccagg

SEQ ID NO: 1176153 - RNA, 18 nt, Human
aggugggauccuccaggu

SEQ ID NO: 1176154 - RNA, 23 nt, Human
agguggggcagcuugaggguugg

SEQ ID NO: 1176155 - RNA, 19 nt, Human
agguggggucacucuggca

SEQ ID NO: 1176156 - RNA, 23 nt, Human
agguggggucacucuggcagcuc

SEQ ID NO: 1176157 - RNA, 17 nt, Human
aggugugaaccaccaca

SEQ ID NO: 1176158 - RNA, 15 nt, Human
aggugugcucugauc

SEQ ID NO: 1176159 - RNA, 20 nt, Human
aggugugcucugaucaucca

SEQ ID NO: 1176160 - RNA, 14 nt, Human
agguuuaagcuguu

SEQ ID NO: 1176161 - RNA, 16 nt, Human
uguagaggagaaacug

SEQ ID NO: 1176162 - RNA, 16 nt, Human
uguagagccagggucu

SEQ ID NO: 1176163 - RNA, 18 nt, Human
uguagagccagggucuca

SEQ ID NO: 1176164 - RNA, 13 nt, Human
aguaaaauccaca

SEQ ID NO: 1176165 - RNA, 14 nt, Human
aguaauaugcacac

SEQ ID NO: 1176166 - RNA, 15 nt, Human
aguaauaugcacaca

SEQ ID NO: 1176167 - RNA, 17 nt, Human
aguaauaugcacacauu

SEQ ID NO: 1176168 - RNA, 17 nt, Human
aguaaugauaacuggaa

SEQ ID NO: 1176169 - RNA, 18 nt, Human
aguaaugauaacuggaaa

SEQ ID NO: 1176170 - RNA, 20 nt, Human
aguaaugauaacuggaaacu

SEQ ID NO: 1176171 - RNA, 12 nt, Human
aguagagacagg

SEQ ID NO: 1176172 - RNA, 11 nt, Human
aguagagacag

SEQ ID NO: 1176173 - RNA, 17 nt, Human
uguaggcauaaagucag

SEQ ID NO: 1176174 - RNA, 20 nt, Human
uguaggcauaaagucagggg

SEQ ID NO: 1176175 - RNA, 19 nt, Human
aguagaagucuuagaugua

SEQ ID NO: 1176176 - RNA, 20 nt, Human
aguagaagucuuagauguau

SEQ ID NO: 1176177 - RNA, 21 nt, Human
aguagaagucuuagauguaua

SEQ ID NO: 1176178 - RNA, 19 nt, Human
agucaccccggccaccugc

SEQ ID NO: 1176179 - RNA, 15 nt, Human
agucacacagugagu

SEQ ID NO: 1176180 - RNA, 23 nt, Human
agucacacagugagucgaggaca

SEQ ID NO: 1176181 - RNA, 14 nt, Human
agucaccucaugga

SEQ ID NO: 1176182 - RNA, 15 nt, Human
agucaccucauggaa

SEQ ID NO: 1176183 - RNA, 17 nt, Human
agucaccucauggaauu

SEQ ID NO: 1176184 - RNA, 17 nt, Human
aguauuucuaugaaaua

SEQ ID NO: 1176185 - RNA, 18 nt, Human
aguauuucuaugaaauau

SEQ ID NO: 1176186 - RNA, 22 nt, Human
aguauuucuaugaaauauuaug

SEQ ID NO: 1176187 - RNA, 21 nt, Human
aguauuagaauaccacaggaa

SEQ ID NO: 1176188 - RNA, 14 nt, Human
ugucaauuacagga

SEQ ID NO: 1176189 - RNA, 15 nt, Human
ugucaauuacaggaa

SEQ ID NO: 1176190 - RNA, 17 nt, Human
ugucaauuacaggaagu

SEQ ID NO: 1176191 - RNA, 21 nt, Human
ugucaauaaaauccauacauu

SEQ ID NO: 1176192 - RNA, 19 nt, Human
ugucaauuacaggaaguac

SEQ ID NO: 1176193 - RNA, 15 nt, Human
aguaugguggcuggg

SEQ ID NO: 1176194 - RNA, 16 nt, Human
aguaugguggcugggu

SEQ ID NO: 1176195 - RNA, 17 nt, Human
aguaugguggcuggguu

SEQ ID NO: 1176196 - RNA, 18 nt, Human
aguauuacuucugcuaca

SEQ ID NO: 1176197 - RNA, 18 nt, Human
aguauuagaauaccacag

SEQ ID NO: 1176198 - RNA, 19 nt, Human
uguauucucuccuguaccu

SEQ ID NO: 1176199 - RNA, 20 nt, Human
uguauucucuccuguaccuc

SEQ ID NO: 1176200 - RNA, 22 nt, Human
uguauuacaaauccaaugaaau

SEQ ID NO: 1176201 - RNA, 13 nt, Human
uguauuacaaauc

SEQ ID NO: 1176202 - RNA, 17 nt, Human
uguaucaaugaguaaca

SEQ ID NO: 1176203 - RNA, 14 nt, Human
uguaguguuggaga

SEQ ID NO: 1176204 - RNA, 15 nt, Human
uguaguguuggagaa

SEQ ID NO: 1176205 - RNA, 16 nt, Human
uguaguguuggagaag

SEQ ID NO: 1176206 - RNA, 15 nt, Human
ugugacugaauuucu

SEQ ID NO: 1176207 - RNA, 16 nt, Human
ugugacugaauuucuu

SEQ ID NO: 1176208 - RNA, 16 nt, Human
ugugacugaucucucg

SEQ ID NO: 1176209 - RNA, 15 nt, Human
ugugagaugcuagaa

SEQ ID NO: 1176210 - RNA, 19 nt, Human
ugugagaugcuagaacucc

SEQ ID NO: 1176211 - RNA, 22 nt, Human
ugugagaugcuagaacucccuu

SEQ ID NO: 1176212 - RNA, 14 nt, Human
agucuuuguacaga

SEQ ID NO: 1176213 - RNA, 15 nt, Human
ugugaaaggaaagag

SEQ ID NO: 1176214 - RNA, 18 nt, Human
ugugaaaggaaagaggcu

SEQ ID NO: 1176215 - RNA, 21 nt, Human
ugugaaaggaaagagggaggu

SEQ ID NO: 1176216 - RNA, 19 nt, Human
ugugaaccaccacacccag

SEQ ID NO: 1176217 - RNA, 20 nt, Human
ugugaaccaccacacccagc

SEQ ID NO: 1176218 - RNA, 21 nt, Human
ugugaaccaccacacccagcc

SEQ ID NO: 1176219 - RNA, 14 nt, Human
ugugaagagaacca

SEQ ID NO: 1176220 - RNA, 21 nt, Human
agugaggcucugcccuugguu

SEQ ID NO: 1176221 - RNA, 19 nt, Human
agugaggcucugcccuugg

SEQ ID NO: 1176222 - RNA, 20 nt, Human
agugaggcucugcccuuggu

SEQ ID NO: 1176223 - RNA, 15 nt, Human
agugagucgaggaca

SEQ ID NO: 1176224 - RNA, 15 nt, Human
agugaggcucugccc

SEQ ID NO: 1176225 - RNA, 16 nt, Human
agugaggcucugcccu

SEQ ID NO: 1176226 - RNA, 17 nt, Human
agugaggcucugcccuu

SEQ ID NO: 1176227 - RNA, 21 nt, Human
ugugcccccauguaagcaccc

SEQ ID NO: 1176228 - RNA, 17 nt, Human
uguggaguucaucuuga

SEQ ID NO: 1176229 - RNA, 21 nt, Human
uguggaguucaucuugaauug

SEQ ID NO: 1176230 - RNA, 17 nt, Human
agugaaagaaaauaaca

SEQ ID NO: 1176231 - RNA, 15 nt, Human
agugaaagaaaauaa

SEQ ID NO: 1176232 - RNA, 16 nt, Human
agugaacaaauuuaca

SEQ ID NO: 1176233 - RNA, 20 nt, Human
agugaacaaauuuacagaga

SEQ ID NO: 1176234 - RNA, 18 nt, Human
ugugaugagaggaaauca

SEQ ID NO: 1176235 - RNA, 19 nt, Human
ugugauggggcccugccuc

SEQ ID NO: 1176236 - RNA, 20 nt, Human
ugugauggggcccugccucc

SEQ ID NO: 1176237 - RNA, 20 nt, Human
ugugccagguuuuuggucug

SEQ ID NO: 1176238 - RNA, 12 nt, Human
ugugccaugugc

SEQ ID NO: 1176239 - RNA, 16 nt, Human
ugugccaugugccagg

SEQ ID NO: 1176240 - RNA, 19 nt, Human
uguguguuuauugucaaag

SEQ ID NO: 1176241 - RNA, 23 nt, Human
uguguguuuauugucaaaguggu

SEQ ID NO: 1176242 - RNA, 20 nt, Human
ugugugaaagguacuucaaa

SEQ ID NO: 1176243 - RNA, 13 nt, Human
uguguaaguagau

SEQ ID NO: 1176244 - RNA, 17 nt, Human
ugugucucuugguccug

SEQ ID NO: 1176245 - RNA, 20 nt, Human
ugugucucuugguccugcug

SEQ ID NO: 1176246 - RNA, 21 nt, Human
ugugucucuugguccugcugc

SEQ ID NO: 1176247 - RNA, 22 nt, Human
ugugucucuugguccugcugca

SEQ ID NO: 1176248 - RNA, 21 nt, Human
ugugucuugcaauggcagccu

SEQ ID NO: 1176249 - RNA, 19 nt, Human
ugugucuuuaaaugcugcu

SEQ ID NO: 1176250 - RNA, 16 nt, Human
uguggucccaccccac

SEQ ID NO: 1176251 - RNA, 13 nt, Human
uguggucccaccc

SEQ ID NO: 1176252 - RNA, 15 nt, Human
uguggucccacccca

SEQ ID NO: 1176253 - RNA, 14 nt, Human
ugugguguuuccug

SEQ ID NO: 1176254 - RNA, 16 nt, Human
ugugguguuuccuggc

SEQ ID NO: 1176255 - RNA, 20 nt, Human
ugugguguuuccuggcacug

SEQ ID NO: 1176256 - RNA, 21 nt, Human
uguggguuucuaaagcugcca

SEQ ID NO: 1176257 - RNA, 23 nt, Human
uguggguuucuaaagcugccagc

SEQ ID NO: 1176258 - RNA, 22 nt, Human
agugaguugauagcacagaccc

SEQ ID NO: 1176259 - RNA, 23 nt, Human
agugaguugauagcacagacccu

SEQ ID NO: 1176260 - RNA, 12 nt, Human
agugcugcauuu

SEQ ID NO: 1176261 - RNA, 13 nt, Human
agugcugcauuua

SEQ ID NO: 1176262 - RNA, 16 nt, Human
agugcugcauuuaaaa

SEQ ID NO: 1176263 - RNA, 17 nt, Human
agugcugcauuuaaaag

SEQ ID NO: 1176264 - RNA, 19 nt, Human
agugcugcauuuaaaagau

SEQ ID NO: 1176265 - RNA, 20 nt, Human
agugcugcauuuaaaagaua

SEQ ID NO: 1176266 - RNA, 21 nt, Human
agugcugggauuacaggugug

SEQ ID NO: 1176267 - RNA, 17 nt, Human
aguggugcgaucugggu

SEQ ID NO: 1176268 - RNA, 21 nt, Human
agugguggugaacagaacaaa

SEQ ID NO: 1176269 - RNA, 17 nt, Human
aguggugguuuucuguu

SEQ ID NO: 1176270 - RNA, 18 nt, Human
aguggugguuuucuguuc

SEQ ID NO: 1176271 - RNA, 19 nt, Human
aguggugguuuucuguucu

SEQ ID NO: 1176272 - RNA, 20 nt, Human
aguggugguuuucuguucuu

SEQ ID NO: 1176273 - RNA, 21 nt, Human
aguggugguuuucuguucuuu

SEQ ID NO: 1176274 - RNA, 23 nt, Human
aguggugguuuucuguucuuucu

SEQ ID NO: 1176275 - RNA, 20 nt, Human
agugugccugaagucccaga

SEQ ID NO: 1176276 - RNA, 17 nt, Human
agugugguguuuccugg

SEQ ID NO: 1176277 - RNA, 19 nt, Human
agugugguguuuccuggca

SEQ ID NO: 1176278 - RNA, 20 nt, Human
agugugguguuuccuggcac

SEQ ID NO: 1176279 - RNA, 20 nt, Human
agugugucuuagugugugca

SEQ ID NO: 1176280 - RNA, 15 nt, Human
uguuauaaucuuuca

SEQ ID NO: 1176281 - RNA, 20 nt, Human
uguuccacaaguuaaauaaa

SEQ ID NO: 1176282 - RNA, 16 nt, Human
uguucugggacacagu

SEQ ID NO: 1176283 - RNA, 13 nt, Human
uguugcccaggca

SEQ ID NO: 1176284 - RNA, 15 nt, Human
uguugcccaggcagg

SEQ ID NO: 1176285 - RNA, 16 nt, Human
uguugcccaggcaggu

SEQ ID NO: 1176286 - RNA, 17 nt, Human
uguugcccaggcagguc

SEQ ID NO: 1176287 - RNA, 18 nt, Human
uguugcccaggcaggucu

SEQ ID NO: 1176288 - RNA, 21 nt, Human
uguuuuauuuuaauucaguug

SEQ ID NO: 1176289 - RNA, 20 nt, Human
uguuuuccaugaguccccug

SEQ ID NO: 1176290 - RNA, 14 nt, Human
uguuuugcaagcca

SEQ ID NO: 1176291 - RNA, 16 nt, Human
aguucugcagauaaac

SEQ ID NO: 1176292 - RNA, 21 nt, Human
aguucugcagauaaacaguag

SEQ ID NO: 1176293 - RNA, 14 nt, Human
aguucugguuccua

SEQ ID NO: 1176294 - RNA, 19 nt, Human
uguugcccaggcaggucuu

SEQ ID NO: 1176295 - RNA, 19 nt, Human
uguuuauugucaaaguggu

SEQ ID NO: 1176296 - RNA, 17 nt, Human
uguuugauucagacagc

SEQ ID NO: 1176297 - RNA, 22 nt, Human
uguuugauucagacagcugccu

SEQ ID NO: 1176298 - RNA, 13 nt, Human
aguugggcuuccu

SEQ ID NO: 1176299 - RNA, 21 nt, Human
aguuggguggaugccuggugg

SEQ ID NO: 1176300 - RNA, 16 nt, Human
aguuggcuaggacccc

SEQ ID NO: 1176301 - RNA, 22 nt, Human
aguugcauagguuuaauaauuu

SEQ ID NO: 1176302 - RNA, 18 nt, Human
aguuguaccgcaauguga

SEQ ID NO: 1176303 - RNA, 21 nt, Human
aguuguuugauucagacagcu

SEQ ID NO: 1176304 - RNA, 23 nt, Human
aguuguuugauucagacagcugc

SEQ ID NO: 1176305 - RNA, 13 nt, Human
uuaaauaauguga

SEQ ID NO: 1176306 - RNA, 19 nt, Human
uuaauuuuuuugagacaga

SEQ ID NO: 1176307 - RNA, 15 nt, Human
auaaacaagaccacg

SEQ ID NO: 1176308 - RNA, 22 nt, Human
auaaacaagaccacguuucuaa

SEQ ID NO: 1176309 - RNA, 23 nt, Human
auaaacaagaccacguuucuaaa

SEQ ID NO: 1176310 - RNA, 23 nt, Human
uuaaugaaagacuguacaaagua

SEQ ID NO: 1176311 - RNA, 15 nt, Human
uuaauucuuagcuca

SEQ ID NO: 1176312 - RNA, 16 nt, Human
auaaaauaauuuuuau

SEQ ID NO: 1176313 - RNA, 21 nt, Human
auaaaauaauuuuuauauuug

SEQ ID NO: 1176314 - RNA, 22 nt, Human
auaaaauaauuuuuauauuuga

SEQ ID NO: 1176315 - RNA, 18 nt, Human
auaaaauccauacauuug

SEQ ID NO: 1176316 - RNA, 19 nt, Human
auaaaauccauacauuugu

SEQ ID NO: 1176317 - RNA, 22 nt, Human
uuaagaagacugcauuauauuu

SEQ ID NO: 1176318 - RNA, 13 nt, Human
uuaagaggcaggg

SEQ ID NO: 1176319 - RNA, 15 nt, Human
uuaagaggcaggguc

SEQ ID NO: 1176320 - RNA, 16 nt, Human
uuaagaggcagggucu

SEQ ID NO: 1176321 - RNA, 18 nt, Human
uuaaguaaugauaacugg

SEQ ID NO: 1176322 - RNA, 17 nt, Human
uuaaguacuauguauca

SEQ ID NO: 1176323 - RNA, 14 nt, Human
uuaagugcugcauu

SEQ ID NO: 1176324 - RNA, 14 nt, Human
uuacaggaaguacu

SEQ ID NO: 1176325 - RNA, 15 nt, Human
uuacaggaaguacug

SEQ ID NO: 1176326 - RNA, 11 nt, Human
uuagacagagu

SEQ ID NO: 1176327 - RNA, 13 nt, Human
uuagacagagucu

SEQ ID NO: 1176328 - RNA, 15 nt, Human
uuacuguaagaaaau

SEQ ID NO: 1176329 - RNA, 11 nt, Human
uuagaaauaua

SEQ ID NO: 1176330 - RNA, 12 nt, Human
uuagaaauauaa

SEQ ID NO: 1176331 - RNA, 14 nt, Human
uuagaaauauaauu

SEQ ID NO: 1176332 - RNA, 18 nt, Human
uuacucagaauucucuag

SEQ ID NO: 1176333 - RNA, 23 nt, Human
uuacucagaauucucuaguuuga

SEQ ID NO: 1176334 - RNA, 16 nt, Human
uuauuuaguuccuuga

SEQ ID NO: 1176335 - RNA, 17 nt, Human
auagcugggacuacagg

SEQ ID NO: 1176336 - RNA, 14 nt, Human
uuauuuaaauuuua

SEQ ID NO: 1176337 - RNA, 18 nt, Human
uuauuuaaugaaagacug

SEQ ID NO: 1176338 - RNA, 22 nt, Human
uuauuuaaugaaagacuguaca

SEQ ID NO: 1176339 - RNA, 12 nt, Human
auagcugggacu

SEQ ID NO: 1176340 - RNA, 20 nt, Human
auagcucaggugucccugca

SEQ ID NO: 1176341 - RNA, 21 nt, Human
auagcucaggugucccugcac

SEQ ID NO: 1176342 - RNA, 22 nt, Human
auagcucaggugucccugcacu

SEQ ID NO: 1176343 - RNA, 18 nt, Human
auagcuacuaauuuuaaa

SEQ ID NO: 1176344 - RNA, 19 nt, Human
auagcucaggugucccugc

SEQ ID NO: 1176345 - RNA, 17 nt, Human
auagcuacuaauuuuaa

SEQ ID NO: 1176346 - RNA, 14 nt, Human
auagcuacuaauuu

SEQ ID NO: 1176347 - RNA, 13 nt, Human
auaagauaaaugu

SEQ ID NO: 1176348 - RNA, 17 nt, Human
auaagauaaaugugcug

SEQ ID NO: 1176349 - RNA, 18 nt, Human
auagccugccucuucucu

SEQ ID NO: 1176350 - RNA, 15 nt, Human
uucaaggauccugag

SEQ ID NO: 1176351 - RNA, 16 nt, Human
uucaaggauccugagc

SEQ ID NO: 1176352 - RNA, 18 nt, Human
uucaaggauccugagcca

SEQ ID NO: 1176353 - RNA, 19 nt, Human
uucaaggauccugagccag

SEQ ID NO: 1176354 - RNA, 21 nt, Human
uucaaggauccugagccagau

SEQ ID NO: 1176355 - RNA, 15 nt, Human
uucaaacauauauaa

SEQ ID NO: 1176356 - RNA, 21 nt, Human
auaggaauugacccacaagaa

SEQ ID NO: 1176357 - RNA, 22 nt, Human
auaggaauugacccacaagaaa

SEQ ID NO: 1176358 - RNA, 13 nt, Human
uucacaguucucu

SEQ ID NO: 1176359 - RNA, 17 nt, Human
uucacauauugauuucc

SEQ ID NO: 1176360 - RNA, 22 nt, Human
uucaccacaugugcacaugcac

SEQ ID NO: 1176361 - RNA, 17 nt, Human
uucagaucucuaacuuc

SEQ ID NO: 1176362 - RNA, 14 nt, Human
uucagacagcugcc

SEQ ID NO: 1176363 - RNA, 19 nt, Human
uucagccaagaauucuuaa

SEQ ID NO: 1176364 - RNA, 17 nt, Human
auauaacaaugcuguau

SEQ ID NO: 1176365 - RNA, 19 nt, Human
auauaagcuuguauuccuu

SEQ ID NO: 1176366 - RNA, 12 nt, Human
auauaacaaugc

SEQ ID NO: 1176367 - RNA, 15 nt, Human
auauaacaaugcugu

SEQ ID NO: 1176368 - RNA, 17 nt, Human
auauauaacaaugcugu

SEQ ID NO: 1176369 - RNA, 18 nt, Human
auauauaacaaugcugua

SEQ ID NO: 1176370 - RNA, 19 nt, Human
auauauaacaaugcuguau

SEQ ID NO: 1176371 - RNA, 18 nt, Human
auagucaaauugugugaa

SEQ ID NO: 1176372 - RNA, 21 nt, Human
uucaucauccuaagcuauuca

SEQ ID NO: 1176373 - RNA, 14 nt, Human
uucagccugccuuc

SEQ ID NO: 1176374 - RNA, 15 nt, Human
uucagccugccuucu

SEQ ID NO: 1176375 - RNA, 14 nt, Human
uucaguaauaacuc

SEQ ID NO: 1176376 - RNA, 16 nt, Human
uucauauuuacuucuu

SEQ ID NO: 1176377 - RNA, 21 nt, Human
uucauauuuacuucuuauaca

SEQ ID NO: 1176378 - RNA, 20 nt, Human
auaugauuuaaaucagccgu

SEQ ID NO: 1176379 - RNA, 13 nt, Human
auaugcacacauu

SEQ ID NO: 1176380 - RNA, 14 nt, Human
auaugucaagccau

SEQ ID NO: 1176381 - RNA, 15 nt, Human
uuccuucagugccuu

SEQ ID NO: 1176382 - RNA, 11 nt, Human
uuccuucagug

SEQ ID NO: 1176383 - RNA, 14 nt, Human
uuccuucagugccu

SEQ ID NO: 1176384 - RNA, 11 nt, Human
uuccucuuucc

SEQ ID NO: 1176385 - RNA, 17 nt, Human
uuccuguucccaugaga

SEQ ID NO: 1176386 - RNA, 13 nt, Human
uuccuaauccucu

SEQ ID NO: 1176387 - RNA, 15 nt, Human
uuccuaauccucuag

SEQ ID NO: 1176388 - RNA, 17 nt, Human
uuccuaauccucuagga

SEQ ID NO: 1176389 - RNA, 22 nt, Human
aucacggcucacugcagccuca

SEQ ID NO: 1176390 - RNA, 21 nt, Human
aucaagaugugacauguuuua

SEQ ID NO: 1176391 - RNA, 13 nt, Human
aucaaguauuaua

SEQ ID NO: 1176392 - RNA, 14 nt, Human
aucaaguauuauac

SEQ ID NO: 1176393 - RNA, 18 nt, Human
aucaaguauuauaccuuu

SEQ ID NO: 1176394 - RNA, 17 nt, Human
auauugcugauggugca

SEQ ID NO: 1176395 - RNA, 21 nt, Human
auauugcugauggugcaauga

SEQ ID NO: 1176396 - RNA, 20 nt, Human
auauuguuuucaguguacau

SEQ ID NO: 1176397 - RNA, 13 nt, Human
auauuugaaauau

SEQ ID NO: 1176398 - RNA, 14 nt, Human
auauuugaaauauu

SEQ ID NO: 1176399 - RNA, 19 nt, Human
auauuugaaauauugacuu

SEQ ID NO: 1176400 - RNA, 23 nt, Human
auauuugaaauauugacuuuuua

SEQ ID NO: 1176401 - RNA, 16 nt, Human
auauucuguuggccag

SEQ ID NO: 1176402 - RNA, 19 nt, Human
auauugauuuccguuaaaa

SEQ ID NO: 1176403 - RNA, 21 nt, Human
auauugauuuccguuaaaaua

SEQ ID NO: 1176404 - RNA, 22 nt, Human
auauugauuuccguuaaaauac

SEQ ID NO: 1176405 - RNA, 15 nt, Human
auauuaagaaagacu

SEQ ID NO: 1176406 - RNA, 24 nt, Human
auauuaagaaagacuaucuaaaug

SEQ ID NO: 1176407 - RNA, 22 nt, Human
auauuaaggaagacaaugugaa

SEQ ID NO: 1176408 - RNA, 18 nt, Human
auauguuuuaagaggcag

SEQ ID NO: 1176409 - RNA, 20 nt, Human
auauguuuuaagaggcaggg

SEQ ID NO: 1176410 - RNA, 15 nt, Human
auccagguucagcuu

SEQ ID NO: 1176411 - RNA, 16 nt, Human
auccagguucagcuug

SEQ ID NO: 1176412 - RNA, 16 nt, Human
aucccauaugccuggg

SEQ ID NO: 1176413 - RNA, 17 nt, Human
aucccauaugccugggc

SEQ ID NO: 1176414 - RNA, 14 nt, Human
uucugaagaagaug

SEQ ID NO: 1176415 - RNA, 12 nt, Human
uucugaagaaga

SEQ ID NO: 1176416 - RNA, 13 nt, Human
uucugaagaagau

SEQ ID NO: 1176417 - RNA, 19 nt, Human
aucauugaaaucuuuuugc

SEQ ID NO: 1176418 - RNA, 20 nt, Human
aucauugaaaucuuuuugcu

SEQ ID NO: 1176419 - RNA, 15 nt, Human
uucugaaagggacgc

SEQ ID NO: 1176420 - RNA, 23 nt, Human
uucugccgcagcccugcagaggg

SEQ ID NO: 1176421 - RNA, 10 nt, Human
uucugggaca

SEQ ID NO: 1176422 - RNA, 11 nt, Human
uucugggacac

SEQ ID NO: 1176423 - RNA, 22 nt, Human
uucugggacacaguucaauucu

SEQ ID NO: 1176424 - RNA, 14 nt, Human
aucauugaaaucuu

SEQ ID NO: 1176425 - RNA, 15 nt, Human
aucauugaaaucuuu

SEQ ID NO: 1176426 - RNA, 23 nt, Human
aucauaguggcuuaaaacaacac

SEQ ID NO: 1176427 - RNA, 16 nt, Human
aucagcacgauuucug

SEQ ID NO: 1176428 - RNA, 17 nt, Human
aucagcacgauuucugu

SEQ ID NO: 1176429 - RNA, 18 nt, Human
aucagcacgauuucuguu

SEQ ID NO: 1176430 - RNA, 13 nt, Human
uucuaggccuggg

SEQ ID NO: 1176431 - RNA, 14 nt, Human
uucucaacuccaaa

SEQ ID NO: 1176432 - RNA, 18 nt, Human
uucucaacuccaaacuga

SEQ ID NO: 1176433 - RNA, 19 nt, Human
uucucagaaucucaaauaa

SEQ ID NO: 1176434 - RNA, 22 nt, Human
uucucagaaucucaaauaacua

SEQ ID NO: 1176435 - RNA, 23 nt, Human
uucucagaaucucaaauaacuaa

SEQ ID NO: 1176436 - RNA, 11 nt, Human
uugagacagag

SEQ ID NO: 1176437 - RNA, 12 nt, Human
uugagacagagu

SEQ ID NO: 1176438 - RNA, 12 nt, Human
uugagcagggcu

SEQ ID NO: 1176439 - RNA, 16 nt, Human
uugagcagggcucagc

SEQ ID NO: 1176440 - RNA, 17 nt, Human
uugaccauucuccaccu

SEQ ID NO: 1176441 - RNA, 12 nt, Human
uugacuuuuuau

SEQ ID NO: 1176442 - RNA, 19 nt, Human
uugacaggauuauuggaaa

SEQ ID NO: 1176443 - RNA, 10 nt, Human
uugacagggc

SEQ ID NO: 1176444 - RNA, 12 nt, Human
uugacagggcac

SEQ ID NO: 1176445 - RNA, 19 nt, Human
uugacagggcacaccgggc

SEQ ID NO: 1176446 - RNA, 16 nt, Human
uugacaucaacugcau

SEQ ID NO: 1176447 - RNA, 13 nt, Human
uugacaugggaca

SEQ ID NO: 1176448 - RNA, 21 nt, Human
uugagugcugucuccauguuu

SEQ ID NO: 1176449 - RNA, 17 nt, Human
uugauacuacaguuugu

SEQ ID NO: 1176450 - RNA, 18 nt, Human
uugauagcacagacccug

SEQ ID NO: 1176451 - RNA, 23 nt, Human
aucuaauauguaacaagccaccc

SEQ ID NO: 1176452 - RNA, 18 nt, Human
aucuagauacuguaucau

SEQ ID NO: 1176453 - RNA, 19 nt, Human
aucuagauacuguaucaug

SEQ ID NO: 1176454 - RNA, 17 nt, Human
aucuaggaagacuuugg

SEQ ID NO: 1176455 - RNA, 18 nt, Human
aucuaggaagacuuugga

SEQ ID NO: 1176456 - RNA, 19 nt, Human
aucuaggaagacuuuggaa

SEQ ID NO: 1176457 - RNA, 22 nt, Human
aucuaggaagacuuuggaaaga

SEQ ID NO: 1176458 - RNA, 14 nt, Human
aucucaaauaacua

SEQ ID NO: 1176459 - RNA, 21 nt, Human
aucucaaauaacuaaaaggua

SEQ ID NO: 1176460 - RNA, 23 nt, Human
aucucaaauaacuaaaagguaug

SEQ ID NO: 1176461 - RNA, 14 nt, Human
aucucaaauuucua

SEQ ID NO: 1176462 - RNA, 16 nt, Human
aucucaaauuucuaaa

SEQ ID NO: 1176463 - RNA, 17 nt, Human
aucucaaauuucuaaau

SEQ ID NO: 1176464 - RNA, 23 nt, Human
aucucacacaugagcaucaggcc

SEQ ID NO: 1176465 - RNA, 13 nt, Human
aucucaauauuuc

SEQ ID NO: 1176466 - RNA, 15 nt, Human
aucucaccuccugcu

SEQ ID NO: 1176467 - RNA, 16 nt, Human
aucucaccuccugcug

SEQ ID NO: 1176468 - RNA, 17 nt, Human
aucucaccuccugcugg

SEQ ID NO: 1176469 - RNA, 12 nt, Human
aucugaaaaugu

SEQ ID NO: 1176470 - RNA, 23 nt, Human
uugauguucuuucacccuuuucu

SEQ ID NO: 1176471 - RNA, 15 nt, Human
uugauuaaauucuug

SEQ ID NO: 1176472 - RNA, 16 nt, Human
uugauuaaauucuugc

SEQ ID NO: 1176473 - RNA, 20 nt, Human
uugauuaaauucuugcaaag

SEQ ID NO: 1176474 - RNA, 21 nt, Human
uugauuaaauucuugcaaagu

SEQ ID NO: 1176475 - RNA, 22 nt, Human
uugcaagccagauuuuccugaa

SEQ ID NO: 1176476 - RNA, 14 nt, Human
uugcaauggcagcc

SEQ ID NO: 1176477 - RNA, 21 nt, Human
uugcaccacugcacuccagcc

SEQ ID NO: 1176478 - RNA, 14 nt, Human
uugcaugaggcuag

SEQ ID NO: 1176479 - RNA, 13 nt, Human
uugcccaggcagg

SEQ ID NO: 1176480 - RNA, 14 nt, Human
uugcccaggcaggu

SEQ ID NO: 1176481 - RNA, 16 nt, Human
uugcccaggcaggucu

SEQ ID NO: 1176482 - RNA, 18 nt, Human
uugcccaggcaggucuug

SEQ ID NO: 1176483 - RNA, 11 nt, Human
uugcccaggcu

SEQ ID NO: 1176484 - RNA, 12 nt, Human
uugcccaggcug

SEQ ID NO: 1176485 - RNA, 14 nt, Human
uugcccaggcuggc

SEQ ID NO: 1176486 - RNA, 23 nt, Human
uugcccaggcuggcgugcagugg

SEQ ID NO: 1176487 - RNA, 15 nt, Human
uugcuuugugauuuu

SEQ ID NO: 1176488 - RNA, 20 nt, Human
uugcuuugugauuuuuguaa

SEQ ID NO: 1176489 - RNA, 17 nt, Human
uuggaaaauaaauuauu

SEQ ID NO: 1176490 - RNA, 15 nt, Human
uuggagaagaacuga

SEQ ID NO: 1176491 - RNA, 17 nt, Human
uuggagaagaacugaaa

SEQ ID NO: 1176492 - RNA, 22 nt, Human
uuggagaagaacugaaaucaua

SEQ ID NO: 1176493 - RNA, 16 nt, Human
aucuuauaauuuaaaa

SEQ ID NO: 1176494 - RNA, 14 nt, Human
aucuugcucugcug

SEQ ID NO: 1176495 - RNA, 15 nt, Human
aucuuauaauuuaaa

SEQ ID NO: 1176496 - RNA, 15 nt, Human
aucuugcucugcuga

SEQ ID NO: 1176497 - RNA, 16 nt, Human
aucuugcucugcugac

SEQ ID NO: 1176498 - RNA, 17 nt, Human
aucuugcucugcugaca

SEQ ID NO: 1176499 - RNA, 12 nt, Human
aucugucauuug

SEQ ID NO: 1176500 - RNA, 17 nt, Human
aucugucauuugagcag

SEQ ID NO: 1176501 - RNA, 22 nt, Human
aucugucauuugagcagggcuc

SEQ ID NO: 1176502 - RNA, 13 nt, Human
augaaauauuaug

SEQ ID NO: 1176503 - RNA, 23 nt, Human
augaaccacaucuugcucugcug

SEQ ID NO: 1176504 - RNA, 23 nt, Human
augaagcauuuacuuuguguuca

SEQ ID NO: 1176505 - RNA, 17 nt, Human
augaaugaaacauuuug

SEQ ID NO: 1176506 - RNA, 13 nt, Human
augaaugaauggc

SEQ ID NO: 1176507 - RNA, 16 nt, Human
augaaugucaguguga

SEQ ID NO: 1176508 - RNA, 18 nt, Human
augaaugucagugugacu

SEQ ID NO: 1176509 - RNA, 20 nt, Human
augaaugucagugugacuga

SEQ ID NO: 1176510 - RNA, 18 nt, Human
uuggugguuucagaaaug

SEQ ID NO: 1176511 - RNA, 19 nt, Human
uuggugguuucagaaaugu

SEQ ID NO: 1176512 - RNA, 16 nt, Human
uuggguggaugccugg

SEQ ID NO: 1176513 - RNA, 17 nt, Human
uuggugucgggcaugac

SEQ ID NO: 1176514 - RNA, 18 nt, Human
uuggugucgggcaugaca

SEQ ID NO: 1176515 - RNA, 19 nt, Human
uuggugucgggcaugacac

SEQ ID NO: 1176516 - RNA, 14 nt, Human
uugguuuguaaauu

SEQ ID NO: 1176517 - RNA, 15 nt, Human
augaggucagagccu

SEQ ID NO: 1176518 - RNA, 16 nt, Human
augaggucagagccug

SEQ ID NO: 1176519 - RNA, 18 nt, Human
augaggucagagccugca

SEQ ID NO: 1176520 - RNA, 19 nt, Human
augaggucagagccugcag

SEQ ID NO: 1176521 - RNA, 20 nt, Human
augaggucagagccugcagu

SEQ ID NO: 1176522 - RNA, 22 nt, Human
augaggucagagccugcaguua

SEQ ID NO: 1176523 - RNA, 15 nt, Human
augagguacugagag

SEQ ID NO: 1176524 - RNA, 17 nt, Human
augagguacugagagug

SEQ ID NO: 1176525 - RNA, 18 nt, Human
augagguacugagaguga

SEQ ID NO: 1176526 - RNA, 13 nt, Human
augaguccccugu

SEQ ID NO: 1176527 - RNA, 23 nt, Human
augaguccccuguuuguuucuga

SEQ ID NO: 1176528 - RNA, 20 nt, Human
uugucaauaaaauccauaca

SEQ ID NO: 1176529 - RNA, 17 nt, Human
uugucacacacuuuggc

SEQ ID NO: 1176530 - RNA, 18 nt, Human
uugucacacacuuuggcu

SEQ ID NO: 1176531 - RNA, 21 nt, Human
uugucauauaagauucauauu

SEQ ID NO: 1176532 - RNA, 18 nt, Human
uuguccccaccgcagaca

SEQ ID NO: 1176533 - RNA, 20 nt, Human
uuguccccaccgcagacagg

SEQ ID NO: 1176534 - RNA, 15 nt, Human
uuguccccgacccuu

SEQ ID NO: 1176535 - RNA, 16 nt, Human
uuguccccgacccuug

SEQ ID NO: 1176536 - RNA, 13 nt, Human
uugugaggaagcc

SEQ ID NO: 1176537 - RNA, 17 nt, Human
uugugaggaagccgcug

SEQ ID NO: 1176538 - RNA, 18 nt, Human
uugugaggaagccgcugg

SEQ ID NO: 1176539 - RNA, 20 nt, Human
uugugauacaaugcugugcc

SEQ ID NO: 1176540 - RNA, 21 nt, Human
uugugaggaagccgcuggggc

SEQ ID NO: 1176541 - RNA, 18 nt, Human
uuuaaaaaaauuccaagu

SEQ ID NO: 1176542 - RNA, 23 nt, Human
augcacuuuguucuggcucuucc

SEQ ID NO: 1176543 - RNA, 17 nt, Human
uuguucuugguuuguaa

SEQ ID NO: 1176544 - RNA, 19 nt, Human
uuguucuugguuuguaaau

SEQ ID NO: 1176545 - RNA, 20 nt, Human
uuguucuugguuuguaaauu

SEQ ID NO: 1176546 - RNA, 13 nt, Human
augauuucauuca

SEQ ID NO: 1176547 - RNA, 16 nt, Human
uuuaaugaaagacugu

SEQ ID NO: 1176548 - RNA, 20 nt, Human
uuuaaggaugcuuguacaua

SEQ ID NO: 1176549 - RNA, 21 nt, Human
uuuaaggaugcuuguacauaa

SEQ ID NO: 1176550 - RNA, 22 nt, Human
uuuaaggaugcuuguacauaau

SEQ ID NO: 1176551 - RNA, 12 nt, Human
uuuaagagaaau

SEQ ID NO: 1176552 - RNA, 14 nt, Human
uuuaagaggcaggg

SEQ ID NO: 1176553 - RNA, 21 nt, Human
uuuaagcuguuacugucuuca

SEQ ID NO: 1176554 - RNA, 19 nt, Human
uuuaaggaugcuuguacau

SEQ ID NO: 1176555 - RNA, 21 nt, Human
uuuaaauauaugcuaagucuu

SEQ ID NO: 1176556 - RNA, 11 nt, Human
uuuaaaugcac

SEQ ID NO: 1176557 - RNA, 14 nt, Human
uuuaaaugcugcuu

SEQ ID NO: 1176558 - RNA, 20 nt, Human
uuuaaaaaagaaacauuugg

SEQ ID NO: 1176559 - RNA, 23 nt, Human
uuuaaaaauacagauagauauau

SEQ ID NO: 1176560 - RNA, 17 nt, Human
augcccagccccuucug

SEQ ID NO: 1176561 - RNA, 21 nt, Human
augccaugaggaacaaggcaa

SEQ ID NO: 1176562 - RNA, 16 nt, Human
augcccagccccuucu

SEQ ID NO: 1176563 - RNA, 21 nt, Human
uuuaaugaaagacuguacaaa

SEQ ID NO: 1176564 - RNA, 23 nt, Human
uuuaaugaaagacuguacaaagu

SEQ ID NO: 1176565 - RNA, 17 nt, Human
augccucucucaggcca

SEQ ID NO: 1176566 - RNA, 22 nt, Human
augcgugcauaccacuuuuguu

SEQ ID NO: 1176567 - RNA, 13 nt, Human
augccucucucag

SEQ ID NO: 1176568 - RNA, 14 nt, Human
augccucucucagg

SEQ ID NO: 1176569 - RNA, 15 nt, Human
augccucucucaggc

SEQ ID NO: 1176570 - RNA, 20 nt, Human
augccuuuucccaacuccag

SEQ ID NO: 1176571 - RNA, 22 nt, Human
augccuuuucccaacuccagaa

SEQ ID NO: 1176572 - RNA, 18 nt, Human
uuuaccugaagucuuugu

SEQ ID NO: 1176573 - RNA, 22 nt, Human
uuuaccugaagucuuuguacag

SEQ ID NO: 1176574 - RNA, 16 nt, Human
uuuacugcagcuuugu

SEQ ID NO: 1176575 - RNA, 11 nt, Human
uuuacuuaaac

SEQ ID NO: 1176576 - RNA, 21 nt, Human
uuuauaugcuucuguuuuaua

SEQ ID NO: 1176577 - RNA, 13 nt, Human
uuuacuucuuaua

SEQ ID NO: 1176578 - RNA, 14 nt, Human
uuuacuucuuauac

SEQ ID NO: 1176579 - RNA, 15 nt, Human
uuuacuucuuauaca

SEQ ID NO: 1176580 - RNA, 17 nt, Human
auggaagacagcucuua

SEQ ID NO: 1176581 - RNA, 18 nt, Human
auggaagacagcucuuau

SEQ ID NO: 1176582 - RNA, 21 nt, Human
augcuucuguuuuauaauuuu

SEQ ID NO: 1176583 - RNA, 16 nt, Human
augcuucucacugcca

SEQ ID NO: 1176584 - RNA, 20 nt, Human
augcuucucacugccaugcc

SEQ ID NO: 1176585 - RNA, 19 nt, Human
augcuggcuguuggcuggg

SEQ ID NO: 1176586 - RNA, 20 nt, Human
augcuggcuguuggcugggg

SEQ ID NO: 1176587 - RNA, 22 nt, Human
augcuggcuguuggcugggggc

SEQ ID NO: 1176588 - RNA, 22 nt, Human
augcuguauuuuaaaagaauga

SEQ ID NO: 1176589 - RNA, 23 nt, Human
augcuguauuuuaaaagaaugau

SEQ ID NO: 1176590 - RNA, 14 nt, Human
uuuaucagaauucu

SEQ ID NO: 1176591 - RNA, 14 nt, Human
augcuccuggccca

SEQ ID NO: 1176592 - RNA, 19 nt, Human
augcuccuggcccacugca

SEQ ID NO: 1176593 - RNA, 18 nt, Human
augcuggcuguuggcugg

SEQ ID NO: 1176594 - RNA, 19 nt, Human
uuucaaacauauauaacaa

SEQ ID NO: 1176595 - RNA, 12 nt, Human
uuucaaacuuua

SEQ ID NO: 1176596 - RNA, 15 nt, Human
uuucaaacuuuacua

SEQ ID NO: 1176597 - RNA, 16 nt, Human
uuucccuauuagagaa

SEQ ID NO: 1176598 - RNA, 11 nt, Human
uuucagaaaug

SEQ ID NO: 1176599 - RNA, 12 nt, Human
uuucagaaaugu

SEQ ID NO: 1176600 - RNA, 13 nt, Human
uuucagaaaugug

SEQ ID NO: 1176601 - RNA, 12 nt, Human
uuuggcugcuga

SEQ ID NO: 1176602 - RNA, 13 nt, Human
uuuggcugcugaa

SEQ ID NO: 1176603 - RNA, 13 nt, Human
uuuggggaagaac

SEQ ID NO: 1176604 - RNA, 21 nt, Human
uuugggguacccacugcucug

SEQ ID NO: 1176605 - RNA, 22 nt, Human
uuugggguacccacugcucugg

SEQ ID NO: 1176606 - RNA, 22 nt, Human
uuuggauuggaugaauuccaaa

SEQ ID NO: 1176607 - RNA, 19 nt, Human
uuugcuaagcauuccaacu

SEQ ID NO: 1176608 - RNA, 20 nt, Human
uuugcuggagcucugcccau

SEQ ID NO: 1176609 - RNA, 18 nt, Human
uuugauucagacagcugc

SEQ ID NO: 1176610 - RNA, 13 nt, Human
uuugagacagagu

SEQ ID NO: 1176611 - RNA, 15 nt, Human
uuugauccaagcugg

SEQ ID NO: 1176612 - RNA, 15 nt, Human
uuugauucagacagc

SEQ ID NO: 1176613 - RNA, 23 nt, Human
uuucccucccuuccucuuuccau

SEQ ID NO: 1176614 - RNA, 14 nt, Human
uuugacaaggggca

SEQ ID NO: 1176615 - RNA, 19 nt, Human
uuugaccucugcagcaaua

SEQ ID NO: 1176616 - RNA, 21 nt, Human
uuugaccucugcagcaauaaa

SEQ ID NO: 1176617 - RNA, 15 nt, Human
augugaugagaggaa

SEQ ID NO: 1176618 - RNA, 16 nt, Human
uuuguaauuuuuuuau

SEQ ID NO: 1176619 - RNA, 14 nt, Human
uuuguacagacaac

SEQ ID NO: 1176620 - RNA, 17 nt, Human
uuuguaguguuggagaa

SEQ ID NO: 1176621 - RNA, 13 nt, Human
uuugucuuaaaaa

SEQ ID NO: 1176622 - RNA, 14 nt, Human
uuugucuuaaaaag

SEQ ID NO: 1176623 - RNA, 23 nt, Human
uuugucuuaaaaaguggaaaaau

SEQ ID NO: 1176624 - RNA, 16 nt, Human
uuugugauacaaugcu

SEQ ID NO: 1176625 - RNA, 22 nt, Human
uuugugauacaaugcugugccc

SEQ ID NO: 1176626 - RNA, 19 nt, Human
uuugugcauuaucuagaua

SEQ ID NO: 1176627 - RNA, 22 nt, Human
uuugugcauuaucuagauacug

SEQ ID NO: 1176628 - RNA, 14 nt, Human
uuuguuucugaaag

SEQ ID NO: 1176629 - RNA, 16 nt, Human
uuuguuucugaaaggg

SEQ ID NO: 1176630 - RNA, 23 nt, Human
augucgucaaagcugaaauggac

SEQ ID NO: 1176631 - RNA, 13 nt, Human
augugagaccauu

SEQ ID NO: 1176632 - RNA, 14 nt, Human
augugagacugguu

SEQ ID NO: 1176633 - RNA, 19 nt, Human
auguauauuuuauaucaau

SEQ ID NO: 1176634 - RNA, 12 nt, Human
auguaucaauga

SEQ ID NO: 1176635 - RNA, 15 nt, Human
auguaucaaugagua

SEQ ID NO: 1176636 - RNA, 16 nt, Human
auguccaagaagccca

SEQ ID NO: 1176637 - RNA, 17 nt, Human
auguccaagaagcccag

SEQ ID NO: 1176638 - RNA, 18 nt, Human
auguccaagaagcccagg

SEQ ID NO: 1176639 - RNA, 16 nt, Human
auguugcccaggcagg

SEQ ID NO: 1176640 - RNA, 13 nt, Human
auguuggccaggc

SEQ ID NO: 1176641 - RNA, 21 nt, Human
uuuuagacccuauugcugcuu

SEQ ID NO: 1176642 - RNA, 17 nt, Human
uuuuagaguugauacua

SEQ ID NO: 1176643 - RNA, 12 nt, Human
auguugaaagau

SEQ ID NO: 1176644 - RNA, 18 nt, Human
auguugaaagaucaaaag

SEQ ID NO: 1176645 - RNA, 13 nt, Human
auguugcccaggc

SEQ ID NO: 1176646 - RNA, 14 nt, Human
auguugcccaggca

SEQ ID NO: 1176647 - RNA, 15 nt, Human
auguugcccaggcag

SEQ ID NO: 1176648 - RNA, 20 nt, Human
auguuacauaagauaaaugu

SEQ ID NO: 1176649 - RNA, 19 nt, Human
auguuacauaagauaaaug

SEQ ID NO: 1176650 - RNA, 18 nt, Human
uuuuaaaaaacugcugac

SEQ ID NO: 1176651 - RNA, 21 nt, Human
uuuuaaaaaacugcugacugu

SEQ ID NO: 1176652 - RNA, 21 nt, Human
augugccagguuuuuggucug

SEQ ID NO: 1176653 - RNA, 21 nt, Human
augugcuaguaauuggaaagg

SEQ ID NO: 1176654 - RNA, 17 nt, Human
auguuggccaggcuggu

SEQ ID NO: 1176655 - RNA, 13 nt, Human
uuuucuguucuuu

SEQ ID NO: 1176656 - RNA, 17 nt, Human
auguuuuucuucucccu

SEQ ID NO: 1176657 - RNA, 23 nt, Human
auuaaaaaucucaaauuucuaaa

SEQ ID NO: 1176658 - RNA, 19 nt, Human
auuaaaacacaacaucuuu

SEQ ID NO: 1176659 - RNA, 16 nt, Human
uuuucuauaauuuaaa

SEQ ID NO: 1176660 - RNA, 20 nt, Human
uuuucaggcuagauguaugu

SEQ ID NO: 1176661 - RNA, 14 nt, Human
uuuucaguguacau

SEQ ID NO: 1176662 - RNA, 18 nt, Human
uuuuauggcuuuugugca

SEQ ID NO: 1176663 - RNA, 19 nt, Human
uuuuauggcuuuugugcau

SEQ ID NO: 1176664 - RNA, 23 nt, Human
uuuuagaguugauacuacaguuu

SEQ ID NO: 1176665 - RNA, 15 nt, Human
uuuuaguagagacag

SEQ ID NO: 1176666 - RNA, 21 nt, Human
uuuuauggcuuuugugcauua

SEQ ID NO: 1176667 - RNA, 12 nt, Human
uuuuauuaaauu

SEQ ID NO: 1176668 - RNA, 13 nt, Human
auuaaggaagaca

SEQ ID NO: 1176669 - RNA, 18 nt, Human
auuaaguacuauguauca

SEQ ID NO: 1176670 - RNA, 19 nt, Human
auuaaguacuauguaucaa

SEQ ID NO: 1176671 - RNA, 17 nt, Human
uuuuuauauuugaaaua

SEQ ID NO: 1176672 - RNA, 23 nt, Human
auuaaaacacaacaucuuuuucu

SEQ ID NO: 1176673 - RNA, 14 nt, Human
uuuugugaagcaaa

SEQ ID NO: 1176674 - RNA, 16 nt, Human
uuuuguuuuugucuua

SEQ ID NO: 1176675 - RNA, 15 nt, Human
auuacuguaagaaaa

SEQ ID NO: 1176676 - RNA, 16 nt, Human
auuacuguaagaaaau

SEQ ID NO: 1176677 - RNA, 13 nt, Human
auuacuucugcua

SEQ ID NO: 1176678 - RNA, 14 nt, Human
auuacuucugcuac

SEQ ID NO: 1176679 - RNA, 13 nt, Human
auuagagaagaga

SEQ ID NO: 1176680 - RNA, 17 nt, Human
auuccaagugauugaaa

SEQ ID NO: 1176681 - RNA, 18 nt, Human
auucccaagcucugcucc

SEQ ID NO: 1176682 - RNA, 19 nt, Human
auucccaagcucugcuccu

SEQ ID NO: 1176683 - RNA, 20 nt, Human
auuccccaggaggccagccu

SEQ ID NO: 1176684 - RNA, 22 nt, Human
auuccccaggaggccagccuug

SEQ ID NO: 1176685 - RNA, 16 nt, Human
auucaguuguuagugu

SEQ ID NO: 1176686 - RNA, 20 nt, Human
auuauauggcuugaguuuaa

SEQ ID NO: 1176687 - RNA, 16 nt, Human
auuggagcucguggaa

SEQ ID NO: 1176688 - RNA, 17 nt, Human
auuggagcucgugggac

SEQ ID NO: 1176689 - RNA, 19 nt, Human
auuggagcucgugggacag

SEQ ID NO: 1176690 - RNA, 19 nt, Human
auuggcuagagguucaaag

SEQ ID NO: 1176691 - RNA, 20 nt, Human
auuggcuagagguucaaaga

SEQ ID NO: 1176692 - RNA, 22 nt, Human
auuggcuagagguucaaagaua

SEQ ID NO: 1176693 - RNA, 23 nt, Human
auuggcuagagguucaaagauau

SEQ ID NO: 1176694 - RNA, 17 nt, Human
auugcaacaggcugggc

SEQ ID NO: 1176695 - RNA, 18 nt, Human
auugcaacaggcugggcu

SEQ ID NO: 1176696 - RNA, 19 nt, Human
auugcaacaggcugggcuu

SEQ ID NO: 1176697 - RNA, 12 nt, Human
auugcaccacug

SEQ ID NO: 1176698 - RNA, 21 nt, Human
auuugaggucuguucuuucca

SEQ ID NO: 1176699 - RNA, 22 nt, Human
auuugaggucuguucuuuccaa

SEQ ID NO: 1176700 - RNA, 15 nt, Human
auuugagcagggcuc

SEQ ID NO: 1176701 - RNA, 16 nt, Human
auuugagcagggcuca

SEQ ID NO: 1176702 - RNA, 17 nt, Human
auuugaggucuguucuu

SEQ ID NO: 1176703 - RNA, 18 nt, Human
auuugaggucuguucuuu

SEQ ID NO: 1176704 - RNA, 16 nt, Human
auuucuuccacaagag

SEQ ID NO: 1176705 - RNA, 14 nt, Human
auuucccaaagcag

SEQ ID NO: 1176706 - RNA, 16 nt, Human
auuucccaaagcagug

SEQ ID NO: 1176707 - RNA, 19 nt, Human
auuuauuacuguaagaaaa

SEQ ID NO: 1176708 - RNA, 20 nt, Human
auuuauuacuguaagaaaau

SEQ ID NO: 1176709 - RNA, 19 nt, Human
auuuacuucuuauacauuu

SEQ ID NO: 1176710 - RNA, 20 nt, Human
auuuacuucuuauacauuug

SEQ ID NO: 1176711 - RNA, 16 nt, Human
auuguaguccuguaau

SEQ ID NO: 1176712 - RNA, 17 nt, Human
auuguuuucaguguaca

SEQ ID NO: 1176713 - RNA, 18 nt, Human
auuguuuucaguguacau

SEQ ID NO: 1176714 - RNA, 19 nt, Human
auuguuuucaguguacaug

SEQ ID NO: 1176715 - RNA, 17 nt, Human
auuuaaaaaaaaaccug

SEQ ID NO: 1176716 - RNA, 14 nt, Human
auuuaaaaaaaauc

SEQ ID NO: 1176717 - RNA, 15 nt, Human
auuuaccacuugugu

SEQ ID NO: 1176718 - RNA, 22 nt, Human
auuuaccacuuguguuuugcaa

SEQ ID NO: 1176719 - RNA, 23 nt, Human
cuccaggugcacaagcuccaagc

SEQ ID NO: 1176720 - RNA, 23 nt, Human
cuccaggcuccuuuagcgcccag

SEQ ID NO: 1176721 - RNA, 20 nt, Human
cuccaggcuguaucccauga

SEQ ID NO: 1176722 - RNA, 22 nt, Human
cuccaggcuguaucccaugagc

SEQ ID NO: 1176723 - RNA, 20 nt, Human
cucccucuuucccucccuuc

SEQ ID NO: 1176724 - RNA, 15 nt, Human
cucccaggcauuccc

SEQ ID NO: 1176725 - RNA, 13 nt, Human
cuccucugcugcu

SEQ ID NO: 1176726 - RNA, 14 nt, Human
cuccucugcugcug

SEQ ID NO: 1176727 - RNA, 15 nt, Human
cuccucugcugcugg

SEQ ID NO: 1176728 - RNA, 19 nt, Human
cuccuggcccacugcaucg

SEQ ID NO: 1176729 - RNA, 19 nt, Human
cuccuggccucaagugauu

SEQ ID NO: 1176730 - RNA, 18 nt, Human
cuccugggcuaagugauc

SEQ ID NO: 1176731 - RNA, 16 nt, Human
cuccuguaccucuuga

SEQ ID NO: 1176732 - RNA, 15 nt, Human
cuccuuucaccacau

SEQ ID NO: 1176733 - RNA, 14 nt, Human
cuccuuguguuacu

SEQ ID NO: 1176734 - RNA, 17 nt, Human
cuccuuugugaggaagc

SEQ ID NO: 1176735 - RNA, 18 nt, Human
cuccuuugugaggaagcc

SEQ ID NO: 1176736 - RNA, 23 nt, Human
cuccuuugugaggaagccgcugg

SEQ ID NO: 1176737 - RNA, 16 nt, Human
cucgguguggagaagc

SEQ ID NO: 1176738 - RNA, 17 nt, Human
cucgguguggagaagcg

SEQ ID NO: 1176739 - RNA, 23 nt, Human
cucgguguggagaagcggcuggc

SEQ ID NO: 1176740 - RNA, 19 nt, Human
cucuauguucuaagaagug

SEQ ID NO: 1176741 - RNA, 16 nt, Human
cucuccccaugauguu

SEQ ID NO: 1176742 - RNA, 13 nt, Human
cucuccuccagag

SEQ ID NO: 1176743 - RNA, 15 nt, Human
cucuccuccagaguc

SEQ ID NO: 1176744 - RNA, 16 nt, Human
cucuccuccagaguca

SEQ ID NO: 1176745 - RNA, 14 nt, Human
cucucuggccuucg

SEQ ID NO: 1176746 - RNA, 16 nt, Human
cucucuggccuucggc

SEQ ID NO: 1176747 - RNA, 17 nt, Human
cucucuggccuucggcc

SEQ ID NO: 1176748 - RNA, 20 nt, Human
cucugcacaagcugcacccu

SEQ ID NO: 1176749 - RNA, 21 nt, Human
cucugcacaagcugcacccuc

SEQ ID NO: 1176750 - RNA, 15 nt, Human
cucugcacuccccug

SEQ ID NO: 1176751 - RNA, 16 nt, Human
cucugcacuccccugc

SEQ ID NO: 1176752 - RNA, 17 nt, Human
cucugcacuccccugcu

SEQ ID NO: 1176753 - RNA, 18 nt, Human
cucugcacuccccugcug

SEQ ID NO: 1176754 - RNA, 21 nt, Human
cucugcuccucuccccagcaa

SEQ ID NO: 1176755 - RNA, 21 nt, Human
cucugcugacagacacaggcc

SEQ ID NO: 1176756 - RNA, 22 nt, Human
cucugcugacagacacaggccc

SEQ ID NO: 1176757 - RNA, 23 nt, Human
cucugcugacagacacaggcccg

SEQ ID NO: 1176758 - RNA, 13 nt, Human
cucugcugcuggc

SEQ ID NO: 1176759 - RNA, 14 nt, Human
cucugcugcuggcu

SEQ ID NO: 1176760 - RNA, 15 nt, Human
cucugcugcuggcug

SEQ ID NO: 1176761 - RNA, 16 nt, Human
cucugcugcuggcugg

SEQ ID NO: 1176762 - RNA, 14 nt, Human
cucuguacagagcc

SEQ ID NO: 1176763 - RNA, 15 nt, Human
cucuguacagagccc

SEQ ID NO: 1176764 - RNA, 16 nt, Human
cucuguacagagccca

SEQ ID NO: 1176765 - RNA, 17 nt, Human
cucuguacagagcccac

SEQ ID NO: 1176766 - RNA, 13 nt, Human
cucuguccuggga

SEQ ID NO: 1176767 - RNA, 23 nt, Human
cucaggugucccugcacuugcag

SEQ ID NO: 1176768 - RNA, 15 nt, Human
cucaguccauagcag

SEQ ID NO: 1176769 - RNA, 17 nt, Human
cucaguccauagcagag

SEQ ID NO: 1176770 - RNA, 16 nt, Human
cucaguccaugaagau

SEQ ID NO: 1176771 - RNA, 22 nt, Human
cucagucuggcccuuccuuuuc

SEQ ID NO: 1176772 - RNA, 13 nt, Human
cucaggccugggg

SEQ ID NO: 1176773 - RNA, 19 nt, Human
cucaggccaaacucaccug

SEQ ID NO: 1176774 - RNA, 20 nt, Human
cucaggccaaacucaccugc

SEQ ID NO: 1176775 - RNA, 21 nt, Human
cucaggccaaacucaccugcc

SEQ ID NO: 1176776 - RNA, 16 nt, Human
cucaggccagcugcuu

SEQ ID NO: 1176777 - RNA, 17 nt, Human
cucaggccagcugcuug

SEQ ID NO: 1176778 - RNA, 18 nt, Human
cucaggccagcugcuugg

SEQ ID NO: 1176779 - RNA, 20 nt, Human
cucaggccagcugcuugggc

SEQ ID NO: 1176780 - RNA, 11 nt, Human
cucaggccugg

SEQ ID NO: 1176781 - RNA, 17 nt, Human
cucaccuuucccaucuu

SEQ ID NO: 1176782 - RNA, 13 nt, Human
cucagaagacacu

SEQ ID NO: 1176783 - RNA, 15 nt, Human
cucagaagacacuga

SEQ ID NO: 1176784 - RNA, 17 nt, Human
cucagaagacacugaug

SEQ ID NO: 1176785 - RNA, 20 nt, Human
cucagaagacacugaugggc

SEQ ID NO: 1176786 - RNA, 22 nt, Human
cucagaagacacugaugggcaa

SEQ ID NO: 1176787 - RNA, 23 nt, Human
cucagaagacacugaugggcaac

SEQ ID NO: 1176788 - RNA, 19 nt, Human
cucagccucccgaauagcu

SEQ ID NO: 1176789 - RNA, 21 nt, Human
cucagccucccgaauagcugg

SEQ ID NO: 1176790 - RNA, 22 nt, Human
cucagccucccgaauagcuggg

SEQ ID NO: 1176791 - RNA, 23 nt, Human
cucagccucccgaauagcuggga

SEQ ID NO: 1176792 - RNA, 18 nt, Human
cuaucucauuuccaagca

SEQ ID NO: 1176793 - RNA, 13 nt, Human
cuaucucccccag

SEQ ID NO: 1176794 - RNA, 14 nt, Human
cuaucucccccagc

SEQ ID NO: 1176795 - RNA, 14 nt, Human
cuaugugagaccau

SEQ ID NO: 1176796 - RNA, 17 nt, Human
cuaugugagcacaaagg

SEQ ID NO: 1176797 - RNA, 18 nt, Human
cuauguucuaagaaguga

SEQ ID NO: 1176798 - RNA, 14 nt, Human
cuauguugcccagg

SEQ ID NO: 1176799 - RNA, 18 nt, Human
cuauguugcccaggcagg

SEQ ID NO: 1176800 - RNA, 19 nt, Human
cuauguugcccaggcaggu

SEQ ID NO: 1176801 - RNA, 21 nt, Human
cuauguugcccaggcaggucu

SEQ ID NO: 1176802 - RNA, 22 nt, Human
cuauguugcccaggcaggucuu

SEQ ID NO: 1176803 - RNA, 23 nt, Human
cucaauuauuuugcauuuuuucu

SEQ ID NO: 1176804 - RNA, 13 nt, Human
ccuguucagcucc

SEQ ID NO: 1176805 - RNA, 18 nt, Human
ccuguucccaugagauga

SEQ ID NO: 1176806 - RNA, 12 nt, Human
ccuguucuggca

SEQ ID NO: 1176807 - RNA, 17 nt, Human
ccuguucuggcagaguu

SEQ ID NO: 1176808 - RNA, 14 nt, Human
ccuguucagcucca

SEQ ID NO: 1176809 - RNA, 15 nt, Human
ccuguucagcuccag

SEQ ID NO: 1176810 - RNA, 16 nt, Human
ccuguucagcuccagc

SEQ ID NO: 1176811 - RNA, 19 nt, Human
ccuguucagcuccagcuca

SEQ ID NO: 1176812 - RNA, 20 nt, Human
ccuguucagcuccagcucac

SEQ ID NO: 1176813 - RNA, 21 nt, Human
ccuguucagcuccagcucacc

SEQ ID NO: 1176814 - RNA, 23 nt, Human
ccuguucagcuccagcucaccag

SEQ ID NO: 1176815 - RNA, 16 nt, Human
ccuguugggccaggag

SEQ ID NO: 1176816 - RNA, 17 nt, Human
ccuguugggccaggagc

SEQ ID NO: 1176817 - RNA, 18 nt, Human
ccuguugggccaggagcc

SEQ ID NO: 1176818 - RNA, 19 nt, Human
ccuguugggccaggagccu

SEQ ID NO: 1176819 - RNA, 20 nt, Human
ccuguugggccaggagccuc

SEQ ID NO: 1176820 - RNA, 23 nt, Human
ccuguugggccaggagccuccug

SEQ ID NO: 1176821 - RNA, 16 nt, Human
ccuuagcaaauucugu

SEQ ID NO: 1176822 - RNA, 19 nt, Human
ccuuagcagggaaacagcu

SEQ ID NO: 1176823 - RNA, 20 nt, Human
ccuuagcagggaaacagcua

SEQ ID NO: 1176824 - RNA, 12 nt, Human
ccuuauggaaca

SEQ ID NO: 1176825 - RNA, 12 nt, Human
ccuucccaccuc

SEQ ID NO: 1176826 - RNA, 14 nt, Human
ccuucccaccucuc

SEQ ID NO: 1176827 - RNA, 19 nt, Human
ccuucccaccucucucacu

SEQ ID NO: 1176828 - RNA, 14 nt, Human
ccuuauggaacacu

SEQ ID NO: 1176829 - RNA, 16 nt, Human
ccuuauggaacacucu

SEQ ID NO: 1176830 - RNA, 17 nt, Human
ccuuauggaacacucug

SEQ ID NO: 1176831 - RNA, 18 nt, Human
ccuuauggaacacucuga

SEQ ID NO: 1176832 - RNA, 19 nt, Human
ccuuauggaacacucugag

SEQ ID NO: 1176833 - RNA, 20 nt, Human
ccuuauggaacacucugaga

SEQ ID NO: 1176834 - RNA, 22 nt, Human
ccuuauggaacacucugagacu

SEQ ID NO: 1176835 - RNA, 20 nt, Human
ccuucucuccagccccugga

SEQ ID NO: 1176836 - RNA, 21 nt, Human
ccuucucuccagccccuggau

SEQ ID NO: 1176837 - RNA, 23 nt, Human
ccuucucuccagccccuggaugc

SEQ ID NO: 1176838 - RNA, 14 nt, Human
ccuucucugaagga

SEQ ID NO: 1176839 - RNA, 16 nt, Human
ccuucucugaaggaca

SEQ ID NO: 1176840 - RNA, 22 nt, Human
ccuucuguccuacucuguguca

SEQ ID NO: 1176841 - RNA, 17 nt, Human
ccuucucuucacaguca

SEQ ID NO: 1176842 - RNA, 21 nt, Human
ccuucuguccuacucuguguc

SEQ ID NO: 1176843 - RNA, 15 nt, Human
ccuuucaauaggaaa

SEQ ID NO: 1176844 - RNA, 17 nt, Human
ccuuucaauaggaaaaa

SEQ ID NO: 1176845 - RNA, 18 nt, Human
ccuuucaauaggaaaaac

SEQ ID NO: 1176846 - RNA, 20 nt, Human
ccuuuucgcaggauucuucc

SEQ ID NO: 1176847 - RNA, 12 nt, Human
ccuuuucccaac

SEQ ID NO: 1176848 - RNA, 20 nt, Human
cgcugccccuggcagccccu

SEQ ID NO: 1176849 - RNA, 17 nt, Human
cgcuggagugcagugag

SEQ ID NO: 1176850 - RNA, 18 nt, Human
cgcuggagugcagugagc

SEQ ID NO: 1176851 - RNA, 12 nt, Human
cgggcucugccu

SEQ ID NO: 1176852 - RNA, 13 nt, Human
cgggcucugccuc

SEQ ID NO: 1176853 - RNA, 14 nt, Human
cggcucacugcagc

SEQ ID NO: 1176854 - RNA, 14 nt, Human
cgggccagugcucc

SEQ ID NO: 1176855 - RNA, 18 nt, Human
cgggccagugcuccagcc

SEQ ID NO: 1176856 - RNA, 22 nt, Human
cguacacauuuuauuuuauuau

SEQ ID NO: 1176857 - RNA, 20 nt, Human
cgguggcucacgccuguaau

SEQ ID NO: 1176858 - RNA, 22 nt, Human
cggagucccaccuuggcugcag

SEQ ID NO: 1176859 - RNA, 23 nt, Human
cggagucccaccuuggcugcagg

SEQ ID NO: 1176860 - RNA, 17 nt, Human
cggagacggagucccac

SEQ ID NO: 1176861 - RNA, 20 nt, Human
cggagacggagucccaccuu

SEQ ID NO: 1176862 - RNA, 14 nt, Human
cuaaguuuuuaugg

SEQ ID NO: 1176863 - RNA, 20 nt, Human
cuaaguuuuuauggcuuuug

SEQ ID NO: 1176864 - RNA, 20 nt, Human
cuaauaaaauuuaaaagucu

SEQ ID NO: 1176865 - RNA, 19 nt, Human
cuacaaaaagcauaaaaau

SEQ ID NO: 1176866 - RNA, 14 nt, Human
cuaacuugucuuug

SEQ ID NO: 1176867 - RNA, 22 nt, Human
cuaacuugucuuuggacccuga

SEQ ID NO: 1176868 - RNA, 16 nt, Human
cuaacuuuccuucauu

SEQ ID NO: 1176869 - RNA, 19 nt, Human
cuaaaguguauuuuuuuac

SEQ ID NO: 1176870 - RNA, 19 nt, Human
cgugaguccuggcauggga

SEQ ID NO: 1176871 - RNA, 16 nt, Human
cgugaggccagagaca

SEQ ID NO: 1176872 - RNA, 15 nt, Human
cguguuaugacucca

SEQ ID NO: 1176873 - RNA, 19 nt, Human
cguguuaugacuccagaau

SEQ ID NO: 1176874 - RNA, 11 nt, Human
cuaaagcugcc

SEQ ID NO: 1176875 - RNA, 14 nt, Human
cgugacaacacuug

SEQ ID NO: 1176876 - RNA, 15 nt, Human
cgugacaacacuugu

SEQ ID NO: 1176877 - RNA, 14 nt, Human
cgugagccacugca

SEQ ID NO: 1176878 - RNA, 15 nt, Human
cgugagccacugcac

SEQ ID NO: 1176879 - RNA, 20 nt, Human
cgugagccacugcaccgggc

SEQ ID NO: 1176880 - RNA, 22 nt, Human
cgugagccacugcaccgggcca

SEQ ID NO: 1176881 - RNA, 14 nt, Human
cgugaggccagaga

SEQ ID NO: 1176882 - RNA, 11 nt, Human
ccucaggcagg

SEQ ID NO: 1176883 - RNA, 17 nt, Human
ccucccaacucacccca

SEQ ID NO: 1176884 - RNA, 20 nt, Human
ccucccaacucaccccagcc

SEQ ID NO: 1176885 - RNA, 21 nt, Human
ccucccaacucaccccagccc

SEQ ID NO: 1176886 - RNA, 23 nt, Human
ccucccaacucaccccagcccca

SEQ ID NO: 1176887 - RNA, 13 nt, Human
ccuccgccucuug

SEQ ID NO: 1176888 - RNA, 18 nt, Human
ccuccuuugugaggaagc

SEQ ID NO: 1176889 - RNA, 19 nt, Human
ccuccuuugugaggaagcc

SEQ ID NO: 1176890 - RNA, 20 nt, Human
ccuccuuugugaggaagccg

SEQ ID NO: 1176891 - RNA, 16 nt, Human
ccucgaacuggcugca

SEQ ID NO: 1176892 - RNA, 20 nt, Human
ccucugccucugacacacag

SEQ ID NO: 1176893 - RNA, 21 nt, Human
ccucugccucugacacacagc

SEQ ID NO: 1176894 - RNA, 23 nt, Human
ccucugccucugacacacagcuc

SEQ ID NO: 1176895 - RNA, 11 nt, Human
ccucugccuga

SEQ ID NO: 1176896 - RNA, 20 nt, Human
ccucugccugaagucacaca

SEQ ID NO: 1176897 - RNA, 12 nt, Human
ccucucucacuc

SEQ ID NO: 1176898 - RNA, 21 nt, Human
ccucugccugaagucacacag

SEQ ID NO: 1176899 - RNA, 13 nt, Human
ccucuuggguuca

SEQ ID NO: 1176900 - RNA, 19 nt, Human
ccucuuuggucuacacugu

SEQ ID NO: 1176901 - RNA, 14 nt, Human
ccugcagagggcac

SEQ ID NO: 1176902 - RNA, 23 nt, Human
ccugcaggcagccaggccacaag

SEQ ID NO: 1176903 - RNA, 18 nt, Human
ccugcaggcagccaggcc

SEQ ID NO: 1176904 - RNA, 19 nt, Human
ccugcaggcagccaggcca

SEQ ID NO: 1176905 - RNA, 20 nt, Human
ccugcaggcagccaggccac

SEQ ID NO: 1176906 - RNA, 21 nt, Human
ccugcaggcagccaggccaca

SEQ ID NO: 1176907 - RNA, 12 nt, Human
ccugcagagggc

SEQ ID NO: 1176908 - RNA, 16 nt, Human
ccugcaggcagccagg

SEQ ID NO: 1176909 - RNA, 17 nt, Human
ccugcaggcagccaggc

SEQ ID NO: 1176910 - RNA, 17 nt, Human
ccugaggcugggcuccc

SEQ ID NO: 1176911 - RNA, 19 nt, Human
ccugaggcugggcucccuu

SEQ ID NO: 1176912 - RNA, 21 nt, Human
ccugaggcugggcucccuucc

SEQ ID NO: 1176913 - RNA, 12 nt, Human
ccugaggggccu

SEQ ID NO: 1176914 - RNA, 16 nt, Human
ccugaggggccucuua

SEQ ID NO: 1176915 - RNA, 13 nt, Human
ccugccuccuuug

SEQ ID NO: 1176916 - RNA, 15 nt, Human
ccugccuccuuugug

SEQ ID NO: 1176917 - RNA, 19 nt, Human
ccugccuccuuugugagga

SEQ ID NO: 1176918 - RNA, 20 nt, Human
ccugccuccuuugugaggaa

SEQ ID NO: 1176919 - RNA, 21 nt, Human
ccugccuccuuugugaggaag

SEQ ID NO: 1176920 - RNA, 22 nt, Human
ccugccuccuuugugaggaagc

SEQ ID NO: 1176921 - RNA, 23 nt, Human
ccugccuccuuugugaggaagcc

SEQ ID NO: 1176922 - RNA, 19 nt, Human
ccugccucgaacuggcugc

SEQ ID NO: 1176923 - RNA, 15 nt, Human
ccugccucuucucua

SEQ ID NO: 1176924 - RNA, 11 nt, Human
ccugcugcagu

SEQ ID NO: 1176925 - RNA, 12 nt, Human
ccugcugcaguu

SEQ ID NO: 1176926 - RNA, 16 nt, Human
ccugcugcaguugcca

SEQ ID NO: 1176927 - RNA, 22 nt, Human
ccugcugcaguugccagucacc

SEQ ID NO: 1176928 - RNA, 18 nt, Human
ccgaccagacaccuugac

SEQ ID NO: 1176929 - RNA, 13 nt, Human
ccgaccagacacc

SEQ ID NO: 1176930 - RNA, 17 nt, Human
ccgaccagacaccuuga

SEQ ID NO: 1176931 - RNA, 16 nt, Human
ccgaauagcugggacu

SEQ ID NO: 1176932 - RNA, 17 nt, Human
ccgaauagcugggacua

SEQ ID NO: 1176933 - RNA, 15 nt, Human
cccuuccucuuucca

SEQ ID NO: 1176934 - RNA, 16 nt, Human
ccgaaaacguggcugc

SEQ ID NO: 1176935 - RNA, 17 nt, Human
ccgaaaacguggcugcu

SEQ ID NO: 1176936 - RNA, 19 nt, Human
ccgaaagggacuuggaagc

SEQ ID NO: 1176937 - RNA, 12 nt, Human
ccgcccaggcuu

SEQ ID NO: 1176938 - RNA, 16 nt, Human
ccgcagacaggaccag

SEQ ID NO: 1176939 - RNA, 17 nt, Human
ccgcagacaggaccagg

SEQ ID NO: 1176940 - RNA, 13 nt, Human
cccugucuaauga

SEQ ID NO: 1176941 - RNA, 21 nt, Human
cccugugauggggcccugccu

SEQ ID NO: 1176942 - RNA, 22 nt, Human
cccugugauggggcccugccuc

SEQ ID NO: 1176943 - RNA, 23 nt, Human
cccugugauggggcccugccucc

SEQ ID NO: 1176944 - RNA, 19 nt, Human
ccuagcauacguacacauu

SEQ ID NO: 1176945 - RNA, 21 nt, Human
ccuagcauacguacacauuuu

SEQ ID NO: 1176946 - RNA, 20 nt, Human
ccuagccugugccucuggga

SEQ ID NO: 1176947 - RNA, 14 nt, Human
ccuaaucuucugaa

SEQ ID NO: 1176948 - RNA, 15 nt, Human
ccggcuccaggcucc

SEQ ID NO: 1176949 - RNA, 14 nt, Human
ccgucuaccugagg

SEQ ID NO: 1176950 - RNA, 15 nt, Human
ccgucuaccugaggg

SEQ ID NO: 1176951 - RNA, 13 nt, Human
ccggcuccaggcu

SEQ ID NO: 1176952 - RNA, 14 nt, Human
ccggcuccaggcuc

SEQ ID NO: 1176953 - RNA, 17 nt, Human
ccgucuaccugaggggc

SEQ ID NO: 1176954 - RNA, 12 nt, Human
ccgugaggccag

SEQ ID NO: 1176955 - RNA, 13 nt, Human
ccgugaggccaga

SEQ ID NO: 1176956 - RNA, 14 nt, Human
ccgugaggccagag

SEQ ID NO: 1176957 - RNA, 16 nt, Human
ccgugaggccagagac

SEQ ID NO: 1176958 - RNA, 20 nt, Human
ccuaacgaaguauccuucag

SEQ ID NO: 1176959 - RNA, 16 nt, Human
ccggccaccugcggug

SEQ ID NO: 1176960 - RNA, 11 nt, Human
cccugcccugu

SEQ ID NO: 1176961 - RNA, 13 nt, Human
cccuggaugcagc

SEQ ID NO: 1176962 - RNA, 17 nt, Human
cccuggaugcagccuca

SEQ ID NO: 1176963 - RNA, 21 nt, Human
cccuggaugcagccucacagu

SEQ ID NO: 1176964 - RNA, 22 nt, Human
cccugcccaccuggccucugca

SEQ ID NO: 1176965 - RNA, 14 nt, Human
cccugcccggcugc

SEQ ID NO: 1176966 - RNA, 17 nt, Human
cccugcccggcugcgga

SEQ ID NO: 1176967 - RNA, 16 nt, Human
cccugagcuuucugcu

SEQ ID NO: 1176968 - RNA, 18 nt, Human
cccugaaagcccugagcu

SEQ ID NO: 1176969 - RNA, 12 nt, Human
cccugaaggccc

SEQ ID NO: 1176970 - RNA, 13 nt, Human
cccugaaggcccc

SEQ ID NO: 1176971 - RNA, 14 nt, Human
cccugaaggccccg

SEQ ID NO: 1176972 - RNA, 16 nt, Human
cccugaaggccccgcc

SEQ ID NO: 1176973 - RNA, 19 nt, Human
cccugaaggccccgcccag

SEQ ID NO: 1176974 - RNA, 20 nt, Human
cccugaaggccccgcccagg

SEQ ID NO: 1176975 - RNA, 22 nt, Human
cccugaaggccccgcccaggcu

SEQ ID NO: 1176976 - RNA, 14 nt, Human
cccugacaacacuc

SEQ ID NO: 1176977 - RNA, 16 nt, Human
cccugacaacacucau

SEQ ID NO: 1176978 - RNA, 22 nt, Human
cccugacaacacucauugaccu

SEQ ID NO: 1176979 - RNA, 13 nt, Human
ccaugagccucag

SEQ ID NO: 1176980 - RNA, 16 nt, Human
ccaugaggaacaaggc

SEQ ID NO: 1176981 - RNA, 17 nt, Human
ccaugaggaacaaggca

SEQ ID NO: 1176982 - RNA, 18 nt, Human
ccaugaggaacaaggcaa

SEQ ID NO: 1176983 - RNA, 18 nt, Human
ccaugggcacugugggua

SEQ ID NO: 1176984 - RNA, 22 nt, Human
ccauuguggucacaggaaguag

SEQ ID NO: 1176985 - RNA, 17 nt, Human
cccaagcucugcuccuc

SEQ ID NO: 1176986 - RNA, 12 nt, Human
cccaagcucugc

SEQ ID NO: 1176987 - RNA, 15 nt, Human
cccacccaagggccu

SEQ ID NO: 1176988 - RNA, 18 nt, Human
cccacccaagggccuggc

SEQ ID NO: 1176989 - RNA, 15 nt, Human
cccaccgcagacagg

SEQ ID NO: 1176990 - RNA, 18 nt, Human
cccaccgcagacaggacc

SEQ ID NO: 1176991 - RNA, 19 nt, Human
cccaccgcagacaggacca

SEQ ID NO: 1176992 - RNA, 14 nt, Human
ccccagccccaucc

SEQ ID NO: 1176993 - RNA, 14 nt, Human
ccccagccccaaaa

SEQ ID NO: 1176994 - RNA, 16 nt, Human
ccccagccccauccca

SEQ ID NO: 1176995 - RNA, 12 nt, Human
ccccagccccaa

SEQ ID NO: 1176996 - RNA, 18 nt, Human
ccccaaaacucuccucug

SEQ ID NO: 1176997 - RNA, 20 nt, Human
ccccaaaacucuccucugcu

SEQ ID NO: 1176998 - RNA, 21 nt, Human
ccccaaaacucuccucugcug

SEQ ID NO: 1176999 - RNA, 14 nt, Human
cccccuuccaugga

SEQ ID NO: 1177000 - RNA, 15 nt, Human
ccccauuguggucac

SEQ ID NO: 1177001 - RNA, 12 nt, Human
ccccgcccaggc

SEQ ID NO: 1177002 - RNA, 14 nt, Human
ccccgcccaggcuu

SEQ ID NO: 1177003 - RNA, 14 nt, Human
ccccggccaccugc

SEQ ID NO: 1177004 - RNA, 18 nt, Human
ccccggccaccugcggug

SEQ ID NO: 1177005 - RNA, 19 nt, Human
cccagcccacuucugccau

SEQ ID NO: 1177006 - RNA, 21 nt, Human
cccagccccaaaacucuccuc

SEQ ID NO: 1177007 - RNA, 23 nt, Human
cccagccccaaaacucuccucug

SEQ ID NO: 1177008 - RNA, 13 nt, Human
cccagccccaaug

SEQ ID NO: 1177009 - RNA, 20 nt, Human
cccauccucuguacagagcc

SEQ ID NO: 1177010 - RNA, 15 nt, Human
cccauccucuguaca

SEQ ID NO: 1177011 - RNA, 19 nt, Human
cccauccucuguacagagc

SEQ ID NO: 1177012 - RNA, 21 nt, Human
cccaggcuggcgugcaguggu

SEQ ID NO: 1177013 - RNA, 19 nt, Human
cccaggcuggcgugcagug

SEQ ID NO: 1177014 - RNA, 20 nt, Human
cccaggcuggcgugcagugg

SEQ ID NO: 1177015 - RNA, 18 nt, Human
cccaggcuggcgugcagu

SEQ ID NO: 1177016 - RNA, 14 nt, Human
cccauccucuguac

SEQ ID NO: 1177017 - RNA, 15 nt, Human
ccaggggccaugaau

SEQ ID NO: 1177018 - RNA, 20 nt, Human
ccaggggugggacacccugu

SEQ ID NO: 1177019 - RNA, 21 nt, Human
ccaggggugggacacccugug

SEQ ID NO: 1177020 - RNA, 22 nt, Human
ccaggggugggacacccuguga

SEQ ID NO: 1177021 - RNA, 23 nt, Human
ccaggggugggacacccugugau

SEQ ID NO: 1177022 - RNA, 19 nt, Human
ccaguaucuugaagacuuu

SEQ ID NO: 1177023 - RNA, 22 nt, Human
ccaguaucuugaagacuuuucu

SEQ ID NO: 1177024 - RNA, 16 nt, Human
ccagucaccccggcca

SEQ ID NO: 1177025 - RNA, 17 nt, Human
ccagucaccccggccac

SEQ ID NO: 1177026 - RNA, 18 nt, Human
ccagucaccccggccacc

SEQ ID NO: 1177027 - RNA, 19 nt, Human
ccagucaccccggccaccu

SEQ ID NO: 1177028 - RNA, 11 nt, Human
ccagcagccug

SEQ ID NO: 1177029 - RNA, 12 nt, Human
ccagcagccugg

SEQ ID NO: 1177030 - RNA, 16 nt, Human
ccagcagaaaugccuu

SEQ ID NO: 1177031 - RNA, 17 nt, Human
ccagcagaaaugccuua

SEQ ID NO: 1177032 - RNA, 22 nt, Human
ccagcagaaaugccuuacccuc

SEQ ID NO: 1177033 - RNA, 13 nt, Human
ccagcagccugga

SEQ ID NO: 1177034 - RNA, 23 nt, Human
ccagccccauccucuguacagag

SEQ ID NO: 1177035 - RNA, 14 nt, Human
ccagcagccuggac

SEQ ID NO: 1177036 - RNA, 13 nt, Human
ccagccccuggau

SEQ ID NO: 1177037 - RNA, 14 nt, Human
ccagccccuggaug

SEQ ID NO: 1177038 - RNA, 15 nt, Human
ccagccccuggaugc

SEQ ID NO: 1177039 - RNA, 18 nt, Human
ccagccccuggaugcagc

SEQ ID NO: 1177040 - RNA, 15 nt, Human
ccagccccuucugac

SEQ ID NO: 1177041 - RNA, 16 nt, Human
ccagccccuucugacc

SEQ ID NO: 1177042 - RNA, 17 nt, Human
ccagccccuucugaccc

SEQ ID NO: 1177043 - RNA, 18 nt, Human
ccagccccuucugaccca

SEQ ID NO: 1177044 - RNA, 20 nt, Human
ccaggaaaggcuccaggagc

SEQ ID NO: 1177045 - RNA, 18 nt, Human
ccaggaaaggcuccagga

SEQ ID NO: 1177046 - RNA, 19 nt, Human
ccaggaaaggcuccaggag

SEQ ID NO: 1177047 - RNA, 13 nt, Human
ccacuuucuagcc

SEQ ID NO: 1177048 - RNA, 18 nt, Human
ccacuuucuagccagagg

SEQ ID NO: 1177049 - RNA, 19 nt, Human
ccacuuucuagccagagga

SEQ ID NO: 1177050 - RNA, 20 nt, Human
ccacuuucuagccagaggag

SEQ ID NO: 1177051 - RNA, 15 nt, Human
ccacuuggucuguga

SEQ ID NO: 1177052 - RNA, 16 nt, Human
ccacuuggucugugag

SEQ ID NO: 1177053 - RNA, 17 nt, Human
ccacuuggucugugaga

SEQ ID NO: 1177054 - RNA, 19 nt, Human
ccacuuggucugugagaug

SEQ ID NO: 1177055 - RNA, 20 nt, Human
ccacuuggucugugagaugc

SEQ ID NO: 1177056 - RNA, 22 nt, Human
ccacuuggucugugagaugcua

SEQ ID NO: 1177057 - RNA, 14 nt, Human
ccacuuuuguucuu

SEQ ID NO: 1177058 - RNA, 15 nt, Human
ccacuuuuguucuug

SEQ ID NO: 1177059 - RNA, 21 nt, Human
ccacuuuuguucuugguuugu

SEQ ID NO: 1177060 - RNA, 22 nt, Human
ccacuuuuguucuugguuugua

SEQ ID NO: 1177061 - RNA, 17 nt, Human
ccagacccggcugcgug

SEQ ID NO: 1177062 - RNA, 12 nt, Human
ccacuuggucug

SEQ ID NO: 1177063 - RNA, 18 nt, Human
ccacugcacuccagccug

SEQ ID NO: 1177064 - RNA, 19 nt, Human
ccacugcacuauagccuag

SEQ ID NO: 1177065 - RNA, 20 nt, Human
ccacugcacuauagccuagg

SEQ ID NO: 1177066 - RNA, 13 nt, Human
ccacugcaccggg

SEQ ID NO: 1177067 - RNA, 14 nt, Human
ccacugcaccgggc

SEQ ID NO: 1177068 - RNA, 17 nt, Human
ccacugcaccgggccac

SEQ ID NO: 1177069 - RNA, 19 nt, Human
ccacugcaccgggccacag

SEQ ID NO: 1177070 - RNA, 15 nt, Human
ccagaugcaccagcc

SEQ ID NO: 1177071 - RNA, 14 nt, Human
ccagaugcaccagc

SEQ ID NO: 1177072 - RNA, 13 nt, Human
ccagaugcaccag

SEQ ID NO: 1177073 - RNA, 13 nt, Human
ccagagagggugg

SEQ ID NO: 1177074 - RNA, 16 nt, Human
ccagagacacaagccu

SEQ ID NO: 1177075 - RNA, 18 nt, Human
ccagagacacaagccuuc

SEQ ID NO: 1177076 - RNA, 18 nt, Human
cauccugaggcuccacuu

SEQ ID NO: 1177077 - RNA, 19 nt, Human
cauccugaggcuccacuug

SEQ ID NO: 1177078 - RNA, 12 nt, Human
caucccagcccc

SEQ ID NO: 1177079 - RNA, 22 nt, Human
cauccucuguacagagcccacg

SEQ ID NO: 1177080 - RNA, 20 nt, Human
caucccaaacccuucagugc

SEQ ID NO: 1177081 - RNA, 11 nt, Human
caucccagccc

SEQ ID NO: 1177082 - RNA, 19 nt, Human
caucccaaacccuucagug

SEQ ID NO: 1177083 - RNA, 21 nt, Human
caucagcacgauuucuguuua

SEQ ID NO: 1177084 - RNA, 16 nt, Human
cauagguuuaauaauu

SEQ ID NO: 1177085 - RNA, 19 nt, Human
cauagcagcuuauucacaa

SEQ ID NO: 1177086 - RNA, 20 nt, Human
cauagcagcuuauucacaag

SEQ ID NO: 1177087 - RNA, 23 nt, Human
cauacaggaagguagaaauaucu

SEQ ID NO: 1177088 - RNA, 22 nt, Human
caguuguuagugugucuuagug

SEQ ID NO: 1177089 - RNA, 23 nt, Human
caguuuguuaguaugaggcauuu

SEQ ID NO: 1177090 - RNA, 21 nt, Human
caguuauuauauuuacaaaug

SEQ ID NO: 1177091 - RNA, 17 nt, Human
caguuauuauauuuaca

SEQ ID NO: 1177092 - RNA, 21 nt, Human
cagugguaugaucacggcuca

SEQ ID NO: 1177093 - RNA, 19 nt, Human
caguggugcgaucuggguu

SEQ ID NO: 1177094 - RNA, 20 nt, Human
caguggugcgaucuggguuc

SEQ ID NO: 1177095 - RNA, 20 nt, Human
caguuacucagaauucucua

SEQ ID NO: 1177096 - RNA, 23 nt, Human
cagucugauucccaagcucugcu

SEQ ID NO: 1177097 - RNA, 21 nt, Human
cagugcccacaggaucagucu

SEQ ID NO: 1177098 - RNA, 22 nt, Human
cagugcccacaggaucagucug

SEQ ID NO: 1177099 - RNA, 16 nt, Human
cagugggagcugccug

SEQ ID NO: 1177100 - RNA, 17 nt, Human
cagugggagcugccugu

SEQ ID NO: 1177101 - RNA, 18 nt, Human
cagugggagcugccuguu

SEQ ID NO: 1177102 - RNA, 20 nt, Human
cagugguaugaucacggcuc

SEQ ID NO: 1177103 - RNA, 21 nt, Human
cagucugauucccaagcucug

SEQ ID NO: 1177104 - RNA, 22 nt, Human
cagucugauucccaagcucugc

SEQ ID NO: 1177105 - RNA, 22 nt, Human
caguuauuauauuuacaaaugg

SEQ ID NO: 1177106 - RNA, 23 nt, Human
ccaauggacuaacuugucuuugg

SEQ ID NO: 1177107 - RNA, 14 nt, Human
ccaaugggagcuca

SEQ ID NO: 1177108 - RNA, 15 nt, Human
ccaaaucagcugcua

SEQ ID NO: 1177109 - RNA, 23 nt, Human
ccaaaucagcugcuacuacuccu

SEQ ID NO: 1177110 - RNA, 16 nt, Human
ccaaaucauaguggcu

SEQ ID NO: 1177111 - RNA, 13 nt, Human
ccaacucacccca

SEQ ID NO: 1177112 - RNA, 21 nt, Human
ccaacucaccccagccccaaa

SEQ ID NO: 1177113 - RNA, 14 nt, Human
ccaacucaccccag

SEQ ID NO: 1177114 - RNA, 21 nt, Human
ccaacuccagaaagugacaag

SEQ ID NO: 1177115 - RNA, 14 nt, Human
ccaagcucugcucc

SEQ ID NO: 1177116 - RNA, 15 nt, Human
ccaagcucugcuccu

SEQ ID NO: 1177117 - RNA, 16 nt, Human
ccaagcucugcuccuc

SEQ ID NO: 1177118 - RNA, 17 nt, Human
ccaagcucugcuccucu

SEQ ID NO: 1177119 - RNA, 22 nt, Human
ccaaaguacacuguuucaaacu

SEQ ID NO: 1177120 - RNA, 14 nt, Human
ccaaagugcuggga

SEQ ID NO: 1177121 - RNA, 23 nt, Human
cauuuuuuuuaagaaaaaggaug

SEQ ID NO: 1177122 - RNA, 17 nt, Human
cauuuguuugaacugau

SEQ ID NO: 1177123 - RNA, 17 nt, Human
cauuuguauaaaauaau

SEQ ID NO: 1177124 - RNA, 14 nt, Human
cauuuguauaaaau

SEQ ID NO: 1177125 - RNA, 16 nt, Human
cauuuguauaaaauaa

SEQ ID NO: 1177126 - RNA, 21 nt, Human
cauuuggugguuucagaaaug

SEQ ID NO: 1177127 - RNA, 17 nt, Human
ccaaaaaaugcuugcuu

SEQ ID NO: 1177128 - RNA, 14 nt, Human
ccaaaaggcagaag

SEQ ID NO: 1177129 - RNA, 16 nt, Human
cauuuaggugaggaag

SEQ ID NO: 1177130 - RNA, 18 nt, Human
cauuuaggugaggaagca

SEQ ID NO: 1177131 - RNA, 18 nt, Human
cauguuggccaggcuggu

SEQ ID NO: 1177132 - RNA, 17 nt, Human
cauguuggccaggcugg

SEQ ID NO: 1177133 - RNA, 18 nt, Human
cauguucuuaauucuuag

SEQ ID NO: 1177134 - RNA, 19 nt, Human
cauguuggccaggcugguc

SEQ ID NO: 1177135 - RNA, 15 nt, Human
cauguccaagaagcc

SEQ ID NO: 1177136 - RNA, 16 nt, Human
cauguccaagaagccc

SEQ ID NO: 1177137 - RNA, 16 nt, Human
cauguuacauaagaua

SEQ ID NO: 1177138 - RNA, 17 nt, Human
cauguuacauaagauaa

SEQ ID NO: 1177139 - RNA, 21 nt, Human
cauguuacauaagauaaaugu

SEQ ID NO: 1177140 - RNA, 13 nt, Human
cauguucuuaauu

SEQ ID NO: 1177141 - RNA, 16 nt, Human
cauguucuuaauucuu

SEQ ID NO: 1177142 - RNA, 12 nt, Human
cauuaucuagau

SEQ ID NO: 1177143 - RNA, 18 nt, Human
cauucuccaccugccagg

SEQ ID NO: 1177144 - RNA, 19 nt, Human
cauucuccaccugccaggg

SEQ ID NO: 1177145 - RNA, 21 nt, Human
cauucuccaccugccagggac

SEQ ID NO: 1177146 - RNA, 18 nt, Human
caugggaaaggggaaguu

SEQ ID NO: 1177147 - RNA, 21 nt, Human
cauggccucuucagaucucua

SEQ ID NO: 1177148 - RNA, 22 nt, Human
cauggccucuucagaucucuaa

SEQ ID NO: 1177149 - RNA, 20 nt, Human
caugcuccuggcccacugca

SEQ ID NO: 1177150 - RNA, 17 nt, Human
caugcuccuggcccacu

SEQ ID NO: 1177151 - RNA, 14 nt, Human
caugcuccuggccc

SEQ ID NO: 1177152 - RNA, 16 nt, Human
caugcuccuggcccac

SEQ ID NO: 1177153 - RNA, 13 nt, Human
caugacaaagacu

SEQ ID NO: 1177154 - RNA, 14 nt, Human
caugaugcgggcca

SEQ ID NO: 1177155 - RNA, 15 nt, Human
caugaugcgggccag

SEQ ID NO: 1177156 - RNA, 20 nt, Human
caugaugcgggccagugcuc

SEQ ID NO: 1177157 - RNA, 12 nt, Human
caugcaagguca

SEQ ID NO: 1177158 - RNA, 15 nt, Human
caugcaaggucauuu

SEQ ID NO: 1177159 - RNA, 21 nt, Human
cagcggaaagcccugugcucc

SEQ ID NO: 1177160 - RNA, 18 nt, Human
cagcuaacauggaaguac

SEQ ID NO: 1177161 - RNA, 15 nt, Human
cagcuaacauggaag

SEQ ID NO: 1177162 - RNA, 16 nt, Human
cagccugcuccagcug

SEQ ID NO: 1177163 - RNA, 17 nt, Human
cagccugcuccagcugu

SEQ ID NO: 1177164 - RNA, 19 nt, Human
cagccugcuccagcuguuc

SEQ ID NO: 1177165 - RNA, 21 nt, Human
cagcugacuuuucuguccgag

SEQ ID NO: 1177166 - RNA, 19 nt, Human
cagcugagggugagugggu

SEQ ID NO: 1177167 - RNA, 19 nt, Human
caggaaaggcuccaggagc

SEQ ID NO: 1177168 - RNA, 20 nt, Human
caggaaaggcuccaggagca

SEQ ID NO: 1177169 - RNA, 16 nt, Human
caggaaagagaacuuc

SEQ ID NO: 1177170 - RNA, 20 nt, Human
caggaaagagaacuuccaga

SEQ ID NO: 1177171 - RNA, 16 nt, Human
caggaaaggcuccagg

SEQ ID NO: 1177172 - RNA, 17 nt, Human
caggaaaggcuccagga

SEQ ID NO: 1177173 - RNA, 20 nt, Human
cagcuguaugauucccagcc

SEQ ID NO: 1177174 - RNA, 14 nt, Human
cagcuuauugucua

SEQ ID NO: 1177175 - RNA, 20 nt, Human
cagcuuauugucuagugaaa

SEQ ID NO: 1177176 - RNA, 21 nt, Human
caggcugggagagccuuccag

SEQ ID NO: 1177177 - RNA, 14 nt, Human
caggccuccuacag

SEQ ID NO: 1177178 - RNA, 17 nt, Human
caggggaaaaucagccu

SEQ ID NO: 1177179 - RNA, 14 nt, Human
caggggaaaagagg

SEQ ID NO: 1177180 - RNA, 16 nt, Human
caggggaaaagaggag

SEQ ID NO: 1177181 - RNA, 22 nt, Human
caggcugggagagccuuccagg

SEQ ID NO: 1177182 - RNA, 23 nt, Human
caggcugggagagccuuccaggg

SEQ ID NO: 1177183 - RNA, 11 nt, Human
caggccaggcc

SEQ ID NO: 1177184 - RNA, 12 nt, Human
caggccaggccc

SEQ ID NO: 1177185 - RNA, 16 nt, Human
caggaccucaggugag

SEQ ID NO: 1177186 - RNA, 23 nt, Human
caggaccucaggugagaagcaga

SEQ ID NO: 1177187 - RNA, 19 nt, Human
caggaggaucacuugaguc

SEQ ID NO: 1177188 - RNA, 19 nt, Human
caggaggccagccuugacc

SEQ ID NO: 1177189 - RNA, 22 nt, Human
caggaggccagccuugaccauu

SEQ ID NO: 1177190 - RNA, 15 nt, Human
caggcaaugcuggcu

SEQ ID NO: 1177191 - RNA, 16 nt, Human
caggcaaugcuggcug

SEQ ID NO: 1177192 - RNA, 17 nt, Human
caggcaaugcuggcugu

SEQ ID NO: 1177193 - RNA, 13 nt, Human
cagacagcugccu

SEQ ID NO: 1177194 - RNA, 14 nt, Human
cagacagcugccug

SEQ ID NO: 1177195 - RNA, 15 nt, Human
cagacagcugccugg

SEQ ID NO: 1177196 - RNA, 16 nt, Human
cagacagcugccuggg

SEQ ID NO: 1177197 - RNA, 17 nt, Human
cagacagcugccuggga

SEQ ID NO: 1177198 - RNA, 18 nt, Human
cagacagcugccugggau

SEQ ID NO: 1177199 - RNA, 13 nt, Human
cagacaggaccag

SEQ ID NO: 1177200 - RNA, 15 nt, Human
cagacaggaccaggg

SEQ ID NO: 1177201 - RNA, 16 nt, Human
cagacaggaccaggga

SEQ ID NO: 1177202 - RNA, 17 nt, Human
cagacaggaccagggau

SEQ ID NO: 1177203 - RNA, 24 nt, Human
cagacaggaccagggauuuccaug

SEQ ID NO: 1177204 - RNA, 11 nt, Human
cagacaggcaa

SEQ ID NO: 1177205 - RNA, 13 nt, Human
cagacaggcaagc

SEQ ID NO: 1177206 - RNA, 18 nt, Human
cagacaggcaagcaccuc

SEQ ID NO: 1177207 - RNA, 20 nt, Human
cagacaggcaagcaccuccu

SEQ ID NO: 1177208 - RNA, 21 nt, Human
cagacaggcaagcaccuccug

SEQ ID NO: 1177209 - RNA, 22 nt, Human
cagacaggcaagcaccuccugc

SEQ ID NO: 1177210 - RNA, 23 nt, Human
cagacaggcaagcaccuccugcc

SEQ ID NO: 1177211 - RNA, 17 nt, Human
cagacucuacagaggcc

SEQ ID NO: 1177212 - RNA, 18 nt, Human
cagacucuacagaggcca

SEQ ID NO: 1177213 - RNA, 19 nt, Human
cagacucuacagaggccau

SEQ ID NO: 1177214 - RNA, 20 nt, Human
cagacucuacagaggccaug

SEQ ID NO: 1177215 - RNA, 21 nt, Human
cagacucuacagaggccaugg

SEQ ID NO: 1177216 - RNA, 23 nt, Human
cagacucuacagaggccaugggc

SEQ ID NO: 1177217 - RNA, 13 nt, Human
cagacuggaagca

SEQ ID NO: 1177218 - RNA, 14 nt, Human
cagacuggaagcac

SEQ ID NO: 1177219 - RNA, 16 nt, Human
cagacuggaagcacag

SEQ ID NO: 1177220 - RNA, 17 nt, Human
cagacuggaagcacagc

SEQ ID NO: 1177221 - RNA, 18 nt, Human
cagacuggaagcacagcu

SEQ ID NO: 1177222 - RNA, 20 nt, Human
cagacuggaagcacagcuuc

SEQ ID NO: 1177223 - RNA, 21 nt, Human
cagacuggaagcacagcuuca

SEQ ID NO: 1177224 - RNA, 14 nt, Human
cagcacgauuucug

SEQ ID NO: 1177225 - RNA, 15 nt, Human
cagcacgauuucugu

SEQ ID NO: 1177226 - RNA, 18 nt, Human
cagauugcaacaggcugg

SEQ ID NO: 1177227 - RNA, 21 nt, Human
cagauugcaacaggcugggcu

SEQ ID NO: 1177228 - RNA, 19 nt, Human
cagauugcaacaggcuggg

SEQ ID NO: 1177229 - RNA, 20 nt, Human
cagauugcaacaggcugggc

SEQ ID NO: 1177230 - RNA, 13 nt, Human
cagauuucacucu

SEQ ID NO: 1177231 - RNA, 20 nt, Human
cagauuucacucuccuuggu

SEQ ID NO: 1177232 - RNA, 19 nt, Human
cagauuugaacucuucaau

SEQ ID NO: 1177233 - RNA, 17 nt, Human
cagcaccaucucuccuc

SEQ ID NO: 1177234 - RNA, 19 nt, Human
cagcaccaucucuccuccu

SEQ ID NO: 1177235 - RNA, 14 nt, Human
cagaggggguggcc
